United States Patent 7,700,838 (BACILLUS THURINGIENSIS CHROMOSOMAL GENOME SEQUENCES AND USES THEREOF) - sequence listing, part 2

SEQ ID NO: 1274 - DNA, 9516 bp, Bacillus thuringiensis
aatacatcaggatgaaacgtaagctatttattttatttactattatgcttgttgttctttctatcgatggctggacttctcagaaagaagaatcgaaagcaaaagaacaaccgaaaacaaaagttgtaaaacatgctaaaggtgaagctacaattccagtaaatccaaagagaattgttgacttatctggatcaacagaagaactattacttcttggacataaacctgttggtacagcaaatacatataaagataaaatccaaaatcacttaacagacaagttagatggagtaaaagcagtaggttggtactgggcacctaaagttgatttagaagctgttactgctttaaaaccagacttaattattttaaacaaccggcaattaaaaatttatgatcaactagaaaaggttgcacctacagttgttctagaaacaaacttagaagactggcgtggtaagtttaaagaagtaggtaagctatttgacgaagagaagaaagcagacaaatggattgcagactacgataagaaagcagactctttatctaaaaaaattaaagagaaaacaaaagatgagaactttatgttcgttgcagttacaccacaaaacttccgtgtatacggtagcttcggatacggtgacatcatctttaatgacttaaaacttccagcaacaaaaggtacggatttaaaacaaacgatggcgcaagtatcactagaaggtctagttgcattccagcctgaccaaatgtttattgtaaacttcggcggcgaagctgataaagtttacgaagactacaaaaacagtgccgtttggaaagacaataaagcagttaaaaataatcacgtatatgaagtattaaatgaagtcttcaatacgaaagcattcaatccaatcggaaaagatatgctaattgatgaaatcgcaaaagaaattttagctaaaaataaataagaaaaaaagcagctcaccatgagctgctttttttcttactttgaactgcgtattgcttcattttttcaatcgtcttcacaaaaccttcttttgatttaatacgaatgccacgtttcaatttcgcacgttcatagctctcaagctttttcatatcaatttgaaagaaagaatggatcgcattatcattttttggcacacctttgaaaatttgtaatatcccttcctctgaaacaccaaaatacccgctcgttttcaataacggagaaatatcatcaactttcttttgcaatacaatttgtacatcatcacgatcaacgagctgccattctttatactgctgtaaaaacttttctaaatccgtcactttttctgtaagtatttcttcgcttacttcgccatcaacatacatacgctctaataaaattgtaacctcaggttcttttttcgtcacttctggtactggcccttccgccttcacattcgtttcataaacgaaacaaaacattataacgaaagcttgcatcgcaatcagtatccatttcatttccgttcacctcttttaggcaagatcatactttcattagtagtttttccggaaatgggggttttatccatattatatttctttcgaaaatataaaaaatgcagataaggattcacctcatctgcatgtatcatttacttttatataaaatgaaagacgcctgcaaagcaggcgtcttgatgcgtttacggcgagagaccaggcgaccacattcgcgtgtttagcacttaagcatatctctcgtcttacgtaaattagctcatcgctttgctaatataacattaataaagtataagtgcaacatgtttataaaaatattttatttcctctttcatctaaacaaattatatgtaaattataaattgataaatgtaatgtatatgttacaattaatgtaacagcgaaatcataataaacaggagatgggtagtgtgaaaaaaataaaggatgaacgtctcattctgcaaacgttaaaaaacgtacgtattgcttttctttttcaatcacttggtataatcggtattttaggctatatcggattcactgaaggaatagatcaaattacgaaatctccattatggctagtatttattcttacgagtataatccttagttatttacagttaagtgtttcaattgatgtagaagaaagtgaaaaggagataaaattaactccttattacaaaattgttttacgctctcttattgtaggaatcgttatggctattatttatatcattttcagtccagaaagccccctatttgaagctattttaacaggtggtattctcttcatatgctttttaggttcttattccgttagttattttattaaaaaacgtcgtttacaagacgaaaatgaataaagaggaagggctcccccttcctcttttgttttgctatcgcactgtaccagttaaaccgtaacgaatgtctctgaacatatttcctatatcacgattaaaatcgtttgtaactgtaccgttacgtagacgcgtactcattgcatcgacacgagtaaacatatcatttcttacagaaacatatacgtttctgtttccaacttcatttgcaacagcttgacgaatttcgttcgccatcgccgtttcatttgtcactgtgttacgtggttttaccgcaatcgctacatcgtttccatatacaactgtagacacacggtctacgttattcatacgtttcacacgatttgttattctttcagctgttttaccatcattgttaatgtatgaattgttcattgtaatattacgagttggatgcggattagcaatttgtccattgtaatttacatcacggtaataattgtatcctgtatcgttacgaccatttctatatgttacataatctgtataacgatcattacgcgtcacattatcacgatactggtgtgtatcattataagatgtacgctcgtaattgtagttacgtccatccattgcattgttttttggtgtaccacatgcagctaatgcactagtaactaacaaagaagcagcaatcacttttactttcgtattcaatacaaaaaccccctctgttagaatgagcttctctactgaaaagctccctcttatgatgagtaacagagaaggtttttacactgttaatatttcactgggaattttctagcacttcataaaaaaactgccttttcttaattaacaggaatgcaaaaaaggcgggaatactcccgcctttttaaacttcttcttcgtcctcttcttctgaaacgggctctccaaatacatttggtggatctggttgataatacatcgttcctggctgtggtgcatatgcagactgagttggttgataatataaaggattcgcatattgcggaccgcctggttgtggactatatagtctactttctcctccgcatccacaatcttcctcaccctgcacaagcggcggcatgttattatccattggcatcatattcgggtttggcatagacgtatgttgcggtccaaacggcgctccttgctgatatggcatttgatatggatttggttgttgataatacggattcggcggcatcatgggcatttgatagggcatcatatttggtggttgattgttatccatactcggcatcatattcggcatttgattgttatccataattggcattatattcggcatttgattgttatccatgattggcatcatattcggcatttgattgttatccataattggcatcatattcggcatttgattgttatccatgattggcatcatattcggcatttggttattatccataattggcattatattcggcatttgattgttatccataattggcatcatattcggcatttgattgttatccatgattggcatcatattcggtggttgattgttatccataattggcatcatattcggcatttgattgttatccataattggcattatattcggtggttggttgttatccatgattggcattatatttggcatttgaatatttggcggtatgacttgtggaataactacattttctttcgatacatttggcgatactatatttcctacattctctttcttcacttgtggtgacactatatttcctacattctctttcttcacttgtggtgacactatatttcctacattctctttcttcacttgtggtgacactatattccctacattttcttttttcacttgcggcgacactatatttcctacattttcttttttcacttgcggcgacactatatttcctacattttcttttttcacttgtggtgacactatattccctacattctctttcttcacttgcggcgacactatattccctacattttcttttttcacttgcggcgacactatattccctacattttcttttttcacttgcggcgatattatattattttttttcgtttgcggagaaatgatattgttaggtttcattttactaatttgaggagcaattaactcgcttcctttttttattacatctgaaattttatattcttttttcggttttattggtggttgtggcggctgcggtaatacatttaccgaaaacttcgtgttttctttttccgccggtttttgtttttctatcacaggtggtttttgaataacagacggtttttctttttgaattggctgttctttttgcacctctttttgcggtttcacctgtacttctttttgcggctttacctgcatctccttctgtggtttcacctgtacttctttttgtggctttacttgcagctctttctgcggttttacttgcacttctttttgtgtttgttgcatagctggctgctgtgtaattggtgctgattgatacgtaacttcttcctcatcttctattccaagcggagttggtgttgctgcaaattctttttgctgcacttcttttacgtattgctttggaggcgctgaacctgctccagcctgttgtttcatgtgaacactctttgatggcactttaattttcatacctggcatgattaaatctggattactaagttgtgtatttgtttttttcaacgtgtcaaaatccactccgtactttttcgcaattttccaaagggtatcccctttttgcacgatatgaattttcaaattttccccctcctgtataacttatctataagtaacaaatctcttgaagtaactctttctaaataacattaacttcttttcacttttatcacttcttcgattttcaatatcattcgaagtggaataagcataaagaaccacaatgatttcttcaaaacaatgtatgcccatttcgttctcgttatgattatatgtatgaaaaaaagcaacgggaataccgttgctttacacacgctctaacatacgatttaatgcaagaactgcttctgccgttacttgtttgtctacgctaataacgttaatttcttctcctctttctatcgtttcaagtgtccataataagtgaggcagatcaattcgattcatcgttaagcacggacacataaatggattaagcgaaacaatttctttatctggatgttgcttaataattcgatttactaaattcatttctgtaccaatcgcccatttgctactagatggcgctgattcaatcatatcaataatatatttcgttgagcctgcataatctgaagcagctacaacttcatagcaacattctggatgtacaataatattcatattagaatgattttttcgtacactctcaatattcttcactgtaaaattttgatgaacagaacaatgtcctttccataaaatcacttgaatttcttctatatccccatcgtactctaatgaatctgtgtgtgggtcccatactgccattttatctaacgggatacctagattgtgcgctgtatttctccctaaatgttggtctggtaaaaagacgagacgttctttttgagtaaacgcccaagataccatttgctttgcattagaagaagttactgttgctcctccgttacgaccacaaaacgctttaattgcagctgtagagttcacatatgttaacggaatcatcgtatctccaaataatttcgtgagctctttccatgctctttctgtttgttcaatatctgccatatccgccatcgaacaacctgcacgcatatctggtaagatgacaacttgatcatctgtagttaacatatctgctgtttccgccataaagtgcaccccgcaaaacacaatatattttgcatctttattgctcgctgcaacttgcgcaagctgaagtgaatcccctgctgcatctgaaaattgtaccacttcatctttttgataatgatgccctggaatgaaaaacattttccccattttctctttaatttcacgaacacgcttttccatatcttccgttgacatcgtgtaataacgctctggtaacatcgtttcaattgactgtacttgttctaaaatactcatatacgtttctccccctctaagccactttccttactcttcaatattgaaactaatatcaagtgctttcactgaatgtgttaacgctccaagtgaaatataatctacccctgtttttccgtattttgataaatctttaattgtaatgccccctgaagcttctgtaacgatagcgcttggtacaatttttgaaaactcccggatttcatctggcgtacgattatcgaacataataatatccgcaccagcagcaacagcctctctcacctgttcctcagtttctgtttctacttctactttcaccatatgtcctaacttttctttcactgatgtaacagcttttgtaatagaaccagcaaacgcaatatgattgtctttaatcatgacaccatcatataaaccgaagcgatgattaaatccaccgccgcacacgactccatacttatcaaacatacgtagtcctggcatcgtttttcgtgtatcacaaatgcgagtatgactgctatctaaagcaagaaccgctttacgcgtcatcgtcgctattccgctcatacgctgaataacatttaatataacgcgctctgctgttaataacgatgcgattggaccttgcactgttgcaataatttctcctttttctacaagatccccatcttttttatgaagctctatttcaattctctcatcaattaatttaaatcctgattcaattactaaacatcctgcaaagacccctgtatccttcgcaagaaacgttcctttcgaaagcaagttatctggaaaaataagctgagatgttacatctctttctcctatatcttctaaaaaaaatcggtttaatgcttctttaacttttatcgtgttcataaagcctctcttcccctcatcacacaagttgtaattttctctttactcgaacaatctctttctttcctatatttctatctggataatcactccggtaatgcccgccaatactttcttctctttgcaaggctgacacaactataagctcacaagccgttaacatattaataagtgttatctcttcattcgtaagaacatcatgttgtaatatcatatttcgaacaccatacttactaaaccatctcttcgcataagataaactttgctctgttcgcacaatcccaacatatttcatcatgcatttttgtatttcttctttcgtcggtaaatgattcagaacgatgaactttggttccttttcagctagcatgttcaccttttcttttgtctctctagataaaatgtgtcgtccggttctttttccaaacacaagaccttctaataatgaattactagctaatctatttgcaccatgaactccgttacaagctacttcaccgactgcgtataagttcggaatagacgtctctccatcacagttcgttttcacgccgcccatgtgaaaatgagtaccaggcacgactggaataagttttttatttatatcgactccatttgttttacatatcgatgacacggtcggaaagcgttgttcaaagttttgaatcatttcgatgtttaagtacactttttcacccgcaagtagctgttcatgaatagcccgtgcgactacatcacgaggtgctagatcctgttcggaatgtatatccatcataaaacgctgcccttttccatttataaggacagctccttctccgcgaacagcttcggacacgaggccggaacaacgcccacccgcgtataacatcgtcggatgaaattgtataaactctaaatctacaagctctccgcctgcacggtacaccattgcaagtccatcgcctgtaatcgtctcatcattagaagtaaaggcgtataaaccgccaataccgcctgaagctaacaccgtacaatctgcattgtaacgtttcaattctcctttattgttgcgagttaaagccccaacacatttatctttttctataataaaatcgagcaccatttcctgttccactaccgtaacgtatggagctacttcttgaataagatgctctaataaattctttcctgttgcatcgccacctgcatgtaaaatacgacgttttcgatgcgctccttcttttccaagatgaggacctgtttcatctccatcaaatttcattccattctcaataaggttattaatttctttcggtccttcctcgactaaataacggaccacttcttcattgttataatgacaccctgctactaatgtatcttcaaaatgatcattaggattgtcatatgtagctaccgctgcggcaattccaccttgagctaaatgtgtattattattacgtttcgtctcctttgtgataataatcacattcttttcgtgacaaatctcttttgcaacacgaagtgccgcaacgccacttccaataattaagacatctgcgcttggcataattgttgcctcctactttacacttttcaactgtcttgacacctatatttacataattttaaaataatgacaagagtttttttataattcttattttcactaccatttaaaaagtaaaagaaatgtaactcttactagagagaggaacttacatgatgatatatcttgactatgcagctactacacctatgagcgaggaagcgttacaaacatatatgaaagcagcgtcgcaatacttcggaaatgaacaaagcttacatgatattggaggaacggcttcttctttattacaagtttgccgaaaaacatttgcggaaatgattggaggaaaagaacaaggagtatttttcacaagtggtggatcggaatcgaactatcttgcgatccaatcacttctaaatgcccaaaataagaagcatattattacgacacctatggaacatgcatccattcgaagttattttcaatctctaaaatcaaaaggctatacgatcactgaaattcctgttgataaaaatggactcatttgtttagtagatttagaggcagctattacagaagatactgtgctagcaagtatacagcatggaaactctgaaatcggaaccgttcaaaacattacagaaattggggcactcttaaaaaaatat

SEQ ID NO: 1275 - DNA, 9110 bp, Bacillus thuringiensis
ggttttttctttgcttggatttttatttacgaaatttggtgtaccagaagctaaaagctttttggatgaattagcaccatatttgttgacagttggtatcgcattgggaatttggtctgatcatgatgtaaacagcgaaggagaggataaataatgggttacactgtagatatttcaaaatggaatggagatattaattggcccgtggcaaaacaatacattgattttatcatcgctcgtgtacaagatggttcaaattatgtagatcctctatataaaggatatgtacaagctatgaagcagcataaaattccttttggtaactatgcgttttgtcgttttgtttctgaaaatgatgcacgtatagaagctcgagacttttggaaccgcggagacaagagcgcaacggtctgggttgctgatgtagaagtaaaaacaatggatgatatgagagcaggaacacaagcttttatcgatgaactacgccgattaggggctcaaaaagttgggttatatgttggccatcatatgtattttccatttggtatggcgaatgtgaaagctgactttgtgtggattccacgttatggagggaagaaaccggattatccatgcgatatatggcaatacactgaaacaggtaatgtacctggtattggaaagtgtgatttaaatgaattaattggaagcaaatcgttagattggtttacaaataaatcgtataaacaagaaggagtggagattatcgtgaacaaacataataaggtgattacttatgaatttggtgtaaatttaattccagaaatgattcaaatgatggatacgcttggatacacttctaaaattgtgtctcgtggagatcgtcaagggcttgtatattttgaaacggattatcgtcaaggaaatgaattagataaagtaactgcgtggttagatgcaaaaggccttaagtatttttatacaaaagaatagttttacgaacagaaataagagccgtcctgtcgggcggctcttatttaatttatattcactaattcatcaaacttaaattctgtgttgagaccaaatgcatccgtacaatatacgatttttaacattggttcgatgtgtagcacatttatgtacatgtcctgtatcatgccatcgcgatagtaagaaattgatatttcttcatgagtttgcatggatcgaataagactatgttgaatttgctctttcatatcttcagaaactattggtttcggtactttatttaagtcattaagtatttctctaattcctgcaaactgttccggcatactggcaaatggttgccacttcaccattttatcaagactttttttcgattattgtagcgatattaatgcctctatcgttgtatacatatcttcatacataattctctttataatagatttctatattttaaagtttgttaagcaattattacattttgataaacctggaaaattaagacacctatgtaagctgtttttaatacactgggattttatatgccaacttaagtacctttacagtggtgtttaaatacaatggtatgagtagttaccattgtatttaagtgttcaataaatatcagaataacgaaggggtttggctgatgaagaacaatattaaaggattaattgaatatggcgaacgtattccacattttcataaagatttccccataattttattttggagtcacagaagtggttgtacttctctggcgaattggtttttcttccaaattgggttatatgaggaagcaatgaaatatgcaccgttcattcattactatgaatctgaaatatacaaaaataaagttgattactacacaaatttagaaatgcaactcttggaactaagtaaggataccataaaacttgtgcgcaacccttataaaagagctgtaagctcatttttaatactttatgacaacccttacgcctcgaaacaatgggaacagattagagagtatttttataatgataaaaatgaatcgaaaggaatttcatttaaacaatttttatattatgtaaaagaaataggggctaaatccattctgttagatcaacatttttcacaacaatatattgagggagaagaaaaggtcatcaaacaaaatataaaactagagaattttaatacaataattccgcagctggagaaagaatatggattactttcttctgatatatcactccttacaaactccaatcaccatagggcacatcaaatgattcataaaggaaattatgcagatgatgatattacaaatccacacttcccttcattaccaacctatcgaagtttttatgatgaagaagctctaaaccttgtttcagaaatatttactgacgattttgaagcatatggatataagaagaatgaaattaatttttaactaatatacctatcacccgactatgtatagagtctctttaaaaactataaccactatgaaaagccagcggtatggaaggggaattataatgagcatttctattataatgatgggtttcatcatagggggattggttggagtaacagggataggcggggccgcattactgactccatttcttctaacattaggcataagtccttctgtagctgttggaacggatctagtatataattctatcactaaaatgtttggaatatcccaacactggaaacagaaaaccatcaattttaaactagtaaaatatctagctattgggagtttacctagtgcaattatcgcagtaataataattcatttcttgccaatttttcatgataatcgagagggaattataaaatatatattaggatatgttttaatccttgcggcaatttctatttttataaaaacatttttctataatgaatctacacaaagtttttttcaaaaacagactatggtccaaaaaaagaacctaacaattcttatcggtgcaatactcggttttatcgtgggacttacttccgttggatcaggctctttatttgctattgcaatgatatatttatatcgactgaaaccatccgaattagtaggcacagatattacacatgcgtttttattagtgacggttgcaagcatactaaatatgaatttaggaaacgtagattatcttttattaattcacttactcattggttctatcccaggtgtcatacttggtagtaaattctccactaagattcccgttaaacctcttcaaatatttttagctatcattattggtgttagtggactaaagttagttatcgcttattaaaaatatttcatgttttgctatataagaatggaggttcaaaatggatcatatagaactatataattttatatacaagcaagggcgtgtccctcattttcataaagattttcccctcatcttgttttggagccaaaaaagcggatgtacttcgctagcccactggtttttttatcaaattaatttatttaaagaagcgataaagtacaatccgttcattcacaactatgagtatgaagtatataagaactctacacattatttagcacaattagctaatggattacaaactaaagagaagaagacgtacaaactagtaagaaatccttatagaagggcagtaagttcttttgttgctctggttccaccaccaaatattgaaaatcccgtatggaaacccattcggcaatttctgtatggtgatgaaacttgcaataaacccatttcctttaaactatttttgtattacttaaaagcacacatgacaaaattagatcaagtagatcctcactttacacaacaatatatacaaggagaagaagaatttgttacaaactatatccatctagaaaattttaacacaggtatttcgaagctagaagaggtatataaattaaaaaaatcaccattagatctattatcaaaatcttggcattatcaagggagtaagatgatttacaaaggagtttatgcagacgctgatattacaacccctgtttttccacgattacctacttatgatagtttttatgacgcagaaacaattcagttggttcaagaggtattttcaaaagattttaatatgtatcattatgatttaaattctatttcttaaaataaaaatgttcaaatcctgctttattaagggtgttattttacaactgataggacgatatcacatatttataaattttcataaacctttcctaaatcttttttcagttgtgtttttaagtgctcattttcactttctaatagcttgttcttatattttaaaagattgagcttattctttaaagtttctatgattacatccttggaggcatccgatgtccttctttttatattcttaaaatcatgtatgccttcttgctgttgacgtaagtcttcaatcgtttttctgattaagggttctctatataaatatgcttttgaaacctgtgctttttctgaaactgaattaaaattaattttttgtccttctttaaccattaactgtattacttcattcactctatattgtgtttccctcttttttttagaggcatgattcaataaccccgttgtattcggatgtttgttaaccatcaatttttctttcctctcctatatattctcgtttatgtttcggcataccgaaaattccaatttcatttttcaatgaatccctaatttccttatacttattaagttttggttgaatcaattcaatagaacgaatacgaccgctagtttgatactttataatatcttcttccatctttaatatctgcgcattatagtaatctaaaaatgttgtatctacatgaaaactcctacaattatttttaatacaaggggtttctaacgaataatctaagaattcacagctaaccttaggactctttatgcataatccatgatccaaacgaatagagtccatgttatggcgaatccattctagttccaaaccgttttcttctgcctgctcagggagactggcttgtattaattctccagttgtgtcaatacgcactgagttttgaactttttcccattccctacgaagagtgttatctgaaatttttgcataagttaatgtcatttcaggactagtatgtgccattaacttttgtacatgaagaatattcataccattattaattagattgaccccatatctatgtcgaaaagcatggttcttaaatagaaatatttctccatttttatcaaggattttatatttttcggctagttgatttaatgcataggtaaccgatttttgtgaaaaggccatccctctattttttccagtaagaacagggaacaaaaattgatttaagttgttatgcttcttttcatgattgttaatatattcttgttgtattttaacgattttcacaatttcttctgaaataggaacaatatgttcttttacatttacttttcgttgatctcctaccaaccaccaaccatcttgcttatatgctagacaatttaattgtaactgacatacatctgagactctaaatcctgttgcttccataatgactattaatcgtgcaatttccgaatctaaattatgtagattttccaacacttgctcccatataaaatctggcacatgtttaacatgttcgtgatagtttttcttttctcttcgaggaaagtcttcgggaaatattaatctgttaacaggggttttaggtgcttctttccattcaaaaccttgcatatattcaattattcttctgacatttgaaaggcactctattacatgacgattactaggaacacgatttttcgtataactctttcctcccatttcacgatttctaacataaaataaaaaatcttcaatgtcctgtctttgtagattctgtaaatctatccactttggatacgtttctacaatgaaatcaaaaaacaaatacattttctttaaaatattttgggcggtcgcaaaggtaatttgttggtgtataagtaatgtttgatttacatattttttaactaattcccgaaagggaaattttatactggtgaaattaagaaatctgtctcttcgagacatattatatggaatccctagtctttttatattccatttatctttttgatgttcaggtcgttcgtcataataattagagaaaaaatcatataaacttttacatactccaagataaggtgaaataaattctcctccacgatgatgggggtattttaacggcttattattttcagttagatataatttgtattcatctaataatgtagtgtaaggaatatcaattattgatgtgacttgagggaatttctcggctaaaaattttgaaagaaagtacattttataaaaatgcttctccataaagctggataaaagccaaatttcattggttaaagaataaaaagaatagtactttatctccagtttaatatattcattactaattttattgaaatcaacaattttttttgtttctttaatttttcctcttctatctggcaggggaaactcttcgattttccattcatctaaagcccaataccctttaaggtcgttcataactttacgttgtattttattagaattaatagctacgatattcattttctcattctcctatgctgctgggcttcatcccagtgctttcttatagtttcttctgaaggatgaatatacatatttaaagtagtttgtacctgggcatgtcctaataatttttgaatgataccagcgtccatgcctagatcataaagttgtgttgcacatgtatgtctaagtgtatgagcggtaaagtttattttcgtttttttagacaatatacgtataacagcttgcaaagcccaatattgcattggctgccctttatttttcccttttaaattaataaacacatggttagaatctacatcattagtatggtaatcgataatataatcttggaataaattcattgtttcatttgatacatatacttttcttttttctccagcttgtgttttagattctctaacagtgatactaccatcattgatattgaagtcctctatccataaacttaataactcagaagctcttaatcctccttcatataaaatacgaattattaactcatctcttatgttattacatgctatatgaatcaattccgcctgcttagtagtaatggtttttatttttcttttaggttccttaagttttaaaatattaattttggttgttggggtatgtgttatatgatctaaaaatttacgatacttccgccttgtattatggacttcttttgtaactttggattttacattaaataagatttgaccactacgccattggtagtccaaaaattcgataacacaattagtgattaagttaacggaagattcagttcttttagcgtacactaacttctttgtgtcatttaaatagatagtatttatatcatctgttgattttcttaaccaatgaataaattctgttaataaacttatatccacttctctgtaatctttattcttttcgtttagaaaacaccagaatattttcaaatgataacagtatgttttaagtgtattaggtgcttttcctaaagaatccttatgttttataaatttcatgattgggataactggttcacccttgttatgtaaaaccatccaacgttcttccccaaacgatgtaataatactttgtactttaaacatttttccacctccaactgttcaatctatctatactataaatactatctcttttatactattattatagcttctacaaagagacaaaaaaagagaactacctatcgttgtatacgttatctctactcatatattatactattgttaacaccatacctcttccacgtactacaggaaagctgttatatcccatgatgtaatacctcacttttgtttttttaactccactacaaacaaacatgtgttcttttttaaggtttgaaaagggaccattttgttaacatgaatattcaaaaataattttttcaagttagaatattcaaaaacttatttatgcaaacaagcatgtcatgataacatttaacaaaagggggtagaagtagatgagtgttgacattatttctaaagaagaaatcacaaaattattaaacgaatggtatcaagctatgatttcacaacgtgtattacagtctcagaaaataaaagaagatattgcaaataaaatcaataatattaaggaagaccaaacaatattagtctactacgctttattgaatgcacgatataaactgctaattcgggatatggatagtacaaaagatattctggacaaaatcgagcctttatcagagtctacagaaacatttttagagtactatcatcatttatttaaagcaatttacgctattaataaagcaaaccatagtgaagcaagaatgcaatttgaaaaagctgaaacgtttttagaatacatgcatgatgaaattgaaaaagcagaatttaattattggcttgcagtccattactatcacgtattaaaaccgatcctagcagttcaatttgctacaaaggcgaatgaagtattttcaattagtccagggtatgaattaaaaactgcagcatgcttaaatactttaggaatggcacacattcgactaaatgaattcgaaagtgcagaggaatatttactttcagcactaggtaccttccaaaaatctaatgatgaacttcttattaaacgagttaagcataatttaggacttttatacgcaagtcaaaacatgccagagttagcaattaaacacttagaggattcattagaaaataacgctaaaactatgtttcttttagcaagagagcattttaagttaggttatagtcatatcgctaatgaatatattgagaatggctataagattagcgacttatgttatcgtcatcatttccgaattttaaaagcagtacatacctatgtcgcgcaagaagacttagataatgtgggtatagaaggtatttcgtatgttgaaaaagaagaattatatgattgggtttagtaaaaagtcgctcagatggatatcagcctctatggcacagagactcgcagaaaagcaagcaagtatagcgcatcgcgttagatgcagaaaaaaagactctgctgtt

SEQ ID NO: 1276 - DNA, 12101 bp, Bacillus thuringiensis
acgctttcgatcggacccgaattcggatttttacataaatcgcaattgctgcgcccacttgtccagcaccagccattgctagtactggtgataaaggtgttacgtgtgtttgattaataaattccatatgaattggtgttaaaccgtgatgcaatccgaccataacaagaggtaaaaatgttcccgcaagtactgcgccagcaaatgctccgccaatatttaaaatcgcattaattccgctcgtaataccatctgataagaaacctgctaatggctgaatggctaacattgttacaatacttacaactaatacagtaatgagtggtgtcacgataatatcaactgcattcggcactgcttttcgaacttgtctttccactacaaccataagccatgctgcaaaaataactgcgaataatccgccccgtccgggcactaatgcttcaccaaacaattttacgtttgccatcgccgggttgaaaattaaaatgccagcaattgccccaagaaccggtgtcccgccgaactctttcgctgtattccaaccaactaaaattcctaagaatgtaaagataccgccgccaatgagtagtaacatttgtaaccacgttgcatttggatcagcaccagcgtttttcgcaaagttagcaaccccgtttataattcctgacgcaacaagtcctggaattaacggaatgaaaatacttcctatttttcgtaaaaagtttttcaccggtgtattatttttcttcttaatctctgatttcatctcttgcccaatatcttcaaggtgatgatctgctatctcaccaattcgtagtcctgtcaagccttccatttcagctgctactttatttactgttcctggaccaacgacaacttgaagcgtctcatcttctataacacccataacgccttcaactttttttaaaaggtccatatttactttactttcatcatgaagcgttaatcgtagtctcgtcatacaatgagcaatactacgaatattttttattcctgcaagttgctccgaagatgcctggggcacacattgtcatttactgatactagaatcccacttcctattattttatagtgctttcttcacaaacccttttgcgcattttagtttctccagtgcttccccatattcgcactgcaacaacaccataacaatggcagcttttacgttacgttctgccttttcataatactctgccgctacttcataactagcgcctgttgcttccacaataattcgttttgatcgttctactaacttttcatttgtggattgaacatctaccattaagtttttatatacttttcctacaccaatcatcgaagctgttgaaatcatattcaacactaatttttgtgctgtaccagcttttaaacgcgttgatcctgttaatatttctgcacctgtctctacttccacatttaactttgcatatttacttatttcagcatttttattacaagaaatactcgctgtactcgctcctacactctgtgcgtatttcaagccgccaattacgtaaggagttctgccacttgcagcaattccaatcactgtatctttctcatttaatccaatactttttaaatcttcttctgctaactcttcgcgatcttcggcaccttccaccgctttagtaaacgctttcaatccacctgctataaatccttgcaccattttatcatccgtgccaaatgtcggcggacattccactgcatctagaatacctaaacgaccactcgtaccagcaccaatgtaaattaaacgtccctcttcttcaaaagatttaataacagtctgtacaaccttttcaatttgttctatctctttttcaactgctaacgcaacagttcgatcttcttcattcatactttgcaacactccttttatgctcatctcatccaaattcattgttttctcattacgatgttctgtcgataaattttctaacatattgccaccctctttgaaattatatttcacacttttattataactttaagaaactaaaaatcaattactctttcttattttatgaaataaaatttcacgacatgacatatttttgtcaaagatcataaagtgaaactttaatcagtgtgggttttgttcatccccactgattattagcccgcaccaatcgggcatttacgggcagttgatccccacctaactttctttgcttccgctgaattttgaagtgagggtcttactgcccggcaaatagggggataaaaaaagatgagtctcctcatcttttcttctactttaacttccgtaaccgcaacgcttcttctcgcgtctccataaattgatccaatactttattaccaatccgattgaaagtaatcacatataaagcatcaatcatattcagttgcgtcattctcgaagcaatactcgcaatacgatgatcttgttctacatctggcatacaaaggcgaatatccgcttctttatataggggggatgattgatctagtttcgtaattccaataacagttgcaccttgtctctttgcatactgcgccatttcaagcacatctttcgttcgaccagatgttgaaatcgcaacaaatatatcgccttcttttaaattcgtcacaagtggcaacatcatatgaaaatcagatagcatcatcgctgtaaatccaagccgcgtaaatttataagccccgtccattgctggcgtagctgatccgcctactccataaaagataattttatcggcatttacaatacgatctgcagctttctcaagttctctcttatctattgcagtaacactcgcctcaattgcagctttattcacataagtaactttattaaataaatcatacggtccatcttctgtattcatcactgaaaaatcgttaatattataatcagcaatagttaattcacgaacgagtgctatcttaaatgctttaaaacttccgattccaatcgatttacaaaagcgaacgacactcgcttcacttgcgcctgcattcgttgacacttctttcgtcgttaaattcggtacaatctctgcattctccattatgtacatggcaaccttcttctcagctggtgaaaattgatccatattactttcaattttaaatagtaatgttgaagctttcactatttaacctccacttcttacggttgcgttcacttattttctcttgcttcaagaaggtaataaccatcatcgccaggaggatgaaacacatttacaatgcgattccctttttgataaacagttctttccccttctgtccacttcttttcccaaccgttcatccaaatcgcaacatcaggtaaaaaagcagtatatttcagcttctgaccgtactcaccatctgcttcttccgaaaaaatagaaaccggaaaatctttcacttttgattctttccatgcagtaaatggtatacatactgcaataagtacgattacaccaataaccttctccttcgtaatcttcacacttccctctccttgtcatatcacatacatagattttaccataattacaaacgcttcatgctatatgatcgttgcttttaggaataaaaaaagagcttacctacatcagataagcccttcctctctatgcaaaatatttcttcaaaagtggtggtgtaataatcgtcgtcaatataacaacaataacaatcgctgtgaaattttctttcgctaataaattcgccgtaagtccatttgctgcgatgataagcgctacttcaccacgtgataccatccccgcgccaatactaatagaagattggagattaaatcctgtcagtctcgctcctaaacctgatccgattaactttgtgaaaattgcaatgagagtcataataataatgaaccaaagctggcttccaataccttgaaatgtaatttccattccgatacttacgaagaatactggaacaaatattgcataagcaatcggttcaattttatgttccacttcatgcttatactctgtttgagaaatagcaattcccgctgcaaacgctccaataatacctgcaattcccatcatttcactgtaataagaaaaagagaagcaaataataagagccgcgctaattaacgcttctgttacacgaagcgggacaagcattttcataatccaaggaacgactttccatgcaataaaaacaatacttacaaagaaaataattttctttacaatgacaagtgttatattcacatcttgtgttcctaaaaaactcattacaaatgctaataaaataacgacaatgacatcatcaaatacggcagcacctaaaattgttgtactttctctcgtattcatttttcctaaatcacgtagcgtctgcaccgtaatactaaccgatgtcgcgcaaagtaataaacctaaaaaaatggcatgggattgtattaatccaaacagcaatcctgttacataaccaccgatgaaaggaaaaataattccaccagccgctactgcaaatgacgatttcaaattccgatttaactcttctaaatccgtttcaagtcccgctataaacataagtaacaaaacaccaatctcactcaattcatcaatcagttcagaactattaataataccgagtacagccggaccgataataataccgacaattaacttaccaagtacagaaggctgaccaagtctcacactaatgtcaccagctaatttcgtacaaagtaaaatgacgacaagttcaaaataaaataacatagcatctgctcctactttaactttaatcagtgggtcgataacccacgtccatttctgcaagtagtttcccctattgatccgcattttatttgtcatatttttatttgacaaaatattctgaattatattaagattaatccagcaattttaaaaaactacataccataactgcacctccacttacttactcttttttaatgggctcatactatagtcgcagttatggaaatgaaaaaacgggggagagagtccaaagtgaagtcattattacgaaaaaaagcgcttagtactgagtcaccaaagcaactagatagaacattaactgcactcgatttaacgtttttaggaatcggcgccgtaattgggacagggatctttgtattaacaggtattgttgcagcaaaacattctggtcctggtattatgctatcattccttattgctgcatttacttgtgcttgtgtagccttttgttatgctgaatttgcttcttctattcctgtctcaggaagtgtgtatacttacgcatatatgacagtcggagaagtcgtcgccttcatcgtcggatggtgtttaatgctcgaatatttacttgccgttgcagcagtagctgtcggttggtctggttatttacaatcattactacaaggtttcaatatacacctgcccgccataatcgcctcggcccccggcgtaggaaaaggtggtctcatcgatttacctgctgtctgtattttacttcttattactggccttttaagttttggtatacgcgaaagcgcacgcattaataatattatggttcttatcaagttagccgttattatcgcctttatcgtagcaggtgcaaaatatgtaaaacctgaaaattggacaccgttcattccattcggatacgacggtattattactggggctgccactgtgtttttcgcctttttaggttttgatgcaatcgcaaccgctgcagaagaaacgaaaaaaccacagcgtgatttaccaattggtattatcggttctcttcttatttgtactattttatatatgattgtatctttcgttttaacaggtatggttccttatacacaattagacgtttctgatccagttgcatttgcattgcacttcgttggtgaagatgcaattgcaggactactcgctgttggagcgatgactggaatgacaaccgtcctcttagtcgttatgtatggacaagttcgcgtttcatatgcaatgagccgtgacggtctacttccaaaagcgttagcacgtgtaaataaaaaagtaaaaatccctttattaaatacgtggattactggcgttgttgctgctttattagcaggccttttagacttacatttgctagcgaatttagtaaacatcggcacgttaacagcctttacattcgtttgctgcgcagtacttattttacgaaaaacacaccctgacttaaaacgcggattccgcacacctttcgtacctgtactaccagttgtcgcgattctttgctgcttatatttaatgattaatttgtctaaaacaacatggattagctttgcagtttggcttatagtcggcttatgcttctatttcttctactctagaaagcatagtcatttagctattgaaaaaacaaatgatgaacagaaaaaggcataacaaaatagctcgccgataaaatggcgagctatctttctatactatcatattttttcgttaacgattgtaaaatgaaaaatatgccgatgcaagctgtaaaccatgcccaatttcctattggtgtcgagtatgtgatcattccaatacccacaagcactaagaaaataatcacctgatatatgagcttccacttttgcatatattccctcctttacttcgtccccttctttttcttcttccaggcattcaaactatcaaagaagaagttaataaataacgttcctaatcctgctaataaaaacgtcattaagaataaaacccaaatacttttatcttttaataaataatatcctacaaggagcacaaccgcgatccatacatattcaagaattctttttagctttttctgttccaacttattcgctccctctttctatgctacttttagtataacaaaaaagaagcctatcatgataagcttcttttcttctctcttatttgttcatacttttttcaacaagtgaaatcgcatactctaatgtacgattcatcgtttctacctgtgcatcttttacttgcacatcttgtaatacagcttctgcaactgtaattttttgttgcaatgatttcactgaaccatctgttacatttacagcttgcgctttcttcactactgcttttgcagattcaatattgatttgtaatttttctttcgttgtttttggttgttcttctgccacttttgattgtacaaatgttacattagctgattttaattcgttatatgtttgaataatttgttccccagtacttcctacattttcaaatgcttgctttgcaatgttatagcttttctctaattcttgaaatgcttcctttgaatattgacctggcttatcaccaaattcatacgtactaactaacacttcttttacttttccaagctcttcaaataacgcatttacttgctctaacttcgtacggttagaaaactcattgtatgatgctaatacttctgaagaacttaaagctttactatataatttcgcaagcgcgatttgtccatttaacggaataccaccatttccgttactatcaggatccgctccaaatgcaaatggtacgttcggatgatacactttcccagtagctggctgactatttacttttttaccatctacgtaaatagccacttcgcttccgttatacgttcctgttaaatgatacgttttgttcgcttctaattgaactccaacacgtttatagctacctccaatgtgagcccataattcaacatatccacttcctgtagactcaaatccaattccgccgctctctgtattttgcaagatgccttgtccgcgaatttcattcattgaaaatacagtttctaacgtaaacgtatttgctactttttctttttgtgctgctgaaaatggaaggtatccaaatgtatttgcttttccgtttaacttcataacattcttcttcaatgctttatcatattcaatagtcacattgcccttcacatcaccttttgtaccaaatggtgaattgtctttaaatgtaccatctgcaaagtttacatcgaaaacatcagcttttggtactttcacattcgggtcaatattatcttttttcgtagtaatttccgcagttaacggctgtgcggtttcattgccaaatgaatcaatcgcaactacttcaagtgtatatgctttcccgccatctaaccctgcaagcgtaaacgtaagatctttcggcactggatcacgataaaactctgagaatgctaacaatttattttttatttcacccgtttgcttatctctagcctgcacacggtaagagtgaacaagaaggttgtccaatgcttgcgggaatgttactgttgccgcattttctgttacatttgatacagcaagctttgcatctttagcaaagtaaggcttttctttatcacgatcttctacatgtgtaaatgtttctttctttgctggtaatttaattttccaaggctcgcctgtccaagaattcgtatggaaatcacggcgattaatcgtcacttcttcttcatctacttctactaataaaccttggcttaacgtactagctcctggcgggatattcccttgtactttaccaccttcaacttccatataacttactgaagatgtaccaactgatgtaaagtctttttgatgtatcgatctcggatcatctaacggataatgtgaatgacctgaaaacgtaataacttgtggatattcttttaacactgcattaatttttgcgctatcttgtgttccccattcctgactaccgtacactgtatctttaatatgttgatgtaaaaatacaaaaatcggtttttctggatcatctttttgtgcttttgccatttcttcttttaaccaattaatttgcttgtccgaataataaccatgtgttgttccattctctggagacataacaaggaagtgataaccttttaccactttatgataataaattgattccatacctgttttttctaagaaacgcttctgtgcaccctctacggataaaccgttccaataatcatggttaccgagagaattcattcgcactgcatctttatttgcattttcattatacacttgcatgaaacgatcatattgctgcactgatcctgtatctgtgaaatcacctacaataacaaacgcatcttgctttggtgctaatgtattaaactgttcaatcgctcttttccagcgaaacgtatcatccgttccactatttttaatatgcacatcacttacaactggaaaaactatcttcttctcacttgatgccttttcttgctttttctcttctgctttaactgatgtgctccatggaaatgatacgaatgctaatacaaaaaccatcaataatccaataaggccttttacttttcgtaaatcagttctgtccacgtaaatcctcctcatataatgaattaattacaatggttattgtatcgaacacatattaacttcgtttaaagtgaaaatgaaatttatttaacttttgtaaatatacagtcatttttctgtaacatccaacattacttgtattatcttatacaagtaccttgtgtctaacagactcttattcattattatgatttggaagcctattaaacaaactttcctgaaatttttcgcccctttattaacacaactatcgttttccaacatttaatagtaataaaaagaaagtatgaagggaggagctactaatggcttgtaaaaaaaatatcggctgttatgcccctttatctatcatctgccctccctatgatccacctaatccaccagaaccaccaggctgtgaattaattacaaatgaatttgccggtaattttcttataacaaaagaaattccaccaccttctgaaaatcctacattaatcttatgggaaggagatggtgtagttaaaatatctggtaccatttctgtgtataatagtactagtagtactgcaggaattaccgttcaaattatcggaaaggtgacaaatacttttacagtctatcctggcaacacaatgtcatatacaggtcaatccttacaatctgtggctatcattgatattccaaataacccaacccgatatatggaaggaaaatattgttgtcaattctcattttgcttataaatttcttcaccaccttaacttacaaactatataaaaaagcataccacttggtatgcttttgcttatgaaattggataacgtactgtcagacataattgtccttggcttactcccgttcctgttgttacaatttgaattgtagtaaagtatcttactgtaaatgatccactgctttgtggttgtacagtaattgtattcaccactgtcgctcctactaaaaaattcaccgtaattggagctgtacctacatcatatttcacataacctgatgcatataaatcttgcgtaatattattcgtatacactgtttcagttaccgcaccagtagcagcccaatctatacatacctgatcttgaacaagtgttttactggaacagcatgataagttagaattgtacatcttagccctctccttttctattatgaaagtggataacgtgtagttatacaaaactccccttgatatgttccagctgttgcagcaggtaaagttacttcaattgttacgaaacgacggtacgtaaaagctatacttgttcctgggtttaatgtttgtgtatcaattgtagcgcctgctgcatctaaaactgtaagtgtgatcggagccggtccgacgtcatatcgaacaaaccctgttccaatcatattttgattaatattattgttgtacagtacattcgtaatagcagtcgccactacagttcctgaccacggactacacactttatcttgcacataatttttatctggacaacaagttaatgctgaccctgagcactcacaagacatagttgtttcccctctctcttttatattccctatatgtgtatgtcccccagagtcttttgcctgtactattcatctattttcaaaaaatattcaaatgactagatagattccgttttgtttctttttttcatatatttatagacaaagatactagcaacaataagaataacgcctcctaatatcggtagcatatattgtccaacaacatccgctgctttttcccaatgtggacctaatttcattccaaaataaacatacaaagtcgttaacgggaacattgctacaaatgtataaatactaaatttccatatgttcatttttgccataccacatggaacagaaataagcgttcgcactccaggtacaaagcgtccaacaaatgctacaactggtccatatttctcaaagaaatcatctgctttttgaatttgttcttctttaataaagaagtattttccgtattttattaatagcggacgaccaccgtaataaccgagtgcatataacgttaaaggtcctgtcgttccaccaagtgtccctgctaatacagccaaccaaaaattcatatctccctcgtatacccaatacccaaccataggcaacactacttctgccggaataaattcaaacgttaatgctaacacaactccaaaataagaaaactgctttaaaaactcgattatatctaaaataatttgctccatatttttaactcctatcctacgtttacgttatgcttttcttgtaattgaactggcgccatttttacaattcggttcaaaataaataacacatctccaatatcatctaaaataccgataaacggtaggaagtctggaattaaatcgagcggcatcgctacatacccaactaaaaaagcaacagataaaattttcttctttattgaaacctcttttgaagtaaaaaagtcaaataggaatggaacaaatcggcgaacatgaaatacaactcttaatctactaataagttttttcatttttatatctcctctctttgtatacgaaaaggaccctaccaaatatggtaagggtcctcaaaaagacagaaaggggcctttaccattgctgggaaaggtctcactaacaacgaaacgttgccaataaagccgagggtttcttcctgtaatgacgactttattgtaataagtactcccctttatacacaattttatacacttacattaaaatatttcagagggcttgtc

SEQ ID NO: 1277 - DNA, 11752 bp, Bacillus thuringiensis
tttctccaggttctactgaaactgagatgcaaagattactatgggctgatgagaatggagctaaaaatataattgctggttctcaaaatacatatagactcggaattccattacaaaaaattgcacaaccttcagaagttgctgaagcagtgttatttttagcctcagatagagcaagtcatattacaatgcacaatttatgtgttgatggcggtgctacgttaggagtttaataaaaattcaggaggttattatattatgaatgaacatatagctgtaaaggaattgtcagaaaaacttttagaagattataagactgaatcttcattctttttcgcttcaccaactcgaacgatattagcagaaggagagtttactacagtaaagcatcgtgaaattgaaagtttcccagagcttgttcaagcgaaattaagtaatgcgaaacaagctggaaatccaaatcctatcgttgtgggtgctttgccatttgatcgtagaaaagaagtccaactcatcgtaccagaatatagcagaatttctgagcgtttacaattggatacaacaaatcagcttgaaacaaatgagaatgtaacatttgaaatgacaccagtgccagaccctgaagtatatatgaatggtgtgaagcaaggaattgaaaaaatacaggacggtgatttaaagaaaatcgttctatccagatcgttagatgttaaatcttccgaaaagattgataagcaaaaacttctgcgagaattagcagagcataataagcatggttatacattttctgtaaatttaccgaaagatgaaaaagagaacagtaagacgctaattggagcaagccctgaattacttgtttcacgtaatggtatgcaagttatttctaacccgttagctggttcaaggccacgtagtgaggacccagtagaagataaaagaagagcagaggaattactttcttcgccaaaagatttacatgaacatgcggtagtagttgaagcggttgccgctgcacttcgtccgtattgtcatacattacatgttccagaaaagccatcagttattcatagtgaagcgatgtggcatttgtctacagaagtgaaaggtgaacttaaggatccaaatacttcttctttacaattagcaattgcccttcatcctacgccagcagtttgcggaactccgatggaaaaagcaagagaagctatacagcatattgagccatttgaccgcgagttctttacaggaatgctaggatggagcgatttaaatggagatggagaatggattgttacaattcgttgtgctgaagtacaagaaaatacacttcgtttatatgcaggagctggagttgttgctgagtcaaaaccagaagatgagttagcagaaacatcagctaagttccaaacaatgctaaaagctttagggttaagagatagttcacttaatgaaaaatagggggaagaaagaatgctagtaggttatacagaatggccaaaagaatttgccgatcgttaccgagaagcaggatgttggcttggtgaaacatttggaggagtgttaagagagcgggctgagaaatatggagatcgaatcgcggttgtaagtggtaagaagcatataacatatagtgaacttaataaaaaggtagatcgtttagcagcaggtttactgaatttaggaataaagaaagaggacagagttgtaatccagttacctaacattatcgagtttttcgaaatatgttttgcactatttcgaattggagcgcttcctgtctttgcactaccttcacatcgaagcagtgaaattagttatttttgtgagtttggcgaggcgagcgcttacgttatttcagataaggctctcggttttgattatcgaaaattagcaagagaagtgaaagagaaagtgccaactttacaacatgtaattgtagtgggagaagaagaagagtttgtgaacataaatgatctgtatatggatcccgtctcattaccagaagtgtagcctagcgacgttgcatttctgcaattatcaggatgcacatcaggtctttctaaattaattcctagaacacatgatgactatatttatagtttacgtgttagcgctgaaatttgtaatttgaatgcagaaagcgtctatatggcagttcttccagtagcacacaattacccaatgagttctccagggacatttggaactttctatgcgggtggaaaagtggtattggcaactggtggtagtccagatgaggcctttgctcttatcgaaaaagaaaaagttacaattacagcgctcgttccgccattagcaatgatttggcttgatgctgcatcttctcgtaatgccgatttatcaagcctagagattattcaagtaggtggtgctaagtttagcgctgaggttgcaaaacgtatacgtcctacatttggatgtacgttacagcaagtgttcggtatggcggaaggattagtgaactatacaagattagatgatccggaagaatttattatttatacacaaggtagaccaatgtctgcactcgatgaagtacgagttgttgatgaaaatgacaacgatgtacaacctggcgaagtaggtagtttattaacaagaggtccatatacaattcgtggttactataaagccgaagagcataatgcacgatcatttacaaaggatggattttatcgcacaggtgatcttgtaaaagtaaatgaacaaggatacatcattgtagaaggaagagataaagatcaaattaaccgcggtggtgagaaagttgctgcggaagaagttgaaaatcatctattagcacacgatgcggtccatgacgtagcaattgtatctatgcctgacgattatttaggtgaacgcacctgtgcttttgttatagctcgcggacaagttccagcagtaagtgaattaaaaatgtttttaagagaacgtggtatagcggcttataaaattccagatcgaattgaatttattgaagcattcccgcaaacaggagtcggaaaagtcagcaaaaaagaactacgtaaagtcattgctgaaaagcttattacagtaaaacaataataaaaaccggaaggaagtgattagatggctatcccatctatttcagtatataaaatgccaattgaatcagaactaccaaaaaataaagtgaattggacgccagatccgaaacgtgcagtacttttaattcatgacatgcaagaatattttcttgatgcatatagcgataaagaatcaccaaaagtagaacttatttcaaatataaaaatgataagagaaaaatgtaaggaacttggtataccagttgtttatacagcacaacctggtgggcaaacgttagaacaacgaggtttattacaagacttttggggtgacggtatacctgctggaccagataaaaagaaaattgttgatgaacttactcctgatgaggatgatatattcctcacaaaatggagatatagtgcatttaaaaagacaaatctattagaaattttaaatgaacaaggaaaagatcaactcattatttgcggtatttatgcgcatattggctgtcttttaacagcttgtgaagcatttatggatggtatagagccgttctttgtagcagatgcagttgctgatttttcactagagcatcataaacaagcattgaagtatgcatctaatagatgtgcagtaacgacatcaacaaacctactgttaaacgatttacaaagtgtaaaagatgatgagagtgaaggaatcactatacaggaagtgcatgaactagttgcacaactacttcgtgagccagtagagagtattgatattgatgaggacttattaaatagagggcttgattcggtcagaattatgagtttagtagagaagtggcgtcgtgaagggaaagaaatcacttttgcacatttagcagaacgtccaactgttgcaggttggtacagtttactatcttcacaaacagcacaggtgctgtaacaaatagactacataataaaggggtagtaaagaatgcctaacagtcaaaagattcgtcattcgttatcatctgcgcagtctggtatgtggtttgcgcaacaattagatccgcttaatccaatttacaatactggggaatatgtagaaataaacggaaatattcatcaagaaattttcgaattagctgtacgtaaagttgtaatggaagcagaagcacttcatgttcgcttcgaggaggatgaaattggcgcatggcaagttattgaagaatcacagtttcatatgcattttattgacgttcgtaaagaagaaaatcctgaagaagctgctaaagtatggatgaaaaatgatttatctatgccagtcgatttgaaaaaagatacattatttactgaagcacttattcaagttgaaaataatcgtttcttttggtatcagcgcatccatcacattgtgatggatggctatggattttcacttcttagccaaaaagtggcgaatgagtatacatcacttatagaagaaacaaacaagaatgaaaagccgtttggttctcttacaaaagtcgtgcaagaagatattgagtatcgtgagtctaaaaaatttcaggaagatcgtactttttggttagaaaaatttgcggatgaaccagaagttgtaagcttggcagagcgagcaccgagaacatcaaatggattttcacgagaaacagcttatttatctagttctagcacgaaaactttattagaagatatcaatatttcgttaacaagttggccggaattcattgtcgctgtaacaagtatttatatgcataagttaacaggtgcaaatgatattgttttaggtttaccgatgatgggacgtctaggttcggtatctattcatacaccaagtatggtaatgaatttagtgccacttcgtattacagtaactccaaatataactcttgcggaattattgcagcaagtttctaaagaaatccgagatgtacgtcgccattataaataccgtcatgaggaattaagaagagacttaaagttactaggtgaaaatcaaaggttgtttggaccgttagtgaatgttataccttttgattacgggctaaattttgctgggaatcgtggtattacgcataatttatcagcaggacctgtcgatgatttatcaataaatgtatataaacgttttgatcaaaatgagctaatgattcattttgatgcaaatcctgaagtatataatggcgcggagctagcattgcataaagaaagatttatgagtctatttgaattagtagtaaataattatgagaaaaacgagtcgattggaaaaataaacattactctgcctgaagaaaatcataaagttttattggaatggaatgaaacgaaggaagacgatgagttaatcagtctgcctatatcatttgaaaaacaagtgcaaaaaaatcccaataaactagccattacttgtgacggtgtaaaccttacgtataaagagctaaatgaacgagcgaatgaactagcacattatttagtagaagaaggaatacgaccaaaccaatttgtagctttagtattccctagatcaatagaaatggtagttagtatgctagcagtcttaaaggctggtgcagcgtatttaccaatagatccagaatacccagcagaaagaattaattatatagtaaatgatgcaaaaccagtttgtatcataacatattcatctgtttcatctaagttagttatagaaaatgatatgaaaaaaattgtattagatgaagaagaaacgaaactagcgttacatacatattctcgtatgaatatagcatgtaagaatgatgtatcacttttaaacccagcctatacaatatatacttcaggctcaacaggaaacccaaaaggtgtaattgttcctatgagaggtttaagtaactttttaatggctatgcaacaaaagttttcattaaatgaaaatgatcatttattagcagttacaacgtttgcgtttgatatttctgctctagaaatttatttacctcttattagtggtgcaagtttaacaattgcgcaaaaagaagacatacaagagccatcagcattaacgacacttttacaagaagaaagagtgaccattatgcaggctacaccgacgctttggcaggcgttagtaactgattatccagagaagctacaagggctaaatatactagttggtggtgaagctcttccagcgcatttagcaaataaattaaaagaattaggttgctcaataactaatttatatggaccaactgaaacgacgatttggtctacttttatgaacattgatgaaggtgaaaagggtatacctcctattggaaagccaatttgcaatacagaagtgtatgtattggatgcagggttacaaccagttccacctggagttattggggaattatatattgcaggggagggacttgcaagcggatatttaggaaaacctgagttaacagctgaacggtttattgcaaatccttatggagaatcagggaagcgcatgtaccgtacaggagatcttgtgaaatggcgtagtgatggtgcgttagagtacattagtcgcgcagatcatcaaattaaaattcgtggattccgaattgaattagctgaaattgaaacggtattacaacgacatgaaaatattcaacaagcggtagtaatggtacgagaagatcgtccaaatgataaacgcatcattgcgtatatcgttgcagaagaaaaggaaccgattaatctttcagaaattcgttcttatgtttcagaaagtttagcgaattatatgataccatcggcatttgttgtgctagaagaattaccattaacgccaaatggtaaggttgacagaaagaaattacctgctcctgattttaatggaatgcacaatgagagagttgctagaaatccgaaagaagaaatattatgtgatttatttgcagaagtctttggtgtttctcgaattagcattgatgataattcccttgaatggggtggacattcacttctcgcatctcgtttaatggcaaggattcgtgaaacgttaagtgtggaattaggaatcgggaaactatttgaatcaccaactgttgccgaactggcgaaacaattaaacgatgcaaaaagtgcaagaccagctattcagaaagcaagtaggccaaatgaagttccactttcatttgcacagcgcaggttatggttcttaaattgtttagaaggtccaagtcctacttataatattccgctagtcattcgtatgaatggaatattgaatcgggaagcattacaaggtgctttttatgatgtagttgagaaacatgaaacacttagaacaattttccctaacgtattaggtagttcctatcagagaattttagatatggaaaacttaaatctagaaatggttataactaatacatgtaaagatgaattagaaagtgtactttcagaggcggtaagatatagctttaacctcgattttgagccggcagttcgtttacaactttttacagtgagtgaaaacgaacatgtattattaattttattacatcatattgtaggtgatggctggtcattacagccgttaacgagagactttgcagcgtcgtataaagcgcgatgtcaaggtgacagagttcagctggagacactaccagttcaatacgcagattatgcactttggcaacagcaattgctaggtgatgaaacgacaccagagagtcttatttcaacacaattagatttttggaaagaagaacttaaaggtttaccagaccaaatggagttacctacagatttccagcgtccaattgagacgagttaccgcggggaaacaattcattttcatatagatgaaggtatgcatagtaggttagtagagcttgcacgtaaaaatggagttagtttgtttatggtattgcaagcagggcttagtgcactatttacaagattaggtgcaggcactgatataccaattggaagtccgattgctggaagaaatgatgatgtactttcagatattgttggtttatttgtaaatacattagtgttacgtacaaatacgtcaggagatccaagttttaaagaattattaaatagagtgaagcaggtaaatcttgcagcttatgaaaatcaagatgttccatttgaaaggcttgttgaagtgttaaatccagtacgtactcgaaacagccacccgttgtttcaagttatgttagcttttcaaaatacaccagaagcaacgtttcatgtaccaggtttagaagcgagccttgaaattcaaagcgtcggttctgcaaaatttgatttaacatttgaaattagtgagagtaacggggttgatggtactccgaacggtttacatggattactagagtttagtaccgatttatataaacgtgaaacggttcaaaaactaatagaacgattcattttgttattagatgatgcagctacaaatccggatcaatcaattggcagattagaaatattaactgtagcagagaaaaatacagtgttagaaaagtggaatggtggttttcaaattgcaccagaaatgacattgccacaattgtttgaaaagcaggttcatataaatccaaattctattgctgttgtctttgaagataagaaattaacttataaagagttaaatagaaaagcaaataaaatagctcgattcctaatagcaaaagggattggtcctgatcaactcgttgctttagcgatgccaagatcattaaacatggttgtaagcttattagctgttcttaaagctggtgctggataccttccgttagatccagattacccagcagaccgcatttcatttatgctacacgatgcgaaaccaacatgtgttttaacgaattcagaagtggaatttgaatgtgatgaggcactaaaagttttagttgatgatgtaaaagtaatagcagaagttgagaaatatagtgaagaaaatattgatgaagtagaacgcattaagccattatctccatcacatattgcttacgttatttatacgtcaggctcaacgggtagaccgaaaggcgttatgatacctcatcaaaatgtagtaagacttttaggagcaactgatcattggttccagtttgacggaaacgatgtttggacgatgttccattcatacgcttttgatttctctgtttgggaaatttggggacctttattatacggagggcgtttagttgtagtgccacatactgtaagtcgctcaccgaaagaatttttacagcttcttgttaaagaaaaggttacggttttaaaccaaactccatcagcgttctatcaattgatgcaagcagatcgtgaaaatgaagagattggccaaaaattatctttacgatatgttgtttttggaggagaagcacttgagctaagtcgcttagaagattggtatagtcgacatcctcataacgcaccaaagcttattaatatgtacggtattacggagacgacagtacatgttagttatattgaattagatgaaactatcgtctctttacgagcaaatagtttaattgggtgcagtatacctgaccttaaagtgtatgtgttagacaactatttacaaccagtgccacctggagtagttggagaaatgtatgttgcaggtgcagggcttgcgcgtggatatttaggaagagcaggattaacggctgaacgctttatcgcagatccatttggcaagccaggtacaagaatgtatcgtacaggagacttagctcgctggcgtaaagatgggacgctagattatataggacgtgcagatcatcaaatcaaaattcgtgggttccgaattgaattaggagaaatagaagcagtcataatgaagcaccctaaagttgagcaagtagccgttattgtacgggaagatcaaccaggggataaacggttagtttcttatatcgttgcatcaaataatgaagcgattgatacgaatgaaatgcgtcagtttgctagtggtagtttaccagattatatggttccatacgcttttgtagtagtaaatgagttacctttaactccaaacggtaaattagatagaaaggtattgccagctccagaatttatcgcatcatcttctagtcgtggtccaagaacaccgcaagaagaaatgttatgtgacttgtttacagaagtgctaagtgtacctcaaattggaattgatgacggattctttgatcttggtggccattcactccttgcagtgcagcttatgagccgcatgaaagaggcgcttggagtggaactaaatattggcactttatttgcagcaccgactgttgcagggttagctgaaagacttgagatggggaatggtcaaagtgcacttgatgtgttgcttccattacgagcaagcggggatcaattaccactattttgtgtacatccagcaggtggattaagttggtgctatgcaggacttatgaaatctttaggaacagattatccaatctatggtgtacaagcacgtggtatcgctaaaaatgaagaacttccaaaaagtttagaggagatggcggcggattacttgaaacacgttcgtgaagtacagcctcatggaccatatcgtttattaggttggtcgcttggaggaaatgttgtgcatgcaatggcagcgcaattacaaaatgaaggggaagaagtagaattactcgttatgcttgattcttatcctggacacttcttaccgaatacggaagcgcctactgaagaggaagcgttaatcgcattacttgctttaggcggatatgacccagataacatggatggtaaaccacttacaatggaaagtgcagttgaaatccttcgtaaagatggaagtgcattagcaagtcttgaagaagagactatattgaacttgaaagaaacatatgtaaattcagtagggttgttagggaaatatgtaccgaaagtttataacggagatatcttattctttagatctactgttataccagactggtttgatcctatttctccaaatacgtggttaaattatttagatgggcaaattgtgcagcacgatgttgattgtagacataaagatctatgtcagccaggtccacttacggaaattggacaagtattagcgaaatatttgcagaataagaaaggggtaagtagagtatgacgaatccatttgaaaatgataattacacatataaagtattaataaatgaggagggccagtattctctctggcctgcttttctcgatgtacctattggctggaatgtcgtatatgaagaagctagtaggcagagttgcttagaatatgttgaatataactggaaagatttgaatccacaaggtaatcaagttcgcgaaaaaacattagtaggaaaacgataatgaaagaaaaactaaatccaaaagtagttgtaagtatcgtttatataactgcgatgtttatggctgcgatggacgcaacgattgtaaatgtagcactgcaaacgataagtagagaactacaagtacctccatctgcaatggggacggtgaatgttgggtatttagttagtttagctgttttccttccgatttctggttggttaggagatcgttttggtacgaaaagagtatttttaattgctcttttcgtatttacaattgcatctgctttatgcggaatggctaacgatattacttcattgaatattttccgtattattcaaggtgctggcgga

SEQ ID NO: 1278 - DNA, 6757 bp, Bacillus thuringiensis
cttacaccatcgtagttttatattttaaagattttagatcattatggggcttcaagagcgacaacattagcaaaaaagatgtatgtgaagcctagcgcgattacagtgatgattgatcgtctaatcgatcaagaacttgtagaacgctatcacgacaaagatgaccgtcgcgttgtcatcatcgagttaacgaaaaaggggaaagctagagtagaagaggcaatgacagctcgtaacgagcatattgcaaaatacttttcacatttagagttgcaagaaagagaagatttattacgtctctttgagaagttagaaaccattatttgcgggacacaagagaaaaaagagaataactaagaggaattgaggagattacatggagcaacaagaaaatcaaaatagaaagttgttgttaatcggtttagtaatcgcgatgctatttgctgcattagatggaacaattgttggtacagcaatgccacgtatcgtcggtgacctaggcggattaagtttaatgacatggttaacgacagcttatatgttaacatcaacgacagttgtaccaattgcaggtaaattagcggatttacttggtcgtcgtaacgtatatataacagggctagttattttcatgattggttcggcgttatgtggtatggcgaatggtatgacagaattaattattttccgtggtattcaaggtcttggtggcggtattatgatgccaatggctatgattattattggagatatgttcacgggaaaagaacgtgcgaaatggcaaggtatttttggtgcgttatacggtcttgcttctgtaattggaccgcaagttggtggttggattgtagatgcagtgaattggagatgggtattctacattaacttaccggttggtattttagcaacaatctttattgcaatgggattaaaatcgcataaacaaacaggaccaattaaaattgatatcgctggaatctttacgatgattctcggtgttgtaagtttattacttgcgctaacgtttggcggaaaagattatgcatgggattcttggcaaattatcggtttatttgcactagctgtaattggtatcgttagctttgttatcgttgaaacgaaagctgaagagccaattttaccaatgcatttctttaaaaatcgcacatttacaatactgaatgcgattggattctttatgagtattggaatgttcggcgcgattatgttcgtaccattcttcatgcaaggtattgtaggagtaagtgctgctgaatcaggaacaattatgactccaatgatgattacaatgattgtgatgagtattatcggtgggcaacttgtattaaaagttggtgtaaaaccacaaattatcgcaggtatgcttattatggccggtggtttctggttattaacaacgatggatatgcacacaacgaagcttacagctacttcttatatgatggttatcggtttaggaatgggtcttgtaatgccgacattaacattagcgttacaagaaagcttcccgaaaaaagaccttggtgttgtaacatcatcaagtcagttcttccgacaaatcggtggtacatttggtattacaattttaggatcaattatgaataacacttcaggtacgacattaacaaagaatttagtacctgtattagatacattcccgaaagaagcgggacaaatggtaacgaaatttaaagatatgattcacacagatccacaaggtttatattcgatgctatttagcccagaggcattaaaacaaatgccagaagcgttcgctaacagtattgtacctattttgaaaaactctttagtagactcgcttcatactgtattcttaacaggattagtatttatcgtagtaggtgccatctttacgattttcttacaaaaaattaaattatcagatcgtaaaaaagatgctaaagagcctgttgtagaagaaaaagaaaaaactgtatcatactcgtaatgaagaagcatcgccttatggcggtgcttttttgagtataaccttaaaagctttttagtgagaaatgattgacgtatttttagaaatacgttatattattttctgtaaacggttacatgaaatgaggagaaaagagaatgagtacgatcaaagacgttgcgaaattagcgggagtatctgttgcgaccgtttccagagttctaaataaaaatggatatgttcacgaagatacattaaaaaaggtagaacgtgcaattgagatgttagattataagcctagtacagtagcgcgttcactgtataataaaaagtctcgtttaattggcttagttgttccaaatatcgtgaatccattctttccggaagttgcacgtgccgtagaagatgtagcacataaacaaggttacacagttgtcctttgtaactctgatgaaagtttagaaaaagagaaacaatatattgatgtgcttagacaaaataatgtagatggatttattgtagcaacgaatccacaaaatagtgttaattacatgaatgtatctgttccagttgttgcgattgaccgtatgtttaatgagcgtattcctactgtatatgcagataactatgcaggaagtcaggctgcgacaaagttgttactagataaaggatgtaaacatattgcacatattcgcggtccacgtgatgtgagtactgcaaatgaacgctttgaaggttttgtagacgttattacgcaaaataatctttcgtatatgattgcagagagtacgtttgatccagcaaatagtgagcttgtagcgatggaattattagaagaatacccgcatattgatggtattgttgctgggaatgatttaattgcgatcggtattgtaaaggctgcacttcaaaaggggattgtcattccaaatgatttacaaattatcggatttgatggcatttctttaacggaaatgatgtatccatctattacaacagttgcacaaccgatatatgaaatggggaaaattgcaacagagttgttgttagagcaaatggaaggaaatacattagaagagaaacattatcgtttgccgattgaaattatagaacgaaatacaacgaagtaaggagatgaaacagatgccaaatattgcagtagtagggagcatttcaatggacttagtggctgtttcaaaaaaacggccgaaagcaggagaaacagtaattggtgaagcgtttcatacaattccaggagggaaaggagcaaaccaagcagttgctgcagctagattaggagcaaatgtagcaatggttggagcggtaggaaatgatgattatggaacagtagttagaaaaaatctagagaacgaacgcatttttatcgattatgtggtaccggttacagatagaacgacaggaattgctcatatcgttttagcagaagaagataacagtattgttgtcgtacaaggggcaaatgctcttgtaaataagtcagttgtagatcgctccaaagaacttcttgtaaaagcggatatggttgttcttcaactagaaattccacttgaaacagtaaaatatgtattggctatttgtgaggaacataatattcctgttatgttaaatccagcgccagcacaagttttatcagaagacattttagaaaaggcaacttatattacgccaaatgaacatgagtgccgcatcgtattagatgatttcatctcaccaattgaagatttattggcgaagtatccaaataaattattgatgacagaaggttctaacggtgttcgtttccataatggcacggagattgtacatgttcctagcattgctgttgatgtagtggatacaactggagctggtgatacatttaatggtgcgttagcagttgcactttctgaaggagagacacttcaaaaagcaattcgtttcgcgaatattgccggtggtctttctgtaacgaaacttggggcgcaaggcggcatgccaacgagagataaagtacgtgaagtgcaggtgattgttggatgaagaaacacggcgtattaaacagtgagattgcatcaatccttgctttacttgggcatacggatacgattgtaattgctgattgcggtttaccaattcctgacggagtaaaaagaattgatttagctgttgaaattggaaaacctagctttttagatgtattgcaagtggtagctgatgatatggcaatcgaaaaagtgacgttagcagaagaagtcattataaataatgcggaagtaaataaagaaatagagcagaaattaatagagccagcatttgagtatgtatctcatgagcaatttaaagagcatacaaagaaagcgaaggcgattattcgtacaggcgaggctacgccttatgcaaatgtaattttacatgcaggcgtgattttttaataaagggaagtgatgggaatgcatattgaaatgaaaaacatttcaaaggcgttcaatggaaatcctgttttgaagaatgcacagtttatgattgaaacaggagaagtccatgcattgatgggggaaaatggagcgggtaaatcaacgctcatgaagattttaacaggtgtatacaaaaaagatggtgggacaatcacgatcgatgggcaagagcgcacctttaaaaatgcgaaagaagctgaagagtacggcatcgcatttatacatcaagaactaaacatattgccgaatttaacagtagctgaaaatatgtttctcggcaaagagttaatgtatgggaaaacaggtattttacgcactcgacaaatgaacgcgattgcgcagcagcaactagcggagttagggttgcatgtaagaggcgctatgttagcagaggaattatcggttggacaacagcaaattatcgaaattgcgaaagcattaatgacaaacgcgagcgttattattatggatgaacctactgcggcactgacggatcgtgaaatcgaaacgctctttacagtaatcaataagttacgtaaagaaggtgtttcattcgtgtacatttcgcatcgtatggaagagattttctcaatatgtgatgctattacgattttgcgtgatggagaattcgtcggaaagagattaattccagaaacatcatttgatgaagtagtgagtatgatggtggggcgcagcattggtgaacgttacccagagcgaaatagtcaaattggtgatgtcatttttgaaatgcgtaacggaacgaagaaagggaaatttgaaaatgtttcgtttcaagtgaggaaaggtgaaatccttggtgtagctggtttgatgggggctggtcgcactgatattatgaaagcgatatttggttatgaacctttagactctggacaaatttttataaatggacaagaagtaaagattgatagtccaatagatgcaattagacaaagaattgctttcattacagaagatagaaagtctgaaggattagtgttagatttttcaattcgagaaaatttagctttaccaaatttagaaagtctttcaaagggaagtgttctaagcaacgagctagaacaacagtttacggcggatatgatgaaacttcttaatgtgaaagcatctagcggagagcaggcagtgaaatctctttctggtggaaatcagcaaaaggttgtaatcgcaaaatggctaggcattcatccgcagttactcattttagatgaaccaacaaggggtgttgatgttggagcgaaaaaagaaatttactctattatgaataagcttacggagcaaggagatgccgttattatggtatcatctgagcttccagaagttttagggatgagtgatcgtgttcttgttattcatgaaggaaaagtaggcggaattttagggaaagatgaggcatcacaagagtctattatggcactagctacagggggagagtaaggatgactaagaaggggaatgtattacaacaactcggttctttaatcggtttagtattaattatcgtcgtaattacagctttaaatccagcgtttattgaaattccaaatttatttaatatactgcgtcaagtatcgattaatgcgcttattgcattcggaatgaccttcgtaattttaacagggggtattgactatcggtaggttctattttagcattatcaagtgcacttgttgctggaatgatggcaagtggcatggatccgttccttgcaatggcagttggattattagcaggtcttgtaatgggaattgtaaacggtatcatcattgcgaaaggaaaagtagctccatttattgcaactttggcaacaatgactatttttcgtgggttgacgcttgtttatatggacggacgtccgatcactggtcttggtgatcatttaatgttccaaatgtttggccgcggttattttcttggtattccggtaccagctgttacaatgatgatcgctttcgcagtactgtacttcattttgaagaaaacgacatttggtcgccgtacatttgcaattggtggaaatgaagaagcagcagcactatcaggtattaatgttacgagaattaaagtaatgatttacggtctttccggaattttggcagcgcttgcaggtattgtcttaacatcacgattagattctgcacagccgactgcaggtacttcttatgaattagatgcaattgcagcagttgtattaggtggaacaagtctttctgggggaagaggatggattgatggcacattcatcggtgtacttattatcggtgtattaaataacggtttaaatttatta

SEQ ID NO: 1279 - DNA, 8174 bp, Bacillus thuringiensis
cgcataattaaggcgatatttctctgtaccaatcggtatatttaatatgtcgctcatttctttataagagtattgttcataatagtagagtacgagcacggttttatatttttcattcaatagctgtataacttcccgtatcatttccgcttccactttttgaataaattcttctgatatattcacatcatctgcgaaatctatttctccaccatcttctttatgaaataaatctaagacgcgatctttccatcttttcttcttgcggtaaaagtcataaaatgtacgaacgcaaattgtagtaatccactttttataattatccacataaaaaagttggtgccttgatgaaaaaacctttatccacgtctcttgaaaaatatcttccgcatcttctttcgttttcgctaacttatagcataaggaatatatttgctgcttatatatatcaattaattcttctatcttttcttccatcataagcctcctgtcatttatataagacgacgcaaattccccttttgtttgataaattttttttattatctccacataaaaaggcaatcacaacatcgtgtgattgccttttatttaaaaacgaaagtccgcttccgcttttctttatgtccagctctgcctcctagccccttctgtctaagaaccttccccacgagaagataaaatgcatcttctgtgggaaagaaccttagccttcgggactaaacagtcggctccgcttttctttattgtccagttccagcggctagaatactcggtggcttcgcgccttcctccgaggcaaagtacacctctctgtcaggagctccatccccctcctattctaaacgagccgcttccgcttttcttcattacattttttctggtgcagatactcctacgattgctaatgcattttgaagtgtagtgcgtactgctttcattaactcataacgagctttacttaattctaagttatcttggtttaatactttttctgcattgtagaagctgtgtaatgttgctgctaattcaaatgcatagtttgtaatacggtgtggtagacgtttttgtgctgcatccgcaactaccgctgggaattcaccaagttttttcagtaactctacttctttctcagaagtaacaagtttatagttcacatctccatctacagctaatcctaattcttcgccttgacgaaggatactgcatacgcgagcatgagcatattgtgcatagtatactgggttttcattagattttgatacagctaagtccatatcgaagtctaaatgagaatcaccgctacgcattgcgaagaagtaacgcattgcgtccacgcctacttcttccataagctcacgaagtgtaactgctttacccgtacgcttactcatcttcattttttcaccattttggtatagttgtaccatttggatgatttctacttcaagcgtgtctttatcgtaaccaagtgcttgaatagcagccttcatacgaggaatgtaaccgtggtggtcagcaccccaaatgttgattaacttatcaaaaccacgctctaatttatcacggtgatacgcgatatctggcgttaagtatgtgtaagaaccgtcgtttttaattaatacacgatttttgtcatcgccgtaagtcattgaacggaaccaagttgcgccgtcttcttcaaagatctcttcacgctcttttaatacagcaagagcttgatcgatttttccgtttttgtatagtgatgtttctgagaaccatacatcaaatttaacgcggaagctttctaagtctttttgaagttttgctaattcatattttaaaccgtactcacggtagaattcatagctttctttttcatcagctttcgcataacgatcgccgaattcttctgctaaacgtttaccaattccaatgatatccgcaccatggtaaccgtcttctggcatttctttatctaagcctaaagcttgcatgtaacgagcttcaacagaaagagctaagttatgaatttggttaccagcatcattaatgtagtactcacgagatacatcgtagcctgcttttgctaataggttacataaagtgtcacctactgccgcaccacgtgcatgtcctaagtgaaggtcacctgttggattagcagatacgaactcaacttgtactttttcacctttaccagtattcgtttcaccgtaagcttcaccagcgtttacgattgttggaattaaatctgttaagtagctattatccatatagaagttaataaaaccaggaccagcgatttcgattttttcaatagaagcttttgctttatcgaagtttgcaactagttcttctgcaatcatacgaggtgcttttttcgcaacgcgtgcaagttgcattgccatatttgtagagaagtcaccatttgttttatcttttggagattctaatacaacgtttggaatctgttcttctgtcgctaattctgcctttaatacagcagcctgaatttcttctttaatcaatccttttacttgttctaaggaattcattattttgcctccttcaaattaattgtaatagtatatctgccagcttcttgttcacttagaagcaatgcgtaagttaagaagagttgtccttttttcttttcatccgaccatttaaaaagaacgttatcagtctttgtttgcaatgcaaacgtaccaagttcactcgtatacgtaccagttgtccattcacctttcacatgcgtctgacgcatagaaacagcacctgaacgcataatgagaacttgttcatcttgaattttaataattgttttcacttcgccttgttcgttcggctcctggaatgttacatatgtaccttgaccttttacatagtattgaccatttgcttcaaaagcaacggtttccttcctcgccccttcacggatttctgttacgaaatgaacgtgtaccggcaagcctgcaagttgtttctccacgtcttgcacacctttcaaatgttatagatattaaatactacttataataaatcacttttcctatcatatcaaaaaaagactctgtctgtctgctgaaaaatcaggaaaactccatttcaaaaaataattcacttctactttatttcatacgataaaatattttttaaatctaaatattctttcaattaaagaggtgaatatagtgataccaacaaagttaaaaaagggtgatgaaatacgagtgatttcaccatcgtgtagtttaagtattgtttcaaatgaaaatagaaaacttgctataaagagattaaccgacatgggctttcaagttacattctcaaaatatgccgatgagatagatcgatttgcttcctcttctatttcttcccgcattcaagacctccataaagcatttggagaccctaatgtaaaagctattttgacgacacttggcggatacaactccaatggtttattgaaacatctcgattatgatctaattcataaaaacccgaaatttttctgtggttattcagatattactgctttaaataatgcaatttacgcaaaaacaggtctcgttacatattcaggaccccatttctcttcctttggaatggagaaagggctcgagtatacaaccgattactttttaaagtgcttaacttctaatgagcctattgaagtcctgccatctgaaacatggagcgatgattcttggtatatagatcaggaaaatcgagaatttattaaaaatgaaggatacgtttcaattcaggaaggagaagctacgggagatattatcggtggcaatatgagcacatttaacttactgcaaggcacaccatatatgccaaatttaaaggacaaaattttatttattgaagaagatagtttaactggaacatctactcttaaaacttttgatcgttatttacattcccttatgcagcagcaagattttgaatacataaagggaatcattataggaaagatgcaaaaaggtgcagaatgtacgatagaagacattcaagaaatgattgcttcaaaacctgaacttgcacatattcctatcattgcaaacgcaagtttcgggcatacaaccccgattttcactttcccaattggtggacgtgcaaaaattatttctaacaaggaaaaaacatctatcactattttaacgcactaaaaaggagcgaatgagtcgctccttttatggtttttctattttttccaacgctttttgtggaatagattctttcgggatttcagcccatccttttccttgcataccttttgcataaatttttataaacgcccccgtatgcaattcacggttcatcattcttttaatgatctgtaactttccgtcttctgtataccctttaaaagtatacaagtattctccgtcttttttctcacctttatctataaccgcataataatcttgtatttctttatttgaaaagaagttgtctacaaaagcatgtacaccttctgtttttgtgttcaaataatacgctgttccacctagaataatggcgaatatagctaaaactttaattaccaatttcatacatgaacctcctgtttgcacttctttctcactagtattatatctatacttgtattatacggaaaagagcatactatactctatctaaaagtcttacactttccttacattattgtaagggattttttcttacagcaagttcccaagaaaaaatttttccgtttcatacacttttatattattattgaatgatacgaatttttattacaaaaatcaaaggagacagttttcaaatggctatcttgcaaggtttagcactattacttgttgtactttgtctatttacactttttagttaccgtgcgccttatggaatgaaggcgatgggtgctttagctaatgcagcaatcgcaagttttcttattgaagcatttcaccgttatataggtggagaaatgtttcataatgactttttacaatcagtaggagaagcttccggtagtatgagcggtgtcgcagcagcgattttagtcgcattagcaatcggtgtttcccccgtatacgctgttttaattggtattgctactagtggattcggtattttaccaggatttttcgctggatacgtttgtgctttcgtcgtgaaatttctcgaaaagaaattaccagctggcgtggaatttttagcaatcctatttatcgctgcaccaatctcacgcggaatggcaatgcttatggatccgcttgttaacgcaacactcggtaaaatcggttctatgatttcagttgcaactacagaaagtcctatcattatgggtattatgcttggtggattaataacagttatttctacctctccactaagttctatggcactaactgcaatgcttggattaacaggtttaccaatggcgattggtagtcttgccgttgccgcctcagccccgatgaactttattttctttaaacgattaaaaatttgttcaaagaaagatacaattgctgtagcaatcgagcctttaacacaagccgatattgtctcagcaaatccaattcctatctatatgacaaatttcgttggcggtgcacttgccggtattattacatcgctattccaacttgttaataatgcaccaggaacagcatcaccaatcccaggacttcttgtcctattcggatttaatgacgttgtaaaagtaacaattgctgctatattatgtggaatcgttaccactattgtcggatacatcggatctattgtgttccgtaaatatccaatccgctctgctgatgaaattcgcggagttacttcggaagagaaggttgcataagaaaaagagctattcccatcgtttgagaatagcttttttttgtgttgcgtaacggtaaatgaaattatatcggcggtttttttaatatatcagcgcaactcgaattatatcggcgatttttttaatatatcggcgcaactcgaattatatcagcgatttttttaatatatcgacttaccgacacataacgacaaaataagagccctctaatcatatagagggctcttactttatctagctgcagcggctagaatgatcggtggcttcgcttcttccttcgaggcaaaaagcgcctctacgtctgaaactccatccccctcacattctgagcgagccgcttccgcttttatttcacccaaccgagcagcatttcccgcacgaatttgcttgctgcgactggtgtttgatcactatggtcgtagactggagctacttctactaagtctgctccaactacatttatatttgaatttgcaattgctacgatggaatctaataattctttagatgtgataccgccagcttctaatgttcctgttcctggagcgtgagctgggtctaatacatcaatgtcgattgtgacatagactgggcggccagcaagtttcggtaatacttcttttaacggttctaatacgtcaaatttgtataagttcatacctacttctttcgcccattcaaattcttccttcattccagaacgaattccgaaagaatatacgttttccggaccaattaaatcacacactttacgaattggtgtagagtgggataaaggctccccttcatacgattcacgtaaatcagtatgagcatccatgtggatgattgctaaatccggatattttttttgccattgccttaaaaattgggcaagacactaggtgctcaccgccgagacctagtggaaacttatcggcatctaaaagttttgatacatactcttcaatcatgtctaagctgcgttgtgcatttccgaatggtaatgggatatcacccgcatcaaaatattttacctcttctagttcacgatctaaatacgggctatattcttcaagaccgattgatacttcacgaatacgtgcagggccaaaacgagatcccggacggtaacttactgtccaatccataggcatcccataaataactacctttgactcttcaaaacttggatgacttttaataaatactttacctgaataagcttcatcaaaacgcatattcttttcctccttatgtggaacttaaggtatcccaacctttcactatttctcaaatttggagcgaattgctcctctttctcgatttaccgggtcttctttttaacaacaagaagacgattttctctacagaagtgtaagtagctagcatgttcaagtcttctggacaaacaccttaaatgagctacttacactttatttgtttgatacaattctcttacttaattaaatccccaacaaatttcggtaatgcgaatgctgcattgtgtaattcttttgtgtagtatttcgtttcgatttcgtggaaacgctcttcacttacttctaatggatcatgttttttagatccaattgtgaacgtccaaagaccacttgggtaagttggaatgtttgctgtgtacaaacgagtaattgggaagatctcttttacgtctttaaacacagttgtaattagttctggtgtaaaccaagggttgtccgtttgtgcaacgaaaataccatcttcttttaacgcttttgaaattccagcgtagaagccttttgtaaataggtttactgctggtcctactggctcagtagaatctaccataattacatcgtattcattttcgctttctgcgatatgtaggaaaccgtctcctacttttacttctacacgctcattatctaatgcgcctgcaattgatggtaagtattgtttagagtactcaattacttttccatcgatttcaacaagagttgctttctttacacttgggtgttttaacacttcacgaataacaccaccatcaccgccaccaacaactaatacgttttcagggtttggatgtgtaaataaaggtacgtgtgctaccatttcgtgataaacgaactcatctttttctgttgtcataaccatgccatctaaaataagcatgtttccgaactcttccgtttcgaccatatcaagtttttggaattctgtttgctccgtatgtaatgtgcggttaatacgcgccgtaatcccaaaatgttttgtttgtttttcagtgaaccatagttccatcgtacaatcacgcctttcaatgcaaatttcccatagggacatcattaatgccccctaacaaaaataaaacaaaacgaccaaaatg

SEQ ID NO: 1280 - DNA, 8613 bp, Bacillus thuringiensis
ttcatttactttcttattttcactttaacaaaacactttggagggatgtggttatgaaaatcggaattatcggagcaactggtaaagcaggaagtcgtattttaaaagaagcattgaatcgcggacatgaagtaactgcaatcgtaagaaacgctgcaaaaattacagaagaaaacgtaaaagttttagagaaagatgtattctctcttacatctaacgacctgcaggcatttgacgtagttgtaaatgcattcggtgctccagcaggcgaagaacaccttcacgtagatgcaggaaacgtacttattgaagctatgaaaggtgcaccaaatacaaaattacttgtagttggaggcgctggaagcttatttgtagacaaagagaaaacaacacgtgtatttgagacaccaggtttcccgaaagaatatcttgcaacagctcaaaaccaaggtaaaaacttagaaattttacaacaaacaaatgatatcacttggacattcatcagcccttctgcactattcgcattaggaaaacgcactggttcttacaaagctggcaaagacaatcttcttgttaactcaaaaggtgatagctacgtaagttacgaagacttcgcagttgcagcacttgatgagattgaaaacccaaaacatgtaaacgaacgcttcacagtagtttctgaagctgaataataaaaaaagctcgtaaaacataatgttttacgagctttttcttattattgcacttgctctaaaccatttggagtaatcttaaaggaaatttctttaaactttttcttatctccttttccaactaactcactctttttataccaacttaaacgatctgactcggcatgatacactttcaatacgtcaccatactcgaacgccataccatttacttgttctgcaaaattctgcgaagtttcttgtccttctgcggttacatgctttttctcagttccattttgatcataaatcgtaaggcctatatactgttcatttacaaagcgataatgaatctcatcatttgtaaatgttgcatgtaatttcttttcagcgtggtttaacgtaataattgaacgtgtaacatcggacacaccttgatagactagactatccccatatgtcacctctacaggaacttccgtcactttcttatttccaaatcgatctttcgtttctacttttactgtttgctgaccaatttttgtcgtatctattttccctacaaaacctactacttctccaccctgtacttaaacaaagttcttcgcgtctagcgtttcgctatttgttccgattactacttgctgcggatttgcttttactgtttgctcaccgtctaatctttcaaatccattttcagttattttgaagactaattcctttatctctttactttttccttcgcccacatatacatctttttgataccaatgtaaacgagaagattccgcatgatatactttcactacatctccatactcaaatgcaattccatttacctccttagcaaattcttgcgtattctctaaaccttttactgctatatttttcttcactcttccttctttatcgtacaatgtgaattcaaaatacttttcatctttaaagtaatcatgaattaggttctttgtatctgtcgcactcagttttttcgtatcatgatgtaaagttacaattgattttaagtcaccatctctatagctcagcccatatacaagtaggctatctccatatgttactgttagaggaacttctgtcactttcttatttccaaatcgatctttcgtttctacttttactttttgttctccgatttttgatgtatttggtttttctgcaaaaccaaccacttctccatcttttacttgtacaaattctttcggatctagtttgtctacatccattccgactactactttttgcggtttcgccgtcacttcttgtaaactctcttttaattcgaacccttgctcagtgatttggaataatttctcttttttatttttagccttcccttgatctacaagtgtattattttggtacaacttcagacgatccggttctgcatggaatacttttactacatcaccatattcaaaatccaattcatttagttccatcgcaaatctttttcccgtttcttgtccttctgcagatacacgtttcttttcaatcccatttcgatcatatagcgttaagcccatatattcttctttttcaaaacggtaatgtatttcattattagtaaagtttacatttaatttcttcttattgtggtgaagtgtcactgtcgacattacatcatctgaaagtccttgaaaaactatactgtcatcataaaatccgttaacttggacaggaattgaatttttatttcctttctcatccccaatttctactaacacttcctgtttaccattctctagtttaggccatacaatctttcctgttacttttacattctcacctaaatttcgaacaagtttacttgcttcattctcgtcagaatctgtaccaactaaaagattttgtacttcattagcaggttcaccatatggaaccttatacggttcaacttgcttctcacgaatatcattactatctgtagctttccagatttccttttctaatttaggtaactttgatttttctattttctctctaatatcatcatttggtgttaatccccattcctcaaagaaaggaattaaattttgccctgccacttgcgatgtcatataaataaatagctgctttttctcttcatcagaatgaggcatttcactctgaggtaacaaacgataagcttgatgtaacctaggataaaaatgttctccatacactacatttaattgccaaaacattgtaagaggattaatgtcatcaatgaatctttctgctttaggcttctctaaatactcaaatgagtttttatagtgctcatccatttctaattgattccctaacgccttttgaacagctaatgagtaaatatttactgttacttcccttactttagaccacttccacggttcttgctgatgtaaatgaccaacttcatgccacggtccccatccatccttctcaagtacctctatatctaaaactctattcattgcagttggaatatatcctgtatgataatgttttgcaaacataaagtcccctttagcaggcttccgtttttcaacaaactgaacataatgagttggagattttgcaaacccaacactgtcctcagataatcctgccactgcgttttctaaacggataatcttatcatgcaatttcattaaatctgttggatccgtattcttcatatatttctgcacagaatcgtaagtagtagtaattaagcttctctcaccttttaattcaactgcataaggatccttatatttttttaacatttcatcccaatctttttttgtatgcttacctaaaataaataaaggaaagtgactaccaccatttgtaacggaagctgttacttctccttcgttattcatattataaaaatataaaataccgcctcttgaagatgaaataacatttttccctggttttaaattaaactcctctgggtccttttcatcataagatctcgttccaataaaagcttggatagactgcgttccttttatgtcaattgtaatctcttcatttggctctgcataaattccagtcggttcattagcggaaagtttccaagtaactcttaaacgattattttcttctacgctacctttccccggcaactgaaatactctctgctcaaacttattctcttttacctcttctaatttcccacctttattttcttccaaaggtgctgcatatcctttcgatgcttcgaaagctactggcgataataatgtagatatacatattccagctactaataccctactcgtctttttcttcgacataatctgtgtcccctgttcctttatttagataaactaccctatatattcatctaataagtaatcctattattcctataaaaacatttgatgaatggactaacacctcgcgcacctgtatatattactaccgcatttctctccatgcattcgctttcttacattgtaaaatttatatgtaatatgccctcctcacttctctctatttgtgatgagttctcttgctacataaaaaagagaatagtaaaagatatttttcagtattgtcatctatacatctaaaaataacaataaaaacttacattttcttcatatatgaccatctataggtagtttttccaaatgaattttacacgctttacactttgtttgatagcctctctaattagaataatgttacaatttcgtgaataaaatctatttattgcaacgtttagattttgtcacattttattatttttaaatactttttaaaacgttaaaatagtgtttcactcgattaattattatcttgatatacctttaaagaattcatataaaaaagcattggcatacgccaatgctttttcattatctcttttgattcggtttatgcggttcatttggagtatatggcttatttggtttatttggagcctcagcctttttccaacttaccgctaactctggacttgttttttcttcactacgctcaagtaatactactgcattttgaatagtcgatgtacctttatgcgcaatcccttgtaatttcgttaaatttcctgatactttaaagctaaatccaccagctggtgtttgttttggaattaaaatgcggaacttttctcctacattaaattctgtttttgtttcgcctttttcatttgcaaatttcacgcccgctggtgcacctgttgcttgtactttatacgttccgctttttgcatttgtttctactgtatataaacctgtttcaaagaaatcattttttaatactgcttcttgttcttctgtaggagttacactcatcgtaatttcttgtaactcttcactagcgcttgcttttgcaacgatgtctttcgttactttctctacatttttattgcggaaatctaaatcattaatatcgatttgttttaacgcattccacactgcaagctgcgttgcgtaatgtgcttctctccaatcagaaacacctaattcttgtggactcttttgtggatatccattcaatagtacacggtatacgttaatatccactttccccatttccggtaaatcttgaccgcttggagatttcaaatctacatttaagcaaaaagcaattttgccatctgcggttttaataagctctgttcgaattggtttcttctttgacttactataactccaattcatttcatactttgtatggtccataacttctgcaaatgctttttgaagcgggaataacacaaataaaacacttaaaaacatagctaaaatcttgaacgattgctttatattcatgtttacagccccttatcacaaacttaatactaagtagtatttatttagaaactatttttatgcacaaaaaaagagtgcttttacgcactcttctttcttactttaatcttagaaatcgaagttatcaggatctggaccaacgcggtgattttgatttaacgcatcgattttttccatatcttctttcgttaattcgaaattaaatatatcggcatttgcaataatgcggtgttctttcgttgattttggaatagtgattactccattttgaagatcccaacgtaaaataacttgcgctgttgttttaccgtgtttctcagcaatttcttgtaatttttcgttatctaataattgaccttgcataagtggtgaccatgcttccatttgaataccttgttctttacagaaagcttgtaattctttttgtgttaaacgagggtggtattctacttggttaatcattggtttaatttctgcatctttcattacatcttgtaagtgatgaatttggaaattacttaccccaattgcacgtacgcgtttttcgttataaagtgtttctaacgctctccacgtatctttatatttcccttctacaggccaatgaacaaggtataaatctaaataatccagctctaatttttttaagctttcttcatatgcagcaagtgtcgtttcatatccttgatccgaattccacacttttgaagtaatgaataaatcttcacgagaaatgcctgcttcttttatacccgcgcgaattccttcacctacagctttttcatttccgtaaattgcagctgtatcaatgctgcggtatcctgctttaatcgccgatttcactgcttctacaagttctggtccatcctctactttaaatacacctaaaccgaaccaaggcatttctacaccattatttaatactgttttactttgtaagtttttcattttattttctctccttttattttacttgatctcttttttctaatgtcatactccacgcagttaaaacaacagcacctactaccataattccacctacccaagccgtatgaattaatcctaacgagttcgttacaataccgcccaagtaagcaccaagagcaattcctgcgttaaatgctgcaatgttaatcgccgatgctacatcaacagcgctaggtacaaacctctcagctaatataacaacatacacttgtagccctggaacattcataaatgcgaatagtcccatgaaaataattgtgatgaatccagcgactttaaatggcgctgtaaatgttaaaacaaataatataatcgcttgaataaagaacatgtaaaataacgctcgaatcggattatgatttgataattttcccccgaccatattcccaatcgcaattgcaattccgtatactaacaaaataattgtaacggtacttgctttaaatcctgttacttcttgtaataacggagataaatacgtaaatgttacgaacgttcccccgtatcctaatgcagtaataataaatacaagtaacagtcttccattcgtaatcagcttaaattgatcgcgaaatgatacagacgtacttttttttaaattagaaggaattagcatactattggcgattaaagcaacgattccaatggccacaataacaataaacgaggccctccagccaaattgttgaccgataaatgttccaattggtacacctgtaatagtcgcaacagttaaaccagtaaacataaatgctattgcacttgcacgtttattctcaggtacaagcgcagccgcaattgtagatccaattgacataaaaataccatgcgcaaatgcagatacaaccctcgcaataagtaacacagtaaaacttgttgctaccgccgcaattccattaccaataatgaaaataatcataatccacattaataacgtctttcgcgacatactagctgttaatgacgttaatactggagcaccaaacgctactcctaatgcatataaagaaacagttaaccccgctgttgtaacagaaacatgtaaatcctctgagatagatggtaataagccgacactaataaattcagttgtaccaattccaaacgcactaattgctagtgctaataaagcaaacatacttctccgattcgtctgcataaccgaagaagatactgtatatgaattcaattgaactcctccttaatgcgagaaatccaatcataatagtatgataaaaaggcctttttatcttctacaaaaataactttactgttgatatacgctattatgaatggctttactctttttttgaagaacgcacttaaaagtacgataggtacctaaaagtaacataggcactttttagtaccgtactactcatttccctcttacgtatgctattatggaacatattcaacatgataaaaagtacgtactttaaagtgctataggcactttttagtaacatttaattatttagcttcttttgttggagaacttaaatctacattcatcaaaggagatttttatatgaagaaatataatattcccgttgaagcgactttagaggttatcggtggaaaatggaaggttgttatcctttgtcatctaacgaaaggcacaaaaagaacgagtgaactaaaacgtttaatgcctgggattacacaaaaaatgttaactcagcaattacgtgaattagaagacgatggggttattcaaagaaaggtatacaatcaagtaccaccaaaagtagaatattcacttacagaatacggttggtctttagagtccattcttgattctctttgtacttggggcgaatgccatcttgaaaaaagcggtaacacatcgatgctaattgtagaaggtgaataataggaaaaaggaaaaaacgaacatgaatttgttcattttttcctttttttctttatatgtatatacatttctaactggaacaaaatattttatacgctttcataccttgtcagcactacgttatacactcaatatcaaataattaggaatcatttttatgttaacataggtgtatatagtatataatataggatatatattatatacactttccggtaacggagcttttccattatgcggacaagccatgtatcggacagttcataaataataagtaagacgttatggttttagatttatgtttgaagaatacttgctg

SEQ ID NO: 1281 - DNA, 8661 bp, Bacillus thuringiensis
tttgcagttattatgatcatggggattttcttaggcgatattgggatgagaattccaattttaaaaaatatcggtggtccagcaatactttcgttatttattccatcattacttgtattttttaactggatgaatccagcttcaatggaagctgcgactatgttaatgaaaaaatcgaactttttatatttatatatttcttgtttagtagtcggaagtattttaggaatgaaccgtaaagtgttagtacaaggtttcgttcgtatgtttattcctttagtagtagggacgttagcttctgtagcagtaggattatgggtcggttcattatttggatttgaaatgaagcacacattcttctttatcatcataccaattgtgagtggtggtatcggggaagggattttaccattgtcgctagcttatagtgatattttaaatgaatcatcagcaacgtttgtatcacagcttattccagcagctattattggaaatatgttcgcaattgtaagtgcagggtatatgaagcgtttaggtgagaagaaaccggagcttagtggtaacggtgtattagtgaaaacagacaatcaagcagaattattaaaagaacaaaatacagagaagccaattgacttctcattaatgggagcaggtttattaattgcgtgtacgttcttcatcttcggaggatttgcttctaagttcatcggtattcctggggcaatcattatgattttctcagcagcgcttgtgaaatactttaaattaatgccagcaaaaatggagcaaggagcattccatttatataaatttatttcgaagaatttaacttggcctttaatggttggattaggattgctatatattccgttaaaagacgtagcagcagttctttcagtaggatatgttgttgtgtgcgcatcggttgttcttacaatggtagcatcaggttttcttgtagggaaagtgatgaaaatgtatccagttgaatcagcgattgtaactggatgtcatagcggtttaggtggaactggagatgttgctattttatcagcttcaaatcgtatggaattaatgccgttcgcgcaaatttcgactcgtttaggcggagcggcaatggttgtaacagcgacaatattattaaagatgttttcatgatcaaacaagctagctatattcatatagctagcttgtcaaattaaggggagattataagtatgttagcaaatcaaattaatgaaagatcattgttattgcataaagaattagtaggaaaaattgaaattacaagtaaagtagaagtaaattcagcggatgatttaagcctgacgtatacaccaggtgtagcggagtcttgtaaagcaattgcggcagatgaagaaacggtgtatgactatacagcacgtggtaatatggtggcagttgtctcagatggaacagcggtactcggtttaggaaacattggaccgaaagcggctatgcctgttatggaagggaaaagtattttgtttaagaagtttgcgaatgtagatgctttcccattatgtttaggcacaacggatgtagatgaaatcgttacccttgtgaaaaatttagagcctacatttgcagggattaatttagaagatattgcagcaccgcgttgttttgaaattgaaaaacgattaaaagaagaaacgaatattcctgtattccatgatgatcaacatggaacagctattgtcgttttagcagctgttattaatgcattaaaagttgttagcaaacaaatggataatgtgaaaatcgttattaacggtgcgggttcggcaggaattgcaattggaaaattattattaaaggctggtgcaaagcacattacgctagttagcctagaaggtattgtttgtgaaggtgaaacatggatgaacgaagcgcaaattgaagtttcaaaaaagacaaatcgtgaacatgtgcgtggaacgttaaaagaagcgattaaccaagctgatatttttattggcgtatctgctcctaacgtattaacgaaagaacttgtacagacgatgaatgagaaagcaattgtgtttgcaatggcgaatccaattccagaaatcttccctgaggatgcattagaggctggggcagctgtagtaggaactgggcgctcggattatgcgaatcaagtaaataatgtattggcgtttcccggaatattccgcggtgcgttagatgtgcgcgcaactgatattacagaagagatgaaattagcggcagcatatgggatcgctaacatcattactgatgaagaacgtaatgcgaattatgtaatcccgaatccattagataaaagagttgttccaagtgttgcggaagcagtagcgaaagcagctattgattcaggcgtggcacaaattacgaaaataccacgttattaatagctaaaagcagtgcctaaaaggcactgcttttttgagataagaaatcaaaataatgaagaagtgtagaattatttatgtttcttcactatttatttaattccattgcaacttgtttaccattcactaaaacctcagttactgctacgattacttctatcatttttttcatctctcatctctcctcgcttcatttcttactttaagtataagagaagagagataattcaactatcgaagtacatgacgtagaaattacattgttgtaagaaagtggtttatttttgtcactttacttagcggtgattacaaactgatcataatatttttcattcacatagatatttaataaccataatccagatgaaggtagtgacatagcgagagggagttcgcttgtagtagaattgattgtatttgaagtagtccaagtttgtttggaaatttctttttgaaagagtactggtgttggagttacagatccttgttttagcgcaataatagacaattttccagtaggtatttcagaatctagaaagtaccacattatttcattttgttcatttgcgataataggactatcagccattgcgatttttccttcgatgccttttaaaggtatttttccgtctatgaatgagggggcttcttcccaatttacatcttttaaaacactaaggtgaaagaaggaaggtgcgttcacttgagtggatgaagttgctattacgtcttttttttgttcttttgaatccggttgagtttgtgtgcatccagtgatgaggagggagagaagtagcatagttccgatttttttcatggtgccacactcctagtttttattgttagtgtaattgtatttgctagaaggcgggacaattcctttaaagtataaaaagaggtcgtaagttttgtacgacctcttttgacattttttatcccgtaaagcccgattggtgtaggttaataatcagtgggagatagccccactaattaaagtttcattttatatttgttccgttgtataggttggttcggtttctttttgaggcatcgtcaaaaaaataacggacagaacgatacatacgccgcctaataattggtatgctccaaaagcttcatttagccaagtgattgaaacgatggcagctacaaggggttcaatgctagataaaatgcttgtttctgttgctgctaaatatttaagactaccgatatatagaaggaaagaaagggtaccactaacaatgataagaataagcatagaaaaagttttcagtgtaagggtttgtgaaaattgattccacccgaatgaacgattataaataagtagtgcaattcctccgattaacattccccaaccaattactacagttgtcccgcattctttaatgagagaagccggatgaagggtataaaatgcaaatccgattgctgttaatagtccaaaaataatagcttctttagataaaacaatattttcaattgagccatttgtaataataaagtatgttcctattagcgcggctataattgcgaatagttgcatggaagcagggaattttctttgttcaaatgcaacatacacggtaataagaacaggacctagaaattgaaatagcgttgcagtgaccgcgttactaatatgaaccgtttcgataaaggcgtattgtgcaccgagcatgccgagaatagaaaaaataataagttgtatagaatatctaaggtgtttccaaatttgaaatatgttttgtttctttataagtaagaaagacaaaataaatattcctgcaagcaacaatcgaattgttaaaaaatcaattgaggatacattagtatgctgaaatagccactgaatcattggaccagataatccccataatgtagcccctgtaataatcataataagtccgatacgtctaccgttgttcattatcatgtttctcctctccagtatttgatttttgatgtgtgacatgataaaaggaattatatatataatctggtactgtaaaaagtatcagattttagttttattaaggggtcagatactatgttagaattaacgcctaatttaaatatgaatagtaaaaaggcattatatgtgcaattgtatgagtatataaaaaaagagattaaagatggatcaattgtcccttttacgaaattaccggctaagcgaaagttagcgatacatttacaagtaagtaaaaatacagtagaggcagcgtacgaacaattacttgcagaaggttatattgagtcgatatcgagaaaaggttattttgtatgcaagattgagcaaatggttcatgtagaggatagcgaagagaggatagaagaagtcccgtttcaggagaagcgttataaatttgactttacacaaacaggaattgatacaaatgcttttccatttaatatgtatcggaaaattgtaaatgaagtatggcagccgcataataacgaacttctctttctaggacaccctcaaggggaagcaagcttaagagaagagattacgaattatttgtatgaatctagaggtgtgcgttgttcagctagtcaaattgtattaggagcgggaacacaaatattagtgaaactattgtttcaattgttaaagggaagcaattatgcagttgaaaacccagggtatcatagaaagatggttgtttttgaacagggagaagcaagagtccaaatgttatctttagatagagatggaatttgtattgcagatttagaaaatagcaatgcgaatgttgtatttgttacaccttcccatcagtttccatatggaatgattatgcctattacgagaaggatgcagcttttacaatgggcaaagaaagaagagagcaggtatattattgaagatgattatgatagtgaatttcgctattctggaaagcctataccggcgctgcaagggttagatacagaggggaaagttatttatatggggacgctatctaaagcattattgccatcgctacggatgagttatatggtgttgccgaagaaattaattaaaaagtatcaacagcaatatttattttacacacaaagtgtttcaagaatggaccaagaagtgattagaagatttttaaatgaaggctattgggaaaaacatattcataaaatgcgtgtcgtctaccgaaagaagagagatcgacttgtttttgaaatagagaagtatttctctaatcgtgttaaagtgataggagaagattcgggattacacattttattaaaagtgcataatggaatgcgggaagaagaattaattcaagaagctgcgaaatatagtatcaaaatatatcctgtgtctacgtactataaagacggtacggcgcctgagagtgtagttttacttgggtttgcgatattatcagaggaagagattgcgaaagcgattcaattattacacacggcatggtttacaagaaagtaaaaaacatcctccaaacatgaggatgttttttattatttattttcatctaagaataagaccatatgctcttcgtcccaatattgtccgttatattttaatgaacgttcttgtacaccgaatgttttaaaacctaatgattcataaagttttttcgctccatcgttgccaacaacaacatcaagcataacttgttctacttctaaagatttagcaagttcaagacattctttaataagtgcttttcctgctccaagtccgcgtgcttttggagatacatatacagaaccgattttagctttatgttcttgttttacatatggtttcgtttccagcgttgcaaccccgattaattttccatctttaaatgcacctagcgtatagttttcatcttgtgctaatttttgtgctttatattcaatcgcacactctttattaataatatcttcataagaagagctgaatgcttcagggttttgctttaatccttctacgcgaagttctaagtaaatttctgcttcgtcttttgttaatacatggatatccaattatatcaccctccaaatctttgcaaatgtacctttattttatattgaaataagaataatttcaaaagcttagcttatatgagctgtttttatgaacaaaataacaccagtagtgtttactactactggtgttttcacacgcatattattcaaaaggtagctcgattataaagtttgttcccgcttctaattggcttgttactagaatagaaccgttatgcaattctacaatttcctttgcaacagctagcccgatgccttttccgcctgtagctcgtgttctggatttatcaacacgataaaaacggtcaaaaatatgcgggatatcttcttcaggaataccttcaccttcatcttgtacacttattgtaaaagaatatgtttccatgagtacacgtatcgtaatggatgtgttttctggcgaatgttgataagcgttgtgtaataaatttaacataacttgttccatacgtctttcgtctatacaaacttctaaatcatctttgcaatatacatgaagttgcatttgcttattcgttaatgttgtttttgttttttcaaccattcgttctaaaaatggctgaagaagcactttttgtttttttataacaaattggtgttgttctaattgtacaagcataaataaatcttggacgagatcggttacactatccgtttcatcctcaatgatttgtaagtattcttctcgctcctcttttgttaaagagtctctctttgctacctttgcataacctttcatataggtcaatggagttaatagttcatgagcgacactagcgagaaattcattgcgctcttttttcatatacgtaagctcactcgataaatcttcaattgtttttgctaaacttccgagttcatcatttcgtttaatacctaattgaattggcttgtttaattttgacattttttctgtcgctctcttcatttttataagaggatctgtaataaatttagaaaaaacaaagacagaaatagttgttaaaataatcgtcaaaatactaatgataagaaattgatgcaggagtttaagtaacatcttttctaagaaagatgtttttaataacatatgtaaattaccttgaaatccttgaatttcaagtggacttactgttgagatgaattttgattttttccagtttctttctacaattaacccgctttttggaatagattttgttttacaaataagttgtttttgcatttctttcgttatgggttctgagttagaaataattttgccgttattgtcagttataatgattgtgatatcagtattagcaattaattcggaaccgattaaatcttcagccgcatgctcgatagtgaaatcctgataccgagggtgtttaggacgttctgtgtattgctgttgtttagaatgatcattccatcttgcacggtttacaatcttatcacgataccgattacctttctctaatagagcatcggtttcttctttcacacgcattgttgaaaggcttttataaaaagatacgaaagcaattgtttcaatacataaagctaatattaaaaagtatgtcccaattttaagggaaagtttactcattttctcaccataccttattcataataaagagtcagtggtatacgatttcccactgaccgaagtaattattcacttttccatttatatccgactttatagaccgtttctaggtaatcttcaatcggaaatccttttttgcgtagtttatcacggatattacgaatgtgtgaatcaattgttctatattcgatatctgtttcatagccccaaattttttcgattaaatcatctcggctataagcacggtttgtattttgcaaaaatagtccgagtaacgaaaattcgataggagttagcgagattttttcatcgtacactgtgacggtatgtttcgttttatcccactcaataccattgaaactaacaaagccatctttttttgtacggcgtaatatagcctcgattcgtgcgactaatacatgctcatcaaatggttctgtaatataattcatcaggcgcccatcgtgaggccctttcaccatattgtaatttttggtttgcgtagctgttaacataattgatatggaacggttagaaaatttggacgaatattgataggcatgtcttcccatccattccatatttcggcattaataacattctaaatagaattaatattcgaatttcctttttgtttcgaattcatttttagtggct

SEQ ID NO: 1282 - DNA, 8087 bp, Bacillus thuringiensis
ttcgtgattcaagatcgtcgtcatctccgtcttcttcttcaagaaccttgtccaaatcttctacatcgtcttcatcttcacttacgtctgcatcgtcgaagtcatcttcgtcttcttcaatgtagtcgtcaaaaccgtcttcttcaactttacgtttcttcttcggttttggttgaggcaagatttcttcatcaatttgctcatatgggtaccagctgcgtagtccccaacgattttctcctaaattaatgaaacgtccatcgatgtttaagtctgtataaaattgtgcgattttcgcattaacttgctcttgagatagtcccagcacttgagcgatttcttgaaccaactcgttgaatgtcgttgcttgttttttatcccctaaaacgctatgtacaacttcaatcattgaacattcttttagctcttctggtgaatattgcttaaaatccacttatgcggcacttcctttcatcaaatataaccttatatataacggcctgcttaaaaaaatccatactattcattataaacaaaagtcgcacaaatatgctacaaaaaaaacgggaaacttttatagggtagtaaaattataatttgtctgttccttatttcggaagcatatgggccccttgcaatacatacctaatttgcatttctgtatattcttcgagcgtatacagtttttgcagcgcccagcgtctaaatccccacatctgtccttgtataaaaatattatgcgcaagaagctgtatttcttttttatttaatgtaaatgttccattttccgtacactgttctaaaatattctcgaacattcctaccatttgaaactccttttctaatacatacggaagtgattctttcggtaaaaagcgtacctcttgatacattatcaatacttcttcctgtaattcgtccatcactttaaagtaattcgttattgctatctttaaactttctatactccctttttctgtacacactacttcctctaatctttcttttacatgttcatatatactatcacaaactaaatataaaacatcatctttggtacgaatgtactcataaagtgtccctatactaaacccagccgcttttgcaatctctctcgttgttgtacgcggaaatcctttttgtttaaacagttgcaccgcacctttaatcatttgttcacgtcttaacgcaactaatttttcatctttcaccgatgcatgcacattatgtttaaccattcccttcacctctctctattattttttggaaggaaaaagcgtaggaaaatacctacgctttcgttcctacttcgttaacatacgagaaattacaagcctctgaatctcttgtgttccttcatatatttgtgtaatctttgcatctcgcatataacgctctactggataatctttcgtataaccgtaaccaccaaatacttgcaccgcttcagtcgtcaccttcatcgctgcatcgcctgcaaatacttttgacatcgctgattcttttccatacggaagcccttctgattcaagccaagccgcttgatatgttaaaaggcgtgctgcttctacatctgttgccatatccgcaagtttaaagccaatcccttgctgcgccgcaattggttttccaaactgatggcgctcccttgcatattctacagaagcatctaaagccccttgtgcaatcccaacagcttgcgccgcaataccgttacgacctccatctaatgtttgcatcgcaactttaaacccttgcccctctcctccaagtagattctctacaggaatacggcaatcttcaaacataatttcagtcgttggtgaagagcgaatccctagcttgctctccttcttcccaactgaaaatcccggtgtatcactttctacaataaatgcactcgtaccgcgctgcttcgattcaggatcagttagcgcaaaaacaacataaatatcagcaataccgccatttgtaatgaaaatttttgatccatttaaaatataatgatcgccatctctctttgcgattgtcttcattccaccagcatccgatccagatcctggttccgttaagccgtatgcaccaattttcttcccttcagccatcggccgtaaaaacttttgcttttgctcttccgtcccaaatttaaaaattggccatcccgcaagtgaagtatgcgcagacagtgttacacctgttgaagcacaaacgcgagataattcttcaatagcgattacgtatgctaagtaatcgcttccaattccaccgtactcttcaggccatggaataccagttaaaccaagctctgccatttgatcaaataactctcgatcaaatcgctcttcttcatcacgctcagctgctgttggtgccacttcatttttagcaaaatctcgaaccatttttcttatcatttcatgttcttctgatagtttaaaatgcatctccgtctccccctcgcccttttataaagcacggctaataacaagtttctgtatttcacttgttccttcatatatttgcgtaattttcgcatcacggaaaaatcgttctactggatagtctttcgtataaccgtaaccaccaaatacttgcaccgcctcaatcgcgacttcaaccgctgtcttagaagcaaataatttcgcaatagatgcttctttaccgcatggtaatccttgtgccctaagagatgccgctctatatacgagtaaccttgctgcctcgacacttgttgccatatctgcaagcttgaagccaatcccttgctgcgccgcaattggcttcccgaattgctctctttcttttgcataatcaattgcacagccaagcgccgcttcagcaattcctaaagcctgcgcaccgattccaattcgcccaacatctaaattcgccatcgccactttgaatccttgtccttcttccccaagtaaattctcagctggcactttcatatcttcaaaagtaagttgtactgtacgagaaccgagaagtcccatcttatgttcatcttttccaatgattaaaccaggtgtatctttctctactataaatgcagaaataccactttttcctgcctctggatttgtagaagcgaatacaatgtatgtacttgcttcaccaccatttgtaataaacactttcgatccattaataatataatgatcaccttttttcacagctcttgatttcaaactccctgcatctgatcctgcatttggctctgttaaagcaaatgcacctaaatattccccggttgcaagtttagaaacatattttttcttctgttcttctgttccaaaatataaaatcggattcattccaactgacgtatgtacagctaaaattacaccaactgttgcacttacctttgagatttcctcaattgctagaatgtaagaaataaagtccatttctgccccgccgtattttgcaggcgctggaatacccattaatccaagctcacccatcttttgcaaaatctctttcgggaacaccccttgttccatactaggaacaaagggagctatttccttctgtgcaaaatcccgaaccattttcctcatcatttgctgctcttcattaaaacgaaagttcatatattccgcctccatttgctatatatcctttaaataatttggtaagaccactatgttgtaacaaagggggcatttattcgtaaacgtagaatccacgacctgttttacgccctaaccatcctgcattcacatacttacgtaataatggacatgggcgatatttactatctcctaatccttcatgcaacacttccataatgtataaacacgtatctaaaccgataaaatcagcgagtgtcaaaggccccatcggatggttcataccaagcttcatgacttcatcaattgcttctttcgtcgctacaccttcatataacgtataaattgcttcgttaatcatcggtagtaaaatgcggtttgatacaaaacctgggaaatcattcacttcaactggtactttcccaatttttttcgtaatatcttcaattgcttcatataccgcatcatcggtagccaaaccacgaataatctcaacaagcttcataactggaactggattcataaagtgcataccgattactttttccggacgcttcgttaccgctgcaatttctgtaattggcagagatgacgtattcgtcgctaaaattgcgtgttctggagcaatttcatctagattcgcaaagattttctttttaatatccattttctcaacagctgcttcaataataagatccgcttctttcacacaatctaaatcaagcgttactgtaagacgatttaatgtcgcttccttctcttcttccttcatgcgtcctttttctacttggcgcgctaagtttttcgtaatgatagccattcctctatctaattgctcttgctttaaatcttgtaccttcacgtcatatcctgccattgcacatacttgtgcaattcctgatcccatttgccctgcaccaattacaacaatgttttgtacacccattttttcttcccccttaattgttaataaattttataccctcgaactttaattagtggacttcaatcatcactgcgtccccttgaccgccaccgctacaaatcgaagcaattccaattccgccgccgcgctgcttaagtgcatggattagtgtaacgataatgcgcgctccgcttgctccaattggatgtcccatcgctaccgcgccgccatttacattcaatttttccggatcaattcctgcgatttctgtacttgcaattgctaccgctgcaaatgcttcattaatctcgaataaatcgatgtcttcaattttcttgcctgttttttcaagcaatgcgttaattgcataacctggcgttcttgggaaatctttagattccactgcaattgctgtatgcgccaaaattgtcgctaatggctttcttccttcttgcttcgctctgtcttcgctcattaatacaagtgcggcaccaccatcatttagtcccggcgcattaccagctgtcaccgtcgctgtcttatcaaatacaggttttaactttgctaacttttcaatcgttgtatcttcacgtggcgcctcatcctttgcaacgacaataggatcgccttttctttgcggaatcgttactggcacgatttcctcttcaaaacgcccttctttatgcgctgaaaccgcacgctgatggctacgatatgcccattcatcttgcgcttcgcgagaaattccatcttctttcgcaacttctccgccataaacgcccatgtgtgtacctgaaaatgcacatgttaaaccgtcagcaacgtttaaatcaacaacttcgttattgcccattctgtatccccatcttgctccgcgtaaaatgtaaggactgttactcatcgactccataccgccagctacaattagtgattgatcgccagtacgaataatctgatccgccaacgtaaccgcacgaagccctgatgcacaaactttattcactgtttccgtctgcacttcccatgggattccagcggcccttgcagcttggcgcgatggaatttgcccctgtccaccttgaataaccgttccaaatataacttcttcaacatcactagccgcaacatttgctctttcaagcgctgctttaattgcaattcctccaagttccgtcgcttttacatcttttaaagatcctccaaattttccaactggtgttcttgcagcacttaaaataactgttttactcatgtttctttcccccatttcattttttaacactgagcgcccgctcggtatccctacgttgagaagaggtgcaatcattgcacctctttctaaagttgtatacattcttacaaactacatcgcttcttttttctgtccgataacagatcgttctaaaatctctgtcacatcaagagtttgaactttctcttctacctctttcgctttcgttccatcactgatcatcgttaagcaatatggacaacctgtaccgataatggatggctgtacagctaatgcttgttctgtacgagcaacgttaatacgtgaacctgttgtttcttccatccacattaagccaccacctgcgccacagcacattcccgtttcacggttacgtgccatttctacaagattcactccaggaatcgctttcaaaatgtcacgtggcgcttcatacacttcgttgtatcttcctaaataacaggaatcatggtacgtaactgtttcttcaatagcgtgaacaggctttaagcgcccttctttcacccactgagctaacaattctgtatgatgatagacttctgcttgcaagccaaagtccggatactcatttttaaatgtgttataagcatgaggatcaatcgtaacgattttcttcactcctgccttttcaaattcttcgatattctttgtcgccatctcttggaatacaaattcatttccaaggcggcgtggtgtatctccagaattcttttctttattaccgagaattgcgaatgaaatgcctgcttcgttcattaacttcgcaaacgatatcgcaatcttctgactacgattgtcgtatgatcccattgaaccaacccagaataaatactcgaattcctccccagcttttgatttttcttttacagttggaactgttacttcgtcatcaccttggcgccatgtttcacgctctttacggttcagcccccacggatttccttgacgctcgatatttgtcatcgcgcgttgtgcttccgcgtccatttttccttcagtcaaaacgagatatcgacgtaagtcaataattttgtcaacatgctcattcataactgggcattgatcttcacagttacggcacgttgtacatgcccagatctcttcttctgtaataacatctccgattaaactcggatcgtaagcgagcgttgtagacgctgattcttgttgcccttttccagctgccatcatcgctaactgatttccttgtgtattattgaaggcaactactggaacccacggtgcttttgatgttaccgcagctcctttatcagttaaatgatcgcgaagttttaaaattaagtccatcggtgataacatttttcctgttcctgttgccggacacatatttgtacaacggccacactctacacaagcgtataagtcaataagttgattttgtctaaagttttcaattttaccaacaccaaatgtttcttgcgtttcatcttcaaaatcaatcttttcaagcttccctgggtttgaaagacgaccgaagaatacattagctggtcctgcaattaaatgcgcatgttttgattgtggaacatacactaaaaacgttaacaaaattagtaaatgcacccaccaagaaaaatagaacactgaaatggctacggtttcatttatcccgctaaaaacgtaagcgattgcagaagcaattggttcactccatgaaagctcctcgccatgccatataagtcccataccgttaccaagtagcacagaaatcattaaaccaccgataaaaataagaacaagacctgatttgaagttacgttttaaacgaacaagcttttctacataacgtctatgaaaagcccaaaatactgcaattaaaataacaagtgtgacaatttcctggaagaatgtaaatgcagggtatagtggtccaagtggaagatgtgatcctggtgcgagtcctttccaaacgaagtcaattgctccaaattggacaagaataaatccgtaaaagaacataacgtgaatgatgccgcttttcttatctttcagcagctttttctgaccgaaaacattgaccttaaggagatcccaacgctctttaaaacgacggtcaaactcaattttttttcctaattgtatgtaggccattctcgtccgtataagatatacaaacaaatatcctgcataagcaataacagcaatggcagccagccaattaataatcagtaagctattcatttttatgctacccctctctttgtaagccctctttctttttgaatcttcaaaaatatataattttctgaattatatcccctatccccattatataatgagtgagcattcagtc

SEQ ID NO: 1283 - DNA, 9242 bp, Bacillus thuringiensis
tcctcaacctttgcagctgcttcaattatctcttgttcattagaatgttcttcttcaacataagaaagttctttctcgaattgtttttgcattctatccattttcgcttctacaataatatcttccacttcttctttaatcgtttcaaaagtagacttcacaccttttgcacctgattcaacaagtggacggagtgtatttcttacaacaggtaataaagcggcacttgctaacgctaaagtagatccaataacaatttttcgtatcattttcattactcctttacactgtttttaataatgctagttcattaactaccaactttttcgagtcatcattcttatatgagattaatttaataataggttttgaaatttgagatactgtaccagctacaaaaagaacaggtacccattgcataaatgttaatggagcggtatggaatatacgagcaaatggcggaacatatatagctgataataatacaagccaagacgttcctaacgccgtcacaaagaaacgatcttttgaccaatcacgcatcgtttcgtccgatccttcttgtctccaagagaatgtttgaataagttgacctgcaactaatgctgcaaatgctgatgtttgcgctaccgcaagaggcacgccagccgctaagctcataccgaataaagcaagtgaccctgctccaagcagtattcctcgcgttacaacttttttgtacaactctttatcaacaatgtcttgacgtttcgtttgcttcgttttgtttccaggatttacagctaaaatcatcgctggtaaagcatctgtaataagattcattaataaaatttgaattggtactaacggaatcggcattcccgcaataactgccgcacttgtcactaatacttcagctaaatttcccgtcaataaacatccaaccgctttacgaatattaccaataatcgttctaccttcttttaccccttccacaatggaaccgaaatgatcttttttcaatataagatcggcagcttctttcgttacttctgttcctgtttgccccatcgcaataccaatgttcgctttctttatagcaggtgtatcatttacaccatccccagtcatcgctacaatttgacagtccgcttggtatgcagctactatacgtaacttatgtgccggtgttacgcgagcaaaaacagaagtattttttacaatttcttttaattgttcatctgttacattgtcgatttctacccctgtcaaaacacgatcatcacgattccaaataccggtctgcttcgcaatagaaattgccgtagtcggatgatccccagtaatcatgacaggttttacaccaagttcaatcgcttcacgaatactctcttccacttcaggttttggcggatcaatcataccaactaacccaacaaaaataaggtcattattctcaacattactatacgcaaaacctaatacacgtaatgcctgttctgcaaaaccttcattttgttgtaaaatgacctctttttctttatcacataacggatagatttcaccgttatgttgataccatttacatctagtaaggatcgcctctacagatcctttcgaaaacttatacaatgattcattttccttacaaacgacactcataattttcgtctcagaatcgaacggttcttcatgatgtcgttcaaatgatgccatatccttatatgaaacacccgctttagaagcaaaacttaataaagccccttcagttgggtcacctttcacaatccactgatcgtcttcatgttctaacttactattattacaaagaacactaatttgcagaacgcgaacaaaatctggatgttctaacggcgttttttcactttcatgataagtcgcttcttctacttccatctctacagcagctgcgactttagacgacgttacatccgatattgtaccaactggttcatatccatcacccgatacactccacatacgatttggtgtggcaatgactttaactgtcatttcattcttcgtaagagtacctgttttatcagaacaaataacagttgttctacctaacgtttctaaactagaaagcttccgaacaagtgcattttgcttttgcatacgaaagattcctgcacttaaagcgattgtaatcataatcggtaaaccttctggcacagcagatgctgtaagagcaactgatgttgtaatcatttgcgtaatcggtaaaccgcgtagcaatcctgctacaagcacaataccgccagccacaaatgctcctttaataaaggttttactaatagacgtcaccttttgctgtagtggtgtaggctctgtttcttcccccttcattaaggaaatcatatagcccatctctgtactcatcccggtttccactactatagctctcgccttgccgcgcgttacggatgtgcccataaagagcatattattctgctccgctaacgaacattcttcccctaccgcatccactttcttttcaactggtagagactcacccgttagcatcgcttcattaacttctaaattccaagagtctataatacgaagatccgcaggtacgcggtctccagcttgaaggcagacaacatcacctgggacgagctcactacttgctacctctatctcttccccttcacgggttactatacaatttggcgcacggaattgatttaaagcttctactactttttctgcttttcgctcttgaagggttccaattaccgcattgacgacgagaattgtccccatcgctaatccatcaaacaccccacctgataatacagataatccagctgctccaagtaaaataagcgatgtaaactctttaaattgccccataaatgaaacaatccaaggaacagactgcttcggttcaattctattcattccatacttttcttgtcgcatttgcacttctcgagcgcttagcccttgctgtttctccacttgtaaatcttttattacatcttcttgcgagagtgcataccattttgtagaagtttctctagctaccgagtggttcatattcagtaactttttattagaaaaaatcttctcacttactcgcttcgctctagataaaaacgttaaagatagagcatttgccattaaagcgataataggtgccgtgaatatagaccaaacagccagcatctccccggcaatattccatattttcgctactcgaaaatgttctttcactaataaatcgatttgtttcgcataggcgattgactgaaatatatttttcatttcataataagatacagacggaaattcaatattatcctcacaaacaaataatacttcttccccatccgaacgaatacgctccacacgctctacaacatcactatgttgccaacttgcatcaataccgtgctgcgaaagaacactatgatttacatgtaaactattttgcaaaactgcaaacttccactgattttcacctaattctttcattatttctgtgaattcaggtgtaatcgtcattttcgatccaactaacaatcctacacattttttacctttagcaacgaactgaacgttaaatccttctttgccaagtcctttcgcttctaactcataagcacttatatctacaccatttcgctgcacaaatactttactcccgataaaggatggaatgccttgtatgtcaccttttatcccttcgtcatcaacttcgatttcaaaagctttccttaacgttcttcctgtttgcttcgctcgttgcacaacttcctctttccaatcatgcccacttttctccagcagtgaggctgccgtgcaccaaacttgcccttcatcttctgaaatgcagctaatctccgcttcttcatgacagaatatacgcgatacatcgtcaaatacgattgttctcgttcgggacagttgagataatgatccttcatttggaataagatatcctctttccctcgcaacgagatctccttgtcgccatgcatactcagcagacgaaactgcaggtttcggattcgcagctaataaaaccgccattccgcgtagtggatttctcgtaaaggcccatgttgctcccccaaaaagcatgccccatttcgattgcttttcactgtatgctttaatctccggggataaaattctttctttatacgaatctttctcttcatttatgttcgcttgactacgcttccaatttaaataatttaatagactaagtcccgctagtacgacgatattttcccgcgctagtgcgagtgcaagcgttcctatgccaagcactagatcagaattcacttttttgctagcaaccatttttttgaatcctcgttttaaaaacgggtatcccgtcaaaacagataaagcccccgacaagtaaaaaagccctggacttctagctaaagctgatcttcccataaatagttgctttataccgaacgcacctaatccagcgacagaaagcgctagtggcaatggaacaccttcaccttttttctcgtaagaaattacactagatgaagaatcttctgctttcttcgtttcttcaatattgttaaagttagtattctttgtagtttgttcttctaggagtttaattatttcacaaacggtatgtagagaggtcttgttgatatcgtaagtaatcagggctcttcctgtagagatagagggactcacttgataaataccttccacgtcacgaaaacgttctactatcaagttcgccatgtccaagttgtattttagtttatatatttcaattcgaattcttccaggtaacgatcgtataaatctcgtttttaataatttactctgcatcatcatcctccttatccttgtaaaggaagtaaaatcacttactatctaaggagtaacaggtatgctttcgtaatctacactctgctcagaatgatatgcatttacacgagacgcccatttttcctggaatttagaaatagttgtcggtacagcttctactgctccaataattggcgatactgtttttactgccactttacgtgccgcttcttttactttcggtaaagcttcttccatttctgaactagcattttgaatttgttcttttgcaccgagaaaagcagatactgtttttaccgctagctttcttagcccctttctcgcttttggtgacgctaatataaccgctgctactccaaccgctataccgattggtgatttcataaattgaaacatgtacatttctcctcacttaattttttcgaatttgtaaaatgaatcaatcttatcctaccaagtaaacatgtaattcatttcatcacatcctttttttgtaaaaagtatatatagagtatatatttacgtttgtattatttcaacaatttattagttttttgtaaattttatgttaattcagaaaatatttttgtaaacactcctattcctatgcaattaaacaggtaatatattccatgttttattactcaattgttgaaattatattgagaatttattttgttttttcgcaaatcacaaactaagacacgcacttttacgaaacaaattttatatactataaaaaatgctacaaggagtgattttcatgagcttatcttattggaaatacgcgattcttactcatatcactgcaaatttccgtacctttttattcaatatcattgtcgctattttaggagaaatcgccctctttcttgtcctcagttttattccaaaaagatttcataaattttttgcataaaaaagcctgagttcctatctatcgtagaactcaggccacttagccttattaaataatgggaacttgttacatagatttctcaatacccaatctggtattagggagaatatatcagcgattttttgaatatatcaacgatttttcaaatatatcgattgtttctttcaatatatcaacggttcgacacaacatatcgatttaccaacaaattgcgacatgttttacatgcaaaataccgacataactttatacaaaaaagacgaccgaaacccggtcgtcttttcctatttatttcggagcatttcctacatattgcgtaatatcaacatttaatgcctgcgctaaacgcataccgtattcttgatctgcacggaagaagttacaaacagctaataattttgtgcgttcatttacgtcttttagatcatttgttaagtttgcaattaagttatcttgctcttctttagagaatgaacggtaacgctcacctgcttgtttgaagtcatttggtttctcaattttttcacgagatacatagccttctactttcatagttgaatcgcggtaagctttgtcttcaactggattctctgcatgacgactcggttcgtagttgattgtagatgggttttgattcacttgcatcgcaccatcacgttgttgattatgaacagctgcgtatgggcagtttacaggaatttgtaagtaatttgcaccaagacgataacgctgtgtatctgggtaagagaataaacgaccttgtaataatttatcttccgatggctcaataccatttacagttgcacttggagagaacgctacttgctctacttctgcaaagaagtttttcggattacgatttaacgtcattgtccctacttccattaatgggaagcgatcttctggccatactttcgttggatctagtggatcaaagtctaaagagtccatttcatctaattgcataacttgtacgtgtaaatcccattttgggtaatttcctttttcgattgcatcgaacaagtcacgagttgcatgattgaagtctttcccttgtacttcttgcacttctttcgcatttaagttacgtacaccttgctgtggtttccagtggtatttaatataaacaattttaccttcttcattaatccatttaaatgaatggacgccgaaaccctccatttcacgatagcttgctggtgtaccgtaatcagaaaatacccatgtcatcatatgtgtagattctggacttaacgtcatgaaatcccaataacgatctggcgtttgaatattcgtatcaggtgctggttttaaggaatgtaccatatcagggaatttaattgcatcacgaatgaagaaaactggtaaatgattacctacgatatcgtagtttccttcttctgtataaaatttaacagcaaacccacgtgggtcacgtgctgtttcaggagaaccttgaccatgaataaccgttgaaaaacgaacaaatacaggcgtttcagttccttcattttgtaaaaatgctgctttcgtatattgcttcatactatttttcgttacgaatacaccgtgagcacctgcaccacgtgcatgcacaacacgctccggaatacgttcacgatcaaagtgcgcaagtttttctactaaatgatagtcttctaataatactggtccacgacgaccagctgtacgagaattttggttgtctccaactggagcaccttggtttgttgttaagcgattatttggattcatctagggggatcctcctctttctttcgtagtaatcattatttatttaaaattattataaattaattattatttaaaactaaatctttgtcaactatttccttcacttttttggaaacaatttcagccaaacagtcgataaatgcagattgtgcattcggcatatttggtctgaaatatttggcatttaattcatccgttacaactttacattcataatcgctgtcatataaaacttctaaatgctccgctacaaaaccaactgggcaatatacgaaagattcgtacccatgctcttcatataaatctttcgttaaatcttgcacatctggaccaatccacggatctggagtattcccagcactttgccaacccgttgtatagttttgaatatttgcagcttctgcaattaaatatgccgtatgctttagttgttctacatatgggtctcctgttgcaataattttttctggcaaactatgcgctgaaaaaattacgactgctttctctttattatcaatttctgtaaacgtctcttttatttggtctgcccaatacgaaataaatttcggttcatcataccattgttcaattggttcaataacaggaccaccaatttcttgcgaaagacgaatagcacggtcattatacgctttaatgctaaatgtagagtaatgtggcgctaatacgatactaatcgcttgctcaatcccatcacgcttcatttcttctaccgcatcttctataaatggtgcaatatgttttaaacctaagtaacaagtaaattcatactctgtaaatatgttattcattgaatctgttaatttatgcgcctgttctttcgtaatttttgcaagcggtgaaattccaccaatcgctttatagcgcccaattaaatcttcaagcgcttcttctgatggcgtacgcccgtgacggatatgtgtataatatgcctctacatcgtctaatgattctggtgttccatacgccattacgagtaaacctattcttttctttgtcatctatataacacctcaattttataaatgagaatctttttcagaacgtttgtttccaattataacaagtaataataagtacgtcaaaataataattctaattaagtattatttataaggtgattttgaattttatatgataatttctttaataaaaagccgcttacataattgtaagccgcttttcccttattccttaatatttaccccatattctttaaaccaaacatgaatttgtgctaaatgagctaaaagctgtggcccagtcatcaattgaccaaacactatataactacaataaaagagcacagcgtgtatataaagtgcgaccaacactctatataccatccgcctaatccatctaggcaaacacttgctgtactcttacgaactattttacagtacgtaagggctccttagcaacagtttgcttacacttggcattctgttgctcttttgtatatgcaaaggggcctacattatgaaaaagaaacgtattgatgttatcgcaactaaagaagccttccgcaacttatcattattcaaagatgtggacgaactaaatagagctatacgtgcatacagagacactatccgtatgtctattaagcgtacagatgtaaaatctaaactcattacattacttgaaattttaaagcgccacagctgcaaatatgtaggtgttagtttcctgtgcaaaaacagaatcgctgtaaaaatggaagtttcat

SEQ ID NO: 1284 - DNA, 6267 bp, Bacillus thuringiensis
gaaatatggagtttttgtgcttgccatgttcattacctcctaacaatatataaatgcaatggttacgcaacctttccgtgcttgcgtcctttatttactactttcaattcttttgtatcttctgtttctttttcatcttttcctaaaataaattgtgcaaataaccctgttacagcaagtaaaataactgttgctacaacaattacagttaaaatttgtacaaagtattgccccattacaccaagagaattaataactgaaatacctgatgggacgaataagaatccaataatacctgttaaagctgttccgagtgattcaacttgctccaatttaataacttttaaacataatagactaaataaaataactaacccgattaccgatgaaggcattggaattggtaaatgtgttgcaataatattagaaattaacataatagctgagaatatgaatgcttgtgataagaaactatatacttttttcgtactcattttggccacctctttcgatttggtacctttattgtataggatacaaacgtataagtaagcgtttacataacagaacgtcaaatatacagaatcagttacaaatataaaaggatgaaatacaaaagctgcttcttaaatacgaagcagcttcttgagttcttttgcatatgtacggctaacaggtactttcgatccttctttcatgattaaattataagtagaattaaaccatggctgaatttcagtaatatgattaatattcgcaataaagctacggtgtacgcgcatgaagcttgcttgtggtaacttcttctctaaaattacaagtgtatcatgtgttacatacgtttccctcgttgtttttactgttactttcccatctacaagccctacatatataatatcttcaatattcacaagtacgattgattcttcaattggtaatgctaatttatgcatctctgctgttacatctgtcccctttatttcgtgcttcgtttctatttgcgcttgtttttgttttttatacttctttaatgtctgcacaatacgctcttcatcaaatggttttaaaatgtagtctaacgcatctacttcaaatgcttgcagcgcatattgatcataggcagtagcaaatacaattgcaggtggatttttcatcttctttaatatattcgcgatttcaaatccgttatcatcggataattgaatatctaaaaacacaatatctggtctactttgcattagttcttctaatgcgtcttccacacaatcagcctcaccaattatctcaacttctttcgttctctctaataaatactttagttcatcacgtgctaacatttcatcgtcaactactaatacttttaacacccggctcttcctcccctactttttttggaataataaaggtaatctccgtccctttatttaattcactttcaatatgaagcatcgtttctttcccaaataacccaataagacgttcattaatattatataaagctgttccagtccctttctttgacgaaactaccatctttcctaattgttctaaacgttcttcctcaattccctgtccattatcttttacttcaaagtgaaccataccctctttttcaaaaacatgcacttccacttcgcatactggttgcttcttcggaaaagcatgtcgcaatgcattttcaaccaatagttgaagaacaaatggtggtactaaagttgtctttagctcatcttcaatatacatctttacctcatacttatttgggaaccttgcttgttctagtgataagtatgcctgtacatggtttaattcttgttctagtggaatcaataactgacgtgccccttgcaaattacaacggaaatatacgctaagctgtaataataacttccttgctttttctacatctgttcggcatagagctgatactgtattaatcgcattaaataaaaagtgtgggttaatttgcgcttgtaatgcttttatctccgcatcttgaagtaatttactttgcaactcagcttctcctaactctaactgcgtggagaatatttttgctaacccttctgctaattcctcttccacacgacttaactggttaggatttttgaaatagagttttaatgtccctatcgtatttccatgcgaagttagtggaattacaatcgccgcttgcaaagggcagccttcatgttgacaattaataacctcacgtgatttcgctttcattattttccctgtgtttaacacttctttcgacaaaccggttattaaactatgtgaaggaatatggtgatctgatgctaatccaacatgagctaatattttctctgtatctgttaaggataccgcatctgttcctgtaaaacggtgaataatttgtgccacatgcttacatgattcttctgttaagccttggcggaaatacggtaacgttttatctgcaatacgtaatactttatgggtctgaagtgcctttgcattctcctcctgacgcaaaatagcttgtatcatagaaagtaaaataaaacttccaaaactatttacaagaatcattggtatcgctattgttttcacaacgctaattccatcctctataattaataaaatcattagcatttctaaagatacgataaaaacacttaaaactgctgaaaacttaggagtaattgtacgattatattttttgaaaatatatccaatataaccagttataatcccagctaaaatagaagagattgcgcagcttagcgctgtcgtaccaccaagcatataacgatgaataccagcaataaatcctactccaacccctacgatagggccaccaagtaagccgctaataccgacacccataatacgcgtattcgcaattgtacttgacgaagaaacaccttgtaaccagttttcattcataatcgtatttcctgctatttcaatcccagtgtaattgcttacaattgtaaataccgaaaaaatacaaataagcttcagcttatctacatagccatcctgtttatgaaggaggcgtctgaaagttttaatatgagagagtaaaaatcctaaaataactataagtccgactcgttcgatcatcatgagtactaaatttagcatctttgattcattcctttttatttagttagttttattatgggaaaataatgaagtcggcgtcaagaagaacgaaatgttttttgaaatattttacacataataacttcctctttatttgacaatacaatagaagagtgctaaaaataaagtaatataatacagtcctttaacccaaccccgtgaggttgagaaggaagtcggaatacaatatacgtatgttcttttttggggatacgtatgcttttttggccttctcatcatatcaggtgagaaggccttttgttattcttccatagcgactgtagaaaataaggaggagtaataatgaacgtcactactgatgtacaacaaacaacagaggagacaaaagcgaaaagatataaaacattatttggttctgcgctaggatatgcagcagaaggtttagatatgttgctattatctttcgtacttgtctatattttaaaagagtttcacttaagtcctgttgaaggtggaaacttaactttagctaccacaataggaatgttaattggttcttatttatttggatttattgctgatttatttggccgtattcgtacaatggccttcacaatcttactgttttcactagcaaccgcactcatttatttcgcaacagactactggcaattattaattctgcgctttttagttggaatgggagttggtggtgaattcggaatcggaatggccatcgtaacagaaacctggtctaaagaaatgcgcgctaaagcgacatctgttgttgcacttggatggcaatttggtgtactgattgcttcactccttccagcatttattgtcccacactttggatggagagccgttttcttatttggattaattccagctttactagctgtctatgtccgtaaaagtttaagtgaaccgaaaatatgggagcaaaaacaacgctacaaaaaggaactgttgcaaaaagaagctacaggtaaattaacaactactgaagcagaacaactaaaacatataaaaaaattcccacttcgaaagttatttgccaataaaaaagtaacaattacaacaattggtcttattattatgtcgtttatccaaaacttcggatattacggaatcttcacatggatgcccactattttagcaaataaatataactatacattagcaaaagcaagtggctggatgttcatttctaccatcggtatgctaattggaattgcaatctttggtattctagctgataaaattggtcgccgtaaaacttttgcaatctattatattggcggtacagcatactgtctcatttacttcttcttattcacagattcaacattattattatggggaagtgcattgcttggattctttgcaaatggaatgatgggaggatttggagcaattttagctgaaaactatcctgctgaagctcgctctaccgctgaaaactttattttcggtacaggacgtgggttagctggatttgggcctgttattattggcttactcgctacaggtggcaacctacttggagcattgtccttgatttttatcatctacccaatcgggttaattacaatgctactatgtgtaccagaaacaaagggaaaagtattagattaaacgtaaaagaggaagcatcttatttaagatgcttcctcttttacgtttttatttattttgatttactagccttctgaaataagaatgcagttttatcttcttcttttacaataccttgttttaatgctaattctcccgcaactttaggcgctaaccatagcattgggaataacaaaattgataccggaactgccgtcaccacgataaacgattgtagcgcattaatacttccttcacccatatataaaagaattgctgcaactgcgcccataataagcgaccaaaaaattcgcaaactaattctaggatctccgtctccagtcactgccattgaaatggaatacgccattgaatcccctgttgtcactacaaataaaattgttaataaaagaaatgctggtccaataatattagaaagtggcaattgtcctgtaattgcaatcatagctgccggcataccagattcacttaatgcgtccgagatagacccaggattcatcaactcataaaacacgcctgatccacctaatatagtaaaccaaaacgttgtaataataggtgcgataattccaattgcaacgatgatttctcgaatcgttctccctcttgaaattcgactcactaaaattgccatcattggtccgtatccaataaaccatccccagaaaaagattgtccaagatcctaaccaacttgtatcaccacggtatgtgctcatcggtataaactcatttacataaaatccaaacgaagaaacaaacgaatcaataataaatccacctggcccaaatagtaatatgaatgccattaatacaattgccaatctaacatttaaattacttataatttgaatccctttatcaatacctgttactgccgatatggtagacacggccaccacacaaacaataattgctaattgagtagtaaacacattagaaattccaaataattcttgtaatccataacttgcttgtaaacctaaaaatccaattgggccaattgtacctgcagctactgcaataattgcagctgcatcaattatcgttccaagcaggctctttcttaatttttccccaaaaataggatataaaagcgttcgaggttttagcggcatatctttatgataatgtccatacatcataactaccgcactaattgtacctaaaatcgtccatgctaaaaatccccaatgcatataactttgtgctaaagcaggcataactgcttctttcgttccagcagatataccatcatgtattggtggcaccgtcatcaaatgatacattggctctgctgctgcccaaaaaacgccacctccggcaagtaatgtagacataataatagcaagccattttgccgtactaatctcaggtttttctaatcctccaagcttaactctcccatatttggagaacgccatacacatcgcaacaataaatgtacctaataataaaacttgccagaaggcaccgaaatatttaattgaaaaaaaaaaacttttattaatcgcactctctacataatcct

SEQ ID NO: 1285 - DNA, 9471 bp, Bacillus thuringiensis
ttctcttactacaatctttgccagtggaaataaaatacgtatatactagaagcggaatctatgaaagaggttgatataatgaagacatttctttccgcctttacaatgggcactatttattttagctggaagccttattgtaccaattagtgtcgcaactagttatggtcttaatggcgctgaagccatcgcatttgtacaaagaacattatttgttctaggttttgctggtctcttgcaagctatatttgggcataaacttcctattcaagaaggtcctgctggcctttggtggggaattttctccctttacgcaagtttaggtgtcgtactatttggatcaaataatgagacacttaaagttcttcaatatgctttcttattaagtggtattatttgtattattcttagcgtttttggacttattgataaactcgttcgctattttacaccgacagtcattggaacgtatttatttcttcttgtcgcgcagcttagtggctccttcttaaagggaatgtttggccttgatggaaaacatacagaagtacaacctaacgtatttattctttcactcattgttattttactatcctttttcatcatgaagctacctattattggacaatattccgttcttttcagtatcgtatgcggctggatattattcgcatgcttcggattatctaatccaataacaccagtgacagacataatccgttttccatccttatttgttttcggaatgcctcgtgttgaatggaacatggtaattacggtcattttcgttacgctcttacttctaacaaatatgttagcaagtattcgcgttgtacaaaaggttgtctctaaatatgaagaaaacgctgcatcagatcgttttaaacaagctggcattataacaggaatcaaccaattgctaggcggcctattttcagctattgggcctgtcgctatttctggatcagcaggttttattgcaacgactaatatttataaacgtctcccgtttatattaggatcaagctttattattgtcgttagtatatttccaaagattacttcattctttgcagcaatccctgttgcagttggttatgccgctatttatcctgtattcgcaagcatgattggcctcgcctttcgagaatacgaaactgtccaggataaagaacgattatttaaagtagccggtctttcaatctttacaggagtcggagttatgtttgttccagcaggagcatattccacacttccaccatttctagcatcgttttaagtaatggtctcgttcttggatctgtaatggcaatcttgctagaaatactattttctcgttccacagcaaaacaaatatcttaaattggaaaacttccattattgcactctacctttagagttgttacgataaaatcaaactttaatcattggggttttattcatccccaatgattattaaccaatattatgagcaacacactcataataatttatctacttcttttcaaagaggtttgatgtcttactattattcctcaatctcttcatgaacatgtattttgatttcaattaaagaaaggaattttctatatgacttataaaatgattgttttagatttagatgatactttattacgtgatgaccatactatttcacctcgtacgaaagaagcgttaatgactgcacaagagcaaggcgtaaaggttgtacttgcttctggacgtccaacgttcggtatgcgcaatgtagcgaaagaacttcgtttagaagaatacggcagtttcattttatcttttaatggtgcaaaaattattaactgtaaaacaaacgaagaaatctttagtagtacactatctcctgaaatcgttcacaacctatttgaaattagtcaaactgaagatgtatggattcatacttatatgggcgatgatatcgtaacggaagaaaataatccttatactgaaattgagggcgatattactggtatgccaattgttgtagtagatgactttaaagctgcagttaaagagcccgtagtaaaagtattaatgaataaagaagctgaacgccttgttgaagttgaaaagaaactacaaaaacagctagaaggccaattaagcgtgatgcgttcgaaaccattcttcttagaatttactgaagctggtgttacaaaaggaacgagcttaaacaaactgatccaaaagcttggcattaagcgtgaagaagttatcgcaatgggcgatagctataacgaccaagcgatgattgaatttgctggtcttggcgttgcaatgggcaatgcacctgatgatattaaagaaattgcaaactacgtaacagatacaaatatgaacgatggtgttgcaaaagttgtagagaaattcgttttaaaaacggatgtacttgtttaatattttcattcacaaaacctatttgaagtcaaatacttcaaataggtttttatttaaattctcatgcttttgtgactatattttgaactttgcactattctcgtagtgtaaactttctttttgtatataatgaaacaaaatagactattttattttgaaaaagaatacaaatttactatatacaagcatacgttaaaggaggctactttatgttatctacaccaatcggacgattaagagcaattggactagttgagggtatttctttcctataactattatttgtagcaatgccattgaaatatttcgcaggatttgcaacagctgttaaaattacaggcatggctcatggtgttctatttattctattcatctttgcagtaattcaagtaacaatcgtacaccgtaaatcaattttatgggcacttggagcatttgtttcatcagttatcccatttggcacttttgtactagatgcaaaattaaagaacgagcaacaataataataaaaaggtagttaacgactgttaactaccttttctatttataaatttggaatttcccaatcaatttctctttcgcccatattagctaaaatcgtatttactttagaatatggcttactaccaaagaaaccacgtcttgccgataatgggcttggatgtacagattcgataatatgatgattcggattcgtaattaacttcttcttcgcctgcgcatggcgcccccacaatatgaaaataactggcttttcacgttcattcaacagttcaattacacgatctgtaaagtgctcccatccttttcccttatgagaatttgcttcgccttgacgaactgttaatacggtatttagtaataatactccttgttccgcccattttactaaataaccgttattcgggatttcataaccatattcatctcgaagttctttatacatatttaacaatgacggtggtgttttaacaccaggttgcacagaaaagcttaaaccatgcgcttgattcggtccatgatatggatcttgtcctaaaataacaacctttgtattttcataacttgtatactgaagagcgttaaaaatatcttctaccttcggataaacaacatgcgtgctgtattcttctgtcaaaaaactggatagagtaagataatactctttctcgaattctggtgccaatagtggctcccaatcattctttaaaacattttccatactgtcacttcctgtctaattaattcaccatatcctgtcttgtaaatactacgaacgaaataacaagagaaacaactgcccaaacagttaaattcatcaaagaaaatcccatcgataaaccttgtaatgcaggtaattttcctgataaataatccgttaatgataaattcacactaaaaatatatttggcgccttcccaagatgttgcgaacgagcttaaaataccgcctgcaattaatgcagctagcataacgcccataccagctggtgtattacgaattaaaacagagaccataaatgatatagttccgacaacgatagcaacaaaccatgctagtccatacgccattaagatgtattgccactgcggaataagatgcacaaagttcgtatttagcgtttccttatcaataacaaatcctgttaaaacaggtaaattccatcccgagtatccaaatacaagccctgataatatgtaagcaaacaaacctacaagaaacagtatgagcgaaatgaaaaataacatcgtcacgtatttactaaggagtattttccaacgccgaattggtcgcgtaagtaacatcttcatcgtcccatcacttcgttctcctgaaacgatatcaatggctacaatcattacaagaagcggaataaataatgtaattccttgttcaataaatgctctgacaaaagtcggtgcacccggtgccatcggattaatatcatgatctaaataatattgttgttgctcaactcttacctttaaccaatcacgccattcttctggcaacctagaattgttcaaccggttctgagaatcaacaatttgctgttgcaatgaaaccttccaatcagttgtaccgagtcttttttgtgtcgtttctatttcacgatactgcgcatacacaaaaagcgggatcaagattgctaaaataagcatgacaacaaaaatacgtttcttgcggtaaatcttttctgattcatttaaaactagattcgcaaattcacgcatgctgctcaccccttgtgagttcaataaataaatcttctagcgtaaatacaagctccttaacgctatgtacatctatttcattttcgacaaagtgtttattccaactacttatagatgcaatatccatgcggcatagtaatcgatcgccttctacactcacttcccttacttctttggccgcttctagcatatctttcgccttagaaattggtgtaacaatccattctacacgatcacttgctgttttaattaattcttcaaccttggcaactgttatcatttttcctttatgaataatagcaacgcgatcgcatatcatttgcacttcacttagcaagtgacttgaaataaacacgctcatattttcttcttttacaagcttatgtataaattccctaagttctctaatccctgctggatctaaaccattcgttggctcatctaatatgagcaatttcggattcccaaggagcgcctgcgcaattccaaggcgttgtttcataccaagtgagtacgtttttaccttgtcatgaattctttcatctaaatgaaccatttcagcaatttcaataatacgttcatctgatatatcacctaacatacgagcaaattgctttaaattttcccatcccgttaaatatgtatacaactctgggttttcaacgatactcccaatttgacgcatcgcttctctgaaattttccttaatcgaataaccaccaatagaaatcgtaccttctgtcgccttaatcaatccgactaacattcgaatggtagtcgtctttccagcaccatttggtcctaagaacccgaacacttctccttgctttacatcaaaggaaatattctctacaagagtcttctttccaattaccttcttcaagtctcgtacggaaagtatcgtcgtcattttacccctccttgttctaattttaatttacttacaacattttgaactaaacgttctgccatatacgtataacctacttcgttcggatgaaaatgatcagagtataataaatctttcccgcggttttggaataaatcaaatgtcggtgtaatatatacatttttatcgtttagcgctaacttctctaaagatgcattccagtccacaacaatgtttgaagacccttttaaatcttctacatcttcaaaaggattgtataaaccaagccaaaaaatcggactatctgtatttaatttacgaatttcttctataattttctttgcttcattttgaaacgtttctgtgtcaggacgatacgtctctaaatctattttcccaagcgattcccagcctgggaacaaatcattcccaccaatcgttaacacgattacatctgcttgcttaattgaatattgagcgccattactttcaatttgttttaataaatcgggcatttttgcaccactaactgctaaatttgttaatgcaattttttgcttataatctttttgtaaatcctctttcattcgcccaacatagccaattccttctttatcaccaacgccacgcgttaatgaatcacctaaactaacgatttgtaacgttcccgttttctttttctcttttgccactacatcggtctttttaattaaatttgaagctttcggatttaatacatcatttacacctgaaacaaagccatatgcaaataaacagaaagatgcaattgtaatgagtagaattacttttactacttttgatctcatatcaaaaccccttttagccctcatagattgtccataattataccaaacgcaattttgaaaagcgattttcacaccttatctattatgttgtttccctatgtactaattctggcaataactctacgtgctttacatctattttctcatcattaatcttttcatataataattcgaatgccttcacaccaacatttttactacaatacgaaatcgtcgtaatgcctaaaatatctgccacatcttgatcatcacaaccgataatcgtaatatcttctggaatacgaatcccttgttttttcgcttccgttaccattcccgctgcaatatggttgcaagatacaagaaacgctgttggttttactgacatatgggcccattccctaattacattacgcccatcctccaccgtaaaacagcctttaaacttccagtcctctatcggtgttacagcaatcgtttgaagcgcatcctcatatgcttgttttcttctctggctattaatgctattgcttcttccaatgcaatacccaatacttgtatggccggcatctattaagctcttcatcccgcgcgaaaacactttatagtaatcaatatgcacactcgaaatgaaattcgagtctatttcttcacacataacaatcggaccaaatttcgtatattcttcaagcttttccttactatttgccctggaacatataataaccccatcaagctttttcatttttaacatattcaaaatttctaattctctttcctcactataattcgtctgacaaagcatcatattataattgttttttgctgtttcctttgatattccctcgataatggcgctataatattgatcatttacgtgcggtaataaaacgccaatgacattcgtttttcctttcactaaatgaattgcattcacattttgcgtataatttaattcttctataattgctaaaatttcttttcgtttctgttcatttacgtacggatgattatttagtacacgtgaaacagttgaaacagatactccagcaagttcagcaatctttcttatatttgtcatctcattttccccttctcacaaaaattatcccttgacctggtaagctttccacaatatatcctttcctagcaaatacattttgaaaggatatacaactatgcttcgattcaaattagaatatatatttttcattggcggtctactcactctcgccatcggtattaatatgatgacgacaattacttcctttggacttagcccttatgattccttctttattgcactatatcaaaatttcgggataagtatcggtttttggattttcatgattaattttgcttttactcttatcgtactcttttggaataaaaaacaaattacgatcggtaccattgtaacgatggttcttatttcgctttttgttgattggattggttccattacaactattatggatgctatccgctctcttccaaaatatataacacttatttgtggaaatctattcgttggagctgggattggtctttacgtctctacaaacctttgcgcggcgcctcaagaagctttcgttttgacggttgctgagaagaaaaaatggacgtttagaagaacagaaatttcattagcctttttatttttaacgttaagctttttattagatggacctatctattttggaacaatcatcttatcctttacaacaggctggattatccaagcatttattcaagttggtacgcagattttaaataaaaaagagcctattaagcaagctgcttaataggctctttctgttttatggtaagagatactacttagcatccccttcaattcgatagttcgctttcaaacaatctatttcttcatacccttgcaacgtatgtagaatataatcataatcagcaagagacgcacgatgcgttacaattacaatttcagcctttcctttctcttcaagcggcatttgaataattttctcaaagctaactccgcgctcagagaacaatgaagtaatttttgcaaatacaccaatttcgtcttttacatgcagtcttaaaaactttttcacgacaatttcgtctggctcttttaatactttttgatattgtgggactacagcactatttcctgttacccctaatctaatattttgcattacagcaactaaatccgaaacaacagctgtcgctgttggtaaacttcctgcgcctggtccataaaacatcgtttccccaactgcttcaccgtacacatacacagcgttatattcattttgtactgccgcaagaggatgtgtatttggaagtaaagttggttcaactgtaacctccaatttttcaccatctcgttttgcaagaccgattaatttaattgtataacctaagctcttactatattcaatatcttcctctgtaatagaggtaatcccttttactttcacgtctccaagctctacatttgtagagaaaccgagagtagctaaaatcgtcatttttcttgctgcatctaaaccttctacatctgatgttggatctgcttctgcaaatccaagttgttgggcttcttttaacacgtcgttatatgctctcccttcgtctgacattttcgtcaaaataaaatttgtcgttccatttacaattcccattactttcgtaataagatctgaggaaagtccttctacgatactgcgtaaaattggaattccccctgccacactcgcctcatagaataaatcagccttattatcttttgctgtcgctaataattcagctccatgtaatgccattaagtctttatttgcagttacaacatgctttccgctttttaaagcttgtaaaatatatgattttgcatcatcaatgccacccatcacttcaatgacaacatcaatatttggattatctaaaatttcatttgcatcttgtgttaatagagtagaaggtacctctacctctctctctttctcaatgttttgcactaatactttcgttaccttcactggacaacctacttggtgtatgagtcgttcttgatgatccgtaataatacgaaccacaccactgccaactgtcccaagacctaataacccaacttgaatttctttca

SEQ ID NO: 1286 - DNA, 13091 bp, Bacillus thuringiensis
tgctagtacacgacgccatttcatcagctacttgaaaagaagctacggcttttacgttttcttttataatgttgatgtccataaccagatgaacgtcgtttataatcgctacatgaatacgagcgccctctacgacgataatcactacttgaatacgaacgatattttttctttcctaataaagaatcaataattcttttgggcattccctcgcctcgtgagtaaagtttccttttcattatatcaatgactattgactatgcttgtgacaggtttgtaaagagtaaatgtgtaccagtgatgccagtcgtgactaacactcatcctctgcatcaaagggttcatcaatcatgcatttctctaataaatgctctaatgtaatattcgcgagatcgtgaacatcttctcgtcttggaacagtcacatcaaagttttagttgctcataaaaaaactccgcaatctcttccgtatcaatcacgacttcaatttccttcatgagcatcactcctttatttctgttttatgaaaaaatctcaaaattatgtatatgagattagaaaaatagattttatttttttataggtcataagctttggacgagatgcatacgattgtagtacaagctattcaaagggggaaataataatggaaaatcaatatgaagtaagacaaacaaaagaagagttcatgcatgaagatcaatgggcagactctcttataaagtggctttttatttttttaatagttgtaggcataccttatactgcatatgttgttgttcaatttattctctctttctagttaactattttttctctgtcaatttaactaaataattatgaacaacatccattacaattttatattcttcatctttaaatgtatcgaacaataattgataatcgttataaatgtcaagtaatccatcaatgatttcttgacgattcgtcttaacactcacttttttcgagttgttaattgactttaactttcctaaatctaatttattcatacctgctttatcttgtttcattttcttcaaaattgcatttgccgtttgagcattggcgagtaacgttaaatctgattcatccgcttctaaccattcaccatccgtaatccgtgacaattcataaattgtatcttcccatgcgtcattcttatatctccatacttctgtacgaaaaccaacaatacggaaaacatctttatcatatccagttacttgcacaagatcaccaaacgtgaaattataatttaattcaatccactccgtatcgccctttttcatatcttgctctgtaacgtgctgcaatgtttgctctacgtaaaatccatcgtgattattgacttcgtatacataaactccatctaaaaccttcatatttgtgattttcccaacggttccatatagcgtaatcacgactatgtcccctacgttgtatttaggttgtttttttcttgccatctctatctctcctttttttgacgtcgtgattttgatatcagtatatgcaacctacataaaaacgcttatcacagaagcttatattcataaattttttcaataaaaaatataatcttataaaatttacattacacttaaacaaaagctagtaactagactagcttcaaatcaacaaatttcataataaaaaaacatacagaatacttcactttaaataaagtaatgtattctgtatgttttcaaatagtttttatctatcttgtatgtataaatcccaggcttcatcaaatatagacatactttctagcattccgctcaactctaagtatgaactaatttcatcatagtcttcagattgcttcggaaaacttaaatcatcatacatcgcctctgctaaatctgaaatttcatttctaaataaagctgcacgatgcttcatcatataatggtaaaatgtctttttcaaaaatattccctacctttctaacttgggtacattatacaaggcaaaaaagaaaaaaaccagcataaaagctggttaaaagtcgaaataatttctttttaatagacgcggtcttcccattaattcttcatatgttagttgttttggtaaatctttcgtgtaaattaagaataattgatcttcaatttcttttactgtatggtctgattgatagtccatcccacacgaggaacaagaaatacatggtgtctcttggatttcaatggctttcgtaccatctggtaattcccaatatacagtattcaagctttctttcgcttctgtactgtcacaccacatacaattcatactgcatcaccctcagtttttttgtcgttttcttctaacttagccatttgtgcttgatattttttatcttttaattgatcgcgcttatcacgtttatcttttaaagatgcatgagtatcattatcttcgtagtctttacgacggttcatacgctgtaagtcgtctggaacgaggttaaatttcttatcgctcataagacctgcgataccaacatctgaacgtttttcttcgtagttcggataaatctctttaaagtatccttccgctcttcctggaatatagctctctggctctggatacgtcgtaataacaccttcaaagttacgaagtacaactttatctgcactttgtgagattaaatagtttggttgaagtgcaattttaccgcctccgcctggcgcatcaacaacgaatgtcggaacagcataaccagatgtgtgtccacgtaaaccttcaataatttcaagacctttagatactggtgcacggaagtgaccgataccttcagataagtcacattgataaatgtagtatggacgtacacggatttttactaagtcatgcataagttttttcataattggaacgctgtcgttaataccagctaaaattactgcttggtttccgactggaacaccagcattcgctaacatttcacatgcctttttcgattcttcagtaatttcaatagatgtattgaaatgtgtatttaaccatactggatggtattttttaataatgttacataagttttctgtaatacgttgtgggaatactactggtgctctcgttccgatacgaataatctcaacatgcggaacctctcgtaaattttttaatacatattctaaaattttatcattaattagaagtccgtcaccaccggagattaatacatctcgtacttgtggcgtttcacgaatataagcaattgcatcatctaattgtttctttggtacacccattccaatttgtccactaaaacgacgacgtgtacagtaacgacaatacatagaacattgatttgttactaagaatagtacacggtccggataacgatgtgttagccctggaactggtgaatcttcgtcttcgtgaagtgggtcttctaaatcatattttgttttatataactcttccgaaatcggtactgattgcatccgaatcggacagcgtggatcatcaggattcattagccaagcatagtacggtgtaatgtttaacgggatcgttttcgttgaaattttaacgccttcttcttcttcaggtgttaagttaatcacttttcttaagtcatctaacgttttgatcgtattcgttaattgccaaacccaatcattccattgctcttcagtaacatctttccataattcgatatccttccagtgacgatttggtttgtatacatcatgtaacattgctattccccctttttatacgctcatcctttatataagcaatagttatgccaactttacattgttgataagtaaatgtgcggagaaccctattacataagcgaaaaaatatttttaagcgttgtatgaaatcaatacttaacatcatattcattactttttatatatgtaaacgctcttttattggtgcaaacacacaaaaaccgccgattattcggcggttttgtcgtacttgctcagtttatattgaagcgtttgacgagggatacccaacatttttgcggcttgtaatatattcccttccgtttcaatcaacgcttgatctattaattctttttctgtttgatgaagtgcttctctaagtggcattatacccttcttcttcgaaaacttctctttccgaaatgtacgtggtaaacaattggctgtcaatgtattcccttctgcaataataacagcatgttcaatcgtatgttttaactcccggacatttccaggccactgataagcttgcagtctatctttcgcttcctcatcaatttgaagtacaacttttttataacttttattatattctttcaaaaaataagatgctaataatagtacatcctcagttctttcacgaagcggtgggatatataatgaaaatacgtttaagcgataatataaatcagtgcgaattttattctctcgtaaacatatttctggaggctggttcattgcggtaataacacgaacatctacttttctcgtcttattatcaccaattcttctaatgactccatcttctaacactcgtaacatttttgcctgcaaatcaagaggcattgaattcagttcatctaaaaataatgtaccaccatcaacaagttcaaatagcccagctctttcaatcgctcccgtatagcttccttttgtcgttccaaacaataaactttctaatagcgactctggtaaagctgcacagttttgtgcaataaatggcttgttttttcttttagaagcttcatgaattgcttgtacgaacagttcttttcctgttcctgtttcaccatatattaaaacattcgcgtctgttggtgctactttttgtgctaactctttcgtctgtttaaaccgcgtatcatttgtcactatcgtctcaaatgcagcgtgctttttaatcactttttttctagatgatcgctttattttcgactgtaagtcaacaattgtgtcagtaagtttttgaattgtagagtaatcctttgcaatttcaacagccccagcaatattcccatctataaaaataggtaacgtcgtatttactgtacaaacatcttcaccatttaaattttgataatgttgtacctgatgtacgataggtttttttgtatctagtactttcatcaatgtactcgtttcccttgataaagacgggaacgcttctaacagatgtttccctaacactttttcaatcttggatccatcgtgttttgcagctacagaattataaaatattgtaattccattttcatctacagcgtgtatagcctcatcaatactgcccaaaatcgcttcaatgacttcttgtgtcgaaactgctagcaatgtcatcccccctcttgccgaaaatccagcaattatatgccgaattttcggcacacctatgtgcgattgtaagcatgacgattccgttctataattttgaccaattttatattttcattagataactcgaaactctaattagtacaactttttcgaacacccagctccacctaactgttttgctttacagccaaattttgagacggaagttttactgctttcgaataactagatagatctttcacccatatattcatatcttccaacttatcgaaaatgtagcaattattcgccagtcttcctgtatacgtatagcctaattgatgaaaggcagcattcattccgaaagaaagcgatcgagcaattgtataggagcagaaaatagatctttctcgaagctcttcctctaatttaattagtaaacttttcataaatccatgtttacgatattcaggtaaagtagcacaattcgttaattctgcatttccttcctttatgttcatttctgcagatgctgtactaataatttccccctcaaattcatacacgtagtaaattgtatcgtcttctttcatcgtctgtaatacataacttgcttcatttaaaggtgtcggatacacttcaaatacttttccgaagacagttgctaattcttctgcatcttcttcagtcgcttttctcagcaaaaatttctctggaactactttttcttttatttcttttccttttacaccgcttaatatagtatcttcctcagtccaatgcatactatttcgtctttcatcattattatatttcacaaaaaagtatgcatcgtgtccttgaaaataatgaggtatcgttgcttccaacacaaaaccgaaagagagccatgttgaaacatgctctccctttcctttaataatacatttagtgaaagaatgtttctctgctagttcgtcaattgtctgtataatactttcaacatttcctgtatagtgatctacccggatacgtttattaaaataatctaaaacgccttctactgtataacaattcgtctgttctctaaaagattcatagtatttcattttttcacctcacaccaatctagtaatgtacatgcaataatttttgcggcagctatcattttatcaacttctatatattcgtttggatagtgtgctactttcgtctctcctggaccaaatactattgttggtacgtttgcaatttgtgtaaataaacctccatcagtcccccacggagatgcttcaataattggttcgttcccttcgatttcaacaaagttatgatgaagtgttgtaatgagttcatgattttcttctaattcaccaggaacccatctcgctccaaaccattctacttctaccggattttcaacaaaccaattgtccacatcatttaattcaacaatccaattctcaaactcttcttttgccgcctctatagtctcattcggcgcaacaccgcatcttccttctaaaattaattcatcgggaacagaacttggccaactccctccttcaattttgccaatgttaattggaattggaattggaattcctttaaataacggatctgtaattcgactatttcttttctcctctagctttcttacatgttctataacaaacatgcttttttcaattgcactaaccccttcatagcgcgttccaccgtgtgcagctttcccttttacacgtagacgaaaccacatggaaccttgttgtttcgggaaaaacttcatattagtaggctctggaataatgacaccatctgctttatatcctcgtaatatagttgctaatgtccctgctccaccactttcctcttctattacactttgaaaatagatgtctccttttaattcaatactagattcaatgatcgcttccatcgcaagcataagtgcgacatttccgcccttcatatccgtcgttccacggccatatatacgatttcctattttctcaccgctataagggtgatgttcccactgattcacatccccttctggaactacatcaatatgcccatttaatatcatagatttcccgtcgccacttccttttaaagttgctacaatatttgggctatctgaaaaacttgtacggggtgatacaaaataaggatgatctttcattttagaaaaggagggctcccatatatcgagatctaaacctaattcacgtaatttttcaatcacaattgcctgcgcaccgctttcatcaccagatacgctcttttcttgaattaatcgttttaaaaatttcacactttcctcttcatggctctcaatataatcacaaacttgcttttttaattgctccatatattacatctcccttcattcaattactagtaagttagaactaatttgaaaatcagcttctgtatgtcgttttacatcttctactgtgtatgggctcattaattcttgtaatataagtccactcggagttacctccatgactgccatatcagtaataattaaatctacacatttctttgaagttaatggcaatgtacactctgaaacaatttttgcatttccgtacttatcaacatgattcatcacaacaacgacccgcttcgctttttgtgctaaatccattgctccaccaatacctggaacacgttttccaggtacaatccagtttgctaaatcgccattttcacttacttgtaatgaaccaagaatcgttatgtctagcaaaccttttcgaatcatcccaaacgctgtgcagctatcgaaataactcgctcctgttataagagaagttggtaaacctgctgcattacacaaattttcgtcttcattccctttacttggcgttggtcccatgcccacgattccattttccgcatgaaacataacatttatatcgtcaggcaaatgatttggtacaagcgatggtatgccaatacctaaatttacaatcataccattttgtatttctttcgccgcacgcctagcaatcttatccctcacttctacgcccatacccatttccagttcactccttccgacggtacaatataatttacgaaaacacctggaacgacaatttcctctggatctaaacttccaagcgggactatttcttccgcttctacaattgttatatccccagccatcgctacgtgaggattcatatttcgtgcacttttgtcaaatacaaggttaccaaacggatctgccttttttgcatatacaattgaaacttcagcagttaatgctgtttcaactaagtaggtcttaccattcatttcaactgttcgttttccctcttccacaatcgtatcaacaccaacatcaactaaaacaccaccaagaccaacgccaccagcgcgaatgcgctctgctaatgttccctgcggagaaaactcaatttgtaatcttccctcgtttagttgccttcctgcatttggattggagccaatgtgagaagtaattattgatttaactctttcatttgtaacaagacgaccgatacctacatcaggaaatccagtgtcatttccaattaaatttgaatttgtaacgcctttttctaaaattgcctgtattaaagatggaggggatccaatccctccaaatcccccaaacatcaatgtcatatcatcatggaacaaagaaattacttcctcaatttcttttaatttaccgaatgtatttgtaatagttgtcatgcgatactatgccctcctttttgcatcatctcttccacacttttagagaaaattgaaagtaattcatctaactcggaatatgtagttgtcattggcggtgctacaagcagtgcactatcttcttttcctgcttgccctgaaactgcttggtataaaagcagaccatttttagctgcaactgaaataagctctgacgcttttgtaaacggttgcaattctactccgattagcaacccttttccgcgcacatcagcaatgattgtcgattgttgctgaactttctgtaagccttttattaaatactctcccttttctgctgttttttcaggaagattatgtttctccatatattcaataacagctaaagccgttgctgcagacaatggatttgcacttaacgtatgaccgctcattactgaacgtgatccacgtaatattggttccataacacgatcacttacaactgtcgctgccatcggtgtatatcccgctcctaaccctttaccaagtgtcataatatccggctctacgccccaatgctccatcgcaaaccatgctccagtacgaccaagcccagtcattacttcatccgcaataaataaaatatcgtaatggtcgcaaatctctttaatgactttataatagtctttcggcggaacaaccgcgcctccagctgctccgataatcggctcagcaataaaagcagcaatatgctctgcaccaattctttcaattgatctttctagttcagtcgcacatgccagctgacaagttggatataccttttgaacaggacatctgaaacaatatggagctggtatagtcggataatcttccaaaatagatacgaaacgttgtctacgtagtggatgcccagacattgataaagcacccatcgtaataccgtgataactcatccatcttgataaaattttatgtttcccttgaatacctcgctcttgaaaatgctgaattgcaattttcatagctgtttcattcgcttccgtaccactatttacaaaaaaactccagttcaaatctcctacacttaaatcacttaacttcttcgctaatttttcagctggttcactcgtaaactgtgatctataaacgaaagcaatctcctcagcttgctttttaataacgtctgcaatctcctttacgccatgcccaatacctgccgtaattgctcctgacgaaccatcaaaatatttattgccattttgatcatacaaataaacaccttttccatgtgaaatcattggatacggctgaccaacaagtggtttaattaagtaatcgcgcatagcgctcccccatttctccaatttgtatatatatatgaagaaaattgacgtttctttcataaaaaagaatcctctgcaaaagcagtgaatttatcaaaaaactattataaaatatacaaatgagtgcttaaaaaattttataaaacagaaaattcagaactaaaaaaccgaagaccaacccttttctatacgcccaaatgaccctcctttttatatgaaatgactgcatcaccaaatgtttttatagcataatgccagctgtccttaaataccgacattctgtacacttcgacggaactcccgttaaactccttcctattatcctactttaaattgcatattttaaaacaaatttcgacacccaccttactaatcaattcagattcctattcattatgtaaacttttcatttttaaactataaaaaaagaaccgattaaccacactaatcagttcgtcatgacgctctcttatgggttaatactgtcaattgctaaaataaatagaaaaatgaagtttacaaattcatcctacagtctataacacaaaaccttttcataacttcattcacaattactatcgggatatccctatcccgaagtggcactcctttcctcagattcaaagtatctttcctttataatttatgtaggacaattatcactttgtatgtgtatttgcctataattaaaaaaatccctagttttctagcgatttttggacatgtattcaatatgttaattgaaatgcactttcaatttggcatttattttactttcgtacagtcatatgtactgctttactctgtgaaattctcgtaagcaccagcacctctttatgaaaacatatttgttgtcactttttaattttccctttataaaatcattttttttgcataaccgctttcttgcttcgcatatagttttaatgatgacaaaggaggaatgttcatgtctcaatctgaaatcgaaaaatatggacaagaagttacgcaatacgaacagctcgcacgttactatcagtttcgtaaccctaaaaaatatatagaattatatatgaaatattacgatgcactatcaaaacttgtacaggcgtatgaaacaagagactcacaagaagctgctttaccatcacatataagaatttttcatgccgatccaaatataccggcggttgacattttagtaaacggacaaaaggttattaaaaatatttcatttaagcaattcagcccttatttatcattagtgcaaggtaaataccgtatagatattgttcctgtcggaaatgaaactccaatcttttcagcgttggtaccaataatgggaaatcatacttatactcttgctgcaataaatagtgataatcacctacaattacaacctatacttgataatacacatttaccagctggtcaagcaaaaatacgctttgcacatttctctccagatacccctgttgtaaatgtagatttaaaagatggagatcatttatttgaaaatgcactctttaaacaaataaccgattttttgcaagttagccctggtacagcagatattgaaatttcactcgcagataataaaaacgttttattgactataccgaaattcaatgttgaaccaaatgttatttatacaatttcaatagtaggttattcaactaaagatcctaaattagaagccgttatactcacaaattaaaacagtctacaccattcatttggtgtagactgtttatttttgaaatgcaatttgaaattctgtccaatcgttatctgatcgacacataatggatccattatgtttttccacaatttgtttacatacaaacaatccaataccagttcctaactttttagtagttacaaatggttcaaaaatcgtttctacattttcagctggaatcattggtccattattttttatcacaattcgaatagcttgatcttcttcaaatacatcaatgataatttttcgttcttctttcattgattcaagagcatcaattgaattcattaatatgtttaaaaatacttgtctcacttcactccgataaccaacaagcggaattggatacggtaaattcttttcaatcaaaacattcgcattgaccaaactcggatataagaattgtataatgtcttgaaacaagtcattaagccaaaaccgttccgattcattccacatttctttttttgatacgagtaaaaattgcgaaatacgaaaatttaattgatctaattcatgcgaaataatatctaaatacgataaactcggatgatctgcctttaataatttgacaaaccccataatggaagtaagcggattacgaaattcatgtacaaaactagctgacatttgtcctaaaatcgtcagtctttctttatgtgtttcgttaatatattgctgtttttcctctaaattcttcgatataatttccgagtattttaaaacggtataataaattaatttgtcaaaacaagtatgtatttttgccataattggtttcaattcacgagcgctaacatctaattcacacatcgcttcgaaaagttcatttcttcccacgtttgcgttataaacaaaatctccaatattcgcatctgctccagcacgttcaatagcaattttctcacataacggttgaagataatttatatctttatcttccatagtaagttcgataattaactctagtaaatcctctccattttgaactacttctagtttaaatggatctttttcggaaattatcattttgtttttccagttctctacgaattggtgcctattgtttttcaa

SEQ ID NO: 1287 - DNA, 10639 bp, Bacillus thuringiensis
tgctcacttactataaaaaattataataagaaaacgttcacatattttattataatcaagaagaaaaagtctcgtcaatttttatttgtctatacaagcttatttgtaagcagtgttcctttttctgtaataattttttctatgtttttatcaaatggctctaccggaatgtgttttaccatttgaaaatcatacgctaatgacagcgttttccctttataatgcacgagataacgatcataatagccaccgccgtacccaattcgctctcctcgttctgtataagctacgcctgggacaatttgaagatcaatttcatccatattcacttcttccgtaagcccgggaatcggttcacgtaaattcatatacaccgtttctaattgatcaaaattattaatttgccggaaggacatcgttcttgttcctttattacacttaggaactacaactttctttccttcttcccaagctttttcgataataggatatgtattcacttcattttccattgaaagagtaattccaattgttttagcttcaacccactctttttgcgcatacaacgaaaatacaatctgttctgataaagttgtatactgttcttctgataaagaattcatgtgttctattatttgtttacgcaaacgtactttctctgctttcacacattctcccccttacagtgacactttactctatgctgatagtgtatcacttttaacataggaatcgaataaaaaaagaaacagtaggaaaatattcctactgcttactttgtttcacggtgtaacgtagacttcttgtcacgcttgcaatactttttaagctcgatacgctcagcgttgttacgtttatttttctttgagatatagttacgatctccgcattctgtacatgctagagtaatattcacacgcattcttatttccctccagtactaataacttaaatcagactatactataataccacttttaaaataaaaattctacaccttttgatattgtctaattttttctataagatttttcatattttcccttgctattactgggtttctagcatgtgaatacaccaaaaattttggttgttttatgtcagaaacgatataagaccactctttttcagtatatttgaactgcactccttcaaatatcccttctcccttcctttctatatcatccaataatttcctcataatttcccctttttcattccatgaacataccacttcatcataaagtaaatagagcggaggtgattgctctactatgctgagaaacgtttttccttgcaatgctattagctcgaataattttccaatccgatataaaatatctcgcttccacctcacttgaaacgattttctttcatcctgcgtataaaatagaagataacattctcctaacttcaaagacattgggtaaatatttcctgtcgattcgagcaagaaatctggaatatctacctcttcaaaatctgtaccttggtaaatattactatgtttatcgtataactcgaaatgatttcctttctccgaaaacataagagccatattcgctttacttgatttcatcaaagctttcacatgatctttttgttcgcttgcataaatccatgtaactgtacaaccaagtctttgcagaaagagcataagtaaatgttgcaacgtatcatttctcttattaataagaagatgaaacttctgcatctgtattttctcgatatcaatatgctccaatataacttctatatactcattcatagaaacatgaacgagcttattacgccccatttctttctcctgcacgtaataaaacaattcggacatatatatttgttctatctctttttgctgcttatacgttaacggcatgccagcttgaccgtataactttataacaatctcattctcattctccacttgaatgaaaacaccacctgcacattgcaaatgatgaacactatattgaaaaagtgactcgttcatttctttacattccatcgtatgaatccctataccatgaatagcatgtaaaaataaatttttataagaggttgtttctatattttcttgacttccaattaatatactttctcctttttcaaaaagagaaccatacgccatcgcaatcttcacgataaactggggagtaatttcaacattccctcttcctacaatgcggcttttttgtaaccaccctgcactcatttcactctcttgaataccagccgctcctactatcgaatgactatcaatcgccttataaggccatagttttcctttttgcttaattaccgtacttctcccgatatgacagtgatccgctacaacacttttttgaaacagtgtaacatcatcttcaactattgtacgctctcctattgtcgtttctaatagttcacaatacttcccaatgtgggcattcgcaaaaacaatacttttttgaagatgagaataacttgaaacgatactatttttcccaataatagaatatggctcaattacagctcctgtaccaatctttgctccttctccaataaaagaggggccatgaattttcgtccctttaccaatcgtcaccccttcccccatccataccataggtaatacttctgtataaggaataggtacttgtaactttttcgttaacaaatcaaattgtgcttgtcgatattgattaaatgtgccgatatctaaccaataaccttctgacaaatatgcgaataacaaatttttgtttgccaataatggaaacacatcatgactgaaatcaaaaaattgcctaggcggtatgtaagaaaagatttctggctccataatatatatgcctgtattcacaacattagatactacctcattccagcccggcttttctatatatcgtgtaacctcctggtttttattcattacaaccaatccaaatgagagtggattttctacttctttcacaaacattgttaccattcttttcttttgttcatgaaacctaattccttctgataattgaaagtcagttaatgcatccccgcttatcacaacaaatgtttcatctaaaaattgttctgcttgtttaatactccctgctgtgccaagcggaggagagtcttcaaaataatacaagttaactccccatttactaccgtcaccaaaatattgcttaatggtcgtactcatatattgaacagtaattgcaatttcacgaataccatgctgacgtaataactcaatattatattctaaaactggtttttctaataatggtaacatcggctttggagtattgcatgttaatggtctaaggcgtcttccttttcctccagctaaaataacccccttcatatacttcagcctccacttatataatgttcagtaactccatataccatatgtatattccctatcccacatgaactagcagcataaacttgattagttaaacaaatcctcatttagaagaccatataattaaatttctcacctataaaaacgtatgtttcaaacaacaagaaagcgcttactataaattggtaaataatacttattaacgacaaacatatatactaatttttccattacattatgatacatcttatcatcataaactaaaggaaacaacgagctttttttgtcatgttttgactaaaaaaagcaggtgatttctcatcacctgcttttattcctactcattcaataaataatgctttccttttactaaataaaagacattttcagcaatatttgtaatatgatctgctacacgctcaatatatctcgcgacaaatgataattgtgtaatttgcgtaattgcttctggttgttccggaaccgacgatataaactcacgaattgcttttccatatatttcatcaacggaatcatccatttcagcaatttgtttcgcaaaagttaaattttcttgttcatatgcttctagcgctaaatgcaacatctcatttgcaaccgcaaacatttcatccaggttgtgcaaactaacagccacttctttttccccaagacgaattgtagcctttgcaatattaacagcatgatctgcaatacgctctaaatctgtcgctgttttaattgaaataaaaatccttcttaagtcacttgctacaggttgctgcttcgtaatgagcataagcgcaagatcgtttatttcctcttctaaattatccatgcggtaatcaccatcaatgacctctaacgctttctctacatcccttgtatgcagaccttccatagccatcaataaagccgcatttgctaattctccaagctcgatcaccttttgctgtaacgcttttaaatcaccttgaaactgttctcttaccatttttcttccccctcaatattatgtgccattatataaaagtgaaactttaatcaaccctcatcaatcgggatttgataggcagcaagatcccctccctaacttctttgctttcgctaaattttaaggtgggggtcttactgcccgcaaatagcggggtaaatctcctacatagcctcttgcgcttgtaataaaccttaagataaggagaagtattagttctctattaacagtaagataaaataagaaatgccctctgttaagagggcatttgctcttagctttgaaacgatatcaaccaaagcgacctgtaatataatcttctgtacgcttatctgaaggagtcgtaaataatttgtttgtatctgtatactccacaacttccccgcttaagaagaaagctgttttgtctgaaatacgcgctgcttgttgcatattatgcgttacgataacaatactaaaatctttctttagctcttgaattaattcttctacttttaatgttgaaattgggtctaatgccgatgttggctcatccattaaaataacgtctggctcaatagctaagcagcgtgcgatgcatagacgctgttgctgtccaccagataaaccgtatgcattatcgtgcaaacgatcttttaactcatcccaaatcgctgctccacgtaaacttttttcaacaatttcatctaatgtctttttgtcacgaataccatggatttttggaccgtatgctacattctcataaatagattttggaaatggatttggcttttggaacaccattcctacatgcgttcttaattcttcaactggatatgatttatcaaatatattgcgttctctatattcaattacacctgtagttcgaacaatcggtactaattctaccatgcgatttaatgtttttaagtaagttgatttaccacagccacttggaccgataatggctgtaacttcattctcatgaatacttaaattaatatcttttaaagcatggtcttccccataccataaatttaagtttttcgtatcaaatactaccttctttggcgcagtctcgattttctcttcgtttttcacctgtacatttactactgttgctaccatttgaattcccctttcatccacttccaacttattttcgatttcgtaaccataaaacaaatatattaataaatagcaacaaacctaacaaaacaatcatcccagctgctgctacatactgaaattcttcttgtggcctactcatccaattaaaaatttgaattggtagaactgtaaatctatcaaacatactaaatggaacataatttgcaaacgcaagtgccccaataactaatagtggtgcagcttctccaattgctcttgatatcgctaacgtacagcccgttataatccctgggaaagcatatggcaatacaatttgatacatcgtttgccacttcgtagcacctaatccgtaagaaccctctaataatacacttggtactgatcgaattgcttcttgactcgccacaacaactgttggtaaaacgagtagactcatcgtcagtgctgctgcaactatactctctcctaaatgaagagcatatacaaaaatagttaaaccaagcaatccaaatacaacggatggtactcctgctaacgtttgattattaatctctattatttttttaaatagagattccttcgcatattgctctaaataaagtgctgttccaactccaaatataaaagaaacaggtataacaatactcataaataatattgtccctgacaaagctgcagcaataccagcttctttcggattacgtgaagcgaaatttgtaaagaaatttattgaaagataacttatacctttttcaacaatttgaaacagtaacaaaaacaaaattaccattgaaaataaaattgctatataaaataacaatttgtaaattcgatcttttaaaaagcgtgatgccatgtttttttgtatttttttatgattcaacattcgcatattatgtcatcctcctaaaacggcgcataatagactgcgaaatgatgttcataataaaggtaaacaaaaataacgttgcacctacagcatacatgctgtaatacgtaatcgttccatgcggagcatcacctaaacttacttgcacaatataggctgttaacgtttgaatagaatgtgtcggatcaagcgatacattcggtgtggatcctgctgcaattacaacaatcatcgtttcaccaattgcacgagaagccgctaatataattgctgccataatccctgtaaaagcggacggaaacaccacttgttttaccatttcaaaccgcgtcgccccgagtgctaatgaagcttctttcgtccctttcgacacagctctcatcgcgtcttcagatagagatgcaactgtaggcatcatcataaatccgataacgattcctggactaatcgcattaaaaaactgtaaatctggtataagcctttgtaaaagcggcgtaacaattgttaatgcaaaaaaaccatatacaattgtcgggatacctgctaatagctctaacatcggctttaatattttccgtgcactatttgaagcatattcgcttaaaaatacggcacacgctaaaccgataggaattgctacaaacatagcaattgcagttataaggaacgttccacatatgagtggtaatataccgaatttagggtcttcaaaaaatggtaaccattctttctccgtcaaaaaggagtataatgatattttttgaaaaaacatgattgtttcattagagagcgtaaaaacaattccaagtgtcgtcacaatagaaacgctagcaattatttttagtaataaaggcactattcgattgattcgctgctttttttttctttgttttgtatttctttcaatcaaatgttgtacagaaaatgtaatttgacttttgtcattatgagccaaagatgaaaacccctttccaccctgacattacctttttatttctgttaacatacgcagctgttcattgtatttttcttttcgtaattttacatacccgacctcttcagcgaggttaccgacatgctgaatcataaactcaacatagtttgctacattcattttatttcggatagatgcattattcacataagcaagtagcggcctagataacggcttatacttacctgattgaatggtctctttcgtcggaaatacaccatttacttttattgctttcaccttatctcgattagccatataataagcatatcctacaaaagcaatggcatgtttatcattcattaccccttgcataataacttgatcatcttcagacaaagagactttttttacaatgcgatgattttgtaagatgacattttgaaaataatcatacgtaccagagtctacgcctggtgcataaaacttcacttgttcacgtggccatgttgaatgaatttgtgaccatcgcttctctcttccattttcactccaaagtagtcgtaactcgtctactgacatatcgtctacccatgtattatggcgattcacaacaatcgtaagaccgtcgttagcaacctcaaaaggtgtgaactgaatagagtttttcttcatttcatttttctcgacttgtttcattactctcgaagcattatttatatctacttctcctttactgaaacgattaaatcctcccccagttccagaaatactgatggaaattttcacgtctggatgcacctttgtatattcctccgctactgcttctataataggaaaaaccgttgaggatccatcaactctcacttctcccgtatcatttaaagcaaatgcagtagacatttcaaaacagaggaaccatattgataatacgaaaatcttaatcggtgtatgcatccatttcacgtgttcttcctcctagaagtaaccggaaataacaggattacagatataagaatactgctaaactattaattcggttttaattgtttgtaaaagttttgtaaagttccacaaaaatcaacatacgatacaattttaattcagtagtagctattcatttcctctgatgatttccctataaaatatttatcccctatcccaccatatacaagtatcatttatagggccgcgttttttaaatgttgtatacttgtccacatttattacacgatatgcataaaccataaaaaaaagcacactatcttttcatatagtgtgcttttttacaacttttttattcatcatcttgatctttgtttttattgtctttatcatcttttggagcttcaccatttacttctttgtttttcaaatcaaagtaagcgtccataatttcacgaccaatatatccattaataccagtcttatcatcatgtacccatggaacgacaacagagaatgctacttctggatcttcaagtggcgcataacctactaatgttaagttatatgtttccacacgttcaccttttgcatttctaccaatctctttatctccaccatacacagtttgagctgtaccagttttcccagcagctttatattttgcacctgtaaagtactttgtagctgtaccacctgaatcattatacacttgtctaaatccttcttgaacgcgtttaatttgcgattccggcatatcaatacgatttaatactttcggttccatagattgaacaactttcccaacttcatctggtttcactgccggttgacgaatttcttttacaacttgtggttgcatacgatatccgccattggcaatcgtcgaaatatattgcgctaattgaagcggtgtatacgtatcatactgtccaattgataaatctagtaagaaacctggttgactactcttacccatctgaccagcagattcattcggtaaatcaattcctgtttttacaccaagtccaaactgtccgaaataataacgcatcgtatcaaatgctttttgaggtatatctaacgtaccacctctcacatatggaacaccggcgatattcatcgctgttttaaacatataaacgttagaagacatttttaaagctgtaaggtcattaatgtatcccatcgttttccaagacgacttcgtaggtgtaccttttaatttaattggttcatccaattgtactgcccctggttgaatcgcaccagtttgatatccagtaagtactgttgcaccttttacagttgaccccatcggataagaacttgtcatggtacctaatgcaaagtcatttactttcgtttgaccatcttcgttaactaattgtttccccgccatagataaaacttcaccattttttgggttcatcattacaacaaatgcgcgatctaaaagaggttcacttcctttaaacctcattaaattcttcgcaagaatatcttccacgcgcttttgtaattccatatcaattgttaagttcaggtcattaccactttgtccttttgatacattaatcgtttctaaaatattaccgtttttatctgtaacatttctaacttctgctttcgtaccatgcaggctatcttcatactgttgttcaagataactttttcctactcggtcatttcgattgtaatcacgaacaagatagtaatctagtctttctctcggtaagccttcatcagatgtcgacaccccaccaagtacacttcggaataaatcatcgtacgtatattttcgctcccaatcaacattcgtatctacacctggtaatgctgctaggttttcactaataatcgaatattccttttctgtagcatcctttttaataacttgaggtgtcattgcatatccgccgtccatcttactcttaatcgctagtatttctagatctttggcggataattgattaatctcttcttctgttacacgacttctctgacgctcgtctaattctttatcatcaatttttttatctttaaactcttgacgatctttattcgtaattttttctttagcttcctctttatgcatagcaagccaataatcttttttatcgcgatctgttaatttatctgtcggtacttcaatcaaatctgctagctttttcgctgtttctaagcgatcctctgcagttgatcccttcatttttgtaaatgtaatagtacgaatggctgcattatctactacaggtcgcccataacggtcaaatattttcccacgcggtacaggattacttatcgttgagttttctttcttctccacttcattcttatattcttcaccgcgaacaatttgtacatatccgagccttacaataacagcggagaacattaaaaacacgcagaaaaaca

SEQ ID NO: 1288 - DNA, 8615 bp, Bacillus thuringiensis
ttttattattacttatcgtaaggtaagttaataacttttaggaggtttttaaaaatgatggatttcggtctacttattattcgtcttattataggaattacattcatgggtcatggcgctcaaaaattatttggttggttcggcggttacggtttaaaaggaacaggtggctggatggagtcaatcggtttacgtcctggtgtatttatggcatttatggctggcgcaactgaattactaggtggtttcttatttgcatcaggtattttcattgtagttggttcattatttatcgttggaacaatgttaatggctatcttcactgttcacggaaaaaatggttactgggtaacacaaaacggatatgaatataacttaatgttaatcgctgtcgctgttggtgtagctttaatcggacctggcgcatacgttttactttaatttttatctcaaatttgagattcttgaaaaaagaacttacttcattacaattgaagtaagttctttttatgaaacaaaatattatttccagcaggattttctcatcgttatcttgtaaacaaacaataagtattcatatttagaaaggggattacaagcatgttatccattaatccaaatgaacaaactgaaaaagatacttacaaattacttactggaagtatcatccctcgtcctgtcgcattcgttacttctgtaacaaaagaaggcgtactaaacggagcaccatatagttatttcaatattgtcgctgctaatccaccacttatctcagtatctgtacaacgaaaagccggagaaagaaaggacacttcccgaaacgcaattgaaaaaggagaatttgtcgtacatatttctgacgaatcatatgtagcagcaattaacgaaacagcagctaacctcccgccaaatgaaagtgaaattgaactagcaaaattaacaccaatcgaaagtgaagtcatctctgttccaggtgtaaaagaagcaaatattcgaatggaatgcgtattagaacgtgcaattccacttggcggaacggaagactcaccagcttgtgatctactaattggacgcgtcgttcgtttccacgttgccgaacatctatatgaaaaagggcgcattcacgccgaaggactcaaaccaataagccgcctagcaggacacaactatgcaaaattaggagaacaatttgaattggttaggccaatctaaaagcggaagcggctcgctcagaatcgcagggcacttcaagctctcgaccttgaagcgctttttgcttcatgcgagagagcgaaatgaccggagattctagccgctgaagctggataatatttaaaagtggaagtggcccgtttagctctgaccagctaaggttctctcgcacaaaaggtgctttttacctttcgtgcgggaggttcttagatgcgaagagctggccactggaactggataatatctaaaagcggaagcggctcgttcagaatcgcaggacacttcaagctctcgaccttgaagcgctttttgcttcatgcgaagagcttgccgctggagctggatatatttaaaagcaaggcggctagattcctcccatcactcaaatataaaatcccctgctttttagcaggggattttctcattgtaattcttccttcttttcctctaaagtaggcattttctcttttttcggcttccctagcttaattacgaagaagtatagggaaagcaatgtaataagaaaaacaattaaaaacgggtacggagagtaaaaggcacgcgccgcctcagtctttcccgcaacaaatttcaatgactcaatatctaaaaactcagcaaacatttgtacaccgagcatactaaaccaaaaaacaaaaaaactaataataataccaaaaacttgcttcaatctcgtcattcatctcatcctttctatatctgtaatttttagcgcaataaatatagtacaaacaaaatattcacagaaaggaactatctcaccattcacgaattaacttaatccaacctaacatcgaaatttgcaaaataataccccaaattataagtcttcttagccatcgaggatagaaggtcaaaaatttaacataccattccaatagcttgttcataattccctcctacataaaattatataggaaaaaggatatataatccaaacccaaccaaaatgataccacctactatctcaccatatgtaccgagcatatctttcgcatgtctcccaattaataaacccatccacgctaataacatgctaacaaatccaaaaagtaaaatcgtaataattgtttgtgccccataaataccaagactaagtcctactgagaaactatctatactgacgccaaatgcaaatacgaataaactaattccaataggggctgttctagtctcttcattttgtaaaatgctcgaatatacgatataaaaccctagtccgattaataaaatagcacccgcaaaatgtgcgatatctccatacttctctgataaaaaacgacctagtaccattcctataaacggcataataatatgaaatatccctatcgtcataccaatatacaggatttgtcttaactttaggggtatcatccccataccaagactcaccgagaacgcatccatccctaaggcgaatgccataattattaaaggtattagctgttcaaacgtcattcatgcccctccttggacgtgctacttcacaatatgcttatccaaggagaaatattctgtttgctaatcttaccttatcattcaataataatatgatgtcctgccgcttttgttaaacgattcataattgcattccctattccttcattagggaatgactcactaaaaataacatccacttcacttgcatcaaatgttctaagtacatcatataatttagtcgcaacactagctaagtcacttctaacaccacaagataatataacatctgcactatatacatgctgatactcttctgtcgttaatacgcctactttaaatccttcttcctttttctcatccacaagatgctgaataaactcacgtgagccctcaacaatactaagtggtgctttcggggcataatgtgtgtatttcattccaggcgatttcggtttttccttctcatcctttaaagctggatctaaagaaacagtacctatcaccgcttctaattgttctttcgtaatcccacctggacgtaatattgttggaaccgcgcttgtacaatcaattacagttgattcaacgcctactccagttgcaccaccatcaacaatacctgcaatcttcccattcaaatcttcatatacgtgagaagctaatgttggacttggacgccctgaacgattcgcacttggtgccgcaacaggtacattcgcctcttcaataagagcaagtgcaattggatgatcaggcattcttactccaaccgtattaagtcctgccgtcaccttctctgaaatcccttcttttctcggcaaaataattgttaatggtcctggccaaaaatgcgccattaacttctctgcaactggtggaatttctttcacaatcccatctaactgagattttgtacctatatggacaatgagtggattatcactcggtcttcctttcgcttcgaaaattttcgcgattgcttcatcatccatcgcatttgcacctaacccatatactgtttccgtagggaaagcaaccgcctcattttctcttaataattttgctgcttcttgtaactgtggataatatttttttctttccacaacattatccacaacccacatgtttgtatgcatttttttccacgtccttttctacccttaaatacttgtatatttttagtttactatgagatttatccaaaagacaaacaaggtttatccacaaaatgtggataaacctaattaatccgtggataactttgtgaatagctgacaatttagtattattgcattctgctcttttatatttttacaaaaatgttctagttgttgaattccctctggaacctcatccttttctatagtaaaaaagtcaaaaaactgaaagatcggtacagattgtggatgatttgttagtaagtacaattgttgaacacttttttctttcatatactgcaaaaacatttcaaaaaaatataagaaagtctgtttatccacatgaggtgtgaataaacaagaacgaataagcacatcttccccacttcgttcataaccaattacagctcgtatttcttccgcctcttccaaaatcataaattgtgcgtacaactcatttattttatcatcttttttattagcttgtccgaaaaaagaatgtaatctttccacatctgctttcgtagcaaaatacactttcttcataataaatccctcctcatttttatatatgaagagggatttattaatagtactatttagagaataaagatgtaaaagcttctacaataaacaatttaacttctggcttttcttcttcctcttctacttttacatactcattttgcttttcttgttttttctccacaggtttctccacttttcccacagtttttatttcttctttacttacaggctgctcttcgacttttgtttcattttttactactttcttttcagaagctgttactttttttactacttcctgctttacagctttcgtttcttttaccttatctactttcttctcttctttatctattacttcctcatctagttgtttcacctgctcctcttcaggagattccgccttcacaacgtgctcttcttttcttacagctgtcccgctcgaaaaatctaagaaacacattggtggaaataatacacaccaccagttcgccccttcaccttctccaattgtgattaatactgcttcatattctcctgctggataaataaaattcccgtatacctttgtaggaaactttacattcttactaaatttcacttgaaatgaatctttacttccttctctttttaacgtattttccaccgttttctcgatttctggaatatgactttgaattactttgcgtgcctcttcaaatgaagttaaatccgctacccacccatcaatttgtgcttttacttcatcacgcactttacgctttaatgcctggtctttatctgaatcactatttgctaaaattcgtaatcgaacggcctctttcggaataactgaaggccctttcgcatcagctttcatatatccaaactgcacaagtaactgtgcaccaattaatagtataagaagataagcaataacttgttttttcatttcctccaccgtcccttctacaaacagtgtggacagactttcatctttctaaactattaaattcaaaatctatatgaatttttccacaaaaaaatagagtaaggtgtgaaccttactccatctctgcaaataccatacgatcttttccgttaatatcgaaaacaacctcaacatgagcatgtggaaaagcttgttgtaacaatctttttacatcctcaccttgtcctactccaatttcaaacgccacaatcgctttcttctgcaacacattcggcaattcttccataaaacggcgatagaaatctaatccgtcttcaccaccaacaagtgctctcttcggctcatgctctttcacaacaggagaaagaccacgccaatcctcttccggtatatatggaggatttgaaacaacaacatctagcttttgacccgttttatgaaatggtgacaataaatcaccgtgatagaacgttacttctgcacctaaagcttttgcattttcttttgcaacttcaatcgactcttgtgcaatatctactgtatacacatgaagattttcattttctaaagcaagcgtaatagaaatcgctccactacctgtacctatatctgctacatgtagtttctcatcaccaaaatggcgctcgattctttctaatactcccactataagctcttctgtttccggtcttggtattaatacttcttcattcacaaagaaagaccgtccataaaacatttcataaccaatcatatattgaataggaataccttctacatgcttgtggataaactccgtaaagcttttctcttgatcctcagttatttcttcacgcatattcataagtaatcctgttctgttcacctttaatacatgacaaaggacaatttctcccgcattttcatctcgtccattttcctgtaaaaaagaagaagcccatttcagggcttcatagacacgcattactcagctgcctccatcttttgagcctgatcttccatcactaaggcattgatgaaatcatctaacttaccttgtaagatttgatctagcttttgaatcgttaaaccgattcgatggtctgtaacacggttttgcgggaagttatacgtacgaatacgctctgaacgatctcccgtaccaacagcttgtttacggttttgatcatactcagcttgcgcttcttgtctaaacttatcataaacacgtgcgcgtaatactttcatcgctttttctttattcttgatctgtgatttctcatcctgacaagatacaactacaccagtcggtaaatgcgttaaacgcaccgctgacatcgttgtattaacgctctgtccaccaggtccactagaagcgaatgtatcaacacgaacatctttctcatgaatatcaatttctacttcttctgcctctggtaatacagctactgttgctgtagatgtatgaatacgtccaccagattccgtttcaggaacacgttgtacacggtgagcaccattctcgaatttcagcttcgcgaaagcacctttaccattaatcataaagataatctctttatatccacctaactctgtatagctagcctcaataatctccgttttccagccctgtacctcagcgtaacggctatacatacggtataagtcaccagcaaataaagctgcctcatctccaccagcagctccacgaacctcaacgataacgttcttatcatcattagggtcttttggaacaagtaaaattttcagacgctctgataatgttttatcttgtgattctaactcagaaacttcttcttttaccatttcacgcatttctgcgtctaacttatcttctaacattgctttcgcatcttttaattgctcacgaacatccttatactcacgatacacctctaccgtttcctgtatatcagactgttcctttgaatattcacgaagcttatttgaatcactaataatcgctggatcacttaacaattcatttaacttctcataacgattttctacagcttgcaaacgatctaacacatcattcacctctacatcctagtatctaatacaaatagtatatggtacttactcaaaaaaacgcaaattatatttaaaagtggcggtggctctttcagctctgaccagctaaggttctttcgacctaaaggtgctttttaccttttgggcggaaggttcttagatgcgaagagctagccaccagaactagatatatttaaaagcgtaagcggctcacaccgctcattctctctattttgaaaaaaacccgccttgtgcagcgagttttacttatctttgttggggggtactgcatgacaatgacgacaacgcggttcatacgtttctgaagctccaactaaaataattggatcatcaaatgccgctggttctccatcaattaatcgttgtgtacgacttgctggagatccacatacagaacatactgcttgtagttttgtcacatgttcagcaatcgccatcagctgaggaacttgtccaaatggtagaccacggaaatcttggtctaaaccagctacaatgacacgatagccacgatttgccaatacttgcaccacttccacaatgtccccatcaaaaaattgcacctcatcgattgcaataacatccagctcttctgtaatatgttcaaatatatcctttgaagctgaaacaggaactgcttttacctttaatccgttatgtgatactacatcttcttcactatatcgattatcaatacatggtttaaatacaattgcatgttgttttgcaaattgcgtacggcgcacacggcggattagctcttctgacttgccagaaaacatactaccgcaaatcacttcaatccagccattttgatttattaagtacatgaagctctcctttcatctacttttcagttaaaagtagggtaaaggtataatattttcgcaaaaaaaacagacaagcgaatacatacacttgcctgttttatgtttttattacttaagaccgtatttcttattgaagcggtcaacgcgtccgtctgcagtagcaaacttctgacgtccagtgtagaatgggtgagaatcagaactgatctcaacttttagtaatggataagtgttaccatcttcccactcaacagtttcgttagatcctttagtagatccgcttaagaatttgaagcctgtgtttgtgtccatgaatacaactttcttgtaatctgggtgaattcctgctttcattcttttcatctccttccgccctgaatcattttcgaaacagagtttttcatcttcagctgcatacacaactatattgatgaaacacat

SEQ ID NO: 1289 - DNA, 11368 bp, Bacillus thuringiensis
aatataaccagcgagtggtccaatataatcatatgcatatttactaaaagaaccagcaacaggttgttcaattgccatttccccaagcgctcgcataatgaaaaaaataacgagaccggcaatcatatagcctagcaaaatagaaggacctgctagtttaatggcggaagcggatcctaaaaatagcccaacgccaatagctgagcccagtgacattaaagtaatatgtcgttcttttaaaccacgatttaaagttccagatttgtttgtgtgctgcataagaagaatcccccttgtagagtgaacgatatttgaatgcgtttactaaatatttaactatttcaaattataaaacatttctatctgttatgctacaaaaataatcataatgaactgtactacatctgtacttgtcagacttaaacttaaaattcgaactattagggaatatattgactctttttttattgattgttaagattaagtattatattttctcgcatactagtaagaaaaagaatgtgtgataataattcaggtgtaggaagggtacataagcatgtttcaattacaaaaatataacacttctgtgaagcaagagtttttagctggcatcacaactttttttacatttgcgtatattcttgtcatcaatccaaaaatattatctgatgcaggtgtaccatttgaccaagcgtttacagcaacaattattgcaaccgttgttggaacagtaggtatggcgattttcgcgaattacccaattgttattgctccagctatgggaatgaatgcatattttgcttattctgttgtacagaaggcagaagggattacatatgtagttgccttttcagctgtatttgtaacggggattatttttcttttattatcttttacttcgtttaggcaaaagttaattttagcaattcctgatagtttaaagcatgcaattgcaggtggaattggactatttattgcttttattggattgcgcctttctggaattatcgtggatcatccgtctaatttagttacgattggtgattttcattctccagctgttattttaactttaattggtttaatattagcggcggtattaatgacattgcgtgtgagcggtgcattatttattagtatgattgtgacaggaattattgccttctttacagggcaattgaagtttgctgataaaattgtggcgatgcctcatttaccagagggtatcatcgtttcaaacccaatcaatgccttttcagatgtaattgaatacggattatacggcgttgtattttcatttttacttgtacttttattcgatacaacaggtgcattactcggtttaattaaacaagcaggtttaattacagacaatacagagaagcgttttggtaaagcgtttattgcggatgcaattggcgggactacaggttctatctttggaacaagcccaacagcagcgacgattgaatcgtcagcaggtattgctgcaggtggtaaaactggattaacagggattgtagttgttggtctaacaattataacggcattttttagtcctgttattgcttctttatcaagtgtagccgctattacagctccttcattaattatagtaggtagtttaatggcacaaagcattcgagatattaattggaatgaatttgaagatgcgttaccagcatttttaatttttataggtattccgttaacatctagtattgcaaatggaatcgcaattggatttttagtatatccagtcttgaaaattgtgaagggtaaagggatggaagtacatccattactatacttatttgcattcttatttggatgtcatttattcttataatataaatataggagagggccttcttatgggaggctccctttttgtgtataataaagtgaaactatgagcagtaggggatatcctcactgtgtattagcccgcaccaatcgggataagatgaaaacttaattggttttgtaaaatataaattacttaacggaatatatatgttacaatatagatagaggaggaacatgaatggctgtaagtaaaataaaagtcgcgcgtgttcagttagatttaacacagcaacaattagcagaaaaagtaggcgttacaaggcaaacgattagtttaattgagaaggggaaatacaatccatctttagatttatgtttaaaaatttgttatgcagtagataaaacgttgaatgatttgttttgggaggaaaaggagtggtaggatgaaaatcgtgaaagatgaacgtttaatgattgaagggttaaaacatattagattagctttcatcttacaaaatatcgtcatactagctatcgtcttttaccgctatgtcttgcatggtgcaggatatgaaagtgtttcggatttattaatggtatttatgggcgggataataattattaactttttaaatctgaaaaattcagtggaagtgtatgagcatacgggcggagtgtcgcgtcgttattttatgaagctattattcattccggtgggtattattattgggattttagctatttgtatcgttgtaacaccagatatttcgataaaggaaattagtatgacaggacttattatgtttgcttgttttttagttcctagtttgtttatatacatatatatgaaaaaaataaaaagaaaagattgaaatataagaaaggctttcccgtattgaggaaagcttttcttatatctttttatacaaaactttatgaaggccaattggttcaagttcaaaaatttcaccatgctcctgaaagcctaatcgcttgtaatagtcagttacagtaattcggccattacaccataacatatttgcttgacgctcttgtaagatttgttctgcattctgaattaaggagcttccagcgtggttgtttcgaaactcaggtaatgtggccattcctcgtagacgataatgaataccggctggtaggtcagggtatatttcttttgagaaggaagcgatactaattagttcatcgtttataaatgcgcctaagtggaaggtgtctgtttcataatcggaaggatatttacaatctgctaatgtttgattggggcgtaaaattttttgacgtaatacgtaagtttcagatccctcaatatttttcacgataatcatattaacatcctttcttataaggccttttctgttaattgtataaagaaataagcaggtgcggcgagaagtccgagtatgctagcagttccgagaaggagtgaaagtaggaggcaagaatattttattccattcgattttttccatccgtaactacaaatctcaatactaacaccgatgagaataatggcaacgagtatttctgctaataataaaagagctaaagttacaatagacataatgtgatccatcctcataatatgtgatagtaacattttaccatatgaagttaaaaaaatgcccctcaattatgtgaggggcatttttttactctaatatgttttttagtgtatcgatatgttcttttgaacctgttacaagtaatgtgtcaccgtgttgtagtcttgtatcaccatgcggtattaatgctttgttaccgcggtagatttgaatgacaagtacatcacctaaaaacgggaggcggcgaagcgcaacgccgttatatttattgctgcgcagttcaacttcacgtactgtttcgtttgctgttgtaattaagcgaacgagactaggtttatcaataagtgcacgtaataaaatacgtgtagagttaattgttgagaatacagcgatatgttcttgcgttgctttttcttgtagaagtggatcttctacacttgcaataacatgttcaacacctagctcttttgcatgttctgccaataataagttttgttcatcatcgcttgttgcaacaacgacgcgatctgcatcaaatgctgtttgttcagttaatgatgcgattgtgatgtcatctaatttcacgatagggaagtcatgtgatttcgcttcttcatcatttattttgttttgacgcatcatatatagcgttacgtcataatcttctcgttttaaatctagtgataacggaagggtaattctgctcgcgccaataatagctacttttggttttggtgtttctacttttgggaacatttttttaaacaatataggtgcaaaaatacaagtaataactgcgcttaaaataagagaggcagataaacttggactgatgatctccagtttttcaccaatttgtgcagccgcaataactaaagaaagtgtcgatgttaataagattgcacttccaagtacgatattacgtggataccattttcttaagacgagtgatggtaagagtttcgaaataaagagtcctacaattaagattggaatcattagcatgctagaaggttctttgaaaatagaccacacctctagatttacaccaaccattacgaagaaaatagggatgaagaaaccatagccgatagaatcaagtttttccaccatatcttcatttggtgataataacgatacaagtacacctgctaagaaggcacctaaaatattttctgctccaacagattccgataacccaactaagattaaaatgagtgcaaaaacagctcgtgtatcaatttgtacactaccagcttttaaactatctaagtatggaatgtttttaaagcgttttgcaataaagtaaatgacaataccggcaccgaatagaataagtaagagccacatactttgaccgctttcggaatttaatccgacgaaaacagcgagtaaaatcattgtaactaagtctgcaataacagcaactaataaaatgatttgtccgattgcagtttttcctaggttgttttcttttaatgttggtacaacaacacctaaagaaatagttgaaataattaaagtcatgaacattgcattatctacaaatcctagccatacgaatagtaatgatagggcataagataagatgaaaataaataagaagataatgcttgctacttgaaatgtatttggctcgtttgtcgtattttttttccctttttgtttaaagatagaaaaatcaatttctaaaccgcttaagaacatgaggaagataaatcctaatgttgataaaacttgaagccatatatctggctcaataatattaaacccacttttacctacaaagattcctgcaataatttctgcaacgacaacaggaagtgcttttaatttaaagcgttgtaacaaaaggggaacgaaaaacgcgattgcaacgacaaccataagtgatagaacagaagtatgatgttccattgcgttctctcccttcaaataaatatagtacctatttagccatataataggtagaaaagcaacgcatatggattcgatttcataaagaaagatttttcttaacatttgtcataataagtatatttttcatgattctgttgttaattccgtaatgtggatgtaacaggggaggggataaaaaaagactgctgaggaatctcagcagtctttttcatgtacattacattgagaagaagatccatacagttaaaccaactgttgcagttgcaacgaagaaactgtatatcattgtaagaatttgaactcttccttctccttcttttaaatgcatgaacataattaattgtaacaatgcttgcgcaacagccattatgataatagttgttaagactgttgaaagtggcaatgttgtgtaaagtgccacgtataacgctagaaacgttaatgcaagcgataaaataaatccgaaaacgtgtgaccaagggaatccgctatgcgcatgcccgtttgcttgattgttgttttgagccatttacgccaccatcccgttcaagtaaactagtgtgtaaataaagacccaaactagatcaaggaaatgccagtataagctgataatgaatactttacgagctgtaactggtgttaaacctcgttttaaaatttggataataacacaagttgcccaaatgataccgcctgttacgtgagctccgtgcgttccaagaagaacgaagaatccagataagaaagcacttgtttgaattgttgcgccttcaccaatgtacataatgaactcttcaatctcaaagaataggaaacctgcacctaaaagtaatgtaaggacgaaccatccaagcatcgctttttggttatgcttacgcatttcatgaattacgataccgcatgtaaaactacttgttaaaagtagtaatgtttgaattaaaagcgttttaagttcaaacaattgcgctggtgttgggccatctgccgtacgaccagcaaggactagataagaggcgaaaagtgttgcgaacagcataatttcagccccaagaaaaatccagaatcctaggatattcaatctgctttgttcggattgatattccaaaggtaagcttttatctaaagccgccatgtcatttcacctctcatgctatatgttctgtttttttaatttcatcaacactgatatagtaaccttcatcataatcgaatgaacgatagattaagcaagctaaaataccaactccaccgattgctgcaagccagaaccagctaaatactaatgcgaaacctgcaagaccgaagaatccagacgcaataataggcacaccagagttacttggcatgtgaattggtttaatatcttctgctgctggtgtaactgtttctccgcgttttttcatgtaccagaaagcatcagcttctttaatttcaggaagcttcgcgaagttgtaatgttgtacaggagagtgagttgcccattcaagtgtacgaccatcccatggatctccagttgtgtcacgttcaccgtgacgtgcactccaaattacgttgtagcaaagaagtaggaagccgatacccatcattaccgcaccaacagatgcgatttggtttagccatccccatccaagactttcagagtaagtgtacatacgacgagtcataccgtctaaacctaagaagtacattgggaagaaacagatgttgaatccgctcataaagatccagaatgtccatttacctaggcgttcatttaacatatgaccagtcatttttggataccagaatgtgaatccagcaagcatagcgaatactgtacctgcgattaatacgtagtggaagtgagcgattaggaagtagctgttatggtattgataatcagcagctgccattccaagcataacccctgtaaccccaccgactacgaagtttggaataaatgccaatgaccaaagcattggaactgtaaaacggatacgtcctttatacagtgtaaacaaccagttaaagatcttaacaccggttggaatcgaaatcgccattgtcgaaatcgagaagaatgagttaaccgctggacctgcacccatcgtgaagaagtggtgaagccatacgacgaaacttagtaaagaaattgcaaccattgagtataccatcgcactgtaaccgaatagacgcttacgtgagaatgtactaatgatttcagagaaaataccgaatgccggtaaaataacgatatatacttcagggtgaccccatacccagaacaggttggcccataacatcggcataccgccgctcgccatcgtaaagaagtgagcatcgaatagacggtcaaatgtcattaatgcaagagcaactgttaatactgggaaagcgaaaataatgataattgttgtaattaagattgaccaagtaaacattggcattctcattaaagtcataccaggtgtacgcatttttaagatagtaacaaggaagttaataccggtcattagcgtaccgagacctgaaatctgtaatgcaattgcgtagtagttatttcctacgcctgaagtaaactctgtacctgccattgggaagtaagaagtccacccagcgtctggagaaccaccgattacgaaagcgatgttgaataacattgctccgacaaagaataaccagaaacttaaagcatttaagaacggatatgcaacatcacgagcaccaatttgtaatggtactacaaggttcattaatcccataacgaatggcattgccatgaaaagaatcattactgtaccatgcgttgtaaagattccgttatagtgttcagcgtttaaataagttgtttctgggaatgttaactgtgcacggatcattaaaccatccataccaccacggaataacatgataaccgcagaaataatatacatggctccgatttttttatggtcaacagttgtcaaccattcgtcccaaagccatttccattttttatactttgttagtacgaaaatgattgctaatgtcacaagaacgatagaagcgtctgcaccgtaaataatcgggtcacctgtgacaaagaattcatcaagcttcactgtgttcactccaatctgttggaataatagctattattttttgtttttgtagtagttataatcacaatattcaagtgattttggatctacataacttaagtggtgactagagaatgtcatacgaccaactacacctggtttaacaatttcgttgtacttagcttctgttagtttaggagcagtttcttgtacttctttaacccacttgtcatatttctctttagtttttgcttcaacttcgaactccatgtgtgtgaatccttcaccagagaagttcgcactacggcctaggtaagaacctggcttatcagcttgtaaataaagatccataatcatgccatccattgtgtacttcataccaccaagttctggtacccagaaagcattcattgggccgacagaagtcagtttgaattgaattggtacaccagctgggatgtttaaatagttaacggtttcaattttttcctctgggtaactgaataaccatttccagtttgcagatgtaacataaatttcaactggtttaatatgtttggactctttcggaacctcttccgaagcataagttgcttttactgttggaatcgataatgcgataacgataataacaggaacaagcgtccaaataatttctagtaatgtgttaccgtgttgttcaggtggctcatagtccatattctctggtttttcacgataacgaatcaagatgactgtaaacagaatgaatacaattgcgataattaatgacataagcaagaatgaccaaacaattaaatcatactgtgcttttgcaacaggtccttgcggatttaatactgcgagttttttatcacagccaccgaggaacagaagtaatgataacggaagaagtgaagccaacttccaaaacgctttctttagttgcacgattgaaaatctcctttctccttggattgaaactatgccaataaaacaatataaacctattaatttatagaaggcaatagtttttgatatattgttaaaaaatagacacaaatgcacactttttaaggtgaatatcatttgtaacttgattacattgtaaactattttccagagaaaaacgtgattgtgaaaattttaagataaataaagttataccaggatatccaagaaatagaaaaaagctatcttatgataaggaagatagctgaatattttgtatatttagtttatttcttgtgtgacagttcgtggctgttcaagtgtgacaatttttttatatttaacttggtataaaatgtaacaaataatcataaatggaatgccgcaataaagagcaattctttgatctggaatgaaagccaaactaacaaatgtaatgaaattgagcgagaacgctacgattggaacgagtggatagagcggtgtacgatattttaaatcatttatgttgccaccatttttcacgaaatttctacggaagaaaaactgtgaagcggcgattgacatccaaacgacaacggcagccattgctgcaatagatgttaaaactagaaagacagtatctgccgcaaatacacttgttagtaaggacaggctagcgaaaattaggctgaaaattaatgcatttagcggtacaccttttttagttaatttcgtaaatgctgggcttgccattccttgttttgccatcgcccacagcatacgagaatttgcatatagaccagagttagcaacggataatacagctgtaataataacaaagttcataatatctgctgcatatgggacaccggctacatcaaatacaagtacaaagggactttcaactagattagcctcttgccatgggagtaaacctacaacaactgatatcgctaagacgaagaagaagagagttcgccaaattgtattttttattgcttttggaattgttttttcaggattttcactttctcctgaagcgattccaattaattctgttccttggaaggagtaatttactgtaatcatcgtaagaagaacagctaatgcaccgttgggaaatagcccgccattttcagtgaaattatgaagcattggagctggctttccattaaagtctagtagaccgaacataacagcgccaccaagcacgatgaaaatgacaattgtcgcgacttttacacttgcgaaccaaaactctgcttctgcatatgcttttgctgataaagcgtttacgaggaagagtgctgctgcaaatgtaacgcaccaaatccaggaagaaacgtctggaaaccagcgtttcattaaaatacttacagttgttaactctacgccaactgtaacagcccaatttaaccaatacatccaaccgacaacaaatccaaaaccaggtgaaatgaatttgcttgcataactttggaatgaacctgcttctggcatagcaacggataattcaccaagacataacatcgttaaatacataacaaatccaccgactaaaaatgcaagaatagcaccaccaggtccggcattatggacgatttgaccagatcccataaatagcccggttccgataacaccgccgagtgcaatcataaataggtgtctacttttcattgttcgttttaaatctgtttgttcaatttgttgattcatatgcccctcaccccgtattttcttgaatgtgtaaacttcgttttattctgagtttttaatcattagtgggggatgcaaaacacactcggtttatttgctatgaaatgaatggagtatgtaaaaaacgaactatgactaaatactctaagaatgtttgttaacatggtgatatcttcactatgttcacagctccgatattagcagattactctgtgcaggtatatatatgctacaccgtattaaaaattaatagaacttatatactatattctatgagccacaatcgacatgatctttctagccaactcgtcgcactaagggcacaatgataagaggtgtatctgaaaataatgattaatggag

SEQ ID NO: 1290 - DNA, 7103 bp, Bacillus thuringiensis
  unsure (1)...(7103): unsure at all n locations
caatcgaattacgccgtactttaggtattgcagataaggacgctcttgaaatctatgttgatgacgaaaaaatcatcttaaagaaatataaaccaaacatgacttgccaagtaactggtgaagtatctgacggtaacctttctttagctgaaggtaaaatcatcttaagcaaagaaggcgctgagcaaatcttaaacgaacttcaagattatatcgaaacagcaaaataagcttctcaattatgagaagcttattttttatcgacatgatagatttgatatacatctcttttcgacaaatctcgatctttagcgactgttttaatcgcttcttttgaattcatacttttttcatttatataatattcaatatgatcatataccgaaagagattcccaccattgttcttctggaacaggttcttctgttgaaccagctactaaaatacaaaactcaccacgtacttcattttgcttcgtccactcaattgcttcttcgattgtccctcgaataaattcctcaaattttttagttaactctcgacataatacaatctctctatttcccaacacttcctgcatcgaaattaaagtatcgtctaaacgatgaggcgcttcataaaacatcattgtagtttgtacataacgaagcttttctaactccatctttcgttcctttttgtttctctgcaagaaaccatagaaataaaactgctttgtttcaagaccggatgcaattaatgctgtaagggctgcatttgctccaggaagcggaattacatgatattgctcagctactgcctcaacgacaatatcgtaacctggatcagaaatacacggcataccagcgtcgctaacaagtgctacattctttccatcctctaatttctctaatagtttcttcccacttacttctttattgtgctcatgataactcgtaacaggtgtttcaatttcaaaataattacaaagttttttcgtttgtctcgtatcttcagcagcaattaaatcaacttcttttaaaattcggattgcacgaaatgtcatatcttctagatttccaataggagttggtactaaatataaaactcccttttcattttgttgaaagcttttttgttgccacatagcgttctcctttttgcatatatgcctctttttgttttctcgttaattgcttaaagtaatactccgcttgcatagctgtacgcttatcatcgtgggtctctacatattttaaaacaacaggaagcctgacgcgtgtatacttagcccctttgccgctattatgagtctgaattctcttttctatatggtttgtatatccagcataataacttccatcagagcactctaccacataaaaaaagtgcttattcttctccatataaaatcgaacgtagctcctttgtatattcgttattgctctcatatacaacgagaggcggtaaaattttcaaatctgcatttccatccttaattccttcaattaacaatgtatttgcttcttttccaaccttaggataaacaaattgcacacgctttggttcaattttatatttacgcattaatgtgacaatgtctagtaatcgccctggacgatgtacaaacgctactttcccaccttgttttactaactgactacttacagatacaacatcttctaatgtacacataatttcatgacgagctatcgctaaatgttcattcatatttttctctgaagtttgaggtgtttgaaaatatggtggattacatgtaacaacatcatattgatgacgcccaagtttctctggcatatctttcaaatctccatgtatgaggtgaattctttcctccaacccattgtattgaacacttcttactcccatatcatataagcgttcttgaatttccaccccagtaatatttccttttgttcttgtacttaatagaaggggaacaaccgcgttacctgtacacaaatcaagtaaattccccttttgaattggtacccatgcaaaatctgcaagtaaaacggcatctaaagaaaaattaaatactgatgggctttgtataatcttcatgtcttgtgctaataagtaatctaaacgttcatcttcatataaattcatatactgctccttttcttacccttaacctaccctatttcatgtataaaaaattacctttccaattataattggaaaggtaatttcactttttatttaagaatgacagacagaataaacaatctccctctttacgtacacttccataatgtagattgcaaatatgaaaaccttcttgatacagtctcgctaaattgtcatagccttcaccaatatctgttttcggcttcacttctttacgtttttgagttttttgtttttctttattctgcacttcttcaaaacggtgtcgcaaattgttattttccatttttatatgctggttttcttccaacaactctgcaagatgctgttttaactctcccaactgtttatataaatgtccaatttgctcttccatactagaaaccgattcaaaaatatcttttttctccacaagcacccacctcattaatctgtggtttgactcgaaacgacccctttattcactaactcatctaacgtatattctactatccgttccttgtctactagttccacttgaattaatctttctaaaatatttaatccgataacacggccagtaccatgcggggtttgtatacgttgatctaaatcaggaagttgttcctttgctgcctcatattcatcattctcatattttaagcaacacattaagcgaccacataaaccagagatttttgcaggatttaatgataaattttgatcctttgccattttaatggatacaggttcaaaatcccctaaaaaagtagaacaacaaagcatacgaccacatggaccaataccacctagcatcttcgcttcatcacgaacaccaatttgtcttagttcaattcttgttctaaaaattgcggctaagtccttcactagttcgcggaaatcgatccgaccatccgcagtaaaatagaaaataatcttattacgatcgaatgtatactctacatctacaagtttcatatcaagattatgctctactaccttttgttgacagacttgatatgcttctttggcagcatgtttgttctcttcaacaatggtacgatcattttcatttgcaatacgaataaccttttttagcggtaatacaacgtcgttttcatcaacttgttttttggtaataactacttttccgtattcaatacctcttaccgtttctacaatgacaaactcattttcagagatatcgaactggtttggatcaaagtaatatacctttccggccttcttaaagcgaacacctactacatcatacaaaacggtcatccctcctgcaaccgcaacactaactgttcgaacacaagctgcgcatttacattagcgttgattctattttttgcctctaatatattaaagagagctgatacaatgcgcttctgagcataggaaaacgattcaaacatctctttctgatcatgaaaaacaagacgatcttcttctccaagttgaacatataataaatccttataaataaggagtaacatatctaaaccttgctgtaattgttctttctctccaaagtgttttccccatttttcttgtacaaaaaaaatagaggttttatctttttcgagcgcttcacataattttatcactaaagctcgtgcttgtgcaaaccattcatcactacataaagctaaagcttcatcaaaactatttgtaagttgagcagcaagtgtcgataaagatgctgtaatcccttcatcctgtaatcttctaattaaagattccgtaggtaacggtctaaacgtaacaacttggcaacgagataaaatcgtatttaaaatttgatgactttgttcagtaagtaaaatagcagttgtatcactacttggttcttctaaaaatttcaaaagtgtatttgccgcatttgctgtcatacgatctgcgtgctcaataatatataattttttatttgcctctaatcctgtttttgaaaactcttcttgtaaatcatgaatttgctgctttttaatagataatccgtctggttttacaatatgtaagttagggtggttacctgaatcaattcgcttacagtttgtacatacatggcagggctctaccccattccgctcagaacagaggaaactctttgccatttgaattgctgtcgcaaactttcctgtccctttccctccctctaacaagtaagcgtgggatatacgctcttttgcaatgctattcatcaacatttttacaccgatgggttgtatagcagaaagctgctcccacgtcttcgtcataatgcatacctcacttatttcattctttccttctattataacaatttatcttctataatctgaacaacttcttctataagtttttccatcggctgatcagcatttaccaatacaatacgatccgagaaacgttctacaacttgtaaatacccttcgcgcacacgtttatggaaagagatatcttccatatctagtcgatttacttcacgtcctgcatctttttcaatccgagccaaaccaacctcaggctcaatgtctagataaattgttaaactaggcatacagtcctctgttgcgaaacgatttatttcaaataccttatccatacccaatcctcttgcatagccttggtatgctaaagagctatctataaaacgatcacataacacgaggtagttctcattaagtgctggcataactttttctactaaatgttgtctgcgcgcagcagcataaagaagcgcttctgtacgtgcttccatcatcgtatattcttgtttatgtaaaatcgtcctaatgtcctcagaaattgcaataccgcctggttcccttgtcgccattaccttttgtgcttttttttcaaaatatggcaataagcttttaattaacgttgttttacctgaaccttctgggccctcaattgttacaaataatcccttcatcctaaaacctactttctatatcatacactttcatatatttcgtattaccttgaaaacgagctcctgctctctctaaatacataatttgctctttatgctctgaagtaattctctctccatacataatcaatggaattccaggtggatacggaatcaccatttccgccgctatcattccaacagcctcttctatagatactatctttgtttcatatccgtctagttgtttatacgtatacggtaaaagagagaattcacctttataagtataacgaatagattccctcttgtctttcacctcataatgttgcaatgctactcggatcatctctataaccttcatatatccctcatttacttgtaagggtaaaataaataggacattgtacggatcagccatctctgtatatataccgaccttttcaaatacagactgtaattcgtaccctgataactgacaacgagtttgtacggtgacctttaactcatcttgcaacggatattctaaaatggcgatttggggaatagaacgtaattgttccttaaatcttcgtaaaaactcaacaatttcactgtgaccttcttcttttatacgcgccattgtaaagcgtgctatatccaaggaagccataattggatacgatggactactagattgtagcatacttaaataagtagtaaccttctcttcgtctactaagtgactatttatatgtaaataggaacccattgtcattgcgggtaatgttttatgtgcagaatgaactacaatatctgcaccatatgttaatgctgactttgggaatggttctcccaagcacagatgtgccccatgtgcctcatctaccaaaacagggattttatgtgcatgtgcaaaagcgatgcttgcctctagatccatacccataccataataattaggatgcgttaaaatgagtgctttcgcatttggatacttttcaattgctttcttaataatttcgttacgaactcccaccggtacgttataagcttcatcaatccatggatctaaaaaaatgggatttgctcccgcaagttttaaagcattaataattgatttatggcaatttctttgtacaagaacaatatcatgttccccacaacaagacaaaatcattgctaagttcccgactgttgaaccattaattaaaaaatagctcctctttgtattataaacttcagccaataattgttgtgcctcatctatacattcaaacggactatgcaaatcatctagtcctgctaactcagttacatcaatagatagaatatctttaaactctcttattgcctcctgagggaagtttaaaccattcttatgacctggaacatgaaaggataacggccctctttctttaaactctattaacgcctcatataaaggcatacgattttgattcatctacatctcttccttattattcattctctatctattatacagaacaaaaaaaataataggcatatgcctatttaaaaatatgatacttctaattttcgaagctgctttaaataatgtatatatttcggatcatctgtctctgtattcaccatatccttttcacattcatagcatattaaattattataaacatatataccttcttttctttttgtctcacaaacaatacaaacttcactttgtaatttcatagccttccctccctattttagtgaacctattttatacttctaatccttaacaatttacagaaaaatatacacccatctcttatataatatgattaactcttgggcaacgtgtttgtatcacccttacttctttcccgttctttttaacaatacaaaaaaacacaaatcaaatgacttgtgtttttagttgcttggcgacgtcctactctcacggggacggggtcccggctaccttcggcgctagagagcttaacttccgtgttcggtatggaaccgggtgtgacctctctgccgtcgtcgccgagctttgggggcatgttccttcggggctggttnncttttgctgcgtgttttttggttcggtcctcgttctattggcccccgtcggctc

SEQ ID NO: 1291 - DNA, 7984 bp, Bacillus thuringiensis
ttgttgttatgatctattccaacgatacattacctgaggtgacatcagctcctggaagcgtggcgcaagtacgtgaatgtacagcagaattaatgaaacttgcaaaaacaaagggaatcccaattttcatcgtaggacatgtgacaaaagaaggtgcaattgcggggccgcgtatgttagaacatatggtcgatgcagttctttactttgaaggagatcgacaccatacatatcgtattttacgagctgtaaagaatcgttttggttctacgaatgaaatgggtatctttgaaatgaaagaacttggccttgcagaagtcttaaatccttctgaaattttccttgaggaaagaccagttggagttgcaggttcaacagtagttgcctcaatggaaggaacaagaccagttttagtagaaatacaggcattaatttcccctactagctttggaaatcctcgaagaatggcgacaggaattgatcataatcgtgtctcgcttattatggcggtactagagaaaagaacaggtttactattacaaaatcaagatgcgtatttaaaagtagctggtggtttgaaattagatgaaccggcaattgatttagctgttgccttaagtatagcttcaagttttagagataaatctacggcaccaactgatgcggtaataggagaagttggattaactggagaaataagaagagtatcaagaatcgaacaacgtgtacaagaagcagctaaattaggatttcaacgtgctatcattcctagaaaaaatttaggggggtggacaattccagaggggattgaggttgtaggtgtttctaatttaggagaagcgcttcgtttgacattaggaggctaggctatggaagaaaataagcaacgtgtcaaaagtataattaatattttacagctcgtggccccgggaacaccactgcgcgaagggatagataatgtacttcgtgcacaaacagggggactaattgttcttgggtataatgagcagattaaaagcattgttgatggtggttttcatattaattgcgcattctctcctgctagtttatatgaattagcaaaaatggatggagcacttattttaaatgaaactggaagtaaaattttaattgcaaacgcacagttagttccggattcatctattgattctattgaaacaggtatgcgtcaccgaacagcagagcgtgtagcaaagcagacgggcagccttgttgtggccatttcacaaagacgtaatgtaattacgctatatcaagggaacttacgttatacactaaaagatataggtgtcattttaacgaaggcaaatcaagcaattcaaacgctagaaaaatataaggctgtatggaatgacggcattacgaatttgggtattctagaatttgaagaggtcgttacaatgtccgaggtggttcacgttttacatagtgttgaaatggtgctgcgtataaaaaatgaaatattgagctatattcatgagctaggaacagaaggtaggttaattcgtttacagcttacagaattactagctgatttagaggcagaggcagcattgttaattaaagattatcaccaggagaaaacacaagaccatcatcaaatcttgaaaaagttacaagatcttgcaaatacacaacttttagaggatagtgatttagttaaattacttgggtatccaggacaaacaagtttagaagaaagtgtgacacctagagggtaccgaatcacaagcaagatttctcgtgttccgccacttattatcgagaatttaattaatcgatttaaaacattgcaaggtgtttgccgagcaactattaatgaattggatgatgtggaaggaattggagaagtgagagcgaagaaaatacgagaaggtctaaaaagaattcaagagcatctctatatgagtagacacaattaagaatattacattgattctataatataacgacactagaacatttttggtatatgatatgatatattggtaaataaaactatttacaaaaaaacacgtccgcttttgcattcggcgttttgattagcgaaacaatggttaataatgagtaggaggtggttggatgttaaaacggattgtacagctcttctttttagtgatcgggggagcgttagggatttacttaatcccaaaaattattaatgtattagatatcggtgcggttcctttgttggaaggatcgtatgttcgtgcaattattggtgcaattattttatttttaacaacattttggcttgtagattatattgttcaacttattaagcatattgaagaggctcttgtaaaggcgcctgtagcagatgttttatttggtacattaggattaatctctggtcttattgttgcatatttaattttgataccaattcgtgaatttacaattccagttattagtacggtgttgcaagtgttcttcacccttttacttggatatttaggattccaagtaggatttaaaaagaggaatgaattgctaggattatttacattaccccaacgcggaggtaagaagaaaaacaatagtgagaatgaagaggtagaggtcgaagcagaaaaatctacgactcattggaaaattctcgatacgagtgtaattattgacggacgtattgcagatatttgccaaacaaagtttttagaaggaacaattgtcattccgcaattcgtattagaagagcttcagcatattgccgattcttcagatgctttaaagcgtaatcgtggccgcagagggctagacattttaaatcgtattcaaaaggagatgccaattccggtagaaatttatgaaggcgatttcgatgatatccaagaagtagatagcaagcttgtaaagttggcaaaaatcactggtggaactgtagtaacaaacgatttcaatttaaacaaagtttctgaattacaaggggttacggtgttaaacattaatgatttagctaatgcgattaaaccagtcgtactccctggtgaagaattaagtgtttatgttgtgaaagatggtaaagaacaaaatcaaggtgttgcatacttagatgatggtacgatgattgtagtagaagatggtagagagtatgtgggttcacaacttgacgtacttgttactagcgtattacaaacatcggctggtcgtatgatttttgcaaaacgtaaattgctagaaaaagcattataagtagaggattattaatatgtatacattaattattccggcagcgggccaaggaaaacgaatgggtgctggtaaaaataagttatttttacttatagatgaagtaccaattattgtgcacacattgcgtgcttttgaaaaagataaagcgtgcaaaagtattattatggcaattaacgaagaagaacgcccgtattttgaagagttaatgcagaagtaccagattgaaaagcacgtacaatttattcagggtggagccgaaagacaagatagcgtatataacgcacttcagtatgcgagtggtgtcgaatatgttcttgtgcatgacggggcgcgcccgttcgtaacgaataaagtgattcgcgatgtattaattgcagcagaaaaatatggagcttccatttgtgcagtgccagtaaaagatactgttaagaaagtagagcagggtgttgttgtagaaacggtagagcgatctcaacttaacgctgtacaaacaccacaaggattctctgtttctcttttgctagaagctcatagaagcgcaaagcaaagttgttttcttggcacagatgatgcaagtctcgtagaacgtgttgggaagcaagtaggtgtagtagaggggagttactataatattaaagtgacgactccggaagatctattaattgctgaaagtttcctacgtgttcagaagaaataacgttgatgatgtgttaataaagaaaagctcggcaacagccgggcttttctttataaggatagcgatataatatagagtcataaagctcagtagtttagcttaaggaggaagtaaggatgtttcgaattggacaaggttttgatgtacatgaatttgcggaagggcgcccgttgattattggtggaattacaattccacacgagaaaggattaatcggtcattcagatgcagatgtattgttacatacgattgctgatgcatgtttaggtgcgattgcagcaggagatatcggaaagcactttcctgatacagacccagcttttaaagatgcagattcagctgtattgttacaaaaagtttgggaatttgtgcgtgaacaaggttacgagttaggaaatttagattgtacaattattgctcaacaaccaaaaatggcaccacatattgagagcatgcgtaagcgcattagtgaactgttagaaacgtctatcgataacattaatgtaaaggcaacaacaacagaaaaattaggatttacaggtagagaagaagggattgcttctcaagcggttgttttattacagaaaaaataatggtttttaattcgtaagatggataatcacatttttttggtgtacaattatagaatgtgttgacattaaggatggaaggtgtaccaattatggaaaagcaagtgagagtacgctacgcgccaagtccaacaggacacttacatatcggaaatgcgcgtacggcattatttaattatttatttgctcgtcatttagatggcaaatttattattcgtattgaagatactgatgtaaaacgtaacgtggctggtggagaagaaagccaattaaaatacttgaaatggctcggtatggactgggatgaaggtgttgatgttggtggtgaatttggaccatatcgccaaacagagcgtttagatatttataaaaaattatatgaagatttattagagcgtggtctagcttataaatgttatatgacagaagaagagctagaagcagagcgtgaaggacaaatcgctcgcggtgaaacacctcgttacgcaggtaaccaccgtgaattaactgaagaacaagtgaaagaatttgaagctgagggacgtattccaagtattcgtttccgtgtaccagctgatcgtgactacacattcaaagatattgtaaaagatgaagttgcgttccattcaaatgatttcggtgattttgttattgtgaaaaaagatggaattccaacttataactttgcagtagcagtagatgatcatctaatggaaattacacatgtacttcgtggtgatgatcatatttcaaatacaccgaaacaaatgatgatttatgaagctttcggctgggatattccacaattcggtcatatgactctaattgttaatgaaagtcgtaaaaagttaagtaagcgtgatgaatctattattcaatttattgagcaatataaagagcttgggtatcttccagaagcaatctttaactttattgcactactaggttggtctccggtaggagaagaagaaatcttctctaaagatgagtttatcaaaatgttcgatgcagctcgtttatcaaaatcacctgcattatttgattctcaaaaactaaaatggatgaacaaccagtatatgaaaaagcaagatttagatacggttgtagagttaagcttaccgcatttagtgaaagctggacgtgtgggagaaactttaagcgaacaagaccaagcttggattcgtgatgtaattgctttataccatgaacaaatgagttttggagctgaaattgtagagctttctgaaatgttctttaaagatcatgttgactatgaagaagaaggacaagaagtattaaatggtgaacaagtacctgaagtacttcgtgcatttgctggtcaaatagaagctctagaagcaatggagccagcagcaattaaggcagcgattaaagcagttcaaaaggaaacaggacataaaggtaaaaatttatttatgccaatccgtgttgcaactacaggacaaacgcatggtccagagcttccgaatgctattgcacttcttggaaaagaaaaagttttaaatcgtcttcaaaaagtaattggttaacattttctaggtttagaaatataataagtatacctaaaacctaataaggaaaagcgacgagaaggagaagtagaaaatcaggctttttacagagagaaccacctttaggctgggagtggtttataagcggatttttgaaatgccccttcgagtcttctgctgaacagcgaattgcttcgtgggatgtcttaggccgcaaagtaagcaggagcggtgtacaccgttatcatggatgagtttgaggcttttttaagcctaaacagagtggaaccgcgcttaaaaggcgtctctgtcaatatgacagagacgccttttttttataccgtgtaaataggtatgaatatagaatttatctccttatataaagaattaggggagaagtgatgagttaggggagttagttcgttcgacaaaaaagcagcccataaaggggagggaacaccgatgtttaagaggcttcgggaagatattgaagtcgtttttgaacaggatccagcggcaagaggttatttcgaagtcattttaacttactctggattacatgcagtttgggcccatcgaattgcacatgctttttataaaagaaattttttctttcttgcacgttttgtttcacaagtgagccgcttttttactggcattgagatccatccaggagcaactattggtcgacgcttttttatagatcatggaatgggagttgtaattggagaaacttgtgaaattggtgataatgtaacgatttatcaaggggttacattaggtggtacaggaaaagaaaaagggaagaggcacccaacaattcaggataatgtattaattgcgacgggtgctaaagttcttgggtctattactgtgggagagaattctaaaatcggagcagggtctgtcgtattaaaagaagttcctgcacattctacagttgtaggtatacctggccgtgtcgttattcaaaatggagtaaagattggtcaagaattaaatcactctgaccttccagatccgatttttgataaattaaaggctatggaagtagaacttgataaattgaagaaacaattggaattaaaggtagaaaggaaggataaaaatgactattcacatttataatacgttaacacgtcaaaaagaagagtttgttccattagaagaaaataaggtaaagatgtatgtatgcggacctacagtttataactacattcatattgggaatgcaagacctcctatggtattcgatacagtgcgtcgttatttagaatacaaaggatacgatgtgcaatatgtatctaactttacggacgtagatgataaattaattaaagcggcaaatgaattaggtgaagatgtaccaacgattgctgatcgttttgttgaagcgtactttgaagatgtaacagcactaggttgcaaacacgcaacagttcatcctcgtgtaacagaaaatatggatatcattattgaatttattcaagaacttgtgaataaagggtatgcatatgaatcagagggtgatgtgtactttaagacgaaggaattcgaaggttacggtaaattatcacatcaaccaatcgcagatttacgtcacggtgctcgtattgaggtaggggaaaagaaacaagaccctcttgattttgctttatggaaagctgcgaaagaaggagaaatcttctgggaaagcccttgggggcaaggacgtccaggatggcatattgaatgctcagcaatggcgcgtaagtatttaggggatacaattgacattcatgctggtgggcaagacttggcgttcccgcatcatgaaaatgaaattgcgcagtcagaggcattgactggaaaaacgtttgcacgttactggatgcataatggatatattaatattaacaatgagaagatgtctcaatcaaaaaggctgtttgtatatgttcgcgatgctataa

SEQ ID NO: 1292 - DNA, 10372 bp, Bacillus thuringiensis
acaaatagcaaatccatgtattcttctttgcatacgacatgattcacactctctcatctaacaaatcaatttgtaaatcagcaatgtctatttcaatcccgccgaaactactcatcgcatcaacaattgtaacctttgcacactgttttcctaatttacatacatctacaattggatttataatgcctgtcgtcgtttcgcaatgaacaactgcaatatgcgtaatctctttatcttcttgcaataacttctctacttctacaatattagtaggttcccactcttctgtttgactgaccactacatcaatctgtaacatctctgccatttgcacaatgcgcttaccgtacgcaccatttgtacaaacgagaatcttcccatttgccggaataacagaaccaattactgcttcaactgaaaacgtaccgcttccttgcattaacactgttgtatatttctcttcttccttcgtcgctaacgatacaagtttagctcttacttcttgcaccatcgtattatattcatcatcccacgtacaccaatcgtatagcataacttcttttactgattttgttgtcgttaatggtcctggtgttaataataagtagtgattttcagtcatgatcctattccccttttatgaaataataagttcttgtttctcgatatgttccattacgctttcgagttcctgcatcgtttctatcgtaaagtgcgccccattttcaacgaaacgattgcgaactacttctattttttcacgaagttctaccgaatccatattctccacttcctcttccgttaaaccgagctcgctactgccaagaattacaccaactgtccacattccagcatttctaccttctttcatatctgatactgtgtccccaacttttatcatatggttcatcggatacacaccaagttccattgcatttttatagcacatccatggatatggacggcctgctggaacatcatctggcgtaacaagaaaatcaggtttatatccttgtaacgctgcttcctttgctacaatatccatcatttctctcgtataaccagtcgttgaaccaattttaattcctctttcacgtaaagaagcaatcacttcttttactccattaatcggcgaagcatagcgcggtaaaatagcgaagagaatctcttcaaattcttcatacatctcctgaatgtctgcttctgttggtaattgtcggaaaacacgattccactcactcgcaatacgaggcatctcagtaagtgcccttacatgatctatttttaataaccccattggcttacgagcttcttctgctgtaattgctacaccccgtttatgaaaaatctccatgaatacttctagtggtgcaaaacatccgtaatcaactgttgtccctgcccaatcaaaaataactgcttcaattttcattctgtccatcacctttcttacttatcttttttgccattgtgaagttcggttacgaagtgctttcgttccccattcatatacaactcttactacaatatttgtaacaacaataagcacactcattgcagctgctggcgccacatttcctgcatcatccatatttacgattgatacggcagctagtttaaaatcagctgcatataggaatacaactgccgatacagttaccattgaatttacgaagtagtacattaccatttctaaaattgctggtaaacacattggtaccgttactctaaagaatgttttataaaacggaatacccatcgactgcgaaacaagctcaaactctcgatctaatttctttaaagcagtcgttgccgtgacaaatgttacagaataaaaatgaatgatatttactagtactaacacagcgattgttccgtataaagaatgaaacgggttcgttactgatagtcccaaaatttgaatcgttggttgactaaagaaaaagacatatcctaatccgagtactaaacctggtatggctaaaggaacgatagagaaaaagtaacctgtttttcggaagaattgtagctggtctattttctcaattgcatatgcaaatacaaatgttaaaatcgccccaataactgctgtaactgctgaaacaattacgctatttttaaatgcttcaagtccatctcctgttaaactcgaaaaattaaaatgctcaaatgtaaaactcatattatatggccatactttcacacttgcagcaataccaactgccacaaataacagaatgatcataaatgtaatcacactacagtatatgaatgagatgacatctcttttcttattagctattattctgtatggtactgcttttgaagataagaaattcgcctgctttctttgcgtaatacgatcaactgcaaatgcgaatatagctgggattaataaaatcattccaactgttgcacccatcgacatattttgctgtccaattacttgtttgtatacgtcagtagcaagcacattatattgtccaccaacaatttttggtgccccaaaatcagtgaaactaagtgtaaacacaacaaacattgcactaattaatccgtactttacactaggtaaagtaaccgtgaaaaattgttttgttttactcgcccctagcatattagaagcttcatataaacgataatcggatccttgaaaggcaattagtaatatgagaaaggcttgcggaaatgtatacataacttcagctattacaattcctactggtccatataaagggatttgtataccttcaaataacccaaacattcctttcgttactagcccttgattaccaaataaatatgtaagtgctataccgtgcatcatcgttggtgcaaacaatggtaataacgctacatactgaaatacacgctttccaaaaacattcgtacgggcaattgcatatgcgtaaacgaatgcaattgaaactgaaataattgttgttgcgcccgaaatccataccgtattttgtaaagactgaactaaagttggtgttgtaaaatatttactgaaattcgctaaaccaatgaaaactccatctttattataaaaagcttgtgtaaatagttgtaatagtggtaatacaagtatgacaaggaaggaaagaatcataccgataattacaagcctttggatccattcctctttccctatacttctcttaatcttttttttcgcactttctaccttgtagttttctaacatctccatctatacaatgaccttctttccatatgacaacatatgattttctgagaaagagatttgaatcggctttccttttctaatatcagctacttctacttctgatgctaatatatccactacaattttctcattataaaggtgtgtgttttcttctacgactcgcacttccgttcgatatacagatccacgaaattccatactttccacaactgttttaataccgtccttttgtacaattgttacatgttcaggacgaattgcatgctcttcgttatttttcgaaaagaaattaatagaaccaataaaatctgccacaaacggattggctggtctttgataaatctcctctggtgttccaatctgcataatttccgcatgattcattacaacaattttatcagccatcgttaatgcctcttcttgatcatgcgtgaccataatagttgttactcctactttctcttgcaaatcacgcatttctctacgtaacttttcacgtactttcgcatctaaagcagataacggctcatcaagtaacaaaatatctggagacagagcgagcgcacgtgcaagtgccactcgctgctgttgtccaccagacatttgagcaggatatttatcttttacattcagtaaatctacaagttttaacgcctctagcgctttctcttttacttctgcttttccatatttttttgtctttaagccgtattcaatattttcaagtgctgttaaattcggaaataatgcatacgattgaaacaccattccgaagtttctctttccaggaggtaatgctgtaatatcttttccattcacagctatactacctgttgttgcctcttctagacctgctaaaattcgaagcaatgtcgttttcccacaaccacttgggcctaataaacatacaaactcatttttgttcacagtaaaagaaatatcttttaacgctgtaaatgcatcaaactgtttttgaatgtgttgaattgataaatattcgctcattttttctctctcccactcacttactttttcggttctgctttttggccaaactctttttcccatttttctaaaattttgtcacgattttctgctgcccacttaaagtcattttttttgtataacttttctgttacatctttagggaatccatctggaagtttataatcatttttaattgtcgcaaatccatttttctcgaagtataacttcattacatcatcagtaatcgcccaatctaaaaatgcttgcgctaatttttcattttttgcattatcttttttaataagtgcgttcgcttctacttcccaacctaatccttctttcggcaatacaacttcaactggtgcacctttttgtttctctttcaaagcactataaaccattgatacgccaactggatattcacccgctcctgctaatttcgctggttttgatcctgaatgcgtataacttgccatattatcatgaagtttcttcatgtaatcccagcctttatcttcacccatgatttgtagccatgcagaaactgttaaaaatcctgttccagatgatgctggatgtggcataacaagtgttcctttatactctggtttcgttaaatcttcatatgattctggcatcggtaaatttttcttctttaactcttctttatttacagcaatccccgtcataaatgcagtatttcctacccatttttcaggttgcttatcatctttaaattgtggaagaacacgatctgctccttttggagagtatccttttaacatatcttttttatctaaagctaatagacttgatgccgcagttccccatacaacatcggcttgtgtatttttcccttcagctagtaatttcgcagtaataactcctgttgaatcacgtacaatgttcaatttcacatcaggatatttctttttaaaggaatcaagataaattggtacaagctcttcttcaattgctgtgtaaacagttaatgatccagataatttgtcatctttcactttcgctccagcactttcttccttctttgcaccacaccccattaataacgaaaataccattccagtcgctacagctttaaagattgtttttttcactgtttctctctccttttacaaatcttatgtacaactcaaatataaacaactagtgtaaaagcagtattaaaccaacattaatcttttgtttgttgtttgtttttgtgtaatacgttgctacttctatgttttttcgcatttttctgctaatagaaaacactaaatttacaaataattaaaaaaacctttataatcccacaaaaaaatgaggcgtttgtaaaaaacgcctcatttttgtttccctttttttgaattacgattcgcatactttgcgctattttctccttcatactctaatgcaaattctgcatctggtaagctttctttcggagttttattattattgattgccgcattttgtttcacttttctttttaccaatacattcacctgctctcaagaaatcactttctactctagtttgaaacaacttaaaataattattactggcaagtgttaacaagtacataagaggcgttagatggaaatactacatatgaagaaatcattataaaaaggagcgataattttgaagaaaaaagaaaagattcaatcacccattttagacgaaacgctcccgcatcaaatgaattttccatcttttaaaggaacaggaaaaacgatgcaacaaccttttgtgaatcaatataatgttgtaattggagacagtaaatataattccgagaacagtccgcttaacaattggagtgatgaagtagatcctgccattatggctggcgatgagtggatccatccgacaaatgatattgggtggatttcagaagaaaatcaagagttactaaaaaacgaagtggataataaaaatgaagcttttatgcatccacaatttggcattaacgactaaaaaaccattctacctaacgtaggtagaatggtttcatactatccaataataatccgctctttcgggtatttatagcgaggtggttgttcccttccaccactagctaaaataaatgttaaaataccaacgcgtccgataaacataagcacaataagtacaagtttcccaacagttgttaaatcaggcgtaacacctgttgatagtcccgtcgttccgaaagcagaacaaacttcaacaattaagctcataagcggtacattttccgtaatagataaaatgaatagcgcagtagcacataacaaaatccccatcgtcataacgacagatgctttcagtacatcctcttcatgtagctgacgtttgaagactctaactgttctaccgccccttgcaaaggtgtatagtgacaatatactaacagcaaatgtagttgtacgtattccgcccccaaccgaacttggagatgcccctataaacattaatatactcataaataaaagcgtcggttgtgataattcacgtatatccattgttgcaagtccaccacttcgcgtcgtcacagattggaataatgtataaaatacagtttcatgccatgactttcctactaaaaaatgatttctctccagtaaaaaaatcataattgtaccaacaacaacgagtgcaaaaaatgttgttgtcgtcaattttgtaaataatgaaaaacggaataattgttgtctccttttactaaggaattgtttcacttccattagcacagggaaaccaatcgctcctaaaataattagtaacatatgaatcatttgaacaatataatcttttttatacggaattaatgattgtcctgttaaatcaaatccgccgttcgtagtggcactaacagctgcaaagaaaccgtgaaaataagcttcttgccaagtcggaaagtaaagtaaaaatcttgtccccaataagattgctccaataagttctattgaaataattacaattaaaatagaacgcatcaattctacgagacccgataaatttccttgattatggtctgccataattaatcttcttctttgcaaaccaatctttttccccgtaatgatccaaacaaatgtcccaagcgccataattcctaagccgcctaattgtaaaataagggctaaaacaataattcctgctgtagtaaacgtatctgaaatcgtaataacagacagtcccgtaacacttaccgcactaaccgatgtaaaaagcgcatctataaatgtccatttcacaccaggcttcgtaacaaacggtaaactaagcaatatcaccgatacaactaccgctaataaataaaacaaaacgatgagttgtacaggacgtaatttttgtaaaaacttttttatatctctcattccatcacttcgctaccttttttctatcgattaaataaagaaaaatctttactttctttatttgtaaataactgctcaaataatttggcaaagaccattccatatacagttccattacctccatacggcaatgcataaaacaaattatgtatcttttcgtcttcttttaaaatggggagaccatcatgagtaccaccaaatgcggctgcccaatagtagtctgcctgtatatttttatactgcgggaacatctcttttacaatattaataaggatatcacgcttatgcaataatttcgtatcaccaattgtttgaatttgtagcgcttcatctaatccgcctacaataatgcggtttcgatacgttcgaaaatataagtaaggccgtgccgtttcccaaattaacgatcgctcatgccagccttcaaattgatctatttcatttgttacaattgcataagaggtgtctactgttgtatttttttctttctttccaaaaagcgcctcataacctgtcgccataataatattctttgctacaatttgatttcctgttttcgtgtaacaaattaaatcatttttgcgtttttttatatgtattgcctctgtatgttcatatatattagctcccatttggtttgctttatgcaaaaaactatacgctagtaaatacggattcacctcagcatcaccttgcgtatataacgctgcttgttttgcaaaagaataacgtttcttaatatcagcttctgtaaaatattcaactggaaatccataattttgtaacgtattatattcctcttgtaaaaatgagacatcctcacttttacttgcataatataaactatttcgcggaataaaatggggattaatatcaagagtcggtataacctcttccattgttcttagcgcttcataacaaagcttatatgctcgtacccctttttctttaccaaatgtatggataagagaggttaacgatttatcatgaagaaattgtagtaaacctgtattagcagctgtgctaccacacgcaattgctcttttttcaataagtgtaacactcatgccaattttcgctaacgaatgcgctatatgagcaccggcttcgccgcttccaactacgagcacatcacatatcatatcattttctaacagtggataacaaggtacagaaactcctgtattccaaaacaacttacccatcataagtttcataattatactcctaaaatataaatttctcctttctatgttttgttatttttcataaaaaaatccaactaacataggctagttggatttttttatttttaattagaacgctcttcaagccaatttccaatcgtcggatatgtttgttttacagctgttccaccgtaaacgatagacatatgccctgttggtaaacatacatattgtttatctgtgctagaaatatggtctagtaatgcttctacttgacatggcaaagcgatatgatcacgtttcccggaaatatttaagacattcgccttaatatttgcaaggtctaccttttgtccgcgaataacgagttcacccttaaccaacttattattttgataaaaatcacgaatccactgtctgtatgattcacctgggaacggaataccatcaccaacccacttttgaaccaatctccagctttcgacgaagcgctcattctctgaacgatctactaaagcaacatatggaccaacaaagttcgtaattggctttaacattttgtttccgaaatcaatcatttctggcggaatatttccaaatgtatcaaccgctttatctaaattgaagtatttctcatctaataaagggccatacaatcctgtttcagagaaatcaaaaggacttgtcatgaaaattaaattacgaattggcatgtgcggatgaagtgctgcataaatagaagttagcgttccacccatgcaataaccaagtaaagaaatctcgtccgattttgcagttcgcattactttttttactgcttttgcaatataatcaaacacgaaatcatcaaatttcaaatgactatcttctaaaccaaatgtgccccaatcaagcatatacacatcaaaaccacgatccactagatattccactaaactatttccaggagttaaatccataatatatggtttattaataagagcatatattaatagaattggaactctttgtgttttttcttgttttggaatgtagcgataaagcttcgtcttattcttcgtccaaataacctctttcggcgttaatccgacttggggctctggttcacgtaataaaatttcactcgcccttttcactcggcggtatgcttttcggtactcttctgggtatagctctaattgcttttcccattctgttgcgaatgtagtcatttttctatctcctcgtatgattaagttaggtttttagggacgggatgtacctataaatccaagggtatctatttttatgagatactaatatttgtagatagagtgttgccgaccatctccctgaatctttgtattcgtaaaaaagagcggtacctctgtctaataagtagtttacgaatgagttggatgttgatgaccattggtcattcttcgtatctcttacgaggtagtagcgcttattagttcaggggaggaaagcactatctaacactaattaatataggggtgtaagctatgttctatttaggtattgatatcgctaaacataaacattatgcgtccattatcgatcaaacgggaaaacctattactaagccattaccttttcagaatcacaaagaaggtggacaa

SEQ ID NO: 1293 - DNA, 9757 bp, Bacillus thuringiensis
atgcattatttattcatgggcatcgaccttatcatagtctttaggtgtcataacagaacctacatcgtttagtcctaatacatctgcggccatttttttaaacatatataatcccccttgtaaattaaagtcttaattgtacaaaaatatattaacatgatcttcatcctttgttttcttgtaatacaaaaatatctgaaggtaagttaagaaaagtaatgaataattattttgatcctaaattatttagtaaatctattagtttaagagtggattctccgaaaaataaccaagagaaaaaagttaattttgcaagtgattataaataaattccgtgaaagcacctcaagcgatatgaggtgtttttcaatctctttttgaaatcttacaattctgtaaggtaactgtaaggtagttcgatggtaagaaattgctaatcttttataatgaagataacaacgataaaacgaggaggcagaaatgatgaaaggattagttgtaacgggcttgacggttgcttttggatttgtagcgtatgagaaattaacgtatgtagttgatgttgtgaaacatttgattgcttagagaaaacagccatgagagggaaagggaatgagtgaatgaatggaatggttattttgggaattataggtacttgtagtgtagtgttattgttcttatgcccaagtggcatacttagttcgacaacaagttcgttcttcttaagtttgtttgcttgtacgatgctcattattatgttcacaatgaagcgaagtaaaccaatcttctattttagcatgattgttatggcaattattgttctccaaattattacccttgtaatataccccacaattataaaagctttccattaatgatgaatcctctgcgtttgttgctggggatttttacttgtacaattttaatttttagtagagatttatttgtattggaatgtaaaaattaaatatttttatatttcaaacaaataatttggggatgttgtgttctcattacgcatttgatatatttactttgaacataattaaaatcaagaaaaagaggcggacgtatggattaaaaagaaaatacggaccgattgtttccgcagctatcagagcgctatattgatgaaggttttttagcgttgaaagagcgaaagttcgaagatgcattgcgctgctttgaaatattacgtcagtataatgcggaaacggaacaaacggaattagcttcagttatttgtttactcgaattaaaacgtatggaagaagcgaaagacaaatgtgaacagttgcttaaaacaggagttgtcttatttggtgatattcttgaaacgtacgtgactattttagttcaaacaaatgattatgaaggtgttattgaaactgttgaaaaggttttacaaacgaaagatataatgcctgatcaaaaggaaaaattagcgcagcttgctttatttgcagaaggtatgctaaatgagggagacgcatcgctagtggattcaaattttgagttgaatgagtttactaatgaaatttttggagaaaactttggacagaagctaagagcgattcagcgactttcattaaaagacttagatcttgcattacctgttttaaagaaatttttaatagatgaagagcaacacccctatttgaaaacttctattttgtataaaatgatagaaagtcaggtagaagaggaaatagaggtggaaaagtttgggaatgcaattaaggtaattccggcatttacaggtcataatgaggagcaatccaataacattatacataaattatcaagtcgattagagcaaaaatatcccgatatatttgaagcgatggttacatattggaaagaattgcaaattagcattttcccattcgctctattaatggataaagaagagatttggtcagctgttttagagagaattggaagaaagcgtttcggattggctattgatgaagaagagcttatggcagcatacaatatcgaattggaagagtttcatattgcctatcaatggttattacgtgttgaaagagaaggatatttgcccgtataattatgaaaaagaatcgttcagttcttgaaacgagcatattctatgttataatgtaagggttgcaaaaggcagaaaactgcctgtttgtaagagaagagaagtgtaattctcttacttaatatgtttcatattattctcgaacaaaatataccgtagttgtcttctgggcaattagtagattggaacattatatctgaaagcttttgctagaggattatttgtgtatttgttatttcaaaaaagagataatgaagatcttaatctatagaggtatgtgcatacattattatagttggagggaaagaataaatgtctacaaaatgggaaaaattagaaggtaacgttggcgttttaacaatcgaagttgatgctaaagaagtaaacaactctatcgacgctgcgttcaaaaaagtagtaaaaacaattaacgtaccaggtttccgtaaaggaaaaatgcctcgtccattattcgaacaacgctttggtattgaatctttataccaagatgctttagatatcattttaccaaaagcatacggtgaagcgattgaagaagctggtatcttcccagttgatcatcctgaaatcgacatcgagaagttcgaaaaaaatgctaaccttatcttcactgcaaaagttacagtgaaacctgaagttaaattaggtgagtacaaaggtttggcagtagaaaaagttgaaacaactgtaactgacgaagatgtagagaacgaattaaaatctttacaagagcgtcaagctgaactagttgttaaagaagaaggaactgttgaaaacggtgatacagctgtaatcgacttcgaaggtttcgttgatggcgaagcatttgaaggcggaaaaggcgaaaactactctctagcaatcggttctggtacattcatcccaggtttcgaagagcaagtaatcggtcttaaatctggtgagtctaaagacgttgaagtatcattcccagaagagtaccatgctgctgaattagctggcaaaccagcaacattcaaagtaacaattcacgaaatcaaaacaaaagaacttcctgagttaaacgacgagttcgctaaagaagcagacgaagcggttgcaactcttgatgaattaaaagcaaaacttcgcacaaacttagaagaaggcaaaaagcacgaagctgagcacaaagtacgtgacgaagtagtagaattagctgctgctaacgctgaaatcgaaattccagaagctatgatcaacactgagttagatcgtatggttcgtgaattcgagcaacgtttaagccaacaaggtatgaaccttgagctttactaccaattcacaggtactgatgctgacaaattaaaagagcaaatgaaagaagatgcacaaaaacgtgtaagaatcaatcttgttcttgaagctatcattgaagctgaaaacatcgaagttactgaagaagaagtaactgcagaagttgaaaaaatggctgaaatgtacggtatgccagtagacgctatcaagcaagctcttggaagcgtagacgctttagctgaagatcttaaagtgcgtaaagctgtagacttcttagtagaaaacgctgcataataaaataacaaggcacgattaaaatcgtgccttgttttataaatatagaaatatatttataaaacttttcgatggagaaggaaaagttcctttacaagtcgaatatacatatttcaaaagttttaaaaattttttatttgtacataactagtcatattatttgtatttctcgccacgtagtgacataatatgtatttacatacgatacatttatcgtgtacatacgaaggcaagaggttagcactttgtaaggggtgtgaaaatatgtttaaatttaatgatgaaaaagggcaattaaaatgttctttctgtggtaaaacacaaacgcaagttcgaaagttagtggcaggtccaggtgtttacatttgtgacgagtgtatcgaactttgtactgaaattgtacaagaggagcttgcgaaggacgaagaagtagaattcaaagatgtaccgaaaccggtagaaattcgtgaaatcttagatgagtatgtcatcgggcaagatagcgcgaaaaaagcactagcggtagcggtatataaccattacaaacgcattaattctaacagcaaaattgatgatgtagaattagcgaagagtaatatcgcacttatcgggccaacaggtagtggtaaaacattacttgcacaaacgttagcgcgtattctaaatgttccatttgcaatcgcggacgcaacatctttaacagaagctggatatgttggagaagatgtagaaaatatcttactaaaattaattcaagcagctgattatgatgtagagaaagcggaaaaaggaatcatttatattgatgagattgataaagtggcacgtaagtccgaaaatccatcaattacacgtgatgtatctggtgaaggtgtgcagcaagcacttctgaaaattttagaaggtactgtagcaagcgttccacctcaaggtggtcgtaagcatccgcaccaagagtttattcaaattgatacaacgaacatcttattcatttgtggtggagcgtttgatggcattgagccgattattaaacgtcgccttggtgaaaaagtaattggatttggttctgagaagaaaaatgctgatgtaaatgagaagcatgttttatctcacgtattaccagaggatcttttaagatttggtttaattccagagtttatcggtcgtcttccagttattgcgaacctagagccacttgatgaagatgctcttgttgatattttaacgaaaccgaaaaatgcacttgttaagcaattccaaaaactattggagcttgacgatgttgagttagagtttgaagaaggtgcactaatcgaaattgcgaaaaaagcaattgaacgtaaaacgggtgctcgtggacttcgttctattattgaaggcttaatgcttgatgtaatgttcgaacttccatctcgtaaagatatcgagaagtgtattcttacaaaagaaacagtagctgataatgagccgccaaaattggtgttacaagacggtactgtacttgatacaaaaacatctgcataatgcgaaagggaaacagcaatttttataattgctgtttttctttatgtttagctacgttcctccgcggaaatactaagagataaaatattgcgggaggaaataaataatgagctggacaaatatatttttagttgttcaacttgtttttggtgtaattgtcggattgtatttctggcatttacttcgaaatcaacgaacacaaaaagtttcaattgatcgagaatcgaaaaaagaattagaacagcttcgtaaaatgcgtgagatttctttaacagagccgctagcagaaaaggtgcgtcctacaacctttttagatattgtagggcaagaggacgggattaagtcgttaaaagcggctctttgtggtccgaatccgcaacatgtaatcatatatggcccacccggtgttgggaaaacagcggcagcacgtcttgtattagaagaagcgaaacgaaatcctaaatctccatttcgtacgaatgcaacatttattgaacttgatgcgacaacagctcggtttgatgaacgtggtatcgcagaccctttaattggttcggtgcatgatccgatttatcaaggtgctggggcgatggggcaagcaggtattccacaaccgaaaaaaggtgctgtaacagatgcacatggtggtattttgtttattgatgagattggcgagctccatccgattcaaatgaacaaaatgttaaaggtgttagaagatcgaaaagtatttttagaaagtgcgtactatagtgaagaaaatacaatgatcccaacatatatacatgatattttccaaaaaggcttaccggcagattttcgcttagttggagcaacgacacgttcgccagaggaaattcctcctgctattcggtcacgttgcttagaagtatttttccgtgaattagatacggaagaaattcaaaaagtagcgaaaaatgccgcggaaaaagtagaaatgcaaataggtgaaaatggtattgagatgattgggatgtatgcaaggaatggacgagaagcgattaatctcgtgcaaatctctgcgggtatggcgataaatgaagaacgttctttcattaaggatgaagatatagagtgggttgttcactcaagtcagcttacaccgaaatatgaaaagcgcatttatccgattccaaggattggtcttgtaaatggtcttgctgtatacggaccaaatacaggtgcgttattagaaattgaagtaacagcaattccggcgaaagataaaggatcggtaaatgttaccggaattgtggaagaagaaagtattggtagtcaaacgaaatctacttcgtcgtaaaagtatggcgaaaggctctgttgataatgtattaacagtacttcgttctttagatgtgttgccagaaggatacgatatacatattaattttccagggggtatcccaattgatggcccttctgcaggaatcgctatggcaacaggtgtatattctgcggtgcatcgcacgtatgtaaataatgaagtagcgatgacaggtgaaataagtatacacggagaagtaaagcctattggtggtgtatacgcaaaaataaaagctgcgaaaaaagcgggagctaagaaagtcattattcctgctgaaaatatgcaaccatttttgtatacgatcaagggaattgaaattattcctgtccgtaagttaaaagaagtatttgagttaacgtttatgcaaggaaatatgcatagagagctagatgtacatactaacgtagacgaaacagatgcacaatctatgtaaaaataaacaataataaaatttgccagacttcgtttaagtttgtatgcttaatcggagtctttttcttttcgtgaggtagaaaaacaagctatttacaattgcgcggaatctcagcaattgcatctaggtgtattgtaatataaaatagttgaacaggagtttaatttattatggaggtgctatgtctagtatgaatacgaacgaaagaatcgtgcccctcctaccattaagaggcgttctcgtatatccaacgatggttttgcatcttgatgtaggacgtgataaatcgatacaagcactagagcaggcggcaatggatgaaaatatcatctttttagcaatgcaaaaagaaatgaatatcgatgatccgaaagaagatgacatatatagtgtaggtacagtggcgaaagtgaagcaaatgttaaaattgccgaacggtacgcttcgtgtccttgtggaaggtttacatagagcagaagtaatagagtttatcgaagaagaaaatgtagtacaagtgtctattaaaacggtaactgaagaagtagaagatgatttagaagagaaagcttttatgcgtacgttactggagcatttcgaacaatatattaaagtttcgaaaaaagtttcaaatgaaacttttgcaacggtagctgatgtggaagaaccagggagattagctgatttaattgcttctcacttgccgattaaaacgaagcagaaacaagagattttagagattgtatctgtaaaagaacgattacaaacacttatttcaattattcaagatgaacaagagttacttagcctagaaaagaaaattgggcaaaaagtgaaacgttccatggagcgcacgcaaaaagaatatttcttacgtgagcaaatgaaggcgattcaaactgaacttggcgacaaagaaggcaagggcggagaagtagaagaacttcgtgagaaaattgaacagtcgggaatgccggaagaaacaatgaaggctgccctgaaagaattagatcgttatgaaaagttaccagcaagttctgcggagagtggtgttattcgcaattatattgattggttattagcgcttccgtggacagaggcaacagaagatataattgatcttgctcattcggaagagattttaaataatgatcattacggtcttgaaaaagtgaaagagcgtgtacttgaatatttagctgtacagaagttaacgaattcattaaaaggacctatcctttgtttagtaggccctcctggggtcggcaaaacttcgttagcgcgttcaattgcaacatcattgaatcgtaacttcgtccgtgtatctcttggtggtgtgcgtgatgaatctgaaattcgtggtcaccgtcgtacatatgttggagcaatgccaggacgcattattcaaggtatgaaaaaggcgaaaacagttaatccagtcttcttattagatgagattgataaaatgtctaacgatttccgtggagatccatcagcggcattacttgaagtattagatccagaacaaaaccataacttcagtgatcattacattgaagaaccatatgatctatcaaaagttatgtttgtagcaactgctaatacactttcaagtattccaggtccattacttgaccgtatggaaatcatttcgattgctggctatacagaacttgaaaaagtacacattgctcgtgagcatttattgccgaaacaattaaaagaacatggcttacgaaaaggtaatttacaagtgcgtgatgaagcgctgcttgagattattcgttattatacacgtgaggctggtgttcgtacgctagagcgccaaattgcaaaagtttgccgtaaagtagcgaagattatcgttacagcagaacgtaaacgtatcgttgtgacagagaaaaagattgttgatttacttggtaaacacatattccgttatgggcaagctgaaaaaacagaccaagttggtatggcaacaggtctagcttacacagcagcaggcggcgatacacttgccattgaagtttctgtagcgccaggaaaagggaaactaattttaacagggaaacttggggatgttatgaaagaatcagcacaagctgcgtttagttatatacgttctcgtgcagaagagcttcagatcgatccgaatttccatgagaaaaatgatattcatattcacgttccagaaggagcagttccaaaagacggaccgtcagcaggtattacgatggcaacggcacttatttctgcgctaacaggtattcctgtaagtaaagaagtgggtatgacaggtgaaattacacttcgtggtcgtgtattaccaattggtggtttaaaagaaaaaacattaagtgctcaccgcgcaggcttaacaaaaattattttgccagcagaaaacgagaaagatttagatgatattccagagagcgtaaaagaaaaccttacgtttgtgcttgcatctcatttagatgaagtattggagcacgcattagtaggagtgaaacaatgaaagtaacaaaagcagatattgtaattagtgctgttaaaccagaacaatatccagacagtgatttaccagaaattgcattagcaggtcgttcaaatgtggggaagtcttcctttattaataaaattttaaatcgtaaaaagttagtgcgtattttttctaaaccaggaaaaacgcaaacgctgaactttttcttaatcaatgagatgatgcactttgttgacgttccaggttaaggatatgcaaaagtatctaaatcagagcgcgctgcatgggggaaaatgattg

SEQ ID NO: 1294 - DNA, 12259 bp, Bacillus thuringiensis
gaaaatattgaaaggaagtgaggaaaaaggggtttctataactatagtgttgttgtgggaaaaggtgaaagaagaggagaagagatagtttatttttttttgatttacattgagaatgataatcaataaatgcgttttatcattttttctcagtttctatgccttcgtataaggaatagggtgagatattatttttaatattcaatgagaatgataatcaataatacttatgttacataaaagaatgctaattaaataataggtagaagagattattttttttcttataaattgagaataattatcattttcaaaaagtgaaatgaaagataaccaaggaggaaacaagaaaaatgaaaaaggtttctgtattacccgcttttattataacgttcgtatgtatgctagcttttcttgtaatgccatacgggaatgcttcagcaaaactagctgatggtacttacgatattaattacgtaattcaaaaagcggaaaatgattcagcttcaatggcaaatgactattttgaaaagccggcaaaattaatagtgaaaaacggtgagatgagagtacaagttccgatgaatcatagtgcttggattacagaatttaaagcaccagagaatggggattttgttgatgcgaaagttgttagtaaagatgaatcggcagataaaagaacagtagagtttaaagtagatgatttatccaaaccggcagctgtaaaaattcatgttgttgtaccaaatgcaaactatgaccaccactacacaattcgttttgcttttgatgcaaatgtaaaagctgtaggtggcgataacggcgtagctgctacaacaaaaaataatgatcaagcgaaaacagatacacaagtaaaagaagagaaaacaaaagtagagagtaaggaaacagctaaagaagtgaacaaagaaacaaaaaatgaaaatggaaaagctgaaaaaacagataacccaaaaacaggcgatgaagcacgtattggattgtttgtagcgttaattcttatttcaggtgctttcttaattcgtaaagtgaagttgagtaaataaatcttttgaagggggatgaatatatgtttaaacaatttaaaatgattattgctgtatttgctgttttatttacgtttatcgcaacactaggtttacaagatgcaaaggctgctacaaaactagctgatggaaaatataatattgcttttactgtatggaaaggcgataaagatgaatcgtctagaatgaatagttattttgaaagcccagcaacattaacagttaaaaatggaaaacaatatgtttcatttaaagtgaaagatagtgcttctattaaaagtttccaagtagaaaaagatggtcaatttgtagaaacaaacgtgttaagtgaaaacaaaaaagataatactagagtagtagaatttgaagttgctgacttgtcaaaaaaactaaatggaaaggtggaaattaatattccaattattaattataatgcttcatatgatattcgctttgtatttgatgggagcagtattaaataattttcaaaagggagagtcgttccattgaacaggtatacaaaaattattgttgctatgtttttaatgatatttacattcgtatcaacattacaaccacttgcagttcaagcagctaccaagttggctgacggtgaatattcaattgggttcaaagttttaaaagatacatcagatgaagaatcaatgatgaatcaatattcagtaagtccgggaactttaaaagtgaaggatgggaaaaagaaagtatcctttacattaacgaatagttcatggattacgaagtttgaaacagaaaaagcaggtaagctagttgcgacaaatgtaattagtgaagataaagaaaaagatacaagagtagtagaatttgatgtagaagatatagagaaggtattaaatgcaaaagtaaaagtagatattgattttttaaattatcatcatgagtacgacgttcgtattgcatttgatcaaaatagcattacaccaattcatgtagaaaaaccaaatgaaaaagaggacccagctaataagccagatccaaatgaaactaccgatccaggtcagaagcccgaccaaaagcctgacccagatcaacaaccaaattctaacacaattacagatggtacgtacagcattccatttaaagtattaaaagatcaaacagatgaagaatctaagatgaatacttacatggtaaatccaggagtattaaaagtagaaaacggtaagaaaaaagcaattgtaacactaaaaagtagctcattaattaaaaatttccaaacggaaaaagatggcgcatttgttgatgcaaaagtagtgagtgaggataaggaaaaagatacaagagtagtagagtttgaagtaaacgatttatctaaaaaactaaatacaaaagtatttatcgaaatggcatcaagaaattataagcaaacgcatgatgtacaacttttatttgaacaagataaacttgaacaaattaaaaatgaagagaaacaaccagaagcagaaaaaccggaagcagaaaaaccggaagtagaaaaaccagatgaaaataaaaaaccagatgctgaaacaattaaagatggtgaatacagcatcaatttcaaagcattaaaagatcaaacagacgaaatttcaatgatgaacacatatacaaaaagtccaggtgtgctaaaagtaaaagatggtaagaagtatgtatcatttacgttaacgaacagttcttggattacaaaatttgaatttgagaaaaatggttcgtttgttgatgcacatgtaataagtgaagataaaaaagctgatacacgcgtagtggaagtagaagtaccagatttatcaaaaaagttaaatgcaaaagtaaaagtagatatcgattcaatgaattatcaccatttttacgatattcaatttgcatttgataaaggtagcattaagccgttagatagccaaggcggaaacaacaaccaaggcggaaacgacaaccaaggcggaaacaacaaccaaggcggaaacgacaaccaaggcggaaacgacaaccaaggcggaaacgacaaccaaggcggaaacgacaaccaaggcggaaacgacaaccaaggcggaaacgacaaccaaggtggaaacaacaaccaagatgaaaataataaaccgagagtaatagttgattcgaaaaatttagtagatggccaatatgatattacatttaaagtattaaaagataaaacagatgagatttcaaagatgcatgactatgttgtaaatccagcgaaattaatcgtaaaagatggtaaaaaatatattgagatgacgctgaaaaatagtgcgtggattacgaaattccaagcggaaaacaatgaactattcgctgatgcgaaagtagtaagcgaagataaaaatgcaaatacgcgagtagtacagtttgaagtagaagatctatttaaaaaattaaacgcaaaagtaaaggtagacatcgatgagatgaactaccatcatttctacgatgtacaaattcaatttgatacaaataatatcggcgcgttaggaactattaaagaggaaccgaaaaatgaaccgaaaaatccagtgactacaccgaaagtagataatgtaaaaacagtaggtactcctgattttaaccgaaatgcagatggtcagaagaaaaaagaagatacaaaaaatgattcaaaaaaagagaaaaactcaaaaactgcagatacagcacaacttggtttatacatggtgttactgctaggttcacttgctttactagttcgtaaatatagagcaggtagattgtaatttttggagtcttgatgcatgttcgcgtgcatcaagacttgtttcatattgtatggaaaggagtggtgattgagagtgaagaaaattgcaagtgtactaatggctatcattttgttaatgggtatagccgggtgctcatcaccaaaaaaagaatcagcaaagcaggtaaagagtgaaagtaaagagcacgttgttgcaacaacagtggctgttactgaaattatggatgcgttagaagtagatttagtcggcgttccaacaagttctaaaactttaccgaagcgatataaaggtttacctgaagttgggaatccaatgagtccagatatggaaaaggtaaagtcattaaagccttcagaagtgttatctgtgacaacacttgaatatgaattaaagccagtttttgatggtgtgggtatgaaagcaaactttttagatttaacgagtttgaaaaatatgcaaagttctattagcgatttaggtaagaaatatgggcgtgaaaaacaggccgaagcagtagtaactaaattagataaaaaggttgctagcattcaaaaagaagtaaaaggaaagaaagaaccgacagtgcttattttattaggtgtgccgggaagttatttagtagcaacagagcattcttatattggagatttagtgaaacaactaggtggtaaaaatattgtgcaaggtgaacaagtagaatatttagcttctaatacagagtatttaaagaaagctgatccagatattattttacgagcagctcatggtatgcctgatgaagttgtaaaaatgtttgataaagaatttaaaacaaatgatatttggaaacactttgctgcggttaaaaataaccgtgtttacgatttagaagagcgtttatttggaacgacaggtaatttagcagcaattgaagcattagatgaattgaaaaaaatgatgtatccgtgatgcattttaatataaaggaagagtagaatgaataaaaaaacttggagtttcctcattgttactgcattgcttattgttatgacatcattgtcagcgatgaaaggtagtttagaagtaggtattgttgaacttgtacaagggatatttacaggtggaaatgaagatgttgaagtcattaaagatttacgttttccgcgtattattattgcgttgttcactggagcggctctcgctgtttcaggtgtgctttttcaagctgttatgaaaaatccactcgctgatgctggggtaatcggtatatcttcaggagcaagttttatgacactcgttattattacgttgttcccgcaattctttttctggacacccgtattcgcctttttaggtggtgcgcttgcatgttatctcgtttattcgttttcatggaaatcaggattaagcccgcttcgcattattttaattggtattgccattaatgcaatgtttactggattaaatgaatcattcgttacgatttgtggatattttattaagagtattaagcaaacgacgacttctaacataacaatgaagacgtggggcgatgtagaaataatggtgacttatggaacgattggtcttattcttgctctgttcgtaggagcttggtgtaacttattatcgctacaagataagactgcgaaaaacttaggcttgcacgtgacgagagttcgtcttattatttctgccattgcagtactcttagcggcagtatcaacagcgattgcaggtgttattgcttttgtaggattactagttccgcatatttcaagacaattagtcggttcagaccataaagtattaattccattttctgctcttgcaggggcgttattaattttgacggcagatacgattggaaggttaattgtgccacctaacgaaattccagcagcaacaattatggcggttattggtggtccattcttaatattcttgcttggaaagagtgataaagttcatggaaattaaaaatgtaaccttttcatacgataacgtaacaaatcgattaaagtctgttagtagtgaaatagaaattgggaaaattacaacaatcattggaccgaatggatgtgggaaatcaacattacttagtgtcatgtctagaaaccacgctcctagcagtggagaagtaatacttgatgggaaagcgattagtgaatataaaccgaaagagtttgctagaaaactagcggttgtccatcaacaaaatgaggctccagcagatattacagtggaaaagctaataagcttcgggcgtatgccatataaaaatatattctctccgcaaacagatgaagatagagaagcgattgagcgtgcgctagtatgtacgaatttacaaagtaagcgtgataagccaatttatgctttatctggtggagagaggcagcgagtttggatcgcaatgacattagctcaaaatacaccaatgctcttcttagatgagccgaccacatatttagatatttactatcagctagaaatattagagttagtgaaagagttaaatgaagtgcatggactaacgattgtaatggtattacatgatattaatcaagccattcgttatagcgaccatattatcgttatgaaagatggagaaatcattacgaaaggtaatcctaatgatgtaataacagaagaaatgattaaagcaatatatggtgtagatgtcattgtaaagcaggatgaagataccggattgtacatggtacctatgggaatctaaaggctgagcataatccgttttgaggtgataatttgaatagtaagaaaggacggaaaaagaattctttttttcaacgcatacttacaattgtgtttttaggaatctttttctattcaatgtatgagttgggcgggattttcatggattattatgaaaatcgtaaagtaatggctgaggcacaacatatttataaaagaagtccaatggaagaaaaatcagaagatggagaggtacgtaaacagtttcaggatctccagaaaattaatccagagatagtcggatggattacgatggatgatacacaaattaattatccaatcgttcaagcaaaagataatgattactatttatttcgtaattataaaggtgaagatatgagagcgggaagcatttttatggaccatcgtaatgatgtgaaatctcaaaatcgaaatacgattttatatggccatcgtatgaaagacggttctatgtttggtagtttaaaaaagatgttggatgaagacttttttatgtctcatcgtaaattatattacgatacattatttgaaggatacgacgtggaagttttttcagtatacacgacaacaacggacttttattacattgaaacggattttgaaaatgatgcagcatatacatcgttcttaaaggaaattcaagaaaaatcactgtacaaaacggatacggaattgacggctaatgatgaaatcgtaacactttctacttgtgactatgcgcttgatccagaggctggaaggctagttgtacacgcaaaattaataaaaagaaattaaagaaaaaagtatagaatatgagaagtgatagataacgcttctcatattctatactttaaaaaaggactgtttttactgtgctgcagccattggcatacgtacaacttttacatcatagtaagcaattttattatcaagaatatattctggcattccgccttgatgtgagtgagcatctttaaatgcagcgctctttgtccaaccttggaaatcttcttttgcattccagcgagtgctaattgttacttcatcataatcaactgtattttgcgttaaaagaacttctagacctaaaaagcctggcatcgtttcaactttacctactttattaaaacgctcaattaatttatatccatttccctttgtaattttagctgtatttgtaacgataatcatgtttattcctcctataaatatagcctttattttcgagaactcatatacattaaatgataatgaaaatcattatcattgtcaatgctaaatgtgaaatataaaagttttttatattatattggacagtaagatttccagttcaaaatgtagtaaatatgtggcagttaagcgagagaatgagcgagttgtactagcaaagcaataatatggtatagtgaaacgaggctgttttttcagtctcgttttttaaatgcttcctgtagagaaagcatgcaaatggaaaggaagttattatatgcgatcagaagtaactgtaaaaataaaaccgaaatttataaaagaaattaaaagtggatatccgcttattttaaaagatgcgattcaaaatttaaatgatgttcgtgaagaaggaacaatcattaaagtagtagatgagaagaaccaatttatcggaaaaggctattatggaaaacaaaataaagggtacggctggattttaacgagaaaagagagtgaacaaattaatcaatctttctttgaaagtaaaatcaaatctgccttacataaacgaaagcaattttacaaatcaagtgatacgacagcattccgtgtggtgaatggtgaaggtgatggtcttggaggactaattatcgattattatgatggctattatgtagtaagttggtatagtgaagggatttatactttcagagatgagattatagccgctcttcaaaaagtagcaaactttaaaggtatttatgagaaaaagcgttttgatacgaaagggaaatatattgagggggatgatttcgtagcaggagagcgcggcgagttcccacttatcgtaaaagaaaatggtgtaaactttgcggtgtatttaaatgatggggcaatggttggggtatttttagatcaacgtaacgttcgaaaacaaattcgtgataaatatgcaaaaggaagaacagtgttaaatatgttctcttatacaggtgctttctctgtatttgcagcgcttggcggagcgagtaaaacgacgagtgttgaccttgcaaatcgtagtttaagtaaaacgattgagcagtttagtgtaaatgaagttgattatgaagcgcaagatattattgtagaagatgtatttctttacttcaaatatgcagcgaagaaaaaaatgaaatttgatatggtcgtacttgaccctccaagctttgcacgctcaaaaaaatatacatttagtgcagcaaaagattataaaaatttattaaaagaaacaattgctattacagaaaataacggtattatcgttgcttctacaaattgtagcgcattcgatatgaaaaagtttaaaggctttatcgatacagcctttaaagaaatgaatggcaaatataaaatattagaagaacattctttaccagaagatttccgtaccattgatcaatttaaagaaggagactacttaaaagtagttttcatcgagaaaattaaaggttaataaagaaaaggagctcgagtttacttgagctccttttcttattgaacgatattttgtactctaccgacttgcccgtcctgcaatcgcactttaatgccatgcggatgggaaggggagtttgttaaaatatcttttacaattccacgtgttaatttgcctgttcgttgatcttgttttaatacaatatcaacttcaagaccgggggcgatattagaacgtttttgtccgttcatttatacacctgtacgtctacgttggttgtttgctttctttgtttgttggttttgtaatttttttgtttcttggctttgattttttgcattttgaccatttccatttccttgctttttcttagcaagttgttcacgcattaaatcagctaagcttacttttttgttttctgacatgataagtctcctttatataaagttaattatgaacaatcgtagtgaatttcatcatatcattgttaaggaaggaagggaagttggtttgaaaattcatataattgtttccagtctgtagtagttacgatacaattggattgttaacgtttgtaaaaaggggatagacatatgtcacatcatattttattagttgaagatgatatctcaattcaagagatggtggaaaagtatttaataaaggaaggctttcaagttacgattgcgtctgatggagaagaaggcgtgaacacatatttaaaaggttcatttgatttgattatccttgacattatgatgccaaagctagatggcttagaggttgtacgaatcattcgagaaaaaagtgcagttccgattttaatgatgtcggcaaaagatacagatgttgataaagctgttggattaggacttggagcagatgattacatttgtaagccgttttctatgattgaattggctgcacgtgtaaaagcaggtattcggaggtctacgaaatactcggctacagaaacaatagaaaaaatgattcaaattggtgatttaacaattgatccaattaattttactgtagaaaaaaacgggaagcctctcaaacttactttaaaagaatttgagattttaaagctattcgtaaagaaccaaaatcgtgtatttacgaaagcgcaaatatatacgttagtttggaatgaagagtattacggtgacgataacgttattaatgttcatatgagaagattgcgtgagaaaatcgaaagtgatccatctaatccagaatatattaaaacgctatggggcatcggctataagctggaagtgatgtaatatgatcaatttgttaataggtattatttttatattgttatgtgttatttatatgcaatataaaatgagaaaaaatagtagtaaaaatttacgatacacatatgaaaagttagaaagtattgtaaatgaaaaaacaggtgagacgttactcgttatgacagatgatctagaattgcaaaaattattagtggcgattaatcaattattagatgcaaaacagaaaacgaatgcagatcatgcaaaagtagaaatttcgatgagaaaaatgctttcaaatatttcgcatgacttgaaaacaccactaacagttattcttggatatacagaaatgttaaataaggataaaacgataaataaagaagaacaacaaatattacttgagaaagtgcatacgaaaacactagaagtgatggaattaattcataagttttttgatttagcgaaattagaatctggtgacaaagcaattgaaatgacaaaaataaatatgaatgaagtttgccgcgagaagattttatcattttatgatttagtgacgacgaaaggttttcaggttcatattgatataccagaaagaaatatatatgcacttggaaatgtagaagtattaggtagggtattgaataatttaatatcaaatgcaattacatatggagacgatggaaaggcactcggtatgacgttaagagatgatgacacgggcgtgtatatagatgtatgggataaaggaaaagggattgatgaatctcatattgataaagtgtttgagcgtatgtacacacttgaagattcaagaaatagattgtaccaaggaagcggtctaggattaacgattacgaaacggcttgtggaagcgatggacggaaaaattcatctttctagtaaaccgtatgaaaaaacaatttttacaattgcattaataaagatacagttttagcttgtagagcagtagattctacaagctttttttcagcgtaaggaatttgtaagaaacgggtaagaaaaaagagatttccgttgtctattatagaaatatagagtattgcgaaaggggaaagtaacatgacatatatattaaaaacaaaccagttaacgaaggtgtttaaagggaaagaagttatttccggtgttaacatgcatgtgaaaaaaggagaaatttacggttttttaggaccaaacggtgctggtaaaacaacgattatgaaaatgattacaaatttaataaaaccgacgagtggtgatattgaaatcttcggtgagaaattaacagatacatcttatgaagtattaaaaagaatggggacaattattgaatacccaatcttttatgataaattaacggcgaaagaaaacttagacctacattgtgaatacatgggctactacgataaaaatgcaattgaccatgctttacatttagtgaaactacaaggggtagataataaaaaagtaaaagatttttcattaggaatgaaacaacgactcggtattgcaagagcaatcgtgacaaagccagaattgctcattttagatgaaccaattaacggtttagatccaattggtattaaagagttacgagacttatttaaaatgctctgcaaagaatatggcattacattattagtttctagtcatattttaggtgaaatggaactaatggccgatacaattggtgtgattcaaaatggaaaactaataaaagaagtttcaatgaagagtattaaaaaaaaacaaacagag

SEQ ID NO: 1295 - DNA, 11135 bp, Bacillus thuringiensis
  unsure (1)...(11135): unsure at all n locations
agtacaggcttggctaaataatggaaaggatgatgagtccatagcacgagatcggcgtcttttccaacttcgatgcttccaattctatcctctaaacgcaaatttcgtgctgggaatatggtgattccttctagtgctgttttctcgtctaacccttctcttactgcaacagcagcgcaaacatttaaatattgaatgggtgtataaggatgatctgttgtgatagaaacttccacaccattttttgataatatatggtaagtatcccatgttttattttttagttcgattttagaacggcgtgtcagagtgggaccgactgaaaccttcaaattgtgttttgaaagttcttcaacaataaagtgtccttctgtgcaatgttcaatgcgtaaatcgagattgaattctgttgcaaagcgtagagcagaactaatatcatctgctcggtgagcgtggatacgtacgggtatttcacgacgtaatgcttttaaaataggaagcattcgaaaatcagcttcgtgcccgtagtgttgtgcttcatagaatgattcccgaagtaaccccataatccccatacgtgtaatggattcttttgttccattactatggacttttttaggattttctccaaaggcaatctttaaaccagcaggttcttgaataatcatatgatcaatacaagttccagctgtttttattacacaagtagtacccccgataatattttgactgccaggcataacgtgaacggttgtaattccgttttgtacagcgtcttgaaaggcaatatcgaaaggatggattccatctaaagaacgaatatgtggtgttgaaacttcagatgtttcattggcatcatttccagcccaaccagtaccttcatcatagagaccaaggtgagtatggacatcaataaagccaggtaagagatggagtgctcgtgcatctataacggtcatatcttgagtaggtggaataaaaggtttgacctcggtaattcgctctcctgtaacgagtacatctccttgaaacttttgagatgtaatagggtatacaatggcttgtttgagcaatattttcataggtacctcatttctgttactttataatgctaatggaagttaagggaaagtaactgaaaggttatttgtatggtaatgcttcggatcctagaaaatgaaagttttgaaagagcccatgtaaaattgtgttttagaagtactacattgtatgcgaaagtatattttgtaatgcatggtctatttctggaaatgtgtattggtatccatgttcaattgctttaatgggtaatacacgttgcccttctagtacaagtatgctcatttcacctaataaagtttgaatgataaaagaaggtacaggcaaccaatgaggctttttcattatagttgcaatggtttctccaaattccttcattcttataggtgttggtgctgtcatattaagaggaccatcaatttcttttttgtgtataatgaaatccatcatacgaacgacatcgtctatatgaatccatgataaccattgcttcccagaaccaatggtgccgccgatatagaattgatagggaagtagcatttttggaagagctccttcatttgcacctaatacaactccaaatcttgcgtagattgttcgtattccgagagaacgtgctttagatgcttcttgttcccatgaatatactgtatttgctaaaaagtcatttccaggagtctcatgctgttctgtaaaagactctatttcagacgttccatagtatccaatagcacttgcgttaataaatgtgtgtggctttgtatggagtccctgcaattgtttaatgagtccttttgttgtttgaattctactgtttaaaatggctttcttttgttgctttgtccatctactattaatagactctccggctagattaataactacatcaatagaagagagggggaaggtttgtaaatctggtgtccattgaacatactgaaggttaggatcggaagtttcagtagttttttttcgtgtgagaatgtaaacagtatatcctttttgaataaaaaaagtagaaagggatttaccgataaagcctgtaccaccagaaattgcgattttcacaagtatttcctcctcattatatatattcttgaaaagaaaaaatgttcctcgactatgttaaaataatagagaggtgagagtatggctgtcattacaaaaatagaagtacaaaaacgatcgaaagaacgatttaatatttatattgataaaggtcaaggcgaagagtacggatttagtgtggatcaagtaatcttaataaaacatggattacaaaaaggcttagaaattgatgaaatcgagttaggaaatattttgtacaatgaagaagtgcaaaaagcatatttacaagcaatctcctatttatcctatcaaatgagaacaaaacaagaaatagaagattttttacgaaaaaaagaagtgggacaggccatcatctctgaagtcgtttcgaaattattacatgaccgatatattaatgataaagagtatgctgttttatatacgcgaacgcaaagtaatgtgaatcgaaaaggtccaactgttattaaaagagagttattaaataaaggtgttcaggatttaattattacacatagtttacaagaatatccgaaggaaaagcaaattgagaatgccttgtttctcatagagaagaagaaaaaatcttatcaaaaacattcttttttacaaatgaaactaaagttagatgagatgcttgttcgaaaaggatattctagagaagtaattcaaatttgtttggaagaattgaaagacgaaaaagatgacgaaaagcaacaagaagcgttacactatcatgggaataaatattatgagaaatataagaagcatgatggatggacatttgaaaacaagatgaaacaagcgttatatcgaaaaggattctctattgatgaaatcgagatatttttgcaaatgaaacgcgaagaggaatgaggagaataagatgaatatgccaaaacgctacagtgaaatgacaccgcatgagctaagggaagaaattggcgctttgaaggagcaagcagtaaaagctgagcagcttgggattgtcaatgaatttgatgtattaatgagaaaaatggcaatggctcgtgcttatatgacggatataaacaaattccgtattggtgaaacatatgaattagtagaagaacctggtgtattatttaaaattacgtatttcaatggggtatttgcttggggatataagcaaaatgataatgaagagattggcataccaatttccttattgcaagaaaaataaaaaccagagagcatatatctctctggttttcatctttggtaggcgttaaaggagataggagattctaaaattggcgttttttacattcatttgccaatataatgagagactgggtttgttgcgtctgtccgttaacttgcgctttcgcatgttttggacgagtccacgtatggttaaataattcagaacgactatctaagcgatcacggtagctcatctttatcacctcgtgtaggaagttaatttaatttgtattactcttcctgctgatttgcagcacgcatacgttcttgtgggtgcgtgttaattgtgccgttaggtcgtttcgaagcgaagcgtgatttcgctttcggttgaccgtcgattttgctgttgttttttgactcagaccaaaattcggcttgtttacccattacgaacgccctcctcattatcggttgatacctctttaagaagtatcaattatagaatgtgcaaaattgaagaaactatcctttagaaatgaagggataaataggtaaaaggagattataatatgaatgatatttatgaaacattaacgaaagaattattagacaagaatgacaagctttcttacgcacaagctcgtgcgtgggttgagttactatgggaagattttcaaacaacttatgcaaaatcaggtcgttatcaaggcgatgaaatgacagaacaagtggtacgatcatggattaataatcatggtgtacgccttcatgaaatgcgtacaaataatccgaagtatagtcatttaattaatcaagaagatcatttgaaacattaaaaaaagcgacttaagtcgctttttttaatgtggaagtaattccagtttttttcgaagcttttcttcactaaagatccatcctgtataggaactaataatatttaaattgtggtcgagctgaacgattgcaacaaatggataataatctttacttcgatatcgtaaatcaatgaatcgtacttcataataatggtcatgatcaaaaatatcccagcgatatacaggagagaaagatagaaaggccgagatgttttcatcttgtttagctgctcgcataatattattgtctgggaacggtacccgatcgaacttatcatatatcatgatgttaccacggtgccatctcgcaacgtagtaataatcagccgtaacgattgctaaatggtaatggtaaaatcggtaagaaggagaaatgataatcttttcgacatttttgaaacgtttgtgtacaacgcttcttatatttctgtgcatcataatccgtccgatatagtaaacaatcattaatatatatgccgctaaagctgtatatcccttatgagaaccgacgagcatgcaagcaattgcaagtatatggataaagaaaattacggtatcgaatgtattaatcacgccgagtgcgacccatttttttgtgaaaggccgtaatgcttgtgtaccataggcattgaaaatatctacaaagacgtgaaggaagacagcaataaatgaccaaagcagtagatgaagatatggagcgtctgaaaagaaggcgaaagagatgccacttataaggaatgaccaaagaattaccgcaggaatagaatgagtaattccacgatgatttcttatatatttagcgttattacgcaattttaaaactgtgtcaatgtcaggaatgttggaaccagcaattgtagcaagcataacagcttgggggccaatatcactttgtgctatggctggatctaatgttgctaagctacctaaagtgatacccataacaaggtgagtggctgtgtccatagaaatccacctccgttttttattaatgtaactctttttattcgatacctcaagtcctttgccttctatttcctgtatcatcttacttaaattttttcctaaaatctttataatagtacttatatgcaaaaaaatgagggggatcaagtttgacacttgaaatactaaacaattttaatatagagcagtttcaaaatgatttaattggttggtttgaagaagaacagcgcgacttaccatggagaaagaataaagatccataccgcgtttgggtttctgaaattatgttacagcaaacaagagtagaagctgtaaaaccatattacgcaaattttatggggaagtttcctacacttgaagcgttagcgaacgcagatgatgaagaagtattaaaagcatgggaaggtttaggatattattctagagcacgtaatttacatgcggcagtaaaagaggtaaaagaagtatacggcggagttgtaccaagtgatgtaaagaaaattgaaaagttaaaaggagtgggaccatatacaaaaggtgctattttaagtatcgcatatggtataccagagccggcagttgatggaaatgttatgcgtgtattatctcgtattttatcagtatgggatgatattgcaaaaccaaagactcgaaaagtttttgaagagattgtgcgtgaaattatttcagtagaaaacccatcttattttaatcagggattgatggaattaggtgcactaatttgtattccgaaaaatccagcatgcttactttgtcctgtacgtgaacattgcagaggatatgctgaaggtgttcaaaaagaattaccagtaaaaagtaaagcgaaagctcctaaaatggtacctattgttgcaggtgtacttcaaactgaagacggtcgttatgttattaataaacgtccaagtacaggtttgttagctaacatgtgggagtttccgaatgtggaacttggagaaggtattcgaaatcagaaggaacagcttatagattatatgaaagaaaaatttgagctcgaggtttctattgatgaatacgcaatgaatgtacaacatacgtttacacatcgtacttgggatatatttgtattttacggaaaaataaccggtaatattgttgatacagatacattaaaatttgtatcaaaagaggtatttgagcaattacctttctcaaaatcacaccgtactatttatgaaaattgtgtggagaaaattacaatgcaataaacaaaaaaagtgttcccaatctagggaacacttttttaatcgtaagaaatttttgtcccatgagtccaactagcttcaccttcttgtaagccgcctcttgattcgatttctactacaatttctttgtaaatactttgcccttctacatttaaataaggcagaacctgttgtagtgagtgatgaaaataagctaattcatcttctttccattcattttttgaaatcatcgttagttcagtcatatcgcgtcctatatacatatttacacctccattttctatagtttgaatgagtaacaaaagttatatgcggaaattttaaaaaagaaaattacggatagcttctaagtgaattggttacattattgattgtggaggtgagaaagatgagtaaaaaacaacaaggttataacaaagcaacttctggtgctagcattcaaagtacaaatgctagttatggtacagagttttcaactgaaacagatgtacaagctgtaaaacaagcaaacgcacaatcagaagcaaagaaagcacaagcttctggtgcacaaagtgcaaacgctagttatggtacagaatttgcaactgaaacagacgtgcattctgtgaaaaaacaaaatgctaagtcagctgcaaaacaatcacaatcttctagctcaaatcagtaatgaaagaaaaacacttctctaattcgggagaagtgttttctttttgcgtggatcgttgtaatgaaaaggaagcgaacgacataacttctaataagtcaacaaatgtagtcaaaggagaaggaagttaaaaattagaattatgtaattaggaataataactgatgaataagtccaaaagggggtaagtaatgaacgattttgataagttggtaggggagcaattagaaacgatggatgagttgttaaagttacaagcacatctagagaagtatcaacaaatcgaaatgaatgaaaaagatacgtgcgataaaaaagaactgcattttatccgtcaggaaatatatagaacagaagtagcgttgaagatgttacatgagaaatttgaagaacaaacgaatagtgtaattcaatcttttacaactgaaaaaatgatttcaaatttaggataagatatattgttatcttcaggtgaaaagtccttctttgtatggaaatagagaagggctttttctattacatgtcctcgcttataaataatgcagtacaatccctatctcttaagaagagttggggcatagtattcaacgataaacctcctgcatattcagtttgaaaaatagagtcttatccctttagttttaaaatttcgacaaaaaagttataatagaaaaaaagtgaatgccgttcaaagggcatttgcagttgaaagaagggagcatatatgggatttcccaaagaaggagaaaaagtacaaatacatagttataaacataatggctccattcatagaatgtgggaagaaacaacaattttaaaagggacacagagtcttgtaatcggagcgaatgatcgtacagtagttacagaatcggatggccgaacatggattactcgtgaaccagcaatttgttattttcatgccaactattggtttaatgtgattgggatgcttagggaagatggcgtatattattattgtaatttaagctcaccttttgcgtatgatcctgaagcattaaagtatattgattatgatttagatattaaagtatatccagatatgacatatacgcttctagatgaagatgagtatgaaaaacatagtcaaattatgcagtatccacctgttattgatacaattttaaaacgaaatgtagcacatttaacacagtggattcatcaaagaaaaggtccatttgcaccagacttcgtagatatgtggtatgaacgatatttaatgtacagaaattaaaacaaacctgcagggggcttcccggcaggtttgtcctattagaggggggattatgtgcaaggcataaaaagatatttacaatttgttaaaccatatcgatggcttattgctattacaattattattggactagttaagttcggtatcccacttattatgccgtggttattaaagtatattatcgatgatgtaattcaaggcgcgggctcacttcaagataaaacatctcaattaataacagcgattggaattgctttttttatttttgcggtattaagaccaccgattgaatattatcgtcaatatttcgcccaacatatcgcaaatacaatactgtatgatttgcggaagcatattttcggtcacttacaaaagttaagtttacgttattactccaatacaaaaacaggggagattatttcgcgtgtcatccatgatgtagaacaaacgaaggattttgtaattactggtttgatgaacgtctggttagatactgcaacaattgctattgctatcattgttatgttttctatgaatataaaattaacatttgttgcgttattgattttacctatttatgtaattgcagtgaaatattttttcggacgtcttcggaaattgacgaaagagcgttcacaagcgttagcgacgatgcaagggtatttgcatgaacgtattcaaggaatgcaagtgacacgtagctttgcgttagaagagtatgaggggaagcagtttgaaaaaagaaataatgaatttttaacgaaagcattaacccatacaagttggacggcaagaacattttcggcagtaaatacgttaaccgatttaggtccgttacttgtgattggttttgcagcatatgaagtaattcaagggcagttaacgctaggaacgatggtagcttttgttggatatatggatagtttatatagtccgcttcgccgccttgttaattcatctacaacattaacacaatcttttgcatcgatggaccgtgtgtttgaactgttagatgaaaaatacgatattgttaatgtaccaaatgcggtacaaacgaaaaaattaaatggagaaattgtatttgacaatgtttcttttcgttataatgcagatgaaaaagagatattacacaacttgtcattaactatgcagcctggagagaaagtagcgcttgtaggagcgagtgggggaggaaagtcatctcttgctagtttgatcccgcgtttctatgatgtttctgaaggcgcggtttatgtagatggcatagatgtaagaaagtacaatatgagaaatttgcgtagtcatattggaattgtactgcaggataatttattgtttagcgatacaattggagctaatattttatatggaaatccgaaagctacagagaaagaagtgattgcagctgccaaagctgcgcaaattcatgattttattatagacttaccagatggttataatactgtcgttggagaacgtggtgtgaagctatcaggcgggcaaagacaacgcgtggcaattgcacgagtgtttctaaagaatccgtcggtacttatattagatgaagcaacttcagcattagatttagaaaatgaaaggtatattcaagaggcgcttcagacgttagctgctgaccggacaacgattataatcgcacatcgattagcgacgattacgcatgttgatacgattatttacattgaagacggtgagattaaagagactggttctcatgaagagttaatgcgaaaaagaggattttattacaatttatatcaacttcaacatataacagaaacagctcctttaccataaaaggagctgtttttttattcgtcttcttttttatcatcgatttggagttctttttctggtttatgatatgtgtagaagctatctacaagcaaatctaaatgctctacttcttcgctatagttaatgatggaagaaataagagggaagagatgtaaccatgttttatatgcttcttcatcgtccttattttgatattccataaagatatcaattaattcttgtttacctgtttcaacttcatcaagcatttcaactgattgttgtttttttgctttaccaataaattttaataaaacttgttcatgataatgcgttaatgagtcaagttcattttggatagattcctgaaattcttccggcatatagcgcagttcattttcagtacggtgtaatgattttaacgtacttaaagcacggcttgttgtcgctaacatttgtctgaataaaacgagcttacgaatttttgcgaactttacttttttcgtatagcttctttcttctttatacagcaaatagtaatgatttagtttaatcattttttctttcatacgatcaatatcagtttttagcgttgtaaaatcagaagcctgcctgctattcattcgaatccattttacaatttcttctgtattatcaacgatacgatgataaagttttgtttcatattttggcggcataaatactaaatttacaagtgaagccgcaataataccaatcataatcgtcgcaaatcgaagtaaggcaaaactaaagaaatcttcgccttgatactccataatggcgataactgttactaaagcaattgatattgtgttttctaatcgtaattgtaatgtaagagcaattactaatatacatgttaatccaataataaaaggattatgtccaaaagcagtagcaaatgcgatagcaaatatcgcaccaattacatttgcttgaatttcctcaagtgctgttaataagngcggtataacngaggatgacagcaaagatagatg

SEQ ID NO: 1296 - DNA, 7269 bp, Bacillus thuringiensis
aaaaaacttcttttgttaaagaaaaaaggaaacggaaatactgttttaaaaagaacattatacgcggaaatagagaaggcattcgtgtttaaaagattagaaatagcagggtttaagtcttttgctgagcgtgtatctgttgattttgtcccaggtgtaacttctgtagtaggacctaatggaagcgggaaaagtaatattactgatgcaattcgctgggtacttggtgaacaatctgcaaaatcattacgtggtgcaaagatggaggatattatttttgcaggcagtgatacgaggagagcggttaatgttgctgaagtaacaataactttaaataatgaagatcaacgtttaccaattgaatacaatgaggtgtgtgtaacacgtcgtgtatctcgttcaggtgatagtgatttttatattaataaacaatcatgtagattgaaagatattatcgatttatttatggactctggtatgggaagagaagctttttcaattattagccaggggaaagtggaagagattttaagtagtaagtcaggcgcgacacgtttctctataagcgtttagacgtgaagtgagagtgttgctgaaatttatcttaagcaacaataactaatatatcgagagttggaatgaaaatcgtcatgttgaattgaaacaactccattaatactcctacatgcatgatttgttagtagacagattgtgtatgaagctaggtgaagtcggctgaacgagcctaagtgatttttaatcatatggtgtaggataggtcggatggctgaaaagataactatggtgagaatgtcccttatgggtctgacgaatttgcgaaggtacgggtctaaaattgcactataccgaaaggtatagcacacaagagtgtggtagggtaccgagaagtacgaatctgacggtaggaaatcgggataagcaacgatgagcttataaactctacaggcttatagcaaacacctacggttatcatgaatagctagatatattggaacgtgggaagcaaaaaactgctaaatgaaaacagctactactgggcaggtggatataaggtaattagccgaaattcctttatttttgtgaaggtaggggcacagtaccgttgaagcgtctaatgaacgtggagggatggccccaagtctagtttgttttatgtttaattttaagaaaatgaagctcaatggtcaggtaggaatgtgggcaaaaacctaggaggtttccacagttgagcacaacaatgagatattgggaatattacaatatgcaagaaacatttgataggttatatgaagaaagtcaaggaaataaatcattccatggtctatatgaattgattacttcggagaacaatattcttttagcataccgaacaataaaatctaacaaggggtccaaaaccgctggcacggatttgttcacgatagataattataaaccaatgtataaaaaggaattcttatcattggtttgtaaacaactagagatatacaaaccaaaagcagtaaagagagtttttattcctaagtccaatggagataaaagacctttaggaattccaacaatgtttgatcggttaattcaacaaatgattaggcaaattttggagccgatttgcgaggcgaaattttacgaacatagttatggatttcgtccgatgagaggaacaaaacatgccatttctagagtaatgtttttgataagcagaaatacttttcattacgcggtagatatagatataaaaggattctttgacaatgttaatcacacattacttctaaaacaattgtggaatatgggtattaaagataagcgagtgttaaaacttatctatttaattctaaaagcaccaattaagggatttggaattccaaaaaagggaacaccacaaggtggaatactctcgccattactatccaatatagttttaaatgatttagaccaatggatagcaagccaatggcactattttgaaacatcatatccatatacaaataatgcaaatcaaaagcgagcaatgaaaggtaccaaattgaaacaaggatttattgttcgttatgcagatgattttaaaattatggcaaaggatttccgaacggcacaaaaatggtttttcgcgacaaaaatgtatctcaaggaacgattaaagttggacatttcaccagaaaaatccagaataatcaaccttagaaaaaacaaatctgagttcttaggatatttattatatgtagtacccaaaagaaacaaatgggtttgtaactctaggatatcaaataagaaaaagaagcaaatcaaacttgagatcaaaaagcgaataaaagctattcagttgtcatcaactcggaaaaatgtgcaattatataatgcctatgtacttggactgcgtaactattttaggtatgttacacatgtaaatattgaaatgaaacagcttgcatttaacctatcattagtaatattcaatcgattaaaaagtgtcgggaaatatgaagttccaatcaatgcacctccggtgtttacaaaattctttaaaaataattatcgaacatttaaagtatgtggtatttacttatttccactagcggatatacaaacagcaactatatggaattacacgcaaacccaaacaccttacaatcaaaaaggccgaaagattgccaaacatattgagttaaataaattggtattaggcgaaattaagaaactactaactgcaaatatccctaatgaaagtatagagtacttggataatcgaatggcaaggtattctatgttgaatggaaaatgtgagatacttaaagaatttttaccagcaagtgagctacattgccaccactatattccgaagggattaggcggaacagatgagtatgaaaatcttagaatcattcataaagaaattcatagattaattcacatgacaaataaacaaacgattgaatcctactttcaaaaacactcgttgactgtggaacaagttaaacgaataaaccaatatcgaagagcttgtaatttagaaaaaattaaacaataaacaaattagatggagcgccgtatgaggtgaaagtctcacgtacggtgtggagtgggggaaaaggtagagataacttcaaatccttacctatcactaacaaaacgtgctgcggatggaattggactaattattacagaaggaattgtcattagtccgagagcaaaaggaaacccaggagtaccaggtatttatacacaagaacaaatcgattcttggaaacctgttacagaggcagtacataaagaaggcgggacgattattgctcaaatatggcatgttgggcgtatgagtcatcatgaaataattggtggtcaaatgccacaagcaccatcggctatcgctgcagagggaaatgttccacgctttcgtaaaccgtttgatacgccagaagcaatgacgttagaagaaatacaagaagtgatcggtcaatacgcacaagctgcgaaaaatgcgatcgaagctggatttgatggagtagaaattcacggtgcacacggatatttaatcgatcaatttacgtatgagtttgcgaataagcgaacagataaatatggcggtgatttaaaacaaaggttaacgtttatgaaagaagtaacggcggctgtaatagaagctgttggagctaataaaacacttcttcgtttctctgctttcaaaggtgataatcctacttatatgtgggaaaatcctgagtttgcaattgaaacgttcataaatatgtttaaagaggttgggttaacgatgatccatccttcaacgatgaattatacgcaagagattgctgacggaaagaattttcatcaactagtaagaaaatattgggatggtacgattgttggggttggtaatttaaatccgaaagaggccgaagaagcgttgcaagaaggaacgattgatgtagcggcattcggaagaccgttaattgctaatccagactttgttcatcgaattaaacacgctgaaagtttagttgaatatgacgcgaaagagcatcttgctacgttagtatgaataaagataaaaggagagcacatcgagtgttctccttttattatggaatttcatagggggaagcgggatgagtgaaacgctactcgttattattagtatattactatttttaatgttgcttttaatcgtcttttttatcattacattttttataaaaaaacgaacacaccattctattttaaaattacatccgtacttaggaagaatgcgctacttactggaaaagatagggcctgaatttcgacaatattggtttgatcatgatacggatggaaagcctttctcacgttatgattttcaaagtgttatgtttttagcgaaatatcgctctgaaatacttggttttggatcaaaacgagattttgaagcttctggatattatattgctaatacattatttccgatattaactgaggaattaagtgtgaatctcacgcaagagcgggaaggtaaaaagtacgtgattcataaagaagggttattttcaagaagagaaaaattgacagcggatacaacgaatctttggctgtacgaagaagatgatgcaattatagtcggtgagaaccgtaaatatccgtggaagctacatggcatgtttggtgcatctgcgacttcttacggtgcgattggagaaaattatattttagcgagtggttttggagcaaaaatggcaggcggatcgtggattaatacgggtgaaggtggcgttattccagaacatttacatacaggagcgagtatcgttgcgcaaattggtccagggttatttggataccgtgatgaagacggtaatttttcaatgggaaaattcatggagaaagcgaaagaaagtaatattagagcattcgaattgaaatttgggcaaggtgctaaaatacgtggtggtcatttagagggacaaaaagtaaatgagaaaattgcttttgttcgcaacgtccgaaagggagagacgattaattcaccgaatcgattttcatttttaaagaatgcagcggatacactttgttttattcaacagttgcaagaaaacagcggtaaaccagttggaatgaaaattgtaattggtcagcaggagcctttggaagatttaataaaaacaatgaaagaactaaacatttacccagattttattacaatcgacggttcagaaggcgggtcaggggcaacgtataaatcgatggcagattgtatgggactgccgcttattccagcattacttacatttattgatacagcaaaccattatggtgtccgtaacaagtttaaagtatttgcatcgggtaaattaatcacaccagataaagtggcgattgctttagcgattggggcggatgctgtaagttcagcccgtgggtttttgatggcaagtggctgtattatggcccttcaatgtaattctggtcaatgtccatctggtgtagccacgacgaatccgcattatcaaaaagcgttagatccgtatgagaagaagtggcgagtcatgaattatattattagtatgagatatagtttattttcattagcggcagcggcgggagtgaagagcccgcgccatttaactagagagcatattgtgtttaaagacgaggtggggagagtagttcctctttcggaattgtttcctatagtaaatcaaacctaaaagtatatttgatgtgtaagattttttagaggaataattatatttttggaaaaattaggagtataataggggagtatttttgaaaatgactatttttagggagagattcacttgcagcaaggttcgtacagtattacaatttttttactcgtcatagggctcgttatatttagacgcatgcgctctatgaatcgaccaattaataataaaggaagacgactactattgccattattcttcttattaccaggtttttctttatacgcagcaccgatacaacttgctggttggcaaattggtatagctgctgggatcggactgttattgtcaattccacttattattttaagtgggtatgaagtcagagaagatggtcaaatttatgcaaaaaaaagtatcgcttttattgctacatttttagttatcgttcttttacgtgcttattttagaagacatttacaaggtctagatccaaagtcaatcggcattcttttctacactcttgcggtttgttatatagtaccttggcgtattggatgctatatgaaatttcgtaaagtatatgtagagaaagcaaaatttgagacgtcaataagctaaaagtcatacatttgtatggcttttagtttttaaaatttatcgggtaaaggaatgaaaataaggtgtgaaaaaacactctttaatcttctgaatattattactttaattccttgaaaaatcattgtaatccactgggataaaggcgtttataaaggttttcacatgtaatgaaaagtgctcgttcacttgaaagaacaaaaaatgtttgttaaggtagggaaccataagtgaaaacaagaaaaatgaaagtaaggacttattgacaataaaaaataagtaacttataataaatcttgagttcgagataaataatgttcataatgaaaatttattatggttataaatcgaacaaatattttttgtgaattatcttgaattcgagataattcaataggttagacgccgatacgtaattttgtgattaatatctcgaattcgagataaaattataatgacggattttactttgtagcatggacaaaatgaataatgaatttaaatgtaaaagaatttttataatgaaataaaaaagacctgcggtagtatgtcaactgaaaaacaaaagaatttttagttatcaaaggcctatttactaaaaaaagacatcacgaaactaaaccagtaacgtatgtaatttactggaaattaattgaaaggtagcgatgacaagttttatgtcacactttcacgcacctttctggcgtaaagagttggtgactacgtagtagcgcatccaccaatcgcacaagttttcttgcggttagaacgagtgcacgtttgtgttgatgttttggtacttcattatatttttttacgtaatattcttgataatcagatacgtgccttcttactgagttggcggcttcaactaagtaataccgcaagtaatgatttccattacgggataacgaagtgttttctgcggtgaatcgaccagactggtgcgtacgccaatataatccgg

SEQ ID NO: 1297 - DNA, 12980 bp, Bacillus thuringiensis
atctacaagtacttaacaacttgtgatgggcttaatgcatttgcaacatattcaactggatcatttgaccagcggacgatgtcaattttttcaccttttaattagtctacaatgcgttgtacacgttgcccttttggtcctacacaagaaccaactggatcaacatcagtgttctctgcatatacagagatcttagagcgatcgccagcttcacgtgctacagaacgaatttctacagttccatcatagatttcaggaacttccatttcgaataaacgttttaaaagaccaggatgtgtacgtgatacgtaaatttgtggtccttttgtcgttttttctactttcgtaatgaatacgcgaatacgatcatgtggtttgtattgctcattaggcatttgctcacttacaggtaataaagcttctacttttcctaagcttacatagatgaaacgagcatcttgacgttgtacaatacctaccataatatcttcttcccggtcactaaatcagaggtaaataaccccgcgctttgcttcacgcactcgttgtgtgacaactgttttagcagtttgtgctgcaatacgaccaaagtcttttggtgttacttcaatttctagtacgtcaccatcttggtagtttggattaatttgtcttgcttcctctacagaaatttcaagacgtggatcaaacacattgtctactacgtctttacgtgctaaaacttgaattgttcccacttctgggttaaagctcacacgaacgttttgtgcttgattaaaattgcgcttataagcagagattaaagctgcttcaatcgcatcaataataatgtctttgctaatgcctttttcagattctaatacgagcaaagcatctaataactcagtgctcatgaagatcccccttctaactaaaacgtaacagcaagtcgcgcatttgcgactttatccatcgaaatttggatttcttttttacgtgttttaattgttaataataatgttattgttgtaccatcgtaagaaagcagttttccttcaaacatcttttcaccatcaatcggctcatatgttttaattgccacttgttttcctaccgcttgctggaagtctttttctttctttaatgggcgttccgctccaggagatgatacatccaaaaagtaaagatgaggaattggatcctctttatctaaagcttcgcttaaacgttcacttaccgcaccgcattcttcaatgtcgactcccttttcagaatcgatgaatacgcgtaagaaccagtcttgtccttctttcacatactctacatctacaagttcaagatttaactcttcaacgatcggctgcgcaaatgcttctacaacttctgtgactttcttatccataaacagcctccttcctgccgtcatgtaccatttaaaagaagaagaccccgccactttaaaaacggtctatcttattctttctcgttagctaacaaaagcccctgctgttcagcagggattatctgtcttagtattaccaaatttaagaagtaaaacttgtaacaaaatatgtatatacgacagaaatcttttacctatctacgtagagaaaacatagatagtaacacgaaagagtgggtttccccactcttttctttacacaatatacatgacatggttatctcggttaatagtatatcataggaaatgttgatttgcaaagacttttcctacctactagaacagtgataactggttttgatccggtaaatctcctaaacaaccttgactatctaaatactcaataattgttttcgaaaccttactacgctgctgcaagtcctcttttgataagaagtctccatttttacgtgcttccacaatacttaaagctgcgtttgtaccaagaccaggtaccgcattaaatggaggaattaatgtgtctccatcaataataaattctgttgcatgtgagcggtataaatccaccttttggaatgagtatccacgctcacacatttcaagtgtcatttctagtactgttaataaactcttctctttcggcgcagcatcgagtcccttttgagcaatttcatcaattcttgcacgtatagatgctgaacctttcgccattgcctctacatcaaaatcatctgcacgaactgtaaaatatgcggcatagaataacagtgcaaaatgtactttaaagtatgcgatacgtacagccataagtacgtaagcagccgcatgggctttagggaacatgtatttaatcttcttacatgaatcaatataccaatctggtacattattatttttcatgtcttcttcccattcttccggtacacctttacctttacgaaccgactccatgattttgaaggctaatgatggatctagaccttgatagattaaatataccatgatgtcatcacgacaaccgataacttcgctcagcgtacatgtaccgttataaattaactcgtttgcattaccaagccatacgtcagtaccatgtgatagtccagaaatttggactaactctgagaatgtcgtcggttttgtctcttctaacatctgtcttacgaattttgtaccaaactctggtataccaagtgtacctgttttacagttaatttgctcttccgttacccctaacgattctggaccagagaaaattttcattacttctggatcatccgttgggattgttttcggatcaataccacttaaatcttgtaacatacgaataacggtcggatcatcgtgtcctagtatatcaagttttaataaattatcatgaatcgagtggaaatcaaaatgcgttgttctccattcagcaccaattgaatcagctgggtactgtattggtgagaaatcaaagatatccatgtaatctggcacaacgataataccgcctggatgctgtcctgttgtacgttttacaccggtacaccctgctactaagcgatcaatctctgcatttcgaatcgttaagttatgatcatttgcataaccttttacatatccgtaagcagttttttccgcaactgtaccaatcgttcctgcacgatatacatagtcttcaccgaacagtactttcgtatagttatgggcacgtggttggtattccccggagaagttcaaatcgatatcgggcaccttatctcctttaaatccaaggaacgtttcgaaaggaatgtcatgtccatcttttacatatggaatattacaagcaggacattctttatctggtaagtcaaaaccagaacctacagaaccatcattaaagaattctgattgcttacacttcggacatacatagtgtggtggtaatgggtttacttctgtaatttccatcatcgttgcaacaaatgatgaccctaccgatccacgcgaacctactagatatccgtctactaacgattttttcacaagcttatgtgaaattaaataaattacggcgaatccatgcccaataatactttttaattctttttctaaacgtgcttctacaatttccggtaactcttcaccataaatgctacgcgccattttataactcatatcacgcgtttcatcatcagcaccttcaattttcggtgtgtatagatcgtcttttactggatgcacatcaccaattaatgacgcaatcttttgtgtatttgttacaacaacttctttcgctttgtcttcacctaagaatgaaaaacattctaacatctcatcagttgtacggaaatgtactggcggtaatgaatgtcgatttaacggattggctccgccctgcgaactgactaaaattttacgatacatcgcatcctcagggtctaaataatgcacgtttcctgtagcaacaactggtttatctaacgtctcacctagttttactaagttagaaataattgtttttaattgaccttcgtctcgaacaagctcacgttctactaaatgacgcaacacctctggaggcattacttcaatgtaatcatagaactgggcaatttcttctacctcttcaggtgccttttgcatcattgcctcaaacacttcacctttatcacaagccgttcctactaaaatcccttcacgatatttttttaatagtgatctcggcacacgtggtacacggtaaaagtaattaaggtgagaatatgaaacaagtttatataaatttttcaatccaacatctgatgtggcaagtaacgtcatatgacttggacggccacgcttatacgcatccccttgtcccatgctatcatttaattgatcgtgatattcaaatcccttttcaattacgtctttcaacattttcacaagtaaatatcccgtcgcttctgtatcataaatcgcacggtgatgttgtgttaattcaatatcaagttttttacacatcgtatttaatcgatgatttttcatttctgggaataaaaatcgtgcaagttctaacgtatcaataactggattattcgttttttctagtccagcctttttaaaacctacgttaataaagcccatatcaaagctcgcgttatgggcaacaagtgtatggtcgcccatccattcctcaaactttttaaacacttcgtccacttcaggtgcatcagttaacatatcatccgtaatacctgtcaattcaataatcgtcgctgataatggttgatgtggatttgcgaaagattcaaagcgatcaataatttcgccaccctttacttttacggcagccaactcaatgactgtatcgtatacagctgataaacctgtcgtctcaacgtcgaaaacaacatacgtttcctctgcaagtaaacgatgcgcttcgttatacgctatcggtacaccatcattaactagatttgcttctacaccatatataactttaacaccagccttcttccctgcagaatacgcctctgggaaggactgagccacggcatgatctgtaaccgcaatagcctcatgtccccatttaccagcttgagcaacaagcttagaaactggagtgacagcgtccatttgactcatcggagtatggagatgcagctctactcgtttttcgccttctggtgctttatctttacgagacggtcctgttatttcattaatatcatttgcaatcattactaaatctcgaacgaatgtatcgttttgaacagaaccacgcgctttcacccacattccttttttcaaggattgcagcattggaatatcttctttgtcacgcgagaacattttgatcataatagaatccgtataatccgttatttttaaagttaataacgtacgcccactacgaagctcttttgtttctacatggaagacatatccttgaaccgtttttcttctttcttcatcttgaatttctcgcatcggtgtaatctcttcatctggcttaataagatacccgagtgtaatcggtccttcatacacaacgctgctttcttcagcttgcttcttcgccatttcttccatagcttgtataacacgctcacggtcttcttgctgcgtttgttcacgaaacttttgcatttcttctgtattttgctgtatatgtgtgtctaactgaaaacgcgggaatccaaaaacttcgtattgatcccctactggtttcgcaacgtttttctttaaagccgtagactccagctcgttatttacatttattaacaacttcactccattcacctgtggaagctgcttctttaagtatgcgaacataggtgaaaatgtaattcgttccgtacaaagcggccaatacgccctcacttcttcttctgtaaattgtttattctctgtttctaatgcaaatgttgttcttgcaatatgagaaaatgattgcttaagctttgtttctagcaattcatataattctgtaggcaaaatacgtggcacttgtaaatcaaaatgccaacttttattcgctttatcaataacgagcctttcaataccaccgccttgtaaatattgatttataaggtcgtctggtatttgcaactgctggagcaaaatttgaaatcgctcttgttgttcatttgttaaagacataagcactctccttccatttgctattataaattgaaacgtaccacaaagaaagatttctcacctcttcttttacaaaatacgtttacaaagaaagagaaggtaccccattacgaggtacctcttcttattttaaaatatttgcaatatatgtttgaagttcttctacttttacttcttcagactcacctgtagcacgtactttcacttctacaataccttcgtctgcttttttaccaactgtaacacgaactggaagaccgaataaatctgcatctgcaaatttaacacctgcacgttctgcacgatcgtctaataacacttcatagccttgttcttgtaatgagttgtagatattttcacccatttcacgttgtgcatcagatttcatatttactggaattacatgcacatggaacggtgctaccgcttttggccaaactaagccgttctcatcgttaaattgctctgcaattgctgctactgtacgagatacaccgataccgtaacaacccataataagtggttgtgtttttccattttcatctaggaatgttgcgttcattgcttcactataacgagttcctaatttgaatacatgaccaacttcaattccgcgtgcgaaaagaattgttccgtttccatctggagattggtctccttcttgaataaagcgtaaatctgtatattgacttactttaaagtcacgttctggatttacatttacataatggaacccttcttcattcgctcctgaacatccgttaacaattgatgctacagcgtgatcagcaataatttcgatatcacctgttacattaatcggtcctaatgaaccaacttcacaatttaataatgcttttacttcttcatgagaagcaagctcaacaactgaagcgccatatacatttttcactttcacatcgtttacttcgtgatcaccacgaacaagtacaactactaatttctcatctactttaaacaccatagacttaatgcacttgtcagctgcaatgtttaagaatgcagatacttcttcaattgctttttggtctggtgttgctactttttcaagtgctttttctgcttcgtcactcttcgtatacgtagctacaacaggagccatttcgatgtttgctgcataatcagatgtgtcagagtatgcaattgtatcttcaccaacatcagataataccataaattcatgtgtatcttttccgcccattgctccagaatcagcaataactgcacggaaattcaagccacagcgagtaaaaatgttagagtatgctttatataagcgatcgtatacttcatctaagctctcttgtgtagcatggaaagagtaggcatctttcattagaaactctcttccacgtaataagccgaaacgaggtctttgctcatcacggaattttgtttgaatttggtataatgttaacggtaattttttatatgatttcacttcatcacgcacaagatccgtaattacttcctcatgtgtcgctcctaatgcgaattcacgagcgttacgatctttcatacgcattaattcagatccgtaagaataccaacgacctgattcttgccataattctgcagcttgcatagctggcattaataattctacagctcctgcgcgctccatttcttctcgaacgatacgttctactttgtgtaatacttttaatccaaatggtagaaagctataaataccagaagcattttgacgcataaaacctgcacgaagtaatagctgatgactcttaatttcagcatcagctggaacttcacgtaatgtaggactgaataccatactttgtttcatttatttgcacctcttcattttactcttacacgcagtaaaacccctcacctcgagttaggtgagggattttattctacgagctctatttcattataagtttcactttattttacaagaaaaacttacgaatgtcattccaagttacaactaacataagtaacattaataatgcaaaaccaataaagtgaaccattccttctttttggcgatcaattggtttccctcgtaacgcttcaattaagaagaagaataaacggccaccatctaaagcaggaactggtaataaattaaataaaccaagattaatgcttagaactgcagctaaacttagtacacgcgtaaacccataatctacaacttgatctgttagattataaattcctactggacctgacaactcattaatagaaaattgaccagttactaatttcacaagagactcaaaaattagtttcgtccattggtacgtttgttcaaaacctgatttaatagaacccatcactgttttctctacaggagagtagacaccaattctaccaacttcttctttaccttctttatcgagtgttggcgttactttcacattaaactgttcattatcacgctttacttgtaacgtaatttctttatttgggttttcacgtacaatagtaacaacatctttccatgtacttgtgtttttcccatcaatagcttgaattgtatcattctctttcaatccagcttgctgtgctgcactgttatccatcacttttccgaccattggtttgtcaacaggaaccccttgtacaaatccaagaatcacaaaaataacaaatgctaaaatgaagttcattgcaggacccgcaaagattgttaaagcgcgttgccctagttttttcgagccaaattgtctattatacggggcaatttgaatttcttcccccgcagtaataatacgagccttttcattcactcggaatgtttgaagctcttcctcgtactcttcatagcccgaaattgttaaattatgctccaaatcagcttgttcgacttcaataacacgaacatttggatacttttcatatccatcaaaaactaatttcacaacttcgtctttttcatttaatacaaggccaacctttttcccaggctttaactcaactgtgtccgcatcctcgccagccattcttacatagccaccaaggggcagtaatcgaatcgtatacaccgtttcattcttttcaaatgagaatattttcggaccaaaaccaatcgcaaactcgcggcataaaatacctgctctttttgcgaaatatagatgccctagctcatggaaaaatacgagtgcaccgaaaattaatataaaggcaatcgctgtattcaattccataaccacctttgctaaatttgttccatcacaaaccgtcttgtggccgcatcaatttccaaaatttcctctaagctcggtcgtgcaatgacattgtgatggttcattgctttttcaatgaggtcttccactgttaagaaatcaattctcttttgtaaaaaggcttcaacagctacttcattcgctgcgttcattacagctggcatacttccacctgcttttccagcttcatacgcaaaacgtaaacaacggaatcgttcttggtccattttctcaaaatgcaacgtccctatttcccataagtttaactgttttgtgtctgaaagaggcaatctatccggatatgtaagtgcgtattgaattggtactcgcatatcaagtgaaccaagctgcgccattacactacgatcttcaaattcaaccatagaatggataatactttctttatgtaaaacaacatcgatttgctcataaggaataccaaaaagccaatgtgcttcaattacttctagtcccttattcatcattgtagcagaatcaattgtaattttcgaacccattgaccagtttggatgtcgaagcgcatcttctacggtcacatgatgcaattcatccctcgttttatcgcggaaacttccaccagaagccgttataataagacgagaaattcttttttcattttcaccattcaagcattgaaaaatagccgaatgttcactatcaactggaagtaacgaaacattatgttttcgtgctgcttccattacaagatgtcctgcagttactaacgtttctttatttgcaattccaattgtttttttcgcctcaattgcacgaagtgttggtaacaaccctacgctacctacaacagcatttactacaatctccgcatctggatgtagtgctacttctaaaagtccttcactaccatatacaatttttgtattacctgaaacagattgtaattttaaaacatcttcttctctttgcacagagacgatttgcggagaaaattcttgaattacctttactgcgtagtcaatatttttccctacagaaaaagcaacgagacggaattggtctgggtgcgagcgtaatacatctaaagtttgtgtaccaattgatccgcttgcacctaataaactaatgtttttcatgactccaacccctcgttcatttattaattatattgtaataagaagtagagaattggtaaaacgaataaccaactatctgttcggtctaatataccaccatgcccaggtaaaattgtacctgaatcctttacgccataatgacgtttaaaagcagattgtactaaatcaccaatttgtccaaaaatagaaataataattgtcagcacaattaaaattactacattcgattcgactgggaagaacacgttgtaaacaagtgccacaataattccacaaacgatgccccctaatgaaccttcaatcgttttatttggactgatttctggccacaattttctcttgcccaatgcttttcctacgaaatatgcgcctgaatcagtagcccatataacaaataatgcgcaaaatacatatttaattcctaatattctcgtttcatttaaatataagaatcccattgccacatatgtcgttgccatcagtaaaaatgaagcattatcaaaagtaaatgtattcttagaaaggactgtatatgataaaagtaataaaacaatcacaaatgtgatttccaatttacctaatccaatccatgtaaacagttctgatgcactacttggaattaaaagaatccacaataatactgcagctaaaactgtcggtactgaaataagcgtaagcttattcatacgaattaattcatataaacctatagaagcaagtgcatacactaaaaccgtaaaaggcacgccaccgtatattacgatgggaatgaatagcgcggcagcaaccactccagtaataattctctgtttcactaccaaaccctctctttctacacgcctccgaatctgcgccctctatgttgaaagtcagtaatcgcatttagcaaatgttcttctttgaagtctggccaatacacgtctgtaaaccaaaactccgaatatgcaatttgccataacatgaaattactaatacgtagctctccgcttgttcggattaacaactctggatcaggtaaagaactcgtcattaagtaggaggaaagcatttctttacttacctcttcagaacgaatttttccttcctcattatctttcatcatatgttgcacagcagaaacgatttcatctcgacttccatagtttaacgcgaaattaagaattaatcccgtattctctttcgtatcttccatggctttctccatcgctctgcgtgtatgcgtaggaagacgatctttttgccctattactcggacttgtacgttttcttcaatcaattctggtaaaaatgtacctagaaattcttctggaagcttcattaaataatcaacttcctttttcggtcttttccagttctcagttgaaaaagcataaagagttaacactttcacattaagtttacttgcaaattttgtaattttctttacaacttgcataccttcatgatgtcccgcaatacgaggcattgctctcctctttgcccatcttccattcccatccataatgatggcaatatgttctgggatatatccttttttcacttcttcaacgagatgatcaaacgatgtgtcctttttacctttaaaaaaaggaaagtttttaaacatcattcataccctccagcaagcagacgtatgcctaaaagtgtaaaaagacccccttaagaagagggtcataattgcgaagttatcgctattacacttccatgatttctttttctttgttttttgcgatttcgtcaacttttgcaatatatttatctgtttctttttggatatcttcagtatatcctcttaaatcatcttctgtaatctcgccagctttttcaagcttcttaagatcatcatttccgtcacgacgtacgttacgaacagcaactttagcttcttcagcatattttttcacaacttttacaagatcacgacgacgttcttctgttaatgcagggaatgcaatacgaattacagttccatcattagaaggatttaagcctaaatctgcttttaaaattgctttttcaatatcaccgatagaagttttatcataaggttgaattactagtaaacgcgcttctggaactgtaatgttcgctaattgcacaactggtgttggtgcaccatagtaatcaacttgtaccttatctaatacagacgcgtttgcacggccagcacgaactgttgctaattcacgagaataagcagcaactgctttttccattttttcatttgaagacttcaatacttgttgtcccatatttatttcccccttaccactgttccgatattttcgcctaaaacggcacgtttaatattacctttttccataactgagaatacaattaatggaatatcattatccatacatagagaagaagctgtagaatccattacacctaaaccttcttttaatacgtctaagtaagtaagcgtttcatatttcgtagctgttggatcaatagatggatccgcattatatacaccatctacattgtttttcgccattaaaattacatctgcttcaatttctgccgcacgtaatgctgctgttgtatctgtagagaagtatgggttacctgtacctgctgcaaagataacaacacgttttttctcta

SEQ ID NO: 1298 - DNA, 11911 bp, Bacillus thuringiensis
cgaccaattacttgtttcttatctaatgatgcattcgctacttccgccaagtctggttgattaattttggaagcatctacaaattccgtctcatgcttttcataatccatcttttgaacagcctgcacattttcagtctgtttcttttcagcctgatatccatcataaaatggctttccaattaacacgccacctacaacaaatagcagaattgctactatactataaattctttgcttattcatacacagttcctttcccttacaaaatcttactctatataaaatgataaaataatatcgtcatatgtacaagtattagcttaaaaagaaaccttcttgccggtgcaagaaggtttctttttaagctaatttatttctgtatagtgatacgtgaaatactgtcatttgaataaagaaaatagaaaatagaatatataatgggtatccaggaagatattcattaataataggcgaaaaagttaaaaatccaactgcacaaggtaacacaaaccataacgatacaaatgttgttcggcaagctttatccgtaatcgctttttcacgttcatcttctagcggaaataataatggatacatccaaaaagataaattcttatattttttcttttgaattctataaaaaattgtaactataattgctccaataaataataaaatgaatggtactccattaaaccatacttcaaatgggaatttctcgtttttaattatatgtgctaactctgtaataacactataaaattcaacaaatgtccaacatgctagtgcagtatagagtacatttataatataagaaaaaacaattctattcatcctcttctccctccttatttaaaacaaacacatcttccatctttaactggaacacatcacaaatcgtaagtgctaataacaacgaaggaacgtaatcccctttttcaattgctgcaattgtttgtctcgttactccaaccttttctgctaatacgctttgcgtaaagttaaaacgagctcttaattcttttactctgtttaaaatggtcaaatttaccacctctcaccattattgtatgctattcttaacaaaatgtaaactcaacttaacattattattataaaaaaatccaactctacgtattgtaaagttggattacttgttagtttaaaattgtaactttaactgttcttctgccccagctacttgatgaacctttatctggcattaaaacatcaattctatgccctttaatagccccaccagtatcggctgcaattgctactccataaccttcaacatttacagtcttacctaatggaataacatttggatctacagcaattaatttcattcctgggtttgcagttagattataacctttaccacctggtccccatgcagaaaatacttgttgacctggtgcataaccattttcccctggatcagctgtataagctgtagcttctacataaatttctttcccaccagcagttggcttagaagatggttcaggttgtgcaggttctaccttcgaattattattagcaactggttcagctggtttactagctttttcctgcttttgcttttcagcaatttctgcttgtgctttcgctaaagcttcttgctctgcttttgcagctgcttctgcttttgcacgctcttccgctgcgattcttgctgcttcttgctcacgagcaatcgtttcttgtactgtcttcatatttgattcaattttagctttttcttccgctgctaaattaagttgacttgcaacttcattatatttagcttgaactgtttgtaagttatcttgacgctttttcaagttatcttgcagttcagcttgcgcttttgctaatttttgtttgtctactactaaagatgcttctttttcgtcaattgttttcttatcttcttcaatttgacgaagatcttgttcttgtagacgtaaaatttctttatcagcttctagaatagtagaaactgcgttcatacgttgtaagaagtctgcaaagttttttgattctactacaacttctactactaaacttgtatttgaactgttttgaacagaaaccatacgttttctcataatatctttacgagcaaggactttatcctccaaaacgacaatttcttgctttttttgctcaatctgcttatgtgtttcatcgattttacgttgaatagcagcttgatcctctttattttttgcaattgtattatttaaattatgtagttcgttttcgatacctttaatttctttactaacagcttgcttctcttgctctttcttttgcatttctgcatcgttttgttgcaattgctgttgcatgttgttaagtttctcgtcgtttgactctgctttaacagcgactgtactagaaagaccgataattcctgctaatactagacagctgattcgcttaaaatagttcataatccgactcccttcttatacagttatacatgatttattttacagtttgtttacaaaacgattaaatacagtttatttttcgtgacgaaaaaaagagaattatgaataaaatgtaatagattcttaaatatttaacaattcctatatttaaaaaatacaaaagatgctaaaatccaaatatagagaaaatataactttcgaaggcggttgaaataaatacatgtttactcaaaaaaaatcactccaacatacaattgctcaattacaagagcgtatacaagaattagaagcagaattaaaacaaaaagatatcgaaaagcaggagactatttctactatccacgatcgtgtacaaagcgttatccaagagcatcaacttgtaaataaccaacataatacacttcaaaatttagttcaacaattaagttcatgtttcgaaaatgtttcaacacgtacaacacattccaatgagttaaataatgaaatgttacaaaaggaacaaagcttaattcagtctattgcagaaattattgactgctctaatgaaggaaaagaatccgttcaccgcttacttattgtaattaataaattaggtgaacaatctcaacgcacgtctaatagtatgaatcatctaagcgaacgctcaaaggaaatcgagcaaattgtagaagtcattcaaaacattgcagcacaaacaaatttacttgcattaaatgcgagtattgaagccgcgcgtgctggagagcacggtaaaggattcgctgtcgttgccaatgaagtaagaaaactagcggaaagtacagcagaaagtacaaaaaacatcggcaacttaacgaaaaaaattcaagaagaaattgaaaaagcatatgataacacaaaagataatttacatttagtcgatgaaggtgtagaaatgagcgccgatacaaatgctagaattgaaaatattttagttatgattcaaacgttacaaaatggtgctacaaatgttattaaggctatcgaaaaccaaaagtcttgtaatgatgacatattacgagaatttgctaacacacaacaaatgttccaaaaattaaatactactattatgaatcatattcatgatgctgaaaaagtcgatgttcaattgtctaaaagtcttcaaggaacagtgacttcttaattaaaattaagaatcccttatactgctataagggatttttattttatttagaatatttatttcttttcaatattcatccatatctttgttatactggaaaagttgtttctttcaactaataaacaaggaggttattatggaacaattttactacgttttaaaatatttaattctcggtctgttccaaggattaacagaaccaattccgatttcttcaagtggtcatctcgttttagcacaacatttgctaggactaaaaatagaagggtttagcttcgaactacttgttaattcagcttcattattagctgtattacttatttatagaaatgatttaattcgtctaacgaagaatggtctctcttatatatttacaagagcagaagacgcaaaatcagatttcttctttattatttatcttgttattgcaaccattccagcaggtgttattggtgttttatttaaagattacatcgatcagtacttaaaaggtgtgaagatggttgggatttcccttcttattactgctgtcggcctttggattattagaaatttacgcggtcgtaaaaatgatggcgacctttctatgaaagatgcaatcatcgtcggattagcacaagcttgcgcactgattcccggaataagccgatctggtgccacaatcgtagcagcaatgttacttggtatgaagcaagaaacagctcttcgcttctcattcttactatacattcctgttagcttaggtggcttattgttaagcattacagacattgcaaatgatccaaatctagacacattattcgtaccatatgtcgttgcattcatcgcaacatttatcatgacgtatatttcactaaaatggtttatgaacattatggcaaaaggaaatttaaaatatttctctttctattgtattatcgtaggtgtacttactcttattttcttataaagtaaaacttacaaattaaaagcgagtcatctagtgtaatagaatgactcgcttttttatacctttattaagttaaaacctattatttacttataattttcagaatagtataatatttatcaagttcactattacagtaattctatctttcctactattatcgtaaaagaggtgtttatatgtttatagttactaaactcattcacattaagtacgaatatgaaaatgagctactttatgggcttaaacaatattatccttcccccggaacgaacggttgtattaacatagagttttcacctgttcatcgtacaaatgataaggcagagtatatgattcgtatgttatggaaaacacaacaagattaccatacatggctttctcaaaaagaaggcaatgaaactttgaagcacaaaatacaaggctatatcctttcttccaaatcaaatgctacctatgtgcattaatccttctctttttattccttacgagggccaaaatgataaagttaaattaatcagccctcatcaattgggctgttcacaaataacgagataaggaccctcttacttttcatactgtaagagggcttctcttatgcatacactttcttctcttgacaatacaaacgaataacatgtttattttgttgaaatacatcatgcgtcagccgaataataataaagtttcgttttgtttgatcatcatgaacaaaaatctgttctccctcctgaaaacgccatgcactttcaaaagtcgtaatatgatccccacttacagaaaaaagttcatatcgcatctcttgtaccctctctcaacttatataatcacaatatccttatattaaatttattataacttaatccctatcaaattagtaattttttctatttcgaaaggttttaactttgtatttaaatatttttagcgctataatgataaacgaatttttattgaaaggagttttactttgactgcatatttatttccagtgaaaacagcatttattttatttccttttttagcaatgtttcttttaatcccttttttaatatttaattatcgaaaatacggttatttaaataaatggcgctcatttattttatactcattattactttacttattaaatgcctattttcttgttattttgccgttgccacaaacgtttgatacttgtagcctacaaccggctaatacacaacacatgcaactcgcaccattttatttcatacaagagattagtagtcatacatcggcagttttaacgaaaccagctacttatttctacttattaaaagagtctgcgtttttacaagttgcctttaacgttctattaactgttccattcggtatttacttacgttattatttccgacgtagtttcttacaaacaatttgcatttcctttttcctttcactatttttcgagctaacacaagtgactggattatacggtatatacaattgtgcataccgattatttgatatcgatgatttgtttttaaatacattaggtggcgtaattggttttatcattgcaccaatatttacgtacttccttccgaagacaaacgagttagatagtcatattgatttggaaacgaaaccagtcggattcattcgtcgccttatcgcgatgcaaattgattggattttcttatctatcgtcgtacctgtcgttaaaaacaaaggaaattctttcttcgtttctaatatgcaatcttacaccaatatgtatgaactcattttcattacgtgttcaatccttatttactttattattattccatactttactaacggaaaaacaattgggaaagcattgcttcgcattcacgtgaaaggaaaatcaaatcgtattacattaaaagaactatttattcgttacggtatattttattttgcattaggtggaatcaattatattctttctagtagctctattttaaatcacacagagcctttagtattactcgttacattattattcctattcatcattaacggcctatttattattcatgttttactgcatgtatttagccgtgataaactactattttatgaacatattagtcatacaagaaatgcaattacactaaaaaaaggtgacaaataattatttgtcacctttttcatatacataatgtgaaactttaattagccctcaccaaccgggcggttatctcccaccgaattttgcgacgagagtgttactgcccgacaaatagcgggataaataacttttctgcataaggattaaaaaacattccaagttcatctagagatttcctcacctgtaaaaacgaatgaaattctggatatatatattgtaattgctcatatgataatgtatgcattttcccccaatgtggacgcccttcatactttagaaaaatcttttccacttcgccaaagtaagcagcatatttcatacctttatacatatgaacagcgatatatgctgaatctcttccataggccggactaagccatatatcatcccctttcacataacggcattcgattgggaagtgcaccttatactttttcttttcaataagatttgagatttcttctacaaccgtcctcatatactttgaaggaatgctatactccatttcataaaatggcaccgtacgtgatgtagcaaatacttcatagctcgggccaattatttttgtgtttggtacagctttagctgataaccgactcacgcctttacttatagaaggaaaccatttacatcctttagatagtaaagagaacatcctattttcaagtaactccacctttagtttatgccatttcaaatcactgcctttattcgttgtttcgttcgtaagtttcacttgtacttcatcagaataaggaaaaacgaaaaattcaaaatgacgatgcttcttatattcttctagtttgttcattacagtggataatgactgtttttcactttcataaacgagtgaatacgctggaataaccttcaattttatctttacaatgatacctaacattccaagtgacaactgaaacgctctccaatattctacgttctcagcttccgaacaaactatactctcaccattagatagaactgccgtaatctctataacttgtgttgataaactcccaaaggtaatacctgttccatgagtccccgtactaatcgctcctgcaatagattgcgaatcaatatcccctaaattttcttgcgcataacctttttcctcaagtaacttccctaaatcatataactttgttcctgcccatacttcagcaaccatcttctctgcatcaatattcacaatacccttcaattcatctaaagaaactaaaacttcttccgtttgcacaaggggggtaaacgagtgtcctgaaccgacaacacgaattttctttcccttttttcgcgcaagccccacaacttctactacatcttgtatactttctggatacatcgtataatgcggcgttccttctacattccctgtccaatttctccacttttgtccctttatagaaagcattggccatccccccgatatgttgaatactccccgacaatctctccttttttaacacgatacaaaaaaggaaagcgttcacataattcaccagccttactatgacgaaacaaaatggtctctcctatatccactcgttcctcgccgttataaaaaattggcgtttgtacctcgccagcaccttctaaagctaataattttgcacccttcggtctccaaacttcaggctctttatcttttccaactgctcctgaagcaatatatccaccacctaggcaagtgtaaataaacgggactggtttacgtacaactggtaaggcaaatccgaccgctggatgaaatttcacctctttataataatcaaacagcttcggagaataaaaagcagaacctattgtaatctctgaaactgaattatctttctcggttatttttatgcttcctgttccgcctccatttacaaaccttagctcaataccaatgttttgtattgcttttacaatatgttctcttctttctttaacttctagcactgatttctgctttaaatacgaaatcactttacttttcaaccattgattcggtatataatcgcccaccccggcaatttgagctttatatcccattaccccatctaacattaaatatgatgacctttttaccttttctactaccttcaacgcatcctgcacattttttactggggacctttgttcaccaaaatgaaattgaaagaagcgactactcatatcaatatccaaacaaacacgaaaacatcctttagattgctcagcaatgttttctaaatacacaatatgctcttcacaatccaccatacaagttataatgaaacctttctttgttaacaaactaatttcatacagagctctttcatcgtaagcaggatatccaagcaataaatcattaaatccttgttctattaaaaataaaatctctctaggtgaaaagcacataataccttgaaatcgatcatttgcagctagtatcttttgcataatcggaacagagcgtaacgatttactcgctatacgaatctttttatttccacttaactctataatcgattgaatatttctatctaaagccacttcatccaaaaatgcacacggtaatggaacttctttaaaaattcctcgatccacatttttctctcctcttctcaatatgtcttatacatattggaaagaaagtgtgattttcctgtttgcaaataaaaaaagtttcttctttacgaagaaactttttgaaactacttcatagaaatagtcgcctctactggataatgatcagagtaatcattatacgtatatttttggaaccatgatgtaacagtccattgtggagattgcggctgtaacaccttattctctatatacgatgggttcgcatggtctttacttgcaataatatagtctaaatactcagcaggactatcagggaaattatattttgcaatactgtttgtcgttgcgtcccaagtcgctgtatgtccagtataagatggtacagaagcgttcaatgttttaaacatagatgcatactctgagtcattcttgttctctgcatttattttatttacgttcatatcaccaccaattaacacatactcattatttggtatatttttatttttaataaagtcttgaatttcttttaattggtctgtacgtacagatgcaggtgaagtttttccgcacatactatcttccgcttgcaaatgcgtaccaattacatgaacaaagcgatcatttttcttaattttcgtgtatacaaatcctttattcgataaattatctggcccgcatccttttgcaaatacatattgaatcttttcagcgattggccatttgctcacaatcgcaacgccaccatcttcaggagttgaagatgaatagtttcctaacgttttatcccattcacttccactactacgacctaatactgctgtttgatttggatattctttcttcaaattccctaataaacgatctgatgcgctattatcaaacacttcatttaatataactacgtcttgattctttatataatctgccgccccgattaaatcagcacgctcagtttgtccccagttcggatataagtttgttgatagcatatatacattatgcgtcatcacttttaatgtatcggtttgatttgtagacgcttctgcttgagctgacgttccactatataaagctcctagaccaacacctaagctaagtacaccttttagcaatttacctttcacgtttcatacctccatgtattgtatagtgataaaaaggccaaatactctattctgagatttgaccttttttaaatacttaacgatttccgtacgtatcaaaccaaagctgaatatatccagcagtaacacgttgtgcatccattaaacgcttacctgtcattggtgtaacttcagcgcgccatttatctgcatattcttgtgatacagcagctctcacgaaccaatctttcgtattatcatttacaatgccagcgtaatcttgtttcgcaactactgccgctccatgaatccaatcttctggattcgtacctttccagttccaatatccatttccatccgttactttatagttatcttttatcgtatctacaaagttttcatatttagaatggaacccttgtggatacgaaaggtttgtaaagtttgctgcatgcatcggttggtttacatcccctagataatgaagagataatcctaaatagaagaatgcttgtttcatatctttatttttgtaagactcaccagctaatttaaaatacttagctccagtttcctttgcctgctttgcatacggaatataagttttcccattgtcagggtcatagaaatgtgaagcaaatgtgctattatcataataaggattttcatagtcagcagcataaataccgttctctaactccgtacgccattcatttaatagtgcaactcgatcttgttttacaagtgttgtattacgagacataatatcaattgcacggtttacaatccataaatgagaattcacgccttctttatgtttatcttcagcagaccagcgcggaataactccaaatctctgtcccccatcattttcatgagcaaatgcaacactttgtaatggagcaactaatgtaatagctgccgctaaagcaagtactttctttttcatataaaatcctccattttataattgaattattgtaaacattttgttaggatcctatgatgtcgtccggttaacctatgactagaatatcccacctttcacgaaatttctatcaataaattaaaatatgcaaatgttcatatcattataactttatacacagtgaatataatgaatgaatacactttcattttaataaactattattaaggcttgtctaaactaatgtaaaaaaagagtaaagcatctgaacgcttggtattatcccctataggtagacagtaaaaaaagagtccatctgatatgatggactcaatactgttttatctggaggggatttttttatggcaagaaaaggacaatcatttcaaaaatatacagaagaactaaagcgagaagcagttcgtcttcgattagaagagagaaaatcattgcgagaaattcgtgaacaactcggtgtgaagagcgatgcccagattattgagtgggtaaaacgtgcgcaacaaggggagtcctttgatgatcaacgtggtgtctggaatcgaagaatttaatagtctagaagaagaaatgcttatttgaggcacagttgagtatttaaaaagcgcaatcaatctacacggaggatgt

SEQ ID NO: 1299 - DNA, 7734 bp, Bacillus thuringiensis
attgcgttgtgcgcatgaagcactccttttggcttaccagtttatccagacgtgtaatgtagaatcaagccgtcttcacggcctaaccattcaatatgtaattcttttgaagcttgttcaaataaaggattgaacgctaccgttttaccgccttcttctacattatctccaacaaggaaaactgtttttaaagccggtaaatcatttaatggtacgcgctctaacaattcaggcgttgtaattaacacctttgcttcgctatcttctaagcgatcgcgaactgcgccttccataaatgcttcaaatagcggtccaacaattgctcctaatttcactgcacctaaaagtgcgaaatataactctggagaacgtggcataaaaataaaaacgcgatcgcctttttctacatcgccataattcttaaggacgtttcctgctttattagaaaaatccttcatttccttaaatgtatatttctcttttcgcgatccatcttgataataaagagctactttattctttcgatcggatttcgcatgcttatcaattgcctcatacgccatatttactcggcctgtttcattccaagtaaagtttttattaacctcttcccagttaaaattcgcgtatgcctcatcataattcggcaaattattttctcctttaatgacaggaagcgtttctactttcatactttacatccccctcctatgtattctattatctattataatgacattatttaaaattttcagtatatttgttgatttttagacaaatttttaatgacaaatttcgattcacatcgcatatattataaagtacgatattaatagattcacaaaccctcaaggtggtgagcaatacattgattcataaaaaaatatataatgctagaaacttaaaaacggcgaaaggcactttaattattgaaggtcctgtctctacacataacttagaaatgtatgagtttcatccagacttaattgcgtttcgtcctgccgagcaacaatataaagcaattgtcgaaatttctaaattaccagaagctcgtctcattattgctagacatgaccaaacaattgttggatatgttacatacttgtatcctgatccacttgaacgatggtcagaaggaaaaatggaaaacttaattgagcttggggcaattgaagtagtcccagccttccgcgggagttctgtcggaaagaacttactagaggtttctatgatggacgattatatggaagattacattatattgacgactgaatattattggcactgggatttgaaacaaacaggattgaatgtgtgggaataccgaaaagtaatggagaagatgatgaatgctggcgggttacaatggatggctacagacgatcctgaaatttgttcacatcctgccaactgtttaatggtccgcatcggtaaacgcgttgatacggattctattcaagcttttgatcgtctacgttttcacaatcgttttatgtattaataaagggggcaactggaatgattgtagaagaaattatgaatcaaaatgtagttacattgcatccaaacgatacaatcgaaacagcaatccgaacgatacgcacgaaaggcattcggcacattccaattgtcgatcaaaataatcacgtcgtaggcattatttctgatcgggatgtaagagatgcaagtccgtctattctagatgaacaagtttcaatcgatatgctacagcaaccgctcgaacttattatgaaacatcctgttatgacttgccatcctctcgatttcgttgaggaaattgctactttattttttgaaaataaaattggctgtcttcctgttacaaaggccgggaagttagttggaatcatttctgaatctacagtactgcacacattagtaaaattaacaggagcacatcaaccaagttcgcaaattgaaattcaagtaaaaaacgaacctggtattcttggaaaagtcgttgctatttttagtgatttacaaataaatatcgtgagcgttctcgtctacccagcaaaagacgagaatgataaagtactcgttttccgcattcaaacgatgaatcctctaaaagtgattgatgcacttgaagcagaaggttaccgcgtattatggccaaacatcatggggatgcaagcatgagtagcgcgtttatttattcggatgactttcggggctattcatttagccctgatcatccttttaaccaactgcgcgtcacacttacgtatgatttattacaaaagggcggtttcatctctccctctcaaatcatctcaccacggatggctacagatgaagagatcgcctacgttcatacagaggagtacataaatgcggtaaaacgtgctggagaaggaaagttagaaaaatcaattgcaatgacatatggactcggaacagaagatacaccgatgttcccaaatatgcacgaagcaagcgcattgctcgttggcggtacgttaacagctgtcgatgctgttctttccggaaaagtaaaacacgcacttaatttgggcggcggcttacatcacggctttcgcggcaaagcatctggcttttgtatttataacgacagttctatcgcaataaaatatattcaaaagaaatacggtttacgcgtcttatatattgatacagatgctcatcacggtgatggcgtacagtggtcgttttatgatgaccctaacgtatgcaccatttcactgcatgaaactggtcgttatttattccctggaactggcgctgtaaacgaacgtggccaaggtaatggttatagttattcttttaatgttccactcgatgcttttacagaagatgaatcgttcttagaatcatatcgaactgttgtaacagaagttgcagcgtactttaaaccggatattattttaacgcaaaatggtgctgacgcacattattatgacccacttacacatctttgtgcgacaatgaatatttaccgcgaaataccgaagctcgctcgtgaaattgctaatgaatattgcgaaggtcgctggatcgctgtcggcggtggcggctatgaccattggcgtgtcgtaccaagagcatgggcactcatttggctcgaaatgaacaacatccaaaacatctcaggttatctccctccagaatggattgaagcttggaaaggacaagcagaaacagaacttcccctcacatgggaagatccagacaacatgtataaacctatcccccgtaaaccagaaattgaagaaaaaaacgcattaactgtagcgaaatcccttgaaattattcggaataatatgacaaaatctttatactaaacgaaaaggaggctcgtttttgaatagcctccttttatttaaagcttgctattattgtcgttttctgtcggtaagtcgatatattttaataatcgctgatatattccgagttacgccgatatattttgataatcgctgatatattccgagttgcgccgatatattctaataatcgctgatatattttcattttataacagtctggcccaacttttatgagaaaaggtcgtgatattatgtggacacaacaaataatcaacacgaaacgcggtacatttgaactctttacaaaaggaaatggcgaatcgctttgtattacacatcactattcacaatttaatgaaactggtgattactttgcggatgtttttactgctacgcatcgtgtatttctcattaatttacgagatactggtcgctctgtaaccgcccagtcagaaaacgaattaagcatgattgaaacaatccacgacttagaagcaatacgagaagcattacaacttccaacatggcatttcgccggtcattcaacaggtggtatgcttggacttttatatgcgattacatatccaaattccttacaatcattagtcgtagcaggagctgcagcaagtaactataccgaaacaccattttgcatttatcacccagcacatccacagtttcattatatgcaaaaacacatcgaaaacttaaaaagccctcaccttacaagtgaagaacgaaaagaactatctactgagagaacaaaattatcattgtataaaccagaaaactacaactcttatttttgtaaaccaatcaataaaacaatgtccgttagccggatgaacgctttcgccaatgaatatccttcatttgatttaagagagtatttacctttcatccaaacaaagacacttattatatgcggaagatatgatgtgcagtgtccagttcaatattctatcgagatacatgatgggatacgtaactctatcttcattccattcgaaaacagcaaccattatccttttttagaagaagcgaccctgtttacttctactactcaaatattttataaatcgttacgccagtaccgttattattaaggaaagctcacagtctctataagactatgagctaaattttcagaagaaatatttcgtactatataaaaataaaagataaaaggaaaagagcaccaaacctacatcaaacaacactgactttttatctccttcttttaaacctatcgtaatattaaaaatgcttctaactatccaacctaatactaaaaataaccagccgaaatgatcatttgtataatctttatcataaaacatttgtattgcaccaataattaataaaataattataatattagttccaatccttaagaccttgtttgatttattatcttgtaatgtatctcccaaaatgtagcacaccctctcatgctctactatgttttatctctctttatatcttaacacaaattacctattatttccttttgacaaataacataaaaaacctgccaattactcggcaggtatattacacgttaaaacgataaccagctccccatactgtttcaatatattgcgggtgagcaggatctctttcaattttttcacgtagctttctaatgtggacgacaacagtggctaaatcaccagcggaatctaatccccaaatgcgttcaaataactgttctttatttaatacttggtttggatgtgtaacaaagaatgttaataaatcaaattccttcgttgtaaacgcaacttcttcattgtttataaaaacttttctcgctcgttgatcgatagaaattccgtgaatatataacgtatcacgttgcttacttacatttcctaataatctttcataacgggcaatatgtgcttttactcttgcgactaattcactcgggctaaacggtttcgttatataatcatccgctcctaatccgagtccgcgaattttatctatatcttctttttttgctgaaacaagtagaatcggaatatcttttacagcacgtatttgtttacaaatttcgaatccgttcattttcggaagcataatatctaaaataattaaatcatagtcttcttgcagagctgtttgtaaacctatttctcctgaatgctctacatcaacttggaaatcattaatttctaaataatctcgctgtaattctgcaatacttacttcatcttctattaataaaattcttttcaatttactcaccacattcctctactttttccaatgagaagaaaatgcttgtgcctttaccaagctcgctttccgcccaaatttccccgccatgttcttcaacaatttgcttcgctattgctaaaccaagtccacttccacctgtgctagaattccgcgattgctctgcacgataaaaacgttcaaagatatacggcaatgtatcagcttctatacctgatccgttgtccatcactttcacaataactttattattatcactcgatactgttacagtaattttcttctcttctttatccatgtatttcacactattatgaactaaatttgatatcactctatttattttttcacaatcagccgttacatatagtgttgatgcatgtaattgtaagttaacttctataccttctttacttaaatccatctgcatctcttctattaattcttgcataaacgtatttaattcaactgtttcaaactggaatggaactcgattcaaatcgagcttcgaaaacaaaaagagttcatcaatgagtgtgtccatatgttttgccttcgtatggatagttgttaaatacttatccattttttctggcgtatttgctaccccgtcctttattccttctacatatcctataattgatgtaatcggtgtttttaagtcatgagagatgtttgaaataagctcttttcgattttcttcatactgtgtttgcatctctatcgattcttttaatctcttcctcatttcctcaaacccttgatttaattgccctatttcgtcgtgtgatgtaattggtatttgaaaatctaaatttccttctttaattttctccgttgcgcctttcaatacaaaaattggttttattacacttcttgaaacgaggtaacttaataatccaatgagtaaaatggctagtagtaaaagcgatacgaataagattggaaataatttttgtgtaagatctacaaatgaactttgcttttttaatacaaatatacttccctcttcttcctgaggaaaataaaaatcaaactttacatatcgataaaatgtatcgcctagttccgttgtaccacgactattaatatttgctgattcaaatttcggaagggcttcttttaaagatacactttcaaatacgtttgaagcatatgaaagtgtttctccttttcttactactattttcacaccctctttttctattgctgagacaaacgactcatctagcaattgagattgatgctgtttggctgctgacttcaactcaagataggcattctcttcttctggtgtaagcggcttttgaatgtaagaacttttatagaaatttttcactgcttccaagtcacctgttatcgaaaaaacgattaaaaatcccgcgactaatataagcgtaatggaaacgaggataacagcaatataagaaaataaaaaccttgttttaatagacatatcttaaatcctcactttatcaaaccttattatttataagcataaaaatatatgttcaattactcaagcgattttatagtaattttagcgtcagtttataaaaatttaatgttcctattttacagttgaaattaggaggttgaaattccatgttcaaaaaaacattcagtatgatatgttgcgtaatttttttacaaggatgctcgcaagaacaagaagtaaaaaagaccaactatgagaagtcaagaggaattttataaataggaaattaaaaaaagggtgcaccaaataaccctaagagatgttaaaaaaataaaagtatcaaacttcttttgaatattgagggatttcatacggtttattgttttttaggatggcatagataatgtaacacaactttctagctacagctcctatacaaacatagtagtgctttccttgttttcgtttcttctcataaaaagctttcaagacagggtcatgtttatgggctgtaatagcggcttggaataaggctctacgtaaatgagaagagccacgcttagatatagacatacctgatgattcaaattgtccagattgggacacagaggcatcaatgcctgcataagcgacaagtttagatggtttgtcaaagcggtgtatatcccccatttctcttagaatagtggcacctactagagaaccaagtctttacttatgtagtcgtcaaccagcttcacc

SEQ ID NO: 1300 - DNA, 7725 bp, Bacillus thuringiensis
ggtgagccgttacctcaccaactagctgaggcgactcgggtccatccataagtgacagccgaagccgcctttcaatttcgaaccatgcagttcaaaatgttatccggtattagccccggtttcccggagttatcccagtcttatgggcaggttacccacgtgttactcacccgtccgccgctaacttcataagagcaagctcttaatccattcgctcgacttgcatgtattaggcacgccgccagcgttcatcctgagccaggatcaaactctccaataaagttagtttgtctagcatctaaaataaaaattgacgtttcacgttgtttgtttcgtttagttttcaaagttcaatatcgcgtttcagcgacttttataatatatcatagtatattattttcgtcaacaagttttttcgataagttgtatctctcatttgctgactctgcctattatataggctttctcttccctatgcaagtattattataaaaaaataaagagagggaaaatcccctctcttattcttctgaagaaacctcttcactcgtttcttcctcttcatctttttgtgcttttgctaccgtcgctacctcttggtcttcctctaatcgaattagacgaacaccttgtgtattacgtcccatttgagagatttgatcaactggcatacgaataataacgcctgccgctgtaattaacataatatcttcttcacctgtaacagatttaacagctactaatttaccgttcttatctgtaatgttacaagttttcagacctttaccaccgcggctttgcagacggtattcatcaatcggtgtacgctttccgtaaccatttttcgttacaattagaacatttacatcctcttcgacaatttccatacctacaacttggtcttcatcgcccaacgtaatagctttaacacctgcagcattacgtcccatagaacgaacatcttgttcattgaaacgaattagcataccgttacttgtcccgacaataatatccttatcacccgatgttaaacgtacagatattacctcatcctcttcacgaagagaaattgcaattaaaccatttgtacgtatatttgcaaatgatgaaagtggcgttctcttagaaaccccttgttttgtcgtaaagaataagaactgatcgtcaccaaattcacgaatcggaataatagcgttaatccactcacccttatctacccctaataggttaataattggtagtccttttgcagtacgactatactctggaatttcatatcctttcgtacggtatactttacccttgtttgtaaagaataaaatatgatcatgagtagacgttgttaataaatgttcaacaaagtcatcatcattcgtacccattccttgcacaccacgtcccccacggttctgtgttttgtacgtagaagctggtaacctcttaatataaccgttatgagttaacgtaatcgcaatgttttgttcaggaattaaatcttcatcttcaataaattccataccgccaattgtaatttctgttcgtctcttatcattgaaacgctcttttacttctgttaattcttcacgaataatctcaagaactttttcttcatctgctaaaatcgcttttaattcagcaattaacttcattaagtcttgatattcttgctcaattttttcacgttctaatccagttaagcgttgcagacgcatatctaaaatcgcttgcgcttgtttctcacttaaaccaaaacgttccattaagccttgcttggcaatatctgccgtttttgaactacgaattaacgtaataacttcatcaagatgatctaaagcaattcgtaatccttctaaaatatgagcacgtgcttctgctttttctaattcataagcagtacgtctacgaattactaccttctgatgctctaaataatgatatagattttgttttaaatttagtacttgtggctccccatttacaagagacaacatattaataccgaaacttgtttgaagcgctgtatgtttatatagattgtttaatagtacgtttgcattagcatcacgacgtacttccatgacaatacgcataccattacgatctgattcatcacgtaaatctgtaataccttcaattttcttatcgcgaactaattctgcgattttttcaattaatcgtgccttattaacttgataaggtagttcagttacgataatagattgtttaccgtttgacttctcttcaatttcaaccttagcacgaagcataatggaaccgcgacctgtttcataagctcttcgaattccacttcttcctaaaattaaacctgccgtcggaaagtctggaccgggaatatattccattaattccgcgatagtaatatcaggattatgacttaatgccagcacaccatcaattacttcgccaagctgatgcggcggtatatttgttgccataccaacagcaatacctgttgtaccgtttactaataaattagggaaacgcgctggtagtactatcggttctctttcggaaccatcatagttatcttgataatcaattgtattttttgaaatatcacgtattaattccatagaaatcttagacattcttgcctctgtataacgcattgcagctgctgaatctccatctacagaaccgaagttaccatgcccatctacaagcatataacgttgactaaaatcttgcgccatacgtaccattgtttcataaacggctgaatcaccatgagggtgatacttaccgattacttcaccgacaatacgtgctgatttcttatacgctttatcagctgtaattcctaaatcattcatcgcatataaaaccctacgatgcacaggttttaatccatcacgaacatctggtaatgcacgagatacgataacactcattgcgtaatctaaaaatgaggtacgcatttcatgactaatattaatttctcgaattcgtgcttgttgttgattgtctgacatcaacgagcacctcctcttacatttccgttacacatacattgatttatatgtagaagacaggaatacttagattcctgtcattactcatttaaatatcaaggttcttcacgtattttgcattctcttggataaagttacgacgtggctctactttatctcccattaaaatttcaaatgtttcgtctgcttcaattgcatcttgaagggaaacttgaagtaatgaacgtacttctggatccattgtcgtctcccatagctgagttggattcatttcccctagacctttataacgctgaatccctggcttaggttgggccggtaattctgctaagattttttcaagttccttatcgttgtaagcatattgaatttttttaccttgttgtattttaaacaacggcggctgtgcaatatagatataaccacactcaattatttgacgcatataacgatagaagaacgttaataatagggtacgaatatgtgcaccatcaacatcggcatcggtcataataataaccttatgatagcgtgctttttcaatatcgaagtctccaccaatattggtaccaatcgccgtaacaattgtacgaacttcatcatttgataaaatcttatctaagcgtgccttttccacattaataattatacccttcagcggtaaaattgcttggaaatgacgatcgcgtccttgttttgcagatccacccgcagagtcaccctctacgatgtaaatttcactaattgctggatctttcgaagagcaatcagctaatttaccaggtaaacttgaaacttctaacgcactctttcgacgtgtcaattcacgcgcttttttcgcagctacacgtgcacgtgcagccatcgtacctttttctacaatttttcgcgctacattaggattttctagtaagaacttttcaaacgcctctgagaatacagactctgtaattgttctcgcttcactattcccaagttttgtcttcgtttgtccttcaaattgtggatttggatgcttgattgatacaattgctgttaaaccttcacgaacatcctcaccagttaaattactgtccgcatcttttaaaatgctatttttacgaccatagtcgttgattacacgagttaaagctgttttaaaacctacctcatgtgtaccaccttcatacgtatggatgttattcgtaaatgagtaaatattatttgtgtatccctcgttatattgaagagaaacctcaacctgaataccatcttttgaaccttctacgtacacaggctcttcatgaatcggttgttttgagcgatttaaatgctcaacgtatgatttaattccaccttcgtaatggaattctttcttttgcttatgttcacgtttatcttcaattgttaatttaatattacgatttaaaaacgctaattcacgcatacgagttgctagcgtatcaaaatcgtatactgttgtttcttggaaaatttccggatctggtttaaatcgagttattgttcctgtttgatctgtgtcaccaatgacttttaaatccgcaaccggaatacctctttcgtatttttggtaatggattttaccttcacgatgtacaaatacttctaattctgttgatagagcatttacaaccgatgccccaacaccatgtaaaccaccagaaactttataaccgccaccgccaaatttaccaccggcatggagaacagtcataataacttctacagctggacgtcccattttttcttgtataccaaccggaataccacgcccattatccgttacacgaatactattatcttcttcgatactaacattaatttcatcacaataacctgcaagtgcttcatcaatactattatctacgatttcccacacaagatggtgaagcccttttccacttgtagatccaatatacataccagggcgtttccgaactgcctctagtccttcaagcacctgtatctgactttcatcatatgcattttcttgcatttgcttttgttccattgacacaaagatcacctacttttccatttaaacaggggttattccctatctatttcacaatctacagtgccgttcgttacatgaattgttttcgcttcttttaatgtttcgtgttcaattccgtcgacactcgtcgttgtaacaaatgtttgcacttttccttgaattgtatttaaaagatgtgattgacgataatcatctaattctgataaaacatcatccaacaaaaggattggatattctttaacctctgaataaatcaattcaatttcagctaattttagggatagtgcggtcgttcgttgttgtccttgcgaaccaaagacttgaacatttttactattaacgaagaattgtaaatcgtcacgatgaggaccaattaaagtcgtaccacggaaaatttcacgttgtttcacagattgaaaactttcatagtatacttcttttattttcgacaaatccattgattctgatacatctacacttggtttatagacaatttctaactcttctaatccacggcttatacctcgatgaattggagctgcccattcctgtagcaaatgcaaaaattcaaaacgtttttgcagtattttcgcaccatgctcaattagttgaagtgtaaatacatccaacatcgtttcctcattcttactattcccttgcatttttttcaacaagtgatttcgttgcgtgagcaccttttgatattgacttaattcatacaaatatacaggagctatttgtcctaattccatatctaaaaagcgtcttcttacttgagggcttccttttacaagatttaaatcttctggggcaaacatgacaacgttcatcacgccaatatattgacttaacttttgttgttcaagttgatttaattttgcctttttaccttttttcgaaatatttaattccaaagacaaagaactgtttcttttttgtaatttcccctttatttgaccaaaatcttcatcccagcggataagttcgcgatcattagaggttctatgagatttcgccatcgctaaaacataaatagcttccatcaaatttgttttcccttgtgcattttcgccgataattacatttaccttatcttcaaaggaaagctctaatttttcataattgcgatagttttttaattgtatttctgaaataaacaaagggctccccctttatgcctgaacttggaaagttccgcttcctggaatttcaataacatcattcgcatatagtttgcgacctcttctattttcaagttcgttgttcacgtacacttcatattcttgtaaaaaccattttacagcgccacctgtatcaattacatcagctaactttaaaaattgtcctagtgtaatatactctgttgaaattttaatacgtttcataaaatcgctcactttctgaaagtgttcattctttcattgtactaaataaactagcattaggaaagtaatacccaaaaatcaaataagggccactagcatctttaaactagcaacccttattccttacctagtaagtacgaaccggtaaaattaattgaataattgaatcatcatttactgtacgaattaagaacggtctcattgccccagtaaagctaactttaatctctgtactatccaaagcttttaatgcatccatcatatattttgcactaaaagatatttttaactcttctccatctactttttcgcattgtacttcttcgacaacttttccgatttctggtgaattcgaagaaatctctagcatttcttgctctaaagttgataatttaacaacgttattgcggccatctcttgctaatagtgaagcacgatcaattgcttgtaggaattcttttgtatttacaaaaatatccgttttactctctgctggaattaaacgtgtcgtatcaggataatttccttctaacaatcttgagaagaataataaatgttttgtacggaataatacttgatactccgtaataacgatatctaccatttcttcagactcatctaaaattttacttaattcatttaagctcttacctggaataacaacattagcttggaattcatctgcaatgttatgtccttcaatttttgcttttcgaagtgccagtctatgactatctgttgcaatacaagttaactcgctgttatataccttccagtttacacctgtcaagatcggtcttgtttcagaagtagaaactgcaaatacagtttgtctgatcatatgcttaagtaaatctgttggtatcttaaatacatgatgttcttcaatctgtggcaataacggatattctgcagaatctaaaccatttaagttaaactctgattttccagattttatttttgtcataaaatgattttctacagaaatttcgacagtgtctttaggtagtttttttacaatctcactaaaatattttgcctgtaaaacaatgcttcctgattgagcaatttctacgatttcttttccatcttcttcgactggaataaacgattcaatagaaatatcagcatcgcttcctgttaatgtaaccccttcttcagtagctacaactttaattcccgtaaggatggggattgttgtacgagaagaaactgccttcattacatcttgtacacctcttacaagatagtctttttgtaaaataaaacgcataaagaaaatttgaatttgtgaccaggctttcgagccaggcagcttagccacacgtgt

SEQ ID NO: 1301 - DNA, 10627 bp, Bacillus thuringiensis
attcgtatttatataaatttagtagaaatggggttttaaaaaggaatgagtataagcataacgcggcaaaagattttggcggccgcttctcaaattgtacaatgtaaaggggttgctaaattaactttagaagcagtggcaaaagaggcgggtttaagcaaaggtggattattgtatcacttttcaaataaagaagctttaatagaaggtatgatagtccgaggggtagaggattatgaaggggccatttacaataaagtagcggaagactcagagaggaaagggagatgggttcgctcttttgtagaggaaagattaagtaatgagagaagaacagaagagttgtctagcagtatgatggcagcactcatgttaaaacctgaattacttgagccattacaacaatcatttcagcaactgcaaaaaaatatagaaaatgatgagatagattcagtttgtgcaacaattattagattagcagcagatggattatggtattcggaatatttaggggttggaaggctaagccccgagttaagagaaaaagtgattcaagctcttattagtaattcatataaatagaatatgcgaactatataatgagaaaataattcaccattgcttctttaatgtagtggtgaattattttttttattagaaaaatagaacaattttatagagtattgaattataaccgtccagacggtatagtaatatttggtttaagaggaaaatgaaacaaaaaaagaataaaagatatttttagcacactattcgaaaggataggccgcaaagcttagagtctacggtaatacatattggttactaagatcgtctggttgcacatttttgatgcaaccggacgatctttttttgttatataaatataaaaatttaggagggaactatgcaaatgaaaagtactaaaagacatatttcaatggtttcattagtttttctagtattattttcagtgctgaatgtgtgggctccagttattcaagctgctgtgatgaaaagtccagtggacgaaattaatatttcccgtactgatggcacgacatctgaaccatatcaagcctcagatggtatgaaagtagaagtgaagtggtcagctaaagaaaaaataaaaagtggagatcaattcacaattgatatgccaaaagagtttcgaaaagaccttatgaatatgagttttcctttaaaagatgctgaaggaaaaacagttggtacatgtgagatgaaaaagggtctattaacgtgtactatgggtgattacgtagaaggaaagaacaacattaaaggttctttattcgtagaattctactttggtctagaagcatatgatggtgttaaagaaattccattagaatttaacgttgatggtcaaatcgtaaataaagaagtaaatgtaagtaatacgacagagagaccgaagccacaacccaatacggaaaatctattgaaatggggttcttataatcaagaagatccgtctattgctgattggcttgtatatgtaaatgcaactggaacagaaatgcaagatcttaaattaacagatacattaggacctgggcatgagttaattacagacagcgtagtattagaagaggctgtatttgaagatggttatgcaccaacaaatattaagccagcaaatttatctaacattaaaataaatgcaacaaagactggatttacaattgaatttccagacagttcaaaaggctatattttaagatataaaacaaaggttacaaatcctgctgcaaaacctcataaaaatactgtgaaattagaaggtaaaaatattaaaactgaagaaaaagtaggacaagtatttgtgagtggtgggggaggatccggttcaggtgacaataatccacctagcattgaaaaaaatatagttgatgagaatgacaagcttgtagagaatgagcagctaacacaaatggatcaagttattcaataccaagttggtacacatataccgaacgatcctcctaaatacacatctatggtaattagtgatgatttagaagatgttttagaagtattagaggcaaaagtgtatgataaaaatggccaagatattacttctaaagggacgttaaatatagataaacaaagaagtgaagtaacatttacgtttggtgagaattttgattataagtcatatgaagaccagataattaatcttagtatcaaggcgaaaattaaaaataatgcagacttatcttcttacgtagataagaagattcctaataaagcggaattacattttgatgataaaacattaacatcaaaagaagtaactattacaccgcctgaagctccaaaagatggtacagtatcgcttcataaaatagattctgagaatccgaacaaagggttgaaaggtgccgaatttgaagttcgaaatagtgcaaatgaagttgttgcaaaactgacaacggacgaaaaaggtttttcagtacctcaaactttagctcctgggacgtataaagtttatgaaacagtagcaccagaaggatatcaaaaattaacaagcccagtagaggttacacttcaagctggagaaacaaaaacaattgaaattaaaaatactgtgcaaaagggtcaaattgaaataaagaaaattgattcggaaaatggtgaaaaaccattagcaaatgcagagtttgatatagtaaaagacggtgtagtagtcgaacatattgttacagataaagatggtaaggcaatctctaaaccgttagcactaggaaaatatattttaaaagaaacgaaagcgcctgaaggctaccaattaaaagaaacagagttcgaagtaagtgtaacaggggacggcatattcccaatacaagtggaaaatgcaatggtagacaaaggtaatatagaaattacaaaagtggacaaagaaaacggagcagtattagcgggtgtcgaatttgaagtccaagatgagaaagatgaagtagtaagaaaagtagtaacagataaagatggaaaagcaaatgtttcagatctatcagtaggaaagtacaaattagtagagacgaaaagcttaccaggttataaaaagctaacagaaccagtaccatttgaaataaaaaaaggtatgacaaaagctttagcaataaaagtagaaaacgagcagttagacaaaggctcagtagaaattacaaaaatagataaagatagtcaaaaagtattagaaggcgtagtcttcgaagtgcaagatgagcaagaaaaagtagtaacagaagtaaaaacagataaagatggtaaagcaaaaatctctgatttatcagtagggaagtacaaattagtagagacgaaaagtttaccaggctacaaaaagctaacagattcagtatcattcgaaattaaaaaaggtatgacaacagtcctatcgttgaaagtagaaaatgaacagttagataaaggttcagtagaaattacaaaaatagataaagacagcaaaaaagcattaaaaggcgtagtttttgaagtgcaagatgaagctggaacagtagtaaaggaagtaaaaacagataaagatggtaaagcaaaaatctcagatctattagtaggaaagtacaaattagtagagaaagaaagtttaccaggctataagaaactaacagatccagtatcatttgaaatcaaaaaaggcatgaccgaagttctatcattaaaaatagaaaatgaaatggtagatacgggaaatatagagataacaaagatagataaagataataaagcaccgttagcgggagtaacattcatcgtccaagatgaaaagggtaatgaagttacaaaagtaacgacagataaagatggaaaagcaaatgtttcagatttacttgtaggaaagtatgaattagtagaggtagaaagtttacctggttataaaaaattagaaaaaccaatatcatttgaaatcaaaaaaggcatgaccgaggttctatcattgaaagtagaaaatgaaatggtggatacagggaatgtagagataacaaaaatagataaagatagtaaagctccattagaaaatgttgtatttgaagtacgtgatttaaaaggaaaagtagttgcaaaagtaacgacggataaagaaggaaaagcaaacgtttcagatttatctattggaaagtatgagttagtagaagtagaaacaccggcaggatacaaaccactagaaaagccaatttcattcgaaattgaaaagggtagagtaacagcattacaattgactgtagaaaatgaattagtggatacaggaaatgtagaaattacaaaagtagataaagaaaataaagatgctttagctgatgcagtctttgaaattcaagatgaagcaggacaagtagtcgctaaaataacgacagataaaaaaggacaagcacaagttactaatttatcagtcggcacatacaagttagtagaagtaaaagcaccaaaaggatataaacaattagtagatccgattactttccaaattgaaaaaggcatgacaaaatctcttgctttaacagtagaaaacgaaatgttagacaagggaaatgtggaagtaacaaaagtagataaagatagtcaaaaagcattagcaagtgtagtcttcgaagtacaagacgaacaaggcaaagtagtaacagaagtaacgacagataaagaagggaaagcaaaaatctcagacttatctgtaggaaagtacaaattagtagagaaaaaaagcttaccaggttacaaaaaactaacagagccagtatcattcgaaattaaaaagggtatgacagaagtcttatcattaaaagtagagaatgaacagttagacaaaggtttagtagaaatcacaaaagtagataaagatagtcaaaaagtattagaaggcgtagtcttcgaagtacaagatgaaaaaggcaaagtagtaacaaaagtaacgacagataaagaaggaaaagcaaagattgctgatttatcagtaggaaaatataagctagtagaggtagagagcttaccaggatataaaaaactagcgaaaccagtatcatttgaaatcaaaaaaggtatgacagaagtcttatcactaaaagtagagaatgaactagtagacaaaggctcagtagaaatcacaaaagtggataaagatagtcaaaaagtattagaagacgtagtcttcgaagtgcaagacgaacaaggaaaagtagtaacggaagtaaaaacagataaaaatggtaaagcaaaaatctcagacttatctgtaggaaagtacaaattagtagagaaagagagcttaccaggctacaaaaaactaacagagccagtatcattcgaaattaaaaagggtatgacagaagtcttatcattaaaagtagagaatgaacagttagacaaaggttcagtagaaatcacaaaagtagataaagatagtcaaaaagtattagaaggcgtagtcttcgaagtacaagacgacaaaggcaaagtagtaacagaagtaaaaacagataaaaatggtaaagtaaaaatctcagacttatctgtaggaaagtacaaattagtagagaaagaaagtttaccaggttacaaacaattaacagaaccagtatcgtttgaaattacaaaaggtatgacagaagttctatcattaaacatagaaaatgaaatggtagatacgggaaatgtagaaattacaaaaatagataaagataataaggcaccgttagcaggtgtagtctttgaagtacaagacgacaaaggcaaggtagtaacgaaagtaacgacagataaagctggaaaagcaacagtttcagatttatcagtaggaaagtacaagctagtagaagtagagagtttaccaggctacaaaaaattagaaaagcctgtaccatttgaaattacaaaaggtatgacaaaatctttagcgttcactgtagaaaatgaaatggtagatacggggaatgtagaaatcacaaaaatagataaagacagtaaagcaccattagaaaatgttgtatttgaagtacgtgactcaaaaggaaaagtagttgcgaaagtaacgacggataaagaaggaaaagcaaacgtttcagatctatcagtaggaaaatacaaattagtagagacgaagagcttaccaggttacaaaaagttaacggaaccagtatcattcgaaattacaaaaggtatgacaaaagtcttatcattgaaagtagagaatgaacagttagacaaaggttcagtggagattataaaaatggccgctgaaagcaaggaagtcttatcaggagctgtgtttgaggttcatgatgaaaagggaaaagtagtagtgaaagtaacaacagataaagatggaaaggcaaaaatcacagatctatctgtaggtaactacacactagtagaagtagaagcaccaaaaggatatgaaaaattaactaatccaattccatttgaaattacaaatggaatgataaatgcagttcaattagaagtattaaacaaattgaatcatttagcgccaccaggcccagaaacaccagatccagaaaaacctggaacaccagatccagaaaaacctggaacaccagatccagaaaaacctggaacaccgaatccggagaaacctggaacaccgaatccggagaaacctggaacaccgaatccggagaaacctggaacaccgaatccggagaaacctggaacaccgaatccggagaaacctggaacaccgaatccggagaaacctggaacaccgaatccagaaaagcctggaacaccgaatccagaaaaacctgggacaccagatccagaaaagcctgggacaccgaatccagagaaacctgaaaaagaattaccgaagacagggcagaaaatgcctgtggaaccatatatgggagcacttcttgtaatgatgagttttggattactcatattaggtagaaaacagcagagataataaaggtgaaaaggtatcctcaaagtatttgaggataccttttttagcataaaaaaagcatctagcaaaagtactagatgcaaataaaaacacaagggaagacaaagttcttcccttttcccgtatgtaattatatcaaaaaatttataaaaaactagctatatttaaaatataattttaaaaaaagttatatacataaataattgcaatacgcgcagttttatctttctgaaaaatctatttctttatttttgaatattaagactaatgttgataaatcttcagataattagaaaaaatacccgaaaggatatataatattgcttaataaataattttaatgaattacgtatatttcatttggtgtattaattgaatatcataatttttaattttattaagcaagaatctcggttacttattgcatttctaacatagggtgagatagaaaaatacaatagtgtggaggtttttataatgacgtttgttcttagtaaaatgagtggctttagcatagaagaaaaggtacatgaatttgaatctaaaggattccttgaaatttcaaatgaaatctttttacaagaggaagagaatcatcgtctattaacacaagcacagttagattattataatttggaagatgatgcatacggtgaatgtcgtgctagatcttattcaaggtatataaagtatgttgattcaccagattatattttagataatagtaatgattacttccaatctaaagaatataactatgacgatggcgggaaagttagacagttcaatagcataaatgatagctttttatgtaatcctttaattcaaaatatcgtgcgcttcgatactgaatttgcatttaaaacaaatataatagatacaagtaaagacttaattataggtttacatcaagtaagatataaagctactaaagaaagaccatcttttagttcacctatttggttacataaagatgatgaaccagtagtgtttttacaccttatgaatttaagtaatacagctattggtggagataatttaatagctaattctcctcgggaaattaatcagtttataagtttgaaggagcctttagaaactttagtatttggacaaaaggtcttccatgccgtaacgccacttggaacagaatgtagtacggaggcttttcgtgatattttattagtaacattttcttataaggagacaaaatgagagagaataaaataattatgatttctggagccaatagcggtataggtcatgcttgtataaaatactttttagaaaaatcatttcatgtaatagcgcttgatattaataataataacttaatagattatatgaaaacagatatgcctttgaaagtagtgcaaattgatttaagtaatagcgaagcgattcataatctgtttactcaattagatttagaaaagctttctcctgatatattaataaatgcagctggtattcgagagataacacctgttttacatttatccgatgatatgtttaaaaaagtaattgatgtaaatttagtagccccatttatcctttctagggaagtagctaagcgatggtgtgaatcgaaaataaaaggttgtattgtgaatatagcatcggtttctggattaatggctgaaccagagcgagctgcttatgttgcatcaaagcatgctttaatcggattgactaaacagatggctatggaatttggaaagcaaaatataagggtgaatagcatttctcccggtgttattagaactgaacttacagaagaatactttagtaatacagccttgatgtctatgataaaaagtaatcaatctttagatacttgggggttgccgcaggatattgtttcatgtattgagtacttgatttctgatcaggcccgctttattactggttctaattttgtaattgatggtggttggactgctgggaaaaatttataattgagtgtttttgaggaaaagcacctgtccttttttaggctggtgtttttctcactataaaccgagtttttattggagggggattaatttgcttcaaaaaagttttaagcaagagaaaacggtaccggctttaaagatgatagcatcaatggttatctttggatcagttggatttttttcagttcaaacaaacttaccttcgtttgaattagtgtttgtaaggtgtatttttgcgacaatatttttaagtgtatgctggttgcttacagggcaatataaacaagataaatgggaacgaaaagaagttattcaagttttaatatgtggctttttcttagtatttaattgggttttcttatttaaagcctttgaaaatatgtcagttacaattgctatctcggtttatcatcttgcaccagtaattgtactgttaattggaagtatcgtctttaaagaaaaattaacattaatatctatcatttcaatagttgtgtgttttgcaggagctttattaattgctggtatcgatggaagtttctctgtcggttcattaatgtcttcaggtatgatatggggatttcttgcagctctcttttatgcatttacaactttatttggtaaagggattaacaaaatgagtgcgtatgcaatgacatttttacaaacattcttggggatatttcttttaataccatttatagatttagatgcttttagtggcctcactcaaagtaattggacatatattatagctactggttttattcacacagggatagtatattatctgttttttgatagtttacgctatttatctacaaaaacaatctcaatattagtttttttggatccggcagtggcaatattattagatactgtacttactggattccgtccaactttaatgcaaataacaggaattctttttatttttattggtatgactttaacattaaaaaaatctaaagataaaaaactgagccaaaaagaaaagcgaattgaaagcgatgctagtatatctcaacaataatgaaatatattgtgtataaaacgataaaccttacatgaatcatgtaaggtttattttagttcaatataattcatatttataatatataattttcaaaactgaggtatgtttttctttaatctgcttttgattcatatatttttatttgactataaatttacaaaaatgtatatgaaatcttattttttgataatatataagtaataaattcatagaattggagtgatgagatgcagccgttagaaagggagattcattctaatatgctgaaagtgtggcgaattcacgctttaattgggacggcagttatactaacagtcgtaattgcgtatttcttttttatgattaactttaactggtggggctggttgtttggactattagtaacaggagctattacatttattccacttgattattttgtgtttccaaatttacgtcagcgctattatagttacagattaaatgaagaagagattgagattcaaaagggaatgttcgttgtaaaacgcgtacttattccgatgatccgtgtgcagcacgtaacgattgagcaagggccgatcatgagaaagtataatttagcagaattacacatttcaacagccgcaacttctcatagtattccaggtttaacgaaagaagaagcagaccagctaaaaagacaaattggagaac

SEQ ID NO: 1302 - DNA, 12149 bp, Bacillus thuringiensis
aataataattgtaaaaaataatataaatccataatcttgcactagtctaggtgaagaaaacaatactacgaaaacataaattccacataatacgatggtaaataaaataaatttattgtccccataacctcgtaaaaaccttttcatatacagtaaaataaataaagcgaaacctacaaacgatgtatatataattttcatatatgttgaaaattcaaattcatacaaagagaacaaaaaacgttcatccgtaattaaaaatataatacctgcaaatatactaccaagtgaaaaatatagaatctcaacatttttcggcttcatcacaaaaatgataaatgcatatataccatgtaaaaacactattgtcgttgcaataatttgcatcataagattgttaaagctatcctgtacaatagcattttcactgccaaaacgcactccacctgtaatcccgccatgtttcgattcttgtgtcgttttcgtaacaggaataagaagattaattaccccttgttcattcgcttttacctttatgacagttggtgtaagtgaagttttatgtacatcattcggtttaaaaatacttcctctttcctgtacaagttctccatttacatacaaatcgaactgattatgaacacgctgtatttttaagccgtaattttcattcgaattcttcactttgatagatagcgcatatgtgccatattctttttgatgagtacgatcaactctttctttccagttccccggaacattaatatattcataatctttattattttccttcatttgatccggggtaagtaaaacattcggataaaatttccattcaccatttaacgtaactaaatttttttcgccaaatgttatatctgataaatttactatcccttcttcagcatgtggttgatttatataaagagattgtttaaaccaaatggaacgaaaaccgacaatacaaaggataaataagaatactactatcaatatttttcttttagacatacttattccctctttataaaattacggaatcttttcaaatctttaccataacatatcacactttctttatcgagtgaataataactatattctaaaaatatttccatcactcgtactttaacgttttttcactttaaaataaagaaacattccaatgaaaaataatagaacgattactattccaatcatccacttttctactacaaatggattcacttgagccacaactgcttccttttcttccacttcaaaaggaacccgttcccctcgaactatcaatctatgtgtatttactccataaggtgtgcatgtaactaacgtaacgtaatctttatttttcacaactaataaatcatttgtttcatttggtaatacaacttttatttgatccaccttataagcaagcactttatttaatgaatgtatgtaaaaagtatctcccttcttcaccttatccaagtccgtaaataataaagcagaaggcaaaccacgatgccccgttaaaacagcatgcgtactttctccccctactggcaaagaagaagcattaatatgtcctactcctcggctcaaaacattttcagatgtgccagcataaattggaagctttacatcaattgtaggaatttcaatataccccatactctcacctacatttaatacatctgcatatgaacgtccactctcgtcgccccctttttcattaaatggatccgaaaatgactgtgacgtcgtctggacatttttattatattcattcgcttctttcttcctacgttcaatttctttttgctgtaactcttttacttttttatcatacgaactaaccgctgaataatgagctcgtgttgctaaccaattactaactgttggatataagaaaatacaaagtcccaataaaaaaatagcaccaaatataatgttacgtttcatcatatcctcctataaagtgaaactttaatcagtgtaggttttgttcaccccactgattgttagccctcaaataacgggctaaaatgccgaaaaagaggaaaggcctccctctcctcttttcattaccgtttaaatcgcttattaattatttgttgctttttttctaaagaaaacaaatgctgctattatcattaatacaagacctactacagtaaataagattgtaccgataccacctgttgaaggtaaaatccatccactcttattattttctacagtaagtgtaactgttttatgatcagcatcaatctttacatgaattggctctcttaattgttgataactacctgttgtaccatcttctttttcataagttggagctttcgtttccacaacttgatactcaccgtaaggtagctatattccatgtaattacaccatttttatcagatgtacctactactttctttccatcgatttctactggatttccttttgtatcttgcagcgcaaattctgcaccttctaatttcttaccatccttcccatcaactttcgttaatgtaataccaccagtcgttggagtaacgataactggttttgttgccttctcacctgttacatcatctttgtttttaaatgtaattgttgccgtattcggaatctctactcctgtttctacgccatctctaatttgtgctttaatttgcaaatgaaactcttttttgttatctaatttagagaaatcttttacagtagccgttactttttgaccgtctacaactacttctacaacacttgcatctactactttaccatcaatttttacaactggttgatcttgaatttctaatcgactatctaatacatctgttacgacataatatttataatccttaatatcttctggaattagtgttttaatatcatagttataatccgtcttcgtattaattggtaaattgtttaaatctccattaatcttcttatcaattgttggttcttcatagtttttcacatcaactttaactacttcaccagaagtaactgtaccatctttattaattacaccagattctttaatgaagaattcatattttttcggatccaacacataaccatctagcgctttcgtttctaaaaagtaatacttcccgtacgataagttaccgacacgaattttaccatttccatctgtctccaaacctttttctaactctgttccatcttctttatataaagagaattgaacaccctttaacgctttattttccacaccaatttttgttaattctactgcaccacgtttcgtttcatttttcggataaattttaacatcatatgttaatactttcccatcttcacttgtcatcgggatatcaactttgtatgtttttgtgtctatatttacatgtggtggtccagaaatttctttcacttcgtaacgacctagtggtaaatcgccaaaaaatgcaatcccatccgcattcgtttcaacttcaattggaactccatttactggtttgatgtcttctttaacaattttcccatcgtttgaaattgttccaaatgattcaacttgtttaatttgatacacaactcctgctaaaggcttcgcatctttaggaatttctactcctttagagctactttcttttaaagctggattattaagcggctcttgttcaaatttatggattgttaacgtgccttttttttcacttttcgattccgcttttattaacatacttggcaatgaagcaaatgctagcaaaaagattaaaaacatacttaaaaattttttcatttctcgttctcctcttctaccaatttaatattctagtaattactatttctcttatggaaaaacaaaaatacaactacaatcattaaaaaagtaccaattaaataaaatacatttgttccagcaccgcctgtgtttggaatttcccactcgctttttttgttttctacttttaacgtttgtgtaggtgtcgctgccgttacctcgacctcaattggatcacggagcaacatatatccattcggcgctttcacttctttaatcgtatattttccaaacggtagtttctctaagctagccttgccattttcatctgtaattaactttccaacttcttttccttcttggttaaaaacttgaaattccgcatgttgcaacttaatattttcatcagctgcatctaccttttcaatttcgatcttacctatagatggcggaataacaactactttattcgaactaattggcgtattatcaaatatgagctctgctatatttggcacgccgccatttgcaatatatttcgctaacacctctactggtgtaccttctgctattttgcttttaatatgcatcgtgtactttaaaccagctaaatacgcatatgaaccatctttcttctctaactcaattgtcactttctttgtttgcttatcaatgttcggtgttacttttacaacttcacctttttcattcataagcttcacatctaaaatatctagaatatcctctaagtcatcttgtaaggtaaccttctctaaatttgctgtatcattaccaaattgatatgctacattccaagtaaactcttcatttctctcttgcaatgtacccttttccacttctttctcattttgagtagaaacggtttttgttactttcggtttttccttcggaggaaccacatacacttcgttagatttcactgacttattatttagtactaactctgctgtatttgggattccaccttttactatataacgtgctaattctgattgatttacaccatcagcaattttagatgtaatttgcaccgtatatacttcacctgttaaatacacataacttccttcttgcttcggtacttcaatcattacctgtttcttagcagtatcaattttgggttttatatttacgacttcaccttttttattgatgaccttcacatctaatatgtctaaaacatcttctaaatcatcttgtaatacgatagaatcgtatccacttggtgaacttccaaattcatactgcacattccaaacaaacttctcttttacattggataatgtagccttttccacgttcttttcatcatcatccgatacagtcttgcgtaatttcggttcttcaattggtggcttcacaatgactttattagaaacaactggattgttatctataatgagctttgccgtattcggaacgccacctttatctaggtaccctttgatcacatcgatatttgtaccaatctttatcttcgctttaatcgttaatcgatattgtccaccagctaaatacgcgtacgaatcattttgctttggcaacttatacgttacaattgacttttctttatctataactggcgctatatttacaacttcgcctttttcatttactaatttcgtctctaaaacttctaaaatatcttccaaatcatcttgtataacgatttcttgttttgactccatatcaaatccaaagttgtaattgacatcatatacaaattcttcatgcaatgaatttaacaatgcctcatcgaccagtttttgatctgaatcagaaacttttttcgttaccgccgtattacacttagtagcattttcattcggaagtgccttgacggcttgaatatcaaacttttgatcaaagaacataaaatatccatccgcaacattaaattctttcgattgcggtgttttttccttcaccttataagtgactttatacgttccttctggctgtccgtctaaatcccaaatgatctgattcccttgtataacaggctttgtattaacaccatttggaccagacccttgcacacctgttacgagcaaatcattattaatatttaaaatcaacttatctttttctttttttgtcacttttgtaacggtttcaattaaattttttgtaaactcttcaatatcatttgccagtacaaaccattccggttttgttgccatcttttttaactcttgccttgcatatggacctacttctttatcgtacttagtataatattggtcagatgctgctagtatacttttatcttcccaaaaagctgtaacaagtttatatcccgcgttttttatattttgagcctctgtagttacttccttcaaagcacctacataatcttgcccatattcattcgacctataacctgtgccctgatccgttagttgatttgttaatttgtaaatatagccatcctttcgaatgttagcaacaccatctgtaacaagcagaaaaactgtttctcggtctggatcattttgtcccttcgctttctcatactcagctaacgcaaactgaagaccactggcagttggtgtaccgctatctggagttattttattgatgccattctttgctgaggtaaagttattagttaatcctgcttgcaaggttgttttaatcccattacctctactttcaagtacacgaccgtcactagctttatatcccttataatcttgataactcgttaccataatccgatccgtcgcaggatttagttcatctacgatattgctcaatgcttttttcacatttggcattgtgcctttgaaacttccacttgcatcttgcacaataacaaaatcaactttcttttgttttggtgctggccacttaaaaattagctccccttcatgctcccttaaacacatattccctgtcgatttagttgttaccttatgctgcaccgcttccaccgtattagcagcaaccgctattatccctgggctaatcacttgaaatacgagtagaagcaacataaataatgtgacgttcttcttcatcgttccatcctctcacttaacataaatttatctcgcctcatttccccctttttcgctaaattacttttacgctcaaagtataaattgggacactgaacaaaaactgaacaaaaaatcaaaaaatagaaatatttaaataatttatcgtatataacaattaataagaatcatttataatagtaattacaaataattaccatgtaatatttatggttatttatggaggaatgaaaaatgtcctattttgtctaaatatttattggtgatatgacttgagttaaatcattaaacaagattgtaagaaagaggtaatgaactatgagggcaattattgttgatgatgaaccattaatactccaaagacttgaaaagatgttaaaagaacttcaaatttttaaagatatcgtttgctttgatgattgtgaatctcttagtttttatagtaaagatcatacaattgatgtcgcatttcttgatattgagatacctgaaaaaaatggcgttatgttagcccgcgaactacaatcaaaacataaaaatataaaaatagttttcattacaggacacgaccgttatgcggttgaagcatttgaaatttatgcattggattacattatgaaacctattacgagggaaagattgcataacactattcaacgtcttatgcaaagcatgacgattgaaacaactaattcctctacaatagaaacttcgatactcaattgccttggtgagttatattatgtagatcatgaaaaagacaaaaaaatccccctagaaaaatggcgcacaaaaaaagcgaaagaactatttttatttttagttcataatcgaaataaagttattaatagagatactttaattgaattactctggtcaaatactgatttagaacaagcaagagtaaatctacattcagccatatatcaaattcgaagaaccatccatgcttacgaaatgaatgtaaacattactcgagtgaatgacggatataaactcgatttacaaaacattttgattgatgttgatctattcgaacaagcagcagccgctcttccaaaagaaatatgtagcgatacattagataaatacattgcatgcctctctttatatactggagattaccttattgatatggactattggtggagcgaaggagaaagaacaagattacaaaacttatattttcaacacgccttttcccttattcgtttttatatagaaggcgcgagttacactgaagcaattgatatttgcatgcgtatgcaatctatgaatccatttgaagaaaatacgtatcaccatttaatttccttatacgctaaaacagggaataaaacagctaaacaaaatcaagaaaaaatgctacacaaattattaagcgacagcgaacttactatgatataaagaatctctcaatatagattcttcatttttgccattctcagctatcctatgctacatttattccggcatataaatattgaataataaggcggagataaaatgaatatacctaaaatcggaatgattggacttggaagtattgcgcaaaaggcctatcttccaacacttacaaaagaaactgattggaattttgtaggggcgtttacacctaatgcagagaaaagaaaacaagtttgccagcaataccgaattcaagactttcattctattgaaatgttagcttcggaatgcgatgcaatcttcgttcatagttcaactgcatcgcattatgaaatcgtttctgaacttctaaaaaaagggatcgacgtttatgttgataaaccgctagcagctacagtggaacaagctgagcaactagtcgagttgagcgagaagtataaccgaaaattaatggtcggatttaatcgcagattcgttcctatgtatgtcgctgccaaagaacaggctaatgatatttcatggattcgaattgaaaagcatcgtacaaataaagtcgggccatatacgtacgacttcactatgttagatgattatttacacattgtagataccgctcgctggttagctaatgatgaccttaacgccgttcacaatatgatgcaaatcaatgaaaagaatgaacttctttacggacatcatacatatacaactccaagtggactgttactttctactgcaatgcatcgccatgccggtactaatttagaacaaattgaacttgtaacgccagggaaaatcattcgcgtaaaaaatatgaatacatttgaaattgaacaggaaaactcagtttcacaaagtggttccccatcatgggatacgacgttaaaacaacgtggttttgaagatgctgttcatcattttattgagtgtgtacaaggcgatacaaagcccgttgtagatggattagaaggattaaaaacacagcaaatgctacaatctttactagatgatgtaaacaaaaattaaaacagatacatttttcagaatttactttcattcccattccctctttatttctctcgtaaatttctatagaatatgttgataggaattataaatttcataatgaatcgtggaaaggatgggattaacacatgtggaacgagtttaaaaaattcgctttcaaagggaatgtcgttgatttagctgtcggggttgtaatcggtgctgcattcggtaaaatcgttagttctttagtaaaagatatcatcacaccattacttggtatggtattaggtggcgttgactttacagatttacactttggatacggtaaatctgctgttatgtatggtaacttcatccaaacaatttttgacttcttaattatcgcagcttctatctttatgtttgttaaagttttcaacaaactaacatctaaaaaagaagaagaagaaaaagaggaagaaattccagaaccaacaaaagaagaagttcttcttggcgaaattcgcgacttactaaaacagcaaaactcttctaaagatagagcataattgaacggataaaaaggcatgtccctcgggacatgccttttctatatgctataacgtttccgaattcatatgaataaataaaataataccagcaaccataagtaccataatgctacctgcaaatagtgtaataccaataaacattaaacttgtgctcatatctactgatacactttcaataaaaatagaaattacatacgtgataagggcaattcctgcaagaatacttcctggaacaaatcgctttaaaccattttgttttaacgtcatatatgcaaaaatagcagtcatacaaagcgtaattatccaaagaacgatcatctcttttcccccctcacaagccttttctttctattatacatgacattgccctataatagttaaatttgcacttatgtgacatataacaaggaatagccccatctatagcgaaggcattataacatacacttatacaataaggaggctttcatttggactatactactacatgtaaattagagctatccgaacgattcgattatgttacgattgacttagacaaacagtttttttacatagaagttgtaaatttacaaagtaatataactgtactaaaaatatcaattaacttgcaaaaagacgaaacgatggtagagggaaatataattcattatgatactttgcacgtagatgcattattacaaggattgaaatatgttgctcgaacatgtattgatcgcaatttaaaaaaccaaaaggaactgttcgcatttttagaagaaaattagccccactaaaaatggttattttttctttttattgatataattgttatagagaaatattctttgtaagggagtgttcataatgatttggatttcactaatcgtattagcttatttcatcattctcgtcccaatacagtacaactacattaaaatgctcaaagaaaaacagaaaaaattgagtgtctcacaaaacgaactatatgataacatgtcttatgaagaatcccaagtacattaccattatcaaagtaacgtatttacaatacctgcttcgcttgtcgcaagtattatttataaagtgaaacatgcagcataatatgtacgctgtaaaattattgtttgaatctgttcattgtagtgagcctgatcctacgaaaattgatgagcattatgaagagaatcacgatacactttttgaagaaagtattattcttgttaaagcaaacaatttagaagatgctcacgaacttggtaaaaaaattgctatgcaatctgaagatacgtacgataatatgtacggtgagcaaataacgtggaagttccgaaaagtgttgcatgtgtttgaattagacgatacaccatttgaaaccggaaaagaactgtacgcaagatttttacacgttaagaaagacgaaatggtaaatgcagtcgtacaaaaatactatcctgaatacgaataaaagctcacagcaatcgctgtgagcttttttatacttacttcgttgaatctctaaattggatacggtgaggtaagataacagtgtgatcttccactttttctttgttcatatactttgttaatagacgcattgctactgcaccgatatcatacatcggttgaacaactgttgaaagctgcggacgaaccattaatgcaagacgtgtgttatcgaaaccaagtacttctacgtcagttggtacgtttaatccagcgtcttgtgctgcatggattacacctagtgccatttcatcagaagatacgaagattgctgttggcttttcatcattgctccaaagcttttcgaatgcttcgatacctgagtcatatgtgtaatctccatcgattacaagattttcatcatatgaaataccagcttcttctaaagcttttttataaccttgtaacttcttcgcacttcccgctttatcaatgaaaggaccagagacgaaaccgatacgtttatgtccttgctcgataaagtgcttcattgcatcataagctgcttgtgtataatcaatatttactgatggcgtttcattttgctcatcaaatgacgctgctaatacaattggtactggagattttttaaattcttcaatgtgaatgtctgtaatatcttcacccatgaaaacaattccgtccacttgttttccaagcatcgtatttaataaatggaactctttctctttgttttgatcagagttacttaaaatgatgttatatttgtacattgttgcgatatcttcaattccacgtgcaagttctgcataaaacgtatttgagatatcaggaataataacacctactgtagttgtcttcttacttgctagtccacgtgctaccgcattcggggcggtatcctaaacgatcaattgcttctaatactttctttcttgttgtaggctttacatttgggtt

SEQ ID NO: 1303 - DNA, 8842 bp, Bacillus thuringiensis
  unsure (1)...(8842): unsure at all n locations
cactttttgatgaaggagcacatattactggtcacccttcttcaaaaggtgatatcgtagtcggcaatgatgtatggattggttatcaatcctgcattttatctggtgttacaattggtaacggggccattatcggcgccaggagcattgttacaaaagatgtacccccgtatgcaattgtagctggtaatcctgcaaaatttgttcgatatcgtttcccccaagaaacgattgacaaactagagaatctcgcatggtgggactgggacatttctgttataaaagaagccattccattactactctccgacaaaatcgacgaatttttcacctcacccgaaaaagaatctacatgataaatacagaaagagcatccttttttccggatgctctttctgtatttattttttatttatttgcaaatgattacacggagaacattgaaaaggaattttccctaagcaattaagatttgtttcacaaatttgttctatcgttggaacaaatggaatgacaactatgttactttctaccatttgtgtaacaggtggcaatactgtgcctacttgatgttcgaaacgaatactcgcttgatttatataatttcctgaaccatttggcgcgctctgcactactacttggaacgaaactgtccgtgcttcacctggatttaaatttcctataataaaacctgatactgggtttacatttggcactggcgtattatcaatcgttacagttccaaggacaaattgaacactactatctaacatatcttgaaaacgaatattttgtattgctgtatcccccgtatttgtaataactgtcgtaaacgtaataacatcgccaattgttgctgcctgtaaatttgccgtttttacgactgtcgttgagacattttgaggaataaacgggataacaactgtattgctatcaccttcaactactactggcggctcattcggatttacagttgcgagcccatttgctatagcagtatttgtaactaaattatttatttgtcctcctgttattacaacttggaaattaataattgctgcgtcatttggctgaaaatcacctaacggaataccggtattcggattagcaaatggaagaggtacatcatttaccgttaccgtgccatttataaataaagtattcggatcaatgatatctgttaaaacaatattcgtcacaggaactgtactgtcatttataacggcaattccataagtgacaacatctcctaccatcgctacttcaaagtttgctccttttgcaacaaataagattgcagtatttaccgtcactataactgtattgctcgtatccatcactgtaactggcggctcccctggtactaaaatatattctgctaacgccccagcaacgttcactactgtaccaccatctggaaagctcgtaatcgtagcttcatatgttacaatcgccgtctcaccgactggaatgtctacaatcgtaaatccaacctgcggatttactcccggacgagctactccatttacagttacactatttggtacaaaaacagcttccggagataggacatcgataaattgaatattcatcgcatcagcagtaccagtatttaatattcgaaccgtatactttactgtttctcctactccaacaattgaatgatctacttctttttgcatatctaaactgcctctatttactggtgtgactgtcgtattacttgaattcgtaattgtaaacggaggttctcctggaattaattcaaaatcacccgttactcttgctgtattcataatgctattagaaggcggaactgcgattacatttacttcaaatgtaattaatacgctatcccctactgcaagattaggcaatgcaaagcctacaaatggatctaaacctacttgcggaatcccatttatttgtacacttccaggaacgaattctaaactaggtgatggaacatcgctaaactgaacgttcgtcgctgttaccgttcccgtatttgtaacttgcacactatacgttaacgtatctcctaatcgtgtcgcttctttatttacagattttataacgctgaatcgtcctctattcactctagttatcgtcgtattactcggctctgttactacaaccggtggctctcctggcactaaagtaaagcttcctgttatatttgcaacgttcgtaattgttcctgatgacgggatgtttgtaactgtcgcttgaaacgtcactataactgtttcaccaactgggatatctccaactccaaatccagtaatcggatttaagtttggttgcggggctccatttatcgttacactatttggtacaaatgacgcacctgttgaaatcgtatcaataaactgaacattgttagctgttactgttcctgtattcgttatttgcactgtatacgtcaatacatctccaactagagtagcggctctatttacttgtttaataacattaaagcgtcctctatttacagttgtgagtgttgtattacttggctgatttactataactggtggttctcctggtactaaaataaagcttccggtaacatttgccgtattggcaattgttccgtttgacggaacgctaacaactgttacttggaatgtgacttctacactttcacctggagttatatccggaagtgagaagccagtgttgggatctaatccaggctgtaacacaccgtttatcgttacactattcggtacgaatgttatagaggatggtaatacatcactatattgaacattcgtcgctatcactgttcccgtattttgaactactgttgtatatgtgattgtatcgcctactgcaacaaccggctgacttactgattttaaaacattccaaccagattcatttatttctgttaatgtcgtgttacttgtcgtcgtttcagtaataggaggctctgtttcacttacagcaaacgtagccgtaacgtccacaaagttaacaactgttccaccttgaggtatgctcgttaccatctcttggtatgtgacaagtacaaaatcacctacaggtatatctggaactgtaaagcctatgaacggatctaatcctggttctggcactccgtttatactcacacttcctggaacaaacgctacaccactcgtactagaatcaagaaattggacattcgttgccggtaccgttccaaagttaaaaattagtacatcgtaggttaatatttccccaaccgtcgctgcccctttatctactatttttactggaaaaattgaagctatattaattgtcgtaacgactaaattcgttaatatcgtttgcgtaatcggtggctcctgcggattcggttgtgaagtaaatgtaacgtcagcatcatttaatatgacttcattatcaggaatttccgtaatggtcacttggaacgttacagaaatactcgcaccagcatttaataacggactaactgtaaagcctatttctggatttaatccaggttgctgcactccacctatcgttacactgttgtcaacaaacgtcgtcccttctggaatgacatcttggaagagtacatctgtaacagggataattcctacattcgttattagcactgtatacgttaatacatccccaacagccccagttgcaatatttactgtttttattgctgtcacttcaccaggaggaggtaacggtattgtaactaccgttgtattacttgagttcgttgttgttacaggtggttgtaaaggattcaataagaaagtagctgtagcagacgctgtgtttagaactgccccaagcgttgatggtgcaacaactatcacttggaatgttactgtcaatgatgtgccagctgcaatattaggaagcgggaaaccaatatttggatcaaatccaggttgaggcgttccatttatcgttacactatttgctacaaatgttgtttctggagcaatcgtgtcaatgaaagaaatatttgtagctgcaactgtacctgtatttcgtataacaacagaatatgtgtaagtctctccaagtgctgcttgttgtacagatgaagatttttgtatagttagtctcgctgtatttacttgtgttactacaaaattactatttgtagtagtcgttataggaggtcctgccggatttataaggaaacttgcagtaacattcgattgatttcttatatttccaccactcggaacgcttgtcactgtcacttggaacgtaattgtagcagtttgcccaactggaatatttgtaacaggaaaacccactataggattcgcaccttgctgaacgactccattaatcgttacactattcgctacaaatgtagctccagatgggattggatcttgaaaaataatattcgttgcggggacagttcctgtattttgaataagaatcgtatacgttaacgtatctcctacacctgcttgtggtgtatttacactttttattacattaattgatcctacattcacccgcgtcacaacaatattactaatcgttacaattgtaattggtggctggagaggacttacttggaaatcagcagttacattcgcattattcggaagaactctatttggtggtacactcgtgattgccacttggaaagtaactgttactatacctcctactggaatattagcaagtggaaatccagttgtcgggtttaaacctggttgaggtgtcccgtttattgttacactattcgctacaaaagtggttccaactggaatcggatcaaggaatgatacatttgtcgctactaccgttccactattttgtatagcaactgtatatgttagtgtatctcctacacctgcttcagtagcgcttacactcttcattacatttagtcctgaggaattcacaactgtcataacagtattacttggaaccgtcacagtaattggtggctctgttggatttacaagaaaatctccagttacattcgcgttatttacaacattattccctggcggaatttcatcaattaatacttcaaatgaaataattacactcgcgccagtaggtaaatcatttaatgggaatcctagtcctggatctgccccctcttgtaaaacaccattaaccaatacactattttcaataaataatgtccctggcggaattgaatcttggaaaaatacacttgtagctggtacactacctgcatttataacttcgattgtatatactaaaacatctcctaccgttgccacattcgtattcactgctttcacaacttcaaagttccctgattgtactgtcgtattcacaacattactcggtacattgattgttactggtggttcattcggattcacttgaaagcttgctgttacatttgcttgatttaaaatatcttcattttctggattctgtacaattactacgtcaaatgtgactacaaccgtttgagccgcaggaatatttggaagagagaatcctgtattcggatttagtccactttgctgtactccattaattgttacagaatttgcaacgaaggaaacagcggaagaaatagtgtcttgaaataacacatttgttagcggaacgtttcctgtattttgaacggcaatcgtatatgttaaagtatctcctactgctgcttgtgttgtattcacttcttttattacatttaaactgcctgtattaacttgtgtcacaactgtattcgtttgtctattaatcgttattggcggctgattcggaataacgacgaaattagcagacacatttccgcgattcggaatcgtacctcctgatggcgtagaagttactcgtacttgaaatgtaactgtcctagtcccacctggagatatgttagcaactgtaaagccagttgccggatttgccccaggttgcgaaattccatctacagttacactatttgtgataaaagtcgttccagttgggattggatcttgaaaaataacattcgtcgcaagtacatttcctgtattttgaattgttaccgtgtacgtaagaacgtcgttaaccgttgcaaaagctttatccactgtttttctcgttgttatatcagctatattaattgtcgtaactacagtattgcttgtcgcttgccctgaaactggtggttgaccaggtactggagtaaagttaaatgttacactcgcacggtttggaattggattgacaagagggtttgatgtcactcgaacttgaaagcgcactacagtcgtttgcgatgcattaatacttccaagattaatactacttgctggattcgctcctggacgtgctaccccgtttaccgtaacgctatttgcgacaaatgttgttccagcagggatactatcaacaaaaataacattgtttgcagtgatgtttccattattcgttacattaaccgtgtacgttaatacatcattaagtgttgccgtctgtagatctacagacttttgcatacttatagttgcttgattcactgtcgtttgtactgtatttgaagaagacgtacttgcaataggaaggctaccaacgaaaggacgaaattggtaagacaccattgcacgatttgaaatagggtttggatttggaaacgatgtaattcttacttggaatgtaacgattctttgagcattatttggtatcgttcctaaattaattccactagctggattcgcacttggttgtgttactccaccaaccgttacactaccagctataaatgctgtgccgttcggaatactatcttgtaataaaacgttgtccgcacttcctgttcctgtattcggaactgtaatcgtataagtgagaatatctcctatacctgcaactgctttatcaacagatttgacaggatttataatcggtcccgtcgcatcaatttgaacaccaaaaccagccgctgcataaccatcaccatttgtaacgaaccgaacggttgctgacgtttgattatttactaatgatgatgaagcatctacgtttgtaatatcccatccttgtcttcgaacagccaaagctatccctaatggctgattcaaatctccaaacgttccggttgtatctaattccccaaagtcattacaaatttgagattgaaagaaattatttgccggatttctcggtccgaataatgcaactgtagcatttgggtttggtccaaagcgaagttgatctccagaaatgttggaatctccctcttgaacagttacgagtactcttcctgtaacagctcctgtagctggagtagcaaatcctgaaatagtagcatcaacaggcggggatgaagcatcaataatttcttggcctgcataaactgacaaattccgaagaggtaaacttgcattttgatatacaacctcaagcgtccagccagctgaacgactgattgttggatcagctgaagttcttgcagcgggcacagcacctgttgtatatgtgcctgccccacctgcactaacaagattggttacattagcagagcgagcataataaaactgatttcctactgaaccttgctgcgcggtagcgggatctggcgtaacagcaaacgtccctgatggtgttgtaaatgtaatatcatcatttaaaaatggtaaaacatcttccgtatcagtccgaaaagtaccagcccaaactaactctgcatatagtacactactccccgccggaagatttaaaattgcacttgaagaattcaattgccattcatccgtcgttcctgctgggaaccctggtacttgcagcgctgtatttaccgtagtaaatacagcaagtgtaccaaaaatattacctggcgcaggtgatgtagggctaagccctaacgtgttcccagtgaacgtgacggcaccaggtactgttgttgtaaaacggtttataaaaggcacacaatcatctcatttcatttatagtaaaaagtgctctatactataaaatgtagacaaactatgcaatgtacgttgtccaacaaaattccgcacatacgagaggagtttataaaactatgcgctacgttatcataacaggaacttcacaaggtttaggtgaggctattgccactcagttgttagaagaaagtacaactgtcatctctatttctagaagagaaaataaagaacttactaaacttgcagagcaatataacagcaattgcatttttcattccttagatcttcaagatgtacataacttagaaactaactttaaagaaatcatttcatccattaaagaagacaatgtatcctctattcatttaattaataatgcaggtacagttgcacctatgaagccgattgaaaaagcagaaagtgaacaattcattacgaacgttcacattaatttacttgcacctatgattcttacatctacgtttatgaaacatacgaaagaatggaaagtagataaacgcgttataaatatttcatctggtgcaggaaaaaatccttatttcggatggggcgcttattgtacgacgaaagctggtgtaaatatgtttacacaatgcgtagcaactgaagaatgggaaaaagaatatccagtaaaaatcgtcgcttttgcccccggtgttgttgatacaaatatgcaagcacaaattcgtgaaacagctaaagaagacttcacaaatttagaccgcttcattgcattaaaagaagaaggaaagctattatcacctgaatatgttgcgaaagctattcgtaacttactagaaactgaggaattccctcaaggcgaggttattagaattgatgaataacaaaaaggcgtgctaaaatagcacgcctttttgtttttaatacaccccaaatattataaaagacccnccgatttgttcataaccaatttcttaagttatttt

SEQ ID NO: 1304 - DNA, 12318 bp, Bacillus thuringiensis
atcatgatgtctatatacatgagcgatattcataaaaaggattatttgaaaaaatgtaagagaaacaggtagaaccttctgtattgacctgtaaacgcccttcaagtaaactagagagagtttgcaaatgaaaaggtgataatgttgttaatttcaattaaagcgttacaagatgatcgttttttacgtccgctacaaaatattggcggcttattttttgaagatagtacgattggatttgaacaagaggaagcaaatcttatcgttgatatacacattgaggataatgtgaaagcatccgctcgattaacggatgttagcacaggaaatgtgtatgaagaaacattctcgaaagatttatctgctttcacagatgaaaaagagcgtatgaagcaagtgaagcatgttgtttcttatgtatatctttctgttcttcagcagttaactggtattgaacaaagctggggtattttaacgggagtacgtccgacgaaacttcttcataaaatgcttcaaaatggtatgtcaaaagaagaagcgcatcaagagcttcgtgaaagttatttaattcatgaagagaaaattgaacttcttcagcgcattgttgattgccaattagcagttgttccggatttataccgtttgaaagaagaagtaagtatttatatcggtattccgttctgcccaacgaaatgtgcatattgtacattcccggcttatgcgattaatggacgccaaggctctgttgattcgttcttgggtggtttacattatgaagttcgtgaaattggtaagtttttaaaagaaaaaggtgtaaaagttacgacgatttattacggcggcggtacacctacaagtattacagcagaagagatggatatgctgtatgaagaaatgtatgaagcgttcccagatgtgaaaaatgtgcgtgaagtaacagttgaggcaggtcgcccagatacgattacgccagcaaagctagaagttttaaataaatggaatattgaccgtattagtattaatccgcagtcataccatcaagagacactaaaagcaattggacgtcatcatactgtagaagaaacaattgagaaataccatttagctcgtgaaatgggaatgaacaatattaatatggacttaattattggtcttcctggtgaagggttagatatcttcaaacatacgttagatgaaacagaaaagttaatgccagaatcattaacagttcatacgttatcattcaaacgtgcttctgaaatgacgcaaaacaaacgtaaatataaagtagcaggtcgcgaagaaattacagcgatgatgcacgaagcagcagagtggacgcaaaagcataattacgtaccatattacctatatcgtcaaaagaatattttaggtaacttagagaacgttggttatgcaatgccgacgcaagaaagtatttacaacattgtcattatggaagaagtacaatcaattatcggacttggttgtggtgcatcaagtaaatttgttcatccgaagacaggagcaattacgcacttcgcaaatgccgaaagatccaaaatcatataacgatggctttgtgaaatatacagaagataaactgaaaattttagaagagctatttgcataagaagaaagaggttgttccgagtcggaacaacctcttttttatcctgcagtaacgggcggtccgattatatcttgtcagtttttgtcggtaagtcgatatattcgaaaaatcgctgatataattcgagttgcgctgatatattttgaaaatcgccgatatatttcaagttacggtcgatatatctggaaaatcgctgatataatttcatttaccgtctagtggtaccgtatgtaaaactatgtcgataataatcagaaaaattagtcaaatcattaaaggacaatgtctacttatggacgaaatgatagatttatgaaagagaaaagggggaaattgttggcatgtacatgacgatagggagaatttttgatttatcagttggtaagtatccgaataaagaggcgttagtggaacctgaaaagaatattcgctggacgtataaacagtgggatgaacaaataaataaaacagcgcacgctctattagaagacggagtaagaaagggagatacggtatctgtttacttatataattgccgtgaatttgtaaacgtttacttagcctgtgcgaaaatcggagcgatctttaacccgattaatttccgcttaaaggcgaaagaagtatcttatattcttcaggacgcatcctcgaaagtcgttgtctttgaaaaagcagttgagtcaactgttgctataattgaaagagattttccaaatacatctttttggtctatagaaaacgataaaccttcctatgcaagttcctaccatgaaaaagtgaatgcagcatcttctgagaaagtaaatatcgaaattgatgaaatggattattgttcaatgctttatacgagcggtacgacaggtcatccgaaaggcgtattacatcgtcatcgcgaaatgactgagcatagtatgatttgtacgtatttccttaaatataatagagatagtgtagggcttgtcgttgcgcctttatatcactgtggtgaattaaacgctggaatcataccacgcattcaagttggcggaaagaatgttattttgcatcattttgatacagaaacagtattacatacgattcaagaagaaaagattacgacgttctttgcagcgccgacaatgtggaatatgttgttgcaaaaagatttagctcagtatgatttaacttcgatgaagattggtatatacggcggagcagcaatggcaccggcgttagtaaaagaatgtaaagaacgtctttatattgatcttgttcaaatatacggaatgacagaaatggggccagttgttgcgtttctcgtagaggaggatcaaattacgaaagctggttcagcaggcacgccatgctttagccatgaagttcgtattgtgaaaccgaacgaggatgcaccggcagaaccagaggatgtattacctccttatgaagtgggagaaattattttgcgcggcccaactatgatggctggctatcataatcgtgaagaagcgaataaaaaatcgatgtataaaggatggtatcattcgggtgatctaggctattttgataaagacggttatttattcgttgctgatcgcgttgatgatatggtaattagcggtggcgtaaatatttatcctcgtgaaattgaagatttccttcatagtcatcctggtatattagatgtggcggtacttggtgagccagacgaattatggggagagcgtgttgtggcagttattgtgaagaaagatgaaacaataacagaagctgatttagaaacgtattgcaaagaaagtgatgaactagcagattataaacgtccgcgtcattatttatttgtagatgaactccctcgtaatgcgagcgggaagttgcagaaatttgtgctgagggagtcattgaaaggtgcgaaaaaataaaaaatgaaggataccccatatctatggggtacccttcatttttctatattaaacagaagaaacaatatctttgttaattctcatttcttcttgttgaaggttaattagcgcatttgaaataaggtggaaaaacaaaatggatgtaatgtccaaaaagaaaagacaccttaaggtgcctctctccgacttgaaccatttcatttcatacgaatctatccgtattaccattacccctttgttatgagtgtaaacacatactataaagcagaatcgtctatatacactagattgttagttcacaaaagacaagagatttgagatcaatattgaagtgacgccacatcccctataataattgatatgttacgccttttaaaagaatctgctttatagaacgtgcccacaagttatattttactacatgtaatattcatttagtgtattttttgatgaatatgtataattacataaactgtatgaaaaaaagagagtatactctgatgttgtgtaataaagataaagcccgcctacggaatagggggcttttcttactttttataaatatttattccaattatattatcagatgagtctaaacgaatataaacgtcatctgataaaaggtgtgcattatatattctttgtttatatgttgatatctcgaagcgttttccatttaattcacattctagaataatcatatcgccatgttctttccaatttattaatttagcagtcgtattcatataaacctcctctgaatcattttatgaaaattagtagagatagtgtgagaaaggagtttatataacaaaaaaagacaccttaagtgtcttctttgattactataaaagtcgttgaatgaaataggtttctatttttatttgcgtgaaaagccttcttcatcaaggtattccgcagcttctggataagagttgaatgtaccgtctaagtttacaccagcgtacacgttccacatgtcatcctctgaaataagagtaagaatatgaccatcttcgttctgccattcttcttctttcgcaggttctacaggtgctactacctcttcttgtgatagaaggtcaattgatttctcaattactgaacgtaactcctctgctgaaaactcacggatgttaaccatgcctttatcatctgttttataacctttaataccacttgcatatacaaatccatttccatttgggtgtaaatgaaatacaacgttctttttatctaaacgactttcttcaaagtggaagtttacacgttttaatgatacgttctttctttctagttctgggaaagattcaataatcgataatttttcttcaaaagttagcatagtgcctccaagtatatagtaaaagatttaatttgttcattatagcatagttgcaattgtttccaaagataaggggaaaacttttcgttgaatacgtttacgtcacgagaatgtaaaaagtgagctaacgaatgtatctttttaggtgtacaatggaacatggactttatacaaaggtggtttttttatgtttcaaaaaatagcaaaggaatgtttagcaggatttactgttgcgattgttgcgttaccacttgcgattgcatttggtattgccgcgacaggaacgtctgagggtgcgcttgttggattgtatggtgcgatttttgcaggtttattcgcagcgttatttggcgggacacctgggcaagtaacagggccaactggaccaattaccgttattgcaacaggagttattgcgacgcacgggttagaggcaagttttattgcctttatgatggcagggttatttcaaattttattcggtgtatgtaagctcggttcttacgttcgatatattccgtatcctgtcgtttcaggatttatgaatggtattgcattaatcattattttaggcgaaataaagcacgtacaaaatagttttttacttgttgtgttaacgattattgtaatgattgtttctggcaaatggattaaggcgattccgtctagtttagtagcactagtcggtgtgacagctttgcttcctttattttcttctctactcgaaggacttacagtaaagttaccgattatcggaaatctttcactaaataaagtaattgaaaagattggaaccattccagaagcgatacctacgcttcatattccatctttaagtggaacaggaatagcagcacttattttaccagcgcttagtattgctttattaggatcgattgactcgttgttaacatcggtcgtaatggataatgtgacaggtacacgtcataaaagtaataaagagctcgttggacaaggtatcggtaatatgatgagcggattgtttggcggattagcaggtgcaggtgcgactgtaaggtctatcgtgaatataagaagtggcggtaaaacggcactttcggcatgtatgcatagtgttatcttatttatttttattatgggtcttggttcggtcgtacaatatattccacttgctgtattatcaggtattttaattttaactggtattggaatgttcgattggggaagcatgaaaaagatgcatgtcgctcctaaaggtgatgtcgttgttatgctcgtaacgatgattgtaacggtgaagttcgatttaatgattgctgttgccttcggtattattctttcgttcatcatatatatggtgaaatgtaaagaacgtaaaacttctatcgtaaaagaaaaagaagaaacgtacacaattcaagggccgctctctttcctatcagtagatcgtattttctctactttacaagatgtgaagtcaccggttgttttacgtatgaaagatgtgcgttatatggatgtatcaggagctatggcattattaaattttgttgagcaatcaaataaagtaggagcaagtgtaaagcttgagcaagtacatccgagtattgaaaaaacaatcgcagtaatggcaagcgatgaacagaaagagcaattgaaaatcttaagtgtttagatagtaattagaatatctcacaattttacataaattataatgtagagttgtgggatgtttttataatgtttttagtaatatgtatcgcagtgacagagaggaagggctcttttggcgtaacagaaacgcttatagtgtgtacatatataatggaaggaattagaaaaatattgtgaagagacaggcttaaatgggttcgcttttctattttgaaaaaaaaaccaagtattcaacctataataaatttgttatgataaccaatgggataaaatgaatccctatcgcttaaaacaatatgtttgagagtatatgtataaaagaaaagagaaaaaatatgaataaaacatttgtaaaaggagcagcaattttaaccattacaacttttttgtcaaaattgcttggtagtttttttcaaattccattacaaaatattgcaggagatgaagtgctcggtatttttcgccttgtttttcctgtatatatgattgctcttacattatcggtagccggagttccacttgcaatttcgaaactaattgcagagttgaacgaaaaaaataagcaaaaggaaattgcgaaattatttaaatcagcgtcaattattgggatagcatttggcgttttcggctgtttagtcattgtattattttctattgaaattgcgaatatgctcggtggacaagaaactagaatgccgttgcttattacttcattagcattactcattgcgccatacatggcggtgtatagagggtattttcaaggtttcggtgatatgaaaccaacaggggtatcacaggtcattgagcaatttgtacgtgtgttttttatgttaataattgcttacatactagtatcatgggataagagtaatactgttattactagtggggcgatggttggctcttttcttggagtcattagttcgcttatatatttgcgtataaaatataatagaagtccatactacaataaaagcaattcctattcgctccgagatttaagagaaaacggcaaaaagatattgcgggtatcgatcccaatcgctatcggagctttatcaatgccacttttaaatttagtagactcgcttacaataccgcatgtattacaaggatcatcaacagaaattcaagaacaatttggaatatacagtcgcggttttgcattcacacaaataattgttatttttgcaagtgcaattgtatttccgttaataccactcttaacttccgcattggccaaaagagatataaatttggcgaaaataacaattcaaaatacaaatcgactagcgcatgttttgacagcaccgttaacaatatggttgatggcattaaccgtaccgttaaatgtcggattgttcacagacgtaaaaggcagtagtatgttaacagttatgattggcagttcgtattttactgcggttatggtattatcaataggtgttttacagggcattaaccgttctgcacaagctgcatggattgttattggtgcgagttgtgtgaaagtcatgctaaacatgatgttcgtgcagaagtttggcatagatggagcggcgtatagtacattaattacttacgtattgatttgtattgtaaatcatttgtatattcgaagctatattgcctattctattcatttaaaaagctttttcggtgtgctagcaatagcatgtattttgggactaggattgtatgaattatgtaatgtgatagatgttacaacttcaagaattatgacgttattattcagtggtatagcattaagtattacaaccattttgtatggtgtatgtgctttgaaattaaaatggatatcaataaacaaaataccatttttgaaaagataaatatagaaatttaattttttattataattcatatgaactgataaagaggaaactatgtagggtatcaagtgtttaggtaaggaatgggtactagtttatgttagatgaaataaacggttacctagttttggaggagatttagggtgcgtttagtcttatcaggatattatggtttttataatgttggagacgaggcgattctacaatcaattattgaatcgttaagtaaagagaacccggatatagaactagtagtactatcaaatgattctaaatatacaaaggaaatgtatggtgtagaatcggtagatcgctgggatataaaagctgtttatcatgcgataaaaaacagtgatggagttattagcggtggcgggagccttcttcaagatcagacaagtacgaagagtattctatattatacgggtattatgggactcgctcgattattaaaaaagccgtattatatttattcacaaggaataggtccaattacaaaaggatataatcgtctattagtaaaatggaacttgtcaaaagcttcctatgtatcagttcgagatgaggattcgtttttatatttaaaagaacttggcataaaaaacgatattgaaattgttccagaccctgttttaacatggaaacggacaaaacaatcggattggttgcaaaagcattcgatacatggaaaagtaattgcggttagtgtgcgttattggaatgcaaaagaagattatataaaaaaattagctgcggcattaaaaaaattaaagcaagaaggataccaaattctatttgttccaatgcatgagccatttgatcaaaaagcttcacgtgaagtagtagacttaatgggagaagagacgtatatgcttccatataaaatggatatcgacgagaaaatattcattttatcacaatgttcattactaattggtatgcgtcttcatgcactagttttttctgctgtagccaaaactccaatggtcgggatttcatacgatccgaaaattgattcgtttttaagtcaagtgaatcagccagttataggaagtgtggatggcgaatggagtgctgagtatttatatgaaattgcgaaaaagcaattaatgcaacaaggaactgtgcagcaagagttacaattgacaatagatgagcttcggttgcaaggcaaacaggcaacaaagaaactcattgatcatatggaaaaaggcactttattaaaaaagtaaagtgtcttttgttttgttttgaatttaatgaaaattctaattaaaaaacgttttattttaattcctatttattatgctaaaatgattgtgattattatataatcaaatttgtgataataaattcgtagattacgaggaggataaccttgaagactttttcaaaaggtataacagcagtggcattaacgggatcattacttttaactcctatttcaagttatgcggcaaatgatgatattacaggacatatgtttgagacgaatatgcgctcacttattactaaaggagttttaatggggtatggagacaatgtatatgcgcctgataaattagtaacaagagcagagtttgctacattcatagcaagggctttaaatttaccgaaagctgattcgaatttcgaggatgtgccgaagacttacggtttatatgatggtgtaagtagagcatatggagcgaaaattattaatggtcgtacgaacgagacattctcaccaaatgatgtgattacacgtgaagaaatgtcgataatggtaaagcgagcgttagactataaaaatattaaagtagctgtaagtccgcttacctttactgataaagatagtattaactataaagagcatgtacaagttatggtggctactcaaattattaaagggtatccagaagataatacatttagaccacatttatcagctacaagagggatggcttcagctatgttggatcgcatgcttcagacgattgaaaaaaacggaaatagcaatcctgtagaaactaagaaatatgttgtgacaaatgtaagagaaaacggaacagagcaagaagtagagcgctataatacgtataaagaagcggttacggctgctcaaaataaaggtatgaatgcggtaaaatacgagaacgaatttttatggattaaagatggttttgcaagtgcgaaaagaataactgggcaaaacatcattaatatttatgatgagaatttatcaacagtatatacgtatattcagtatggaacagaattgaaagtattagaagttggcgaagatcgtgtgaaagttcaactttctggtttgacaggttatgtgaagaagaatgaaatcactttaattcctacaaatgaaatgaaacagtcgtcttattatgtgaaatcagatggatatttataccataaatattatacatataatacaagttcacctggatatacagaatttagatatggtgtggcaccttctttcatgaagcaaggacagcaaatgtatagtgtagatggaaagacatttggagacgaaactttctatcaatatttcaattatttatcattacgttcgaaaacagattatacagctgaacaactagatagttatgtgaaatcgattaaaccagactctccattaattggtttaggaaagaaatttaaagaagtagaaagcaagtataatgtaaatgcattattcttatattcattagcaattcatgaaagttattatggaacaagcgctcttgcaaaagacaaaaataatttatttggtttaaaagcaacagacgatagtccgtatggtaacggagaagcattcaattcaaaagaagattgtattgaacatgcagcaaaattatacatgaatgaaggatatttaaatccaggacattggcgttatacagcaacatatacaggtgataaagctgctggtttaaatgcgaaatatgcatctgatgcgaactgggggaaaaaagtagcggggcatatgaaccgttttgattcttatttaggtaaaaaagaatacaacaagtacaaacttgcacgtgtgatgaataacgtggaagtgaaaaagaatcctagtatatcaaatgagcgactgtatcgtttaaatacaaatgtagttgtcacagttactggtgaagagataataaatggaaaagcgtgggttaaagttatttcagataatcctactgtaacagaagcgtatattgcaaaagaaagcttagaatacgtaaaacattaattaaataaaaaagaaggtgctactaatatttcgtagcaccttctttttattcaatttcaaaatcaacaatgatataagcgagtataacaacgaagaaaatactaacggctggtgctgttaatacgtggccagacataaagccaatgccaagtgatagaacgagtgtgctcgctaatagcatatactttactttcatgattttcttaaagtttgtgatcatgcggataaataatttaataccaaagtatagaagaggtattaagtaaataaggaaaccgacaattccaaaggcgaaaaataggtcatggaagtccatttcaattaatttaattttatctgtgtagttaccagcgtaacccattccgaatagtttttgtgaaagcggtgcgtctttatagtattgtttgtatgtttttaagaatttgtcgcgatcactgtaaattaaactttttacttcagaatctgtaagttcaccttttgcatgtttttttgcatcttctggatctgctttaattacttttccttcttttcgatctttctcttcttgtactgattttttgtattcgtatatttgcatgtgaatgcccttatggtttagcgataggagtatgcggtgtaagagctatttatccttgtagcctaactgcgacatcaacggtattcacaacctgtgtgagtccttttccttc

SEQ ID NO: 1305 - DNA, 12176 bp, Bacillus thuringiensis
gatatgaaataatcccaggtgggaacctggttgcgatacttaatgtaagaggcatgcataagattactaaaaatgctgggaatgcttcatcagatgtgtcccaatcgatgtggcgaactgaacccatcataagactaccaacgataattaatgatggagcagtaatagctgatacaccagagacagcacttactaatggtccgaagaatgctgctagtgcgaatagaacagctactgtaacagttgttaaaccagtacgaccaccagctgcaacaccagcagatgattcaatgtaagctgttgatggtgtcgttccgaacatagaaccaatagttgctgagaatgagtcagatagaagagctcgtccagcttttgggagttttccgtctttcataaatccaccttgttgagctaccccaagtaatgtacctgttgtatcaaataatgtaacaaggaagaatgaaaatacaacgccgtataatccgtagttaattacgtcagatacagcagtaattggatttgaaacgataattccttctggtaatccaggcattgatgtaacaccgtttgagaatgttaattgtcctgtgaagaaagcgataataccagttaatagcataccgataaatagtgcgccatttacatttaaagacataaggataatagtaattccaagtccagctaatgctagtagaactggagcagagtgaagatcaccaagtccaactaagtttgcatcattttttgtaacgataccagttaatcgtaaaccgataaaggcgataaataacccgataccagcagtaattgcatgttttaagttttcaggaattgcttccattaattttgtacggaaagatgtaaatgatagcaaaattaaaatcatacctgctacgaatacagcagagaatgcaattgcgaaagtcatgccttcatgcgcttttacaacagagtaagagaagtaagcatttaatcccatacctggcgcgattgcgattggtaagtttgtaaagattgccataaataatgttccgacaacagcagcaataattgttgctgtaaatgcttgttcaaatggaacacctgcatctccaaggataacagggtttacgacaatgatatatgccattgttaagaaggtaataatacctgccataatttcagttttaatagaagttttatgttttgaaaggttaaacatataaacatcctttctgtttacgaataattttcacaacagttatatataatattcgttttttatctattttgcaatagttttgcataaaaagtttataacaattcatattttgtgtcttaaattcgaatattaatcgtaaaccgatgtgtgaatttcagctttttattgtgcacatgctaaggaaaaggagttgaaagcagctatgccacagcaaaaaaactttataacaatgcctgcgcaacatcaaaataagcagcctggtattgaatcattaatgaatcctctaccacagtttgaagatcccaattataaaggtagcgaaaagttaaaaggaaagaatgtattaattacagggggagatagcggaattggacgagcagtttccatcgcttttgcaaaagaaggagcaaatgttgcgattgcttatttagatgaggaagaagatgctaatgagacgaagcaatatgttgagaaagaaggtgtaaagtgtgtattgttgccgggtgatttaagtgatgaacagcattgtaaagatgttgttcaagagaccgtccagcagctaggtagtttacaggttttggtaaataatgtcgcgcagcaatatccgcagcaaggactagagtatattacagcagaacagctagaaaagacttttcgtattaatattttttcttattttcacgttgcgaaagcagccctttctcatttgaagaaaggggatgtcattataaatacggcatctatcgttgcatatgaaggaaatgaaacgttaattgattattccgcgacgaaaggagcaatcgtagcttttacaagatcactttctcaatcgttagtgcaaaaagggattcgggtaaatggtgttgcaccaggaccgatttggacaccgcttattccatcgagctttgatgagaagaaagtctctcagtttgggagcaatgtcccaatgcaaaggcctggtcaaccatatgagttagcgccggcatacgtatatttagcgtctggtgattcttcttatgttactggacaaatgatacatgtaaatgggggcgttattgtaaatggatagttttcatttataagagcaaagtaatgttaattccacttattatagtgagcgctaggggggatatagctgaaaaagttatgtttcgtcatactattatttttcatcctaccggttagtgcttttgctaatacagatcatttaatattagtgaatcttacgacaaatcagttgtctttttttgagaatggaaattatacaaaaacatttccagtaacgactggaagagatcgtacacctacgcctgaaggtaacttttgtattataactaaatttaaaaataaagaataccatcgaaaaaaaatacctgggggtgcaccgaataatcctctcggtacgaggtggcttggactagataagaatgaatatgcgattcacgggacaaatcgggaatggacgattggaagtagggaatcaaatggttgtattcgcatgcatgacagggatatacaatggttgtatgacagagtacaattacaaacaaaagtaatcatttctcgttttcatacgagccccgaatatgaagcgaataagcttggttatcgcgttgtgagctggaatagtcggaaaatagaagaagaacaaattggagtacttacgttagtagaccgcgcggatatatattggcaagaaccaaatggacagttaacgaaagtgaaaacggtattgccaaatgaaagatatccagtgtactcaaaacgaaaagatggaatatattatataggaaacaattcgtatattatagatgaaacaggagagaaaattcgttacgagcaaattccttcttcgattttaagtaatatatataaacggaaatacaatgttccgtaatggctaccgttttatagacggtagcttatttatacttggagtttaactgcaactattatattttgctgaatataatacagtacagatagggggcggttatattatgaaaagtgaatttgcgtttaaagtttttttagtaacgacctgtttatttatcgtgtatttatatgcgtttctcgtcttttctttttatgttccatatgttgatttaatattgttcttcggatttatttgggcgtttgtgaaagcgagggaaggagagaagagtatatatcggcgcattaccttatgcgggacggccgttctcgttattttgtacttttttattatgcatgatttttggaggggaatgtaaaaagcatacgattaatcgcatgctttttttgtttaatatttaggcttaaatgtatgacaacaagtttctacactcgttgctacagaactttctagcgtctcgtttgttaaaacagcagctgtatatgaatcattttcagtttgaccagtttcatctgcatcaggctgaacgatgatcgcacttgcttgacaaaagttaccttgtccccaaaaagaacagttggaaacagaacatcttacttctggcataaaaccccctccttatacattagtgtgggattttacacccatttcatgtgtagaaggagtttccttttctagttactttttcgtttgctcaagccattcttttaatttatctttcggctgttcaccgctaatacggctcacttctttgccatctttaaaatgaatgattgttggtgttccttgaattttatattcatcccaaggagcatctaatttttcaatatccataactttcatatcaacgtttaagtctttagccattggcacgaggacaggagataatttttggcaatgaacgcaagatgtttgataaaagtatactgtttcttcttttttctcttttaagttcttttgaagatctgaaagagagattttatttgtgtagtagtcaggaccgtttgtcttactttcagtaggattatcaatcttttggctagtagcatttttttcttccatttgtgtgacagcgaaaattgctacgaacaaggcgataataataccaccaaatataagcatttttttcattctttcatctccttatttgtttttgatgacaataaagctacaaacagcgattgtaataaagccgataagtgctaaaaacgggattgtaataaaaccaaaccagtttataaattctccggtgcagggtacacgaccgcaagctgctccagcagctgaaaacgctgggactttttgaattgcatagtgatataaagaaatacaagcaccaatacttgcaattggtaaagaataacttgcgatgcgataatctttttttgctacagcgataccgagccataaaacgaatggatacataaaaatacgttgataccaacaaagtacacaaggctcaaatttcatgatttcggaaaaataaagacttcccagtgtagcgataaaagaagctccccatgcggtaagtaaagcatattcttgctttttttctcgtcccatattttatacctctcttataatagttacatactaaattatagtatgaagtggtatggaaaagaaagaaaaaatatgtttatcaataaaagttttatgaggagaaacttttattgatataaaaatttaaaaaaagcgccattctccggaagagaatagcgctatagtttacatttgaatttgttctacttcttctacatgcgacttttgggatgcgtggtcaatatattgaaataggagctgcaattgtttatcaacttctggcagttccttgctgtattgataagcgtgtaaaaaatgctcaatacgcttagaaaataattgatcgttcgtttgaaccatgagaacgagtaatttatcccaattacagcaatacgtgtaatagagagctttatcatagtcgttatatgtttgcactgtgtaccctccttaccgagagttatatatagtgtgtgataagtaaggagaaatacacttgaaagaatttgttaagaaaaaatgagaatgaaaagaaaaaacgaggaattccctcgttttttaagcttttggcattggcgtaggtgttggtttgccatagccttctttgtatttattatcgatatagttacgaatttcaagcgttgattttcctttttgtttcatggaagcagattcaactgcaatttctaggcaattgacgcaagtcgttgcatgggagtcccaaacaacttcaccattctttttaatttcacgaataaagcagtttttattatttttatgtcctacactttcaccacaaccacaatagcatggaatccaatctaatagctctgcattttgtccagcgacggtgtagatatctttcatttgtggatcaagcttatctaggaaggttggaagtgtgtcgactccttttgttttctcttgaatgtcagcttgctgagtgtgcgatgcgtggtcatgttcttcttgttttgattcagaagatttttggtcatttgtaccagtacttccgcatccagcaagaattaagcttagtactgcaagtaaagaaaatacatactttttcattcgcttgtcccctttacaaatgtattaatcaaattgtatcagagattacggtgtatcggttgaagatttttttgactgatttttgaagcgccatcttagcgaatggaatagaaataaaattgggatataagcgtatacaatatataaacccgcttgagatagtacggtatttaatgtgttgatactttcacggtttgtgaaaagtagagaagctgaaaatatgatgaaaataaaaaacggtaatgtaaatttaaatgaaatatgaaaggaacgcttcatcgtttgacatgatgaccaaatggttaagcaaaggtttggtaaaataattaaaaaccaaacgaaaataataatatattcaaagcgctgaataaaaggaactttaattatttttaacatcgttaaagtaggccaaatagtacggtttaattgtccctcgctgtaatacataaaagatacgatagctaaaactacataaattaaggtgctaaaagcaattccagcatgggcccatctttttaaagattttcctttttcaataaagggataaaagataagaattgtttcaaaccctagaaattccaatgcagagtgttttgcagatataagcatgtcaaaaggtgaatgtgtaaaaataggtaaaatattacgaaaatgtgcatacttcatcggatagactaaaaagaatacaacgaacataggaagaacaataccccaaaaacatatccctgtcacagaacggaagccaccttttataatgtagtaagtgactaataaaaacataagcgtaagtttccataacttaatggtagggaaaatccaaacttgtatcacttccatatatgtacgaagaacagtaaggcaaaataataagcaataaagagtgaaaattacagaaaatatagagccaacccattttccaaaggttgttgtatgaatactaattaaatctccgtctttttcaagcatttttaacatacaaaacagtacaatatgagttgcaatacctgcaataataagagaaatccaagcatcataacctgcatttttcaaaattacacgttgatatccgagaattcctataccaatctggagagaatgcaataaaataaatgcaaaatatggagatactgtctttgttttattcattgtattcattgcttatttcacctcactattctccgattccagattgtacaatattaagatctaaatttatatctaccgctacatttttatacatatttcgaatttgttttatattccattttctcgtatggcttctaatttcatctcgtattcctaacggatcaatttccttttcttgaaattgttttattaaatcttcacagtctttttcgacatttcgttcaatttgtttttttatatagttgatatttgtttcttttcttaaatcaatccaattaggagagtttttaattaatccatttaattttaaatggatttttacttttggtatgtcgccagtttgatctatatcatatttgtttttcccagctaagttttgtatcacaaccatacctttatgtttatccttttttattgctgcttcgtaacgtccatttttcgtaggattaataagtaattttgctaaaacagaatgtcttttatccgtatacatgacgactttatcgccttttaaaaaggcaagtcctttgacagcgacagaatgattatcgtccattttaatataaggaacataggcatcacatacagaagagtaataattatataaaaaaatgtttaattcagtttgtggaatgttctcatttcttatattttgctcgagtaaatcagcaatatataaagacccattttttttcccgtaatttaaaagctcttcagccgatccatctacaattgctagttgtacatcacgcccgatatttgggtcacgttgtaagttagtaataatctctcccattccgcgttcccctagagcctttccaaataggacgacacgcatttgacctacaacaacattgtgaggagatttcgcatttaatcgtgaagcaattgtttcaagtgaacgggcagatgttgtttgcgtctctggtttagactttacaccatgtgtgtactctgggaatagaatagttccttggaattttttgttttttgtgatgtcaaatccagcaatatgaataatacgctgtgcatccactatatacgtttgtgtacagccagtttgtaaaacgaagaagataatgataaggtgcaataaaatttttttcattcattctcaccatcacgtttttgcttcgatttgtttggattgtagcgccattttgattttggtctaagaaaagaaggtctttgtgccgtttgactaaatggtaatcgaagaaaaccttctgctgtacctaaaccacgaaatggatataaaggtaacaaataaggtgatccaagcgattttaatttaattaaatgagctaaaataaatacaaatccgacagcgaggcctaatcctccgaatgcaccggctaagagaataagcggaaagcgtaacaaccggatagtagaagacatctttacagtcggtgttgtgaaagatgcaagggcggataaagcaactgcaattaataaaattgtacttgttaaagctgcttcaacagatgcttggccaattacaatccccccaacaatcccgatcgtttgtccgacttttgttggtaaacgcgcccctgcttcacgaagcaattcgattgtaatttctaaaaagagtgcttctagaataggaggaaaaggtacgttagctctcgagaaaataataggacctagtagatcggcagggatcatttgataatgatatgttaaagccgctgtataaatagcggaggaaaaaagagaaaatatagctccgaaaaaacgaataatacgaaagaacgatccaatcatccacggtaaataataatcttctggtgaaatgaaaaaatccagtaacgttgttggtcctgataaagcatatggagagccatctgttaaaattaaaacttccccgttaattaatgcaaatacagctcgatctaatcgttctgtaggtaatagaacaggaaaaggtgaattgctattatcactaataaattgctcaatcatagttgaatcaaatgggacatcaaagtcaatgtcttctagccgttgaattgcggtgttgacaaattgttcatttgtaattccttctatataagcaactgctacttttgtttttgatatagatccgacggtaacttctttaaaaatgagttgctccgttacgatatttcggcgtaataagtggatatttgtatcaaggttttcaacgaaaccgattttaggcccgattacgctatactcattttctgtatcgttatataatcgttttcctaaaacagtactttcggcacgaattaaagcatattgatcaggattcgaatcgttttttaagcgtattaaaatatatccacctaataatttttcacgaatatcatcaatagaaggggaggtaataatgtcttcaatagagataatattacataaatcagagatgttttggatttgttccgattccttttttataggagttaaaatgaattgtttaataataagtgcttccacgacagatttataataaaacaagcacaacgtttcatctttaagtatgttataagagacaaaatcgcttgattctttcatggtttgtataaattctgggatagaacaaagtgtttttgtattagtcttttttgatttcttagatgataaaccgaacattttctcacccctaacttacatcatttacttgtgttagtttttgggaaagacgggaatttatacttaaaaattgaaagttcataaagaaaaggaagagtagtgtaatctgtaccctttgtaaaggacattttgaaaaaagttaggcaacatcaagaagatggtttctgtatccaacaggagtcatcttttttaaattccattgatatctataatgattataatacgtcatatatttcttaatctcttgtttcaattcattaaaggacacgcaaggttttatatgagcttcatctttcagatgaccaaaaaatgattcttgtggggcgttatcccaacagtttcctcttcttgacatggattgtcctaggtttagctttttaactagcttttgataggtagggcttgtgtagtgggatccttgatctgaatgaatataagcaccttcagtcaatcgaatccgcggattcctttttagtttatggagagttgtcgttacgagctctaatgtcatctgttctgaaacatggtaagctaaaatttcattagttgagccgtctaaaattgtagataaataggccctttgattcttaccgtaaactaaataggtgatatctgtaagaagtgttttccctggggtattttgtttaaattcccgatttaattgatttggtactattcgatgttcttttgtagctttaagcattcttttataaggattcgctttgcgaaccggacagataatctcgtatttcttcataattctacggatacgctttaaattgtagacaacttgaaactgacccgccaatgtcatctttatctgacgagcccctttgtttctatttctaaatcgaagtgcttttaatatggtttccttcaagatttcatctcgatcactcttttgtttccgttgttcttgagatgaaactgaaaagtaattatagtatcccgaacgggatacaccagctactttacacaaatgactgaccatattccttaagttgtatttcatgatgacagaacgaatcaagatgaatttctgactaggtggtagtgttatttccttctcatcctcccttccataagtttgattttttttagcaattcgttttccgcctttagtaagtttcgttcggcttctaaacgggcatacttttcttctaacgtaagctctctctcaagagttcttccagcgttttcgatacgtgtatcccttaaacccaatacaccattttttctataagcagcacgccatctacttcccgatgacataactcgtttcattccaatcatatctatatcaaaaccacattcttcaaaaatatttcgaggtagctttcctttttcattttcctcaataaaaatatgcttaaattcctctgtataagtgatacctttctgacttacagattttacgtataggttatttgatagaatttgaatttctctttctgtaaatagtttttttgtcattttcaacattctccgatcccaattttccttttattatacaagaaataccctatagaatagacttttttcaagtgtctattctatagggtacattttaattggcttgggtgtctttttttataaaaattatttaccatacaaatagcccaacgagcatagcacttaataaagaaacagccatcccgctaacaagaagcttccaaacatttttaccgatgactgatgatttttctccgccaaataatgaattgtaagttccgtaaatcatacctactgtactaaagttagcaaaagaagctagaaatgtcgttgcaaccgcaaccgtatgcggttgtaacgactttaagtttgattttaaatccatcattgcaacaaattcattcgtcgttattttgatccccattaattcagctacatacatagcatcactgcctgataaaccgagtaaaaatgcaaaaggactaaagataatggagaagattttttgaattgttaaccccgttacaaaaaatcctaaaatcccatttaaacatgctgttaaagctacataaccaattaccatagctaaaataacgataaccatattcatcccaactaacatactgtttgaaatagtagaaaagaaatcctttttttcatgttttgaaggtgtgtaaacaacgtcttcttctttcgaaacttccacaggatttaatacattggctaaaattaatgcgttaatacaatttaatggaatggcactgaaaatatatgttgctggcaccattgataaataagcgccaagaatggatccgctaacgctactcatactcataattccaaaagttaataatcgattttcttttaacacagataattgatcacgaacaaccgcaagtgcttcggtgtttcctaaaaacatcatttgaatcgaaaagatactttctaactttggtaaacgagaaatctttgaaatatctgcaccgactttatcaataatacaagttgagattccgaaataagatagaatgtcggaaaaagtaataacaataatgatagttagtaacgcactagagaataaatcaatgtagtgacgttccagaggtgaaggaaatgctagtcggatgcctgcatgcggtcatggtagtagcagtgtgaaaaagtccttttcttaattcgttaaaatactcccgagcgttgggtctttcatctcacaagaacatcgatctaattcgtggcaagcttctgagc

SEQ ID NO: 1306 - DNA, 12365 bp, Bacillus thuringiensis
tcgtgatgaaaaaataacatatatttgttatgtttcatatcatttccgaaattaaaccgaaaatcaactaaaagttcagaagattatatatatgatgcaataaaacctaacatgaattattttgtgaggattaaaatcgacatatgcgcttcattcagaaaattggtataatattcttacaattaaagaacttgggggatgcgtgtgggaaaaatacggactaggaaactattcatttgtttttgcttagctgttgttttgtttgtaccaatacatacttttgcagacgaaaaaagagagtggcgagatgaagttatatactccattatgattgatcgcttcaataatggagaaccgaaaaatgacaagcagttagaagttggtaatttagaagggtatcaaggcggggatataagaggaattataaaaaggttggattacataaaagaaatgggttttactaccgttatgctttcgccgctttttgaaagtggaaagtacgatggattagacgtgcaaaattttaaaaaggtaaatgaacatttcgggacagacaatgatgtgaaagaacttgtaaaagaagctcatgcaaaaggaatgaaagttgtatttcaatttccacttggagaaaacgaacgacaggtaattgacgcaatgaaatggtggataaaagaagttgatttagacggaagctatgttatacatagtgaaaaaaagccgcgttccttttgggataacgcgcaaaaagatatgcaagtgataaagaaagattttcgtattatgacaaaggaggatggtgaatacaacgaaaaaatagtagaatcgttttctaaagcagatgtatcggtgaaatcgttatacgatgtgagtaaaaaagaaggagaatttgttacgtttttagatgatcaagaaacaaaaagatatgcgcgtattgcaaaagaaaatatgtattatccgccatcacgtttaaaactggcgcttacttatttgttaacatcacctggaattccgaatttttattacggaactgaaattgcattagatggaggaagtgtacccgataatagacgattaatggattttaagtcagacgaaaaatttatgcagcacataacaaaactaggtgaacttaggcaggcgagaccgtctttacgacgcggtacgtttgagcttctgtatgataagagcgggatgagcatactaaaacgaaaatataaagatgaagtaactttagtagcaattaataatacgaaagaaacacaaaaagtctccttacctgcaagtgcaattggtgaaaaacaagagttaagaggattgttgcaggatgaaattataagagagggaaacggaaaattttatctcgttttaaagcgtgaagaatcaaacgtgtataaagttaacggagaaacaggtgtgaattggttatttatctccttaatcgttggtgtgaatgtattatttattgcgtttttaattgcagttaaaaggaaacgtagatgagaagttgctggctctatgttcatgtcttcttattgtatatgtaagtttgttcggtggcgcgatagtatttattctgttgatatgaaatttcttaagagaaacgatgtgagaatgaaaacgtccctagtgagaggagggccaggttaggaaggggatgttcttcctaacctgttttttgtgttagcaccgatagggaagaatctttgaagcaatcaataattgtaactatattgattttacattacattaaaagttagagaatactcttatactaatacagtgctaaatagtaggtggaaaatggaattttacgatttgggtattaccattaaagagcttagaattaaaaaaatatatcacaatccgaattatgtcatggaatatgttcacaaagtcaaattagctattaatctaaatactttatacttattaggtgaactttactatttaaagggatggaatttattgagatttaaacaacagaatgaagaagatattgcaaataacatgaaaaaagcattatttatatttgaactaacagaaaaagaaaatctgataaaaatggttaaagaaaaatattttgaaaaccaaaatgaaaaaagccactcataattcatttggggattacttgaaatataatagaacctacagggaaaatccctgtaggttctaaacttataaactttcttctaaaatattagtgtttaatataaatttttgaataagagtttacttagtgtactttttattttgaagtctgcatctttattaaccatttatgcttctttttaactccatccaaatataattaaaattaagatggttcaagtcggaggaaggcgctttgaggtgtctttttttatgacttttatcattaactatttaatgttttttaaatgattacatgacatagtttttttgtaccaagctttgttgatacagttagacttatccgttagtgaattcgcattattagaacatcctacagtatttagggagaatgtggccaataaaaaccatagtattaatttcttcatataaccacttctaactcttttttaattaacattttttaagttccttattaattttacaatacattaaaggttgggaaatattcttatactcataaattgttacgttttggcggggggaggaattatgagttacagcgatttttaagatgactttggtctagggtgtagttactaagaaaagtaattcaaatcgaagggggaaacgtcttgaggtgtctttttcttattttcaataaggtctgctaaatacatgtataaaacaaattctacaataaggcctagtttaatcatacggtcacttgtaaagtgtgcgtatggttagaccctgttcacttagcgattttcaccgcatatacctttttctatagtttgttctcgtaatattgtctctacaagacaaaaaagaaaactcctctaattaagaggagttttctttttagcggtagttaatgaactgtacgtcgattggtaaatcagcgctacgaacagctgcgattactgcttgtaagtcatcacggctttttgctgtaacgcgtacttgatcatcttgtacttgtgtttttacttttaatttcatttctttaatgatgttgttaatttttttcgcgttatctttatcgataccttgttgaagtgttgcgcgttggcgaacagtgttgccagttgcagcttcaacttttccgtaatctaagttcttaattggaacgttacgttttacaagtttagagataagaacgtcttttacttgctctaatttaaactcgtcatcagaagttaaaacaagtacttctttttctaatttaatatcacttttacttcctttaaagtcatatcggttctggatttcttttaatgcgatattaattgcgtttgttacttcaggtaattctactttcgaaacgatgtcaaaagaactatcttttgccatagttagcacctccaaataaatttctaatctttttatgtactgtacatactaaagtatagctgaaaacgagtctagacttaagtgttttcgtacttatattcatgtaacctcattttattatagtgaattttgggcagttggacaaatataggaaaaatcatgttataattaacttttgtttggaatgataaaaaagataattttatatatatagaagggaattaaaaaatatgtatttgcaaataggatcgattgaacaggtaactgttttacgcgaaacggaaatcggatatatggttgggaatgaagaagaagaaattttcctacataaaaacgaagtggctggagaaattgaagaaggcgatacgattgatgtattcttataccttgatcaccaaaatcgtatttcagcaacaatgaaggaaccaattattacaacttatgattggaactgggtaaaggttgtagaagttattcctagtttaggtgtgtttgttgatattggtgtgtcaaaagatatactaattccagctgatgagttcccgatttatatgccggtatggccagaagtaggcgacgaattatattgtacgttaaaattaacgaatcgtgatcgtttaattgctcttccggcaagagacagtgatatgcaagaaattatcgtagatgcaacgccatctatgcgtaataaaaacgtaaacggacgtgtatatcgttcacttcaagttggttcattcatactaacggatgagcatttccgtgctttcctacaccatacagaaagaaaagaacaagtccgcatcggtcagcgtgtaacgggccgtattattgacgtaaaagatgacggtacaattaacatttcacttcttcctcgtaaagaagaaggaatggaagatgatgctgcagtaatttatgcatatatggaagaacgaggcggagcaatgccgttttgggataagagccatccagaagatattaaagaacgctttaacatgagtaaagctgcatttaagcgcgcacttggtaagttgatgaaagaagaaaaggtttaccaagaagaaggttggacgtactttaagaaataaggtggatgaaaaaagaactattctttctctgaatttttaagagaagggatagttctttttatttttaataatgtattcgctctataaggtagatattgtgaaagaagtaggcaggatggaaactaaagttatagaagaggtatgttataaagttttaaaaatatatggttaattattatgtagttttttaagtgagattttgattgtagtatttcttatgtgattcattaaaaaggctaaaagaatataagagatttatcgcagtgtttgtactgcctatcctgctatttgccgggcagtaagatcatcactgattaaagtttcattttatgtataaaattgtgatagcttttacactgtgttttgaatttttacaacgctgacagtattaaaaatataaaataattaggatgattatatgcatatttggatactaacaaattggcggaaatattataatctagaagagaagagtcatcgcatgggactacgagtaaaattcgataaagatgttgatcctgaagtgagaagagctattaaagagttttgtaaatggatacgccgagaatatttttttccaattagagtacctatttatgtaaaatcttcatataaaataaaggcgatggatggtgagttggtctatggtactttctttgaaccatttgatcgaaatgatgagccgtatattcgtatttcgacaggagattattacgatgagctagagaaaagagggaaagatgacgctttgggaggatatttgtttactattgcgcatgaactaacacattattttcaatggattaatgatataagactaacgagaattggatatgagaggcaggctactgcttattcaggatatattattgatgagtataaagaaactagagagcatccgtgaaatagaaactttatggataattggaagtatgataattagcaatgggcttgaatgaatgccctaatatttaggggctatccgggattagatatctgagttattaaacaaaaataagtgtgggtaatacgctttgacgaaaaggtgtgtatatgaaattttataacgcagtatatcttataatttcttatgatgatgagatattgaaagagaggtacgaaaatgcaagataatgtactggaacaattgataaagagtctctcggtattatcccttgaaaaagaacacgaaatagcagcagttgatttacatgatatatatgagagcactgaaagattcgaacaattacttgaaaatattatgaactcacaacagtctaaagaagaattaatagatgcgctaattgaagtggagatagaattagatcacatcaattggcattacaaaagcttgaagaaaaagttggaaatattgatgaaagattaaaaagcacaaccttatttaaaaaaataaggttgtgcttttttaatttccttgcggagaaacaagagtaaatgtatctttcaaatcactatcatttattttaatatttgccttttttaattcctcttgtaacaattttttgctgaatacaggatcagcagtacgttcttcctctaagtttttgcgaatagagttttttacctcatcgtaaggttttaaatcttttttatcagttaatttaataacgtgataaccgtttgatgattttacgggattgctaatttgtccaacatttagtttgtaggcagccctttcgaattcaggagccattgtacctgaattgaagtatccaaggtctccgcctttatcttttgatagtagatcttgtgattcttgttttgctaattcttcaaatgaagcaccagcatctagtttactctttatttctttcgcttcattttcgtcacttactaaaatgtgactcgctttaatttctggcttatagtggtcttttacgtctttctctgtaatgcttttcttaatcgcttcattcatagcaagtttgaacttaatttgatttttgaaatcctcttcatcttttaaaccattattttctaatacttttttgaattgatctccatattgtttttttactttttctacttctttatttacctcttcatcagatactttatatttttttgtgatgacgtcttgtgccatcatttcgtatagcatgtcttttccgtaacgatctttcaattgtttttcgaagttatcctttgtaatggtcgagtctgttgctgtagcgactgtagctgagccgtttttttgtccgcaagcagataacatcaatatacttattagtgcagtaataatgaaaatatgtttccctctcatgccaacacctcatccgaatatgttatcgctattgtagaatatagaagtgaacatgaagtgaatttttaatgtttttttcctttaaaatgtaaaaaagtacatcaacataattgttgatgtacgatggaatcaaaggtgatcggtctttttagagtatgcacgtttaccttgctgaatatttttttgctcttgctcatttttttgctcttgctcatttttttgtgtgcgttttgcgttattatcgcgtgcttttttgtcgttatcactcgtatgtggcatatgtatcaactccatttctaaacgttgtacgtttatcatttcctttttcgtaaagactatgtatagcggtgcatttatgaagggtaaaggtggattcgaaatggatttgaagttgaattatactgaacttataaagaagttaatcgttgtaatcatcgcaggtttattaaacgcgattgggatgaatttatttttaacgccagcaaaagtgtatgcgagcggctttgctggattgtctcaattattatcacaaatattaggtgattttttatcgattcacatatctacgggagtattgtttagcttatttaatattcctgtcgttattttagcgtggaaaaaggttggaaaggccttcaccttttttagttttctttgtgttatatttatgactctgtttctagaaatcatccctgttagagcggtttcgaatgatatcatattaaatgcgatttttggcgggattatttcggcaattggagtagggattgctttaaagtggggtgcttctacaggtggattagatattatcgccatgattttatcaaaaataaaagataagcctgtcggtacatactttttcttttttaatgcaattatcattatcgctgctggctatgtatatggatgggaaaaagcgttgtatacgctagtgactttatatgtatcaacgagaattattgatgcaattcatactcgtcatgtaaagattacagcattaattgttacgaagaatggggcagacgtaagaaaggcgattcactcgcgattagtaagagggattacaacgataccagcaacaggtgcttatacgaatgaaaataaagaaatgttaatgatggttattacccgttacgagttatacgaattagagaggattattagacaagtggacccaggtgcatttacaaatatactgcaaacagttggggtgttcggattgtttcggaaagattaaagaggaccaaagttggtcctcttttttaatgtaaattcgtaatgttttgcaattgctcttgcatttcacggagctgaactttttcagcagttgaagagtttgcgtaagcggattgcaaagcattttttgctctatacacgagatcttgttgctcagtaccgcttgaacaagatacggcattttcaacagcatctctagcttgttggaatagtaagttccccatttaaacccctccaaaagaagagttacttcttgctttttctgcctcagctaatgtacctctgtacgggaatcttgcatcatgcttcataacagcatcggctccttgttggataaaacgttttgatttgttctttttacccattcgaaaaaccccctttatttagctgaaaacaatcgacgcaatgtctcatgcgtctacttatagtatggacatttggcaggaaactataagtagggaatttttagattacaacccaagaacctcttctaaatataaagcaataccatcttcttcgttcgttaacgtcgtatggtttgcgagtgattttaattcagggatggcatttcccattgcgatgccatgaccagcaaattcaatcatttcaaaatcattatcttcatcaccgaaagcgataatgcgctcttgtggaatgttgtaatgactagaaattttttgtaatccaactgctttatttaatccgcttttcacaatttcaataatcggccaaggtgcgccccattttctatggtcgattacttccgcatgcatatccgttaaatgttgacgaattgcagtagaatgctcgtcatgtgcgtcaattaataagcaagttggatgatcgtttaaaatatttaataagtctccggtaaaaatcttaggagagccgaattcgaaaatatgttttttatcttcatcaatttcacgaacatacacatcgtccattacttccgcgtatatattttttacgccaaaatcaaagcaagctcggacaatttcttgcgctgttgctagctcaagaggagagtgatgtgttccccagtttgaatcaagaggatgatgtacgtaagcgccgttaaagtttacgataggtgtgttaagatcaagttctttatagtaatcgtaactagcacggaatggacgtcctgttgaaataacaacaatatgtccctgttcctttgcttttgcaattgtatgtttcgttcgagtggaaattattttgttgtctgttaataaagtgccgtctaagtctaatgcgattaaatgttgtttgttcataatttcacctcttataataatttttttgtatctatctgtatttccgtttttaatatgcagaaataagaggttaggctcggtgaaatcaccatagatggaaatttcactatatatccatcttacgtctcaaagtgctgtggtgtctactatttatcgttggaaattaagaaaagtcaacatctttttagaaagttcaaacaatgtttctttcattatgtacaaattgtgaaaagggttacattgctcgtgtggtgaggcatataatgaacatgtaatcttctcgtatatgtttgactctcctttgaaactagcctagagtaggttggtttctttttttttctacaagtaggaaagaaatccctgcttacgcttgtgtcattcatatatatgtacaagaatgagatgtagtactgtttcctaaacatgacagaaaagctttcttttaaaatggatatactaatgaggcaagacgtcatggaaggagaatgaagatgggacaaaatcgcaggtttcgttctggacaaaaagcgccgaatgatggcatttacgtagaaattggtgaaacgggaagtatggtgaaagatccgcaaatggtgaaattaactgccggtgaaaagtttccggataacacgaatcataaccgccagtggacatataaaagaaaaccgtaacagaagccgcaatcattattgcggcttttttgtcgttacacattgtaatttcatttaccgtattttttagcagtataatgaatgctctctttttctttttcaaataataagtttgaaaatacataggcaaaattattgtataaaaaagtcagttggcgtataatcaaatcaaaggtcaaagaaagtcaaacttttggagggctgtaaagatggacttaaatcaaatgacaacaaaaacacaagaggcgattatgagtgcccaatctttagcggtatctcatcatcaccaagaggtggatactgttcatctattacttgcattattagaagagcaagatggattagcagtacgtatatttcaaaaaatgaatgttgatatagaagcattaaagcaaggtgctgaaagtttaattaaaaagaaaccttctgtaacggggagcggtgcagaagttggaaaattgtatgtaacgagcgctctgcaacaactgcttgtaagagcagggaaagaagcagaaaaactgcaggatgattacatttcagtagaacatgtgttgcttgctttttctgaagaaaaaggcgatataaatcaattatttacaagattgcatattacgaaagataacttattacagtctttaatgacagttcgggggaatcaaagagtgacgagtcaaaatccagaagcaacttatgaagcgttagaaaaatatggtcgtgatttagtggcggaagtgagagcagggaaaatcgatcctgtaatcggccgtgatagtgaaatacgacgtgtaatccgtattctttcacgtaaaacgaaaaacaatccggttttaattggggagccaggtgttggtaaaacagcaatcgttgaagggctagcccagcgtattgtgaaaaaggatgtacctgaaggattgaaagatagaacgatttttgcgttagatatgagtgcactcgtagctggtgcgaaattccgtggtgagttcgaagagcgtctgcaagctgtattaaatgaaattaaaaagagtgaaggacgcattttattattcattgatgaacttcatacaatagttggagctggtaaaacagaaggagccatggatgcaggaaatatgttaaaaccgatgcttgcgcgtggtgaactgcattgtatcggggcgacgacgctcgatgaatatcgcaaatatattgagaaagatccagcgctagaaagacgtttccaacaagtattagcagaagaaccaactgttgaagatacaatttcaattttacgtggattaaaagaacgctttgaaatttatcacggtgtaaatattcatgaccgtgcgattgtagcagcgtcagttttatcagatcgatatatttcagatcgattcttacctgataaagcaattgaccttgttgatgaagcgtgtgcaacaattcgtacagaaatcgattctatgccaacagaattagatgaagtaacgcgccgcattatgcagctggaaattgaagaagcggctcttggaaaagaaacggatcgtggtagccaagagcgtctaaaaacattgcaacgtgaattatcggatttaaaagaagttgcaagtggtatgagagcaaagtgggagaaagaaaaagaagacattcacaaagttcgtgacttacgtgaacatttagaacgtctgcgtcgtgaattagaagaagcagaaggtaattacgatttaaataaagcagccgaacttcgtcacgggaaaattccagcaattgaaaaagagttaaaagaagcggaagaaatgggcgcgcataataaacaagaaaatcgtttattacgtgaggaagtaagtgaagaagaaattgcagatattgtttcacgctggacgggtattcctgttgcgaaactcgtggaaggtgaacgcgagaaattattacgcttagagcaaatcttatcagagcgtgtcatcggacaagaggaagcagtaagcttagtgtcagacgcagttcttcgtgctcgcgctggtattaaagatccgaaccgcccgattggttctttcatcttcttaggaccaacaggtgttggtaaaacagaacttgcaaaaacgttagcgcagtctttattcgatagtgaagagcaaatgattcgcattgacatgtctgagtatatggagaaacacgcagtgtcacgcttaattggtgcacctcctggatatgtaggatatgaggaaggtggtcaattaacagaagcggtaagacgtaaaccatattccgttgttttattagatgaaattgaaaaagcacatccagaagtattcaacattttattacaaaagatagatgatgggcgcattacagattcgcaaggtcgtac

SEQ ID NO: 1307 - DNA, 9961 bp, Bacillus thuringiensis
gtttgtcatttagtcattttaagaaactgtttctgcacgaatgggtccacgctcaaagtctgtatgaataacaccagcacattgcggtgccttcattccttgtttaaatgtccaagcacgtacttcttgaacgccagctgtaaagtaagtagcaagtcctaatagatcatatgctgcacgaattaattgatctaaaccagactcttcaattcctaattcttcaaggaatacttttttctcttcttcgtctaattcagcgatttctgattcgatttttgcacatacaacgataacttgagaattttcatttgctgcaaattcttttaccatttgtacgtatttattttccgaaggatcgataacatcgtcttcacttacattcgctacgtataacatttcttttgttgtaagtaaatgaaggcctttaacaatcttcatctgctcttctgtaaattcaacagtacgagctggttttccctcttcaaaagcttcttttaaacgaactaaaatttcatgctcatataccgcttctttatctttttgtcttgctaatttcgcaacacgctcgatacgcttatcaacagactctaagtccgctaaaattagctctaaattgattgtttcaatatcatcaattggatctactttccctgaaacgtgcgtaatattttcgtcttcaaaacaacgaacaacttgacaaattgcatctacttgacgaatgtgagataagaatttatttcctaaaccttcacctttactagcaccttttacgatacctgcaatatcagtaaactcgaatacagtcggaacagtctttttcggttctactagttccgttaatttatttaaacgctcatctggtacttctacaatccctacgtttggatcaattgtacagaatggatagttcgcagattctgctcctgcttgtgtaattgcattaaataaagtggacttccctacgttgggtaatccaacaatcccagccgttaatcccatatttttcactcctatgtctcaatctttcatcattatagatagtaacgaaaaaaatgacaagtttccgccaaacgaaaaaaagtaacagctacctactgtaactgttactctccctctattcttcgtgcttcacaagtattttttttaccttacgatcaaactctcttcgaggaatcattactgaatggtcacacccctcgcacttaatgcggatatccattcccatacgaataattttccaacgattctcgccacatggatgggctttcttcatttccacaacatcatacaagttatattccttttgctccactctccaaactcctctccatactaaattgcttttccactaactaattcttcacgattatataaaaccatacgcggatatggaatttcaatcccatgtaaatcaagacgatttttaatctctttacgaagtgcccttgcaataactgcatgttgcatcggttctacttcagcaataacacgtaatataacttctgatgcagctaatgtttgcacacctaataattgaggcgttgttaccattttttcgtactttgaaggtaattctactaataaatcttcaataacctgctctgctttcgcaatatcagcctcatatgaaatagatacatcaacaaacgctacactattactaactgagtagttagtaacttgaataatacttccatttggtaaagtatgaatttcacctgtccaactctttactttcgttgtacgaagtccaatttctaaaacgactccttcaaattgaccgattttaacataatcgccaactgaaaactgatcttctaacaaaataaataaacctgtaataacgtctttcactaaactttgagcaccaaatccgactgctaaaccaattaccccagcacccgctaataaacctgatgcattaatatcaaacacacctaaaatcgcaattagcataatgaacataacaacgtacgctacaatattttcaagtaatttcgctactgtaactgtacgacgttctgaaatttgaattggagaacgacttcccatgcgaaacgcatttcgtacaaccgctcttgcaattcgcacaacaaccgcaccaattattaaaataatgcatatttttaatgtcgcaactccaatatgagcccaacgatcagcatctaataaatactgtttcatagaattaaaccacttcgttaataaatccatgtacctctacctctctagctaaaatttctttttagttacccttattattgtatcagaagtcccctaattgctgaaaaaattttatgattttaatcctattttatccccgatatccaggtataaaatggaacgaatatatatatactagtactattatttccgttttcattcacattttgcaaaaattacgcacttataactttccattttcctcaccatataacacatattgaaaatttattaaaaggatgggtgcttcatgaatattggaagttttcgcttaccattttttgagaaagaaactcaaaacgttatgcaccaagatctagaagcctccgagataatcagtaatttcttacttacccatattcctattaaaactaatataccactcattctcgtttgtatcggcacagatcgctctacgggtgacgcactcggcccattagttggtacaaaacttgaacaaatagacatccaaaacctccaagtattcggtacactagatgagccagtacatgcgctaaatttagaagagaaaattcagaatatacagaaagaatatcctactgcatttataattgctgttgatgcatgtttaggaaagtcccaaaatatcggatcaatcactactggaaagggacctagtaaacctggagctgctatgaataagaaattacctgcagttggtgatttgcacatacacggtatcgtcaatctaaatgggtttatggagtttttcgttcttcaaaatacaagattaagtttagtcatgaaaatggctgatgtaatcgcacaaagtataaaagagacggatcaaaaattatccgcattaaaaaaagcaaaccatctataaataataagatggtttgctttttaatttttctgtgctaatagttctaaaatacgatttaaatcttctttattaaaaaattcaatttcgattttacctttttcttttttcgtctctttaattttcacatctgtgccaaacttttctcttaagaacgtttcacgttctacgaaaaatatatttcgctcttttttcactttttttgtttcacgtgaaacgtgttgattaatctcttggacgattttctctaattgacgaacatttaatccttctttttcaatgcgtttcaataaggacttcaattgttcttcatcttttatcgtaagtaaagttctcccatgagccattgaaagttgaccatttgcaatcatatcttgtacgaaagaaggtaggcttaataacctagtataatttgcaatgtaaggtctgcttttaccaagacgtttcgctaattgttcttgcgttacatttagctcattcattaacatctggtatgccattgcctcttccataggatttaaatcttctcgttgtaagttttctaacaaagcaaattccatcatttgctgttcatttaattgtcttacaaccgcaggtactttttctaaaccagcctcttttgcagcacgaaatcgtctttcacctgcaacaatttcatatcctttaatgctcttcctagcaattaatggttgtagaataccgtgttccttaatcgaaattgctaattcctgaatcgcctctttattaaagtgtttacgcggttgatatggattcggccttaattcagttacaagaatctcctgaattgtttcctcttctttcacatctaaatcaggaaaaaacacattaattcctcttcctaatcctttagccacctgcaatcacttcctctgctaaatctatatatacttctgctcctcttgatttagcgtcatactgcataataggtttcccatgacttggagcctcgctcaagcgtacattacgcggaataatcgagcgatatactttatccctaaaatactttttcacttcatctataacttggatccctaaatttgtacgggcatccaacattgttaacaatacaccttgaattgctaaatttttatttaaatgtttttgtacaagtcgaactgtatttaatagctgacttaacccttctagtgcgtagtattcacactgtacaggaataataacagaatctgctgctgttaatgcattaatcgttaataaccctaaagatgggggacagtcgataataatatagtcatattcatcacgaactggctgtaatgctctttgcaaacgtacttcccgggaaatagtcggtaccaattcaatttcagcaccagccaattgaattgtagcgggtagaacatctaagttttcagttgcggttttctgtataaccccttgaacatctgcatcttccacaagaacgttgtaaatacattgatctaattcagatttttcaattcccacaccagtcgttgcatttccttgagcatcaatatctacaagaaggacttttttacctacttgcgccaatccagcccctaaattaacagatgttgtcgtttttccaacaccgcctttttgattagcaatagcaatgatttttcccatgatgtcacctactttcaacctttctatcttattctagtaacaattacgtttattgtaacatgaaataaaactttttcttttacgtcctttattaaacttcaaaatttatttctaaactccttcttcatttaacaagaaaatatagtaaaagagacctctccaataggataaggtctctagcacgtcattattattttttctttggaattttaattgtaatttgatagtactcatcaaattcttcttcctcagaattaacattcaaaccactttcagtaaccatttgtaaagattgtctaattgtattcatagcaatcctcgtatctcgacttactgctttttgctttgccttacgcttcggtttcgcttcctctagtaacttcgcaattcgttcttctgtttgctttacatttagttgtttctccacaatttcctgtaaaactttcagttgtaattcctcattttttaaaggaatgagagcgcgggcatgacgttctgtaatgcttttttctaataatgcactttttatttcttcaggcaactttaacaatcgcaacttatttgcgattgtagattgtccttttccaagtcgttgtgccaatgcttcttgtgttaaattatgtaactcaatcagcttttgatatgccacagcttcctcgattgccgttagttcctcacgttgcaagttttcaattaaagctacagaagctgtctctgtatcatttaagttctttataattgcaggaaccttttcccaacctaactttgttgccgcgcgaaaacgtctttctccagcaataatctcgtacttatcatcctcatattgccttacaacaatcggctgaataagtccatgtgtacgaattgttaatgctagctcatcaatacgcgcatcatcaaaaactgttcttggttgataacggttaggggtaatatttactatcggaatttcttgtatttcttcatatacctttttatctatctcttcatggctttcgtcttgtaattcgaattcgctctctttatctccaaagccaaataaacgagaaaacgtatttttcatacatattccaccaccttttaggcctattgactattctccataaaatgtttcctatgaaacatttacgttttcatttatataatttaatcttacgtctaataagatttatttttcaataggtaatttattgggtgttcccggtttgcgtggatatttctttggtgtcttgcgctttttctcgattaataaaatattacgttcactctcttcaaacggtaattggaacgtagacatctcttttaactctccgcctagcacctctaaagcatacttgccattttcaatttcttcgtttgctgctgcacctttcattgcaatgaatgttcctccaacttttacaagcggtaaacatagctcacttaatacagaaagacgcgcaactgcacgtgccattacaatatcgtatgattcacgtacaccttcttttttcccaaacgtttcagcacgatcgtgacaaaatgcaacatcacttaattctaacttttgtgctaagtgatttaagaaattaatacgtttttgcaacgaatctacaattgttacttttaaatgcgggaaacaaatttttaaaggaatacttgggaatccagcccctgcaccaacatcgcaaattgagaatggttttgaaaaatcataataaaaagcagctgtaatggaatcaaaaaagtgttttaaatatacttcttctttttctgtaatagccgttaagttcattttttcattccactctactaatgtttcaaagtagattttgaactgctctaactgtctagaagagagggtgattcccttctcttctagcatagattgaaattgttctatgttcatctagcaatatctccttactatttattggttcgatacgcgtgcaatttttccttgttctatatacacaagtaaaatggaaatatccgctggatttacgccagaaatacgtgaagcctgccccattgaaagtggacgaacatctttcaatttctgtctagcttctgaagcaatgctagaaatcgcatcataatcaatatctacagggatttttttattctccattttcttcatacgctctacttgctgtaaagatttttcaatatatccttcatacttaatctgaatttcaacttgttctttaacttcatcacttaattctacttcacttggtactaaaagatgaatatgctcatatgtcatctctggacgacgtaataagtcacttgcacgtattccatctttcaattcacttccgccaatattgcgaattaattcttgaacttcaggacgtggtttaataataatgctgcttaaacgttccttttcctgttcaatttgtaattttttatttgtaaatcgctcatagcgctcttctttaattaatccaattttacgaccaacttcagttaaacgaagatcagcattatcgtggcgtaataatagacggtattctgcacgagacgttaataaacgatatggttcatttgtacctttcgttacaagatcatcaattaagacgccaatataagcatcctcgcgacctaaaacaacttcttctttacctaaagaacggcatgctgcattaattccagccataagcccttgtccggccgcctcttcgtaaccagaagttccattaatttgtcctgctgtatataaatttttaatctttttcgtttcaagtgttggccatagttgtgttggcacaattgcatcatattcaattgcataacctgtacgcatcatttcaacattttctaggcctggaattgttctaagcatgtcacgttgtacatcttctggtaagcttgtggataaaccttgtacatatacttcttgtgtattacgcccttctggctctaagaaaatttgatgacgtggtttatcattaaatcttactactttgtcttcaatagaaggacagtatctaggacctgttcctttaatcataccagaatacatagctgaacgatgtaaattttcatctattaaacggtgtgtttctgtacttgtatatgtcaaccaacatggaatttgatccataataaatttcgttgtttcaaaagagaatgcacgtggcttatcatcacctggttgaatttctgttttactgtagtcaattgtattactgtttacacgaggaggtgtccctgttttaaacctcacaagatcaaatccaagctcctctaaatgctcagataatgtaatagacggttgctgattatttggaccacttgaatattttaagtcgcccatgataatctcgccgcgtaaaaatgttccagttgtaattacaactgtttttgctgtatattctgcaccagcttgtgtaactacccctttacatacaccttcttcaacgattaaacgctctaccattccttggaacaacgttaagtttggtgtttcttcaattgttttctttaattcatgttggtaagagaatttatcagcttgcgctcgaagtgcacgtacggctggtcccttacctgtatttagcatacgcatttgaatatgagttttatcaatattacgtcccatttctccgcctaatgcatcaatttcacgaacaacaatcccttttgctggtccaccaacagaagggttacatggcatgaatgctaccatatccaagttaattgttaacattaatgtttttgagcccattcgtgctgccgcaagaccagcttcacatcctgcatgacctgcaccgattactatgacatcgtatgaaccggcattgtatcccattgtttattcctcctaataatctctatctttctacaacttcactatattattttcctaaacaaaattgagagaacaactggtcaattaagctttcatgcactgtgtccccagtaatttcaccaagtatttcccacgttcttgttaaatcaatttgtaccatatcaattggtacaccattttcaatcgcctcaactgcatcaccgattgtttttcctgcttgtgttaataatccaatatgtctcgcattagaaacatatgtcatatctgcagaatcgattgttccttcaaagaataaatcagctattgccttttcgagttcatctattccttgttcctcaattaaggatgttgtaataacacgatttcccgcggctaactctgtaacacgttccatatcaatcgcttgcggtaaatcagtcttattcacaataacaataaagtcttttccttgtaccgcacggaatagatcttcatcctcatttgttaaagcctcgctatagttgacaacaactaatactaaatccgcttggctcatcatttcttttgaacgttccacaccaattcgttcaacaacatcttctgtctcccgaataccggctgtatctataagtttaagaggtacaccacgcacgttaacgtactcttcaataacatcacgagttgttcctgcaatatcagttacaattgcctttttctcctgaacaagactatttaataacgatgatttcccaacgttgggtctaccgataattgctgtagcaataccctcacgtaaaattttcccttgttttgatgtttctaatattttttcgatttccgaacgaacatgcgtcgctttctcaattaaaatattatgtgtcatctcttctacatcatcgtattctggataatctatatttacctcaacatgagctaatgtttctaatatttcttgacgcaaaagaccaattaatttagataatcgcccttccatttgattaattgctacattcatcgcacgatctgtttttgctcgaatcaaatccataacagcttctgcttgtgataaatcgatacgtccatttaaaaaagcacgttttgtaaattcgcccggttctgccaatcgtactccttgtgctagaataagttgcaatactttatttactgaaacaagtccaccgtgacagttaatttccactatattttcacgtgtaaaagtccttggtgcgcgcataatagacaccataacttcttcaataacttgatttgtatctaaatcaacaatatgaccataatgaatagtgtgagaaggaacctctgttaaatccttccccttaaaaatacgattaactttctcaaccgcatcatccccacttactcgaacaatggcaattgcaccctctccaagcgctgtggaaatcgcagcaattgtatcaaattccatgtcctttcacctcacttgcttatttatctctataaaaacaatg

SEQ ID NO: 1308 - DNA, 12946 bp, Bacillus thuringiensis
tttctgtcgatgcagctggcttagctatcggtacgcgtatgcgtgccaaagaaggcggattaaacgttggggcacgtaacacacaagacgctatgtctgctttacgtactggtgacgctgcattaggttctgtttcaaacatcttacttcgtatgcgtgatcttgcaacacaagcatcaagcggtactaacaacgataaagatatcgcatctatggacaaagagtatcaagcattagcacaagaaattgatcatattgctgacaaaacaaatttcaacggtaacgcatttttaagtggtggtgggaaagatatcacaattcagctttctgacgcttcaaatgatacaatgaaaatcacagctatcgatacaaaagctataacaactgcaactttagctacacctacagctacaggcgcagataaggctttaaatgcagcttctgcaccagctcaaatcacagctcttgacactgctattcaagaaattgctgacgctagagcaactttcggttctcaattaaaccgtttagaccataacttaaacaacgtaacgagccaagctactaatatggcagcttctgcttctcaaattgaagatgctgatatggcaaaagaaatgtctaacatgacaaagttcaaaattttaaacgaagcaggcatcagcatgctttctcaagctaaccaaacaccacaaatggtttctaaattattacaataagccatttgagttagtttcctgaataaacctctctgcttgcagagaggtttattttttctatatagatagattatttataaaactttcttttttatgtggaagagagtatccgtgatgcttttatcttgattccctcttatgttaaaacacaaacagtaaataagcataagcccctctatccttccataactgtttattagatcaaaagataccgactctatcaatctataaggagtgtctattatgcgtattggtacgaatgttttaagtatgaatgctaggcagtcgttgtatgagaatgagaaacgtatgaatgttgcaatggagcatttggcgactggtaagaagttgaacaacgcttcggataatcccgctaatattgcgattgtgactcgtatgcacgcgagagcaagtggtatgcgcgtggcgattcgtaataatgaggatgcgatatcgatgcttcgcacggcggaagctgctcttcaaactgtgtcaaatattttgcagcgtatgcgtgatttagctgttcaatctgcgaatggtacaaattcaaataaaaatcgtgactcgctgaataaagagtttcagtctttaacagaacaaattggctatattggcgagacgactgagtttaatgatttatctgtatttgacggtcaaaaccgccctattacattagacgatatcggtcatacaataaatatgatgaaacatattcccccttcccctacacaacatgacattaagatttcaacagaacaagaagcaagagcggcgattcttaaaattgaagatgctttgcaaagtgtgtcacttcatcgtgccgaccttggtgctatgataaatcgtttacaatttaatattgaaaattaaaatagtcaaagtatggcgttaacagatgctgcatctcaagttgaagatgcagacatggcgcaggagatgagtgattttttaaagttcaaattattgactgaagctgcacttagtatggtttcacaagcgaaccaaattccgcaaatggtctctagactactacaatcataaacattcatcttccatctttggaacgattccatacaaaacaaaagggaaatacatataaactatgtacctcccttttattttgtacccaaattttattactgcgtgacagtcataacctgtccactacgatcaaccataattttcattttaccgtcttgtgcattatatagccctagtttatgtaattccattttacaatcttgtacgaaagttggtaatttacgaatttgatcgatatcagaacttgtaatgaaatgaattaaaagctgcgtcatgcctttaatatcttgtacaagctcttctttctctcgttttagcctttcattttctagttgtaacgactgcaattcaccttctagactacgtgtattctttgcttctctagaacgtcctgctgccatgctagaaagcttataaataccttccataaactgatgtagttcgtcttctttcctttcactacattgattaattgtttcaaagttatcaacgataccagatataactgttacaagatttttttcatcctctttatgctggatttcttcttttaattcgtactcgttttcttgttttcttgcaacgattgtctcttttactggtatatattttcgctttcgtcctggtttttgtttttcaatattttcaaacggtatttcacgtttttttaatttataatacgtattttgcaattgactttctgtttttggaaaaagatttagttcatttttacttacgtattttgaaatatttaaaatgtttaaaccgtgacgttgacaaaattgatacacttcatacagtagcactagttcagacttcagccatgtaattgctgatttttcatatgctcgcatcccgccatttttttctatatctatttggaataataccattctattatgtaaatcaactaattcttcatactttacttggaattctttttctattttttttaattccgcctctagttgcatatcgttcattttattatttgacatgttttgtaaaagacctaatacattaattgctgtgtggtgatacataatttgtgccactccccctcatcctttcacaattctcatctgactcccatgtcttttaagaaaatagcaatttttacatatccatattataacagttcgaaattatctgtcaaataataaacatacaaaaatgtatagaaagtataaaaatttggaaaatgttttttaattaatatgtaaaattgcatattaattacatttaattatattatatggtattttggatgttttttcaccgaaaaaatttgcgttaccacgaaatgttactaaaataaccctcaaaatacgtttgcttatattttcaaatcaaaaatcttcatttgaagatttttcatacatacagcgccaaacacctcagaaacctttcatttttctgccagcttaaagtatagaatactaaaaaggaattagccaatgctacacatggctaattccttcctctctctaacagaatagagttataaacccagtcttcaaatcctcaatcgaagtctcgcttcttctaaagctatctcggcggctatctcgtcccatttacctaaaaaacactccatatctctggtcttacatcgcatgggtctctattaggcactgaccgctgccacacatagctagttcctctattccagctaaaaaagtgcttttcttacaacactaacttatcaactaaaccaattagctcttgaatatctggcttacttacttgagcatttgctcctacagcttcacctttatggaataattcatttgtaattaatgaagagaaaataatgactggtaaacgattcattacttcactatccttaaccactttcgttaaatgatgtccatccattttcggcatttcaatatccgtaattagcaagtgaatatgttcaaacattttctctccttgctctttcgctaatttttcaatttgcgctaacgcttctgcaccattgctgaagaagttcattttcgtatatccagctgatgataatgtttcttctaatatttggcgtagcatcgctgaatcttctgcaatataaattactttttcagctcgatctgttttttgttctaaccctgcaattgatttattgtcataaccagtaccgctaatttcacatacaattttttcataatctaatagtaagatgattttgccatctagttttacaataccagatgtcgtttcttctagtcccatagataatgaagctggttcatcaatttgttcccacgaaatacgttgaatacgatgcacttcatcaacgcggaaaataactttcatttggtttaattctgagatgataaatttcgtttgatcaagtggctttgttgactttaaattaagagccattgccaagttaataacaggtaaaatttcaccacgtacttgaacaacaccttcaactgcatgatgagattctggcacagttgtaacagggaatggattaatgatttcacgtactttcattacattaatactaaataggttttcaccaacagtgtacgtaacaatctctaattcatttgttccgctttctaataaaatactttgtgcttgtgacataaaggtgtcgctccccttccattaattccgtatatctaattattaagctttataaaagagaaaaagtcaactacctatataaaaaatatagatagtcgatcaattcattttattaaaaaacaattaatcttgtataaacgaagcaagtgcttctaataacacttcttgcgcccctacaatttctgtcggcattgcttcccattttttcgaaagctccgtctctactcttattctcagctcagaattcatttctgctagcacatattctttcgttgctatatcaacatcaagtagtgcgagtgcatatagttctggttcatttattttttcgaataatcgtttgaataccaccggtgctatatgttttaatttttcaatatgaatttccttatccgaaaatagtaactcatattgaataaacgtaacattttctttaatcactttaaaataacaattattttttttatcatttacaaaataaccgtttggatctgcaataatactctctactttacgaattaaatctggcaaactattcgccgccattacagtccgctgctcaacctcactcggcgaaatgaatgtaacgcgatacttattttgcgccatcctcctcacctctccttttataaaaatctatcatcacaaacatatgaaatgaaactagcatactctcatttcattgccctattgtcacaactcacagactataaaaagtactgacttgctataaagagattattgttcaaccactccagtacatttttatagttctcttcttacagctccgagccacctaagcctaaaaacacttttaagcgcctttaagcaactcgatattgttgaaccaaaacgcaatttgctgatccgtaatgcctgataatgtaataaaaaactcacggcacttcatctcgtccttaaacagttgatacttccatgcgccatcactgccaacactgacgaaataaaactcatgaatacgaccaataatcgctttcttttcagcaaatgaatacgggggcacttgcttaatttcaaattgatctggtaaatatatatgctcttctcgttccatttttagtacttgttcagcaagttcacgtttattctcgaaaaatggcaattgtaaaattcgttcttgtcttgtcatacgaataaaaaccctttctactacattacaatctttctttataatatattatcgaattaaatttacaacttcatttaatacttcatctgaaactttaattactttcgcatttccttggaatccacgttgatatagcattaagtcaacgaattctgcagataaatctacgtttgaactttcttttgctgacccccttacattacctgcaccattctcaccggcaacacctatccctggaatccctgctgatggtgtggcaatgtaattgccattcccagttttcattaatccacctgaattagggaatgtagctacagctagttgtcctacaaccttcatactaccatccgaatatgtcatcataacgaaaccaccgtcagaaattgaatagtcatttgcaattgcagctggacgccccgttacttctgttgtagaaatagttttccctgtcggataatttgttaaaccacttaagtccagtgtcagtcccttaccaaaaggaattttaactgttccacctttagtaatttcaccagttactggatttttttgtacagattcatctgtttcttttagatttcctaatgtatcaaatttaagatttttttcgcccgtcatgccttcaacaggcttaaactctttttcgtttttagaatcatttcttacagaaactgtatatgtatattcacctggcacaggcttttcaacttcttttccatctacagtctcttttgtagtcttttgtttaatatttacacgtaacgttaacgagtttccttcctcatcaaaaactgtgaattcgtgagataatgcattttgatttctaggaaggtttccacctattgttgctttatctgtttgaatcccaccaacagctgatcccattggaatatgaattggacttggtcgtgaagaaaaatctatttcttgtgttcctgttttcacaccataacctagcacatactgtccacttgtatttgtaacatagttatctttcgatacaccgaaagacccttttctcgtatactctacatttccactattacgatcgccaactaaaaataaaccatttccctctatggctgtctccatcttatcactagttaaagtaagagaaccatcactaaaatctgttgatgtcccactaaactttacaccgttaccaatactctttggattcgtgccagcataagcaccatccccacgtgaaccaaccgtattattatatagcagatcatcaaaaatagctttttgctttttatatccaactgtttgtgcatttgcaatattatttgaagtaacacttaatgcattttgtgccgcattcatccctgtaatacttgtatataacgctttaatcataacctatatacactccttttattaattttgcttaacctcttcatttttttctatatcatctttcttctcatcttctggatttgtttctgctatcggtttatctgaaaccctttctacaaaacgaagtgagacaacttgattatcaacaataagttgtacatcgttattttcggcaagtcgaacagtttccacttgaccagtcacttgctctcccttattgtttatacctctaacatactttcctaaaaatttcatccctccatcaagagctgtcgtatacatcgttgattgtagtttatctactgcttttgtcatattttgtacttgctccataagcgatagttgagccgtttgattcatcatttggttcatatccatcgcattaaacgggtcttgatgttgaaagcttgctaaaaaaagtttcaggaaatcatctttatccataataccgggtgttttttgattacttgctgatactccgtttgtttgttgaactggcgattgcacaccattaacagatgcattttttgcttgcgcccctacttgtaacggaatatgatttgtactcgttgtatttaatccaactgttggcacactttattcctccaataatcccgcaaattcttttgattgttgtttctcatgttgcgtacttgctaatttctgcttttgcctttgttcttgttctcgctgttctttacggttttcatctttatcagaatagctaatttgaatgttaatttctttttcttttaactttagcctcaattcatcaaaaatgacttcaacacgttttttcgcatcgtgtttttccatttctacgtgaacatcaatttggtctccatgctttttcataaacacagttaacgtaccaaatttttctggatttaactgaaataaaacacgttcttgtttcactacaaatttttgcaaggcttctacttgcgcttccattttctttcctaagtcaggcaatgaaactttctcagcaccactatttgatttccctatttgttcggtactcgtcgttttatttaataactctgcacctgcagagctcgaatcgtttaatgcatcaccttctggcaactctacctttgcaccatcgttctcagctttcggaagatctacgtctttaaattcttcttgtttctttgcaatattacaagtttctgtttctacaaccttcaatgcttgcatcgtttgctctggcatcttcattttgtctaataccatttgcattgtatcttctaaacatatagcatttttgatattcatatttgaaagaagttcttgtaattgttgtaattcagctgcaggtaattcattaagtttaatattgccatattctttatatagctcttgtattttttgtatgtattgatataacaattccggctgcacatgtaattgctcaattgcaaccatttgctcagatacagctaataacaactgttctgtctcttttttttcttctttctttacaattggttcttctttcgttaccgatggtttagaaaggttatattcttttttctcttcttttggtgcttcttctcgtttcgttttctccgttttcggctgctttttattttccattctcatcgtacgatcaaatgaagaatcttcatttttcgattgtacttctagccctttttctttttgcggaggtaaactttgttgcaccggtaatacagactgtatcactacattcacctcatccattcatacacattttcaaatccagaagcattttttcttccagcttttcttgtgctttcgcaagctttttgcaatcttcttgatacatctcatcaatgacacgttctttttcttttacttgctctaaaagactttcatttttttgaataaaaccttccgtttttttaattttccgattccattcttctattctttcaggtgaaaacgtatgtgaagaaagcataccagccataatacgttgcccagtttgtacgactttactacgcgatttcacaacatataaatcatattcttttttttgttctatttttcttttttcagctgttaattcatacacttcttttaaaatatgttctttttcttgatttatttgcaattttattgtgtcgtactgctgtttatccacctgttttcataacccctttctattataacgttctctttttctattatatagtttttttccaaaaaaatctgtgaaatattaaaaaacaaaaaaataagacctcttatgcagaggccttatactatatgctgtatcgcttcaacgatatcatcaaattggaaactatccgatcgaccttgctttaaaaatgtatttatgccttctactttatttttacattcaaaaatataagcattttcttcattttcttgaatcgttcctagcttaaaatacaattcattttctttataaattgataaaatctttctcatttcatttgcaagctgccaatgatgtggcgaaacaatttcttccataatcctacttactgaatctaatactgaaattgcagggtaatgactaagcgttgcaagctcacgctttaatacgatatgtccatctaaaataccacgtgctaaatctggtacaggaccatttaaatcatccccatcaacaagcaccgtataaatacctgttatagatcccttttgtgtttttccggaccgctctaacaacttcttcatataactttccattaacagtgttttaccaccaatcggtaactctttaacagcaatatcaacacttcttcgtgcatcggcaaaacgagtaacagagtccatcataagtaatacgttattaccttgatcacggaagtattcagcaatagacgttgcgagtttcgctgcacgaagttgcataagatgactttcatctgacgtcgctacaacaacgacgctttttcgcataccttcctcgcctaactcttttcgaataaagtcttttacttcccggccacgttcccctactaaactaataacgtttatatcagcttttgcattttttgctatcattccaagtaaagttgatttaccaacacctgacccagcaaaaataccaatcttttgaccgataccaattgttagcatagaatcaattgattttattcctgtttcaaatacatcggtaatctcttcacgttcaaatgcatgtataggtggtgcatctagttttattttctgtaatggaatgttttcagcttcctcatttaacacttcaccatttgcacttaacacttttccgagcaagtgattaccacgtggtacaacaacatcttctgaaactaatgtcactgaatctccataacatactttttctgtctgttcaaatggaagtagcatattattttccttttcaatggcaatcacttcacataagacgttatgttctccaacgaagcaaacatcaccaatcttcgctttcggcccttttgctacgaaaaactgttcttgtacactatgaactttgcctactttcgtatacagcggtgtttcaatgaacttattccatttttcgttctcattcattaacaggcggctcatacattttgctcctcaaataacttctcttcttcccatttctgacgaagtttcgcaaatataggtgcaaatttaaatttaaagaactctttctcttcttccagaacaaattcaccaaactgcagggagaaatcatatttccattctactaattgtagtaaccaatattctttcgtattttccttctcttcttgaatacgttcaaacgtttctggatgtactgtaatgattaatttttcaaacgaagttggcaatgtttgcacgatgccagttaaaataggtaacacatcaagcaatcgtgaatctaccgcttgattcacgattttttctgctagatgaaaagattgatcccataataactctgtccattcatacgctgtttcttgttgttctttttgaaattgcacacgcgctgcttccatctgttccagttgctcatgaatatgcatttgaaattgttctttatcttgtaataactgctgccgctctcgttctagcatttgcttctcttgccttagctgattcatttccatatgtaacgattcttgctgggcgcgaagttctgcatgatcagcttgtaattcttcctcttctatttgaattgaagctggttttggaaattgtaattcatacgtttcttcagaaaaagaaacagaattcttcggaattctgtttttaaataaggacatcctcttcacctctttgaacgataattcttccttctttctctagctttttcactgtaccagtgatcgtttgctgcgctttttcagcatccgtcatcttaagcggtcctaagccatctaattcttctagaatcatctctttacggtttgaagacatacatgtaaataatttctctttaatttcttcttttgcaattttaagtgctttcgcaagaacaccgttatctgtaatttcttctaatacacggcgaagcgcaagatcttcaagaccaagtaagtcttcaaagacaaacatattttctttaattttctcagataactcataatcgacttcatccagcttttgaaagactgttttttcaacacctcgtgaaacattatttaaaatatttacgattgttttcaagccatcagttttattaattgcactaaatgccatattatttaatttcgattttaacaactcaccaatttgattaattaactcaccatcaacttgttctagtttcgctatacccattaccgtttcaacgcgcttatgatctggcaatctctcaattaattgagacgcaagttgcggtttaatataagaagcgataattgcaattgtttgtggtgactcatcattaagcactgtaagaagtggctctaaatctgtaagtgaatttaagaactcaaacggattatctttgttataccaaagatcttccaataatttttccagttcgtcttctggcatgtttttaaatatgcgacgaatgtattctttatctggagtgactaagttcaattcttttacatttagttcatataagaactctcctagtacattttctaacgtttctggtttgtatacacgaaactttgcgatttcacgaagtaatacttctttttcctcagctgtcatatattcaatgacttttgctgccaccccttcttctaatgtacgaataaggatggcagctttttctttggaggagatttcatctaacatcgttgttcctcccttactgtccgtttaaccattttttaattacttttgcagttccttctacatgttctttcgtagcatcctgcacttgttcatctaacgttggttctttcggttcttctggttcaggttttggctctggcactattttttcttcaggaatttccaagatactttcattacttgcagcaatttcctcttctactaagtattcttcatattcctcttcttctttctttctcttacgtcttgctaataagaaccatactaggccaccaatcgctaataagccagctgtaattccaccgaataaccaccagttcataccacttttttctggctctttctctttttcggctttcggctgatcgaactgaacagttacaacgttaacttgaccatttataaagttaccgttcggatcagcttgaagtcctgccgctgttccgattgcttctttaaaagttgtcatatcaattttacgttttactagcgtatcattatctacccatacaacaacatttgttttcgttaattctgggtgtttcttaattgtttcaactgttttatctatttcatagttttcgattttgttaccatttttattatcatagacaactttaccattttgattattgttcgtaccgtagtttggcacttcaccgttcgctgtaataccagcaccttgcttcgtatctgccccttcttgcgcagtagagctttcctcttgctcttgtttactacgaagtacacctttatcaccatacttctctgactgacgtgtaacttcatcgtagtttacagatactttcgtattcactttatattcattcggtttaaacatcgtcat

SEQ ID NO: 1309 - DNA, 13243 bp, Bacillus thuringiensis
aacttgaatttctttcatagtactgtccacccctcaaaaattgtgtttagatgaaattatatgagtaaaaaatctgaaaaacaatgtattttgaacattcggaaaaataaaggttaatctttacaaggaaaacgttgccacgtgttacacaatccttctttacaatatataaggggtttcttgatacacgtaataattcaaccaattagaaaacaataaattaccatgactcctccacctaacaagcggcttttcatctggattattatgtttaaaatagttttttggcacatcaatatttaatcccttgtcacgatctcgttcgtattcttgttttaacgtctcacaactatattcgctatgtccaagggcaaacacttgctttccttctggcccaataacaaggtgaacacctgcttcttcagagtttgctaacaatgttaagtctttcactcctctaatatcattctctcgtacttctgtatgacgagaatgcggagcaaaaaacaattcatcaaatccttgtaacaatttcacatgttgctcgcaaacttcatgttcaaatacaccgaacattttttccttaaggggatactttggaacaccataatgatagtacaagccagcctgtgctccccagcaaatatggagcgtagatgttacattcgtttttgaatactccataatatgtttaagctcttcccaataatctacctcttcaaaagcaagggtctccactggcgctcctgtaataatgagcccatcaaacttttcattttcaatatcacgaaacgttttataaaagcttgttaaatgttcttgcgttacattacgagatagatgtgattccatatgaagcaaatgaacatctaattgtaacggtgtgtttccaattaagcgaagtaattgtgcctctgtgtcttgcttcgttggcattaaatttaatatagcaattttcaaagcgcgtatatcttgtgtttccgctcgctccttcgtcattacaaaaatattttctttttgtaacactttgcgagccggtaaatctttatcaattatgatcggcatgtgttttgcccccaactagagctgcttccaaatctgcaataatatcagaaacatcttctataccaactgataaacgaattaaatcagatgtaacaccagctaaacgctgatcttcagcatttaattgtctatgcgtcgtactagcaggatgtataacgcaagttcgtgcatcagctacgtgtgttacaagagttgctagttttacatttgcgataaattcttttgctgcttctaatccgcctttaataccgaaagttaaaacaccactagcaccttttttcaagtactgttgtgccaatgagtaattttcattactatctaagcccggataattcacccattcaatacgttcatgattagcaagccacttagcaactgcaagagcattttcactatgacgttccattcgtaaatgcaatgtttctaagccaatattgctaatatatgcattgaatgggctcatacaatttccataatctcttaatagctgaacacgtgctttcacaatatacgctgctgcaccaaagttttgaacgtaacttacaccgtgataacttggatctggttcaacaagttcaggatactttccatttgtccaatcaaagtttccaccgtcaattacaataccgcctaaggagctcgcatgcccatcgatatacttcgtcgtagaatgaacaataatatttgccccatgttcaaacgcctggcataaataaggagttgctaatgtattatcaacgataaaaggtacctctaattctttagcagcagctgaaaattctttaaaatttaaaacattcatcgctggatttcctaacgattctgcatagataagtttcgtcttgtcattagcaagcgccgtaatttcatctgccgttaaatttggattaaagaacgtaacatcaatgcccagtttacgcaaactcactccaaataaattaaacgttcccccgtaaaccgttgaagaacaaagtaaatgatccccactactacaaatatttaaaactgcgagcataatagctgcttgcccagaagccgttgcaacagctcctacaccgccttctaaatctgataacttctgctcaaatgcggctagagtagggtttccaatacgtgtataaatatatccttctgcctctaagttaaatagggctgctaaatcatctgaagtatcgtatttatatgttgtactttgataaagtggtaaaacacgtggttcaccattttttggcgtatagccaccttgcacacaaattgttccttttccccatgattctcccatctctcattctcctttcttttatacaaaataaaaaactgcccctttcctgaaaacaagaaaggagcagtttgaaaacacgctctaaaggctctttcttatctctcaggattactacctgcaggatttggcacaattccgttatacggctgttgccaaggtttcatcgggcctgtccctccaccttttcttgataagactatgcaattaccgttgattttatagcaataatttcctaatgtcaaacggtttttctgaatgttctaaaataaatgttaacagtttcatataaagcaacaaaagaaatatattctagtctatttcaaaaaagacctttaaaaacctcaaatcagtctataaaattaaataagtaatttaacctataaattcaaattcccctaaagttaacctatatgttgaataggccatctcctcaaaaagatactatatatattcaatccatttttcactagtatatttcacttttttacctactaagatttacataacggaggtataacatgacaaataaaaaagatatgcagtacatacttgctctatatggcattcttctaggatctatagtaggagctacagtctggttatttttagtcacaataaatattggaatccactttatttggggatacttgcctgaagttctctcttttccctcttattacaccctttgcgtaacaataattggcggggtccttgttggtctatcacaaaaacatttcggtacatacccacgccttatgcctgaagtgatggctgaatataaaaaaactggtcgaatcgaatatcgctttgtccatcaggctactttaacagcgattattgttttaattttcggtgctagtcttggtccagaagccgcactagttggaattataggcggactgtgcacatgggtaggggatcgctttaaatttgccttaaagagtatgaatgagctaaccgagatcggaattggagctactttaagtgtcatttttaacgcaccattattcggttatttagcaccaaatgaaaatgagggggaacaaattgctgctttttctaaaggaaaaaaggcgattgtatacttagctactactttcgcaggtttttctgtttatttactactgagtaaactcgataatcgtggatcctttattgttgatttcggggaaggtgcactttcattcaatgaatggatcgcatttcttccacttgctagtatcggtgctatagttggtttcttttatttcaagttagaattcacattagagaagttaattcacccttttagggaatacaaactgacactcggaattatcggtggtattttattaggaattgcgggaacttttcttccgtacacattattttcaggtgagcatcaattaaaagaattagttgttgaatggagccatttatctttttggatactacttctttcagggattttaaagttgtgcattactgccgtttgtttgaacacagggtggcgaggtggacatatcttcccaattatattttccgggtcaagtatcggatacgctgtagcatctattcttcctatagatccagtagcatctgttgccatcgtaacgacagcaatttcaagctatgcgttacgaaagccaatagctataacattactattacttatgtttttcccgcttaatttactattgcccatgcttggtgcagctgctatcgggaatgcctttccgctcccaaaacataacgaaaataaaaattaataaaaataggcagtggggatgaaagctccactgcctatttttttattacacatgctgctttaataacgcttctaactcctcaaaattatgcacttcatatgtcggtataatcccactatcatttaatttcctttctggattaaaccaacaagtatcaattcccgctacatatccacctttcatatcagcgcttaatgaatccccaataatcagccctgcttcaggtgcaaagttaggaatccgttcaaaaacataatcaaaatactctttcatcggtttttgaaaacctgtatcttccgaaacaaaaacatctttaaataatgaatgtaaacctgcattacgcaaacgcttatcttgcgtcttagaaacaccatttgtcactatatacaattcatactctccttgaatttgatttataaattcaaacgcaccttgcatgagttgatttccttcttctaagtagttacgataattattttccaataatattccatctacttcttctccatactctttaaacaacagagaaaatcttgtatttacaacttcattgcgtgatagttctcctttttcaaaagcatcccaaagacctttatttatttttttataacgagcctctatctcgtctgttaaagggattcccttctcttcaaaaagcacccgtaaagccactttttcagccttttggaaatctagtaatgtatcatctacatcaaataacaatgttttatattttttcataaattcatcacactctcttttctacaaaaacaaatttacataaatcgtatcattcattcttgtaaagataataggagatatctcatactatacatgggggtgaaaatatgaaaatcagcaaaaatgaggaagaaatttatcaatacatgcgaatccatcaattccataccctattttcatttcatgtcttgccatatgtagagctgcattcttttcaaacgaaagagatgatatgtagcgaaggaaatgctctcccttatctctattacttaatttctgggaaagcaaaaatatatatgagtcataaaaacgggaaggtttcattaattaattttattcaagcaccatcttttatcggggaattaggattaataggagtagaaaatattactaagtccgttgaagtactagaagattgtgtgtgtttggcacttcctcttaaagattgtcagcaacttttattacaagatgcaacgtttttacagcacttatgtaaatttattggagaaaagacaattactcgcactgaaaatcacgcaaaaaactatagttatccttttgaaaatcgattagctgcttttattttattaacagagcaaaataattgttatatagaaaagcataccgaggcctcggaatatttaaatgtcagctaccgtcatcttttatatgtattaaatcagttttgccaactaaattatttaagaaaagaaggccgaacatattatatacaagatcgaaatacattagaaaaacttgctgatgaactaaaaatataaaaaaacagcattaacgcttacatgttaatgctgttttttcgagtgacgattatacttttaattaaaatttacttgctactttagctgcttcttcaagacctgcagcaatgatttcttctgctttatctgggaattggttatgcccttcaataactactgtttccatgtttgttgcgccgaagaagcccatcatacttgctacatatttaacagccatttctacctcagctgctggaccttctgaatatacgccgcctcttgcatttaataatgcaatcttcttatctccgattaggccaactggaccctctggcgtatatttgaacgttttaccagcacggtttaaataatcaatatatgtgtgcaatactgctggaatcgttaagttccataatgggaagccgaaaacaactttatcagcttctaggaattgatttaaatacttatcagcaactgctactgcttttgcctcttcttctgttaaatcaaatcctttacctaccttgaatgtaccattaatcatatctacgcctacatatggtaattcttctttatataaatcaagttctactactgtatcatttgggtgtgcttctttatagtttgctaaaaatgcctcatataattttacactaactgcttgttccgctggacggttatttgctttaacgaataaaactgttgccattatttattcctcctagtactcactcttatgttgttatatgctttcaaaaaaggtatcccttgtaattgttgttttgttgcttacaaacatattttatctttatataatgacaatttcgtcctcacatagacgtatttttccataaaaaaagtccaccttccaaaggcgaacttggtcttacgactttcgtcttatacaattccatttttcactgcatataatgccgcttgcgtacgatcagataaattcaacttactcaaaatgctacttacatgcgccttaaccgtcttttctgtaataactaaaacagatgcaacttccttattgctcatccctttcgctaatagctgcaatacttcattttctctcgctgttagcacatccacttgaatagaaggttcttcttccttttcttctacaggtaatgtttgagagagaagagcatttgctatatccggatgtaattgaatattacctttatatgcgcttcgaatagcctcaacaagctgatctggttctacatcttttaaaatatacccacttgctccagcccttaatgcaggtaacacatgcgcctgatcagaaaagctagttaatacaattactttcacatttggatactcttttttaatatatgccgtcgcctcaacaccatccatttcaggcatgtataaatccattaatataacatcgggagttgtttctcctactttcactaacgcttctttcccattattcgcttctccaactaactctaaatcttcctgtgtacttaagaaaaatgctaatccttttaaaacgactgtatgatcatcaactaacaatacttttattttcacaaacttccctcattttcacatcataatggtacatttacttttacgctcgttcgtttattactacttacaattttaattgttccaccaactaattctactctttcacgcatcgtagtcatacctagtgatttcttttcttttatattcttttccacaaatccctttccttgatcaactatttctaatgatacatttttctcattcactgtaaaataaatcgtcgcttcttttatacctgcatgcttacttacattgttcagtgcttcttggcctatgcgccacaaagcttcttctactacacgaggtaaatcacgaacacccgtaacttgctccctaattttcagtcccaaattttcaccgtactgctttagagctggcaataatcctttttctaatcccgccggacgaagctgccaaattaatgtcctcatttctttcaaagctccttgcgcaagttcacgcatctcatgcaaagattgatctaccttttcatttttaccttttaaaactgcctcggcgccttttgtcatgaaggttaatgaaaataatttttgcgaaacagaatcatgtaaatctcttgctaaccgatttctttcttccattcgcacaagttcacggcgctgctcgtttaacctcaaattctctattattaacgaaacatggttcgataatgcttgaattacgtctattgtattagcatcaaactctccattattcaggctaacacataaaacaccaaatatatggttttgaatatgtattggtgtagcaataacagctcgatttagatgtacattatgtcctatttgatgttttattagaactggttcatcttgttctaacgccctcttggccgcctcttttatatcctcttttaactcttcctgaacgtaagacgctcgcagagataattctttttcctccctaataaaaagcgctacttgattccattgaaatacttcacctacgtgatttaccactttttcaggtagtacattaaacttatgaatcgtttttaagtcttgaatgaaacgctctaatttcacataataatgggctcttctcttttcatttccatataattttgttcgctttaaagccgtaccaatttggaaggcaaccgattggagtaatactaattcttcttctgaaaaatgtgttttacccggacttgcaacatttaacaacccaaatttttctcccccagcttttaaaggaaccgtagcatgatgaagaatgccctccgtatccccccaattatattcaattgcattattaattcttttacattcaataatattaacggctctctctaattttccatctacaaaacctcgtaaacaccaacattcaccttcgcacatcgggcgtttattttcatatgtaagtgcctctggtaattgataatcaattaacttcgtatacttcccattttcatccgcaagaaaaatccatcctgtcgttaaacctgttacacttagtaatttctctaggacagcttgcaatacatgatatgtatcatttgatgtatttaatgtttctgcaatttcctttaatataactaattcatttgtacgattatctcgaaacatactcagtctcctgcatacaagattttaaatagctcttaaaataaatcatctacttttcactttgtacttattcgtaacattgatataatggtgagaacatagttttcattatatcactcgagggggctttcataatgacattaaataaagcacttactatcgctggttctgacacaagtggcggtgctggtatacaagcagatttaaaaacattccaagaactgggcgtatacggaatgacatctcttacaacaatcgtaacgatggatccacataacggttgggcacataacgtatttccaatcccagcttctacattaaaaccacaattagaaacaacaattgaaggtgttggcgtagacgctttaaaaacaggtatgcttggatcagtagaaattattgaaatggttgcagaaacaatcgaaaagcacaatttcaaaaatgtagtagttgaccctgttatggtatgtaaaggtgctgatgaagcattacatcctgaaacgaatgattgcttacgtgacgttcttgttccaaaggcattagttgtaacaccaaacttatttgaagcttaccaattaagtggcgtaaagattaattctcttgaagacatgaaagaagcagcgaaaaagatccatgctttaggtgcgaaatacgtcctaattaaaggcggtagcaaacttggtacggaaactgcaatcgacgtcctatatgatggagaaacattcgaccttctagaatcagaaaaaattgatacgacaaatacacacggcgcaggttgcacatattctgctgcaattacagcagaacttgcaaaaggaaaacctgtgaaagaagcagtaaaaactgctaaagaattcatcacagctgctattcgttactcattcaaaattaacgaatacgtaggtccaactcaccatggtgcatatcgtaaatttgttgtatcaaaagaacttgtctaatatataaataaaaaacactcacaaagttcatacattgcctctgtgagtgttttttataagctttatgtcttctggtcatcttatctttaagatacagagctgaccttatttctaccatttcgtttcgagtagtataacgcatcatctgccgcttgaataaattgctccggtgattcttcatattctgaaacccccaccgaaactgtaatttttattttcgtttcatctaacaattgaaatgagtgactttcaacagctgtacgaatttgctcgcccgtaagaattccgtaagctaatcccttattcggtatcaaaagtgcaaactcctctccaccctttcgaaaagccaaatctggaaattgtgaagtttctcgtaaaatacatcctacttgttttagcacttcgtcccctgcaggatgcccgtacgtatcatttacatacttaaagtggtcaatatctataagtagtaaacaaaacgaatcatttttcatgttcttattactaatatgacgattcatctctaaatcaaactgtcttacgtttcctaaacctgtcaatgcatctatcgttgcgtattgtttcatcttttgaaataactcattggattgtaaaacataatttgcacttatgaatgttatgtaacctgtaataatactagaaattaaatataatcccactatgtggatctctttaattaaccatatatataacgctgggattagaatagataaaatatatgtgtgtaaccatacccactttccccctaaagaaagcttcatgcgcgaaataaagatactccctattcctatcgcaatgattgtataaaaagccacttgagaagctaatgaataatccataaacaacagcctagttactaaaatcataccaattgttatggtactcgctatcggtcctccaataataacagctagaataacagctaagtagcgtaaatccaatagaatggtaccaacacgaacactgaaatacattaatactatacctagtatcccagtaaaaatgcctactacacatttctgcccaaaagagaatccttcttttaacggcttatcccttaaaagctgacctccaataaaaataaaggaaagaataattgttgtatttacaaataagtcccttaacataaaataatctccctacttttccatctatccccttcctcaccttattgtatacgaaatacctttaattcccaaatattttgtttatttttgctgttccacgtgaaacagcaaaaaaataaaaagggcgaaaactcgccctttttcattaacaacagcgtgatatttttccaccctttgcattaaatcttgcttcttgtgcctcagcaaaaaattgcttttgacatacaacctcttcttcaggatgatgctttttcatatgctccacatatacttcataacttggtaccccaacgagcaaactaataaagcgttttctttcaccccatacttgccacaactttttaagcatagttcctcgactcactttcatctctaggaatatatggtgcctcttttaacggcattggcttatttcttaatacttggatccaaattcgaagtgctgaaattaacacagcgattacaactatcataaaaattccgcaaagcgccgcatcgatataatcattgaaaataatttgcttcatttgagcaacattttttgctggcgctaacacttttccctcatctaatgctccctgaaatacctttgcatgcgatagaaatccaattttaggattttcatgaaatagcttttgatatcccgccgtcatcgttacaatcagcaacccgacagttggaataagtgttacccaaacgtacgccttttttcccattttgaacaaaattgtcgttccaagtaataatgcaatacctgctagcatttgatttgcaataccgaaaagtggccataatgtattaattccaccgagcggatctattaccccttggtataagaaatatccccaccctaatacacataatgttgtagcgattacattcgctaatgtagaatccgttttcccaaatggcttatatacatgccctaaaatatcttgaatcataaatcggccgacacgcgttccggcatcaattgttgttaaaatgaatagagcttcaaagagaatcgcaaaatgataccaaaatgccatcatggccgttccacctattacttgtgagaaaatatatgccatacctatcgctaatgttggcgcaccacctgtacgtgataaaattgtttgctctccaacatttacagcgagatcttttagttcatttggtgtaatagcaaatccccatgaggaaataacttgagctgcctgcgaaacatctgtaccgataagtgctgcggggctattaattgcaaaatacgttcccggtgttaatacacaagccgcaatcatcgccatcgctgctacaaacgactccattaacattgctccataaccgattggctgtgcgtgtccctcttgctcgatcatcttcggcgtcgtacctgatgaaacgagagcatggaatccagacactgcaccacaagcaatagtaataaataagaacgggaataagtttccagaaaacacaggaccagttccatcaataaatttcgaaactgctggcatttgtaaatctggtgctacaattaagataccgattgctaaccctacaattgttccgacttttaaaaatgtacttaaataatcacgtggtgctaaaagcatccaaactggtaatgccgatgcgataaatccatatacaataagcataatagcaattgtttcaccactaaatgtgaacatacttgcaagtgttggattttctgctacatactgtcctccaacaagagataaaataagtaggataataccaattactgatccttctccaacacgaccaggcctaatatagcgcatataaactcccattaaaatagcgataggaatcgttgctgctatcgtaaacattccccaaggacttccgattagtgcctttactacgactaacgctaatactgctaataaaataatcataattcctaaaatacctatcattgcaattagtcctgtaacaggtccaatctcatccttaatcatttctcctaacgatttaccattacgtctcatcgaagcaaataaaatgacaaaatcttggacagcccccgcaacaactaccccaacaataatccaaatggttcctggtaaatatcccatttgtgctgctaaaatcggtcctactaaaggtcccgccccagcaatcgctgcaaagtgatgtccaaacaatacccacttatttgttggaacatagtctttcccatcgtttaatgtatgggctggtgtttgccgattatcatctaaattaaaaacctttctcgctataaatctactataaaagcgataagcaactgcatatacacatacggcagctactaagagccatacagcattaatggtttcaccttgtgataaagctactaccccaaaagcacctgctcctactgctgtaataatgccccaaagtaagatcgattt

SEQ ID NO: 1310 - DNA, 9193 bp, Bacillus thuringiensis
  unsure (1)...(9193): unsure at all n locations
tcgtcttttttagcgagctttatatgaacaatattgagatataccagaggagttgcgaaaacacaagttttccgtttatacttgaaacaaaaccgtaccatctcataaaaacatatgatatactatagaataattacaacataagaactattaaaaacagattcaacagaaatgctgctatccattatggatggcagctttcgtcgttttataggggtttcgattttgattatttttctcaataagaatgcggaaggagcgggtagtaatgaactcagaagtaaaaacgttacagtcaaaagaaacaatttctcatccctctttatgggacacattaaaaaaacattatgaacttgtatttgcagtagcatctggtatttttattttagttggctggttattcacaaaaaacgatgtaatgaatgtaggtattacttgctatatccttgcttatatagttggtggatatgcaaaagcgaaagaaggcattgaagatacgattgaagaaaaagagctaaatgttgaaatgctaatgctctttgcagctattggtgctgcaattattggctactgggcagaaggggctatcttaatctttatctttgcgctcagcggtgctatggaatcttatacattaagtaagagccaaaaagaaatttccgctcttcttgacttacaacccgaagaagcattacgcatttccaacggaacggaggaacgtgttcctgttggagagttacaaattaacgacattattttaattaaaccaggtgaacgtgttcccgctgacggtacgattcataacggtgaaacaaatattgatgaagcagcaatcacgggagaacctattccaaatgagaaaagacatggcgatgaagtatttgcaggtactgtaaatttacgtggtgctatcgaagttaaaattacgaagccaagcgatcaaacattattccaaaaaattatccgtctcgtccaaagtgcacaaagtgaaaaatcaccatcacaactattcatcgaaaagtttgaaggaacatacgtaaaaggtgtactactcgttgttgcgcttatgatgttcgttcctcatttcttacttgactggagctggaatgaaacgttttatcgcgctatgatcttacttgtagtcgcatctccttgtgcactcgttgctgccattacaccagcaacgttatctgcaatttctaacggagcaagaaatggaattctctttaaaggtggcatacatttagaacgcctcgcttcagtaaaagcaatcgcctttgataaaacaggaacattaacagaaggaaaacctaccgtaacagatgtatatgttcgagaaaatatgacagaaaaagaagtactttctattacagcatccattgaaagtcactctacacatcctttggctgcatctattgttaaatatgcacaacatgcgtacgacattacattaaaaaaacctgaaaaggttgaagatgtaactggttttgggctaaaaggaatattcgaaaacaacgcttataaaataggtaaagctgattttatcggtgaagaaacaaaaacatttcataatggtatttctgcctcacttgaaaaggaaggtaaaactgtcgtttatattagtgatgagggaggcattcttggacttatcgctttaaaagatacgcttcgccaagaaacaatagctgctattcgtgaattacaaagcattggtgtcgaagcaattatgattactggagataatgaagaaacggcaaaagcaattgcctctgaaagtaatataaaggaatattacgcatcatgtttaccagaaacaaaagttgaaacgattaaaaagttaaaagaaaaatacggtacagtagcaatggtcggagacggtataaatgatgcacctgcactagctactgctagcattggtgtcgcaatgggagaaggaacagatgtagctttagaaactgcggatgttgtactgatgaagaacgaactatctcgtctttcccaagcaattcgtttatcaaaacgaatgaaccgtattgtgaagcaaaacgtaatcttttcgctagccgttattgccatgctaatttgttcaaacttcttgcaatttttagctcttccattcggtgttattggccatgaaggaagtacgattcttgtcattttgaatggcttacgattattaaaaggcagcaaataaaacgggtccctcatagaggacccgttttttttaatgatagctattatgaccgttcgcactgctactcgttttatgctttggatgcgaactgctcttttgtttattattacttttattattatggttctttttattattactcatgaaatatcccccctgttcctttttattatggaacaagagctcattattcattacgggaattattgtcaccggttctataatggtggagtaaaccattaatttcaccgccaagtaaaattacccatccagttaagtaaaaccataacattaaaataatgataccaccgagaccaccatatgtattggcgtaattcgcaaacttatctacataataagcaaatgagtacgataccacaatccatcctacagtagcaaataacgcccctgaaataacttctcttctttttaactttcgatctggggcaaatgtatataagaaactaaacaaagcaaatagcacgaagaaactcgctactaatcgtgtaatgctccacacgaaagaaaaactatctgataaaccgagtgctttaaacactgctgctccaataacttgtccgaataccggaacaattaatgcaaagacaatcataaaaataatagctaatgtaaacacaattgataacgctcttgttgtaataaaagaacgtgtttccttcacgtcataagcgcggttaaaagcattcataaccgcattaacaccatttgaggcaaaccataacatggataataaaccaaatgataataaaccaccattttgctggtttacaactttatctacatttacctcaattaagttcattgcatcatctggtacataaacctctaataaactaagcacatcctctgtttgaatgggaataaatccaagaagcgtaattaagaaaacgagcccaggaaaaattgcaagcaagaagaaataagcgagctgtgctgccaagcccgctacatcatcgcgcatcgtccggtcatataaatctttaccaaacgaataagtacgatttcttctcaccttttctaaaatttttctcatatatgtttaaacgcttttcttctcttctttatcttgctttaactcaatgtacgcttcagtttttttttccactgcatttgagtctttcataaataattcacgcgcttctttcataccaccatcttcagcaactactggctcttcttctgctttcagctcatctacctttggagatacagcttgaatttcaatcgtttctggcttttcttctggctcaacttttttcttactaaaaatttctttcgtttcttttaacgtctctacaacagatggcgttaattttttaatttctgctactttcgcttttaccacattgaaatcagcaagttcgcgtcctttatctgtaacagtttgcactttttctttaatctttgcattttcaccaatttcaatcatctttgtttttgctttttctgctgtattttttactttttcacggttttctttctttaacatggatacagctacacctgccgctacaccaatcgcaatgtttcgagcaatattatttttctttgccatattccttcaccctttcatttcttatgttagaaagtatttctttctaagcttcctcatattccttgttcatttcgaatgaaagctaatagctttgcacacccttctgttacaaggtcatatacttcttggaaattccctgtatagtaagggtcaggaacgtctgtccagccaccgtctggaacaaagtcggacagcctaccaatatagcctccagttttacctaaactttttaaatctgctatattcttgttgtccatggcaataatataatcaaactttgttaagtcttctttttctacttgccttgctttaattccttcaaaagtgactgcattttcttttaaaattttttgtgttcctttatgtggcggatggccaacatgccaatctccagttcctgcagaatcaatgacaattttctcttcaagtccctcttttacgacaagatttcgaaaaatcgcttctgccatcggagaacggcaaatgttcccaagacaaacaaacaatacttgaaccatacttttgtttcttcccttcttggtgcatttctttatatatacttatagtataaacaaccaattattaaatataaaggaaatccctactaatttaatgggattgaaaagattcattaacgaaaatgataaaaaatgttaagatagccttatgttattttaaagggggacacttcggtggatttatccgtaaagtcagaagaaaacgttgaatatatggtcgaagctattaaagaaaaattacgtatggttaatgctggagcgatgagagctgctagttttaacgaagaaatgtacgaagatttacgtgacatttatgatcatgttatgaaacgtgaaacattcagcattagtgaaatgcaagctattacagaagaattaggtacattaattaaaaagtaaaaaagcctctcttatatgaggctcttttttatttccaacaaattcatgacaactcttctctttccctcaaccaactgtaaaatattgtacaatagaagtagaacctcaccttagatttttctccatacatactactcacaaataatagcaacactaccattgctaactgtttttactggaggtgcttacttatgagcaattggtacagtaagacgaaagatcaaacattaattgacctagaaacaaacgaacaacacggtttaacagatgaaattgtaagtgaacgtttaaagcaatacggttctaatgaattagctacaaaacaaaaacgcactttatggcagcgtattttcgcccaatttaatgacgtcctcgtatatgtccttattattgctgcccttatttctgcctttgtaggtgaatgggcggatgccagtattatcgcgcttgttgtagttttaaatgctgttatcggtgttgtccaagaatctaaagcagaacaagctttagaggcactaaaaaagatggcaacacctaaagccatcgtcaagagacatggtgaactaaaagaaattccatctgagcacgtcgttccaggtgatatcgttatgctcgacgccggacgatatatcccatgcgatttacgccttattgaaaccgcaaatttaaaagttgaagaatctgctctaactggtgaatctgtccctgttgataaagatgcaatctaccacccttccatgcaaagtgatgaacaagtaccactcggcgatcaaaaaaacatggcctttatgtctactcttgtaacatacggaagaggcgtcggtgttgctgttgaaactggaatgaactcacaaattggtaagattgctacccttttacatgaagcagacgatgatatgacaccacttcaaaaaagcttagcacaagtcggaaaatatttaggctttgtcgctgtagctatttgtatcattatgttcctcatcggttttttacaaggccgggatacgttagaaatgtttatgactgctattagtttagccgttgcagctattccagaaggcttgccagctatcgtttccatcgttcttgcaattggtgtgcaacgtatgattaaacaaaacgttatcattcgcaaactaccagctgttgaagccctcggttctgtcacaattatttgttcagataaaacaggtacgttaacgcaaaataaaatgaccgttactcacttttatagtgataacacatacgatcgcttagaaagtttaaatgtaaataatgatgcgcaacgtctattgttagaaaatatggtgctatgtaatgatgcgtcttataataacgaatcacaaacgggagacccgactgaaattgcacttctcgttgctggaaccacttttaacatgcaaaaagattatttagaaaaaatacatgaacgtgttaacgaagtacctttcgattcagatcgtaaaatgatgtcaaccgtgcatacatacgatgaaagctactatagcatgacgaaaggcgctatcgataagctcttacctcgatgtacccatatttttaaaaacggcaaaatcgagattttaactgattctgataaaaatcaaatattagaatctgccggagcaatgtctcaagaagctttaagagtactttcattcgcatttaaacaatacaattcaaacgatatggatataaatcatcttgaagaaaatcttatctttattggtcttgtcggtatgattgatccaccacgaactgaagtgaaagattcaattaaagaatgtaaaaaagccggtattcgcacagttatgattaccggtgaccataaagataccgcctttgcaattgccaaagaacttggcattgctgaagaacttggcattgctgaagaaatatcggaaattatgattggaactgaattagataacatttctgatacagaactagctagcaaaattaatcatttaaatgtattcgctagagtctctccagagcataaagtgaaaattgtaaaggcattacgcgcgaaaggaaatatcgtttctatgactggtgatggtgtcaatgatgcaccatctttaaagcaagctgatgttggcgtagcgatgggcattacaggaacagacgttgcaaaaggggcagcagatgtcgtgttaacagatgataatttctcatctattgtgaaagccgttgaagaaggtagaaatatttatcgtaacataaaaaaatcaattctcttcctactctcttgtaacttcggagaaattatcactttatttttagccattttactcggctgggcaacaccactacgacctattcacattttgtgggtaaatttaattacagataccctgcctgcattatcacttggggttgatcctgaagatcctgatgtgatgaaggaaaaaccacgacatgcgaaagaaagcttatttagtggtagcgttcctttccttattttcaatgggattgtcattgggcttttgacgctaatagcctttatcgccggagcaaagttctatactggagatacacatttattccctcttttcccagagcaaattgatgaggatgctctattacacgctcaaacgatggcatttgtcgttcttagtttttctcagctcgttcattcatttaacttgcgttcaagaacgaaatcaattttttccattgggatctttacaaataaatatttagtcttctcccttcttatcggtgttcttatgcaagtttgtatcatctccatcccgccccttgcaaatatattcggtgtacatgcattaacgatgcgagattggggatttgttctcttattaagtatcattccacttattgtgaatgagattattaaattagtgaagagaaactaaaaggcaatgaggaatagtcctcattgccttttcatttaccctactattttccgtgcagtaaaactcccacctcaaaattcagtttgagcaaagaagttaggtggtagattaactgcccataaatgtccaattgtgaaggctaataatcggtggggatgaacaaaaccccactgattaaagtttcactttatccttgtaattcttttttgatattctctgttaatgtagccatacgtttgcggctttcttcacgctcacgtttgttttgttcttcaatttgttgtgtttcttgcatacctcttgaaataatgttccaagtttcctcaagtgtttccatcttaatactagaagaacctgataatctcgctacttctacactttgcgttgcgatattttgtgcatttttcttaagtaattcatttgtacggcgatccagttcagccatagaatctgcaacaagcttttgacgcttcgcatttaccgcttgaatgataccatttttaaaaataggaatcgttgtaataaatgctgtattaattttaccaattaatttattattaccacgttgaatcatacgaatttgtggtgctgtaagtagcgcaaccatacgcgctttttctaaatcatcaatacgttgctctaaaatttcaaccgagtttttaagcgactctaattcaatacctgctaattgatcattattacgcacacgctcttcatacatcggaactaactctgtatttaaacgctctaataacatttctcctgctactacgtacttctctaagtctaaataatattttaagttttgctcatacaagccatctaacgtaccaattgattttttcatctcatcttggtacttcgtaatttccacatacactttatcaatttcacggcccatcgtttgatacttgctaaagatttgttcaatcattttatccgcttttttgaacatacgtgagaagaaaccacttttctcttccgcaaagtctttgctatcaaatctgtccataattttaccaagctgttttaataattcaccagaatcttctatctttgataatgacattgtatgtaaaatttgatcagcaaaacgtgaaatttccatagaaggttcttttccaagttcaattaattctaattgatctttaatatctactgcattataaatacgttgtacatccgcatcttgtctaagttgcaagcgaatatcttgtgctggttgctcatttaattctgttttcggatctagtacgactgggttattcatatggtattctccctttccttataaaaatggacgaaatagtccttttattgtttgtgataaatttttataggctgatgaaccatgaaactcaagatcgaaattaacctcttcaagccaatgggaatcaaatgcccccgcttcaatatacggttcaatatcgtttcttcccgttggattgaaatggaatacatctactccaatttgatttaaaaatagtaataaaacagcatcagaacgagttaactctccactcttctcattattaaatataacaattttcggcacntcccgctgaataatccgatttctcnggctgttctnnaatatacgggngaatttgngggggttgcgcgtcaacat

SEQ ID NO: 1311 - DNA, 13639 bp, Bacillus thuringiensis
tatgctaaagttctcttatttcttaacagcttctactctataaaacttctgttataatccttaaatgtttacccttcgccttataggcatattactaaaactctgcgtactaatttatttgacgctctttacataactaattgcctgacttcccatttgtacccatgcctgttcaaaggtttctctcggtacttttacatctaagctatcctcaagtggatctcgaatatatacaaattcctgatcatatccaataagtacaacacaatgttcattatacgtaatagaaacatctgcactatttgtttcccatgtagtaaattcagctgcatctaatggtgcaaatgttgcatttgcgatcatgactacaggttgccctgcttttatcctcttataaatttcttctatattcttccctgttaagtctacagctttattaggtaaatatttttccgctaactgaaaaagtggcccatgatatacaccatatcccgattcagaaaatgtataaatattacctacaaatccttcatttggattcccgcgcacaccatcgtctataaaatcaactttttttatttcatttgctaatgtcatcttatccactgaaacaccagcgtattgtaacatcatcgctaagcttgtcacttcacagcctctatctagctctggtagttgctgaattaatggtacacttgataaaatgaccttttcatcattattactaaattccggttctttcccgttttgtatattgaagaatgtccacttctccccatactttgtaattccatttgtatatacactccataccgctatagctagtaatgctatacatatataccacttaaacctccgtatcactctcacgccctttttagttcgttaaataagaataaaatgcgtcagcatccgttcgaatcactggtacaaaatttagttctttttctctctcaggttgatctttttttattttttctgttagctcttgaatattcatgttcgctttatccatattaagctcatctgccaattgtagcaccttttgttcattaatttctcttaatacttgatatatatctttcccatataaatcaatatgatatttttttgcttcttcctgcactttttgttcgtacacctcttgtgctaacacttctatctcttttccttttggtgaaatacctaacttccctgcttcctctcttaccttcgttccatagatttcttctgcaatgtcctctatttcttttccatttgtcgaaatacctaatttatccgcttcatcattaattttaatcgtattaatttgattaattaaatttacaattgatgtattttctatagatatgcctagttttaacgcttcttgctttacttttgtttcatagatttcttctgacagcgtcccaacatcttttccttcaatcgaaattcctagctgcttcgcttctcttcctacttctgtctcatgaatttctttttctaacgtaatttgttctttcccttccgtttcaatacctagattctctgccttttcttctgtatgcacagcatgtatctttccattatttaattgttctttactacgttgtgtgtaatctgtctttccttttgatgtttcagaaggagaggcaccccctaatatacttaagctcattactccaatagtgaataccgtcatcattttctttttcaaaattaattcctccctcttatactttctttcccatcattcccctagtttttttaatactatacatacatctcatcgctgcttgagataacattatgattgataaaccccactcacatacacctagtctcttcttcatgtaacgaactttcttcatgccatatataatataaatagtttcttaactttgtcttaaaaaaagacgaccttgtaaaaacaagatcgtcttcttacttatattttttggtttttagggaaaatcacttcaaaacaagtgccatctccccatttgctctctactgatatttttccgtaatgcttttctacaatccaatttgcgattgaaagacctaatccagctccttctgacgtacttcttgctctatccccttgataaaaacgatcaaataatttcggaatatcttcttctttcactcctatcccgtcatctttcacctgtatgcgaatcgaactactcgtctgcgtgcaatcaatttgaatatgcccgccttcgtttgtatacttcatcgcattatctaacagtatgaccatcatttgatgaatccgctctctatcagccataaaagatacgtcacgttctacttttagtatcatttctttttcttgataagaagcaatctctttatatggagctactatttcttctaacaatttatcaagttcaaatgtttttttatccatctcaatttgattagaatcagaacgtgctagtaataataaattactaacgagttttgataaccgcctacattcttttgaaattgtagaaatatccatcgctttttcttctatcgtagcggatggtgactgaaataacacatccgtttttgattgaataactgcaagcggtgtccttagttcatgtgatgcatcagaaacgaattgctgctgtttctcccatgaattttgaataggtacgagtgctctgccagctaggaaaaagccgatacctatcgcacataaacttcctatgctacaacctataacgaggattaaaaataaagtatttaacattccttcttccgctgttatatctcgcacgatttgaactatttctccatctttttgaagcgaaaatgctctaaaatatcgtccttgtactttgatatcttgtaactcccctattttttccggagaaaacttttccaaattctcttcaaaaattgaacggaatttacgattatcgccctctattttcactattttcccattccaagttattctagttactcgcggatctccaatttggatattctccatacgttttcttggtggtattttaacatctaatttttctctatactgagccatcatttttatagattgatccacttcattataaatacgcttatatgtgtatgaataaataatactacctaatatacctattaataggataaatactaatgaattcactatagtcaaacgaatgcgtgtcttttgaaacatacttccctttttcattgttcttttaatatatatccaatacctcgaacagtttgaatatctttctgataaccgaatggttctaattttttacgcaaatgatgcacatacacttccacaatggctactgtcgtatctgaatcaaatccccaaacacgatcaaaaatttgttcacgcattaaaatcttcccgctattttgaatgagatactctagtagctcatattgtttcaatgtcaacttaatactttgtccatctacttgaacgtctttatcttttccgaacaattcaatccctttataacgaatcgtttgctgcgttgttaaactaccacttctgcgtagtaaagcgcgaattctcgcttttaattcaggggcctgaaatggcttaacgatatagtcatctccaccaaaatccaatcccttcacccgatcttctaaagaatctctcgctgtcaaaaacaggactggtgtttcaatcttttcatcacgtattttttgaattacttcaaatccatccatccctggcatcatcacatccagcaaaattgcatcatatatattttgaagcgctaaaaacaatccatcttctccatttattgccgtatctacttcaaattcatcacgcaaaatttgtacgatagactctaataacgaggcattatcttctactacaagtaagcgcatgctctcaccttccatcaaatagttcaattctatttattattacatttcttctcttcataacaaaagaatgtagttacattacgtattttcatttttaactatttccttctaaaattttgaagttttattataaaaactttgtcttaaatttagcttaataaaaaattgaaagaaataagattcctcttatctctttcaattttttattacatatacctttttactcggcaattccaaacaatttagctgaccaccgtacacagccccgccatcaattccaataatacgattactaccaaaatacactccgcactcctcactaccatgaagcgtttttgtttccgtatgcccaaatacaacaaccttttcaccgctatatccattatgaaattcattacggatccacattaacgtatatggttcagattcagaaactcgtttcatcggttcaaccccagcatgtacaaatatatactcttctgtttcaatgtaatgatctaattcttgaataaactttatatgttcctctaatacacgggagtgtaaaatcggtttttggaagtctttctcattaaccgcaatatcttcttctacaaatccatagctatataatgtcttatctccaccatttctttttacccaatggttccatgaatgttcctcatttgtcgttaacgccttaatcatcatatcttcatgatttccctttaaaatgagtgctccctcttctttcaattctcttaccttttcaattacagcacgcgcatttggaccacgatctacataatctcccagtaagattaattgatcctgtttcgcatcatattgagcttcttccaataactgttcaaacttttttatctctccatgaatatcactaataacaagaattcttttcatattatcccccctctttctaattatagttcaaaacggcagaaatttctgaactcaaatctaaaatcacatttattacaaataaaatgattatccttacaacgatgtaagtctcttgtcatccaattcgatagttgtaattactgtatttccttatactgaaagtaagaaatgaaacaaaaaacaaggagagatgagagatgaaaaaagtaatggaagttgtagtagcggtagtagaggttttcgtaaatggtaaacaagtcacaatggagttaaataaataatgaaaaggacaacatttactctagaccctttactcatataaaagagataagacttcatcatttctttgatcccttatctccctataaagaaagccgtatcccttttaaggatacggctttctcttatttttgactcgtacgagctgaaatgctaattgctctatctgttgctttggcagcttcatctaacgcttctttactattcttcccgtcatacatcgcttctaatgcttttacaactgcatctcttgattctgggaatacactaattaaagcaccttgtgttgctggagattgcttcgttgcttgcagttgatctactgttactttcaactgtgggtatttttcatattgctcttttactaatggctcattatatgcatctggattaattgagaaatagcctgttgcagtatgccattttgcttgtacgtctggcttcgttaaatatttcataaagtcccaagcaccttgttgcgtttcttctgaaaccatattcgtcatccataatgatgctccaccaataacaacaccattttgtttcgaatcctctggatacggaatatatgaaacacctacattaaacttagatgcatcaattaaatcacgaacacctgctgaagaatctaaatacatagcaacttgtccagactggaacgcggcacgaatatcatcccaacttgctccatactttccaagtgcgccagctttatttaaatcatctaacattccaaatactttctgtccttctttaccgttaaataccgccttttttgcagcatccttacggccgttttcgttatctacatataaagcaccttgtgtcgctaacaattcttcaaagaaccaaccgtagttaagcatggagaatccatattgttttacatttccgccttctttaatcgttaactttttcgctgcttcttgtaattccgcatatgttttcggagctttctctggatctaagcccgcctttgcgaaagcatctttattataaattaatactggtgtagatgaattaaatggcatagaatacatttttccatcaactgaataataatttgtaattgctttttctaattttgacgtatcgtacttatctttttttatccagctatcaattggtgtgatttttttactatcaatcatatatttcgttgtaatttcactcgattgaactagagctggcgcttctttcgttgcagacatcgttctaaatttcgttaaagactcttcatatgttccttggaactctgcctttatctcatatttattttgtgacttattatagtctgcaacaagaccatctagtactccttgtgtttttccacccatcgcatgccagaagcgaattacagttttatcaccatttttttcaactggtgctacttttgcctgtgcttcaggttttccttctgttttactatttgaacaagcggcactagataatgccattgttgctgccattaatagagcagcaccttttttaactagactcatttaaatctcaccttctcttagttatttaattgcaccttttgttaatccttgttgtaattgcttttgccctaaaaatagtaaaatcaatgttggaataacgataaccgtaacaccggccattacgcttccccaatcagttgcaacttcttgagactgaagctgcttcacaccgatttgcactgttcttactttttcatcagtggtcactaaaagtggccataaatacatattccatgttgttaaaaagctatatactccaagcgtaataaaactcgttttacaatacggaattacaacgctgaatagaaatcttatatttccaatcccttcaataaacgcagcttcttttagttcattcggaagtgtcataaaatgttgacgtaacaagaaaataccgaaagctgttgcaaaaaacggcactgtcatcccggcgaaactattgatccagccaaagttttgaatcgttaaaaagttaggcaccatcgttgcttcccacggaatcagcatcgttgaaataaacaggaagaaaattaagtttctccctttaaactgaagaaaaacaaaagcataagctgctaaacttgatacgataagttgtccaatcataacgactgtcgatacaattaaactgttatataagtatgtaaaaagtggtactttttgaaaaatattaatgaaattatcaaaagtaaactgggtcggaaataaccttctcatttgaatatcgtctggtgtcataaaacttattaaaaatgcatacagtacaggaaaaaataccattactgcactaataatgagcagcatgtataataggaaattttgtttccactgtttaacaatcatttataatgcacctttctctcagcaaacttaaattgaagtaatgtagcaagaaaaatgaaaacaaataataccattgcttgtgcacttgctgttccaaattgatgattcacaaacgcctctttgtaaatcgagtacacaatcaaattcgttgcatcatttggtccaccgtgcgttaaaatatcaatttgtccaaagctttggaacgcactaattaatgttactgttacaataaagaataaagttggtgatagcatcggtaatgtaacacggcgaagtttatataaataactagcaccatctatagatgcactctcatataacgacgtatcaatattttgtaaaccacctaatataactaaaaatgcaaaacctgtattcacccaaactgttgtaactgatacagagaatagtgcccagtccggactcgttaaccatgcgattgcaggaaggttcatagaggctaatatattattaaataatcctacacttggatgaaataaaaatagccaaatcactgcactagcagctactgatattcccatcgtcgaagaaaacagaactcggaataacccaatacctcttacttttccatttgcaatcaatgcaagaaacaaagcaaatataatactcgtaggcactgtatataaaacaaataataaagttgattttatacttttgtagaaggctggatcagagaataagtattgataattttctaagccaacgaaaagattagcttccccatgtatatcggttaaataaaagctatagtaaattgtcctaaacaatggatagaacaaaaaaatcgaaaataacaaaatagatggcgccaaaaacaataatcctattcttaaatctttcgttctcccccataattttttcttttttgacacctttgtttgaactggtaacttacttacttcgatcattatttcgccaccactttcaactcttcttcagctaccacttttaagcgttcattcgtgttttcattaaagaagcataacttttcttgcgagaataataattttactttgtcacctttgttcaagagtaactgtccgatgactttcgcactccaagttgttccatttaccgcaaagttcaatatagattcattccctaatacttctacagattgcaacgtcacttcttgtccctcctcagacagtgcaatatgctcaggacgcatgcctatgcgaattgttccttctggtaattgctttaactgtctaatagataatggaatttgcaattgccctatatgtaatacacctttttctttatttacttccccatcatttatattcatagaaggagaacctataaagcttgcaacaaattcgtttgctggttcgttatatatgtcaagtggtgttccaacttgctgtatacttcctttatttaaaaccatgatacgatctcccatagtcatcgcttctatttgatcgtgggtaacgtaaatcatcgtaattcctaatcgctgctgaatttctctaatttcaattctcatttgcgcacgtaatttcgcatccaaattcgaaagtggttcatccattaaacagattggtgcttgactcacaattgccctggcaagtgcaacacgctgtctttgtccgcctgataattggcctggtttcattttcacatactctttcagtcctaccatttcaatggcttccattaatcgcttttgtcgctcttctttttgtacttttcttaccttaagtccaaataaaatattttcttctacagataagtgtggatataatgcataattttgaaataccattgatagattacggtctttcggctctagatcatttgcaacacgttcattaataattaaatctcctgaagaaatctcttctaagccagcgatcattcgtaataatgtgcttttcccgcatcccgaaggtccaactaaaacaaaaaattcacccttcttaatatgaaccgatacgcctttaaccgctgtctcttctgcatttttatatacctttgaaacatttttcaattcaatcacaaggttgcactccttttttcttcttgtatccatacttcataatgacttgttgaaatcgcacttgctcctgcatgaattgcaatttccgcatcttctcgcgtttgaatcagcccacctgcaataataggaaactctatttcctctactagctgtttaattatagaaggcataatccccggcataatctctactgcatttggtttagtcgttttacaattttcaattgatttagtaagggataaagtatctacaataaaaatacgttgaattgttttcaatccaattttattagcatttcgaattgttgaaccctttgttgaaataataccttgtgccccgataacatcttgaatatacaaaagcgcttcctctgtattcgtatttaagccttgtataaaatcacaatgaagaaatacatcatgtccatgtttctgcaattcatatacacgctctggtaattccagcattgaaccagtcataagaaaaacttttttcggcaattttttgtatgctttgtatcctttccaatcctttatcatcgcaatataaggttctttaaacatttttccacctaactgttctatttttatccaaactaaaaacacctacttacatagaacgcctttctccttatttgaactctagggaatagagcacacctaagaaagtggcacattatatgtaagtgggtgttctcaaatgttctctaccctatttattttgttacctttactatattacgcatttattaagtcagttttgatagattgttaattaggtgttaatcaaatgttaatattcaccatattttcttaatattaatctagatatacaaataaatcccaacggcaaacaactatctttaaaatttaagtgatatgtaaattcattccatagttaataagttttagttttctcgcaacggcttgtgaagcataattattccaagaagtactataaagtggaatgcttttttcttcttttattgatatcgcccaggctgtaacaccatcagtaccatatccgttcccttgaaactccgctaaagtttccacacttgcctcagcagctacgggcgtacttctggcactgcaacaaacagaaactaccttttcattttttacaattgccaaataaggttgcctccttatttactccatttaccatccattcataatctatttttcatattcaaaataaaaatcccattcaaatacacattactgaatccatcatactaactgatttcttcattctgtctatctaaatgggattatttttcgttttttactctactggctgttgtggctgtactacttcattcgctccagctaccctcaacatatttacaatatctttaaaacctcttttttcagcgtattgcagtggcgtcagatgttccttgttagccatgtttacatctgcaccgtgatcaataagcaattgaattactttcttatggttttcactaccatttcctaatacaattgcttctaataacgctgttccaccacgttcatttgtataattcacatcaatatctgtatgctctaataattctttaacaacctctacatggccacgctcagatgcagaaataagtgctgtcccacctgacctagtcgtttctttcgtattaactcctgcattaattaatacttttacaatatccgtatatccttctctacttgcataaagaagtggattactttttttctcatctttaatttcaatattagcacctgcaccaattaatgctttaactgtctctacatgattttggtacgtcgctgcaaggacaggcgtttctccgttgtcaccttctacgtttatattcgctccatcctgaatcaacttcatagctgtctctgtatctccaagggtagctgaaagtaacaactgtttgtccattaaatttatacttttctcttctttagattcttcctgttctttatgcttctcttttttcttttcatttttcacatgaaccggtttcgattctggttcttcttgcttatcgcaagccactaccgtcattaaaagtcctaataaaatacataataaaattttttgttttctcacaactacagctcctatgaaagataatgttttcttaaccattcctccatcacatacaataactcttcttgagtacatttatccataagccctttatattccttctttaatcggattatcttaagcttatactatgtttctcaacctattgaaatgatacgcctgatggccccatcattaacattatgaagcaattagtttagcacgtttttaccgcatttgtatacatttctaaaaagtacataaagtgaaactttaattagtgggggttttgttcatccaccactaattattagcccacaccaatcgggcttttacgggcagcccgactccacctaacttctttgctttcactaaattttgaggtggggatcttattgcccgttaatgcgggataaatgattgctttaggttactatattccattgtaaccgttcttctaaaaattttacaccttttctatatttgcacctgattaataatagaaaaagacaactatatagttgtctttttctattattaatgatgtccaccatgatttcctgctttcggtttccccatcatctctttattcatttcccatttatgctctgctagctctttatatgaaagaactttccccttatagttagatacaaagctctctgcatcttttttatttttaaatgaaatgacattataagccatcggtgtcgttattgttttatcatatacgtaagtagcgtcttctaacgaaatccaatctttcgaatcataatctcgaacaaatttctctttcgtcttttcacctgagttgatctccatccatttatacatacaaccgatatcatcaaactttaacgcttttccattttctaaaataatttctgttgcaaattgattatctgttaccccaatttgacaaatatcacatttatcatgtttctcatcaatggcaacagctgctgtttcctttttcccacacccgactaccgtaaatacgaaacataaacatatagcaagtacgacatattttactttcatcaatattcctccctagaaaccgtatactccacgaaaagaataccaaaaggttgtgtgagatttgtgaaaaaacaatgtgctttttgtaatataggaaacaaaaaaagatgtgtagttatttctacacatctctcatcactcacaacctgtaattaataaatcatcttctaatttaactaataatgtatcctcactaatttcctgtccaacttctacatttaccaatcttatatttccactaatcccgactgcaatttttttaagctcaccgtcattttttcggatcatcagtaatttctcccattcatatacgtaagaagattcattaataaaaatctcctctacttttccttcataagagctataaatctcttcaattctcgttttcatataacatctactccctatttcacacttcactattttcatcttattctaccattcttacgaggagcagcttactttttaaaaattcaaattaactaccatgaacaaaatgaacaaaataaaaattatgcttctaatgatgttatttttcaaattatttaccatttgaatagatgcttttattataaataaaaaacctttttctgaatttttattctattttgaaagcgcaatcattcttttgagggggaaattacatgttagcactacttggatttgcgatggtatttgtctttatgtttttaattatgacgaaacgtatgtcagcgctagtagcattaatattaattccgagtgtttttgcattaattggcggattctatgccaatatggggcctatgatgttagagggaattcaaaaattagcacctactggtattatgcttatgttcgctattttatattttgggattatgattgatagcggtttattcgatcctgtcattagtaagattttaaaatttgtaaaaggagatcctttaaaaatcgttgtcggaacagctatattgactattatcgtttctctagatggtgacggtacaacaacatacatgattacagtttccgcaatgtatccactatataagcgccttggaatgaaccccctcatattagctggagttgttatgttaggggcgggggtaacaaatctttatacttggggtggacccacagctcgtgttatgagcgc

SEQ ID NO: 1312 - DNA, 12077 bp, Bacillus thuringiensis
ttagaaaacaccagaatattttcaaatgataacagtatgttttaagtgtattaggtgcttttcctaaagaatccttatgttttataaatttcatgattgggataactggttcacccttgttatgtaaaaccatccaacgttcttccccaaacgatgtaataatactttgtactttaaacatttttccacctccaactgttcaatctatctatactataaatactatctcttttatactattattatagcttctacaaagagacaaaaaaagagaactacctatcgttgtatacgttatctctactcatatattatactattgttaaaaccatccctcttcctttaatcttcggtgtaccccaactttgattttccatgatgatccctcaatttcgtatgatatgtcattattttacacgaacaaacgttctttttaaagagggtgagagataaaattttaaaaaaaagagcaaagtataaaactcggctcttttttgaccactgaccacaaagatgaccacacacttaaaataaattaaattcatttgaaataacaagaggacattttaatttatttttttgcaaaagaatgcactacagtaatataggatataccaaaagatatgatatactttatacgactcatgtggagtgtgtggcttggcttaagttagtataataggaaagcagttgatatagaaaaaatctataccacctgctttttggtttacaaaaataccattcataagcgattttagttaaaataaatattgctgattttcacaaattataaatttagattttgaaattgtattcatagtgagaggatttgaatttgaaatgatagataatttttggcgtgaattaccacgaccatttttcgtacttgcaccaatgaaagatgtgacagacgttgttttccgtcacgtagtaagtgaagcaggtcgtccggacgtattcttcacagagtttacaaactcggatagttattgccatccagaaggtatgaaaagtgtacgtggccgtttaatttttacagaagacgaacaaccgatggtagcacatatttggggagacaatcctgaatacttccgtcaaatgagtatcggtatggcagaactagggtttaaaggtatcgatattaacatgggttgcccagtaccgaacgttgcatcaagaggaaaagggagtggccttattctacgtccagacgttgcagcagaacttatccaagcagcaaaagcgggtggactgcctgtcagcgtaaaaacacgacttggctttaaagagttaagcgagtgggaagattggttaacgcacattttcaaacaagatattgcaaacctttctattcatttacgcacaagagaagaaatgagccaagtagatgcgcactgggaactaattccggaaatcaaaaaattacgtgaccgcattgcacccaatacgttaataacaatcaatggagacatccttgatcgtaaaatgggactggaacttgctgaaaaatacggcattgatggcgtaatgatcggacgaggcatcttcaaaaatccatttgcgtttgaaaaagagccaagagaacatagcagtaaagaacatctagatcttttaagactacaacttgatcttcaagatcaatatgcagaagtactgccacgctcaatcacaggacttcaccgcttcttcaaaatttatgtgaagggcttcccaggagctgcggaattgagaaatcaattgatgagtacgaaatcgaccgatgaggtgcgtgctttgttggataagtttgaggatagtgttggtgtggctcaggatagtgagatggtttaacttttaagcagttaaatcatttcatatgtagtgcatgacatgagtgagttgaaaataagtgcagagctggaaaagaacagtgtatttgagaaatcaaagcactgtttttttcttttagttaatgttaagagagaaatctttttataggcatataaaaaacatgtaagagctctgtagatacaatgatagagaaaagttcgggtaagactataaaacatatctttaaaatgttaaagtattaatttagcggacaataactaaaaggttagattaaacatgataatttaaagcaggttatagcataaactttaaccgctgaataaataatcaacatttcaggaggaaacccaatggcaatgagcaacaacgatatattaaaaagagtacgatacgctttagatataaaagatatagatatggtagaaatctttaaacttggcgggatggaagtaacgaaagaagacgtagttgatatgcttacaaaaataaagagagctcctcagcatgaagctgaaaatgatgaggtagctgaagatgagtacgtaaaaacatgcgatatgatgatgttagaggcatttttaaatggatttattactttaaaaagaggaaagcaagatccgaaaccagggcagcctgcacctgtacagagcaaggagagtgccaataaccttcttctaaagaaaatgaaaatcgcactatctttaacgagtgaggatgtacttgatatattagatagcgtaggcgttacggtaacaaaaggagagttaggcgctctattaagaaaaaaaggtcataaaaattacaaagagtgcggcgatagatacgcaaggaatttcattaagggattaggtgtaaagtatagaggataatgagttcgttaaagcagtaaatgatataataggtagagtaggacgttcgtatcctactcttttttatttgtaaaaatactatgctaggtgatgaaatggtacatacatatttaggtgagacaattaattttcatataacttataagaagaaaaagtccgtgcgtctttttgtagattcgtatggaaatgtagaaatacaggctccgaaagggacacctgttgaatacttagtccagttgctagaagagaagtgggggtggattcagacaacacgtaaagaaatgcaggagcgagcgcatggaccacaggaaaaggattatgatcaaggagaaggctttttgtatttagggaatacgtatccgatacagatttcccaagatgcaagcattgagcaagacaacgcagtatttaaaggggataagttacatatttatgtgaaagagcttaaggatgagaaaatacaacaagctttaaaacgattttactataagcagtgtaaatctttagtagagaagagtattaaagcgcatcaaagtaatttcaaaacaaaaccacgttctattcgtattacagatagtagtcgtacttggggtacttgcgattcgaatttacaactaacattcaattggaagctagcaatggcaccacagcgagtaattgactatgtagttgttcatgaaatgtgtcatatggttcatttaaatcatgatcgatcgttttggcgtcttgtcgggaaaatcatgcccgattataaggaaatggagaactggttagctttatctagttggaagatgacggtttaatgttgcgctttgtataggttgcaattattgtcaatctttgtcggtaagtcgatatatttcgaaaatcgctgatatatttgaagttgcgccgatatattttgaaaatcgctgatatattcggagttgcaatcgatatgttcaatgaagagaaagtaaaaggagaggtcacagcagacatctcctcttttcgagtatataggttagcgtccaaacatcacaacaaaatccccatccactttcgccatctcatacccacgatacccctccgaaagcaaagcctgctgtccactagcatcactcattagaatactttgaacatccgtccaatcgctttctttatctccgcgcaatttcttcacaaaaacatatcgcagactaccaccatacttctccttcagcgcagcaatctccatcccttgcgcaaatttatccttcaaactcgggatgttaaaaggagcaacggtgcagcatacataatcatatttgctatcttctttttgtaattcgtccatgatgacgtttgctaatattttttgcatcccatttcctcgacagttcggatgaacgtttgagatttcttgatagatgacgcggtgcagttcactttctgatagaccaatatcaagccctaaatgttcatcgtcgataggagggacgagtagagcgcgaaatgcgatgagtttgttttcgataaaagcaccgatcatcatgccgtttccttctagaatgtattgaaattcttctagtgagagtggttgtaaacgacttttatcttctagtgcttcaactacgatgttttgtagtgataaaatttgttcgatgtgctctagtgatagtaatgtaacgtgaaatgattcgttattttgttttaatgttccttcgtatagaaccgtcatatgatagtcctcctttagcgtacaacgtcttgaaagacggttagttcttgtagtgtatcttcgtttatttcaatgccgagtccgggcttttcgtttaagcgaatgaatggtacatcgtaatgtaagtttccaatgtctttcgtgaattttaatggtcctgttagctctacgctcgtaatgattttctttgagaaagcgacatggaatcctgcggaagaggcaacagatgattcgaccattgatcccacttggcattcaatgccggccatttcagcttgatgagcgagctttacagctggatgtatgccaccgcatttcattagttttatattcactttatcagcagcttctaatttaataatttggcgcatttcacgagaactttttagtccttcatcaatcataagcgggaggtctgtcttagaacgaatatgagccatggcatcaatatcgtccgcgataacaggttgttcaatccagtcaatgtttaaatgtcctaatgaccgcagtgctgttaatgtgtttgcgctatttttccagccttggtttacatcaacgcgaatagcgatgtcatttcctacacgttctcgtacagcttcaatacgtttcacatcttcttttacattcgtaccaactttcattttgaaagattggtaacctttttgaatcatagaagcagcttcttcagccatatcttcaggatcggcaatacttaaaacgtgagtgacagggaattcttcatgatagcgcccgccaattaattgatatacaggttgatttagttttttgcccattatatcaaaacaagcaatatcaattgcagctttcgctgttggaacaccgtaaattgtattgtccatcatgtcgtgtattttttcgatattcattggatttttcccgattagagcaggggttagcgtatgttttaaagtatggaaagtactttcccatgattcacctgtgacgtgatcatcagcaacgccttcaccgtaaccgataataccttcatctgtttccattttgacgataatagagggcatatcagaataagagccataactaataacaaacggattgcgaagcggtaaacgaattgcgtaaagatgaatagctgtaattttcattgaatagaaaccccttcctgtttacaatagttttgtacatttgatatagttgacgttaaatagtcgttaattaatgataaggagttagagaaaatgatgataaaaattgcagttgtcggttcaaaggagtttatggagaacctttttcctattgctcaaaaattagaaggaatagaaattgatccatatatttaccttcatccggcggaatcttctgaattattaaagtgtctaaagccttgtgatgtcatctttttctcaggtgctttaccttattatatggcaaaagaaataagagaacaattacgaattccaagtacatacttacagcaagacgagacaactgtcgcatcttcaattctttctatcatgtatcatcaaagtattcaaccacataacatttccatcgatttagtagaccgctcgtttattacaaatgtgttccatgatattggtataaaagaaagcccgcaagtgttggattatgaaaatatgctgtggagtaaagatgaaataaatagagttatcgattttcatgtagctaaatatcaatctggagaagctcatttagctttaactagtattcacgctgtttacgacgagcttcaaaaaataggtgttccttcagagcgcatgattgatccaacacaatccattatacatggtctaaaagatgcaaaaataaaagctgagttagcaaaaagctattcagctactgttggtgcttgtattatttcttccctagaattacgaacgagtttgcttgaaaaactagatgtcatttcaaaagaactacgtggttcatttaaacaagtggatgaaatgacatgtattttgtatacaactcgtggtgatatcgaatcgattattaaaacaaatgcgataaataacttgtttgcgagcgtagaaggaacgatagctattggatttggttatggaaaaaccgtgaaagaggcggagcaaaatgcaaaaattgctcaaagttttgcaaagaataatccaatagatcgttgtttttatatactaacaagtgataaagatttgtttggtccgttcccgaaagaacagagagtacaaagtttgaaaaatgataatccggaactaatgaaaatagcgaaggaaacgaagcttagtccggccaacttgtcaaaaatcattcaatttagtcaatcgcatccgtcattgaagtttacagcagctgacctttctgagtacttacaagtgactcgaagatcgacagaaaggttgttaaagaaattagttgattacgggtatgctcatatttgcggcgaggaaatgccctatcaacaagggcgacctcgcgcactatatgaactgaatttaccgctatttttaagcttctagttgagctttttgtttctttagcagttctgctttttcaatgtctgatagttttacaattgtgaagcctgttataccataaatgattgagataataggtacgatgaaattcaaaatagcataaggggcatattcaaatgcacctacgccaagtgtagcgagaataaatacaccgcacgtattccaaggaacgaagacagaagttaatgttccgccatcttctaatgctctggataagttttttgaatgtagtcctttttctgtgtatgcatttgcgtacattcttgaagggacaacaattgaaatatattgttcagagcaagtaaggtttgttgcaaaacaagatgcgatagtagaagcgataagcccttttgctgatttcgctaactttaaaatctgatttacaattgagcgaagaatacctgtatgttctaatactcctccgaaagtcatagcgacaattgtcatcgagactgtattcatcatcgaatctaagccaccgcggttaaatagttcgtctactagcttgtttccagtgtctataacaaatccagcttggagtgcaccgacagatgctgagacagaaccaccttgaataaagacttgtgataaaaatcctaaaataataccgacgagaatcgctggtatagcagggaccttttagcgaccaataccataacgactacgggtataatgagtaggaaaggtgagataacaaagttttgttgcaatacttgtaacgtttgatcgatgctcttcgcatcaatattgttagcgccgaagcttcttcctaagaccgcgtagacgataagagtaataattaaacctggaactgtagtaaataacatatgacgaatgtgtgcgaataaatctgtatttgttaatcctgcggctaggttagttgtatctgaaagcggtgacattttatcgccaaaataagagcctgaaataatggcaccagcaaccattggagctgggattcccatacttaggccaattcccattccagcaacaccaattgtccccattgtagaccaagagctaccaattgctaatgcaacgatagaacaaatgacggtaatggaaactaaaaatagtgatggagttaaaagttttaaaccgtaataaatcatcgttgcgacgattccaccgccaatccaagcaccaattgttaagccaacaagaataataatgacgatagcaggtaatgcaagacgaatccctttatacattgcttcttcaagatcattccatttgtaaccataacgccaagcgacaatagaagcaacggttgtaccgataataagtggaacgtgaggggtttgttttaatacaacaattgtaaccatcataactgcaacggtaatgataatagggataatcgctattccaaaaggtatttcttttttcataaagttcctccttgttacgtatgtttgtttgtatttttagaattgtcgtaaaatagacgtttattaggttatgataactaaaagtttatgtaagcgtcaacataaaaaacagaaaataaggaatgttctagttgtttgtttagtttgtaatataagtgcagagtaaggtttttaagtatttaaaaataaacaattgacttttttcttaaaattcaatatgttcataaaaacatctgtttttcataagtataattaacccgaatcgtttgtaatgtgggaaggagactggaacgttgaaaacattagaactacaagagcgcttaacggagatttttcagcatttacacgaaaaccctgaagtaagttggaaagaatatgaaacgacagcgtatattactgactttttaaaagaagaaggaatttcatatagaacatttgatgattgtccaggtgtaattgctgagattggaggcgggaatccagttattgcgattcgtgctgatatggatgcactttggcaagaagtaaatggagaatttaaagcgaaccattcatgtggccatgatgctcatatgaccattgtaatgggacttattttacaattgaaaaatatgagatggaaaagtggtatggttagatttatttttcagccggcagaagagaaggggaatggtgctttgaagatggtggagaaaggtgctgtagatgatgctgatttcttatttggcatccatctaagaccaattgaagaactatctttgaaacaagcagccccatctattcgccatggagcagcaggatttttagagggtatgattcatggggaggatgcacacggggcaagaccacaccaaggtgtgaatgcaattgatgtcatttccatgattaatatcggtttgaaaaatatttggctgccaccgcaaagttcctattcagtaaaaatgacgagatgccaagcaggtggtgataatttaaatatcattccaggaaatggtcatttcagtttagatgtaagagctgagagtaatatactattagaagaattaaagaaaaagattgagcatgtaatagaatcagctgcatcgatggggtcgaaaacttcatacgaatggatggatcttgcaccaggagcagaggtttccgaagaagcagagcgctttatgcgtaaaggtattctcgaagtgtatggggaagagagatgcacagggcctctctatacgacaggaagcgatgatttccattactatacagtgaaaagaccacatttaaaagctgtcatgcttggactaggagcagacctacaacctggattacaccatccgtatatgaggtttgatcatagttgtattatggatggggtagaaatattgaaacaaactgtattgaaagtgttagaagacaggggctaaagagctcctgtttttttgtcgtgaattgtcggtaaatcgatatattgagaaaatcgttgatatatttgaagttatgatagatatattgagaaaatcgttgatatatttgaagttacgatagatatattaagaaaatcgttaatataatttcacgtacctattaatttgatgaaaaatgagcctccagtacatggtgtataataataagtaccattttttaataggagaaaacgaatgaacgaacaatattacgatgcagttttacatataaaaacagtcggtgagcaaaaagggtttaacaagtctatgcattatcaccgctacgaaccgacgccgtatagcgggttagatgagttattgaatcaatatgaaatacgaagtagcgaccgaattgtagactttgggtgcggaaaagggcgattaaacttttatatgcatcataaatgtggggcttcagcagttggaattgaaatgaatgaagaattttataaagaagcgatggataatcgagatcgttatgcccgaaaggcacgaaacagtaaggggaaaattcaattccaatgttgtttagcgcaggaatataagattgatccacatgataataggttttatttctttaatccgttttctgtgcaagtgtttatgaatgtagtaaataacattttgctttcagtagaaaatacggggagagaagtggatattattttatattatccttctgaggactatattttcttcttagaaaatcagactgcgtttgagctgaagaaagaagttagattgccaggtgcttatgagaagaatgggaatgagaggtttttagtttatacattagggtaataaaaaaacaggtgccaaggcacctgttttttattagttacggattaagtaatcaaatgcacctaaagctgcgtttgcacctgaacccatagagatgatgatttgtttgtacggattatttgtacagtcacctgcagcaaacactcctggtacgtttgtagcgccgtgcttgtctgttacgatttcaccgcgaacgcgttcaactgtttcgcctaaccagtctgtgtttggcacaagaccgatttgtacgaatacaccttgtaattcaacgtgatgaacttcttcagtttcacgatcgatgtaagaaataccgtttactttatcagtaccagtgatttctttcgtttgaacgtttttcagaacagttacgtttggtaagctgttaagacgctcttgtaatacagcatcagcttttaattctggcatgaattcaagaacagttacgtgcttaacgatacctgctaagtcgatagctgcttcaataccagagttacctccgccgataactgctacgtcttttccagtgaataatggaccgtcacagtgtgggcaatatgctacacctttatttttgaactcagcttcacctggtacgccaacattacgccagcgagcacctgtagaaacgattacgctcttacttttcagaatagcgccgttttcaagttccacttcaataagttcttttttctctaaacgtttcgcacgttgtagattcattacatcgatgtcgtattcttttacgtgttcttcaaggcttgctactagcttaggaccttcagtcttttttacgctgatgaagttctcaatgcccatagtatccattacttgaccaccgaagcgctcagcaacgataacagtgcggatgcctttacgtgctgcgtaaattgctgcacttgcaccagcagggcccccaccaacaacaagaacatcgtatggatctttatcagaaagctctgatgcatctggaccgttacccattttagctaaaatttcttcaagtgtcatacgaccgcttccgaaagattcgccgtttaggtaaacagttggtactgccatgatgtctttgctttctacttcctctttgaatgcagcgccatcaatcatagtatgtgtaataccagggttaagaacgctcattacgttaagagcttgtacaacatcaggacagttatgacaacttaggctgatataagattcaaaatgatattcgccttgaatgtttttaatttgatcgattaatttttgttcaacttttggagcgcgtccacttacttgtagtaaagctaacactaatgatgtaaattcgtgtcctaatggaataccagcgaatacgacaccagtgtcttcaccagggcggtttacgctaaagcttggtgttctctctaattcaactttttctactgtaatcttagatgacatagtagctaattcgtctactagagctaacatatctttagatacgttatcgtctcctgcgcttaccttaagtaaaatatcgttctccattaattgaaggtattgggatagtt

SEQ ID NO: 1313 - DNA, 10863 bp, Bacillus thuringiensis
aattatggatgtacagtatttaaaacaaatgcaaacaatggatgagcaagctgcaactgtcgaagccgcagtgcataaacgtcctaaacttctatggattaactttttattaaccgctacattacttgtctgtctcatactagaagttatgccgttacctgttttatttacagtcgcttttgctattgctgttatgattaactatccaaacttagaacaacagaaagaacgtattgcttctcatgcagggaatgtattagcagttgtttctctcgtatttgctgccggtattttcactggtattttatctggaacaaaaatggtagatgcaatggctaacagtgtagtaactcttataccagatgcacttggaccacaattgccaattattacagctcttctcagtatgccattcacatttttcatgtccaatgatgcattttactttggggtattacctattttaactaaggctgctgctacttacggaattagtgcagctgaaatgggacgtgcttccttacttgggcaacccgttcacttattaagtcctcttgtcgcttccacttatttattagttgggatggcaaaagttgattttggtgaacatcaacgttttactttattgtgggcagttggaacgacaatggtgatgttgattactggcattgtaattgggattattccaatataagacgcaaaaaacagtagaagaaataaatcctctactgttttttattatgaagaaacaagaaaataccgtctctccggtctccccacactcccatatattagctctgcgtggactttcttcccagatattaaatactctaaatagcgccttgcagttgatcggcttacgcctaccattgaacttagtacctctgctgtaatcccttcttcattaactgttaacatatgcttttttattttcgctaaagttaaaggatctatccctttcggggcatattccatttcatttcccttcacgcctctttgagaccataaatattcaatttgttccgtagataattgattgtttttctttaactgtataatctttttttgatagccttccagacttgctttaaatcggtcaaacattagtggctttacgatataatctgttactccgccccgcagggcgtgcctcactacatctgcttccgatgctgctgtaatcataataatatctgtatcgtgcaaatgattcctaatatatgtgacaagttccgttccttgcatatcaggtaagtacacatctaataaaacaagctgtggcttcacaagctctagccattctttcgcttgttctccagtcgttgccgttccaattactttaaatccctcaattttttcagtaaaacgacgatgaatgtccgcaatccgaatatcatcttctacaattaatacttcaatctcctcacccattactattcgcctctctctttcggtagtgcaataataaataacgcaccacctaaatcccctttttcgattgcaatacttccatttaaatcttctactaactctttcacttttgctaatccatatcctcgctctcctccttctttcgtcgaaaagcctttatagaatatgctagtaattatttcatcatgaatcccttgccctgaatcttccacttcaattaatatttcttctccaatatcagttacaaacatccttactttcttatcattctcttcatttttttcaattgcttcaaatgcattcgtaattaaatttcctaaaatagaaacgacataattactctcaatatgtggacttaatttgtctaaaccactttctctatctagcataaaatcaatcttcaactctcgtgctctattataaaatccaattaaaattccacctagccatggattttgaatccgcttcataataaattgaacaaaatcttgatataccgctgtttccttatgaataagctctaaagcatcttcgtatgattctaattggataagacctgaaagcgtatacaataaattgttatattcgtgcgcttgcgctcgtaatgcctctgtatattgcttcgtctgagataattctgctgttaactgatccatttcagatttcaaacgtaagctcgatacaacgccagttactttattctttactttaataggtagacggttcgcaataacagcctgtccttttatatttaattggcgatcaaactgttcttcaccagtttgaagtacatctagtatcgctgaattaggaattacatttaaaataaattccccaataatattttgttgtttatctagcgaaagaatatcataggctgcttgattgactaaactaatcatgccatttttatcgattacaataatcccttcacgtacagattgaatcactgtactatgctcttcatataaagatgaaatttcttctggttccataccgaacatcattctttttatacttgccgctaaatatatagagccgattactccaattaatagccctattattgtaatccaaaatacacgctttccatacacttctaccgctccatgaatatcatccattgaaaatccaacagacacaacaccaatgatttcattttcctgattacggattggaacttttccgcgtaatgaagggcctaatgatccagttgctttcgaaacatatgattttccttctaataaaacgcctttgttatctccaccaatcatcgcttctcctattttatctcgctcaggatgtgcatatcgaatcccctctttatttccaactacaatgaagtcagcctctgtatccattcgaattctttctgcaatcggctgaataatagaagctgggttttctttttgaaaagcttcctttatttcaggtatagcagcaactgttttcgcaacatgtaaagcccttttgccaatttgctcttctaccgtttcagataatatgtaataaaataaataactcgttagcataagtacaactaaaataagtatactaatagttaatgtaattctcggttggagttttaatttttttaacttcaaaaccattcccctaacatgattaaagatagaatttaaagaatatacagtctctttaattatacttaatcataacacggttactctatatttctttttctcttcataaaaaaagaaacgaagtaaaattactacctcgtttcttaacattcgttattacactttaaacttactaatcatctcttgtaattcttctgccatttgtgataaatggactgctgctgcatttatttcatctactgaagctaattgttcctcagaggaaccagcaatattttgaacgcttgctgcattttcttcaattgtagctgcaatttcattaatagatgcacttacttgttttgcatctaccgtcatttgttttgctacatctaccatgttatcaatttgtacaactgtatcatccgtagatttcaatatttcagcaaagctttgcttcgtttcatttgcaactacaagtcctgattgtacttctgctccaacttgattcatagagcttactgtttcttttatatcaaattgaatctctttcactagtttcccaatttccgtagaagactgtcctgattgttctgctagctttcgcacttcatctgctacaattgcaaatcctcttccttgctctccagctctcgcagcctcaattgccgcatttaacgctaataaatttgtctgttctgcaatatgttgaatcacttcaaggattgctccaatttgtttcgacttatcgtctaacaaaccaatgattttgtctgactgtgaaacagactcatgaattaattgcatttgattcacagtttgttcaactaacttcccaccattttcagcttttttcttcgtatacatagaggctgtagatactaatgaagaactatctgcaacacgctgaattccttctgtaacttcttctaacaatgttgctccttcttcaacttctttcgtttgtatttctgcaccacttgatacttgctctatcgcctgtgtaatttgttccgttgcttcgcttgtctgcttcatactagctgttaattcttctgaagatgccgctacatgacttgctgaagtgtttatattggaaatgacactttgtaacgatgcagccatctcgttaaaactttctcctagctgcccaatttcatctttagaatgaactgtaattgactctgttaaatcgccttcactaatctttttcgatgagataacaagttgttttaacggactaataatagaagcaattatgaagtaaattaaaatcccaccaattactaatgaaataccaataacagttattgttttatagaaaatagggttagctgcttcgataatttcttttgaaggcataattcctgctattttccatccagtctgcttatttgttataaaggtaatattgcgatcatcaccatcaagtttgaatttaaaatcacctgtttcttgtttatacaattccttctccactttttcttctaccttgtcacctggcttcatcgtcggatgcgctattacatttttagattggtcaaagattgctacatatccttttttgccgatattgaccatttttgaagtatttacaatatcattaataattaaatcaataccgagaacaccacttttatcctcattttgttttgctattgtaataacaatattccctgttgtacttgacttatatggggctgtgataaccacttctccgctttttttcgctgcttctttataccaatctctttcggtaggattatacccatctggcatttgaatagacggtgattgaataaattgtcctgtactagatcccgtataaactgcttctatttctggatgtaatttattatattcttctaatttattttgcacattttggagctgatcagttccgtaacttactccattaaataactttgtaaaatatactgcgtctacctttttactgtctatctccttgttaataacattatttaaaatctttacgttatcttccgctgattgtaaaattgtttcattaaaatttgtctttgcttgttgataagacgtccaaccaattacaatacttggaagaattaaaatgataacaaatgacacaagtaactttgtttttaaactactactccttaatttcccttgaaacatatttctacccctccataccgttttaaatgtaattatctcacatttaatttatttatataaattacacgattaattgtattaactctttgtctctttttctattaaagagttaatacatacctttttcattctatataaattaaataattaaaacaatatataaaaatgtatattattcgaaatattataattcacagaagaacctccagtatttcacttactagaggttctttccaccttactattctttatctttttctacttcttttttctcatcttctactacagatacaacaggtttatcacttgataattgttgtaccgctccttttccagcaaatccttctaatagctcttttaagtcaattccagaagaagcttttaacgtttcttgcatcgttgccattaaatcagttgcataacccgcaacttttccggcgccgctatttttaccaccgccgcctgtatcaacaactgtaattttatcaatgttactaagcggacttgcaacttccttcgcataacttggaagcattttaagaaccatatccataattgccgcttggccatataactcaaatgcctctgcaattttttgcttcgcttctgcttctgctaaaccttttaatctaataacatctgcttccgccgtaccttgtgctttttgtacttccgctttcgcttgaccttgcgctttttcgatttccgccttcgctaaaccttctacacgtacttcttccgcacgagctctcgcttcagcttcaatcttatattgatccgcatctgcctttttaatttgttttactttttctgcttccgctgattgctcaacagcatagcgatctgcatctgcttttttcttaacttctgcatcatattgcttttcacgacgcgcaatctctttttcttctaactcgatttgcttttcacgctcaatgattttaacgcgcatttgctcttctgtaacaccttgttgtgctttcgcttgttgtaattcgtaagaaagatccgcatctgcacgggcttgctcttgttccctcttataggactgtacttttaattctttatgtttttcagcttcagcgatttgtgcatcacgttgatattctgcttcttttgcctctttttcagcacgtgctttttcaatacgtgcttctttttcacgctctgcgttcgcaattgttgcatcacgcttaacggtcgcaatttgcggctgaccaagcgcatctaagtatccgtttttatccattatttctttaattgtgaaagaaacaatgcgaagtcccatcttctttaaatctgtagaagctacttcatgtaccttttgagcaaattgctctctattactatacgcatcctctactgtcatagaagataagattgcacgtaagtgaccttctaaaacctcttttgcttctacttttaactcttccgtttcttttcctaaatattgctcagctgcagtagatacttcttcaattgtagaacctactttaataatagaaacaccatttactgtaactggaacaccttgcttcgtatacgtatcacgtgtaccaacttctaatttgtagtttaataggcttaaaggttctgctctttgcataattggaactacgaaagtaccgcccccgcggataatcttaatcttctttccatcatcagtggtaacaacattctttcctccaccaagccagttccctgtaacaattaacgcttcatctggaccaaccgtacgatacttcgtaatgaatactaaaatgagtagaattaaaattgccagtaaaactccaccgataattaatggaatcgtcatgtaaattcccccttataattttggtttttttaaagaataagcgatgttttgtacaagtaaaacaccatcttggactccctcgataataacctctgttccttgcgaaatatctttttttccaactgttttagctgggattgcattacttccaaattgggatgaaattaatacttcaccaaatccttctgtaggaattgtcgtaatgacttctcctttgcaaccgataaattcatccatacgttgtacggtattttgctctgcttctgcaatcggttttaaaattagtattttcatgatgaaaacaccgataaaagatatagcaaatgcagccccaaaaatagtaatactattaaaggaaaacaaatattctcctatataactaagcccacataacatggcgaagaaactaagtaataaagtaacaacggatacagctccgcccccaaaactaaatatcgattcaaatatatctccaaagaagatataaataacagtgagtatagtagcaataataaatccatataaataaattgtttcaagtggataaccaaacaagaccatttcttatccccctttcttaaacaatcccttttttgttatatgtatgccccacctctttcaaagattatagttcttaattttcagttatttaccttttaaagaaaagcctgtaagacaggcctctaaaaaagaacaggagaaacctattgtgacaggctcctcctagaaaataaccgatatattatatatctatataatatactattttccacaaaaagtaaagttaaacatacattggaaagacacttattttactgataatttgtacgttccatcaccattatcatatttatatacatacaagtaatacttgcctggttttgcattaaatttcgcttctatatgattcccattggcttgaccgtaagctgcataattttgcatatctgattcatggtgaagtacccatgtcatcccaattccatactcatttaaaacagaaatgtcgatatctttcgctgatgctacattaaatgtataaacatcagtgtggtccccgccaataagactgccttttatcgtactatttagcccgatacgatttgcttcttctagacgattatttggttctgattctgttaaacttccatctttaatcgtaacagttgtttcgcttctgctctctttgcctttatcatcttttactcttaatgatactttataagaaccttctctttcatatacatgtactggattcacttctgcacttgtgcttccatctccaaattcccataaataagaaacaatttttccatcttcatcgtttgagccatcacttttaaattgaattccctcttttacaagaccgctataagggccatttatattaaccgttggagctttattttctccatcatcttttgcgattccatggaagactacatcatattcaaattcatttgaactattcacacgataattgacgaagtatgctgtaacagttttgtagccactccattctttttgcgccaattgttctaaagattcatttactcttttactcattgctttccaatcttctgattcaccttttgtgacactacctgtatacgtaccttctaatgtaaatgtattaaagaattgagaattatgttttgtcatttttgtatctttcataggcaacgtatcactaatttcttttttcacttcagttaacgatttcggtgcatgttcagctaaataatcatctgctacttccggtacattatatttatcttgattatcaattaactgctgcatatactcttgatactctttatttaacttaggatctttacttagattttcatgatatgcatcataatttttcacgtcattcgcacgaatcaaatcttgaattttatcaaatgtttcaaactgatgcgtatataagtaagactgcaatgcgaacgagtaattatagaaatcccaagaaccgtatttagcaaatagtgtacgctctgctgtataacggcttgcaggatcagatgataatccgctaattatactctttcttggtacaacgttattcgtacgagtagatcctgcgaaaaactctgcatttccttcttggaaccaagttagcctttcattttgatacatatctcctcttccaaataaaccaggaacttcatatctcccttgcagataatgagtaaattcatgacggaataactcttctaaactataaatactttgctctggtgtacgctcatatgtaaagaatgtacctgtctcttcaatataaattccaccgttgtttgtttcatatccatacaattgtctatttaactgatattcatctggactattataaattacgatcgttaatacatcatccgcatttcctggctctaacgctttgtcatttccaattacacggtgatactgtgcctttacttccttcgcagcccaatatagtctcttaattttttcttctgatactttatctcctgttttgaacacaattgatccatcgtcgaatgtatacgtttttggtaagtattgctcttttccttctttacgtattttctctaaatctactgtattcccgctataatctttaccattataatttgttgtaatttgttctaccgcaacaaaatacggttcacttaagcgcgggtacatatgcattgcttgtgtaacaacctctaatcctttatttggattactatgaaacttccctaaacggctagcaaaataaatgccattattaacaagccatttattttctggcgttacttcatttagaagagcaatacgatttatttcattaataaacccatctacttttccataccacatcgtttcattcgcttctttacgagcttcagttaagtacgactgtatatcatagtcaataccttgcatgatatcgtatattgcttgtcccttcattcgatcatttacataagtagtataattatcattgtattgctttaaaatattcgatgcgtattgaaccgtttcaacatcgcttgaagcattactaattaatttaccgtatgcagatacgactgtatcttgttcaactgtaccaagcttaaagtttggattgtttgcgattgcttttaaagcaggtaaacatttatcctggaagcttctttcatttaagtcgcttaattcactattataaaatgcaagataaaaagctgaacgcagcacttcagtaaacgtttgaattccttttgaatcatctttcgtaaatgtactacctctatgagctaattcatctataatgacttgcatttttcctttatctttataaaaagcctttgcatcttcattaaactggaataagtctgtaatttggtgccacttaatactgcctaacgtttcaactaattctcgatcattcattttgtttaaatcagccattgaatagctttctttaacttgctttactgcagttttcttcgtaatagatgctggtcgctgtgaaaaatctcctacttttaaacgttcttgaaatgataaagtttcatcaacttttgaaatatgtccaacttcatctaccgacttttcaattccaaccggtttcgttttcaacacgttatacggtactttttcttccgctgctgcatgagtttgaagtgcgcctaacgataaagccattgtactaatgctaagcatcactttattgatctttgatttcttgttcatatccttgccccctattttaatattccattcaagaatttaacataaaatctggatgtaacaatataaaatgcaatatttcatattatttcttcctataatttgtacatatcgtgaacacattgctctttacctccccaaaacaaattgcatcctttcacattataaaaaagtaatttt

SEQ ID NO: 1314 - DNA, 12602 bp, Bacillus thuringiensis
ctgctgattcagcatataaaaaggatgaaaaagttcaaaatattgggaatcaccgtgaaccaaatctagaaattattgcagcggcaaaccctgatcttgtaatcgttggtcaaagatttgctgatcattatgaagaaatcaaaaaattagtgccaaatgcagctgttattgatcttaattttgatgtttctgagaaggctactaagcctggagaaaacttagtaaaaggacttaaagattctacaactactttaggtaaaatctttgctaaagataaagaagctaaacaattagtagctgatttcgataaatctattgaaaaggcaaaatctgcttataacggaaaagataaagttatgagtgttatcgttactggtggaaatattggctttgctgcgccgcactctggtcgcgtttggggacctatgtatgaaattttcggttggactccagcattagaagtttcgaattctactgcaggtcataaaggtgatgatgtttctgttgaagctatcgcacaaacaaatcctgattggcttttcgtattagatcgtgatgctgcaacatctgatgcagctaagtcaacacctgctaaggatgttatttctaaatcaccagctcttcaaaacacaactgctgtttctaaacaacaagttgtttatgcaccagaagatacttacacaaatgaatcaattcaaacttatatagagttatttggaaatcttgcaaaaactttagctaagtagtgtaaaggggtacgaaacagtgtcaaaaaatatgatttctagggttgagaatatttctcaaccccagttttataatcacaataaaatatggacaaaaccttttataatagcggttatagttgttataattttagggattatatcactgtttactggagtttatgatatacgtggacaagaggacggaatggagatgtttttcatcactcgtgttccgagaacagttgcattaatgcttactggagctgcaatggcgatggcaggactcgtaatgcaattaattacacagaatcgttttgttgaacctactacaacggggacgattgaatggtcaggcttaggcctgctttttgtgtatttattatttcctgccccaactttagttcaaagaatgactggtgcaatcattttttcttttataggaactatgattttctttctatttttaagaagagttaagcttcgttcgtctttaattgttccgattatcggattgatgcttggagcagtaatttctgcagtgtccacttttttaggactcctttttcaaaagacgcaaagtattgaaacttggtttgtaggttcatttgctaacattcaggtgggaagatatgaatatttatggctgattgttatcattacttttcttatttttatgtatgctaatagattgactttagctggactaggagaagatgtcgcaacaagtcttggagttaattacaatagaattgttctttttgggactgctcttatctctgttgcagttggaattgttgcagctgttattggacacttacctttcttaggattaattgtgccaaatatcgtttcaatgtttagaggtgatgatcttaggagtaatttaccttgggtttgtgtgatcggaatgggatcaataactgcctgtgacatcatttctcgaacaattatacagccttttgaattacctgtttctttaatacttgcaacagtgggagcagtcgtgtttattactattttattgagacaaagaaaaccaaggaggctacgatgatcacattagaatatagaaaaaaagaaaatgtcgaaatcgattctagccttcataatgaaagtagatcagctagcgcttttcggtctaagaaggaagcaagacgttattggattttactcataacattgattgctttaggtcttctttcttcatatggacttttagtttataacaatccagttccgatagattcaccttcttttatcccagtcgttaagagaaggatagtagctattgttgcaatgattattgctgcggtttgccatagcttgtcgacagttgctttccaatctattacgaataataaaattattactccttcacttttaggtttcgaatcactttattcagcaattcaaacgagtacagtattcttctttggtgctagtgcgttaataaattttaatggaattggatcatttttattccaagttgttgttatggtcttcatgagtttgatactttatggatggttactttccggtaaatacgggaatttacaacttatgcttttagttggaattattattggtaccgggctaaattctgtgtcaactttcatgagaaaactacttgcgccttcagaatttgatattttacaagcaagattatttggttctgttaatcatgcagatcctgcatattttcctattgtaattccgatgatcataattgtagcagtattaatttttgctcattctaagaatttgaatgttttgtcactaggaaaggatgttgctacttcttttggagttaaatatcaacctagtgtaatttatacacttgtattagttgctattctgatgtccatttcaaccgctctaattgggccacttactttctacggctttttagtagcaactttgagttatcaggcggcgtcaacttatgatcatagatatattttcccaatggcttttgctataggatttttaataatgacgagcgcatactttttaatgtatcatgtattccatgctcaaggtgtagtttcagttattattgaattatttggtggaattatattcttaactatagttttaaggaagagggctttatgataaaaattgataatgttaaaaagttctatactgataaggtaaaaataggacctttggatattgaaataccaaaagcgggctttacttctttaattgggccaaatggtgctggaaagtccacgacacttttgatgattggtagacttttagatatggatgaaggccaaattcaggtagcaaatatggatgtttctgaatccaaatcaaaagacttagcaaaagttttgactatattgcgacaagaaaatcattttgtaactaggcttacagttagacaattagttggatttgggcgctttccttattcaaagggaagattgactaaagaagatgaggttatcatttctaaatatatcgatttcttagatttaactagtttagagaatagatatttagatgagctttctggtggtcaaagacaaagggcatatgtagcgatggtattgtgccaagagacggaatatgtacttttggacgaacctctgaacaaccttgatgttgctcgttctgttcaaatgatggagcatttaagacgtgcagctaatgaatttggaagaacaattttgactgttatgcatgacataaattttgcagctaaatactcggataaaatttgtgctatgaaagatggacaaattgctgcttttggaacagtagaagaggttatggactcaacacttttgacagatatttttgaaacaaaaatagaaattattaatggtccttatgggccaatcgcagtttattagttataaaatgtgaaaaaataccgtagcttgtgtagattatgcaagctactctagttgaagttgctgtctgtattttataggcagcagcttttttatgtgactactcataaaatgcaaaagaatgcttcaccttttcaagtatgtactaaacgaaaaaaatatccctgtataactttttaaaagaattcagcttgttttttgatatgtaatattgcatatcagagtgtattgataaaagtgtaaggggtcactataatgagggcataaagataaatcacattttcgtagcaataaaaaggaggaaataatatggaaatcgcaatgacagttttaaaatttgtaggtggcgtaatcccgttaattcaagaacttttaaaagcatttatgtaagtttattagttagctatcatttatcgatcattatcatattttactaaaaaagaacggggtgatttttctgaatattaagaaaaacactaaaagaagaaagttccttgcatgtttattagttagtttatgcactattaattattcatctatttccttcgcagaaacacaagcaagtaatgcaactgatgtaaccaaaaatgctagtggcattgatactggtatagcaaatcttaaatataataatcaagaggttttagctgtaaatggtgataaagtagaaagttttgttccgaaagaaagtatcaattcaaatggtaaatttgtagtagtggaacgcgagaaaaaatcacttacaacgtcaccagtcgatatttcaattattgattctgtagtgaatcgcacgtatccaggagctgtacaacttgcaaataaagcttttgcagacaatcaaccaagtttattagtggctaagagaaagcctttgaatattagtatagacttaccgggcatgagaaaagaaaatacaatcactgtccaaaatccgacatatggtaatgtagctggagcagtagacgatttagtatctacttggaatgaaaagtattctacaacacatacgttacctgcaagaatgcagtatacggaatctatggtttatagtaaatcacaaatagcaagtgctcttaatgttaacgctaaatatcttgataacagtctaaacattgattttaatgcggttgcaaatggagagaaaaaagtgatggtagcggcgtataagcaaatattttatacggtaagtgctgaactacctaacaatccatccgacctttttgataatagcgttacttttgacgagttaactcgaaaaggcgtaagtaattcggctccacctgttatggtttcaaatgtagcttatggtagaacgatttatgtaaaattagaaacaacatctaagagcaaagatgtacaagctgcttttaaagccttacttaagaataacagcgttgaaacaagtggacagtataaagatatttttgaagaaagtacctttactgctgtagtattaggcggagatgcgaaagagcataacaaggttgttactaaagatttcaatgaaatccgaaatatcattaaagataatgctgaattaagtcttaaaaatccagcatacccaatttcatatacaagcactttcttaaaagataattcaactgctgctgttcataacaatacagattatattgagacgacaactacagaatattcaagtgctaaaatgacacttgatcattacggtgcttacgttgctcaatttgatgtatcttgggatgaattcacatttgaccaaaagggtaacgaagtactaacacataaaacgtgggatggtagcggaaaagacaaaacggctcattactctacagttatcccactcccaccaaattcaaaaaatataaaaattgtagcaagagaatgtacaggtcttgcatgggaatggtggagaacaattattaatgaacaaaatgttccattaacaaatgaaataaaagtttcaattggaggaacaacattatacccaacagctagtattagtcattaagtataaaacaagcgccctataagtagggcgctttttacttggtcacaaattttattttgtatcggtatgtttttaagttttgtaaatcatcaactataaggtgggaatattgtgcagacgaaaagctacatgtttttcgtctttttgttctcttgcttaataagaaagatcctgtaactcagtacaggatctttaatcaaacgtttttaaaagctaaattgtggtttcatatcacctttataaggttcatgttcaacgaatatagttatatccttaccagcttggtctttaccagttctcttatacgtaaatttattcttatttagttcagtaagttcaagagcagcaccgtatttgttatttccaattgaaacatgggctcttattttattttcgtgtacaacatcgaagtagccataatcaccgcggctttgacctgtttcgctattgaagaactcatatttattagatttgtcatcaaattttgctagacttataaaattcgaattaaactgtgttacatcgttaccagtttcgtctaatacctttgttccgtgccaaagggtaccgcctaaaattttatctccatcaacgtttttaacaatatctcctgtagtcgtgttcagctgcttgtccggatcagtgaaagaaagttctttttctttatatggaacatgttcaacgaaaacttctacatctttaccgttagcgtctttccctattcgtttataagtaaatacatttttatttagttttgtcatgtcaacgacagcttgatacttcattgattctgaaattaatattctctttttcccatcatttgtgataaagaaagttcctttatcgccacgacttgcacctgttttagcatcaaaaaattcatatctgccggacttcgcatcatattttgcaagaccaatgaagtttgcattctcttttgttaagtcattcttatctttgtcatacactcgtgtaccttgccaatttgtctcgctaagaatattagccattttttgccctttagttaatttattttccttttttgtttctttagcaacttgttcttgcttttgtttcccatgattttcttcagctttagtaccagcacaccctgttaatgctaatgtgaatccgagcagtacggatgatagtgcttttgtttttttgttcatgttttatcgtctccttattttatgatttcaagtagtacggttagcgattatagtagcagtgcgtcatatataaacttaattgctacgtttcttatgttaatccccgactataaactgcctctaaataaaacattaaaaaaagataaactaattcctaaatttttttcatacttataaaaaggtcttttacatggggggaatgtaaatttcttattttgaaaatggcgtaatcacattggggtatacacattatgcttacattgcgattttagatgtgatgttatactgtgtataagattttatgtgtgtatgttgtgtcggtttttgtcggtaagttgatatatttcgaaaatcgctgatatatttggagttgcgccgatatatttcgaaaatcgccgatatatttggagttgtgctgatatatttgaaaaatcgctgatatattttggagggggataaaaatgattgtgaaagagcggaaaatgcccgtatatttgctgcaattagaagctttacttagaagattgcctgctcatcatccaaaaaggaatgtggtggttgaaagtctagcgaaatttatggccggctataaaggagagcaggcgattgagtatccgctgagttttctatccgaagcagaataccatattttacatgatattaggttatttgatcaaaaacattatttccaaattgataccctcatagtttcatcttattttcttcttttttttgaaataaaaaatattattggtacattaatttttgatacaaagttcaatcaacttattcgaatagtagatggtaatacggaagaaggattcccagatccgcttttacaactgaaacggcaagagatgcaactgagaaaatggctgaatctacatgatttacataatattccgattgaagccctcgttgtaattagttcccctcgtacaattattaaaacttcagatgaaatactgtctagtaaaattatccacagtgcaaatttacctaatagaataaaacagattaaaaatcaatataaagaaaaagtgattgataatataaatggacttataggccagattatgaatgagcacattccgcaacgtcaaaatgttcttgcgcaatataaaattaaaaaagaggaattgctaaagggtgtacagtgtgaggaatgttttacaatggcaatgttaaaagaaagacagggatggcgttgttcaaattgcaatagtatgtctaaacatgctcatttacgtgctgtacaagattacacacttctgtttagtgtgataactactaatagcgaattgagggaatttcttaatatggaatctagttctgcggttaaaagactcctccaaacaatgaacatcaccttcactggcaataacaaaggacgaatatatgatttaacttctttccaatcgtaattttgctataataaataagtacttatacgaaggggagtctaaagagagtatgaagtcatttaatatcgatcatgttatagctagtgttttgcaatggatattaaatatagccttaattatattatccattgtgttatcaattttcttagtgaatgagacaattacgttcgtgcagtatattttttcggcaaaagagtatacgtcttataaattggttgaaagtatcatcgtctatttcttatacttcgagttcattgcattaattattaagtattttaaatcgaactatcatttcccgttacgttattttatttatatcggaattacggccttaattcgattaattattgtgtctcatgaggaaccgatggagacgttattatacgcaggagcaattcttgttttagttattgctttatacatatcaaatatgagagatttgagaaaagagtagtagtgcagacataagtcagcactacttttttacatcttgaccttcaagttgcttgaaagtttacaatgaaattagggcgtttgaaatcgaaaaaaattgagaaattaagtgaagaggtttcttttacttggaggttataggaatgaatcaggaattgaagttacgtccattagaacgagaagatttaaagtttgtacacgaactgaataataatgcgcatattatgtcgtattggtttgaagagccgtatgaggcatttgtggagctgcaagacttatatgataaacatatacatgatcaaagcgaacgccgatttatcgttgagaaagacaatgaaatggttggattagttgagttagtagaaatcgattatattcaccgtagaacagaattccaaattattattgatccgaattatcaagaatatggttatgcagtggatgcgacgcgtttagcaatggattacgctttttccgtactaaatatgcataagatttatttagttgtggataaggaaaatgaaaaggcagtacatgtttataaaaaagttgggtttatggtagaaggtgagcttatcgatgagtttttcgttgatggtaactatcataatgcgataagaatgtgtatgtttcagaagcaatattttgaaaacaagtagttgaaagattcggaagtaatgttgacgcttcgtaaaaccgtatgctaaaatcctttttaagtattaaggaaggtgcataatatgctttatataaaatttgtaaaactcattagaaaactttgctccgcacaaatgtatacggtgaagcgttgtacggagcttaatcaaggggtataaatcccctatattcatcggctgaataacttttctaaaaaagtatagtgtatctatgcttatttcgttatggtttttcagctggtgtataaaatagattaaggggccatagacaatgctttgtctatggccctttgtgtatattattccgatgagtctttactataaattggagtagtataggaaaaaccacgaagcagagggctagtgtcgaatgacgctatctctctgctttttttaatttcaggaaaagaggaataaaaatgagtttacttaaagtggaaagtttatcacatagttttatagataaagtattatacgaaaatgcttcttttgatttgcataaaggggagcatatgggaattgttggacagaatggtgcaggaaaaagcacattaatgaaaatattggtgggggaaattattcctgataagggagacataaagtggcaacctaatattcaaattggacatcttgatcaatacgcagaaattgatgaggtttataccatttcacaatatttaaagagagccttttatgatttgtatgcaatggaaaagagaatgaacaagttatatgaagaaagtgcgatgactggagatgaaaatcaactattgaaagcggcagaaattcaaggactgctcgaggctcgtgatttttattcagtagatagtattacgaataaggtggcagccggtttaggtattgatgtgattgggatgaatcgtgtgattggtgaattaagcggagggcagcgtgcaaaggtaattttagcgaagctcttattagaagagcctaatattttattgctagatgaaccgacgaattttctcgataaggagcatgtggagtggcttgctaattatttaatgaattttgaaggagcgtttattgtcgtatcacatgattttgattttctggaaaaggtaacttcttgcatatgtgatgtagagttcggaacagttaagaagtattacggcaaatactcagattttgtaagacaaaaggagcatttgcgaaaagattatattcgccaatattatgcacagcaaaagaaaattgaaaaaacggaagagtatattcgtagaaatattgctggggtgaattcaaaaatagcgcaaggtcgtagaaaacaattacagcgtatggaaagaattgcgccaccaagttttactcataaaccgtctattcattttcaggaacttcccatttcagttcagacagttcttgaagtaaataatcttgaagttggttacgacttcgctctcttaccaaagttgaatttttcagtaatgggtgggcaaaaacttgtcattacaggtttcaatggagtagggaaatctactttattaaaaacaatcgttggaaatattgctagtatttctggagagtttcacttttcagagcaaataaagattggatattatgagcaagatttaaattggagcaatgattctttaacgccgcttcaaattatttcagaacagtttcctaaactgaatatgaaggaaatacgccatcatttagctgcgtgtggagtgaaggatacgcacgtttcgcaagaaattcgtacgttaagtggtggtgaacaatcgaaggtgaaactgtgtggattattactatcaccttgtaacttcttaattttagatgagccgacaaatcatttggatgcagaagcgaaggaagctttgcaaaaggcgttaattaagtttaagggcagcattatactcgtatctcacgaagcaagtttttatcttgattgggcagatagcatctttcatatagagacgggattagttaagggggtgtgaaacatatgagtgaaaacaattggaaaacgaaaattatattatttttgaccgctcaaactatttcgttgttcggttcctctctcgtgcaatacgcgattatatggtatatcacccttacaacatcatcaggagtgatgttgactatttcaactgtttgcggttttctaccacaaattgcgatatctttgtttgcaggtgtttggattgatcgttatgaccgtaaaaagatgattatgttatcggatggaattatagcgattgcgacgttagtcttagcaattttatttttaacaggatataaaagtatttggttactttttattgtgttactcattcgttcagctggaacaggagtacaaacgccagctgtgaatgcattaattccgcaaatcgttccgaaagagtatcttatgaaagtaaatggaataaatagcagtattacatctttaattatgtttctttctccagcagcaagtgctgcgattctttctattgccagcattgaaacaacattttttattgatgttattacagctatgattggaattagtattatgtttgtcattcatgtggaaggacatgtgaatgtagaaagtaagcaaaaatctaatctacaaggaattaaagaagggttcacttatttaaaagaaaatgtatttattaaaaggctaatcgttttattgattatcgtcatgattttaataagtccagctgcttttttaacacctttaatggtaactcgttctttcggggccgaaatgtggagacttactgctagtgagatgacctttagtgcgggtgcggcagctggtggcgtattgattgcagcgtggggtggttttcgtaatcgtatgcatacaacagcgctagcttgtgcattatatggactgcttatgattggactcggaatagcaccgatatttattatgtatttagtctttaattttttaattggtataacaatgccgtgcttcaatacaccagttactgtgttattgcaggagaaagtagaaccatcaatgcacggacggatgtttagccttgtacaaattgcgaattcatgcgcgcttcctttaggaatgataatatttggtccgttgtcggatatgtttagtgtagagattttgttaatttatgctgggatattcgtgctattttgcgcaatgtatattgtattaagcaagaggtttgaagtgtaaatatttataatttagaaggtttgcgaagtgatttaagatgctttgcaaacctttttgttgtttgttcagtcaataattatttattgtttaacaataaataattattgactgttaattcttttttagataat

SEQ ID NO: 1315 - DNA, 8138 bp, Bacillus thuringiensis
gccttatatgtatcaaggggaagaaatcggtatgttttttcctaaatttgagtccatcgagcaatatcgagatgtagaatcgttaaatatatacaatataaagctaaaagaagggctatcaaaagaagagattatagggattttaaagcaaaaatctcgtgacaactctcgcactccgatgcagtggaatgaagagatgaacagtggttttacaacaagtacaccttggatttcagcggctgaaaattttaaagaaataaacgtagagaaggcattagaagataaagagtccgtattttatcattataaaaagttaatagagcttagaaaaacgtatgatgtaattacagaaggagaatatgctattttggataaaaatgatcctaaaatttgggcatatactcgtactaaagaaagtgaagtgctacttgttataaataacttctatggagaagaaataacgtattcagtaccagcgcacgttcagttagatggaatgaaacaagaagtactactgtcgaattataaagatgccagcaaggatattgcaaaacttaacttaagaccatatgaatcaattgtgtatcgatatacgaaataaaaaggttgtatgcccgagcggcatacaacctttttattttaagacaccactatacaaaatgcttacttctacttcaggtttgaattttacttttgcataatctttattccaattttttttcttccataagttaggatgataagcgataagatgtcttccaataccgaaagcatcacaatttgctttttgtagttttcgtgttatttttttcgcttctttcgtgagttgtttagaaagttctttatttagtttttctctatcgtccattgtatacatattatctcttggagattcaagtgctataacttttaattggagcttaatgtgagcataaacatttccttttttatctgttgttatttttaagtcgcgttttaattttcgattactaatttccattgttaaataatcagatgtcttctcagattcatcactagtcagtttttgggttatacgggcacttgttcccatttttccggttaataacacgaataaaacagattgttgcaaaggtaaatgcccagttaatttatcattgttaaataaagctaacccgtttgtaactacttcttttccttttatttttatagaaggaagggtaaagtctttaccgggatctaacatttttgtagcagctgtttctaaagtttcttttggaaatacactcatatcttctaagcttttcacttttttctttagaaaatctccaattagtaaatttcctattttctttttttcgagtatctccgatgtttcaccatctactgcaataagttttactaaagcagttgggtttgttggatctcgaaagctgacatctaaataggggagtatacccttttttagaattttggttccgagtaattgaacaccatatttaaaatagcgaatattcccagtcacatttttttttagggcatcgcctgtatccattatgttatgcccggttgctgaatatatttcattctcaaatgaagattgctctccgcttgaactttttacaagctcgattgtttgctggagtttattctcttccgtaatatcagctccaacgctataagctaaacttgcctcccttaatggttcttgatcccaacagccagaaaggagggaactagtacataatattaaaagtaatttaactctttttgggaacatactgttctcctttcttctttcttattattgaataaagtagaaataaaagagggaggacaacgatgaaaatataggtgaacttatcagtgaaagttgaaattacttttaattcttcaggtgtatctataaataaggctacactaaaagcaataataccaacgattggaacagcctttttatgattagcaaggttgaatatatgtccaattccgattgaagcagcgcagtaataactagcaatagaagcgacaactgttatcatccaaattgggatgaagattaggtccgttcgatctataattccaatatgcaaggagcgtaataagtaagcaactggctctggaataagctcaatttgctttggactaaatacgataaagcaaatccaaacggtaaaagtataaaaaagagttacaaatccattggcgatagaaatggccttcagttttgcaatagaactcccatttacttttgggaaagcgataagaataatttcaaaaccatacatggctgtaattgtttccttggatgcttgaattatattccaccatccggcttctgtaataggaaaaatataagagaaatcagctcgtgaaagccctagggcaattaaaagggccattggaataatgagaatagaggccatgacataaaatcgtacgatgactttaaatgtgttataagctacataacaacaagctactgtacataatatgagaattgcagaccacggagttgcgtgtaaaacccatactttaatgacgttacaagcattcaacataaccgtcataccgataagggtaaaataaaaaacataagaaaagcccaatagttttcctaacttattaccaaatagcatacaaacacttttatacatatctgcatcaggaaatcgttttaagaaaagccacataagtaaaataataagttgaatggcaagccccgcgatgagcgcagaaatccaaccaccaccttttgctatcggatgaagccggttaggtagagatagtataccgaccccaatttggcattgaataacgaaaaaggtaaattgaacaagtgaaattttactttgcgtgtttgtcaccgtcctcatcctctctcgttacatgttggcgctgcatttttttcggttttggatcatgtggtctttcccaaaatgaccaaattggtagtcttatgaaagaatctttcatatctttaatccgcatcggggcaacaggagaaagatatggtgtatgaaatgaatgaagctgacataagtgaacgaaagttataatgagaccgaatgatattcctacatatccgaatatggcagcaaggagcattaatggaaaacgaagaatccgaactgctgaactcatatcgtttgatggaacgagaaaagatgagattgcagttaaagctacaacgatgatcattgtgtaagaaacgagtccagcttttacaattgcatccccaattactaaaccacctacaataccgattgtttgtccaacgcggctcggcaagcgaataccagcttctcgtaataactcgaaaattaactccattaagagagcttcaaaaataggaggaagcggtactttctctaatgaagctttaatcgtatacacaagttcgagcggtaacacatcaggatgaaaagcaacagttgcaatatataaagctggtaagagaaaggcaattaaaaaacttactaagcgaatcattcggacgaaagaaccgacaatccaacggttattataatcatctggtgattgatagaaagcaaataacgtaacaggaacgatgagcgctgttggatctccatcagataaaatagcaacacgcccttccattaaattagcaacagttctatctggacgctctgtatttaattgctgcggaaatggggagaaagacgtatcctctataaattcttgtatgtatcctggtggcataagtgcatccgttttaatggtttccaatcttcttttcacttctataactaaatcgtcattcgctatattttgcatataagtaattgccactttcgtgtgcatttcttcaccgagtgtaaaatacttaacaactaaatttggactcttaatgagtttacgaatagaggttaaattagttgctagatcctctacaaaaccagtatgtggaccgcgcacaactccttcattatcaggctctgctatatctctctttaaagataaggttgtttcgaaaatacaaaaactgtcgacgtgttcatgaaaatataaggatttaccttgtaataaaagttgtatcccataatttaaattcgtttcttttttcatatttaacgtagaaaaagctttatctaaagataaagctgatcgcgttaataatggctcaaggactaactgatgaattagatttggatctgctaaagattcgatatataagattgctccttttccgttttgaaaagggagatctaatttttttatatcatcagaatgagaaagtttattttcaatgtaattaatgttctccggaagtgatggaaacatatgcttttggtttttactctcttgttgttctttttgctctgtcataatttccacctctcttaaagtgcaattgtttctgttaatttttgtcgtttgtgagaaatttatgcttgaattattttaaaaaaagaggattgaaggttacgttacattgtcttttgtgcattattcaatttcatagcagtacttctaacatttgtgtcgaattaagaagatatataggagggatacatatggaaatagctgtagaacgtgtttttacaaaagagattttaaaaagagcagcgagtttgtttcatgtaacagtggaagaaaagccacttggagattttgaaaattatatttttaaggcaaagggtgattgtggcgaagattacgtattgcgtttaactcactcttctcatcgctccaaaaaagaggtagaggctgaactagattttttacgatatgttgcggagaatggggcaaaggtagcaggacctctttattcaacgtctcaaaatcttgtagaagaaatcgtagcagaggatgaaactttctttttcgcttccttatttacatatgcaaaaggtgagcaagtaaaaggagaggaatcgccttattggggcgagcctctctttgaagcatggggaaaagcgattgggcaactgcatcgccttacaatggaatatcctaaaacagactatcgtgatacgtgggaagaagacgagagtgggattgttaatgaactagaagatgatcaagtgaaaaaaatcgctgcggtattaatggatgagataaaggctctttcaattgaaagagaaacgttcggccttatgcacggggatattcatccaggtaattttcattatgatggtaaagagttaacaatctttgattttgatgatgcagcttataattactttatacatgatttagcgatggttctttattactctgttctatttacaccgtggacagcagaagagaagacagattttgctcgtaaacagttacaagtgttacgaaaaggatatgagtatgagcacaggctggcggatagttggtatgaatcgttgccactatttttacgtttacgtgatataggtttatatggaacgcttcagaagaagtttaaagggaaagatatgcctgataacttcttgaaattatcagaagagctatacgaaagaattattaaaagagaagcaattgtgaatatataatacatttagttcaaaacaaagtatataaaacaaatatatactttgtttttttatacaaaaatatgtttactttattaaaataatattgtcctagattcggtatgcacttataattttatatatattctgaatattctttataaagaaggagggggaatgttgggaactttcgtaaattggttaaataatattgtttggagtccagcacttgtttatttatgtttaggagtaggtttatatttttctattcgaacgaagtttttacaagtaaggcacgtaggagaaatggtgaagctgacatttcaaggagaaaaatcagaggctggtgtttcttcattccaagcgttagcactttcgttatcaggacgtgttggaacagggaatatcgctggggtagcaacagcggttgcattcggtggaccaggagctgtattttggatgtgggcagtagcctttttaggggcaggatcagcttatgtagaatcaacactcgcgcaaatatataagacgaaacatcaagggcagtttcgtggtggacctgcttattacatcgaaaaaggtctaggagttaaatggtatgctttagtattcgttgcagcgacaattcttgcaacaggacttttactaccaggcgtacaagcaaatagtattgctgtaagtttagaaacggcttttggtattaatactaccgcatcaggggctatattagttgtcgtattagctcttatcattttcggtggagtaaagcgaattgttaacgtagcgcaagttgtcgtaccttttatggcaataggctatattttagtagcttgcgtcattgttgctatgaatattgaaaaattgccagaagcatttatgttaattataagaagtgcatttgcattagaagctgctttcggtggtattatcggtttagcaatctcttggggggtaaaacgtggtatttattccaatgaagcaggacaagggactggaccacacgcagcagcagcagccgaagtatcacatccagctaagcaaggtttagtgcaagcattttccgtttacattgatacattatttgtttgttcagcaacagcatttatgatgattattacaggcatgtataacgtatttgatgcaagcggaaaaaactttatcgttaataaactaaatggtgctcagccaggaccaggatatacacaggcggcggtagaatctgttttccctggatttggaaacggtttcgttgcaatctcgttattattcttcgcgtttacaacaattatggcgtattactacattgcagaaacgaatattgcgtacttaaatcgtgataaagaccgtccttggatgtctatggtactaaagtttgtatttttaggagctgtattctatggatgtataaaaacagcagcaacggcttgggctttaggcgacattggggtaggaattatggcatgggtaaatatcattgcgattttactattacaaaaacctgcattagtcgcattaaaggattatgaaaaacagaaaaaagaaggaaaagatccagtattcgatccaaggccattaggaattaaaaatgctgatttttgggagcatgaatacgggaaagataagaaagaagaagtatcttaacagaatagaaatgaagaagcaaaggggaaactctttgcttttttttatggacaaattgaagctaaaagttatttttgggactatttttgaatataaaaagaatgtacatgcattgttaggggaagggggagtatgttgatagaatttcgtaatgtaaataaatattatggtaactttcaagttttgaaaaatattaatgtgcaagtgaaaaaaggcgaagtggtagtagttgtcgggccttcaggatcaggaaaaagtacattgcttcgatgtataaatcaattagaggcaattacagatggagaattaattgtacaaaatacagaggtacacaataaaaaaacggacatgaatgaattgcggcgaaatattgggatggtctttcaacatttttatttatatccacataaaacggttcttcaaaatattacattagcaccgattaaagtaaataaagtttccaaagaagaagcagagaaaacagcaatgttttatttagagaaagtaggaatcccggagaaggctaacgtatatccacatcaattatccggaggacaacagcaacgggtggcaattgctagaggacttgcaatgcagccggaaattatgctattcgatgagcctacgtctgctcttgatccagagatgattggagaggtacttgatgttatgaaagcactggctaaagaagggatgacaatggtcgttgtcacgcatgaaatgggatttgctagagaggtagcagataggatcttatttatggatgatggtcaaattattgaagatacaacaccggcgcacttttttgtaaaccctgaacaagaaagagctcgtttatttttaagtcgggtgctaaatcattagaggaggaatttcatgcttaaaatgaaaaaattatttactttaatcgtattttcatgtttattcgtgcttgttgttgctggttgcggaagtaagaaagatgaggcaaaggaaacaaatacgaagcaaggcggggctgttgagcaaattaagaaacgagggaaatta

SEQ ID NO: 1316 - DNA, 11908 bp, Bacillus thuringiensis
aaagagtaatatccagattaaaagctttaaaggaaaaataaagaagaaattctagtatagaaattggctgaggcattagagatagagtacaactaccttgaatgataagattaacggttactctgtgtttgatacagaagaagtaaataaaattgtgaatgaattaaaaatagaaccgaatgaggttatacgaattttttttcctcgaatgttgcgtttcgtaactaatggtgttgcttaatgaggtgtggttgatggatgtctatagatgtgaacatgtcatggatttgtttagtgtgaaagagacgaaagcgcgagaaattattaaacagcttaacaatgaactaaaagaaaaaggttatatcacggtagccggacgagttccaatagagtattttcacgaaagaacaaaaatacctaaaaataatcatgaattacggtaagcgggttaagtgaaattaatcttgatgttgtagatacagaggaggtgaatataatgaaaaacggtaaaaagccaaccaagaaggaaaagatccatattgagtcacacaatttaaattctgataattggttaatcttcaaaaagttaagtaatgaaatgcatttagtacatcgtgatacaaatacaacaaaagtaattccaaatgcataaataggaggaaaataacatggataaattaacggtagcaaatgaactacatattttaggtaaacaaaacattgcgggttatcaattcactggaatcgagggtggattcggtgaaagtaagaaagcaatgttagtaaaagaaattgctgaaattcatgggcaacaaattggagaagtaaatcgtcgtattaatgataaccgaaatcgttttaaagatactgtagatattattgatattagggctaatgggtttgagccattaggtcgattggctggatatacaaaacaatcatttaatcaatcgaagaacatctacctcctctccgaacgaggatacgcaaagcttttaaaaatccttgaagatgatacagcatgggaattatacgatcagtttgtagatggatatttcaatatgagagaacagaaacaaatccctacagacccaatgagtattttaaaactaacatttgatgcgttagaaggacaaaagcaagaactccagcacatcaaatcagatgtcaaagacttacgagaaaacgcaccattattcgcagtagagtgcgatgaaatatccaatgcagtaaaacgttatggtgttgtattacttggtggtaagaattctaatgcttatcaagaccgtggtttgagatcaaaagtttataaagacatctatagacagttgtatagagagtttggagtaacaagtcataaagcgattaaacgtggtcatttggagttagcatcaaaaatcgttgaagaatacacattaccaattgtattaagtgaagaaattacttttgtaaattcacaaataaatatggcggaagttcagtaggaggaaaagaaaatgaaagaaactaaatattttgtacttcataacagaggatatggtttaaacgcttacgagtgtgaatcaaaaattgaagcgagtcgtatgattaaggggttaatagaagatggtgaaccagcatcttctattatacttacacaacaagttgcattaaaaacaaagattcaaagtgtaatagttgagattgatgactaatcatacgctaagtttattcagaaggggaagtgatttagtggaagatacaacatcgttagtagtattcgcaatgtttatcgcatgcagtgcattgttgctttacattacttacgaaccaataaaacgatgggcatggagtgatgttgaacaaaaggaaaagacccaaggcaatgggtccctttagaaaaacacttgatgttagtataccacggaaagtagggaaatagtacatggatttaattgaatatcaagtgctattacctaatgagttttgggacttagcaaaaagcaacgatgaattaatgcaaatgattgaacagtatttcagtgttggttatccacattatgaaattcaaagaattatcaaaagcggacaagcatatgtggcggtttgtacaaggaggtaaatatttatgtcaaacgtagtaactgaaattggtgggttaaatttcaaaggtaatgtggtagatcatgaatggtttaattacatcacttttagtaatggtaagcctcacattgtagcgattatggtattgagtgaaattgtttattggtatcgtcctacagttattcgagatgaaatagatgggaaagtaacttacaagaaaaaatttaaagcggacaagttgcaaaaaaattatcaacagttagccgatacttttggatttacaaaattacaagtgaaaagagcatgtgatttattaactgatatgctacttgtcaaaatcgagtttaggactattagcgctgatgggaaaattttgaataacgtaatgtttgtggaacctgtaccaacagaaataaggaaaatttctagtatgtatcaagagataaaagaagaccctggttacttagaagtaaatagggtggttacttctaaatcaagaccctcttcacttacaagtaaggagtctcctaacttcaaagtaaagacaaatacagagattactacaaagagtactacagagaatgtaagtagtagtagcatcttctctttctacgaaaataatttcggtattttaaattcattcatagccgaaagtatttcgcaatgggtaaatgatacaagcgaagaacttgtacaagcagcaatggaacgtgctttgaaacagcagaagaaatggaattatgctgagggcattttaaaacagtgggttaataaaaatattcgtactttagctgatgttaatgcagcagaaatagagtttaaaaacaaaggtaaaaaaggagcgaaacgaaatggcaacaccaatgaaaaagctggcagaatccctggaattgaaggtgaattaccattctgatcaatgtatgaatcactcttatgaaataggtggacaaaaaatcattaagccagttcaaatgattgaatacagaggacaagttgtttgccctagatgcgtagttgaacaaaacaacaaagttttagaagaacaggctaatgctcactataaaaaaattaaccgtttgcaaaaatttaacatgctggaaaaggctagtgttattacaaataagaaaattcctctttcaagattatctgattacagaaccgggtgtgatgaaacgattagtcacaagaaagctatagaagaaactttggaggatttaaagaacggagaaattagaaaagttgtatttacaggaaatcaagggacggcaaagagtttcttagcatacagcatgcttcatgaattaaatcaatatttctgggatatcagtcagggagaagaaaactatcatcttatgaaaagttgtttatatgtggaattagaagcaataacaaggatgattatggattctttcgatgataagagcagtaaatatacacttcaatattttgttcaattaattggccaagctgattttgtagtgttggatgatcttggggcggaaagtggttcgacagattcaaatagacaagcttcagatttcatccaacgtcttttatatgcggtatcaaatgctagacaaggaatgagtacctttaccactacaaactttactggaaaacaactttttaataaatatgatgctaaaaccgttagtcgcttattaggtgattcaaaggttttgaaattcaccacagcggatcaaagacttgcaaatttaggtttctaagaaggaggaataatcatgtgtgtattatgtcgtgataaaggaattattcgtaaagaaatttattcaggtgtaactctaacggaaggttgtaactgtgaagtagcaaagcaacaacaagaagaaaatgataagcgttggaaagcgtacttaattaaatttgaggcaatgaagcaagatttacaacttaatcagcaacaaaaagttagctaacaagaaaaagggggatttcagtcgtatgaagcctacgaaagttgaaatcgatgttaatgataataaaatttacgtggtcaaaaatggtgaagttactccgctgaatcctccagcaacaggatttggtgaacaaatcattacgtggcaaagtgggaaggttgatcgcgtatcaactacgtatacggaaaaaatcaaataactggagatgcgattatgaagcaattatcgattgatgatgtaatagggagtttttgctacaacgccataagcaccagtgaaaagtttttaaatccaagttttgaagtgcatttttacgataaagaagaacgacaaaaaatggattgttttgatgctaaaactgaagtggaagcttggaatgcagcgttagaagagcacggcaagtgtattcagaagattaggataactcattcaaatcgtactaggacagaatttttggcactcgattaggagggagaatggtggcggctttaaatcgatggttaaccgatgaagaatatgcaagggctttatctaatggaattagtaggaaaacgttacattatcgtgtttatgaagcggattgggatttagaagaagcattaacagcaccgccaggaagcgtaagacataacaagtttgagggagtgcacacgaaatggcgtagaatcgctgaggcgaatgggataaacgcagctacattttacagtagattaaatagcggttggggatatcaagaggcctctacgaaaccagctataaaaagaaaaggtttgggaaaagtgtggttagaacgagctaagcccaatggaattggctatagcacgtttatgacaagagtaatcactagaaaatgggatatagaaaaggctgtaacaacaccagtaattagaactggaaaaaatgcctcagtacgattcgagaaatcgattgtgagaaactgaaggaattagaaaaggagctggagataatgaaggaagtaatcaaggaatatataaatcaattgcaacaatcagcgatggaaaacagaaaggaatcagacaaagcgtatgaagttggagatttaggtttatcaggttactatcgtggtcaatggattgcgaatgagggaacagcaattgcattagagactatcttaaatcaacacagagggaaaagtgtggattcagatctattaaagtaagaccaaatttgaattttgttaagaaatgaggaatcgtagtgaaaatggtacgtagacgtgcggttattcgtttagaaaagcaacgaaaaagcgaagatagattcagtgtgattagatgggaagtacacataaatttaggtaaacgtaattataagactaaagatatattaggtgcgtatcaagatatgcaagccaccatgaacaaagtggaaagcataatgatggattagttttataacaaaagcgttatttgaataaaaaacaaaggggaggaattagaggtggaagcgttagacttaggcggacttaaaagcaattggagagcatttaaagaattactggaaagtaaacaccaagattatttaacggagtattactttgtctttagagaagatgattgtggggatgaagcatatgcattcacgagtcatactgatttagatgaatggttatctaaaaagttttgggaatgggagcgttatgatactaggaatattgaagaatcaatgaatgacatatttgtatggaaactaatttctgaaagtgattttaaacgtttaagttctttatataagggtgcaagaaaaacgggaattgagatcgatggggaaagatactaccgaaagttgataccagtgagtgtagaacctacagtagttgtttcaactaatttttattaaaaaggatcgaaaaggggaacggaaatgaaacctacatttgaaatgataaagaatgaacatggtggggttgagatgacttatacaacgagtggagggaagcaatcttccacttacttccctggtcctccagaagatatagatcatgtttgcttggactatatgaaaggtcgctttgcaaacgttagaacgttgaagcaagtagaatttataaaacgaaaatataaagaagcttatcaaacagtattcggtgcaatggaagaattaaaagcaggtgacaaggtagtgatgcacacttgcttagaagcgaagcgttatgagggaaaagtttggacttgtagaacagatcaatttaaagcaaatagtggttcgcaagtggtgtttttagaaggatttagtggttacttctcagttaagtatttgcagcgtattagcttgttagaaaactaaacaaaatagttatttgaatagaaagggagaaaatatggaaccttcaatagaatcaattaaggctaaatgtgacgaagctgttgaaaatgcatttactagtaaccctttagtgatgttagaagtagatacaatttattggttaattgaaaaggcacaagaaaaaggagaataagatatggaattttataaaatgtcttttggcggagatcaggatataaaagttatcctggccaatagcaaatatgaagctgcaggatattatttaatgcattgtcataatggatgcggatatatggatgacgtggtgttagaaacaatgcatccagatgaaaaaattgaagtttcttgtgtcggatttccagtatatcaaacattagaagaattatataaagagaaagaatttggtgatacaccatgcgttattgtcggattagcaaattagaaaactaaacaaaattcttattttggagggaaacggaatggaaataaaagtgaatgagcaagctcaacgtttttatctagcatttgatgaatgggtacctgcagttggtcatgaaattaaagtgggaaaatatcgtttttgtgctattccattaagtaaatctattaatatttcagaagtaacatctggtgtacatgctatgagcattccgattgattttaggatttggatggcaacaagtactaaggaagatacaatgaggtttttagaaaaagcaggtgaaggtttaaagcgaatccttaaaagacaaagtaatttagatgaattacttaaaaaaaataaaaagatagcatttgatcgtttgggagaaatgccaccaattgaagatgttgatacggattggataactgctgagattagtgatgtgactcattaagtaatacaaaatctttatttgagaggggaacgaaatcgtgaaatatgataaacaagaatgtccgaaatgtagcaagccagttaaaactttatatagaccatcaatgagtcataaaggcccaaatctttgctattggtgtaataagaaacgtgttaaagaagaaaaagcaatgagcgcacaaaaataatacaaaatctctatttgaaaaacgaacaaaaagcactactggatccagtgatagttcgtgatttaatacaaaatcgttatttgaaaggaagaatgagggatggatttacaaaagttgcaagaactgaatgatcttagactcacaatagaaatgtacaacgatttaatggataaatacgatgatgaagatttcgttttagaaaacttagataacattttaaatgtttttcattcagtgccacgtctggttgaagaaattacattattacgggaagagaatcagcaattgcagtatgagttaaaagaagaaagaatttgaacaaaaacgctattttagtataaaatatttaaaaagaaggacccacattaagggggtgggtccttttaacaaagctaagcatatagagattaactatatattactaaaaacggattgggatttctatgtgttaattgttgagaaataattaataaaaatttcattttgtagaaaaggagaatggatatggtcatagatccaccagaaccatacaagcataaaaatggcacggttgttcatttaatggaggttaatccgaatgattggtactgttgggctaaatttcccgacggttacatcaaaccggtatcagaagatgttttctttagagattttgaaccattaaaaagagcagctagcaaaagctaactgttcggctggttctccaagggggaacaaggagaaagtaacttaatgggttgtctacagtattgacggaatattgagttttattcaagggaggaagaagaaatgagtaaagaacaaatattaaaaaaagaaataattaaatgggtgaaaactatgaatagtgatgacccagaacaatttaattcatgtgtaatggaattggaagatatgttgttaggatatattgagaaaaatatggaggtagagggaaatgagagcaagatattttgagtatatggtttcttatacttttggaagttataaaggaaacggaaatgggagcataattttaaagtttaatagaaggataaatgggcgcatgttaaaaaaagcaaaagatcacatagaaatgaacaataaatttccaaacgttgttatacaaaattataaattattaagggaatgtagaagttaaaaccaaacaaaataatcctttgaatagaaagtgaggttgggaaaatgggaatgagtgtagaaggtgtgaaattctatttagaaacacccgatggagaaagcgtggaaataaagggtggtgttgattgggcggatacttctcctggtgaaacaggtaattatgattttgactttactaaagaaataagtgtgccgtgcacttttgaagaaccgcaaaatataaaagatctgcaagatataggttttacaccaccacaagcatggaatattcatttgcacaaaggtgagagttggaaagaaaactcaaaagcaagtcttttaaagtaaattaaaaatcaatattgtccggctagaaaactagaggacaccaattcattaaagcagcaattaaagctgttttaggaataggtgtcctttttattttgaaaagggagatggggaaatgaaggtgttaaaggatcagctacgtgaatggaaaaagcaatcgaatcaagcaaagaagaaaaagaagaaaaaacgaaaagagaaattaagtactcgtgaaattgaggatttaatggggatgcatagaccttgctatgaacgaagacgtggagcaataagacaaaagtaatttaaaaataaaaaggagtggtcttacatgactaaacaattatctttcttaccaaaaatcgatagaacagcgacacaagaggaattagaaggtgtgttggaaagcgtacgtatacatagacaatttgggatgatgcgtaaagaaatgaaagtcactccttcttatgaaatacgtgagcatggtcctacacatacagttggaaaaccattagaagatgttgctttagcaaatattcaacaaagtaaacgagaagagtggcttgaaagaatgtcagtacgtatcgatcagtttctaaatcgattaggaaatggacgtgctggaagtatccaaagagatattatttataaacgttatttagaagaagaggacgtatgtgattacatggtttataacgaaatagggatgtcagagcgtacttatcgccgttggaaatctaaagcattttataagcttgcttttgcacttggattagaagtttatgagacagaagagactggaggtaatgaataatgaattttgttcagccgatacgtgatccagaagaaatacagcagctaaaagaatattttaaagaaaagagcttacgtaattacattctcttcattatgggaatcaatacaggcctgagaatctcagacattttgaaattgaaggttggagatgtcaaaggtagtcatatatctatgagagaaaagaaaacagggaaacagaaacgaatacaaattactgcagcactgaaaagagaacttaaatggtttattgaagaaagagaagataatgagtatttattacaaagtagacaagggaagaatcgtcctatcgggcgtagcatggcatataagatattaagtggagcagcggcagagtttggattagatgaaataggaacacatacactgagaaagacgtatgggtatcatatgtacatgcaaacaaaaaacatagcattactcatggagatattcaatcattcgtcagagaaggtcacgttacgttatataggcgtaaaccaagatgcaatggataaagcaatgactaggtttaaaatctaagcattgctttttctttttaaatctatacagttactcataaatttcgtactgtgtaactcaaaagggaaagtttaattaagtcaataatatcaagggatttggcgaaggggtcagttacacacaatacaagatatgggtaactcattggagaaagaacaggggagataagcggttgccaaaaaccactgatttgggcaaaacagttgcaaagaataagtgaggatattgataagaaaaaataagtggcagagtcgtgaccgctttttggcaggatatgtaccggttgttttggaaataccgtgttatatttgtattgtgagaagtggcggaaaacacaactcactatgttgtttctaaatttctaaacgattcgtaatgatggcacataaaatccgaaaccagcagatggtactgattgagtgataccgttattaaggagagcttttgctcttctttgagctaacaacatcctaggtagacggaatgaggagacctgataagtcggacaagagtttctgtcgtggttgttagttgagagaagaataaaacttcatttaccgtatgcgaatttattgtaaataataacgttctctatacatttgaaattatatatcgataaaaggatgttgtgtttatttgtcgaaatatagaatgatgggaagggggtgtgtaagtatggctagaacattacatacaaaagttattatggacagtggtaaagaatatgaccttgatgttcatccagaagactttatgagtcgtatctcaaatgaaaaaggggaattgtataagggatttgttcatttttttaacctttcaataaatcctctacatgtatcttcaattgagaccgtagaagtgaaagttgatggaagttcaggagttactgcaaagtatgtgcttgaaccatttgttacagggattaaaagagattagggaatagttaatatctgaacagtcgctatcgatatagatagcggctttttattttggaggaggatgaagggtggataaacattacgtagagcggaatctatagattctattaaatgtcgagcaattaaggagtgaggatagatgtgtaatgtttctagatgttgtttagcttgtgactatcaaattaaaacttatcaagcgccagaagatgaatatcaagaagtaactgtttgtccgaaatgtaatggtgcgtttgtagatatgtttaagttagagaagtacaaacaatctaacgagactgtagaacctttattaacaattacattaacagatatagatgctaaacctatagttcattacaaaggtaaacagatagatagaaagttacgtgttgcatttgattgggaatcacaatcgattgataggattaatcggacatacattcatattgaacatgtaccagctgataataagcaattcaatactgaagttattcagcacaatcatcctattgtggaagaccaagtggagctttatcggttatgaaagaatacaaaaccaaacaacagaagcgtaagttctatgacagtggtgagtggaagagtatacgagagcaagtaaagaagagagacaactatgagtgccaagagtgtaaacgtaacggtcgagtacaaacagataccaatgagtacagtgagagtgcaaagcgtaagaagatacagctcgtcgtccatcataaaaaagaactagaacatcatccagaactcgcattggaa

SEQ ID NO: 1317 - DNA, 12204 bp, Bacillus thuringiensis
taaaagcgacaagtattattttataaatgtcatgattacttccaaatttaaaacgtgccaagattgagaatcgcctagaatctcgtttaaagcactatacaaaatacaaattacttattattgatgaaattgggtacttgcctattgatccggaggatgcaaaattattctttcaattaatcgatatgcgttatgaaaagcgtagtaccatcctaacgaccaatatcaacttcaagtcttgggacgaagtattccaggaccctaaactcgccaatgccatactagatcgtgtcttacatcatgccacggtggtcagtattgtaggacaatcctatcgaattaaagatcattttagcaaagaaaatgattgattttgtacatgcttaaacaagcgaaaatgtacatgtttatcttgacatttacactaatttccaaaacttccaccaggacttctttttagctgccctcccaccactatgagaggtaaatgaaggaaaccgatacagcttgtgcgtatgcagtgcattttggtctgggtcacagtcttttaacgtggtcgaactacagggggagtaagcatattcccgatggatccatttctatacctccattatctagggaaatcccccagtatccaagactaaattttacccatacatcattttttgatgtagctcttgaagataaaaactatttaattttcaaggaacagttattaacttaaaacttattatatgaggagggtgtatcatgaaaaaaatatgctttgtattaattgtcgacgctggtataaattatggttcaatattttctctaccatttttaaggaatcaggatgatttgaaggaatatttctctaagtattatgatgtctcaattaattatattagggataaaaactcagttgactatttggtagttcccaaaccgtgtccagcttttgataatgaaaataatcttccaataattgaagtaccagcaatcttatttatggaaaagaattttgaaaaaataaagacttatatagataattatttttccaataactcataaagaaaataaaagtacaataaaaagaagtccgataaaaaacgaatatttctattaatcattcgttttttattatatttacatatattttttaaaagaggattatagacgttctgaaaaaaattaattataacaagaacagtgttcgtgctactatctacggttattttttgtactaagtacccctttaactaacaagacaacaaaaaataattaatatattaaagtgaataatgttactatttttcaaacctaatctagaagacaccggaattctttcggcttcatattccttcatcagctcaaaatcagcctgattattaacatctaactttcgtaaatcttactttttatctatttgacgtatcatatttgaaaccttcaagctgaagctactttcttgcaccttttcaaaaccaaatttaggataaaattctaacaccgtatcattcgcgaataagtatataaaattataattcttctcgtattttttaatgatatgattcattaatttagtcgctaattaattgatattcattcatgataaatcctccattttttattatattttcctaaaaagagtgtatatttcttacaacaatctactactaagttttcgttaatcaccgccttataataggtgtaacggcataaaaacatgcttccggaatcaaaaaacgacaaaaaaaagaccacaagaagaaacatcttctcatggtcaaatttctgtctattataaatacacctatcccgaaagaatagatatcgtgaaataacatgaaattttttgataagatataatgtcttctaaccgctactagtaaaagggtataacaaataaaatcaaggaattgtccttaatttgaccttttacagtataaaattcgtttgaattttaattagcgattaataagcttcatcatatacaatcaaaacctcttttcaatataatttcttactaagaatatctcctttgaaaaccgttgtaaatgaagacataacaaaaaacaagatttatgtccttctgtatcaccaaaatcggtcgtttttggtgatacaaaaagacacatactattattctcgaaaactacagaaaaatccctccgtcttaagacagagggactttctcattcctatttcaaactacctgcaatctccgtaaagataactccaagcgcatgtgcacctgcatcagggtatcctaaacttctttcgccaactgtaccagcgcggcccatgcgagctacgatttctttcgtgtactctgctcctttaaccgctgcttctgcacctttttcaaaggcagtttttacgtctacttcgtttgaggcgctatctaaccaagagtctacacatggagcaagtgcgtcaacaagcgttttgtcaccaactactgctcctctgccgaatgatctctcaccgatcgattggatgccttgcagtgctgcttgcagtatttcagcgaattctttcactgttaactcacgcttctcgcctgctgctttactagctgcgcggaatgcaccgccccaaattggaccagaagcgccgccgcaatgttccataataatcatggagcaaccatcaaggaatgatccgattgttacgttctcttgatctacaatagaatgccactcacgttttaattgcttaaatccttttgctacactcattccgaaatcgccgtcaccagcgtgcgtgtctaactcacagaatggtacttcatttttaatgataatatcgctcattttatcaacgagataaatcatgttgtttaatgtaatgacattatctttaataacagcgtgttcttctgctgtttctagttcaaatgaaacttccttctcttctgtttcttcaagtacatttacatactctaaactttcaactggtccatctactttaaacgctggtgtattacattcttttgatagtaatgtttttaactcatcatctaatttcattacagttaaagacataccagccatatcgatactcgtcatatagttgccgacgaatactctattaattttaatgtttctagcagctaattctcgcgtcactgcattgttaaataagtaaagttcctgcagtggtgttccgccaaaaccgttaactagaagtgcgatttcctcgccatcttttactcctaaatcttttataaggtcatttgtcatacggttcgctagttcatctgctgacaacattttttcacgcttaattcctggctcgccgtgaatacctacgccgtattccatttcatcttccgcaagtgtgaaagtaggtgatccgctcgctggaactgtacaagacgttaacgctaaaccaattgtgcgcacgttaaccgctgctttttctgcgacagttttcaccgctcctaaatccatacctgcttccgctgctgcaccggcaattttatgaactaaaataactcctgcaacgccgcggcgtcctactgtatacagactatcttctaccgcaatatcatcgtccactttgacgtagtcgacttcaattccatcttccgtcgctaaatgcgcaccgtttttgaaattcataatatcgccgctataatttttaataattaataacgtaccttttttactagctgtttctttaattgcttgatatacctgaatttgtgaaggagaagcaaaaacatctccgcacaccgccgcatctaacattccttttccgactaatcctgcatgtgccggctcatggccactaccgccgccactaattaacgttactttgttttcgttcatttctttcttcttaatcactttatattttttcaaaagttcaagctctgggtgagccataaccattccgttacacatttccattactaatgtttctggtttgtttataatctttttcattgtgattatccctcaattcctttaatatattgtgatatatttgaaatcttcttcttactactcatgttaaaatgaaagcgttttatagtaaacggacaaaatggacaatctgtctaaagacaccgctctcatttatagataggatttttatattactaacattctagggatgattcagatgacctcttctataatttctaaaaagataatcgcgaactcattgaaatatttaatggaaacagagtcgtttcataaaatatcagtgagcgatattatgttacactgtcaaatgcgtagacaaactttttattatcattttaaagataaatttgaactattaagctggatttatagagaagaaacgaaagaaaatattatagactttctcgattatgaaaaatgggaaaacatttttgatttattatttgattacttttatgaaaatcaaaaattttaccgaaatgcttttaaagttattgagcaaaactcgtttaatcactatttatttgagcatacgaaaaacttatatatgaagattattgatgaactatctgtaagctgtggatacagcctttctgatgagacaaaaaatacgattgcctccttttatagtcacggcttcgttggaacaataaaagattggattgaaagcaagtgcgaagtagatccttccattatgtcttctcttatgaaaaatatgataaacaatcaattactactattacttgagcaatcagcaaagtaattaaagggtggcaaaagcaatgaaaaagattatgaatgatgtacaacatatcgttcaagatatgctgcatggcttttattttgaacataacgacaaagtaaattacgacgaaacaaataacatcatttatgtaaaggatatcgaaaaactaaagcaaaacgtcgcgattataagcggcggtggtagcggacatgaacccgctgatattggctatgtaggaaaaggtatgcttacagcggcagtaaacggcagcattttcactccgcctacagtggaacaaattgtagcggctactcgcctcatgccaaaagataaaagtattttattcatcattaaaaactttaaagatgacgttgagaactttctagcggctgagcagatcgctaaagaagaaggaagaaaaattgaccatatcatcgtaaatgacgacgtttcaattgaagatgatgcttcttttaataaaagaagacgcggcgttgctggtactgttttcattcaaaaaatacttggtgcgtctgctcttgaaggtcattctttagaagagctaacaacaattggccgttctgttacagaaaacttacacacattaggagttgctctttcacctgcaaacgatccagtgcaaggaaaagcttcattcacattaaatgacgatgaagtgttttacggcgtcggcattcacggagaaaaaggatatcgtaaagaagcactatcctcttctgaaatattagcaatcgaactaatgaacaaacttaaaagcatttatcgctggagaaaaggagacaactttgccatccttattaacggactcggcgcaacgccattaatggagcaatacattttcgcaaatgacattcgccgtttatgtgagctggaaggattacagattacattcgtaaaagttggtacattgctaacttctttagatatgaaaggtgtttcgctcagtttgcttaaggtagaagatttggattgggtgaagtggttgaaggaaagtacggaaactgctagttggtaatacaaataaagtgaaactttaatcagccctcaccaatcgggcttttacgggcagaccgatcctcaccttgaaataaacttttagataactcaaaataacaagcaaaaagtcccttcaaagttaaagggactttttagtatgtagaaattagcctaaacctaagattacatctcttgaaagggggcatttttatgttattcaggtttattgaggagcttttgtttgaagcaactttaaccccataccaataaaaatcagtcctgttatcttatttagaatcattcctaccttttggtttcctcttaatttttttgtaacatatgaagagaaataagcaacaaataaacaccataatagtccagttactgtaaaagtaagtcctaaaatgataaaaggcataggacctgaagcctttgtatctataaattgcggaagaaacgcaataaagaataaagagacttttggattcgtaagacttgttaaaagcccttgtatatatatttttctaatgttcaatttattggacgagacctggaaagctacattcgtcttatcaagtatcattttaatccctaaatatacaagatagataacacctataaccttaatagtgttaaatagcacaatggattttgtaagtataatagataaaccaaaagcaaccaacaacgtatgaactaaagaaccagtaataataccaaacacagaatacatacctgcttttctaccttgtgaaatacttctccccacaatgtacatggtgtctgcaccaggaattaaattcaataaaattcctgttagtaaaaacacttcataattaataataccgtacattttagcacctctatctatttttttggtgcccttattgatattaaattaaataaacgaaaaaagaaagtattttctatttattcaataaaattagcggatttttgaatctacaaacgaaatccagctatttaaaaattcaattactgaagaattctgccctcaatattacagcaaatttacattaaaaatgtaaatcctcatttcctttgtattttcctttattaagtctttttcttatgaataattctgcaacaattaaattgggtacccacgctaaccaagcaataatagcgtaactaagttcaaaacgctctattccaaatagaacgataaacaacggtagccaaattcttaatgtaactgctccaaaggttaaagaataatttctaatcatccaattccgatgctctttaatttttttattcttaactccatgtaacgcttgatatgctgatgttagccaaaatacagataacaaaccgaaacctagcttcgctaccaatcctcccgtagcataaaaagataggtatagtccagaaacgcctcctaataatataccaaccatatagattctcccaattattcgatgacggttgatattcctttctctaaatctagtggataatgtaaaaggaccaattactaatgctactatactagttgtaatatgtataaatagcatcatataccagaacgcacttaatttagatccaaacataagcttcacttttacaagccctgtttgaaatccatccataataaaatattggacaacaatataactagctactaaaaatgcaaaacaagtaactacaaaccaaattttcctgttcaaattttactgcctccttattacattcacgaaaattagattatatatttcttttcattctcgggaaaaatagaaaagccttctttactctctttagcacattgtttttataaaccgaatgacttacatgcaacgacgaataaaatatatgatacaaggcccttcttcatacataaaaaccctcaagtatgtcgttctatacttgagggttttttcatttattctctctcgtctctcattttcttaaatcaataattagctcatctgtaatctgctcaagatggaaaaatctttttatataatggatatcagaccatttttcttctccaccaataataaataattcttgcgcatcatacataaatgaaaagcttggatagaaactgtccgcttttatttcaatcccaccagtacgattactgataatcttacagtctgctgaatagcttaatagcgtatagagagaatcttgtgctgattggaagaaatacttcataagtgtggttatatcatcactattggtaatgcacactttaaaaaagttcgtatcctttttcttattagtaaaaactagctcaaaatgaagtttattctcttctaaaaacccttcaataaagtctctacataaataagtttcaaataacatatacataggaaatttgttatgtgcgcctataaatcctttaataatttcttcaaatcctgtatgctgattcaaattcgttcccactcctatcataatagggtgatttaaataaataggatacggtgattgcccttcatcttttaacatatacactcgtttttcatctgtatgaagagctggtttagactcttttagtaagtattgagataattgaacatttaacacatttacacctgcctatcatgtcatacataaactgtatctattaagttagaaaaaaggatgaacaattcatattttaccgtgtataagcgagaagaactagaatagatcgccggcttacatgtctccaggataataaatgaacatcgcacctacaaatgaaaaaactaaacaaaaaacagcctcgtattttataactaaagaagagttcgtatcaagccttttttcctctcttttacatatcattttaaacattttaaataaaactctatatattacataccccacaattgccccaagggtattcgtaaatacatcatcaatatctgtaattctattatttaataattggtttaactcaattgccaatgaaaaaaagaatcccgcacatacggtgtttttcatttttctaaactgcgaccaaatagtcggtaataaaaaacctaatggcataaacagtacaatgttcaaaagatacgtcgtactacctgccgtatcaaatagagtcaagttgatttgacttacacgaatccacgtttcatatctacttatatcccatacagtcgcgatctgcgtcaccctatacactagcgaaaggtagaatagaaaaacatatacccacaaaaaatgcagaatagatatagttcttttcgctttaaaataaaatccaatttgaaacacaatacaaaacataatagtaaaaaaataagtatacaaataactcatcaaaactcctgtatccatgtagaatcccctaactttacaatttcatctatgactttgttgtttataggataggagaaacttttaaaataaaaagtggggtaaacataaaatttttcttaaatcttcagttgggttttattattactcttcttaggaatccaccattgatagctaggcaacagtatgcttacacttaacaatattatcatttttgcacgtaatcctcgtaatactttaaccgatgaagcatatataaaatcatgtgaatcgtttgttcagttaaaacatgaaattaagaaatatatgacgtactataatcactcttgctatcaatagaatgtacagaagatgactcctgtttgcatacagaaatcatcttttttaggttaccgattttttttataatgtcctttacaaagggtacaaatcaagagcatcttattcctattcaaggggatcaactataccttcctcccttaaaatcactaaaacccatttacgaatctataaaagtagatataatatccttatggaacctttattaatttataaagcattgtcaaatgaaacaagatgtcaaattttatcatggttaaaaaatccagaaaaccatttcgacgaaaaaccttacctagaacaagaccttaactttcaagttggagtatgtgtaggagatatccagcttaaaactggcttagctcaatcggttatttctagttatttattaactatgaaaaaagcaggcttactagagtctgaccgaattggaaaatggacctactatcgtcgaaatgaaaaaacaatacgagagttttctgaatacgtccaaaacgaattataaaatgaaagctaataatcaatcagcatactaattgattattagctttcacacattctgcttttttacaggtatccaatgacttcttataaattgcactgcctgtaaaagcaagaaacatcgaaaggagaattttttttaatatatcatatctagttatttagatatctgttattgtatttcagattacatactcctgataatattggcatccaatcatgcttataataatgcttctttgttaatgaatttactttcaaaatactgatacgaatggagagttttataaatgaaaaaagtaaatcctttacttattctgacactcgcaataggtgtgttcggaattattactaccgagatgggtattgtcggcgtattaccacaaatcactgaaaagttcggaatttcaactacacaagctggatttttagtaagtatatttgcactagttgttgctatttctggtccgtttttaattctgctcgtctctagtattaatcgcaaaataattttattaacagcaattttcacatttgttatttcaaatttaatctacgcttatacaacacaatttgaagtcatgcttgtttttcgtattttaccggcagcgcttcatccactcttcttttcaatcgctcttgtaacagctgctaaacttgtccctccagaaaagagcggtcaagcagttacaaaagttttcatgggaattactgttggtttcgctttaggtataccactaacctcttaccttgcagaccaattttcactcgaaatggctttcttattcggagcattcgttaacactcttgcattcattggaatactactcctacttccttctatgcctgttaaagaaaaaatgtctttcggcaaacaaattcgtatactcggcaaaccaggattatggttaaatattttaaccgtcacattcctttttgcagccatgttttccgtatacagctacttcgccgagtaccttgcaaaagtaacttccatgaatggatctctcatcagtatcatgctattcatatttggtatagttatgattttaggtaatcatttatttggtggtctcctgcaaaaaagcataataaacactgtaatatcattccctattctatattctattgtttacatattggtttattatttaggttcctaccctgttccaatgatttttatagtattcatttggggaatcgtacatgctggtggattaattgttggtcaaacatggttaataagtgaagctaaagaagcacctgaatttggtaacagtctattcgtttcgttctcaaatctcggaattactttaggaaccactattggaggctggttcatttcaaacttaggtattcaccagcttatttggagcggctttatattcacactactctcatttctattaattataataaaactaaaatttttcaattctaatagccaggcttcattatcaagctagtacattttcagttccaaattcgataaagtgaaactttaatcagccctcaccaatcggacttttattaatttcaacgtttagacagatacataactccaaaactaaaacgtttattgcaattatcgatatggaacattttacaaaacaacttaacatggtaaaataatattcggacaggagtccaatattattaaaattaagatggttcaagtcggaggaaggcaccttagggtgtcttttctttatttgcaaatggacctgctcaattattgtgtaaaaaacataaagtaagttgaatccattaaaatacatgagtgaccccttgttttcccctcttattaaaggaggaactattatgggatttggtggtagttgtagtagtggttgtggcggcggctttgctttactagttgtattgtttattttattaatcattgttggagcttcttgcttctgctaaaaaactattggaaaagacactcttatatgaactgaacccaaaaaattagacaaatatattaagcagctactaaggattgaactctgtattgcacaggggacaatccttttagttttgttttaattcttttgtgattgtagtaatgaatataagtttctagttcttgcttaaattgttccatactttcaaactctttaagataaagtaattcagactttaataagccaaagaaattttccatgactgcattatctaagcaatttcccttacgggacatactttggataacgttatgttttttaagcgactgatgatattgtcgcatttgataatgccaaccttgatccgagtgtaaaataggagtttccttatcattcaaacattgaaacgccttatttaacattttagaaacaagggaataggcaggtctatgttctatattgtaagctataatttctccgtatataagtctaaatgggtgat

SEQ ID NO: 1318 - DNA, 12268 bp, Bacillus thuringiensis
ttttttaaaataggattatgattacgaaatgaaaaatatgaatgttatttttagacagcgctatttttgttattttccccctttttcagcaaaagtcgttatatatccccggatttataaaatcgggacgtccgtttattgaatacaatagattcgtatcaattgatgaaaatccttcttttaaacaaatatttttttagtggaagttggcgaaaaaaattttttgactttttgtaaacgttaacaatgttgttaaatcagtataagcaaagaagtacgtatgattaaaaattataaattttctaaaaaattcacttgatttatttagaaaggagagtaaactaggaaacaataaaaaattcatagaacataggaggcgcttctagtgaatgagcaatggattttcttaaatggagaatttgttccaaaagatgaggcaaaagtttcagtatatgatcatggctatttatatggcgatggagtgtttgaaggaattagagtttatagcggtaatgttttccgtttgagagagcatcttgtccggctgtatgaatcagcaaaatcaatccttttagaaattccatattcattagatgaagtaacaaatattgttgttgagacgattcgacaaaataaattatctaatggatacattcgccttgttgtatcaagaggagcaggaaatcttggattggatcccgattcatgtaagaagccgaatgtagtagtaattgcagaacaattatctttattcccacaagaatattatgagaaagggattccagttgtaacagttgcaacgcgccgaaatcgtcccgatgttttatcccctcaagtaaaatctttaaattacttaaacaatattttagttcgtattgaagcgaaattagctggagtacaagaagcacttatgttaaatgatcaaggatatgtagctgaaggatcaggagataacgtgtttattgttaaaggaaataaattaattacaccaccaagttctgctggagcgttagaaggtattacacgaaacgccattttagaaatcggcgaaaaacttgggtatgacgtaagagaagagttatttacaagacatgatgtatatgtagctgatgaagtgtttttaacaggaacagctgctgaagtgattgctgttacgacagtagatggtagaacgattggcttagggcaaacaggtccacatacgaaccgtttattaaaagagtttcgtaagttagttgtagaagatggagagaaaatttacgaagaaaataaagttggataacaacttttttaacataagaaagcgttgatagggaggagtagttgattgtgaagcctcacagagagtcggtggttgctgaaaaccgatggttcacgtcgacgaacatcgcccttgagtgctaagctaaagcatttgtctaggcttagacggtagctccgttattagctagatccatttatggatcactgaggcaagagtattcttgcgaagaagggtggtaccgcgaaatctttcgtcccttcagcacatagctggagtgtggacgtaggatttttttattgtataaaagtttgaaaaagggggcttataagaacaatgtcttcaaaaacggaagagaaactggcaactggtgcacagctattgttagaagcgctagaaaaggaaggcgtagaagtgattttcggatatccgggtggtgtcgatttacctgtctatgatgcattgaatgagtgtgaaattccgcatattttaacaaggcatgagcaaggggcaattcacgctgctgaagggtatgccagaattacagggcatccaggggttgtaattgcaacgagtgggccaggtgctacaaatgtaattacgggtctagctgatgcgatgattgattcattgccacttgtagtatttacaggccaagtagcaacaacgttaattgggagcgatgcttttcaagaggcagatattatgggacttacgatgccagtgacaaaacataactatcaagtgcgaaaggcctcagatttacctcgaattattaaagaagcatttcatattgctaaaactggaagaccaggaccagtcgttattgaccttccgaaagatatggtagtcgagaaaggtgagcaatgtagcaatgtacaaatggatttaccgggatataaccctaattatgaaccgaatctacttcaaataaacaaattactcaaagtaattgaaaccgcaaaaaaaccgttaattttagctggagcgggtatattgcatgcgaaagcttcgaaagaattgacaaattttgctcgtaaatatgaaatccctgttgtgcatacattacttggtcttggtggttttccaccagatgatgaactatttctagggatgggaggaatgcatggttcttatacagcaaatatagcgttatatgaatgtgacttactcattaatataggcgcgagatttgatgatcggcttacagggaatttagcttattttgctaaaggggctactgttgcgcatatcgatatcgatccagcagaaatcgggaaaaatgtgccaactgaaattcctattgttgcaagtgctaagcgggcattggaagtattacttgaaccagaagggggaaaagaaaatcatcatgaatggatcactttattaaaggggagaaaagaacaatatccattctcttataaaagaaattctgaaagtattaagccccaatacgcaattgatatgttatatgaaattacgaagggagaagcgattgtaacaacagacgttgggcaacaccaaatgtgggcagcccaatattatccgctgaaaaatccagataaatgggtaacttctggtggattaggaacgatggggtttggatttccagcagcaatcggtgcgcaaattgcaaagcctgaagaattagttattgcaattgttggtgatgctgggtttcaaatgactctacaagaattaagtgtattaaaagaacacgctttacccgttaaagtatttattttaaataatgaagctttaggaatggtaagacagtggcaagatgaattttacaatcaaagatattcacattctttattaccatgccaaccagatttcgtcgctcttgcgaatgcatatggcataaaaggtgttcgtattgacgatccacttcttgcaaagaagcaaatccagcatgctattgaattacaagagccagtcgtaattgattgtcgtgtacttcaatcagagaaggttatgccgatggttgcgccaggaaaaggtgttcaccaaatggagggagtggaaaaagggtgaagagaattgttacagcgacagttcgaaatcaaagtggtgttttaaaccgaattacaggggttatgacacgaagacattttaatattgaaagtatttcagtaggtcatacagaatcatcagatatatcgcgaatgacgattgttgtacacgttgaaagtgaacagcaagtggagcagttaattaaacaactgcataaacaaattgacgtactgaaagtatcagatattacagaagaagcgatgattgctagagagcttgctcttattaaagtagcaacttctgtagcgagggcagaattatatagtttaattgaaccgtttcgagccgctgtaatagatgttgggaaggattccatagttgtgcaagtaacaggtacgcaagacaaagtagaagcgttaattgaattacttcgtccatacggtttgaaagaaattgctagaacaggtgtaacagcatttacacgtagtatgaaaaaacaagataagcaagttatgttaattcaataatcatttaaatatagggggaaatgaaaatggcaaaagtttattatgagaaagatgtaacagtaaatgtattaaaggaaaagaaagtagcaatcatcggatatggctcgcaaggtcatgcacatgcgcaaaatttacgtgataacggatttgatgtagtagtaggtttaagaaaaggtaagtcttggaataaagcgaatgaagatggattttctgtatatacagtagcagaagcagcggaaaaagctgatgtagtaatgattctactgcctgatgaattacaaccagaagtatatgaagctgaaattgcaccaaatttacaggctggaaactccctcgtgttcgcacatggatttaatgttcactttgatcaagtaaaaccaccagctaatgtagatgtatttctagtagcgccaaaaggaccggggcatctcgtacgccgtacgttcgccgagggcggggctgttcctgcattatttgcagtatatcaagatgcaacaggagttgcgactgaaaaagcactttcttatgctgacggaattggagcaacgagagctggtgtactagaaacgacgtttaaagaagaaacagaaacagatttatttggagagcaagctgtactctgcggcggagtgactgcacttgtaaaagcagggtttgaaacgttagttgatgcaggatatcagcctgaacttgcatattttgaatgtttacatgaactgaagctaatcgttgaccttatgtacgaaggtggacttgaaaatatgagatattcagtttcagatacagcgcagtggggagacttcgtatcaggaccacgcgttgttactgaagatacgaagaaagcgatgggggcagtattagcagaaattcaagatggtacatttgcaagaggctggattgcagagcataaagcaggaagaccaaatttccatgcgacaaatgagaaagagaataaacatgaaatcgaagtagttggacgtaaattacgtgaaatgatgcctttcgtacagccgcgagtaaaggtaggggttaaataatatgaagcaggttttgttcatggatacaacgcttcgtgatggcgaacaatcaccaggagtaaatttaaatgaacaagagaaattacaaattgctaggcaattagagaggcttggtattcatgtaatggaagctggattcgcggcagcttccgaaggtgactttcaatcggtaaaacgtattgcgaatacaattcaaaatgctacggttatgagtttagctagagcgaaagaaagtgacattcgaagagcatatgaagctgtgaaaggtgctgtatctcctcgtctacacgtatttttagctacgagtgatattcatatgaaatataaactttgtatgtcaaaagaagatgtgttaaatagtattcatcgctcggttacgcttggaaaatcattatttccgacagtacaattttctgcagaagatgcgacaagaacatcgagagcatttttagctgaagcagtagaaattgcaattcgagcaggagcgaatgtaattaatattccggatacagttggatatacgaatccagaagagtattattctctttttaaatacttacaagaatccgttccatcatatgaaaaagcgattttttcttgtcattgtcacgatgatcttggtatggcagtagcaaattcgttagctgcggttgaaggaggagcattgcaagtagaaggaacgattaatggcattggagaaagagcagggaatgcagcgttagaagaagttgcggtagctcttcatattagaaaagatttttataaagcagagccttcaatgactttaaaagaaattaaggcgacgagtatattagtaagcaggttaacgggtatggttgtaccgaaaaataaagcaatcgttggagcgaatgcatttgctcatgaatcgggcattcaccaagacggggttttaaaagaagtaacaacttatgaaattatcgaaccagcgcttataggagaatctcaaaatctctttgtacttgggaaacattctggccgtcatgcgtttacggaaaaaatgaaagagcttggttatgaatttacaaatgaagagcgagatgcggcattcgaagcatttaaaaagttggctgatcgtaaaaaggaaattactgaagaagatttacgcgcacttatgcttggtgaagcagcatttgcagctcagcaatataacattacgcaattacaagtgcatttcgtatcaaatagtacacaatgcgcaacagttgtgctgaaggatgaggaaggaaatgtatatgaagatgcagccactggttctggtagtattgaagcgatatacaatgcgattcaaagaattttaggattagaatgtgaattggcagattatcgcatacaatctattacacaaggtcaagatgcacttgctcacgttcatgttgaattaaaagaaggtagtcaccaaatatcaggtttcggagttgcgcaagacgtattggaagcgtcggcgagagcttatgtccatgcagcagggaaattaaaatctcttatagcgcttgggaaataaatatttgataggtgagagaagctttcctcacctatcaaattaaagttctgaaaattcagttaaaaggagtgttaaaaatggaaaaacgtatcgtttgtttagctggtgatggtgttggtccagaagtaatggaaagtgcgaaggaagtattgcatatggtagaaaggctatatggacatcattttcatttgcaagatgagtactttggtggtgttgctatcgatttaactgggcaaccattaccacagcgaacacttgccgcctgtttagcgagtgatgcggttttacttggagcagtaggtggaccaaggtgggatagtgcgaaagaaaggcctgagaaaggattattagcattaagaaaaggactcggtgtatttgcgaatgttcgccctgtaacggtagaaagtgcaactgcacatttatcaccattaaaaaacgctgatgaaattgatttcgttgtcgttcgtgaattaacaggtggaatttatttttcttatccgaaagagcgaacggaagaagtggcgacagatacacttacgtatcatcgccatgaaattgaacgtatcgtttcgtatgcttttcaattagcgaataagcggaagaaaaaagtaacatctattgataaagcgaatgttttagagtctagtaaattatggagaactgtgacagaagaagtagcacttcgctacccaaatgtggaagtagaacacattttagtagatgcagcagctatggaattaattcggaatccaggaagatttgacgttattgtaacggaaaatttatttggtgatattttaagtgatgaggcttcagtattagctggatcattaggaatgcttccatcagcaagtcacgctgaaaaggggccttcattatacgagcctattcacggatcagcaccggatattgcggggaaaaataaggcgaatccaattgcgatgatgcgttctgttgcaatgatgcttgggcaatcgttcggattaacgagagaaggatatgcaattgaagaagcagtttctgcagtccttaaatcaggaaaatgtacagcagatatcggggggactgaaacgacaacttcatttacaaaggcagttattcaagaaatggaagagcaagcgttagtagggagaggaagataatggggaaaaggttactagataagctttgggaaagacatgtagttgcgactaatgaaaatggattggatttattatatatcgatctacatcttgttcatgaagtaacgtcaccgcaagcctttgaaggcttgcggcttacaaatcgaacagtccgcagaccagatttaacatttgcaacgatggatcataatattccaacgaaagatgtttggaatattaccgaccgcattgcgaagcagcaactagatacacttcgggaaaactgtaaacaatttcaggtgccattagcggatatcggagatgaagagcaagggatcgttcatgtaataggaccagaacttggactcacacagccaggaaaaacgattgtttgtggtgatagtcatacagcaacacacggtgcttttggcgcactagcgtttggtattggtacgagtgaagtggaacatgtattggcgacgcaaacgttatggcaacgaaagccgaaagcaatgggcattgagttaaaaggaaagttaccgcaaggtgtttatgcgaaagatattattttacaccttctttcaaagtacggagtagcagttggaacaggttacgtaatggaattttacggagaggccattcatgctatggatatggaagagaggatgacgctttgcaatatggcaattgaagggggagcaaaggctggcattattgcaccagatgaaaaaacggttgcttacgtaaaagggcgtaaatatgcaccgaaagactatgaatctattaagaaaaaatggtcagaactttatacagatttagatgcagtttatgatttacatattctagtagatgttacggatttagcgccgtacgttacgtggggaacaaatcctagtatgggcgttcggatcgatgagaaattgccagaaaagcatgatgcaaatgacgaaagagcgttttcttatatgggattgagtcccggacaaagtacgtatgacattccagttcaacatgttttcattggatcttgtacaaattccaggctttctgacttagaaattgctgcatctgtcgtgaaaggtaaaaaagtaaaagaaggtgtgcgagcacttgttgtacctggatctcaaagggtaagagaagcagcgatgcataaaggattacatcgcatatttgaagaagctggatttgaatggagagagcccggatgctcaatgtgtctaggtatgaatccagatcaagtgcctgaaggggaacattgtgcctctacgtcaaatcgcaattttgaaggaagacaaggaaagggagcacgaacgcatttagttagcccggcaatggcggcagcggctgcgttatatggtcattttgttgatattagaaaggagagttatgatggagccatttcgtattcataaaggtactgccgcagtactgatgaatgataacattgatacagatcaaattattccgaagcaatatttaaagagaattgaaagaactgggtttgggaagtttttatttgatgagtggcgatatgataataatcgccaagaaaaccctaatttcccgcttaatgcacaagaaagaaaaggagccagtatattaatcacaggtgataattttggatgtggctcgtcaagagaacatgctccatgggcgcttgctgattatggtttccgcgttattatcgctggaggatttgccgatatcttttatatgaattgtatgaagaatggcatgttaccgattgtaatggataaagatatgcgtgaacaacttgctaaaacagatgcgagggaacaaattacagttgatttagaaaatgaaataatgacaacgaatacgcatagattccattttacaatcgagaaaatgtggaaagagaagttattaaatggtttagatgaaattagtattacaatgcaatatgaacaagaaataaaagagtatgaaagaaaagtggctttacattaaaaaagtgacggaatattaaaaatgtatttacattcaaaattaactgttatatactatgtgaaaatcagaggagaaagggagtaagtattatgaatatcgtgcaatctattacaatgcttacacaactacatcatcatacatgaaacccttgaacctagcgtgaaaacgtgtaggtacaagggttattcccgttgtacctacactctactgaagagccttgtaggtattttgtctacaaggctctttttattttcggcttaggggaatgaaataggcatacattagaaggggaaaggtgtgaaaatttagatgacaaaatggaaacgagcaaacccgaatggaacgagagattatttattcgaagaatgtacgttaattgaagaagtagaacagaaattaaggcttacttttttagagagaggttatgaggaaataagaacacctacaattgaattttatgatgtttttgcatttcaaaatagaccgatagatgaagagaagatgtataaattttttgatgaaaagggaaggattatcgttttacgtccagatatgacaattcctttagcgagagttattggaacacagagatgggatacgccacttaaagtgacgtatagcgggaatgtatttcgagcgaatgaatcccattctggaaaatataatgaaatcgtacaaagtggtattgaagttatcgggattgataatgtaagagctgaaattgaatgtgtaataagtgtcattcaagcacttcaaaagttgaaggtgcaatcttttacaattgagattgggcaagtacagttatataaatgtattgtaaaaaaactctccatccatgatgaagaagaaagggtacttagaacgtatatagaaagtaaaaattatgcagccctctcaaattttatcggagaaaagaaattaaatcgatgcgatgagacagtaaggttacttgagaaattgccaaggctatttggaaatttagaagttattgaggaagcagaaaagcttgcttcaagtaatgaaatgaaaatggcaattgcaagaataaaagaaatgtatgaaacaattgaaacgttaggatatggttcttacatatcaattgatttgggtatgattcaacacttagattactatacgggtgttattttcaaaggatatatatatgaaattggagaagaaatcgttagtggcggaagatacgatgagctaattggcaattttggagaaatgctgccagctgttggactcgcggtacaagtaaatcaaattgtgaaggcgctgcaagagcagcaagaaccatatgaacgaaatcaaattgatattgtgattcattatgagttaaatagattagcggaagcagaaaggttacgaaatttacttcgaaaggatgggaagaatgcttggttatctctattctctaatttaagcgatacctttcaatttgcaagaaaaaataaaataggaacggttgttgaggcaaagaatgaatatttagtggaatatgtatggaatgagaaatgggtagtccagaaagaaggagaggcttcatgcgtaacattcaaattgcgttaacgaaaggaagattagaaaaacatgtcattccactttttgagcagattggaattgattgttccgagctcaaaaataaaggtcggaagcttgtatttcaaagtaaaaatacaaatatttcatttattttagtaaaagcggttgatgttgctacttatgtagaacatggggtagctgatattggcatcgttggaaaagatattttaatggaaaacgagaaagatatttatgaaatgctggatttaggagtggggatttgtaagttttgtgttgcttctattcctacgtataatccgaagagttaccggaagaaaagaatcgctacgaaatacccacatattacttctacttattttcatgataagggagaggatgtagaaattattaaaatagaaggttctgtagaaatcgctcctcttcttggattggcagatgcgattgtagatattgttgaaacaggaaaaacattacaagagaatggactcattgtatttgaggaaatgtactttatatcggctcggatgattgtaaataaggcagccttaaaaactaaaaaagacgaaatattcagcattataaatatgatggagcaagaaatcttatcagggaaataggaggatttaaaatggaaatcatttatgaagactttaaggaggcattatctaaaataaaagtgctaagagaaaacgctaatataatagaagaaactgttcaaagaagtgtaagagaaatcattagacatgtaagggaaggaaatgatgaggctttatctttctatacaaaaaagtttgatggtgtagagatgaaagattttcgtgtaagtgaagaagaaatacagcaagcgagtatgtttgtagagaattcatttttagaagctttaaaagaggcgaagaaaaacattgtttcgtatcacgaaaaacaaaagaagtattcaatcttcgattgtgaaagtaaaggcataattagagggcagcttattcggccattagaaaatgtaggtgtatatgtaccaggtgggacagcttcatatccttcttcagtattaatgaatgtattgccggcgaaacttgcaggtgtgaaaaaaattgtaatggtaacaccgccgaggaaagggggaattgatcctcatatagtagctgctgcaaatcttgcgggagtagatgaaatttatacgataggtggcgcacaagcaattgctggtttagcatacgggaccggaatcgattccaaagtggataaat

SEQ ID NO: 1319 - DNA, 11474 bp, Bacillus thuringiensis
ttcttttacttcttcttttcccactaaaatctgtataactgttccgttaaaccttatgctaatttcatcagaatctaaatcaaatttatacaccttttcacctggcgtattccattttattactccgttattaaacgtcccatccctcacttgtcaattgaatattttcaatactttctccttctaaatcatatacaggaacttgaatttcttcgtttatttttgcatcatttaaaatgatattttgtcttccaacatcaattgtaaaccactgccctaattgtattaacgacctgacatcacgaatctcattcccagctagatttaagctaaataagtttagcatggaaccaataaccgttacatctttaatatgattgtccgcaagatttaaccactgtaaattttccaatgaagatagtggtgttatatcttcaatttgattatgagatacattcacattattcaattgtttcaagtttgagatgaactcaatatttttcaggcctactccttctaaagtgagtttttctaagttcgtcatgtactctaaacctgttatattttttatctcatttccattttctttaaatatctctaattttttaatctgtaataaatcttcttttgtaataggagcgtttaaattctctctacctaaattctctttattaatatgttgttgtaaagttttatcgagaattatattttccttttgttcattatcctcttttattgtttccttgatttcgtctaatctttcaacaacattttgaattactgttccattaaacttaatacgattctcttctggctttatatccaacgtaaattcatatattttttcaccagtagtcccccatttaacagaaccattattaactatcccatcttcactcttcaattgaatagtatcaagtggctctccttgtaaattatagataggtattttaacttccttatctttttctacattatctaaaaagattttttgtctttgaatatcgatatatatcctttttcctagctcttgaacaggtctaacatcacgaatttcatttgaacctagctttaaatcatataagtctgttaagtgactaagtggcgttatatctgaaatatagttttcttctaaattaagtgattgtacagtagataatcttgataaaggttcgatgttttctaattcatttttagcaagatctaactctactaattttttcattgatgtaatatgttcaatattcgtaagtccattgttacttaaagataagttttttacatttttcaattgctcaattccagcaaggttatcattactaatttgattatttgccacagtcaaagtccttaaagatttcactgtaaataatggtttaatatcttttatataattactatttaaatctagcattttaatcttcttcatttggcttaatgggcttaaatctgagattttattgtttctcaaagttaaaaactcaatatgctctaactcagccaaaggtccaatatcttcaagttcaccataggttatacttaatgattttaattgtctcaatcccgagataaattttatattttttaacttaacttcttccaaagttaagttttctaagttcgtcatatattctagaccgcttacgtcttgtattcctttatttttagcttcaacgactattaaagctttaacttttaataaatcttccttagttattggggtatctagattttctctattcaaattatatttattaatatgcctttgtagttgcttatctactattacatttccaattccatcttgttgatccactttatcctctttattttccttttgtttttctggaacattgttctctaaattcaatgtatttacttcaaactgtacttggtacttattatcataggccattgttggaatataaatatgcattcgcatattatacctttttcctaattcccctacttcaaaccgaatcactttcgttccatttttctttttatcttctgatattactttcacatcatgaaacacacctggagtatgaatatcctctgttttcaagtattgaaagaaatcactatcacttaatgttgctgttacaattttctttccattctcaattgttaatttcggatcctttatataaacagctgccatagactcttcattcgttttatctttatacgctttaataacagcatcatatgtaccatcttctaaaccttgtccagttttattcgcctcaattgctactgccgctaaagcaggtgttgaataaacagcaaacggaagtgataacgctgccgctataatcattgcatttatacgttttcttttattttgtttcaactttacatctcctccgaaatatataattcgaaatgtaatcatttctcgaataaacgataatgattttcattatcattgtcaactaggaaaataaaaagtttacaaaaaaagaacctctttaaaagaggttatgccattttctcacctgattcttctctaaaaaagcttttcatcgcatgaaatacgtctgctttttgctttaaaatatagtatctaaagttttcatctttaatatttttataggctgacatgagtgtactatggcggttgtactgattcacttccccatacccaaacatattacacttcttcattagctcttcaacaagttttacacatctagcattatctgatgttaaattatcaccatctgaaaaatggaatggataaatattatagcggtctggtgaatatttattatcgataagttcgagtgcttttttgtatacagaagaacaaatcgttccgccactttctccttttgagaaaaactcttcctctggaactacttttgcctccgtatgatgggcaataaattcaatatctactgtttcatactttgtgcgtaaaaatcttgtcatccagaaaaagaagctacgtgccatatatttctcccatattcccatcgatccactcgtatccatcatcgctaatacaacagcttttgaatctggctttaatacttcattccaagtgcggaactttaagtcttcttggtgaattggatgaaaagatgctttaccactcattgcatttcgtttatatgcggatatcattgttcttttcttatcgatatttccccataatcctgtttttctaatgtcattaaattcaacatgttcaatccggttttcatccatttcttttctctttaaattaggcagttctaactctctgaaaaacgcttgctctaattctaaaatagagacttcagcttcatagtaatcttccccagctgcatctcctgctccttgcccttttcctggccctttttgtttttgaccacctgatccatctctcgcaacgacatcaccaactttgctgtcaccgtttccttgcccaacatgtttatttttatcataattgtatctaatcttatattcatctagagaacgaattggtatttttacaacatccttgccattagacataactatactttcttctgttacaagatcgggtaaattattcttaattgcctcttgtactttttcttgatggcgctgttggtcgtcatatcctttgcgatggagggaccagttttcctgtgaaatcgtataatttggttgattttcttcgcccattcctttccctccttactgtaattgtcttcctgtatgaacagcaatctataaattttgttctgtaatgtgcaagctagaatgtttgaaaggtaactgcccacagaaaatcatcccataaacatttataacgtttttcatacaataccccgagcatcctaaacaaaattttgccactcacataatagaaagaaatattcagccactgataagaaagaaacacaatgcattgttgcacatatttttactttgcaacatattgtattgtgttggcttttttcgtatgaatggttggttactctatcatatgcatattgtaaaaataattgacaataaattcataaaattgcatcttaatttattacatttggacaaggtatgacactttatacacatatgaacggataataaaacgctgtcccgcaaaatacaagagacagcgttttgttatcaaactatctgtttaacaagctacctacatagcgtagtaattcatttgctgaagaagaattatagccatgctcatcaattaaacgcgcaacaacatcattgattttcttaagctgattttcgtccggcgttttcgttgacgttgtaattttcactatatcttttaaatcagcaaatagttttttctgaatcgcttcacgaagacgttcatgtgaattataatcaaagcgttttcctttacgggcataagcagaaatgcgaattaaaatctcttcacggaacgctttcttagcattttctgaaattccaatttgctcttcaattgagcgcattaatttttcatctggactcatttcttctcctgttaacggatcacgtaatttcgatttattgcagtacgcctcaacgttatctaagtaattatccataagcgtcttagctgattcttcatatgaataaacaaacgctttttgtacttctttctttgcgatttcatcgtattcttttctcgctaatgagatgaagttcatgtaacgttcacggtcttcattactaatggatggatgctgatctagcccatcttttaaagatctaagtacatctaacgcgttaatagatggtacctcttttcgaatgattgtagacgaaattcggttaatgacataacgaggatcaatacccttcataccttcatcttgatattcgcgttgtaattcttctacatcaatcgcattataaccttctaccgtttccccatcatacaaacgcatctttttaattaaatcaatatccggacgcttcggatcttttaaacgagttaaaatggtgaacattgctgcaacgcgaagtgtgtgtggtgcaatgtgaacattcgatacatcactttcacgaatcattttttcataaatatgttcttcttcacttactcgtaaattataaggaactggcattacaataattcttgagtgcaatgcttcatttttcttatttgctataaatgagcgatactctgtttcattcgtatgcgctacaattaattcatctgctgaaataagcgcaaatcttcccgctttgaaattcccttcttgcgtaagtgataataagtgccataaaaacttctcatcgcattttaacatctcttggaactccatcattcctcggtttgccttatttaattctccatcaaatcgatacgcacgcggatctgattctgaaccatattctgcaatcgtagaaaagtccagactacctgttaaatctgcaatatcctgtgattttggatcagacgggctaaatgtaccaatccctgtacgacgatcttcagagaagaagatacgctctacaactacatcctcaattcttgatccgtattcttgctctaaacgcatgacatttagtggtgataaattcccttcaattctaaccccatactcatcaaagaaatcatctcgtaaatgatgtggaattaaatgcagtggatcctcgtgcattgggcatcctttaatcgcaaaaattgctccgcgatctgttcttgaatatgtttctaatcctcgtttcaacattgtaactaacgttgatttccctccactaacaggacccattaataataaaattctttttctaacatctaatcgttttgcagatggatgaaaatattcctctacaagacgttctagagcatcctctaatccaaagagctgattactaaagaagttatactttcttctaccatcaacttcttcaattccagcatcttttatcatattgtaaatgcgagagtgtgctgtttgagccacccatggtctttctttcacaagctccaaatactctgcaaacgtaccttcccattgtaaacgttcttctgctgctcgatgctgttcaatcttttttagaatatccattatagctcctcccccatctccttgttcaatcggattattataaaaggtatgctaggatgtccttaaacattctttaaatcaaaacgaaatatataatagcacactaaaattctctccaaaattcaaagaaaattctgtataatataggtattaacgtttttacactgctattcattataaataaattcttttcttctaagaaccttacatacattttgggtaataaataaaactcatgaaccgaaaaaagtaaggaggatattagtatgaaattattattaattttaggtgtatcactcacatttcttacagctatttttacatccggttacaatgacaaaccaggtacacataaaaaatgatgtgcttttagcacatcattttttttatttataatacatattttccatatcatatttggatagtggtcggctataataataaccttgtacaagcttcacattcttttctttcaaaaactgtatttgctcctttttttctactccttctgcaattacatttaattctaaagtatgagctaaatgaataattgcagctgtaatattcgtatcacgttcatctatatgtataccttccataaaagaacgatcaatttttaaagtatcaattggatatgtttttaaataacttaaagatgaatagcctgttccaaaatcatctaaatgaatctttaaattttgctcttttaattgtagtaacactctcttcgatatatctttatgtataagagctccttctgtaacctctatcgctaataaatgagttggtacattgtacttatttaaagcccgtgtaatcatctctattaatgtaatagaacgaaagtgtctagctgaaatattaactgcaattgggaccacatcataccctttatttaaccattcgcgcaattgctgacacacttgatttactacccattcatccagcttaataataaatcctgttctttctgccaacggaataaattggtttggagaaacaaatcctaattccttattctcccaccttattaaagcttccatactagctatttttttcgtttcaatattaatttgtggctgataatataagaaaaattcatttttttctatagcacgatgtaactggttttctattataaacctttgttcacgctcacagtctaatccactacaataaaaatgataatgtccttttcctttttcttttgctttttctaaagcagcatcgactctctgaaatagtattttttcatcttctccatctgttggagccattacaattccaattgacgcgcttaaatatacatcttcttcttcgattacaaaatattcactaatgttttttaatatgctttttgcaacttcctctacatattctttcgttatattttctatcaacataacaaattgatcatcgtgttctctaaataagtgcatatcttctatttttagattacttaaacattctgtaactttttgtaatactttatctccctctttatgaccaaatgtatcattaatacgatgaaactcatctaaatctataaatacaagtgcaaaatttacactctcatttaaaaaagtatttaacttatttgtacatgaaattctattcattaatcccgttaactggtcatagtaagctaaatattctgttcgcatttcgtttaatacttgccttgtaacatctctcgtaacaatataaatcccaacaatttcaccgttcacaataatcgggatagttctcaaagaaatatatagctcgtacccttctttatgaacatatttctttgaaacaatttgttttgcttttccttgcatcgatcccttaaatataatttgaaaatctttttcatattctttattaatgaattcaaaaataaatttattatttaattcctcataccggtatccaaatatttcatacgttgccggatttgcatatgtaactctccctatagaatctatagatataattgagtcattattatattccagtaacgacttaaataacatttgtttttcctctatctctgtcttctcctcaatttgagctgtaatatctcttgtaatacaaataacaaattgacatattccttcttcgtcgcagacaggattaagtgaagattcatagtgtatctcaccttttggtaaattgactacatcacaaaaggtgtgtgctttcgcttctctcactacttttgcatattgcctttgcaatatccccgctatatcttttggtaatacttctgcaaaggtttttccatagcactcttcgcttaacctagcataatccattcctattttattcacatacatatattgaaacgtttcattatcaataactttcaatatgaatactaaatcttgaatagcatgtaataatccttgtctaattaaatccatatctatcatacttaaaaaggtattttgattactatattcttccttcatatttatctcaacccgtcttatctatttttaatcatatatcccattctatatgattatgtcctctcttttaaatgtatgattatatattatttttattttataaaaaaaagtcgccatatggcgacttttaataaacgatttctaaatctaatccagggtaattttgttgacggaacgcttcataaattaaaattgctgctgtattagataaatttaatgaacgtactttatctgtcattggaatacgtaaacaatgatcaaagttttcttcgattacattagctggtaagccgtttgtttctcttccaaatacaaaatagtaatccttctcgcgcttgctatagtcaaacgctgtatgagctttctcgccatactttgttaaatagaagaattcaccgtctttatttttttcataaaattcttcaattgaatcataatacgtaattttcacgtgctgccaataatctaatcctgcacgctttaacattttatcatccgttgaaaatccaagcggtctaatcaaatgtaattctgttccagttgctgcacaagtacgagcaatattccctgtatttgctggaatttctggctgatataaaacaacatgtactcccacgcgatattcacctctgttttttgtctactacgtattataccacttgagcgaaaaatctctacccattaataatatgaaagaatttatatttcatttgtggtgtatatttactagagtcttcatagttccaataacgtcgacggctattcgctgaatgtgcatttacaagcggcataccatctgcatcttttgctactacaatcgtcgtatgattccatcttccgtcatcctcgaaatcataagcaatgacatctccaagaataagttcttctggcctctctaccgcctctgctcgaagtcctgttgtagcacctgacaaataccaataaaaagaatgtgcaacagcccagctccagctccactgattctccctttgccaccatcctttacgaatattaggatatccgctcataggtacttctccagtatgaagacattgagaaatgaaattcgtacaattatcagggaaattacgatacataggatttcggtcatcccaccaacgctctgcatatttcactgcctctaaacgattatactgataagaaccgtacttctctttcgtaatttccctttctaatgtctcacccattctaatttcttctgacacttcaatagcataatcgcctataattcgactattatttaaacaaactcttcgttttaattgttcctcttcaatataaaataattctttatgcttaattaaatatttaaaatgtatttgataatcaatttcttgatggtcattactatttaattgtctaatgaaagaaacatccgcagttgctttcactatatgtgcactacgtctttgaaacaattgtttctttctcagtgccatttgtagtaaatcctcagcaataccatccacattcgttcttttctccgttatatatgctaaaaattgttgtacttggttttcaatcttcgtttttacaaccattctgtctccctcccatattacaatatgaaaaagggaaatattatctactcttttttctgtgctaacaattcaagcccgcgattcatttcatgaagcacttcttcatctttctcacgttccatcgctttctcaatcgcttcgcctactccatctccgccaattttcccaagtgcccatgctgccgttccgcgtagtactggtcttgggtcatctttcataacaccaattaaatcaggaattgccgatgtttctttaaaatgtgctaatgctaaaatcgcatttctttgcagtggctttttccctctccatgatcctgacataatcccatatttctctttaaaatcacgattactaattgttaaaagtggtgttaataatggtttaactagctcaggatccggctccatctcaggatgattatgaaaatccattcctttgtttttcgggcaaacagtctgacacgtatcacatccatatatacgatttcctattttatcgcgatattcttcaggtaggaatcctttcgtctgtgttaaaaacgcaatgcacttcttcgaatctaactgtcccccctgtattaaagcaccggtaggacaaatatcgatacatttcgtacagcccccgcattgatcttctatcggcttatctggcgggaatggaacatttgtaatcatttcccctaagtatacgtacgaaccaaattcaggtgtaataatagagcagtttttaccgctccatccaatgcctgcacgctctgatacagctcgatcacttaattcacctgtatcaaccatggacttcacttctatatccggaagtttttcaattaaatatgcttctaatttttgcaaacgatctcgtaaaacaagatgataatcttgtccccaagaagcacgacaaaaaatcccacggcgttctccacgcttacttaatggtgcattttttaattttgaaggatatgctaaagcaatcgcaataattgatttagcacccggtaataacagttgcggattcgttctcttctctatatcaggctcttcaaatccagattgataatttaattgttgttgctggattaagcgctgctttaattcctcaaaaggagaagcactcgcaaagcctattttatctatgccaattgttttactatacgcaattacatcttgctttaattgttcaaaatccattcctaatcgcctcctcagatgaatccatcccttatgtaacgaccctattggttagtaattcacttttgggatactattatttacttctattttcgcatgtaattaggtttttcaaacattaaaaaacgcaatgcctcgtttatctcggaaacgaaacactgcgttgatcacaatttatagaaaaacatttaataaaatttggagcgggtgaagagaatcgaactctcgaccagagcttggaaggctcttgttttaaaaata

SEQ ID NO: 1320 - DNA, 12941 bp, Bacillus thuringiensis
cagcattgattatcgcaacagcaattggtgctcaaatagatccaaatgcaaagccgtcttataatgatgcaaaaaatagttgggcagcttcatttattgcagccatggaaaaagagaatattattaaagggcgagaaccaggagtatttgatcctgaaggaaaagtaactcgtgctgaaatggcagctatgcttgtaagagcatataatctgaaaagcaaagtaacaggaccagttcctacaaaatttgctgatttagagaatcattggggtaaagaagaagttaatattttagtagaattaaaactttcattaggtacagaggatggctggaaaccgaatgattctattacgcgtgaacaagcagctcaacttactgcgcaaacagataaatttagcaagaatagtgatcgtccagtagaaacaaagaaaatgtacatagatagaaaattcattacatatcacgcaccatcattaagttctgggattagtgcaaatcagcataatccacaaatggttgaaattaaagaagaacgagatggatggatcaaaattgcaacaagtaaaggtgataaatggacacctttagtagagaaaacagaagttattaatgaaggattcactacttatgcagaagcttcttcttcttcaaaagtaatgggaacacataacgcacaacaagtaactgttattgaagagaaaggcagctggattcgtatccgcatgggcgctggtttccaatgggttaataaaaatcaattaaatccagtgaagcaaggtaacttcttagaaggaaaagcgattatcattgatccaggtcatggtggagcggattcaggtaatccaggttattatgagaaagaaagtgaaactgtattagatgtatcactacgattacagaaaatatttgagaaaaagacaccatttactgtgttattcactcgtacagatgatacacgtccaggaacaagtgcttctgattctttaaagaaacgtgtagaatttgcacaaaaaaataatggggatatttttgtaagtattcatggtaatggcacggaagagaaaaatggacaaggtacagaaacgttctactatgaatcagcgacagcaagaggaacaaatcctaacgtatcagaaagtcgtttactagcagaaaaaattcaagagcgtcttgtagatgcactgggaacaaaagatcgtggtgtgaaaaaaggcgatttatacgtaattagagaaaatacaatgccagctgtattagcagaattagcatttgtagataataaaagtgatgcagataaaatagctacaccagcgcagagacaaagtgcagcggaagctatttatcaaggtattttagattactatgaagaaatgggtaacaacgtgtcttctttccgttaataaataataagagattgccattggcagtctcttttatttattaacgtttctctttatttccggcatatgatatcatttaattttatatacaaaagaaaagtatttgagtaattgtaatcataacaattttaaacgatagaggatgataatagattgaataatcacagtaaaacacctgcctgtatatatacgtatgcatttcgtgaggaggagcgtgctttatgttacttggaaatgcgctcgttctttggaatggagtcccacgttaatattttaaaaagtgatgtcaaaattgacccgagtagaagtgcgtttatttaaagagcgaattgaagttatgtatgaaggggacgacttagaaagcattttaaaacaagtggaacaaattgatttggcgggagcgacgttcaaagtcatcttcgttaaaattaatgaccttgttggagagaataaaattgaatatggagaaagacgtcttattgaaagagacctcggcatgcatattgaaggagaagcggatgttcgtaatccagagcgtgtattcgggattgttcctcttggaggacgctggtacttcgggcactatgtagaaagcgaaccagtttggtatcatcacataaaaaaaccgcatagttattcgacatctcttagcacacgtgttgcgagatcagttgcaaatatcgctgtaccaaatccagagggagtacgagcaattgacccgtgctgcggtattggaacagtagtagtagaagcactttctatggggattaacatcgttggtagagatataaatccacttgtagttcttggaacgagaaaaaacatcgcacatttcggatttgaaggaacagtaacaaaagggccgatcgaggaaattactgagaactacgacgttgccattatcgatatgccatacgacttatttacgcatgccacaccagaagatcaactatcaattctctcaagtgcacgccgcatcgcgaaaaaagtagtcgttgtcacgatggaaacaatggacgacatgatccatgaagcaggattcgaaattacagatcgctgtattacaagaaaaggatcatttactagacagattcttgtttgtgaataagaaagaaaggtcacccgtttgggtgaccttttttgtttgtattgatgtgtaatcggttggtggtttaggtagatgaattagcgaaatttgtcggtaagtcgatattacatgtcgaatcgccgatatattgtgttgaatcgctgatatattccgagaatcgccgatatcgttacattagaatgttactgttcttttaatttctcttgttgtgcaagtagtaaattgcgcaagatgtgcccgcggtaactttctagttttcgtccttcatgatagcgtacgcctaatttttttagttcagctacgtaccagccctttgttccgtaatacattggatcacttcctttttgcttttgaacagtatatgttgggggtggaagtaactttccagtgaaaataataagactggttgtatcaaggggctccataacatagcctctggacagtgtataaaaaaatagacagtaatgtatgcttttttaaacaatgtatacaaatttatatcctatgcgttggcatgatatttgcaataaaaagagtatcaacatataggggagagatagaaatgaaggttagtaaagtgtacacaacaattgatgctcacgtagctggggaaccgcttcgaattattacgggcggcgtgccggaaataaaaggagacacgcagctagaaagacgtgcgtactgcatggaacatttggatcatcttcgcgaagttcttatgtatgaaccgagaggacatcacggcatgtacggttgtatcattactccgcctgcgagtgctcacgctgattttggcgtattatttatgcacaacgaaggatggagtacgatgtgtggtcatggcattattgctgttattacagtcggaattgaaacaggcatgtttgaagtgacaggtgagaaacaacagttcattattgatagccctgctggggaagtcattgcgtatgcaacatataacgggagcgaagtagagtccgtatcatttgaaaatgttccttcctttgtatacaaaaaagacgttcctattaaaatagataactatgaatttcaagtagatatcgcgtttggcggagctttttatgcggtagtagactgtaaagaatttggcttgaaagtcgatttcaaagacttatctgctattcaagcgtggggcggtaaaattaagcactacatcgagagcaaaatggaagtgaagcatccacttgaagaaggattaaaagggatatacggcgttattttctcagatgaaccgaaaggagaagacgcaactttacgaaatgtaacaatctttgctgatgggcaagtagatcgttctccttgcggtacaggaacttccgcaagaatcgcaactctttttgaaaaagatgctttacaaaagggagaaattttcgtccatgaatgcattactgacgggaaattcgagggggaagtattgtcggtaaccgcagtagatacatatgaagctgtcgttccaaaagtaacggggcatgcctttattacaggatttcatcagttcgttgtagacccgagagatgatttgaaccgtggatttttgttaggatagaaggagggggtggaaagatatgttagtcataagcgcgaacgaacaaagaaacttagtaaatatgaatgaagttattgaatacgcggcgcttgctttaaaagaattttccgcagaaagaacgattacaccaataaggggctcattaccatttgcgaacgagcgaaatacggcattaattatgccttcagtagcggaagggcttgaggcacttggcttaaaagtagtaacggtagtcccgcaaaataaacagataggaaagaaaacgatcaacgggattgtgatgctatcagactttcaaacgggagaaccgctcgcacttttagaaggatcgtacttaacgatgattcgaacaggcgccttatcaggagtagcgacaaaatatttagctcgtcataacgcaaaaactttatgcattatcggcacgggtgaacaagcgaaaggtattgctgaagcaatatttgcggttagagatatcgaaaaagtcatcttatacaatcgcacagaagaaaaggcgtatgcatttgcggaatatatacaagagagattcaacaaacctgcatatgttcacacaaatgcaaatgaagcaataagcgaagcagacatcatcgtcacaactacgaacgcatccacaccagtcttctcagaaaaactacaaaaaggcgtgcacataaacgccgtcggctcattcaaaccgaacatgcaagaactaccatcccatgccatcgcgggagcaaacaaagtagtagtcgaatcaaaagaagcagcactagacgaaacaggagaccttcaagttccgataaaagaaggtctattcaaagcaaacgccattcacgctgaacttggtcaaattataagtggagaaaaagctggacgcgaaaataatgaagagattactattttcaaatcagttggtttggcagtagtagatattattgttgcaaagtatttgtatgagaaagcggtggagtgcgggattgggaataggattgagttttgagggactgccttttggtggtcttttttgttgatgtggatgtgctagtatttataattgaatccttttaatattatgttgcaatgtatgaattctgtgcggacatcaaatcattcattcaattggtatatgaaaaaagttgcccctctaattattagaggggcaactttttaccattctcgccattcttctgttatatcttcctcggattctaagccagctattcgtgctgctgtatcgataaattcatagagatcttctctttccattgtttcaataaaatagtcatgttcgtcatttaattcatttatgttaagaacaacctctttaacaacatgcattatttcaatttcagttggattttttcccaatttctctaaattatttatgtaagtatcaagaactttatttgttgcacttatattttcttcagtgaaaaattccccatcttcatcattctcaatccattgggttgttggtttgttttttttcagttcatcaaatgtcatgataacctcctaaatgtgttttttgtctttaatcccattctacattttcggtcatatataacaatcattttagagtttttttgtaagctactagttttttaactcattttacgaggtaacctattcgtggtcttcttttttaatcctccttataaatatattttatggcaagaatgtattagtagatttcaaactttccacatttacaaaaaagtttgactttacatacaggtagtggtaatttaaaacttataagaaaactcgggattaattccgagttttcttatgggtataactagtttgagggggccgaaagatgaaacggaaattatttgcattaccatttgttctaatactacttattgcattagcggcttgttctggggaaaaagattcttcgaagcaagcgggcactagtaaatcagggactccgaaagatggaggagggttaacgattggtgttagcgataatccagatacgatgaatccgctttatgcgaatgatcgtgtgtcattaactgtgcagcaggctttatatgcgccgctatatcatatggaagacggtaagaaaaagtttgttcttgctgagagctttacgccttcagaagatcaattaacgtggacattgaaattaaaagataatttgaaatggcatgatggtaagaaaattacatcagacgatatagcatttacattccaatctattttggatgagaagcaaaatagctcaagtcgtgaaaactttatttttaaaggaaagccgcttgaggtgaaaaaggtagatgagttaacaactcaattcgttttaccacaagtaagcgcatctttcgaaggtgtaatgaatgatttcttcccaattccgaaacatgtatttgaaggggaagcagatttagcgaagagtaagaaaaacttacagcctgtaggatcagggccgtttaagtttaaagagtataaatcagatgagtatgttgcattagatcgatttgatgattatgtaggtgggaaagctaaattagactctatcgtataccgcgttgtaaaagaccgtaatacagcaaatgtttcactgcaaaatggtcaaatcaacatgaaaatgattgagccgcaagactttaaaaaactagatagtactgggaacttctcaatggtgacattccctgaaggtagattattctacttatcttataacatgaatacagatttgatgaagaaaaaagaagtgcgccaagcaattgcgcatgcgttagataaaaaagaaatgattaactcagcattcgtttcgggtgaatttgcagaaccagcaaattcaatcttaacgccagacgctatgtattatgcgaaagatattaaaggctataagtatgataaaaaagaagcgaaagatttattagcaaaagctggtgtgaaagataaagaaaaagtacgtgtgatgtatgtaacgaataataaaattatggaaagcttagcgctttatacacaacaaaaattaaaagaagttggcttagaagttgaactaaatgcattagatgctagtgcggcaagtgaaaaaggcttagataaagagaataaagaatatgacattacatttggtggttacataatgggacctgagccagattcatataaaagcctattcttaagtaatgctgaatacaactatgcacgatataaaaacgctgatttcgataagttatgggaagaagctgcagttgaaacggataaaacaaaacgtgcagagctataccataaaattcaagaaacagctagagaagatgtaccttatctaccaattgcgtatccgaaagcagttattgcagtagataaaaagtttgatggattaaaagaagcgaaagcaattcctgtcacaatgtttgaagatctatctaagatttatgaagtgaaataagaaacaataaagaagctggtggaaatcagcttctttagcttgaggggggaagtttgtgtataaagtaattgcgaagaggcttttaaatgcaattccgcttttatttgttatttctattatttcttttctattaataaagctagcgccgggggatcctgttcgaaactttgtaacgccaaatatgagtccaattgatgtggagcgtattcgtaaaagtttaggactagatcaaccaatttacgtgcagtattttttatggttaaaaaacattttaacagggaactttggttattcacttcaaaatcatcgtcctgttttagatcttatcgcagaaagattacccgcaacaattgggttaatgggatcatctttactcgtctcattcgtaatcgcaataccacttggactatttacaggtgtgaaaaagaattcgttctttgaccgcattgtaaactttatttcatatgttggtatttctatgccggttttctggtttgcactactattagtctacttattctctttaaaattgaacctacttccgagtatgggtatgcgcaccgtaggtaaagattctgtttgggatattgtgcaacacggcattttaccttgtatggtgctagcgttccaaaacgtatctgtttatatgagatatattcgttcaagtacgattcagcaattagaagaagaatatgtacaaattcaatatgcgtacggtgcttcaaagaaaacggtgttatttaatcacgtacttcgaaatgtattaataccgatcattacaattttcggattatcgattccaagtttagtaggcggagcatttattacggaaacagtattttcatggccgggtcttggttcacttggggtaaatgctatttttagatttgattatccgattatcatggcaattacattactatcatcattcatgttaattctcggtaacttaattgctgatattttatatggcgtagtagatccgcgcattcgaatgagggggtgatttggaatgaataataggagatttcaaacgataaaacatagctttacgaaaaataagtttgttgcaatgggagttattatacttgcgattttaacggtcgcatcaattttcgcattcgtatcgccgtacgatcctagcaaaatgtcgattccagatcgcttacaagaaccgagtatgagtcatcctttcggaacggatgattacggaagagattacttaacgagagcgttatatggcggacgagtttcacttgcggtcggttttcttgcgatggttgtttctattacaatcggtaccgcagttggaacaattagcggatattttggcggaaagttagacaacttcttaatgagggttgttgaagtacttatgtcaattccatcattctttttaatgctactattaaatgcgtatttaaaaccaggaattacgacgttagttcttattatcggattactaacatggatggacaccgcccgtattgtaagggcagaaacgttatctgtaaaagagcgtgagtacgttttatacgcaaaagtatcaggacaaaaatcacttatgattattgtaagacatatcattcctaacattttatcaaccattattatcgctgcgacattaacaattgcgacatcgattttaatggaatcatcacttagtttcttaggtttaggtattagagaaccagattcttcttggggcagcatgctaaacaatgcgcaaggatatattggtgaagcttggtatttaacactcttcccaggattccttatccttttaacggtacttagttttaacgtaattggtgaagcattgaagaaagctttcgcaccaaaaggagccggacatgaaaactaaagtgttaagtgaagggagtgagaagcgtgtctgaaaaactactagaagtgaaaaatttaaagacttcttttttcatagaaagtggcgaagttgaagcggttcgcggcgttacatttcgcttaaataaaggagaagtagtcggtatcgttggggaatctggaagcggaaagagtgtaatggcgaagtccgttatgtctctcgttacgtcaccaggaaaagtgaaagaaggggaaatcctttttcataatgaaaacatactttctaaatctgaaaaagaattgcgttctattagaggaaatcaaatttcacttatctctcaagacccaatgtcagcgttaaatccggtcgtgaaaattgggaaacaaatgatggaagtaattatacgtcatcaaaaagtgaaaaagaaagaagcagagcaaatcgcggtcaacttgttaaaacaagtcggtctttcttcaccagaagaaagggtgaaacaatatccgcatgaactaagcggaggtatgaagcagcgagttatgatcgcaatggcgatgtcttgtaaccctgaccttctcattgcggacgaaccgacgacagcacttgatgtaacgatacaagcacaaatactagatttaatgaaaaacttaaaaaacgaaacgaacatggcgttacttcttattacgcatgacttaggaatagtcgcacaaaactgtacacgcgttatcgttatgtatggcggacttattatggaagaaggacctgtacttgatattttccaatcgccgaatcatccatatacgaaagggttattaaactctctgccgaaaatatcgaacggcgtaaaagagagactcgcgccaattcaaggtgtaacgccaaacttattaaacccgccacaaggttgcccattcgcagagcgttgcccgcatgcgatggacatttgtgaaaaagaacgtccaccatattttgaaatcggaaacgaaagacgttccatgtgctggctaaacgatagggcggtaggtgattttcatgcatgaagaaaacttaattgaagttcggaacttaaaaaaatactttcctattaaaaaaggactattcggcagaaaaacggagcaattaaaagcagtcgatgacttaagtttcacaattaaaaagggtgaaacattcggattagtaggagaatctggctgcggaaaatcaacgacaggaagaagcatcattcgtttacaagatgtcacttcaggtaacgttttattcgacggaaaagacatcgcaagtttaaaggaaagtgaactaaaagaatatcgaaaacgaatgcaaatcattttccaagatccatacgcatcattaaacccagcaatgaacgtattccaaattattagcgagccaatgaacattcacggctcttacgaaaaagaagaacaaaaagaaatcatattagacctgctcaaaaaggtaggcttaaaagaagaacatttatatcgctacccgcacgaatttagcgggggccagcgccagcgcattagcatcgcgcgcgcactatctgtaaaaccagactttatcctatgtgacgaaccaatctcagcactcgatgtctcagtccaagcacaagtcgtaaacatgctgcaagacatccaagaagaaactggagtcacatacttattcatcgcacatgacctatcgatggtaaggcacatatcagaccgcatcggagtcatgtacttaggaaacatagtagaaattgccgacagtgaagacctatacacaaaaccggcacatccatacacacaagcactactctcatccatgccagaaccagatccaacaaacattggcaaagaacggattatcctagagggagaagtaccgagcccactaaacacaccatccggctgcaaattcagaacgcgctgcaaattcgccactgaaaaatgcgcacaggaagtaccgaagatggttgagattgcgaaggggcatgaggtggcttgtcatttgttttagagggagagcactaggggggacctggtgcttttttcttttgtgttggggtgtgggattggttgtagattaatggtcagcgactgtctatatttgtatctcctatcatataattccctttattctttaactataatgctgggaaagcacgtaaagtaagacaaagtattaaaaatcatcgtgatgaagtgtatcgtattgatgtatgtattgtagaagatccgatggaaagagaaatttacgaaacatatatgattaacgaatttcaagcaaagtataatgtggataaagtattttataaataacatcaacgtaaaacatgatcttggtactacatcaagatcatgttttttatatgtaataaaaacaattgattattcttaatcattcgacaagatgcaacaatttaagatcatattttttgctatgataagtaaggaatttacatatcgtgttattgggggataaaaagagatgttgaaaaaatttactacatgtattttaggtggcgctttagtattcaatttatctggttgcggcaatacatccgacaaaacttcttcagaatctaaagaaaccaattctaaacaagaagaaaagaaagtgcaaacaaccgatgaggcgaaaacgaaagaaaatacaaagcagaaaaatacagaacaagcaaaagagaaatcaaaaataaaagaaaaagagtatgctgtaaacaaggattttcatacacctaaatttgatgtaactgtaaaaagagttgtagaaagagataaggttggtaaagagagtataggattccaaaaacctgaagatggacatgtctttattgttgtagaagcagaagggaaaaatatcacaaacgaaccgatgaaattagccgttttaccatcagtggatttagtggatgaaaatgataatgcttaccaaagtgatgtgttggcagctagtagttatgcggttgaaaaaggcgagacctctagtattactaagggattaaaaccaggggaggtaatgagagaaagtaaagtttacgtgattaataaagaaaaatttgatacaggaaagtggtatgtagttgttaaccatgagtataaggaacaaattaaatagtgtttatttatgaagaggagatggctcctcttttttttacaagttaacacagaatttctttataatgtagaaatttaatgttttcgaaaaaaagaattgacttctacattagttgtaactaaaatggttacataaagatgtaattaatttagttacaactaatatctgctaaaaatatgatttatatatttaattaaggatggtggtccatacgttgccacccggtgtagaaagttactaacacattcaaatcaatgcatattccaagctttagtattttctgttacggggcaataaggtgcaatgttatcttttgttaaaaaccttggtggatctttctttggaaatattagttttggggaaatatagtaaggtatctaaaaaagaacaaggtataaaaatatgtacttatataaaccaaaaatttagttgagctggataataaaaaaggtaggagatttaaatggagacgaaacaagataatcttatttacgtatgggatgcatatt

SEQ ID NO: 1321 - DNA, 9577 bp, Bacillus thuringiensis
atccgttacaccacctagtccaaagactaaaactttatatagaaaagatcctcttctcataagaagaggatcttttttatttttaaaggtgcgccttataatgaacgactctactgcttgtacaaaaataatttatcaacagttgttcctaatacttcagctaaacggaacgctaacgctaagcttggatcatatttattattctcaattgcatttatcgtttgtctagaaaccttacatttatcagctaatgcgccttgtgaaatattattttcagtgcgtaattcatagatttgatttttcacaccattgctcctaacctgtaaaatcgtttttacaacatcagtatataattggctcatatagttgtcaaaagttcctcaaagaaaaaaggagcaatattgctcccttacaatagttattttgaagctaatgaatttgttagtgcctctttgttagcgatatcttctttctttatttgcatacgtacaactggccctatcgctaataaaataagtgccatcgctatacaaaacacagtaactagtgaagttagttcctttaatcctccagctaatgaagttccaattagcattgcccccataaacagtggtaaaatcgttccatttactcttccaaccatattttctggtacaagttgaatcataagcgtaccgacaacaatattaacacaagctaaacaaatacctgttccaaatctcatgaaactagtaatccaaaatgatgtagatagcccttctactaaaaatgaaagggctaatatacccataccgaatacaaacatctttttcggattcacttttgaagcgaaaactgcagcaacaataccaccgagtaacatacctattccgtcagctgccgctaaatattgaacagcttctttttccatacctaaacgttcaattacaagaaatacttctaatggattcgttaatccaacagctaaacccataattgtaaaagtgatcgtaatcatacgtaaatttttcgtatgaagaacatacttccaaccttcttttatatcattttttaatgagtctctcgccacctgctctttttcaacccattttggtaagaatgaaagggcgatagcagataacaaaaataaaatgattaagctatatagtgatgtaaataaaccaagttgtgtatacacaagcgatcctaccactggtccaaaaatcagaaataatgactgtaatgtttggttaaatgcaatcgcatttgctacctctccttcttttacatagcgcttaaatatacgcgaagatgagggctgagaaaactgacctacaatcgcggaaatgagtgttgcaaaaaatatagcctgccaataatccagctttaacaacaagacaattcctataatagacagtacacttaatacatctccagcgaccattgttcttttcggattccagcgatcagctagcgcaccaccgataaacgagaaaataaaaataggtgcatattccataactgataacaacgaaacagaaactggatcattattcgttcgctccattataaaatacaaaagagccatatttctgatccaaattgcaaattgttgtaaaatatcagacgccataacgagcataaatgctcggtttttaaataaagcgttcattttcattcccctttcataaaccgaccgttcggtctaatttattttgtaagaaaagcaactgacctattattcagctgccattccttttaacaatacatctattgcctttttataaatacgtttcagctctttataatctaattcgtagtaaagcactccaagtcctgataataatccgtttacaatatacataagatcacgagtattatcttcacggaactctccagactgtatacctacttcaattaatttctcaaacataacatatgattctctagttaaagctaacagttcatccagaatctctttacttacaacttggctcatagagaattcctctattgcatttgaaattggttgctgtatgtcctctacatgatattccgcgagaccatatagtttttcagtactagtgctatacaacttctctttttcattccatttttcaatccaatcatacgtatgctgtttcactacaaataaaaataattcttctttacttttaaagtgataataaatacttcctttacttcgctctgtaatttcacaaatctcttccatagatgtagctgcgtagcccttctgtgaaaatagactttctgctttatatgcaatttctttctttatctcttctgcgcttcttctcatattcacacctctttaaaccgaccgttcagtctaataataacaaatcaaaaacctctatcgcaagaggctatattccttatttaagaaaacgtactttcaaaccaagttcgaatcatatgtatggttccaaatttaaatgctaatttaacaagaaatacgcctcccgcagctaataaaaataacactactttccccttatttttcactttcggttcccttttcatttccattccccttagtatgttaaaaatattaaacaaacgtttgtttaactgtgtttatgcatatgtaagccgactaatcaaacgtttgtttaaaaagaaatacgcctatataaggcgcatttttatcaatcaccaccgccaccacagcttcctccgctatctcccccaaaagatcctccacaatcatgtgagccgccatcatgcgagctatcattatcagatccagcaaagaaaaataatggtgatgagctgttagatgaattatgaatgttattttgttttgtaagatttaccttctttttgttcgatcgaactgctgttacgattgttccaactacaacaaataatagtatgacaataataaattccatttaaaagcctcccttattcctcgaataattgaatggttctctctagattttcaagtgaaatgaagcgtgattcacgaagaatttcttttccattatgaaataataaaattgttggccctgtaaatactccatatcgccccgcaatctcctgcatgtcttgtagtaatatctctattttctctacgtaatcataattctctaatacgcaatttacttttcttagcataacatcacaaacaccacaattttccgttttaataaacagaagtaccaattgttgttcttcgatataggtcgctaattcttctatcgttttaaatgtagtcatcttatccctcttagcgtaatttacgaaatactttgtcttgatacatacgaaaagctgaactatctttaatctttctcttttccattacctgctgaaaacgaagcgtttttgctgttaactcttcttgtaattcttttctctctgcttcatcataacagcaagcaattagatcctctatttttaatatatctttttgtagttccatttctggtagaatcattcccgcattttttaaaattttataactcattctaagttctggaggtaccattgaaagatcttctaattgtagtggttttccttttcccggaagataatcaagatcaccattccgtattgcttgtcgaattttttcttcagcaatgttcaaaaacacatccacactattccctcctttacatatttttactattattttacatgatatttccttatctttctacgtctttaataattggctccatacaattttttctcaaatttatttataatgagctatttcctcccataccaatctttcgttttcatatatagtttgtattcaagcctttttgtattgagaaagtctttttcaacttaataaagcgtttacactaaatcttacatttgttacgatttaatcacccccagctcccttgtatagacttcgtgatgtctgatcattttatctagacgtttcacacgtctagattcattttgatttattggcgtatgcctttaaatatatcttttattttgaaaggagaaatggctatgaggtctcaaaaattcacactgctattactatccctactacttttcttacctctttttctcacaaattttattactccaaatctcgcattagcagattcaccaaagcaaagtcaaaaaattgttgggtactttccttcgtggggcgtttacggacgtaattatcaagttgctgacattgatgcatcaaaacttactcaccttaactatgctttcgcggatatttgttggaatggaaaacatggaaacccttctactcatcctgataatccaaataaacaaacgtggaactgtaaagaatctggtgtaccattgcaaaataaagaggttcctaatggtactctcgtactcggggaaccatgggctgatgttaccaaatcgtatcctggctcagggacaacttgggaagattgcgataaatatgcccgttgcggaaatttcggggaactaaaacgattaaaagctaaatatcctcacttaaaaacaattatttccgttggtggctggacttggtctaaccgcttttctgatatggccgctgatgaaaaaacaagaaaagtatttgctgaatctacagtagcttttcttcgcgcatatgggtttgatggcgtagatttagactgggaatatccgggcgttgaaacgattcctggtggtagttatcgtcctgaagataaacaaaatttcactctccttcttcaagacgtccgaaatgctttgaataaagcaggtgctgaagatggcaaacaatatttactaacaatcgcttcaggtgcaagccaacgctacgctgatcatacagaactaaagaaaatttctcaaatactcgattggattaatattatgacatatgatttccacggcggatgggaagctacttctaatcataatgcagctctatataaggatccaaatgatccagcagcaaatacgaatttttacgtagatggtgctataaatgtttatacaaatgaaggtgttccagtcgataaactagtattaggcgtacccttttacggacgtggctggaaaagttgtggcaaagaaaataacggacaatatcaaccttgcaaaccaggtagtgatgggaaacttgcttctaaaggtacttgggatgattactctaccggtgacacaggtgtctatgattacggtgatttagcagccaattacgttaataaaaatggttttgtacgctactggaatgacacagctaaagtaccttacttatataatgcaactacaggcacatttattagctacgatgacaatgaatctatgaaatacaaaacagactatataaagacgaaaggtttaagtggagcaatgttttgggaactaagcggagattgccgtacaagtccaaaatatagttgcagtggtccaaaattacttgatacgctagtaaaagaattacttggtggacctattaatcaaaaagatactgagccaccaacgaatgttaaaaacattgtagttacgaataaaaattcaaactcagttcaattaaactggactgcatctactgataacgtaggagttacggaatatgaaattactgctggagaagagaaatggagtacaacaacaaatagcattacaattaaaaacttaaaacctaatacggaatacaaattttcaataattgccaaagatgctgctggaaataaatcacaacctaccgctcttactgtcaaaacggatgaagctaatacgacacctcctgatggaaatggtactgctacattttcagtcacttcgaattggggcagcggttataacttctcgattataatcaaaaataatggaacgaaccctattaaaaattggaaattagaatttgattatagcggcaatttaacacaagtttgggattctaaaattagtagtaaaacaaataatcattatgtaattacgaacgcaggatggaatggtgaaattcctcctggtggatctattacaattggcggtgcaggaacaggtaatcctgccgaacttttaaatgccgtcattagcgaaaactagacgtaatatccattaattacttcactgaagtttgaatttaggtttgagcaatacctcctaaattcaaacttttaattttatgaaaaatcaaaaacatctcaataacttgttataattatatttagtttctaatatgaagtttatatgaagttcatttgaattttacatggatttcctttaatttctattgtcttcctataatatccatattatcctttacataaaggaattattttcattccattttgaactatctatatatataaagaaagatagtcacctgttagggaaaggctttcgtattattataaatataacaaaagaaaaagcacgcttataagcgcaccataagagtgcttcttcatacaattctcatgtaagagttctcgaaaatcatgttaatcacaaagaaaaggcattagctcataaaagctaatgccttttctttattcatattgttcagcattccaatcttctatattccatacttttgttatccacgattcatagaaagaaggctcatgtgagacaattaaaaccgttcctttgtattgttgtaatgcttcctataaagccatcttagtttctacatccaaatgattagtccgttcgtctaaaattaaaacatcagctttttctattttttcatataaggagctaacacacttaaaatctcttctttatccttttttaattcgagtgatgttaacatatccatcgttctcggcctaggtaatttcacttgtacctcgccaactattgaagctggtctttgagataaaataaatacgcgatctgaaagcaagattgcctcatctaggtcatgtgtaaccataacgattgtttgcttctcttgatgccaagagtttaaaagccagctatgtacttccatttttgtaaatgcatctaatttaccaaaaggctcatcaagtagcataattggcttttcacataaatatgtgcgcagaaaactaattctttgacgcataccaccagacaattcatctggataatggtctgcatattcatctagttcgaactgctttaatgcttccattccctctgttagcctttgttttttcggtttcccttcgatttccaatggaagaacgatattttgcaaagctgatcgccacggtagcaataaatcttgttgtggcatataactaacaacatcttgttcttgtacttgcttatcgttatacgttacgttcccgtttgttggtttttcaacatttgcaatcatgtttaataatgtgcttttcccgcaaccactcggtcctacaaaggaaacaaactctccctcttgtatagaggcactaatattctctaatacattttttccgtcgaaagatttcactatattttttatttgtaatccgctcatttttcacttggaaggaattcatttgtaaaagcatcttttacatcgattttcttcttaataactttgttgtcatataagaaattcatgtaattcgtccaaatttcttccttctgtactccccatgctttagcatcatcttgatacttcgtacttaaccatttttggctttcttgaactaaatctttattcacatctggaacagctttaattaaaatatcagcagcctctttcggttccttaattgcaaaattataaccttctgtcgttgcactcataaactttttcacaaagtctttatcttgcttcgtatgtttttcactcgtaataataacaggactatagaaatcaagcgctggatctaagtccttcaccataatcgtatttaactcttttccttgacgcttcgcttcaataccatcccaaccgtaataaatccattcgaaatctgcatcacggccaattgatttaaagaaatctgtttgtcctaagatgattttttcaactttattaaaatcagcttgatgtttatccataatcgtctttaatgtcgcttcttctgctggtcctccccagccgccgtaacgtttaccttcaaaatctttcggtgacgtcatattgtctttcttaagcgatgcaaacgctgaagtgttatgctgaataatcgctcctacagatacaacaggaattccttctacacgagctaacgttacattttcttgtgcgcttattgcgaagtctgcttttcctgatgctatcatttgctctgctgttacattgtcacctggttgaataatttctacatctaatccttgctttttgtaataatctttcgttttcgctacatacaagccagtatgattcgtatttggaaaccaatctaatactacttttactttttgatctttacttgcactttcttctttcttcgccggattacatccagccacacctaccgctactaaggcagctaacataactttcaaaccttttttcattttctgccgtcctttctatatatccatggtgctgttattcttgccataaactctacgataaaatacaggcataatgtcaccataacgatgattgctgcaacaccaaatactcgggcagtcaaaaaggattttgtagccctcgtaagcataacgcctaatccttcacttgcaccgagccattctccgataattgctcccattacgctatatgtaactgcaatttttaaacctgagaaaaagtatgggagcactgctggaaattttactttctggtaaacttgccatttcgtcgccttcattgtttgtaacagtttcagcatatttttatctactgtttgaaaaccttctaaaatactaagcgcaattgggaagaaacaaacgagtattacgaccattactttcggcaacatcccatatccaaaccaaataataaatagcggtgcaagtacaacaattggaattgtttgcgaaataacgagcaatggatttattaaaatacgaaataacggtataacgtccataataattgcgatactcgtccccaataaaattgcaaagaatagtccaattataacttcctgcagtgtttgcatcgtatttggtaatagtaaatctttcatcccaattaattcttgaacattggcagaaggctttggtaaaatccacggttcgattttaaataatgaaacagatccttcccatatcgcaatgagaaggataagccaaatagttgtaataagtttagattgcttctggttttgcatattcatcacggtacttccaaaccttttcatctatcgttacaccagtgcttggacgataatggattttaatagaagtaatcacttcttctgctccagcatcgacgcaagcttgttgcgcacgtttaacgacatcaagaagtacatctaattctccttccaaagttgtttccattgcccctacttcataacgaactcccgattgttgcacaacttcaattgctttatcgacaacagaatatacatctttcgttttcgcttgtggtactactgaaaatgacattgtaacttgttgtgacataataaaatcccccttataaaattaaatttcaaaaataagaaaaggctttcctactgcgtaggaaagccttgtatgcaagttattacagaataacatatgctacatcactttaagtaactccctacgctggcat

SEQ ID NO: 1322 - DNA, 16159 bp, Bacillus thuringiensis
cagacgcttacgtagatcccggagtcggggataaggaaagcaaaaccgaatatttttgaaatattttttagaacctaatttcaatgcattattcactctgtaaacaacataaatactaaaaaagctcgacatagaatatacagaaaaaacaattgttaaaggaataaatatagtcgacaaattatacaacgaaataaccttatacaaagctttcaattcggtcattttctcttttacaattccgggttcaaaataattgaacaagcaaccaatgatactaacattaagtacaaaaagaatacttaaccaaacatatttcatccttatagtttctttcataacattataaaagaacatgcttcctactcccccgtaaataaagaactacagaacaaaaccaaatacataacagtacactaagaaaaatttgcaattcaaaaaagccaaaatctttaattaaataatctttaggattgagaatcccttttccaataccaagccaaaaaatatgtaaaataaatggaactaaataaataaaataaactcgttttataaaaaacgaaactgataaagctaaactcgaaaaaaccgcaccgtataaaccatttaaaaatacatacattagaaaatataaagtagggtacttataataaactatatgaaattgagctgttggcgaaacagtagaagccatataatttaatattggatgcggagcaactgttggataagtcatcacatataaataaaaattaaatagtaaagggacacttataataaaaaaagatacgctaaaattaataaaataaagcagcttaaaataataacatgttcccatcttagaaataacaggataaataaatccataatttttatcaattctataaatccctgctacagccattgcggaaagcataggaaatataagtaaataaaactcactataaaacgataatctattaaaatataaaatattagataaatatggggatacctttataatcccagcatcgttaaatcctttagttgtcacaaacatagcaatatattgagcaataacaattactaacataataaataaagacaaccaaaacatcctaccttttaaaatccttcctaaaaagtaactcatctatagctcctccataaaccattaaatttaaatcttttttaatatgaacaattgatccgcaacaccataacatttcttttctttatttaaccaaatgtaacgaaaagaaacatttgctctctctccttcaaatttaggaaactcaacttcatactgataaacatcatttgtgccttttctttttacactcttaacttcttgtttccactgaattacttctccatcagtttgttcaatccgtcccaagagatacgttggttttttcttattcgtaacacccgtcaaaaaaacataataattttctggtataactcctaatttcaattttttatttgaaagcttatcctctattaaactatcatttttttctatttgtccttgaaagaaatcatcaccattttcactttccaaaaacacttgttcaaaaatagtatttttgttaattccttttaattcaatacttttcaaattatctttttccgttaaagtatcttcaatatgtacaataggttcatctactttcttttgacaagaaactaagaaactaatactcaatataaaaaaacaaactaaaatatattttgaaataaacctcattacagctcctcctattttaaaaatgaaatagcaggaaaagtcgtataatccggatttgaaactatacgactttttctagcactataaaataaataatttcaatttataatttctaaatcaatattcaatgtaaggtccactatgtcttacactatcaggactccaagcagtaggataagcattattttctctagaataaccaccaaatctcacaggcacatttttcccatggttttcatatgcataattttgaaaaagatatgttctacctggtatcactgttccttcatgcttacctgaaacatttacccattttctatcttctgcatttttatttttatctgcttctgtccaaacattgaaagaacctccgcccttctcactgctcttcacacgcatatacatagaggtaggcgtctctttaggacgtgcattagtataatcatatggactccaaagtctaaaggtaaaattcacatggtcatcccttgtactagccttagccggttcggttaaagcgaaagtactagctaaaatacctaacgataaaacagatccaaacataaaacgactttttttcttaatgcccactaaaagcacctccgataatttgtagcattatattgattgtatttttccactgaaggaacaaaatcaatataatacaatattatggtaacaacacctcaacacaccttcaatggatttcagaatatttaatattacttttacacttgcgaacatttcgttaaatttttaaaaacaatactatatccctagcaaagaattacttgtaaaggtagctacattcctatgcctgttccaaataataaagagtaactcacctctctaagtttcgaattttctcctgctgttttgaggaaataccgcctaaaaatcacttcttaatgaaatcggctacttataaaacttttttaaccttgctgcgaaaaatacaaaaaaagcgcagccatttcggctgcgctttcgaattattatttagtttcgattaaaccgtatttcccatctttacggccatatacaacattagtttcgtttgtatcagcatttgtgaagacgaagaaattatgtcctagcatatccatttgtaggattgcctcttcaacgtccatcggttttaaatcgaatcgttttgtacgtacaagttctaattcatcttcttctacctcatccaaaacagctactgcttctggaaggataaagttcgttttcatagaacctttctcacgtaacttacgatttacttttgttttatgtttacgaatttgtcgctcaattttatcaactactaaatcgatagcagcgtacatatcgctattagtttcttctgcacgaagtaataaatcagtaaatggtattgttacctcgacacgttgcttgtcagagtatacttttaaattaactttaatctctgggaatgtatcaaaataacgctctaacttacttagttttttctctacatattcctttaatgctggagttacttcaatattttcaccacgaatgttgaatttcatagatgaattcctcctttcaagcctatgtattataatttcgacattggcttaaaaactccttctaacttttttaaaaaaattagtggaattgcgatttttttatcgtttttggtgaaatgaaaagatgcatcgtttctatctttattttatcctattaacatcgtgagtaacgaatataactgtggacaattcgttacagaaaagaaacaactttttgacaacttacactataacaaaaaccccttgcgaaaaacaagaggttctactacatatatataacgttgccacaaacgcagctttctcttccaaaaacaatataccctacagtttcacaacattagctgcttgtggtccacgtgctccatctacaatgtcaaactctacttgttgcccttcttctaatgacttatatccatcttgttgaatagcagaaaaatggacaaatacatcgtcaccatcttcacgctcaataaacccaaatcccttttctgcattgaaccatttcactcttccttgcatgttcattccattcccttcactctaaaaatcagggcattcgccccatattttgactataacgaatgacaacatatgaagtcaaagaagacttatcgcctttttattatccctttcgacactgccatattaacttctacaaagtgtcaaactagatacttctcttgcccctctttcatataacaaacttccgatttgcctaactgtaatccctgtcgtatacacgtcatcaacgagtaaaatatgttgctcagaaaacatctcttctccctgaaaataaaaaggattgcttcctgacaccctttctttacgtgtcttcttactttgcttttctgtttcccttcttcttaatgatggataagaaattttgacaggcaaacaagttgctaataactcagcttgattaaaaccacgttcaatttccctttccttactaagcggaacagcgataacggttgaaacattggcaaaatacttttgaaataaacttcgaaaaggacgataaaaaatgtgcactaactccgcatccccccgaaacttaaactgtgctactatttctttcatctcatcatcatacatatataacgaacggtttttaaaagaacgatacttctcctctttcgtccaccttatacaatctatacaaataccgtcttcttgaaatgcggcaggaacaaattctaaaggtcgcccgcactccatgcaaatttctcctataatataggaaagtttctgctcacatctatcacatatatattttctatgacactttacaaaaaaagtgtaccaactaatcttttctacaaaacactcatcacaaagtaaacaatgcattaatcgatcaatccttgttctttcgcatttttattcataccttgaatatgttttttcgcgcgcaccatcgcctctgtcttgccatagtgaaaataaatgacctctccatacggtgcttcaaagctccgccctgctcggcccgcaatttgtacgagcgcactttctgaaaacatttcttcttccgcccccaaaactgcgacttgcaaatttttcaccgttacgcctcgctctaaaattgtcgttgtaactaataatgggatttctccctttttgaaagccgctactttttcttttctccctggatcttctgcatgtacaccttcaattcgattgtttaatggttttaacaacaagcttatttcttctatatatcgcacatgggggacgaataaaaaaatagggaattttttatttaagtatgtttgtaaccactgtagtaaaactcgaggaattcttttatgaatgaggttttttttccaattcccgcaccaacaaaataaaggaactggcaaaggatgacgatgatatcgtccagaaacaataacacctttttgtttaccttgtttaagttttcgcttccacgtttcatctggagtcgcagttaaataaatacgcgccgctttttctttcatcgcttgttttaccgcgtactgtaacatttgatctgcacaatatggaaacgcatctatctcatctacaaccatgacatgaaacgccctataataacgtaataattgatgcgtagtcgcaacgactagtactgcatctttttctttatccacactccctccatataaagccgctacctttatatatggaaatacttcttgcaatctcggtgctaattccagaacaacatccgttctcggcgttgcgatacaaactctttctcctttttgaagcgcttcgttaattccgtaaaacaacatctctgttttcccagccccgcatacagcccaaataaaaaatgattctttttgcttaatagcctctataactccttgcgccgccaaattctggccagtagacaacgtcccgttccactgtaacaaatttgaattcttttctctctttctttcagcaatcccgcgaacaagtacagcacattcacttactctccccatcgttatacacttccggcaatatgcgcacactttactgcaccttttacataaaaacgacgcaaatagccgccgatctacatttccgcagcgttggcacatatatttagaattcttcttttttacaccttgtacacatacgatctctcccttctttttcaaatcgtttaattccctctgtaaatctgaagaaagttcttctaatagcaactgtttccccgctagcatcaacaatcacctccagcactactataaacctttctcatcatctcgtaaaaactcaaaaaagccgataacctacttataaaatagtaagctatcgactttatacacggtttttattcttttataaatcctagaatcgaccgtatcctaagaaatgtttttggttatacgaactgttaatatcaccgtacgcaattcctttatcgctagcatggatcatttggccattaccaacgtaaataccgatgtgagatggacctgctttataagtaccttggaagaatactaagtctcctggttgtgggctatctactttagaaactgagttccagtaacccctaacgtcttgacgacctacaccaaagatgtaagaaatgaatccactacagtcaaaaccaccgtttgatggagatgcacttccccaaacatatggtaaacctaagtagctttgcgctttaccaattacgccacccacatttggagctggttttttctcttcttgtttaggtgcttcttttttaggctcttctttcttaggctcttcctttttaggctcttctttttgagcttgtccaccattgtttgctggtgcagcttgctctgcaggtgcttgtgctggttgagcttgcgcagctttagcagcttgctctgcttgtttttgagcagcagcttcttgtgcagcttttgcttgtgcttcttcttcggcaatgcgttgtaattgtaatgcttgtttctcaagctctttcaattgaccttccgtacttgtcattgaagttacaactgtatccattttaccgcttaaatcgtttaccgctgttgcttttttctctttttcagcgtcaagttctttcttagcagtttcaatttgagcttgtgcttcttttaattctttttgtttttcttttaccgttgcaacatcttttttcacactagcttggtcttcttgttgtgttttcatgatatcttcatcagactcaagaattttagaaacagaagttaaacgatcaactaaatctgcaacgtttttagagtttacaagaacttctgttacaacgttcgtatttggttgttcttgaagtgcaactaaacgctttcttaatagctcttcacgttttgcaatctttgtttgtaattctgcaatatctttatttttcttttcaattaattgctcagtatcagaaacttttttcattgtttcatcaagctttgcagcattctcttgaacagatttatctaaaccttgaattgttttgtttaagtcattcatttgtttttgtaattcatcacgttcttgttgttgtttatgtaaagtgtcattttgtgtgttaatttgtgatttcacatcagaaattttatcttctgcaaatacatttggtgttagcccagaaaacattaatcctgcaactaatgcacaagatgccatttttagctttttcattttattttttacaccgctttcttttttctttttccgtatataacctataaaatttataccataattcgggattttttttgctaatgttacgtttttgtaaaacaaatgtaatattatatgtagctctagcgcaaaatgcgtatatttttgtatgtatgtgtagaaatttatatacttttctcacttctataaacaaagaaaaaacgtaaggaattccttacgttttattaaatatacgaatacagatgaaatgctacttcatccatttctcagcccaattttggacctcatccataacactttctaacgcttttcccttgtcagttaagccatactcgattcgaactggtacttctggatagacattacgaactacaatgccctcgctttccaattccttcaaacgctctgacaacatacgatcgctcatatttgggataatatctgcgatttctctaaaacgtttcgactcttcaagcaaagatttaataattaagccagtccacttcttactaagcagagtaaaagctgactcaaactttggacataaacaagaattatgctccatatgtttcacctctcttccattataatatagtttcttgtaaaaagtaagttataaaactttcctcattattttattttacgtacattttaccatttccaaatattaacttgtcaactaaacgtaacatacccgtaaaaaaaccctcttaaaaagagagctttttatatctttattacttcgtataccatccaagacctaatgcaccttcacctaagtgcgtaccaattacagccccaaaataacctgtacgaattgtgacgtgaggatattttgcttctaattctttcttccattcattcgcttcctcttcacgttgcgcatgaatgataactgcttccataggtacacctttacttgcttgctcatcaaaaatttcaatgatacgttttaatgcttttttacgtgtacgaatcttttcaaacgcaataatgattttatctctaaaatataaaactggcttcacttgtaacagactaccgatgaaagcttgcgcgctatttaatcgaccaccacgttgtaaatgatgtaaatcatcaactacaaaataggcgtccatcgttttcttcatttcatcaaaacgagcgataatctcttttggattctttccttcacttgctaactttgcaccttcacgcacataaaatccttgtacttcacaactaatttcagagtcatacgtgtatacatcaataccttctaccatctgtccagctgtcgttgatgtttgatatgtaccactaattccacttgataggtgaatactaataactgcatcataatctttagctagttcttcatatagctcaacaaactttccgattgctggttgagaagtttttggaagttcctcttgttcacgtactttcacataaaaatcatctgctgaaatttcagcttcttcttgataagattctgttccaaacacaacgtttaatggaatcatatatatattgagttcatcacgaatttgcttcggtatatatgccgtactatcagtaacaatagctattttcattttcgtacctgccttataaaaagttttatttcctaattttacacgaaaactacaaatggtgcatccatacatgaaaatgccggttgaaattatacctaccatctcgacaaattacaacaaaaagataaaatactcaccaaaaacttcagcatatttagaaaaaatgtttgaatataaaaaggctcgcttttaaaatggaaagtactagtcattttgatagataggggcgtacacaattgctattacaatattttacaatcaaagactacggcgaacacgaaatcgtcattcaaaaatcaagatttatttgttatattagccgagcaacgactgaggaagaggctcaagaatttatacaaaaaataaaaaaacaacattggaatgcaacacataattgttccgcttatttaattggcgaacaagatcatattcaaaaagcaaatgatgacggcgagcctagcggtacagctggcgtaccaatgctagaggtacttaaaaaacgtggactaaaagataccgttgttgtcgtaacacgctattttggtggcattaaacttggcgcaggtggattaattcgtgcatatggaaagtgtacaagcgaaggcattaatcatgtcggtgttgttcagcgaaaactaatgcgtgtgatgcaaaccgagattgattacacattacttggcaaagtggaaaatgaattacgcaattcaaaatatgccattaaagatattcattatctagaaaatgtcacatttgatacgtatgtagaagaagacggcaaacaagcatttacagattggatgattgaattaacaaacgggaaatgtacaattacagaaggagatatgttgtacttagaacaagatgttatctaagaataacccatttatcaccttcaaagattaatgtagtgaattacttccctacaaatgaactaacgaactaaggagattatatatggaagaacgttattatcatctccaaaatagcagaataaaaaagaagcgaagaaggaaacttttcttcttccttattttcgcatttttatttggcagcataggagtttatgtgttaaattcttactcttctcttatggggatgtatagtggttttactcgtgaaaaatcggatttaagaaacgaagatgtagaaattacaaaggaaccttttacaattctcattatgggtatagaagattatgcgacagatggtaaaaatggttgtacagactcattagtgtttgcaacagtcaatccgaaaactaaaaaggtttcacttatgagcattcctcgtgatagccgcgttccgattgttggaaagggaaaagaagacaaaattaatgccgctcatgcttacggtggagaggaaatggcaatcaaaactgtagaaggttttctaaaagttcctgtagaccattatattaaaattgatttccaaggttttaaaggtatcgttgatgctgttggcggtgttaccgttgacgtacccttcgatttttgggagcgctctgacgtggattactacaaaaaaattcaatttaagcaaggacagcaaaacttaaacggtgaagaagcacttgcttacgtccgtatgcgaaagcaagatccaaatggcgattatggtcgtgctgctagacaaagacaattactggccgctgttgcccaaaagctaaactccacctctactgtatttaaaattaaagatttaacgactgtagttggaaaatatataaaaaccgacattcctatttcagacggacttgctctttacaataaactctctggatttgatccttctacaatacaaacgttaaagcttgaaggcgaagacaaaaagataggcggtatttattacttccttccagatccaatcagtgtcgaaacggtgcgtaacgaaattgaaaaagaattaggagaaaaagcaaaaaacccaactacaaaaaacaattcaaatcctgattcaaattcaagttctaattctaacgaacaaacaaaaaaagcaacaaaccaaaataaaacaccaactgatccgccaccttctacaaatgctcatgcagagtggattatgcgcaatcagccgtaacaaaaaggcccaatctatgcgattgggccttttttatttacttattaaagtgctgtaaaattgcttctacaatacgctctgatgcacgaccatcaccgtaagggttagatgctttcgccatcttatcatgagcttctttatctgataacagctcatcagcaagaccaaagattgtctcttcgtctgttcctgctaatttcagcgtacctgcttcaataccttcagggcgctctgttgtatcacgaagaacaagaactggtacaccaagtgatggagcttcttcttgtacaccaccagaatccgttaacattaagtatgaacgagctgcaacattgtggaaatcaattacatctagcggctcaattaaatgaatacggttatgttcacctaaaatttcatttgctatttcacgaacaacagggttcatatgaacagggtacacaacttgtacatcttcatgtttgtcaacaagacgcttaattgcacggaacatattacgcatcggttcacctaagttttcacggcggtgagctgtcataagtacaagacgatcatttccaagtttctctagtacaggatgactatatgtttcttttacagtcgtttgtagtgcgtcaatcgctgtatttcctgtaatgaaaatacgtgactcatctttattttccttctgtaagttcgttgctgattttgctgtcggtgagaaatgaagatccgccattacacctgttaattgacgattcatctcttctgggtatggagaatacttatcccatgtacgaaggcccgcctcaacatgacctactggaatttgattataaaaagcagctaaacttgcaataaatgttgttgttgtatcaccatgtacaagtacaatatccggcttcgcttctttcattactttatccaaaccttctaaaccacgcgttgtaacatcaattaaagtttggcggtctttcataatatttaaatcgaaatctggcgtaattccaaagatacttaatacttgatctaacatttggcgatgttgtgctgttacagtcacaatcgattcaattttttctgggtgtttttgcaactctaatacaagaggtgccattttaattgcttctggacgtgtcccgaaaattgtcattacttttaaacgttcagtcatgtgattgcctcttttctttcactaattacagcttctattatgacatataaaaatatgcatgagtacatccctttttaacgcataacagaaacttttctattacaaatactttttcttcccaccgagtaataatctatcttttgtttcttaacatcttcatcagtataacaatttctcccatcaaataaaataggctccctcataagttgtacgtacttttctaacggatacgtttgaatatctccccattctgttacgataaaaaccgcactcgcatctctaatcgattcatctatacatctactatattgtatagcatctccaaatatattctttacatattgaattgcttttgggtcataaagaacaatatctgcacctatattaattaatgcttctattataataagagatgatgcctctctaatatcatccgtattcggtttaaaggatgcgccaagaactgcaatccgctttttattcatgttcataacttttttcgctttttcaatcaatagcagctgttgcttattatttacttcaataactgcttttaacaaacgaaaatcatgagcaacatttcccgcaatttgtaccagtgctttcgtatctttcggaaaacacgaccctccgtagccaatgcccgcatttaaaaaagatgcaccgattctcttatccattcccatccctttggcaacatccaatacattcgcgcctaccttctcacatatatttgaaatttcattaatgaaactaatctttgtagctaaaaaggcattcgacgcgtatttaatcatctccgcacttttaatatctgtaacatacgtttctaaacataattcactatacaaactctctactcttcttgctacttcctcactatccgctccaattacaatacgatctccatgaaagaaatcataaatacctgaaccttcacgcaaaaactctggattcgatacgatatgtactgtatgcctcccttttaacttctcctcaatccatcccttcattacatcatttgtacctactggaactgtacttttcgtaacaacaataatatcgttcgtcgcatataatccaatatcgttacaagcactctgaatatacgttaaatctgccgtcccatctaataaaggtggtgttccaactgcaataaatataaactctacatcatcaaatgcctcttctttatttgatgtaaaagttaaagcattattctcatatgcataatttattaattcatgtaatctggcctcataaataggtaaatccccttgttttatccgttcaattttttcatcatctatatcaaaacatgtaactgaatgccctaattttgccaatcctactcctgtaatcaatccaacatatccagtacctactatcgtaattttcatttccttttcgcacaggaatttacaatagaaaagatatgaaatatagaactcttcctgtgcttcctcctctcatattaaaaatgagaaaaaccttttccttcttcattatatgaattacttcccttattttttttaaagtttttgtaaaattaaatgcactataaagtaaaacttaatcagtgagaatccggctgccagttcacgcgtgataaattcccacattttaacacgaaacttactcatttctaggtgcaacacttataatactgaaataaaagtattcactattgaagaaaaagaggaaatgttacattccaaagcccagtacaattaaccttcttatatgattcaacattctatatacaattgtcatatattctatccgtttccattaaccgtaaaaagaaaaaaagattgaattctaatctttttgtgataccatatgttatgagcctgtaaataaacatcataattttcagataaatatattttcaaaaaaaaattacgttagactataaagggtggggtattaatggactcacaagtgatttatgccattttggcatcattcatcactgtactcgtcgttactcctttagttattaaattagcttttaaaataggagcgacagataagccaaacgcacgtaaagtgcaccaaaagattatgccacgtcttggcgggttggcaatatttattggtgtagctgtaggatttgttgtcggcggcttatatgaacaaagaatgttatcgataacgctaggtgcgattatcattgtaatcatcggaattttagatgatatgtacgagttatctgcgagagtaaaattcggtgggcaactgttagttgccatgatgattgtaaaaagtggattattagtgcaagtattatatatcccattccttggggatactgaacttggatggcttgcttatccaattacagtattttggcttgtaggtattacgaatgcaatcaacttaattgacggcttagatggattatctgctgggatttcatctatcgtacttgcaacgctagcatatatggccttcactagcccatggggtactggaacagctattatcttgccacttgcattaattatattagcaagtacaattggatttttattctacaacttccatccagcaaaaattttcatgggagatacaggagcactatttttaggatactgtatttctgttatatcgttacttggattatacaaaagtgtaacgttattcagttttatcgttccaattatcattttaggtgtacctatatttgatacgatatttgcaatcatccgtcgtatcgtaaataaaaaacctatttcagcaccagataaatcgcatttacatcaccgcttacttgcaatgggattctctcatcgcaaaacggtactaattatatacgcattcggtattttctttagtgtaaatgccattattttcactagtgcaacgttatggttatccattattcttcttttcgctttgattttcttcacagaaatcatcgctgaaataatcgggcttgtacatgaacgctacaaaccaatcatttccttttataaaaaagtgaaaaaacgcgaagactaattgtagtatagccttttcaattatgaaatattcaaatagcatcctctttcttataagaggatgctattttttattctcattttatatttccaaaatatagattgtttgagagttcctctattggagaaagctatacataataagaaaagtatcaagttttcttttttacatcttgattgtcaaactgagggtgaatgttatgatcaagcgagtatttcaatgtattattttatttttaacgattactatgtacgtatcatctaatactgaagcaacaactgttattcctgctgaatatcatccaaatactgaaacaacttctcctacacaaaaaattgcgtacttaacatttgatgacgggccaaacaaatatactacacaaattttaaacatcttaaaagaaaagaacggaaaagcaactttctttgttattggcggaaaagtgccacattacacaaaaacgatgcaacgattaattaaagaaggacattatatcgggctccacagcatgtcacatgatgtaaaacgcctttacactggtgacccttccactttaattgcagaaatggagcaaacacaaagcattgtccagcaagttacgaaattaaatacacatctcgttcgcgttccatatggtagtatgccttatttaaaaaagaattaccgtgacgcacttgtatcggcccagtataaaatgtgggattggacgatcgatacatacgactggaaaagctatgacaatccttctgccatactcgaaagagtacgtaatcaaagtgatgaacaagtcgaagtcattttaatgcatgattcgagtgtaaccgtacaaatactgccaaaagtaattgattacttacagtcacaaggatacaaacttcttccctataatccttcttctcatctcaaagtgaatttttggaaagacacaagattgtaa

SEQ ID NO: 1323 - DNA, 11059 bp, Bacillus thuringiensis
atctaaacttgtcgcttacgcaggcattgatgcctctgtgtcccaatctggacaatttgaagcctcaggtacgtctatatccaaacgtggttcttctcatttgcgtagagccttattccaagcggctattacagcgcataaacatgaccctgtattaaaagctttttatgaaaagaaacgaaagcaaggaaagcactactatgtttgtataggggcggtagctagaaagctgtgttacattatctatgccattcttaaaagcaataagccttatgaagtaccacctcacacaacagaaacatgaccttttcattttttttgaaaatccttaggtttatttggcacgcccttttttagaaaaacaccccctatttatataaaaaactccccttgacttctcatagttggtctttattttttattgtataaaaaaagcaccatttcaaaacatggtgcttttctaaaaattacttttgttcagtagtagacgttgtaacttgccattcaatattaaatttatcttttacttgtccgtatgctgggctccagaatgtttcttgaagtggcatgataacttctccaccttcttgtaacttatcgaatacttcttttgctttttctgcattactaatttgaattgcgattgttacttgagatccgtttgcatgtccttgacctgggaatgtatcagaaatcataagatccgtattaccaacttttaaagtagcgtgtaaaacgcgctctttcgcttcagctggaatcgggtattctggattttcaggcatgtcaccaaaagtttgcatgacttctacttttgcatctaaagcctctttataaaactgtacagcttcttgcccactaccatctaaaactaagtacggattaatacctaaaatcatacggacacctcttttttaagtttataaaatcgaacttgtgttcgtttttatattatcattgttttgcatttcattcaactatttacttcactgttttcaaaattattttgacggaatctccatctcttgttttctaagttcaatacggcgaatttttccagaaatcgtttttggtagttcatctacaaattcaattttgcgagggtatttatatggtgcagtgagttctttgacgtgttgttggagtgttggaattaatgtttcttcgttcttttctatattctctcttaatacgataaatgccttcacgacacttccacgaatttcatcaggacttgcgacaactgcacattctcttacgtaaggatgttttacaagtgcatcctctacttcaaacggcccgattgtataaccagagctaataatgatatcatcaccgcgcccttcaaaccagaagtagccgtcttcatctttcttcgctttatcacctgtaatataataatcaccgcggaattgcatcgctgtacgttcatcgtctttgtaatattgtttaaagagggccggcgtttcaatgtgaactgcaatatcaccaacttcgcctactttaactggagtaccttcctcatttacgatatcgacgtggttacctggcgttggtttccccattgaacctggtctaatatccatccctttcattacaccaacaagtaatgtattttccgtttgcccatagccgtctctcactgtaatatgaaagtgcttttggaacgttccaatgacttctctatttaacggctcacctgctgatacagcgctatgtaatgcctctaaattgtactgacttaaatcttctacctttgccattaatctatactcagtcggtgtacaacaaagtacattcaccttattatcgtctaataagtttaggtacgtttccggttcaaacttaccgtgatatacaaaccctgttgcccctgatcctagcgttgctaaaaacgggctccaaatccacttttgccagcctggactagctgttgcccatacaatatcattctcttcaattccgagccaatttggagcgctcgtacgtaaatgagcgtatgcccaagcatgtgtatgaacgacaccttttggatttcctgtcgttcctgacgtgtaagataaaaagaccatatcttctttatctgtcttcgccatttctaacatgtcactctctgtttctaacgctgtttttaaattaatccatccatctactgactgctcgctcaggacaaatttccgaagagattccatcgcttctatatcatcaaactgcctaatatacggctcatagcttactatcgcttttacttctccatgtccaattcgatattctatatcttttttacgtaacatttccgagcttggaattacgacaaatcctgctttaatagcagcaatatacgtcatgtacgcttcaattaaacgcggcatcataatgagaagcttgtcccctttttgcaaaccactttttataaaagcgtttccaattttattcgcaccttgcattaattcagcgtatgtaacttcccttcgattccctttatcatcttgccaaattaaagctaatttccctttatcacccgtatatttctctatttcagaaactaaattataagacggtggcgccaacaattcttctctcttcataaaatatcctcccttttctttatgcctcctttatataataaagaattttctgttaattttgaaccctcttcttttgacaaatttttcagttctgtcgaattactaaatgaaattacatcaacttaccgacaaatggcaacacaaaaaagaaagagcgggagaacccgctctttctaagccatcatatgggattatttttggtaaccgcctaattgttgctcagctagtgaaactagacgtttagtgatttcaccaccaacagaaccgttagcgcgagctgttgcatcagctccaagttgaacaccaaactcttgagcgatttcgtatttcatttggtctaatgctgattcagcaccaggaaccgctaatttatttgtgctacgtgacatgttatatcacctccttgtgagtatagagtgtgataaataacatgacttcatacacgttttaaatatggtaatttatggttttagaaaagttcttcaaatttttcttcttccgccactacttctaccgtttgtaataccattgtttctttgttcgctacagcttcatcgattaatggtgtgaaatcgtatttcgcttcaaaacgatttgctttttcacgtttcggcttcgtcgctgggcttgctggtgtaaatacagtacagcaatcttcatatggacgaattgaaatatcatacgtgccgatttcttcagagattttaataatctctaatttatccatcgtaataagcggacgaataactgggtagtttgttacttcgttaatcgtatgcatactatctaacgtttggcttgctacttgtccaagactttcaccagtcgtaattgcaagtgcgttacgctcctcagcaatacgttctgtaatacgcatcatcatacggcgcataaccgtcattgaatagctagatggaatttctttattaatcgttttttgcacttctgtaaacggaacaaggtgaagcgttactcgtttacaatacttcgttaactcttgcgctaaatcgattactttttgttttgcacgctcacttgtgaaaggtggactatggaagtgaactgcttccacagatacgccgcgtttcatcgttaagtaagctgctactgggctatcaataccaccagaaagaagtaccattacttttccgccaacgccaactggtaaaccgccagctcccatacgctcatcacacataatgtagctataaccactgcgaatttctacgcgtacatttacatctggattatgaacatctactgtaatatcttctgtgttttctagaatgtgtccgccaatctcaggtaataattccatcgttctcattgggaaatgcttataagaacggtgtacagtaattttaaatgttttcacatcaccttttacttgtaagaaagctgctaatgcaccttctttaatgtcttctaattctgatggtactttcatcgctaagttaaatttatgaataccgaatacatctttcaatctttcagagactgcttcatgatcttcaccatttaactggatgtacatacgatcatgtgttgcatcgattttaatatttgggaattttttcagtttgaacttcacgttatcttttaatgtgcttacaaacttagaacggttcttaccttttgtcgtcatttctccgtaacgcactaaaatatattcatatttcaacataatttctttacctcatcacttcatataattttggcatcgtctcttttacaataccttcaaattgttttacttcttccattgtgttttctggtgctaaactaatacgaatagcgcttgcagctgctgcatgcggcactcccattgacactaacactctgctcacttcatttgcttttgaagaacaagcagatttcgttgacacatatacaccgtgttcttctaaagcatgaacgactacttctggttttaaaccaacaaatgatacatttaaaatgtgcggtgctgcatatgcaagcgacgtgttaatcgttacatcttccatctctttaaagaaacgaacaagctctgcttgtaaactttgcaaatgagctaccttttctttcacttgttccattgtcatgcgaagtgctttcaccatcgctacaatgccaggtaaattttctgtaccagagcgatacttaagctcttgttgaccacctgataaaatcggatctaatcttacgccatcgcgtacataaagaagacctgttccttttacactgtggaatttatgtccagatattgagcaaagatcaatatgagaagcatataaatcaagcggtacttttcctatcccttgtacatgatctacatggaatcttattttcggatgattcgataataacgttccaatttcagcaacaggctgaattgctccagtttcgttgttcacatgaataattgacacaagaatcgtatcttcacgaagcgctcgtttcacatcttctaccgatacaacaccatgctcgttaaccggtaagtatgttacatcaaacccgagttcttctaattgcttatatgcttcaaacacagacgcgtgttcaatatttgttgtaatgatatgtttaccacgcgaacgattcctcatcgctatccctttaatcgcaaggttattcccttccgttccacctgatgtaaaaataatttcagaaggtttaacacgaagaagctgcgctgcaatcgttcttgattgtgttaatagacgctctgcctctcctccaagcgaatgaatagaagaaggattaccaaaatatttcccagcaaccgtcacgtacgattgaagagcttctggatatggcttagtcgtcgcactattatcaaaatagatcatcgttcttcccctttcagcgctatcacatcgtataatcatatcataaatacgtgtcattacgctaagactacgcaaaggttccgttttatctcgattggtgaaggctaataattggcgaggatgccctcctattacagtttcactttatcccgcgttaacgggcaataagactctcacctcaaaatccagttagagcaaagaagttagatgggagattaactgcccgtaaatgcccgattggtgaaggctagtaatcagtggggatgaatcttcccaccgattacagtttcactttattttgaaacgaataaccttactgtattccgctattcattatagcaacatcgcctgcaaaattacataaaaaaacaaacccttttatgaaagggtttgttcattgtctacatattcagctattttttgaacaacgccaggttcaagttgctctaacactgaagccgcttgttctaaagctgcatcgtattggtattcacggaataatttctcagcataatttaaactttctgctaggttttcatcatgactacggtaacggttaccgtactgaattaatttttccactaaatatgcttgtccaattaactcttctgtcatttcagctacaccgttcacagttgtgtatgcttcttctaaactgctatttacagcgttcatatttaacggcttcacttctaattgttcatatacagcttgcattgccatttgccctctttttaaatcttccataatactctctggaagacctggcaaattcgacttttgcataaagcgtttcgtttcgaaaataatatttcgcatttcttgtaacttctcacgtgcttcaaattcttctttgcgcatcgcttgcagcatttctttatattctgcatgaagtacttttaacgtttcacattgctcataaacctcttctagttcctcacgaataatagagaaggcaatatcttgttctgcaacgcgtaattgcagcatttcaaaacgtttcgttaaaatgtgcatttgcttttcaattactttttgagactcaatgtctttatcttgtaactgatagctttgtttcacaagttgtgtttctgttttcgtttcaatcgtttcgatacgcatttcttctaagtcatcgtaaacagaaagtgttttttgctccacataatgtctcgcatgtacttcttgttccaattgatcgtagaagccatctaaacgtgtttttaagttttctactttttcagccgcttctgttatatgaagctcctgtatatccattaaacatgtttgtagttgtttcgtcatatcgcgaacttctttagggacttccaaataatctaatacataaccttgtcttaccatatcattatgtccgtgtaataaatcttccagctgaactggtaacgtcgcttggcactctaccaataaatctggaatttggtgaataatgatttctaaatctgctaaaccttcttccaaactaataacaatttctctcgcttttaaatagtcgccattgtttgttgcttcttcaaaggttttaaatttctcagattcagcgtctagcatctcttcgattttctgctctgctgctccatacatatgtctatgagcaagaacactctttttcatactacgatatgtatcacgtaacccttcaatttccgagctatttttctcatggctttctaacaattgctgtaattcatttaaaatgtccgtaatacgattatcagcgtcatctaaaccacttatggattcgttcatcgcatgctttgcttttcggaaggagaattgcgaggcgaattttcgcgcttgcgctaaatctttgtcagctttcggaagggttgttgatacaatttcatcccattcttcacgccatttaccaaacagttcttctgtttgacccgtcatgtttaaatcttttacccgttttaattcatctgccacaggtttatcttttatctcttgtttccactgctccagtgcttcaatatctttatatgaacgatttcttatcacaagctctatcatgagcagcactagaatagagcttactacaatgataacgatcgtcaggatagaatccatgcaaaaaagcctcctagttatatctctttttttgtccgttccgtttatgaaatggaaggcattatgtataaaaagggaattcccctatatttaacaactaacaatgtactaatcataccatgtaatggtttgtttttgacctagtttttttaaaaatttcatgttcctttcaatgtgattgtaatctttctcaatattccgcctacctcactacctatcctcaaatgattgtaataacaaacaatctttcgtatgggatacgaaataaattttccgcatgagtggtggttcaacagagattacatgtacatttccttgccttacagactgctctactgccctttctggaagtaacgtgataccaaggccagcttttaccattgcaagcatcggttctgcgtaagatgtttccacagctatagttggttttacacctatttcatgaaacatgttcataatcattttccttacatcacatatttctggatatacaattaatttttcattgtgcagctcttctatttgaatgactaccttctctttgtacggatgattatttgaaacggcacaaacaattttctcttgttgcacttcttttatatacgtaacaccttctactactgaatcgatgaacatcgcgtcaatctcccgcgctttaaataaatctcttaatacttccgtatgaccgatttgccattccacttcgaactcatcacctaatatatctttacattctgatatgtaatgctccgctaaactcggtagtataccaattgaaaacttccggttctcttgataccccctcatttctgttttcacttcatttatttgctccaaaatcggtaacattctttttataaataactctcctgcctccgttaactctactccttgcgccgaacgcttaagtaaagtaacctctaaatccgcttctaacttttgaatttgtttactaagcgctggttgagatatatgtaaaatcttacttgcctttgataaacttcgcgtatgcttcacttcaataaacgatcgtactgcctccaaatccatcgtacacacctctaacaaaaagttataaccgttataagaaatcgatatttcctcctataaacaattactctttatacttatttcatcaacttactataacgaaatgtaaaggggaaagatactcttgaacaaaaaacaaatgctactcggatcctttctatgcttactcgccgtcactgcctggggatttatgtttcctgtaatggcaaatgctctgcaatttatcgatccattcttcttcacaacgcttcgctatggatcagcagctattatttttcttattttgctattaattactgaaggaaagacttcactccgcttagaaaaaagaacactttctctattcttttacgggacagtcggtttcgcggggtatggttttctcgttttctacggacaacaacttgccggaccttccggagcaatccatgcagctatgattcaatcccttatgccactgattgccttatcactgcaatggataacgaaaaatcgccgcccacaaaactatacattcctttgtatgttcgttgcattacttggtgttatgcttgtcatttcaaaaggaaatattgaattactatttggagctgcaagccacttatcaacaaatatattgatgctatgcggcgttacttgctgggtcatttatacaaacgggggtgctcgttttcaatcttggtcaccacttaggtacacgacattaacttgtttatttggctccatttcactcatcgttattgttactttcttaacgtacacaaatatagttactatgccgtcactgcgtacagttgtgagcgttcgttttgaactcttttatatgtcgattatcgcaggcgttatcgctgtattttgctggaatatgggaaatcgctatatttcatctattaacggcatattatttatgaatttagttcctatccttgcactgattggttctatctttcgaggttatacagtcgataaaattgaaatcgctggagctgcattaacaattatcgcgctattatgtaacaatttatggcaaagaaaagtaaacataaaaatccccacctcagttcgttaggtggggattcttcacatatgaacagctcttggccattcatggtacatattcgctttacataatgcttgttccatccattgctcaatctctttcgtgtacatctctataaaaaatgtctcagacgggaaagaatggagtacttctgatatatattgtggatataaaaacggcatatttatcataccttttaattgcgtcataaacattgtaaatgatactttctgaaattcttgtttcatttgtccttgtctaatcatttgttctatataatatctttctttagaaaaataaacggtcatcacttcacgaattaatgtcgtatcaagcgaaagctctcggtagaagaaacgtgttagttctctattttcaaattgatatcgtaaaatccctcgcaccatttgcaccatcacatctttagccgacaaatactctctctgttcaaacgacatttcaatcacatgaatatatccttctaaaaaatcagtaataagctgttctaataaaccttgcttcccagcaaaataatatgaaatattcgctacattcacatccgctcgctttgcaatgtctcgcaccgacgttccatcataacctttcgtattaaacaacgatattgccgcatcaattactttttgtttcgtctgcttcatgcgctcacttcccttcaatgaacagctatagtttaaatttcttgacttttaagacaaattcctttaattttctatcgacaaagtcatgtgaaatacatcgtattttgctaatattttacacatctcgataaaaaaggagctgtttccatgtttactaaagaaagttatgcaggatctcgcgtgcagcaatatgagacagtaattaaacaactggatgcgttattaactggcgaatcaaacgtagtcgcaaacttatcaaatgcgtccgcattattaaaccaatttttagatcgcgttaattgggttggcttttacgtaacagaaggaaatcagcttgtccttggaccgttccaaggaatgcctgcttgcgtacgcattccatttggacgaggcgtttgcggcgtagcagctgaaacgaaaacaacgcagcttgtagcggacgttcaccaattcccaggtcacatcgcttgcgatagtgcttctaattcggaaatcgttgtaccgattgtgaaagaaggagctgtcattggtgtactggacattgatagtcctgaaaaaaatcgttttgatgaattagatcagcgctatttagaaaagtttgtggaaacactcctaaaacatatgtaaaaagaaaagagcgagttatcgatttagtacgtcctgtacaaaaccgatagctcactcttttttcattgattaacagtagatattttctttaatgccgtttgcatcataaaaaaaaaacctcccacgattctaaccgaccgaatccgaatt

SEQ ID NO: 1324 - DNA, 11468 bp, Bacillus thuringiensis
gaactcgtgattctctctcttgcattacaaactgttcttgctcttacttattcatttgcagagagtgctgaaaaatccgctgaagtatatacggaagatcaagtttttaaaagtattaaagagcatgttaatgagcatagtactcatgaagaagatatcgaggttactagccaatttctactatacacttaaaaaaaacattcattatataccgcgaatgatttaaaaaacaaatcgaatatcgagattacagaacaagtcgtaacggcgacaaagaaaaaaggaaatgcttattacataacgacgccaactggcgctggatggatagataacaatgataatagcttagaagttcaagagattcataaactatctaatcaaaaattaatcgtaaaagaagaagcttccatacatgcccttccgttccaatcatttaaagaagaagggaaactacagccacaagtcataactcctactgaacaagctggaaattggtttaaagtccaaataaatgaaacagcaaaatggatttatgcaccttctgctacatttgaaggtacaaaagcttcattattaaaaaacagtcgtactgctaaaaatagtttattgagatcgccagaagctctacaaacaaacaatatttatggcgttacatttaaagaaatgattgtcccaaaaggaaatgacgatattcgccctggctacccgatggtacctaaatatattacgattcacgaaacagctaatacagcgaagggtgccaatgctctaaatcatgcaaaattcttagataatcaagcacgcggaacagctgatcgcgccgcatcttggcatttcacagtagatgataaagagatttaccaacatcttccagtaaatgaagttggatggcatgctggaaataaaactggaaactatgaatctatcggaattgaaattgccgttaatcaagatggaaactatgaaaaagcggtagaaaatgcccgtaaattggcagcttatttaatgaacgacttaaatatttctctagataaggtccaaaaacaccaattttggtcaggaaaaaactgccctgcgtttatgattcaacgcggacaatgggatgctttcttaaaaggaactgaaacatactataaggaaaatcaaaaaaatcccgtaactgatgacattacaggtggatggtatgaacaagacattcgtcaattagcagctagaggcattatgcaaggagaagggaacggcaagtacttcccagaacgtcttgtaacgcgtgctgaatttgctacactaattactcgtgctttacaattaccaagtggaaatgctaatttcacagacttagaacaagtacacccatcgttaagagacggtattaatcgtgcagcaagcgcaggtataatccgcggacgtggtgataatacatttgatccaaatactacaattacacgcgaagaagctgttattatgatcgatcgttctctaaaacacgctggtatttttgcaaaacaagttgaactaccattcgtagaccaaaacttaatttacgctaaagaagaagtacaaagagtgtatggatacggaattgtaaaaggtaatgaatttaatcaattcgtaccaaaaggaccatcacaacgtgcacacgcagctgcatttataaacagaatgcttagcgtaattgaagcttaacatatttatcattccatatagatattttcattttatctgtattcacttaaaaggcatcagagattatatatctctgatgccttttatacatcttttagctatttttagccatgaatcttaaacgtattcctaatagcagaagcataaaaccgatgaatggaacgtaattcgtattgtgtcctgtagctggaagttgttgattattagaagaaccttgtcctttttctggtaaattaggtttttctactccctcacctggtttttctgttccttcacccggcttttctgttccttcacctggcttctctgttccttcacctggcttctctgttccttcatccggcttttctgttccttcacctggtttttctgttccttcacctggcttttctgttccttcacctggtttttctgttccttcacctggtttttctgttccttcacctggtttttctgttccttcacctggcttttctgttccttcacccggcttctctgttccttcacccggcttctctgttccttcacccggcttctctgttccttcacctggtttttccggacctttttctgtatctttttcatttgtaatttgaagctttacaacttcaattttttcattagaaatcgtaaatttcatttccttatcggataaagtatatccttctggcgcttggatttcttttaaagtgtaatctcctggttctaacttcttagaagtcgctttaccgctcttgtttgttgttaatgtgtcgatttttgttccgtctttccaaatttcaaacactgcgcctgctaatattttatttgtattattagcgtctacctttgtaatttctaattgacctgtaatttcttctttcactttttcattcataacttcttgttttactacttcatttgctacaacatttacttctactgttacttctaacgctttataaccttctggtgctttcgtttcttctaacgtatactttcctggcactaagctttcgaatttcacaacaccgtctttattcgttgttttcgcttctccaactacttgaccagcttcgttctttaatttaaattctgcacctgctagaacttttccactctctgcatcctttttgattacttgtaagcttcctagttcttttgcgttttctacttgtacttctactactttgtttgcttccacaacgacttcaatttcttcttttaacaacttatatccttgtggtgctttcgtttcttttaatgtatactttcctggttctaatttctgtgaaactactttaccagttttatctgttcgtaacgtatctacttttttaccatctttatacacttcgaattctgcatctgataatactttcgttttatcttccgcatctactttcacgatttcaaattgacctgttactttttcggggatctttttattcaccacatctacagtcactactttattagcctctacatcaacagaaactgaactagatgataattcatatcctttcggtgcttctacttcttttaatgtatagcttccaactggaagttgtttcgataaggcttcacctttatcatctgtaacaattgtttccacaactttcccatctttatcgataacatcaaattttgcacctggtagaagttgaccagattcactatcttttttcaataatttaaattggccattctctacttttctcgtattcttcataacaagttcaattacgtttgtattatcaattgttactttgactggtgtatcaacttttatatatccttctggtgcatttatttcttttacaaaatagtcaccaaatggtaaatctttaacttccgcaatccccttttcgtttgttgtaacagtagccacaacgttattatctttgtctataacatcaaattttgcgtcttttaaaacaatattttcatcgttttcatcaacttttttaatttgtaaatgtcctttttcagctgctggcttattccactttggccagttaaatttaaagttatgaacctcaaaaccatctctttggtgtaatcctccaacataggcttgtccattaatagaaccaccttttgtttctacaactgcattaggtgcaaacacactacctactacaccatatcctttagttgttatctttttagcattagggaacacccaaatgactttactagctaactcagtgaagaaggaattagggtcatatgcttgagaggtattagctaatgtgaacccgcccttatctgtcgtatcatacaggattgcaccgccaccaaaattaacttcttctgcatctgaatgaataacaataaaatctttgttacttacatttggaagataaacatcctttacattgaatggttcttgcccttctaatcctgaagagacataaatattaggattctttacatcttcaccgattccaaaggtcatacccgattttggtttatcagtatgtaattggcccgcatcctcaattacgctatcaacgtcttttctaaattctttaaacttagcatcaatctccgcttgctctttataagagatacggtcatatgatgttttcattgcgccatctgggtcaccgtcttttgtcatcgccactgttccatcttgaataattacttgtcctgctcccgctttcgtaaattgaccgcctagtaataatgatggatatccttcatctacccaagttgctccagctaagttatttgctccagttgcagccgctacgactgtataacttgatgcgttcatatttttctgaacagccatcgcaccttcaatatccgcactcgttgcactatgatctccaaaaatgatggcgttgtaataagatacatcacctaaaccttttaattctgttgtagctgcctctgctttaaatggtaaatggattaaaaaattcatacatattagtaatacaactattaaactactacttaactttttaattttttgattaaatgatttcctcaagaaattcattcccccttttaaacttcctaaaaccacaaaaagaagtacatatcatatgtaccaaaccttactcacattaacttaaaataatccatttaaataaaacaaagaaacactacaactacttaataagattgctacaattcatttttgaaataatacgtgaactaaactgtcatgcggaaatacttttacgtatgggagcccaataaaattaatctgaagaatatttcatgtggtgtaactgttttggcaacatcatccactttacattagttttctaaaggattcaagtgaattgtatagatttcatacacaattcatattttaaaacgctttcactgtttttaataagataaacaaaaaaacgtagccaaaaagctacgtttttctgtcatcgtttcggtgtatttttatgattcttcaaaaacggaagcgggaattgcttacggaaatgctctttaatcatatactctacaccgttttcactatttgaacgtgtgatccaatctgctgcttgctttaattctacaggcgcgttccccatcgctaccccaagtcccacgttttcaataacctctaaatcttccatactatctccaatcgcaaccatttcatttagcgaaatatttaaatgctctccaagcaattgtaatccacgtaactttgatacattttgcggtaaaatttctattcgttttgaatcacattcaacatactctacatcttggaatgcttttcttaatgtatttagcccgcgttctttttcacctttagtttggaaaagaacatcaatttttggcgccgctaccggatggtcacgaagcgcatcacctaacgaatctacaaattgaactggataaaataacgggtctgcacttgataatacagtgcgcgcaattaagtttggtgtatttctctcacgatttccgattgaaaaccgttcatgagaaatacgtacgttacaatcaaagtgctctaacacttgcacaatgttaaaagtcttctcttcagataatcttctttgaacgtacggcttatctaacgttgctgaaacgaaagcaccaccatgtgtcactaatatagaatctaattttaacgcctttgctactttatgagcggattgaaaattacgactcgtaaataacgtaacatatacatcttttctttttacaaattcaattgtttctcttaatccttttgcaatttttccattgttgtatagtagtgtcccatctatattaagagctagtaagcgataaatcatgtcgcactccccctcttcgctgttgtactctatccataatttatgaaataaacccgataaatagaacgagttagaattactactgaaaatttggtttactatatacatatacacttagtaaaggagatagtacaatgcaggcacctccttctttttatgaaggcgatacgttagaagtcgcaaaaaaattactcggacaaaaacttgttcatattgtagacggaataaagcgaagcggaatcattgtagaagtagaagcatataaaggccccgatgataaggccgcacatagttacggaggcagacgaacggaccgcacagaagttatgtttggtgcaccagggcatgcttacgtatatttaatttacggtatgtatcattgctttaacgttattacagcaccagcgggcaccccgcaaggtgttctcattcgagcccttgagccggtagatggaatagaagaaataaaactagcgcgctacaataagaccgaaattacaaaagcgcagtacaaaaatttaacgaacggtcctggcaaactatgccgtgccctcggaattactttagaagaacgcggtgtatcgttacaaagtgatacgttacatattgaattagttccaaaagaagaacacatatcatcacaatataaaataacagcaggacctcgtattaatatcgactatgcagaagaagctgtacattatccgtggcgtttttattatgagggacatccgtttgtttcaaagaagtaagcatatgttaaagggagagattatgagaggcaaacctgaactaaaaatagaatcagaaaaagtacataaaaggaagaaaaacccaaatggaatgtttgtagcaagaatactacaaattccgaaagaagaagataaactagactttgtccttattttacaaaataaaaaaacgaaaaatattatttataacaaagttttagtaacaacagataacgactattattctttccgactcgctcgtgggaatattaaatggtcatccttatatactgttacagtatgggatgggatgggcttggacatcaattagtagaagtatcagccttaactggtaaagagaactattctatttctgatgagcattgttccgcatatcgggagtaactcaaaataaaagagaagccgaatcggcttcccttttactctgcaccttccgcagttgcaatattatcctctaagttttctcttgataattcagccgccataaaatctgctgtttctggaagtgctaaatgcatatgagctttttgacaaatttggatcgtacagttttctacaacatagtcgaaaacatgtccgcccccgcttctttcatcatcaatgtaatgtaagtggaatccagctaccccaataccttgtgcgtaatctggtgtccaaaatccagcaagcgtaccttctgtattttcaaatgaaaagattggctgtgatttcgtcacttcaacgagcggtgtatacggtttttcttgtcttggaacagttctcgtccttacttcacggaacgtaccgtccattcgaatagcgtaaaataagtttttacttggcatcaattcatgtaataacgcttcaacttcttcacgattcatcggacgctctaccgtataactcatttctttttcaaaaaacgttacagttgcaaatggcgttgtttcttctggctctactttttccgctgaaccgtctgaacgtaaatgataaaattcattatcaaatgcaatcatttcaccgtctaattgatcaaatgtgccgatgccaaaatcaccatgttttttcaaatcttcaaagctaatcacaccatcatatataccatctaatagcgcaagcattgtagatgtttgatatacttcattactcattttcgttttttttgcatcaatatcaattaattgcgcaacagtcatctcaaatctgcctccattagtttaattggtttggtaataatttttcgcttaatttaatgttgtcacgatagtcaattggaatatcaataatgacagggccgtctgctgctaatccttcttttaatacgccttctaattcatcaggcgtgttaacacgaagacctaacgccccgaaactttccgcatatttcacaagatcaacatcgccaaactctgtagcggatgttctgccgtatttcatcatttgttggaatgcaaccatatcatatgtgccgtctctccaaacaagatggacgattggagaatttaaacgtaccgccgtttctaactccatcgctgagaataagaaaccaccgtcacctgatacggaaactacttttttacctggttctactaaagtagctgcgattgcccaaggaagtgcaacacctaacgtttgcataccgttactaaataataatctacgtggttcataagaacggaaacatctcgccatccaaatagaatgggaaccgatgtcacatgtaacggttgtatcgtcactaattaaagaacgaagcgtacgaatcacttgaagtggatgcgtaacaccttctgcaggacgatttggaacttctgcttgttctgataattttgcgcgtaatcgttctaataccgcttctgatttcgtacttaacacaagtttcggtaacttttctgcgatgctatttaccgttaaggcaatatcaccaattaattcacgctctggttggtaatcatgatcgatatctgcttgatggtcgtcaagatgaataatcgttctgtcgccaagtttattccagaactttggatcatactcgattggatcataaccgatagaaataacaaggtctgcttcttctagtaaaatatcacctggttggttacggaataatccaacgcggccgaagaaatgatcttctaactcacgtgaaatcgcaccagctgcttgatatgtttcaacgacaggaagttctgtatccgcaattaatttacgaacagctttcgtcacttcatttgtgctcgctctcataccgagtaaaataactggtaatttcgctgattttattttttctactacatatgtaatatcatttgtgggagcgattccaagctgtggcttagaaagcgcaccgatagactctacagttgtttccgcagtcataacgtcttgcggaagacttactaaagtagctcccggatttgtggaagtcgcacttcgaaatgcattactaagtgcttctggcacattatcaggatgctctacttctacgctatattttgtgattggttcgaatagtgcagcattatccatagattgatgcgtacgttttaatcgatccgtacgcggtactgcaccagctaaagcaacaacgggatcactctccgcattcgcagtaacaagacctgtcgctaaatttgatgtccctggtcctgaagttacaagacatacgcccggtttccctgttaatctaccaatagcagctgccataaatgctgcattttgttcatgacgacaaacgattaactctggtcctctttcttgcaatacatcaaatacagagtcaatctttgctcctggaataccgaaaacatgtgtaacaccttgtttaattaaacaatcaacaacaagatctgctccttttgtttttgtcttcacgtcgtttacttttacacctgtactcaaactaatcattcctttgtttcataatttgtgtaataaagatttttaatttcacctagttaattaatgtggtgaagtatcatttatcattatattacaaatgcattatttttccaacaatatgaattcgatattattttgacaagatttaaagaatgcgcttacaaccttttgtttatcttaaaataacatttttatatctcttctaaaaatgtacaaaaatacttccacttattcacattattaacaaatttatagtaccttgcaaagaacaatagcaaatgatatatttgtaaataatggaataaccattatttggaatctttttttataatttatatatacccttcaaaaggtagatatagattgtgctgtttagaaagaagataagattctcaactgtaattcatcattctataaaggaaagtgattgttatgaacaaaaatgaatttttggaacaacttagttcctctctgcagaatatgcctaatttagaaaaggaggatattatctcggagtacgaaactcattttattagtggtaaacaagatggaatatctgaagaggaaatttctaaaaagctaggaaaccctaaaactatcgctaaagaacttaatatttcatatgtaatcagtaaagctgacaagaaacgcagcctaaaaaacattatgacagcactgttttctgttatgagcttaagtcttttaaactttatatttatcattatcgcctttttcgtattactctttctattaccgcttcttctaacacttataattgccactccgttattaattatttcacctatcttattaataggattaggattctttaaagggtttcatcaaatcagttattccgatgtttacaatgtattcatagccttttgcatcggcttactaatatccgtcatatgttatcaaataataaaacatctatacgtagctttagttaaatatttgaaatggaatgtagctattttgcaacgacactaatgcaaaaggagattaagatgaaaaattatattttatatccactcatgttacttacaattttatttctatcagcttgttcaaacagtgcacaacctaaggaagaaaacgatgtacaatctattaaagatgttgctattaaagttccagaaaatatatttagttcctcaaagaaaaatgaaactattaatgaagacgaaatgaaacaaaatataaaaaattatatagattatagttggaagttatctgaaaatattatccctctcgcttcaacaaattttgataagaatttcacggaatctgaccgagaaaaattacaaaaactaattgatttagcgaaacaaaacgatatgaatttccatgagtttattagtaataataatttacctactgattataaaaaaccttcaaaagaaatctatgaatttatgtcatcatctacggatattttcgtagagctagatcaagaattagacaaactcgcccaagatggtaacttattcaaggccaatttttcttttacgaaacgccttgagaaaataaatgggaggaaacaaaaagagattgaaaagtttttgaacgaaaaaaatattaaaacttcaattaacagcaataaaaaaaattaaccgatgtgttacatatccctttcaaaataatcaataagaaatggctattttgaaagggagtttttgtgatataactattaaattccctaaacaaaaaagacgctcctaaactaggagcgtcttccactattacgcttgttgttgcgcgctatataattcttcaagtggcttcatgataattttgttaacgtcaccgattacaacgtttaggcgttgctcagtttccattaattttgtaattttagcatcttgttgaatgcgagctacaacttcttgtg

SEQ ID NO: 1325 - DNA, 11391 bp, Bacillus thuringiensis
gcagccatcttatcaattacttgctttcgcttcttacttttttacatcggctgaaatgagcagacgttccgctgccattgttgacaaacgctcgtcccacattacaacgtctaattgtaacagctctcgtaggttttctgcaaattgttggcacgcttcaccacgcgggccaattgtaccattcatatttttaggtaaacctactactatcttgtccacattgtactgctttactaactcagaaatacgatcaaaaccaaagtgacctcgttcttcgttaatcttaattgtttctaatccttgtgctgtccagcccatttcgtcgctaattgcaactccgactgtttttgtacctacatctaaacctaatatccgcataaactactcctcacgatgatgtttcaagtaagacttcacaagctcttcaattaactcatcacgttcaagcttgcgaatgatgctacgtgcatctttatggcgaggtatgtatgctgggtctccacttaataaataaccgacgatttggttaatcggattatagcctttttcttgaagtgcatcatacacagttaaaagtacatcatttacatggacactctgtttttcatcttgaatgctaaacttcattgttttatcaaaaccgtccatttcaagcacctcacttatatagtaagtatagggagaagaacttctcctctccctaccattgtacactactatctctttattttgaaacagatttaacgtactcttgtacaaatgctaaagcttcttcgacttgagctgggtttttaccccctgcttgtgccatatcaggacggccgccaccgccaccgccgcaacgagaagctacttctttcacaagtttaccagcatggtaaccttggctaattaagtctttcgttacacctgctaggatgtttactttatcgtcattaacagacgctaatacaacaactgctgactctaatttatttttcaagtcatccatcatcgtacgtaagttgttcatatctgcaacatttactttcgctgctaatacattcacaccatcaactgtcattacagaatcagttaagtttccagcttcgatattgcttaatttcgcagcaagagattcattttctttttgcagttgtttcacttcagcaaatagaccatcaactcttgttaaaatatctttcggatttgttttcatttttcctgctgcttcttttaataaacctacttgatcgttcattaattcgtatgcagacttaccagttactgcttcaatacgacgagttcctgcaccgataccagactcagcaacgattttgaaaataccgatagaagctgtattttcaacgtgacaaccaccacaaagctctaagctgtaatcgccaacttgtacaacgcgtacaacatctccgtacttttcaccgaataatgccattgcgcccatttctttcgcttcttcgattgctttttgagaaatctcaacatcaatactttcccaaattttctcgtttaccatacgctcaattttttctaattcgtcagcttgtacttgaccgaagtgagagaagtcaaagcgtagacgttcagaagttacaagagaacctgcttggttaacgtgtgttccaagtacgtcttttaatgcttggtgtagtaaatgagttgctgtatgattttttacaacgctactacgatttttcgtatcgataatagcttttacagccgcatctttcgttaatgttccttcttcaacaacaactttatgcaagttttggccgtttggtgctttttgtacgtcttttacaagaactttcacgccatcagcaagaaggtaaccacggtctgcaatttgtccaccgctctcagcatagaatggtgttacatcaagaattaactgtccttcttcaccagcttgtaagctgtctgtgtattcgccatttttcacaagtgcaacaacgttactttctgttgcaactgtaccgtaaccaacgaattcgctcgctactttaatttctccaaggacaccaccttgaacttgcatagaatcaacgtcttgacgagcagcacgtgcacgctcacgttgtttttccatttcattttcaaaaccttcatgatcaactgtcatgccagcttcttctgcatattcttctgttaattcaattgggaaaccgtatgtgtcatatagacggaacgcatctactccagaaataacagttgttttttcttcttttgcttttgcaattacttcagctaaaatcgcttcaccatcatgaagtgtttcatggaaacgctcttcttcgttcttcacaactttcgcaatgaaatctttcttttcaagtacttctggatagaagtctttcattacttctccaacaaccggtactaattcaaacataaatggacgattgatgtttaatttcttcgaataacgaacagcgcggcgtaataaacgacgtaatacataaccacggccttcgttagatggaagagcaccgtcaccaacagcgaatgttactgtacggatatggtcagcaattactttgaatgccatatctttttctaaatcgccattacgatatttttcaccagaaattgtttctgttgcatcaatcatcggcatgaataggtctgtatcgaagtttgtaggcacatcttgaacgatagatgtcatacgctctagacccatccctgtatcaatgtttttcttaggaagtggtgtatatgaaccgtctggattatggttaaattgagagaatacaaggttccatacttctaagtaacgctcgttttctccgcctggatataattctgggtcactaaagtcattaccgtaagcttctccgcggtcatagaaaatctctgtattcggtccacttggtccttcaccgatatcccagaagttttcttctaagcgaataatacgctcttttggaacgcccattttctcattccaaattgtgaatgcttcttcatcttctggatggattgtaactgatagtaattctttatcgaatccgatccatttgtcgctcgttaagaattcccaagcccatgtaattgcttcttctttgaagtaatcaccaattgagaaatttcctaacatttcaaagaatgtatggtgacgagctgttttccctacgttttcaatatcgtttgtacgaattgatttttgagcatttgtaatacgtggattttgtgggattacacgtccatcaaaatatttttttaatgtagctacaccactattaatccatagaagagatggatcttcatgcggaactagtgatgcactaggttctactgcatgtcctttttcttggaaaaagtctaaaaacatttgacgaatttgtgcgcctgttagttgtttcattgtattttcctccttaaatataaaaaactcccgtccctataaaagggacgagagttaactcgcgataccaccctaattatgaattgattacaataacaatcaattcatcacctcatggtgccgtaacgtggcaagacggcagtgattagctgctctcaggattagctttctgttacccttcatttaaagcttctttcagccatatggaagcttctctctataaatggactgtaacgtacttgttccgtcattgatttaatgtattatatgactaaatataatagaattctcttaagtttgtcaatgtagataatcatttatattggattaattacttattaatcataagtattctactattcattcttaacagccttttcatatagtatgcatttattaataaatcggaatctccttataagaataatttataaaaatttctaaatattacttttttgttataattaaattattgttaataaaataaaggagcgatcacaatgacaaccttacttagcaaagctaaaaacatattagcgactgacgaaacgatattattttacgcagcatgttcattagacatatttatttatcgttccgtcgcaaggccaggaatgctagttttaacgaacaaaaggctattcttttatgggccagatgtaagtaagaatccaatatttgaagagtactctttcgcaaaaatttctaatctaaaagaacaaaagcgtcttttcaacaatcaaattgtatttatgtatgataacgaatggaaaaaaataaaacatattcaaacaaatgatgtgagctccctcgttcaaaagatacacgagcagctttctaaataaatatatgattagccctctatttcttacatagagggcttctatacttacacatcttcttttttcaagagcggtctcacatgaacaatgacagtgcgaataactgctaaaatcggaaccgatattagcaatcctacaatcccagctacctctcccccaactagtaaggcaagcataataataacgggatgcatacgaagtgacttaccaacgatgtaaggcgataaaatgttactctccacaaattgcaaaatcgcaattgtgatccccgccttaataagtaaactcgttgatactgttgctgcaatcattaacgtcgggattgctcctaaaataggaccgaagtacgggattatatccgttaccccaataataatgccaagcaataatggatatttcataccgataaaccaaaaagaaagagctgatactccccctaatactaaacaaacaaataactgtcctcgaatataacttccaagtgatttatcaatttctttcgcaagcatttgccccgtacctcgccatttacttgggactagtttccaaaagatatgataaaactcaccataatcttttaatatgtaaaatacaatgaacggtattaagaaaataatgagcaatgaatcgagtacaccacgagctgtactcatcactttatttaaaagcgcttgaatcttcgtttccacacccacaaaaagttgtttcaccttttcatgaatgaacgaagggaaattcgccgtttgttctgtaacgccatccatccacgaatcgtacatttttgtaaactgcggaaattgttcattaatctcttgtaactgtttaataacgactggtgttcctttataaatcccataaccaattccgccaaagaaaaggatataaatgagcaaaatggcaagtgtacggggcatcccttccttatgaattttttcaattaaagggtgcaataaatacgcaataaaacacgcgataagaaacggcgtgattgctactttaaatacaaaaataatcggtgcccatagcggcttaatttttaaaaagacgagcagacaaagaaaaacaagtaacaataatcctaaacgatatatccaaatgattttaagattcttcacatgaaaaacctcctccacctttattttgaaaataaatggggtaggttatgtgcgaaacttttaaaatcttttcatacggaccatactgttttttaaagacgtacatataaataacataacaaggacaaccacccctgagaatacagcatgaattaatataatcaggagggctaattatggttttgtttatgcttggattatcagcactttttatgattcttgaatggatttgtatcgggttcggtatttggaaggggttctttattcattcctcacgtaaagaaaaagcgaagcaattatggcagtatggaatacttggcgttggctgctacggtctatcttatcttttctcagagatcggacttttttatttacatatgggtgcataaaaaaactcccttgtctacaagggagtttttcactttatcgaaatgattataagtaagacttaatcatcttacgtgcttttttcatattgcgttttgaaaatacatcttgcttacgagcatattgatatgctgcagctccaacacctaatgcgattaatgaattgcgtagattcaaagtaaatcccccttttcgttatccgatcgttctttcattctcatcaaataaatcatcaagagagcttagtgaaccatcttcctcaacttgatgcgtatggattttcccctttgaaaccgataattcgatataacaattccagcaataaaattggttgacacctatttttccaatgtctttccctttgcaatttggacaaataaacatatggctttcatctccttacagtctcccagattctattcgccattatgtccaaactgcattcatttatacattttactggagcctttcaacgctatgcgtttgaaagtttcactatataatttcaccttgttacatgaaatcatacggtgaaatgttttccacgtccatttcctcgccattaactgtgaccatctgtacttctccttgtgattcttgcaagcgactagctaaggttgtttgacgcattgcatcatcaaggcgatttacaccagattggaaagctgcttcctctccgcaaataataaggaacttcttacttcttgtaatgcccgtgtaaattaaattacgacgtaacatacggttgtaacttttcacgattggcataataacaatcggaaattcactaccttgtgatttatgaatggaacaacaatatgcatgcgtaatttgatttaaatcgggcttcgtatacgttacctcaattccgtcaaatgaaacgataatcatatcttgttgctcaacgttttctttcgcataaaacaccgaaacaatttccccaatatcaccattaaacacttggctctccggctgattcacgagttgcagtactttatcgcctcttcggtacacaacatcaccgtaagcaatttctttactcttttccctcttcggattaaatacttgttgcagcgcttcgtttaatacattaataccagcaggcccacggtacataggtgctaatacttgtacatctcttgcgctaaagccttttgttttagcattttcacaaacttttttcacaacctcaacaatttgagctcctgtacagccgataaatgaacgatctttttgattttgtgctaaatctggtggtagagttccattttttatcgcatgggcaagttgaatcactgatgagccttccgcttgacgataaatttcagtaagcttcactgtcggaactgcgcctgcatttaataaatcttttaatacttgtccaggtcctacagatggcaactgatcttcatcacctacaacgataacttgaatgttcgtcggcaacgacttaaatagctgatttgcaagccaaatatcaaccattgaaaattcatcgataataaggagcttaccttggacaggatccgtttcattacgctggaaagatccttctggcgtccaaccaagtaaacggtgaattgtgcaagctggaagtcctgtcgattcactcatccgcttcgctgctcttcctgttggagctgttaatagtattggaaatggattatcatcactgtattcattcggatttaacgataacccgtgtagtgatgcatacatttcaacaatccctttaataactgttgttttccctgttcctggtccacctgtcaataacatcatcggtttatgaagtgccgtttgaattgcttcttgctgaaacggtgcatattgtacgttcagttgttcttcaatttcacctaacgtttttaacacttctgcttctggaaatgaaggtgtttcttcttgattcataagcctgcgaatagactttacaacacctttctcagagtagaataacgttgctaaatacactcgttcttcttctatgatgactttcccttcactttgcatcgtttcaatacaacctataatatcttcctcagtcactcttccttcttgattgtttaaaagtgacatcgtttctcttacaagttgatctttcctcatataaacgtgaccaagttgtaatgagacattctctaatgtgtaaaaacatcctgcgcgtacacggtcgtcatgattacccgatatccctaacgcacgccctatatcatccgctcttccaaaaccaatcccgtccacttcttcgataagttgatacggattattacgaatcacttctaatgtcatctctttatattgctggtaaatcttaatagaaagtttcgttccaaaaccgtagccatttaaaaagctcattactttctctagcccttgatgttcaacaattgtctcatatatttcctgagccttttgtttattaacaacaccatttaatgcctcagggtcatccataattttagaaatagcatgttctccgagatggtccacaattttttcagctgtacgctttcctatccctttaaataaatcactcgctaaatattgcaccatacctgcttttgtttgcggcaattcttttttaaatgtttcaaccatatattgttttccatactttggatggtccttaaaatgacctgtcaatgtaaacacttcatcttcatgcatgcggggaaaatgaccgtttatcattactttcttttcgtcatacgtttcattcgtttcaatgactttcatactgacaacggaatagaggttttcttcgttgtggaaaatggtatgaagaacttgcgcttttataaactttttctcttcctcaaacaaatccattgcatgttgatttcccatttttcctctcctttccggtattttcactttaatgagcagtacatcccccacctttttagatgagggataactacccattaaactatatttttatcttattcagcttcttgctctaataaacgaacgccattacccgctaaaaagtgatctggctgaatttcagttgctttcttaaataaagcgagagccttctcattattttcctcaaatacgtacgcaacacctaaattgtaatacgcatctgcatgctcctcatccatttctaataccttttcaaaataaggtttcgcctcttgaacgtgttctaatcgcgcgaagcaaagtccgcactggaatacagcttctacatcgttttcatctaattctgttgctctttgtaagaatggtagtgcaagacgatcatttccaagctgtacatgtgtgatacctaacataaatgttacatcagctgattgtaatccagcttgcattgcttgttcaaatacagctttcgcttcagtaaattgctcttggccataatatacatttcctaaaccataataggctgctgcagatttatcatctaactctagtgcacgtttataaaataaaatcgctcgctcgctatcacctaatacgtctaataaatttgcaaaattaatgtacccaagcgcatctttcggattttcttcgattgcttctgtaaaatttttagctgcttcttcccagtttccttcttgcatatattgaatacctgtttcaagtttgtttgacatgtccttcacctctacaacaaattataacaaagaatgtattttccaagcgaacgaaaattcgctttatgtaaaagaaacctctaaccgctaatcggcagaggcttctcatttatcctaaataatccaatttcttaccactacggtatacttcatcaattgtagcaccgcctaagcactcatctccatcatagaaaacgactgcttgtcctggtgtaattgcacgaattggctcatcacaaagaatacgaactgtattttcatcaacgatttgaaccgttactttattgtcttcttgacgataacggaatttcgccgtgcacttaaattctgtttctttttctttgttacttacccatcctacattcgtagcaataacttcatcaccatatagaagttcgttatggaatccttgatcaacatataaaatgttttcttttagatttttcccaacagcaaaccatgggtcaccattaccaccaattccaaggccatgacgttgtccaattgtataatacattaaaccgtcatgcttccctttcacttcaccagataatgtttgcattacacctggttgtgccggtaagtagttacttaagaaatctttaaagttacgctcaccaatgaagcaaatacctgtactatcttttttcgccgctgtcgctaagccagcttctttcgccatttcacgaatttgcggtttctttaattcacctaacgggaacattgtttttgataattgctcttggcttaattgatttaagaaatatgtttgatctttattgtcatcaacaccgcgaagcattttatattcgccgtccatataagcaacgcgtgcataatggcctgttgccacataatccgcaccaagcgcaattgcatgctctaaaaatgctttaaatttaatttctttattacacattacatctgggtttggtgtgcgaccagctcggtactcatctaagaagtacgtaaatactttatcccagtattgtttttcaaagtttactgcataatacggaataccaatttggttacacacttcaattacatcattgtaatcttctgttgctgtgcagacaccattctcatctgtatcatcccagtttttcataaaaattccgattacatcataaccttgctcttttaataaaagtgctgctacagatgaatcgacgccaccggacattccgatgacaacgcgtgtttcgtgaggtagtttgttcatcatgtcacctcccatactaattttgtgttaatcgcttcacgattttcactgtttcgtacgccgctttttcaatttgctctttcgtatttccaagtccaaaactaaagcgtacggatgaacgtatttgatcggagtcttttccaaacatcgctactaatacatgtgatggatcaatcgaaccagctgtacaagcagaaccacttgatactgcaataccagctaagtctaagttcacaagaaacggttcaatgttcattcctgtaaaacttacattaagtacatgcggtaagcgatgttctaagtttccgtttacctcgaaagtaatgccttcatttttgaagacagataccattatatctttaaactcttcatattgggcatttttttgctcacgagttttttcagctataagaattgcatgctgaagcccagcaatactaggcacattttccgtaccagcacggcgttttctttcttgctctccgcctattaataacggttcaaatttcacatttgtaccagcgtataagaaacctacaccttttggcccgttaattttatgagctgaaattgataataaatcaataccaaactctttcacattaatttctactaaaccgtaagcttgtaccgcatctgtatggaaatacgcttgatgctcttttaacagctttcctatttccacaatcggttgcatcgtccctacttcattattcccaaacataacagatacaagaatcgtctcttctgttaatgccttttgtatgtcagaaacttgaatgcgccctgtttcatcgacaggtaaatatgtcacttcaaacccttcacgctctaacaattcgcacgtatg

SEQ ID NO: 1326 - DNA, 12098 bp, Bacillus thuringiensis
aaattagttatttctttagaaacgtatgatatactgcccggatctcgagtaaaagatggaatcattacgacattagcgttggtatactctatttgggttatcaaaacgggaactgctgatttaaaaacattcttcttaggaattggattgttcgtattaggtcttattctttatccaatactaatgaaagactcacaaaaaacggattaaataaagagaagctgctggcttctcttttttattaaaaatctgtaattaacttttcttttagctctcctacagataaaggtttcgcataataaaatccctgtacataatcacagctcattgattgtaacaaactctcttgctctactgtttctactccttcagcaactactgctaaatttaaactatgagcaatttcaataacggattttacaatcgttcgttctggttgtgcgtgatcataatgaaattcacgaataaaattacgatcaatttttacaatatccagtggtagttgttttaaataatataaggaagaatagccagttccgaaatcatccaaagcaattaaaacacccatatttcttaattcttgtaatgtagcaataatataatcaaaatggcggactgctatgctttccgttatttctaatattaaacggttcggaggaaaaccagttctctttaaaatgctacgtacagagaaaataaaacgtttctgcattaattgttgtatagataaattcactgataactttagtccttcttgataattgggcaatgttttaaacaatcggcacgatttttctaatacccagtctcctagctttataataagtccagactcttcagctaccgggataaattcgtttggtgaaataggtccgtcttctgtcatacagcgtactagagcttctataccagaatatctcttcgttttcaaatcaataataggctgcaatactacatctaactcttcatcacgaattgccttttgcaaagcaaactcaactttcattctacgatttattttcgcgcgtagctcatctgtaaagaaacatgcagcatttctcccctgttcttttgcactatacatagctaagtcggagtttttcaataatgtttccacgtcttgtccgtcttgtggataagaacaaagtcctagactagctgaaatatatacttcatggccttcaagaataaatggtgcctggaaacatgacaacacagatgtcgctaactgcctcatatcatcttgtctatgattttttgttaacagcacaaattcgtcgccacctagcctagccagaacatctttctctcctagtacataatgcaaccttgaagcgacttcgcttaaaagtaagtcccctatcatatgacctaacgtatcatttactaatttaaaacggtccaaatcaaagtaaatcataccaaattcttttttatctgcaatcaatttattaacggtcgttattaattgcaaacggttcggcaaactcgttaaagcatcatgataggcaagttccctataacgactttcacttagccgcaacctctgttccgcttcttttctactactaatatcatttcgtattgcgataaactggtaaggctctcctttttcatttaaaaatggaacaattgttgttttgacccaataatatgtaccatcttttgctcgattccgaatctcacctgtccatactttcccattcaaaatacgtttccataagttttgaaaaaaggttttcggatgatgacctgaatttaaaatacggtgatcttttccaattaattcttctcttttgtatttagagatttcacaaaatttatcatttacatatgtaataagaccttttcgatctgtaattgcaacaattgaagactcatctaatgctaactttaaatctcgcaacgaagagtcatataatgcatgacctctctgttctagcatgcgcatctctccttgcttctatctgactaaaacacaacctgtttctcttcatagaaatagagatatttcattttctaatactagccctttacataaattatctttttaaataaaccgattaaaataacataatattatttgtaataaaaagcaatattataccgtttcaattataactggtagcttcccatatctctaattacttcgcgccttattataccgcaatccttttaagtagctctatgcaagccttgtttccaactaataccactcatatctgatctctttgtttttaataacgaaatagaaattagatcatactacataactattcacaaataataatatgaaaatctacattaatgtgcatgtttttgaattacaataacaaaatattaacatatttccaccttaactttggaattattttataaataaatactgtattaaactaaaaaagaggatagcctcttttttagtttaatacgaatatggtatttgctgataacctgggtatggcattggatacgttacagggtatggtgatggataagctactggatatggagccggataatatcctccacttgttgcacctgttaatgcaccagctgtcagtccgcctaacactcctcctgcaaagcttccagggaaaaatccgcctccccatgaactaccaccaccccagccccatccgcctccgtgatgatgatggtgatcatagtgattgtgtcctccatggtgatgatgtccaccatgatgatgatttcgatagtacaatccattattttctatataattcatgtttctccgctccttttcgattttttcattttcatatgcgttaagagtgggataaaaaatgggatagtacactgtatgtaggacaaatgcggaaagtataggtgaaatgtctatattttgtaaaaaaagcaaaacaccttataataaagatgtcatattacatcttctatttaagaagtctatattgaaaaaagattaggggaattatatagaaatgaagaagcctatcgttcaattactattaatatttacaattgtatctatcgttctgttcctattaaatacatcgtatatttcgttatatacatttgtcggtgctctatggtccatcacaattgtcggaatttcattcgttatttttatagaaaatagatctccacaaagtacgttagcatggtttttagtattagcacttcttcctattataggtgtgcttttatacgctattttcggacgcagccgctggagaagaaaaaaacatctccatcgttcagaagaacaaagaaaattattccgtgaaatattagaaggaagaagactagagttattactcacagtcccactaaatgaacgttccatacatttaacagaagtcatacaaaaatttggaggtggtcctgccgcagataaaacaactacaaaacttttaacaaacggagatcaaacattttcagagattttgcgagctatagagcaggcaaagcatcatatacatattcaatactacatttataaatctgatgaaattggtacaaaagttcgagatgctttaatacaaaaagcaaaagatggtgttattgtacgcttcctttatgatggccttggaagtaatacgttacgacgacgatttttgcaacctatgaaagaagctgggattgaaattgtagaatttgaccctattttttcagcttggttacttgaaactgtcaattatcgtaaccatcgaaaaattgttattgtagatggaaaaattggttttaccggaggactcaatgtcggtgatgaatatcttggccgttccaagaaatttcctgtttggcgtgatagtcatttaaaaatagaaggaaaagcattatataaattacaagcaatctttctagaagactggctctatgcctctagtggtttaaatacttattcctgggatcaattcatgaatagacaatacttcccaggtaaagagatttcaaatgcagaaggtgctgttcaaatcgtagcaagcggaccaagctccgatgataaaagtattcgtaatacattattagctgttatgggctctgcaaaaaaatccatttggatcgctacaccctactttattccagatcaagaaactttaacattattacgcttaagtgcaattgccggaatagatgtacggattttatatccaggtaaaagtgatagcatcattagtgatcaagcatctcaatcctatttcactccgcttttaaaagctggtgcttctatttacagttataaagatggttttatgcatgcaaaaattgtactcgttgatgatacaattgcaactattggaacagcgaacatggatgtacgtagctttgaattgaattacgaaattattagcgttctttatgaatcaaaaacagttcacgacattaaacgtgattttgaagaagattttaaacattcaactgaaattaaatggaactctttccaaaaaagaagtataaaaaaacgcatattggagtctttcatgaggctcatttctcctttactgtaggcaatcaacttcatcttgattgctttttcttttccctttatcctccttccttttctttgcataccatattaaaacaagttatcataagatgtattactttatgaaaataatgttaggtgggaaatacatgttagaacaatttcatatacatgctgatttaaaacaacagctttctacgattcatgaaaagaataaacaagaagctggtgaaaatgcacatttaatcggaacgaaaatatataaagcgtctgataatagcattattgaagatgcgattacagcacttcttcttggcaagaatattctattaaaaggaccgactggtagtggtaaaacagtactagcggaaactctttcttctttattccaaaaaccaatgcatagcattaactgctctgtcgacttagatgtagagggtattttaggatacaacacactacaaacgaaagatggtgcatctgaagtttcattcgttaacggtcctcttatgaaagcaatgaagaacggtcacttcctatatattgacgaaatcaatatggcaaaacctgaaacgttaccacttcttcacggcgcattagattaccgtaaaatgattacaaacccatttacacaagaggttgtatacggtgatgacgaataccgtgtaattgctgcgattaacgaaggttacgttggaacaagtgaactaaatgaagcgttaaaaaaccgtttcgttattattgaagttccttacattcaaggtgatacattaaaagaactattattagcagaatcaaaattaaatgatgttgcaacaattgaaaagtttgttgcatttgcaagcgaccttatgcctttagctcgcgatggacgtgtaagtgaagaagcagcaagtattcgtggtattatcgacgcatgtgatttaggtgtatatattcctgttatgcgagcgattgaacgaagcataattgcaaaacttaatgatgaaacagaacaaatgactgtccgtgaattagcagaaagttatttctttgagggataatttatgagacaaatttttagtgacaaaaaaattgatgcgtcgctgtttctacaaatggaaaacttaatgtatgcccttctaaaagaagacgatgcctatcttgaatatggctataaagcatactacgacgaaattgaaaagaaagttgtcattagtcacttttgggatgatcgaaaagaagaagatacagtaatcggattaaaaagcgaagtgttcttaaaagcacttggtaataaacattactcggacatgactttaattcgctcttatgcgattgaattgcaagaatcgcccctaaaaaagtttttaacacaattatttgttctattagaagatttacgcgttgaggaaatcgtaaagaacttacgtcctggcacgaagcatgtttttaaacgtcgaaaagaaatgtaccgcaattatttcggctctcaaaatgaaataaaccgtgttcgtaattatcacggtgatcgtctattttgcctatgctatctttcattaactagcgataaatacgaaatgtttaataatgaatattttgagcaaattgaagcgattttacatgaaacattccaagcacgtaatactgaagatattatgtatatcgttgagaaaattcgctatcgcttagaggcgcttcttgaaagcgatatgcttaacaactatttcggacatgctccactttacttatctgtccttgcagacgaaaagaactgtcgcgtcgaagatttagcaaatgatgatacgcagcttatagatgacgatgaaaataaaaacaaaatggatgaaagtttctccacatggcatcgtgaaaataaaaataacgaaaacgagaactttttacgctttgaattagaaagcggaacaaaaactaatatgatgggtgatactgcccgtgaatcagaagatggcgaccaagcacttggttctgtacaaggtacctcacaaaaaagtacacaatccaactttgatggcgctgatacagaagaagcaagggcttcacacgcttctagccagcacgacggtgcatacggtaagtataatgtaggtgcttctcatacatttaaagaagctcgcaaaccaaactcagatgagaaaaaagattaccaagctatcaaatcagtcgtcaataaagatgtaaaagaattaaagaaaattatcgaaaaaacaattgaaaataaaacgaatgcgaatagtgataaatattacggaagacttcgtaagaaattccttcgtatttataccgaaaaacaaccgcgtatgttttataaaaaaggacaagagtcacaagaactcgatgttgcattccaactattagttgactgttctggttctatgtataacaaaatggaagaaacgaagaagagtgttgtactatttcatgaagctttaaagtctttaaaaatcccgcacgctattagcggattttgggaagatgcctctagcgctaaacctgaagataagccgaacgttatccatgaagttgtaaattataaaaactcaacgttgccaaacgttggtccagaaattatgcaacttcgtgaagaagaagataaccgcgacggatatattattcgtatcgtttctgaaaaacttgccaaaagacctgagaaacataaattcttactagtcttcacagacggtgagccttctgcgctagactatcaacaagacggaattttagatacgcatgaagctgttaaactcgcgcgtaaaagtggtatggaagtaatcggtatcttcatcgaagaaggcgaagcgaaagaagcaacttatcaattgatgaaaaacatttataaccatcacttcttagttgcaaatcatgctgaagatttacgattgaagattaaaccattgctgaaaaaactattactgaagacgattgaatagaaaataggagccttatggctcctgttttttcgttcaattactttgtttctggttgaaacttgtatggaatggctacttctaataaagattcaaatcctccgtcatagtatgggaaacgctcattcgcaattgttcgatctacccactctattgcagaaatttcaccttcatcttccgcaataagttccccttttactacattcgctcggaatgtaaaaaatagtgcatgattccctgattcttcaaagaatttttcattgatcgcaacaagccccccagccaaggcggttaaacctgtctcttctttcacttctcttattagtgcttcctctaatatttcacctttttccacagccccacctggcaatgaccaaacgttttgttctacattatgtaccattaatattttatctgtttcttcgtcatgtattagtgcgtatacgacatcaactctttgcataagacttctctcctcccaaaaataatgaagagccgattcctaagaatcgactcttcctattaattcatcactaactcagctgtgagctttttttttaacttagccagcatgtcagttgtcattttgtctaaatcgtattctgctttaaagccccactctttcattgctgcagttgcgtcaatagagtttggccagctatcagcgattgtttgacgagctggatctactgcataatccattgtaaacgtcggaatgtgtttacgaattgacgctgcaatttgctctggctcgaagctcattgctgtaatgttaaatgcatttctatgcactagcttacttggatcagcttccattaatgaaatgatcgcttgtaaagcatcaggcatatacatcatgtccatgtacgttccttcagcaatgtatgaggtgtatgcaccttttttaattgcctcataataaatttcaactgcataatcagtcgttccgcctcctggaggagctacgtaagaaattaaacctgggaaacggacaccgcgcgtatctacgccaaatttttgatgataataatcacacagtaattctcctgccactttgtttaccccatacatcgtagtaggacgctgaattgtatcttgcggtgtattatcttttggcgtcgatggaccgaatgcaccgatagaacttggcgtgaagaatttacagtttaattcacgagctgcttctaatgcatttacaagtccgcccatatttaagttccatgcgaataacggatttttttctgctgttgctgaaagtaaagctgctaaatgaataattgtatctacttcattacgctttgcgatatcatgtagtttttgtccatctgttacatctaacgtttcaaatggaccagacgttactacttcactatctgtttcacgaatatctgttgcaataacatttgatgcgccgtatacatcacgaagtttcattactagttcagaaccaatttgccctaaagaaccggttactagaatttttttcattttccccactcctcatttgcaagctattcaaaagatgtcgttacttaaatgatgcccatttcttttcctactttttcatacttaagaattgcttcatctaacatttctttcgtatgagctgctgtaggcatattacgaacgcgccctgttccttttgctacagttgggaacacgatagattttgcgtataccccttcttcatttagacgtttactaaattcttgtgttaatacttcgtccccaatgatacaaggtgtaattggcgtttcactttctccaatgttaaagccaagttcttttaatccttgtttcaagtagcggccattttcccataagcgatcgtgtaactctgtgctttccattaagatttcaattgatctcatgcaagctgctgcatcagctggtgttaatgctgtagagaataagaatggacgtgaacgaacttttaaccagtcaattaagttttgtttccctgctacatatccaccaattaccccaattgcttttgataatgtaccaatttggaaatcaactttatcagaaagaccgaagtgctttacagttcctgcaccttttccaagtacacctgaaccgtgtgcatcatctacgtatgtcattaaatctaactcttctgcaatctcaacaatttctggtagttttgcaacatctccatccattgaaaagacaccgtctgtaattaccattaatttattgtaaagacctgattctttcgccgcaattgctttttggcgtaaatcttccatatccgaatgtttataaacaataatttttgcttttgatagacgactaccatcaataatagaagcatggtttaattcgtctgaaagaattgcatcatttttatccataacagctgaaatcgctgccatattacagttaaatcctgattgataagcaattgctgcttctgtatgtttaaactttgcaattgtttcttctaacttaatatgcaaatctaaagtaccgttaattgtacgaacagcccctgctccaacaccgtacttatgaatagcaccaattgctgcttcttgcaaacggctatctgttgctaatccaagatagttgtttgaagataagttaatatattcttttccgccaattgtaatgatcggtccatttgaactctcaagcggatcaattacgttataaagcccctttgattttaaatcctctaaattttcttctaaaaatttcgcaagtgttttactagacatcgtgaagcctcccatcgttcatgtaagcggattattgtcttaatagttctaataatccctctactagcttaacacgttttcagaatttattatagaaaaatagtttaaagtaaccgcttacaattttagattatatatgattcattacaataaatctattatttacttttcatatttgatagaattaaaaaaatatttcaggaggtttcaaacatggcatttacagaatctgatgtatacaataacacagcatttttcgaacaatatatgaaacgaagataccgagaaaatagcccaaatgaatccattgaaaaaccaatattctttcagctcattggtcatgtacgaggaaaacaaattctcgatttaggctgtggtgatgctaagtttggcgcggaattattagaaaagggatgctactcttacaccggcattgaaggctccgaacttatgtatgaaaaagctaaaaaacaactagaaaataaaaatggaactgttcattttttaaacctcaaagattatacctacccctcttccacttttgatttagtaacatctagactcgccttacattatattgaacatcttgatagcatttttcaaaatgtgtttcaaactttaaaaacaaatggcacctttacctttagcgttcaacatcctgttattacttcttcgtttgaaagcttacaaacaagtggtaaaagaatgagttggctcgtcgatgattactttaaactaggcaaacgggttgaaccatggattgaccaagaagttattaaatatcatcgtacaacggaagattatttcacattattacagcaagccggatttaccattacatcattaaaagaagctacaccaaatccaacctattttcaaaatgaagaagagtataaacgtcgcttacgtattcctctcttcctcttattttcttgtaccaaataaaaaaacgatgaatcactcatcgtttttttatctcattgcctgagcaacttctttaactacacgtcttcctcttccgtgaggtatacaaagcggtgttccaaacaacggatccgtactaatttgacactccattcggaatacatcacgtactagtttctcatctaccacttcttcaggtttaccttgtgcatatatttgtttatcttgaatggctacaatgttatctgcatagcgacatgctaaatttaaatcgtgtaataccatgacaattgttctttgttctgtttcatttaattcgaataataaatctagcacctcaatttggtgagtcatatctaaatatgtagtaggctcatccagtaaaataatatctgtatcttgtgcaagcgtcattgcaatccaagcacgttgtcgttgtccacctgaaagagcatgcacatcacgctcagcaaattctgtcatacctgttgctgcaagtgccttctgtaccatttcctcatctttttctgaccactgtttcagccatgtttgatatggatagcgtccttgttttacaagttgcaatactgtaagcccttcaggtgcttgcggtccttgcggtaaaattgccatttgacgagcaatttgcttagtttgcatactttgaatagcttgattatctaacaaaatgtcaccagttgttggctttaataatctagctagtgaacgtaataaagttgatttcccgcaaccgttggaaccgataaagattgtaatttcaccttttggaatttctaaattcaactcatcaataataattgtttcaccataagacaacgtcaaacgtttcgtctccaatgctttttgcatattcatctccctttatgaattccgacttttataaagtaaataaataaaataaggtgcaccaattgctgatgtaaatacccctgctggaatttcaagtggtgtgaaaactgtacgcccaattaaatctgcagcaagtactagaattgcaccaacaatagctgcaactggaagtaatgcaccgta

SEQ ID NO: 1327 - DNA, 13409 bp, Bacillus thuringiensis
gaacgctctatacatatggatacattccatatacgatctttttaagtatcgcaacggcaggtgtgccacttgctgtttcaaaatttgtttccaaatataatgcgcttggcgattataaaacgagccggagaatgttccgctcgggaatggttatgatgatagtaacaggagttctttcgttcctagtactgtacatgacggcgccattgtttgcagaagcgatgcttggtaaacaaagtatacacaataatgtaggagaagttacgacgattattcgtcttgtaagtttcgcacttattgttgtaccagcagcgagtttaattcgtggttatttccaaggtcaccagtctatgggaccaactaccgtttcacaaattattgaacaaattattcgtatcgtctttttattagcaggtagttttatcgttattaaagtacttggcggtacagttgcaacagcagttggagtagcgacatttgctgcgttcgtttcagcggttggagcactcggtgtgttaatttggtactggttaaaacgtaaaaaatatttggatcaatatctaattgaacaaactgtaccagaatcaacagtaagcaccgttcaattgtttaaagagttatttgcatatgcgattccttacgttgtaattgggttaacaattcctttatatcaacaaattgatacattgacatttaactcaattatgcaggcgattggtcaaggtgatatcgcagagcgagctctcggtattttcacaatgtggacgcataagttaattatgattcctgtatcacttgcaacagcgtttagtttaacgcttgtaccagcaattacaaaatcatttactgaaaaacaataccgctatttgaaattgcaaattacacaaacattccaggcgaatatgtttttaacattgccagcagttgtcggtatttcttcactggcatatccaatttatactgcgttttacgattcagatccactaggtggacaagtattaatgtggtatgcaccagttgcgctgttattcgctttatttacagtaacagcggcaatcctgcaaggtattaaccagcagaagcatgcgattattgcgcttataatgggcgttattttgaaatttgtatgtaacgtaatctttattcgttatttcggtacagtaggagcaattctagcaacagcagttggtttcttagcttctgtttggtacacaaatcaacaaattaaaaaatacgcacactattcattcggtgttgtatataaaagaacattccaaattgcagtactaacacttataatggtcgttgctgtaaaactatcacaatggcttctatccttcatgatttcgcctgatggccgtattggtgctcttataacagttgcaatttgtgcaggtattggcggtcttgtttacggattgttagcaattcgcacaggagtacttgaaagagtatttggcggagaagcattagataaaattcaacgtaaacttggtagtagatttaaaataaagttgaaatcaagaggggcgtaattacgtcccccttttctatgataaataaagaaggtgaaaaacgtgagattagataaattattagcaaatatgggatatggaagtagaaaagaagtaaagaaattattgaaagacggcgttgtgaaaattgatggaacgccagtaaaagatgcgaaagttcatgtaaatgtagaagagcaagaagttatgattcacggtgaagttgtggaatacaaagaatttgtttacttaatgatgcataaaccacaaggtgttatttcagcgacggaagatgataatcatgaaacagtaatagatttattagaattagaagatgcaatctttgatccgttcccagttggacgacttgatatcgatacggaaggtttcttattgataacaaatgatgggaagttatcacatcaattattatctccgaaaaagcatgtgccgaaaaaatattatgcacacgttgcaggagtagtaacagaagaggatgtaaaagagtttgctaaaggtgttattttagatgatggctatgaaacgaagccaggtgcacttacaatattgaaaagcgatgatatttctgaaattgagcttgtgattacggaagggaaattccatcaagtgaagcgtatgtttgaagcggtagggaaaaaagtagtctacctaaagagaacagagatgggtccgttagtattagatgaagaactagaacttggacaataccgagagctaacagatgaagaagtagaaatgttaaaaacatatcaagtagatactgaaaagtagtacctttataggcgcagaaaagacccctttctaattattagaaaggggtatgtatttatttacatacaattatttttcattatgaggtcattctcactttctttcctgttgttgtccacttaccgcggcaagggctatacacgagttcattaaactgcaacacatttagatcacgttgtatcgttcgcggtgtgatcccgaactcatctacaaggtctttcgtcgttaccgttccgttttcattgatgtacatataaattgatttaatgcgtgttagcatacgagtagttgtaggtttcaagagaaaaccactcctctactagtttttttgaccccattcaggaaagaaggtcgttactaccattgtactctacatgataaaattcatgctttaatctacttaaattttacagaaatttaacaaatattcatatagaaaaatattggtagttgacattgtatatatggtcagtcaactaacacataaaattctacgtaaaacgccaaattcctgcaaatttttttgaaaaaataaaagaaaaactaataagaaatatctgaaatattacaattgttcggtatttagttttcgtgtatggcataagagatttcggtttgttatgatgaaagaaacaatatagtgaaggatggatgcgtgatgtcagcaattaattggacagaagaagttgcgaaacgaaaagatgatttaattcgtgatacacaacaatttttacaaattaaaagtgtatgggaagaagaatcggcgaaagagggcgcaccattcggtgaaggtgtagaaaaagctttatctttcatgttacataaaggagaaactgaaggttttgcttctaaaaatttagaaggatatgcaggtcatcttgaaatgggacaaggagaagagttagtaggcattctttgtcacgttgatgttgtaccagaaggagatggctggacgactcctgcatatagtgcggatattcgcgatggaaagatttttgcacgtggtgcaattgacgataaaggcccaacgatggcagcatattatgcgatgaaaattgtgaaagaattaggcttacctctttccaaacgtgttcgtatgattataggaacagatgaggaaagtaattggaaatgtgtagatcactactttaaaaatgaagaaatgccaacaatcggttttgcaccagatgcagactttccaattattaatgcagaaaaaggaatttctgacatacaagttgtgcaaaatggtagtgaagagaaaaaaggtacatatgaacttgtttcatttgattcagggcgccgtttaaatatggttcctgattttgcagaagcggttattacaggagaagatgtaaatgcacttacagtagcatatgaagagtatttacaaactgctaaaaaaatagggaaatcgactatagaaggaaatgcagtgacgttgcaaatagaaggaatttcagcgcacggatctactcctgaaaaaggagaaaatgcaggtttattattagcaaacttcttaactacagtttcacttgatggaaaagcaactgcatttgcgacatttgcaacagaaacatttactggtgatatttttggtgaaaaagctactattgcttataaagatgaaattagcggtccgttaacagtgaatgtcggtcgcatttcttatacgaaagaaaacggtggtaacttagggctaaacgtacgttacccagttacaactaactttgaagaaacaattgtgaagttgaaagaatatgttggtacgcatggttttgaagtggctgactattctaattctcgcccacatcacgtcgataaagatcacgtattaatccgtacgttacaacgtgtgtatgaagaacaaacaggtgaaaaagcagaactattagcaatcggcggcggtacttatgctcgttcattaaaagctggtgtggcatttggcccgctattccctggaaaagaagaacttgcacatcaaaaagatgagtatatcgaaattgaagacttattaaaagcaacagcaatttacgcgcaagcaattcatgaattagcgaagtaatggatatataaataatgtccgctctctattttggagagcggcttctttttacctgaatgagataagaaagaaaagcaacaatagaaagaaggagaagatgtacatggaactgcattattttgtcgcaattacgttaccgaatcatataaaagaaatgctgtataactataaaaaggacatgcaagaggaattacaatttcgttcatgggtacataaagaagactatcatattaccctttcatttttagggagtgcaacggaggaacaattagagggaataaaaaatggattacaaacagttgcagaaacaaaagaactatcgttcacgttacaaggtttttcaacgtttggtagggaaaatcagccccgtattttttgggcgaaggtaagtgagaatcacgatttgtttcagttgcaaaagcaagtacatgccatttgtgaagaaaatggattttctctagaaatacgcccgtatcacctgcatattaccgttgctcgtaaatggataggagaagaaaagtttcgtttagaaagtataaaagaagtgcctgaaatatcatttcaagcagatacaattactttatacgaatcccacgtgaaagaaaccccgaagtataaatcgattgctgaaataaaattacaaaaatagaatgttgaaaacgttttttatgcaggtgaatatactatagagaagaatggagttactgtatagagtcttgttgataagaaaagccttatcatttgcagctcattttatctcgcctaattggtgaaggctaataataagtgaggatggaaaaattttctcgctcattaaagtttcactttattttaactttgagaatgatggtgatttttttatgttgaaagtaaaacgtccatttgatgcctatttagatgaaatgaataaaattacaattttgctcccacatgcgtatggaacaagtcggacatttcgtttgcaagaaggaagtaatgtgaaagatttaccgattgctcatactattgcgcttccagatgcaacgaagtatgagtgctttatagaagagccgctagatgtggggaagtattatacagtacgagatgaacggaatgaagaaactgatttacaaataggtgctgttattcgaacaaaaattttcgatgaaaagtattattacgaaggtacagatttaggtgctgtgtatcaaaaacaagaaacgacatttaaagtatgggccccaactgcaaggcttgcgaaagtaagaatttataagagtgataaagaatataccgatcatgaaatgtacaggggagaaaacggagtttggattcaaacattacaaggtgatttagacggagcacgctatacatttcttgtttgtattaatttaatatggaacgaagcggtggatccttacgcaaagtcagtgactgtaaatggaaagtatggcattgttatcgatttagaaaagacgactgtaacgaaacgagagcaattaccaccattacaagcaatgacagatgccatattgtatgaattgcatattcgtgatgctactattcatccgaacagtggagtgagtaaaaaagggacgtataaagggctaatggaagaaggaacaacaggacgaaatgggacattgacaggtttgtctcatataaaagatttaggcgttacgcatgttgaattattacctttatattgtttcggtggtgtagatgaggcgaatccttcgtccgcctataattggggatataatccattatattacaatgcaccaacaggattttatgctacaaacccctctgatccgtataacaggatagttgagtgcaaacaactaattgaaacatttcatgaacaaggtattagggtgattatagatgttgtatataatcatgtttatgaaagagagctatcatcatttgagaagcttgttccaggatattattttcgtcatggtgaagatggtatgccttctaatgggacgggagtcggaaatgatgtagcgtctgaacggaaaatgatgaggaaattcattgtagagtctattttatattggcttactgaatacaatgtcgatggattccgattcgacttaatgggaattttagatgttgatacaatgaatatgatagagaaagaagtgcgaaacataaaacgagatgctttgttattaggagaaggatgggatttacaaacaccgcttcctcttgaggaaaaagcaacgttaaataatgcgaagaaaatgccacatatcgcgcagtttaatgatcaatttcgtgatgggataaaagggagtacatttcatataaataagcgtggttttgcatttggtgggcatgtagactgtaatcatttgcagtatattgcagcaggaagtcttttaagtatgaaagaaacagggctgtttttagagccggcgcaaagcattaactatgtagaatgtcatgataatatgacgatgtgggataaactagtgcgcagtaatgaagaatcagaaacgattttgaaaaaacgtcacctattagcgagcgcaatggttattctttcacaaggcattcctttcttacacgcagggcaagagttttatcgtacgaagaaaggaaatgaaaatagttataatgcaaatgatgagatcaatcaattagattgggatcaaaaagagaaagagatagagaccgttaactatataaaaggtttaattgcgattcgtaaagagcatggggcattccgattacaaaatgcagaccttataaaaaaacatatgacttttttacaaacatctacagaagtacttgcatatcacctagagcatgcagaatcgtttgggccgtggaaagagattatcgtcttatttaatagcggtttagaagctaaaactgtgcaacttccgaaagaagcaacgtggcatgtgttagtaaacgaaaacgaagcgaaaatagagccaatttcttcatttagaggaaaggaacttaggctcgctccaattagcacgtatatattgacgataatgtgacaaatcgctacttgacgatgagaatgtaataaatgtagaattgacaaaggtgacgattttgataagttgtcattctatgacaggttttgtaaaataaaatagaggatttttggcttaggctaatttttcttttcatttacagtaaaatatatgaatccacaacatgtgtagaaatgttgcggtttttcttttcataactataaaagataaggatttgttaacgggtaatgaatatggaatggttggaacaattattaggaaaagagtggagtcttgtaccggctggtggagtaacgggcgatgcatatattgcgcaaaacggacaacagaagttatttttaaagcggaatacatcgccctttttagcggtattgtcagcagaaggaattgttccaaaattactttggacaagaagggtaacgaatggtgatgtaatttctgctcaaaaatggcttccgggacagaagctagagccagaggatatgaaactagaacgtgttgcgaaacttttaaagaaaatacactcctctaaagcgcttgtacagatgattcaaagacttgggaagcagccgcttcacgcacaagagttattacaacaactgcaactcgttttaagaggagatataagggatgatgaaacaattcagcaaggccttcaatatttaatggattcattaaaagctattgaatacaatgaattcgttgtatgccattgtgatgtaaaccataacaactggctattgtcggatgaagatgaattgtttttaattgattgggatggagctgtaattgctgacccagctctagacctcggtatgttattatattggtacattccgcgccaggagtggagtgagtggctcggttattatgatattgaaatggatgaatcgctgcttaggcgtatgagatggtatgtgatagcacaaacgattttgtctattcaatggcatacaacaaaaaaacagcaagcagaagctgaatattggcatcaatatttacagcaactacttgcttcagaataatacttaagaaaaattgtccattccagcaatccactgagtaagttgttcttgattattggaaatatggttgtccaaattagaggaagatttacccgattgactataagaatatacatcgtttagcattgttttagcgtcactacttatattatcgtttgcgagtaacgattgaatgaggcgctctaattgctcgcattctgaaactgtcccgcagcaatcactttggtggttgactaaaatatctttcagcacttctaattgatgttgttgattaattggcatgaacggatcatcctttcgattgtttttctcttcaaatgtaagagaaaaagctgtttcgtcatggaatgtttaatgctgtatgtagtttttatcaaaatggtacatcttatacttgaaagaaacggaccgagtgctcgtacgtacttggttttttgtttggtagattgattaaaaaagaaagaaggaattattcctttaaaatagctatgtaaagagagggaaacatctatgcgtttaagacataaaccgtatgcaatggatcgaattaatgaatattcacatatcgtaatcggaaacccagaggagcgcgctggtagctggaaagaagtatttggaaacgaacaaccaattcacattgaagtaggtacaggtcgtggccgcttcatgtatgatatggcaaaagcgaatccacatattaattatattggaattgaaaaattcacaagtgttgttgtagatgcacttgataaattaattgaagaagaattaccaaacttaaagttaattaataaagatgctgaagatttaacagttttctttgcgaaaggtgaaattgatcgcgtttatttaaacttctcagatccatggccaaagaaacgtcatacgaagcgtcgtttaacgtataaaacatttttacgtaattacgaagaagtgttagtagaaggcggagaaattcatttcaaaacagataaccaaggtctatttgaatattctcttatgagtatggctgagtatggtatgttactaacgtacttaagcttagatcttcataacagcgactttgaaggtaacatcatgactgaatacgaagagaaattctctagtaaaggtcatcgtatttaccgagttgaagcaaaatatcgtacagagcctatgcagtaatgcataggtttttttacatctaaaataatcagaattttatgttaagattaattgaaagggggatgtgtaatggaacagttacaaattggagatataaaagtaacgtggttaaaaggcgggaatacacatttagacgggggagcgatgtttggtgttgtgccgaaagtactttggtcacgtaagtataaacataatgatacaaatcatatttatttacgaacagatccgttacttttgcaaacgaaagacggaaatatgctcattgattccggaataggaaacggtaaattgaatgagaagatgaagcggaatcaaggtgtaacagaagaatcatcggtttatgaatcattagaaaaactaggattaaagccagaagatattcactatgttttaatgacgcaccttcattttgatcatgcatctggtttaacaaaatgggaaggtgatcaccttgtaccagcgtttccgaacgcgaaagtttacgtaagtgaaacagagtggaatgaaatgaggaacccaaatattagatcccgtaatacatattggaaggaaaattgggagccgattgtagatcaagttgttacgttccagcaagaaatagaaattacagatgaaataaaaatggtgcatacaggtggtcatagtgatggacatgcagttattgctttagaaagccatggggaaacgatgcttcatttagcagacctattaccgacgcacgcacatcaaaatgtattatgggtaatggcatacgacgattatccgatgacctcgattgaaaataaacaaaagtggatgaagtatggtgctgaaaaagaggcatggtttacgttttaccatgacgcatattatcgcgctgtgaagtggaatgaggaagggcatatcgtagaaaaagtagaacggaaaacgagtatagaagcataaaaataggaggttgttccatcatatttattggagcagcctcttttttattgtcgggttttgtcggtaagtcgatatatttaaacaaacgctgatataaattgagttgcgccgatataattgggaaatcgctgatataaattgagttgcgccgatatattcggaaaatcgctgatataattttaatcaatacccgcaatttcaaaaaaataagaggttcacctaatgggaaccctcctttttatgctgctataacctctaaaacagtacctgttttagcatcaactaaaaattcaaatcgttcttgtatatcatttaacattgttgtaagaccgccgcgataaacttcatatgcgacatcatatttttcaaatgtctctggaaccatatgtacccaagagccagtaatttcacctttatgacttaatgcttgtttcaccattttcaatgctttttctgaagaaatatgggattgttcttgtactttgtttgcaacgagataaccagctgcgaacccaacgccaagacctgctactaaacctttccagctcatatattcacctcaattctataaaataaaaatagtgtaccgataataattataaagcaaatacagctaaaaaagaagaaactagaaacatttcgaaaatttcgttacaataaaagaggtattctactaaggtttgaaagaaggggacttcgtgaataaagagacattacaattatttcgtacgttaacagaattacaaggtgcatcaggttttgaacatgatgtacgccgttttatgaaacaagaattaagcaaatatgcggatgaaattgtacaagacggtttaggtagcgtatttggtctgaaaaaaggggacgaaactggtccgcgtgttcttgtagcaggtcatatggatgaagtaggtttcatgattacgcaaattacgaaaaacggaatgcttcgttttcaaacgttaggcggatggtggagtcaagttttattagcacagcgtgtacaagttatgacgaagaatggtcctgttattggggttgttggttctattcctcctcatttattaagtgacgcgcaacgtgcaaaaccgatggatataaaaaatatgttaattgatataggtgcagatagttatgaagacgcgattgaaattggtgtaaaaccaggacaacaaatcgtgccgatttgcccattcacgccgatggcaaacgaaaagaaaattatggcgaaagcttgggacaaccgttacggatgtggtcttgcaatcgaattgttaaaagaattaaaagatgaaacattaccaaatacattatattctggtgctactgtacaagaagaagtaggcctccgcggagcgcaaacagctgcaaatatgattcaaccagacattttctatgcgcttgatgcaagtccagcaaacgatgcatctggtgacaaaacacagttcggtcaattaggaaaaggtgctcttcttcgtatctacgatcgcacgatggtaacacatagaggaatacgcgaatttattttagatacagcagaaacaaacaacattccgtaccaatactttatttcacaaggtggtacagatgcgggccgtgtacatacaagtaactctggtatcccatcagcagtaattggtgtttgtgcacgctacgttcatacacatgcttcaattttacatgttgatgattatgcagcggcgaaagaattaattacgaagcttgtaagaacaacagataaaacgacgttagagacaattaagaataacgcgtagagaagaagggcgaaaaacccttctttttttaggttgaatagatgacccagcgatgagtggtggcggttagtgcctaatgggtgctcgaatgatgtattaagaccgcgggtaggaagaaagaagaagcctgtttttgtgtttaggaccagtaatattttagaaagcgaccttcttttatggggagaaggaattccctgatggtgtgtggtagtggttggtacttaatttgtgccgaagcggatattagaatagaatgatgaatttttatagaggtgaacgaaatgaaagtagtagttggatcgaagaataaaacgaaggttggcgctgtggagaaggtttggaaagatgctgaaattacatctctttctgttccgtcaggagtatcagctcagcctttctcagatgaagagacgatgcaaggagcgatcaatagagcgaagcgagcgctagaggacggagaagctccaattgggattgggctagaaggcggcgtaatgaaaacggagcacggtttatttatgtgtaactggggcgcgctagcaacaagtgatgggaaagtatttgtggccggaggagcgcgtattacgttaccagacgattttttagcacctcttgaagatggtaaggaattaagcgaagtgatggaagagtttgtgcagcgaaaagatattcgtagtcacgaaggtgcgatcggtatttttacagatgattatgtcgaccgtacggaattatttgtacacgttgttaagttgttagttgggcaatataagtatgacaaaaagcaagcataaaccttgcaccgtgcgcgatgtatggtagtataaaagaaagattataacatgaaaaatgtacccgttagaggaggaaatatagatgaagtcattagaaagcatggagcaattccaacagttaaaaaatgaagagaatgtagtctttatgttctcagcagaatggtgcccagactgccgctttgtagacccatttatgccagaagtagaagagaaatatagtgatttctcattttactatgtagatcgcgatgagtttattgatctatgcgtaaaattagacgtatttggcattccgagctttgtagcgtacaataaaggtgaagaaaaaggtcgctatgtaaacaaagatcgtaaaacaca

SEQ ID NO: 1328 - DNA, 16729 bp, Bacillus thuringiensis
ttagtagatgaacattttgaagaaacgcaaaagttgaaaagtgatatgagtgtgttagaaactgaaaaaaaatctcttgaagagcaaatgaaggcgaagaataagcaagggtaaaacaaaaacgctatcttttaaaaaggtagcgtttttgttttgggttataaagttattcctacatttgacatatacagtctgactgtataaaattaaactatacagtttaactatatagtttagctatatagttatcgttacattggaggtctttatgaatagagataaaaatttaccattaacggaaacaacgtattacgttcttttagctttattagagccagctcatggatatttaattatgcaaaaggtggaggaactgagtaatcatcaagtgaaaatcgcagcgggtacattgtatggtgcggtggaaaatttattaaaacaagggttaatagaatcggtaaaaagtgaagataaaagaagaaaagtgtatgtcattacggaacgcgggaaagaagtattgcatttagattttatgagaatgcagcacattattgcggttacaaaaagtttattacacgtatagttaggaggaatcgatgatgtggagattaaaattctttttagactttgagatagaggaaaaatggttagaagagatggcttggaaaggctatcaactagaaagcaatacatttggttatacatttagatatacagaaccggaagatgcgacgattaaaatagaccatagagtatttagtagaaaaagtgattttattaattactgcacattatttgaagatagtggttgggagcatatagctggtaatcggtggtcaggtacgcaatattttaaaaaggtagatgaagaaagtgaagatgacattttttcagatccaatgtcacgagcagggaagtataagcgtctatctaaaacatttttagaattagcgatctgttatttgccgatattatttttatttatgtatagtaatacaatgaatttaggagcctttgtaaatccgaaagaactatacttgacgccaggattatgggataagcaaggtgtatcatttctatggtcattcttatttgaaacgccatttgcattaatgagaggactttttttgacatttatccccgttgcgacatgtatgtttttcgtttgctcgtataaagcaaatcgattgtatgaagagagaagatgataggagaaatccccttaaagtagatgctttgagggtttttttgaatttgtaaatgactcttcttaaaatagatatgagcttagagaaggacaatgatgtattggaggtcaccatatcaaaaaaagaaaattgtacgtttagacgcattttaaatacaaaataaccgattccttatacgttaagaaaccggttatttattcccccacttttttagagggctttttcttataatggtcttaaatgattgatttaaggttataaacttaaatcataaataaaatatagagtaaaaactatatacgaaataaatgtaacgaaaacaaggaaacatataaactgagaattagatacatattgttctattctttttttcatgttaattcgtattatttttcaaatgtgaagtatcaattggaatttgagctttccaagaaccaattacttttccaattctagttatatttacgtctaaagtaagaggctgtttaaaaacgtctttttcttcagtagttataacaaatgtagcaacaccttcaggtctatcattatcacgaatgcctattttatctaactttttacctgctgccataagttcaaaaggaagataatcatctgaatcatggataaatgatagtctcccgtcatttttaatctcagggttttcctcttgttgcccatcaattttaccatcactctcaagatttaatcctgatgtatcaaattcaaatggtactaaacttccgtccgctttttccattctataatgaactgatatacgtgaatctgcgataaatacttctttgagatgtacagtaataccttgatctgtaattttttcatcaataggaatatatttaccattcttcatcatatcttgtgtgataccattttcatcttttattccttcatttacaactttatcatttgtaattgcattagaaaaataggaagcaacatttgtagccgccacttgtacttgtggaatcattgctgttgtgaaaagtgctgctgcagctactgctgtataaataaaacgttttgattttttactcatgtttgtaaagagtcccttcttttgttgttttttgtgatttatattagaaacattgtctaacttggaacgactttcaaatgttttccatgcttgttctatatcaattttgatttcttgtggtgaatttgcagattcttcatctagcattacgttttcccattgatttaatttactaatttctattaataaatcttggcatgcttcacatgtatctaggtgttgtgtgaattcctttcttatatcatgagaaagttctccatcaatatatgtttgaataaacccgatatcataacatttcatgtgttatgcctcctccatttgtttataaatcttgcgaaatttcattttggctcggaccaataatgttccaatagaagatatttcaatttgaagtacttttgcaatttctttatattgaaaaccagagaatttcattagtaaaagggttcgttctcgatcattcattttatttagtatcgtttggacctttgtaatttcttcttttcttatccaatcatcgtctaatgatgaaacattttgtacttcatggtattgtatttctttatcaatcttcgcttgctgccttttttcagatcgaaaatggttataggctacataagtagaagatttaatcaaccatccaggtatgttttcaatctctttccaatcactacgatataattgtaaaaatacttcttgtgctaactcttcagcgatagattgatctttaacaatccagatgatttgtttcacagcgtaagcatagtactgcttaaataaatcttcaaggtcatatcagaagcatgactttcttcattttctatggttaacatgttcgtttaaacctcactttcaatttgatacctgtattatagagaaaccagaaaaacggattttgtgacagtttttctggatattttttattatgtactaaaaaaagcattcgtctaattaaaagagaaatgcaaaaaggaaatgaaaacataaaaactataactcttgcagtagttgtctattaatgcacaagaaaacagttagtttgttgccaaactgtatctaaacgtacaatttcacttcttctattttcatgaatatgtataattacataaaatttcaaagaaaaagagagtatactttcatattgtgtaataaagataaagcccgcctacggaaataggcgggctttttttacttataaagaaaagacaacctttaaggtgtcttccttttgaaatctaggttgtccagtttgttttactttggtgcaatagcaatattgtttggaataaagtttcaccatattgctattaaactaaaatattaagattgcacttaaacgaaatttatagcatcgaagttcattttggagggggaatgtaatactacatttttaaagtattcgttacacttgaacctctgcacattgcgtagagcttttttcatgaagaaaggacactcacgtgagtgtcctttcgatagtttttagcagaagcaagcagctccaacgatgattaataaaataaacaatacaactaatagagcaaatcctccagcgaagccacagccgccacaactaccaccaaagcccataacagttcctcctttaaataggaggagaaaaacaaaggttcactcatgtgttttaacggattccatttactttatgctttttacgaataaatggagcaggtccttttcaaaatagatttattcttagcaggagttcaaaggaaaaacaggagaatccatattattctttaagagcgaatagatagaaatccgcttttatacctttcattaaaataatactagcattatatattataaggaatacttgtccttaattgtaaatgaaaggggggaattgatatgagctatggctatggtcatcctcctggaagatgtcataaacatcacaatgaaactttgtcaacgggtgtattacgtagacattccgctacgttatttcttactgttgaagctatgaatgttgatccagatgatactcgtagagtaacagttgaaatgtttgattggtcatctggttctccggtattgttaccattaatagacccttcaacacaaacattgccacctaatcgatatgttacttttcgttcagcagctcttcctccagcactttttgcttatgaagtaagaatcattcgtccgaaagatagagatgttgttacgaatgtttttggtcttagtgcaatcgtatttaacccacaagaaggaaacaatgttttacaacatgatttagaaaaattagaccttaaatagattttataaaggtctatttattgagcatgattaaaaaaagagtaggatgtaatcctactttttttaacgttaattagaattttaaaagaaatccttcattattttagcatctttaatattcactatcacaccttctaccttatctttcttctcatctttagcaatcgtaatttgctccttattatcagcccacacaagaaattcttcttttgagtcatctttatatgtaacagtaatagtagaatgtgcagattctctctttttttgatctagtgtgatttgtttaggagtgcctttttggactgctgaaacgatagattgtatcattttttcgttgtctgtttgagatttggaagtagtatgatttgttgttttcagtatttcaatgtctgtaatattagcagaatttaattgaaaggtattttgtttatgttcttgcttaacttgtgaagctttatctgtagccgaggtacttgtacaacctattaaagtgaaagataaagcggttagagcgcatatagatatgatttttttcatagtatccctcctcaagcttaattataacaattttctgttaatttaggtggttattgtaaggagaagatgttttaaagtggtaaatgatgatgttcattctctattaaaattaaaattcacataacttttttcatattttatgtttaacatttcgaaaatgggtgtactacatataatataacaaataattcattttaaaggaggaagttaaagatggaaacgaagtatagtaaaccttttgtatatgaatttattacggagaaagaggtcatgaatgcggcgaatgatctcgtgaaaaaaggaatagaccaaaaagatatttacgtattaacgcatgagaaagataggacagatagaattgcggacaatgcagacgtgaatacaattgggataaaagaggagggacttgggacaagcattattaacgtctttcaaaaaacaggagatcagttaagaaataaaatgcaagagttagggcttaatgaggaagaagcgaacttttatgaagaaaaactggatgaagggaaaatcttgttattcgttaaggatttagaaagagtcggtgaatggttacaagaaagaagatgcatgtattctatttaaatttgtatcctttaaatctataaatctattacgaaaaggagattgtaaatatgagtgagaacggactaaaagaacaagttaaaggtaaagttgaaaagaaaaaaggacaagtaaaagaaggaattggtgaagttacagaagatagagagttgaaaaatgaaggtaagtgggaaaaaacgaagggaacgataaaagaaaaagtcggaaaagtgaaacaaaagataagtgatgaattggataataaagaataatatatgttcatcaagctttagttacatactaaagcttgatgaattcaatataaaacgaatataggaggtttaattgtgggacttattattacgtgtattgtaggtggacttattggtgcgttagctggaatgattacaggaaaagactttccgttaggtatagttggtaacgtgattgccggattaatcggatcttgggtaggtagtgcgttatttggtcattggggtcctgaatggggaggcatttttgttcttccagcgttattaggtgcaatcgtctttattttaatcgttacattcttctctagaatgctgcggaaagcgtaagtatgataataaatagtaatcttaagtttattatatatagttataaagttaatgaactgataaaaatacataaaaaagcatccaattaaactaatttggatgcttttttatgtattttacataggaatgagtggaggatgaagaaccccccactcattaacattacactttctattatgtattaagccatcgttacctttttacaattatttattcttacgacttgccttggttctatatgagataagtcctcgctattacttatatcaactacaattgtattcgttagtatgttaataatggaaccaactaattttgtagcatgatcgtgtcgataagaaaattgaacgaaatctccctttttaaagttgtgctcttccatagatagatccccctaaaaataatgtttatacattatacatacacaaaattataagttttaaacatttattagtacgatttaagtgttaagccgagaaaggtgtagaaaatttatttataatgaaaataaaaaaatatgtttaaaactaatttttatgggtaattaaatagtaaaagttcgagataagggggcggaaatgatgaatttggcaataaatattttgcaaaatgatgtaggttatacggtacaacttaatggtgagattgatgcgtatacggcatcagatttaaaaaataaggtaatgcctattacaagcgaaaaagaggttcatattgtagtagattttcataacgtagattatatggatagtacaggcttaggagtttttatagctttattaaaagcagttaagaaaaatgatgggaagctagagtttactggtgtgtctaaaaggctaaaaagattatttgatattacagggctaacagaaatattaaatttgaattccgattttgaaaaagtagaaagaaggtgactagggatgatggagagatttgaaaagatagaaatgaaaattcctgcaaaagcagaatatgtggctattattcgtttaacaatggctggtgttgcgaatcgaatgggctttgcttatgacgatatagaagatatgaaaattgctattagtgaagcttgtacaaacattgtacaacatgcatacaaagaagacgttggagaaattacaattgtcttcgggctatatgaagatcgattagaaattatggctgcggataatggggttagctttgattttaatagcttaaaaaggaaagttggtccgtatgatattagtaaaccagtagaacatttgccggaaaatggtttaggtttatatttaatcaatacgttaatggatgatatacaaattatgcatgatgagggcatgacagttttaatgacaaaatatatacaaagagagcaggtggagaatgatggaaatccaatctcaacctacaaatcttactaaagaagacgttattaaactaattgcagacttccaacaaaaccaatgtgatgaagcacaggaaagattggttaatcactataaaaatcttgtatactccattgcatatcgctattcaaaaggcgggcctatgcatgaggatattatacaagtagggatgttagggctcttaggcgcaataagaaggtatgattattcgatagggaatgcttttgagccgtttgcaatacctacaatagtaggcgaaataaagaaatatttacgtgataaaacttggggtattcacgttccaaggcgaattaaagatttaggcgggaagattaaacttgctatagaggagctaacagatcgtttccagcgttcaccgaagattaaagagattgcagatcatttaggactatccgaagaggaagtgctagaaattatggatgcgaaaaataattatcgcgtatcttccttagatgatgtagttgaaaattcatctgatggcagttcggtagcgaggattgaatctgtaggtgaagtagagcaaggatatgaagaggcagaaaggcgtctcgttttaaaggatattttcaacgtattaaatgacacagaaaagagtgttattcattatatatttggagaaaatttaaatcaaaaagatacaggggaacggttaggtatttcacaaatgcacgtttctcgtattaaaagacaagcgataagtaaattgaagcaagcagcatttttagatacataaaaatttaaaatcattatgtttaaaacatgagaaaaggggtacttattaaatataggaggagatataaaaatgtcacacgatgtgaaagaactaatcgaaggattgaatgaagatttagcaggagaatactcagcaattattatgtataaccataatgcagctacagtttctggtatatatagacaagtgttaaaacctttctttgaatctgaaattagtgatgaacaaggacatgccctatatttagcggagaaaattaagacgttaggtggtacacctactacaatccctttacgagtgaaacaagcagaagatgttagagaaatgttagaatacgctagacaatcagaatatgagacaattaagcgttatgaaacgagaaaagaacaggcagcgaaattaaatatgacagagttagttgtaaagttagaagatatgattgcagatgaaacaaatcatatggaagaattagatcgtcttttaaatgacaaagcaatggtattaaattaatagtggaaatttatagaatgaaagaacaaactctcatttctgggggtttgttcttttgctgtataaaaattatgttagagtaggaaattttcattttgtaactgagtatgcaatactagaaaatgataatagatttacattttaaataagaaaaggggaaataacttgtgtccattttaattgtcgatgataatccggttaacatctttgtaattgaaaaaattttaaagcaagccggatatcaggatcttgtatcgctgaattctgcacaagagcttttcgaatacattcaatttggagaagattcttccaggtataatgaaattgatttaatactgttagatattatgatgcctgaaattgatggacttgaagtttgtaggcgattacaaaaagaggagaagtttaaagatattcctattatttttgttacagctttagaggatgccaataagttggccgaagctcttgatatgggggcaatggattatattacgaaacctataaataaagttgaactattagcacgtatgcgtgtagcgttacgcttgaaatcggaattaaattggcataaagaacaagaagaaaatcttcggaatgaactagatttagctacgcaagtacaaagaaacttattaagtagcccattaagagaagattatataaaaattgaagcaagttacttaccttcatttaaattagctggagatatgtattattggtataaaatcgatgaaaaccgctacggtattatattattagacgtgatgggacatggtatatctgcttcattagtttgtatgtttatttcgtctgtattacgtgaaacgattaaatctttaatcgatccagaacttgtcattaaagatttaaataaatatatgactcttttacataatgagaatgacgatattccatattattttacagcgatatatttagtagtagatacagaaaagagaacgattgaatatgtaaatgcagggcatccttctggatacgttttagtcgatgaaacaaatatgtttgaactaaatcacgggagttgtgcggtaggattttttgatgaaataaaagttaaaaagacagttataccttttgagaagaacgctcaaatcgtattgtttacagatggtgttcttgaagcaattgcaaatgatgaatttgaggctgaagagaaattacgtacttttacagaaagaaaatggggagatttagaaggcgagatagaagggttttacaaggaagaacaaaagaaagcgcaatcagatgatatgtgtctaattatgatacaaacgaatgcgaaataaaaagcgtatgaaatccaaacagaggatttcatacgctttttattgtattttttgataaatttgttcgctaggattaaattgggtataatgcggcattatatttgaaaaacgaagagtttctttatttcctaaacatagaaaaccattgtgacctaagctttcataaaatagttgctgcacttgattttgaagtttacttgtaaagtaaattaaaacgttacgacaaagtataatatgaaactcgttaaaagattgatcggttactaaattatgctgtgcaaaaataatgttttgtaaaagtgatggattaaaataagcaaaacgattatctgttgaataatagttagaaaatgcttgtgtaccgccagcttgtaaataatttttcgtataagtttgcattttatttaacgggaggatagcttgttttgctttttctaacacatttgtattcatatctgttgcgtaaataaccgacttttcacttaatccttcttcgtgaagtaagatggacattgataatacttcttcaccagttgcgcatccagcatgccaaattctaatttcaggttgcttttttaattcaggaataacatgctctctaagcgctttaaaaaaggcagggttacggaacatctcagttacattaatcgagaaatcatttaataactgttctaaaaccccttcctcgtgaattactttttcaattaattttgaaatggtagggatattagagagctgcattctattacaaattcttctataaatagatgtgcgagcatattggcgaaaatcaaatcctgatagtttaaataccgcttccaatagtaattcaatttctaagttcgtgcgctcatccgtatctactgatggatcaaaattataatacttattttccactccaactaaacctcacttattttattaaccatacactcattaccgaatagagttgatgtagatttaatggtttacttatataatctgaagcgccagcagataaacatttttccttatcatttggcattgctttagcagttaatgcgataataggtatttcatttaaccctaagttcattcggatattttccatcgtttcataaccgtccatattaggcatcataatatccattaaaataaggtcaatatttgtattactttttagtatttctaaacactctaagccgttttgggcagtaataatgttggcattttgtttttttaatgcgttttgtaacgcaaatatatttcgatgatcatcatcgacaattaaaatggttttctcttggaagacgttatttgtttcgggagtaacgatagtttcttcaacaacttcagcaggaataacatcttctatcgttgctgcgacttctaaattggataactgtatatctggtaatccatttggaaggttaggaatatataccgtgaaagtactaccttctcctacattactctctaacgtaatccaaccacctaacaatctagcaaactctttacaaatagataaacctaatcctgtaccaccatacttccgaatcgttgcgccatctgcctgttgaaaggcttcgaaaataagttgatgctgttctttagcgataccaataccagtatcttttactgaaattgtaatccaatctttacttatagactgcatatcatgacttaaattacttgtttctatcgaatcgaaatgtaaagaaacggatcctttttctgtaaatttaaatgcattggataataagtttttaataatttgctcaatccgttttgcatctgtataaaacagatcaggaatcgtatcactgtcttcaatagtaaattcgacatttttttgtgcagctatatgtaaaaagttttgatgcatattggctgccatgtcacttatgttcgttgcttcaaaaatgatgtctagtttgcctgcttctactttagataaatcgagtatgtcattaattaaagtaagtaagtctttccctgatgaatgaatgacagttgctaattcaatctcatcgtcggataaattgttattatgattttctcttaacatttcagataatagtaaaatactatttaacggtgtgcgtaattcatgtgacatatttgctaggaactcagatttgtattttgagctgcgtaacaactcgcttgctttttcttctaattctgatttagtaatttgtaagtcagctgttttctgctcagcctcttcagttctagactctaattgttcattcgttgttcgtaattcttctgcttgcatttgtagttcttccgcttgcgtttgcaattcttctgattgaacttgtaactcttctgtcattgcttgtgattcatgtaaaagagtttgaattcgcatacgtcccataatgctatggattgttaaacctagattatcaacggtttgttgaattaaatcttgatgtaaatctgaaatctcagttacacttactaactccattactgcgatcactttatcctcaaataagatagggatgattaatagatttttaggacgtatttctaatactccgctagtgacataacgaaactcttcgggtatatccctgagaataaaacttttcttttctaaggcagactgtccaataaaaccttcacccatttgaatggattgtttcccaatatcagcaccttgatcggcgaaagaagctttcttcacatagtagacagtgtcttcaatttcttcacgtacataaaatgctccgcaagaagtttgcgttttttgtataattccactaagaatttttttacctaacatctcaatagaagatacaccttgatacattaaaattaattctgcaagctcagtttgtaaccattctcttttcgatatttcgtctagtaagtgattcgttgtatgagcaagatcttttatttcatcacgtgtgtttacatgaattctttccgtgattttttctttagaagaaatggatttaatagcttgaattacatttttaatcgtttttgtaatggaattcgaaatatagagtgaaatgataatagaaatacaagaaagtaagaacaataaactgtataaccaaatttctaatttattattttcagtatctaattgtgctgctctttttttcgttaattgctcctcagtgctacggaagttagttacctgtgactgtaatgactgaatttgagtcgtgtcgattgtttgtacattattactattatgatttgcaattaacgggtgaatctctttatttatccaactaataatattttcgttaatctgttttaatttttcttgctgagatgggttatcctctaataatgagaaaagatcttgataatgcttttcgtaatccttttccgcagaattaagagattgtacgtaatttggattattagaaatgataaaccctttcgctttattttcaattgttagtaaatctttctccacttgatttgttaaattgagaactttaaaatcgtgatcaataataaaattacgagatttttgtaaattagaaatctcattgttcaacataatgaaagaaacaagtaagaacaaaatgataactaaataaccagccataattttgtagcgaatactaaattttgctttcgagttcattaaaaattcctaccttcaaggttattaaaacttttctattttaaagaatgaaaaacgtaatatatattatatcagttttcataaggctaaactagaaatccccctattgtattagggggttcttttttaataggggaaatcattttgaaatataaaaacatatatgaaaggtagtaaacgagggaatagaggataacaaatattctaagaagggaagagtgttcttaaagctctttttgcatctattccttcaaaaataaataatacaagatctctcttttttacagtaaggaaaaaggatactagagtgcttaagtttttaatagaagtaagtgctccgtgtttacctataaatacattcgtttgaaatgttgtcattaaagcataaaaatgatgaatctgcgttattgtaggtatttcattataagaaatagtagtagagtgaatggcgttcatcgtaatattcctttccatatagtaagcataacaatataaacatacccgttttaaaaaatgttaaacacataaataagaaaaaatataattatagtttttacgtttagaaaaggttaggaagggtatacatatactacaaagagattgactgaagatgaattgtaagatgtctatgtttagtagattagtctatcaaaatatacttttactttaaataaaaaggagcctggtatacatgaatgaaatgatgattaatattacatttgatttaatttacttgttaagtagttcacttgtagtgcttttactattcgcttttttcataaatggttatgttaataagaaaattagtgtatacagaaatgaagaaaaataaaaatacattatataaaactttaggaggttaatagttatgaatgtagatagaaaaatagtaggtgtttttagaacaattgatgatgcagcactcgttattaatgaattaaatgataaaggatattcagcagataacatttcagctattgcgaaagatcaaaaggaaattgaacatctagaagaaaaatcgggtgaaaaagtgaatagcgaaactgcacataaagcagatatcttttcagcgacagggcttgtagctggaggagtagcaggcgggctcggtggtttattaacaggtcttggtatacttgccgtatctggaatgggtccaattgtagcagcaggaccaatcgcagcagctattggaggagccggtattggcggaggagctggaagtttaataggagcatttatcggcttaggaatccctgaagaccatgctaaaaagtatgaagaatatatttacgatggaaatatattaattttagtagatgcaaaattagatgataagttagaaatctataaaatatttgataagcataatgcctataactctgatttctttaaataaaatgtaaacaaagtgaatatcgtttttgatcttacaactttggcgcggccgaggagtcgtatgactataagagaggaagggcttatagtaaaagatcaagtcctattatgatattgagaagggaagaggtgtctattcgtgattgtaaaaatattaaaggatagtagtaatagtttcctttgcacagttcaaaataaaaatggagatcagtatgtgaaaaaatggtttagtaaacatgaaaataataaagaattagggcgaccaacttttaaagaagtagaaaaggattggaaagaaaatagagactcgtttatgtatccaaatattaaagcgctttattaaaatgaaacataaagcgcattttattattacaaaattgtcacactcctgtaaggtaattcaatagattagttactttttccatgtcataataaagacataagaaagctaattaaaactacaacttattaggagagtgtcagtcatgattgtaacaacaacttctggaattcaaggtaaagaaattattgagtatattgatattgtaaatggtgaagcgattatgggtgcaaacattgtccgagatttattcgcttccgttcgtgatgttgtcggtggtcgtgctggtgcttacgaaagtaaattaaaagacgcacgtgatattgcaatggatgaaatgaaagaacttgcacgacaaaaaggtgcgaacgctatcgttggtattgacgtagattatgaagttgttcgtgatggaatgttaatggttgctgtaagtggtacagctgtacgtatataagtaaataaaaaacaggctcaccccttgaagtttatgctttgagggttttttttgtttttaagttgtagaagtaaactccagttgcaagggtaaaatgaaaaagagacagtgatgctacatatatgtagtgtgagtgcaaactttataataaataataaagttgttatttgagataatggaagaattagtggtataaataactttatagataataatcacaatagagaagacagaatgttcatggatggaatggttaaggggattttccaatctgtaataaaaaacggaggtaccgagaacgttttacagatgtctactacataaaatttataatggattgggggcaatttttatgttttggttaggatgttttttaggatacattgtaggttctgttattacatgtgcgctactttactttggatatagatccaatgaaaataaaaaagcggatatgcaaaaaggggaggagagaaaaatcaataaaagaggtgtatagtaggcgaaaggtaaggtgataacattgatgcaaaaataaaggacagttacatatttcatatgattactatgtactgtcccgcttattccttttggattaggaaaaattgtttcctgtcttgctataaaattcataggcaaaaaaaccaaataaatagcctattccggatcctaaactaattgaaagtagtaaagaatcaggag

SEQ ID NO: 1329 - DNA, 16484 bp, Bacillus thuringiensis
cccattgagccaccgggtctgctacgggattcgttttcctgcttaccgcttcagtactaaaactggcatcacttgacgcacctttcgtacttctaataaacccagaatatcttctttcttcattaataatctattgtttaatgatttcgttaatgaagaagaatcgaagttcttcacatatgtaccttctccttgtttcatctcaattaagcccatcgctcttagcgcacttagcgcttcacgaacagcagatctgccaacttgaaactgctcagctaattgatgcacagggagtagtttgtcaccaggttttaacgttaccactttttaattcattggttataaatagctttcaggatactttcttccgtaatattttttttcggtttaatagatttgtactccagttaaatcacctcagtatcttccaaacaacaattgaaacgatttataagaactttgcatcataactattttagaccgaattgataagaagtacaaatgttttgttcataaaatagtcaaattttcgatatttattacatattaatttatatttttacgtataaagtgaaactttaatcagtgagggttttgttcatcccccactgattattagccctcaccaatcgggcttttacgggcagcagtgcctccacctaacttctttgcttccgctgaattttgaggtgagggtcttactgaccggagaatagcgggataaatattttcttcaatataaagaacatgccctaaaaattagaacatgccccctcatcctgtacattcagtttaataataaccgttgttcccttatctttttcactttcaattttccactgtccaccatgtatatgaacaatttgtttcacaatagcaaggcctaaacctgttccaccatgttgacgacttctcgctttatcaactcggtaaaagcgttccccaagattctccaaatgctctatatcaatgccaattcctgtatcttttatttttaattcacagtaatcatcgatttgctctaaagttataacgatatttcctttttgatttgtataccgtatcgcattatctaacacattatgaagcacttgttgcatacgatcctcatcaatcatgacaatgacctctggatttaaattggttgaaatatgaatttccttttctataaacttaatctcatacgtatctaatacgtcttcaatcagctgtgaaaaaacgataggttgcttctttaacggaaagtgctcaccttctaattgtgctaagtctaacaagtcatgaacgagacgctgcatacgacctgcttctttatgaattagctgagttactttttcctgctgagctccctttgcaacaccatctaaaatagcctcgctatacccttttatataactaagtggtgttctaagttcatgcgaaacatttgctaaaaattccttacgctttacatcttctgtttctaatgaatttgccattttattaaatgcttttcctaatcgtccaatttcatcctctgaagaaactgtaatccgctccgaaaaatctcccgtagccaaatgatttgcaacccgctccatttgcgaaagtggcttcgtaattgcaattataatttttcttccaacccatatcgtaattaaaatcatagcaattgctagcggtgctaaaataagacccatatcatagattaaatcttttatactttttaaaggaatatacgaatagacaattccgactaattttttattttccaatacaggaatgacaacccccataatattacgttcaaaatgttcttcatatcctatttttgtcacagttttcccatctaatagcgtttgcctatctccttcacttataagagaatgatgatgcacatcaaaaggcaaacatgcgcttaaatcacgcggattagatacgaaaataacgtctgaactagatatttgatcaaacgatcttactttctcttcaaaagttgatattccttcacgcttatcatattgagcagcaagacttttcccttccattactaacgaagtttttaaattatcaacgtataacttttcatacgagtataaagatacgaaataaagaaaggacactgttacacatactgcacatactactgtaagccaaagtttttgtaccatcgtaaacatatgttacacctcaaatttatagcctacaccccaaacagtttgaatgtagtttccactttctccaagcttcaagcgcatcgttttcacgtgcgtatctactgttcttgtacttccggcataatcatatccccataccttttcaagtaattgctcccggctaaatacttgtcctgtatgctgacaaagaaaatatagtaaatcaaactcttttacagtaagagaaatcgactcaccattcgcctcaattcgtctgcttttttcattgataagaattggtccaaattgaatctcttcttgctgttcttgctttgtatatcttcttagtacagcttccatacgggcaaccaattcaccaggactaaacggttttacaatataatcatctgctcccatacgtaagccattcaccctattccactcttcaccttttgcggttaaaaatataatcggcacatctgacgtttttctaatttctttacaaactgaaagtccatccatttctggcatcattatatctaatacaacgaaatcataatgatccgtttctagttttttaagagcctcttttccgttttcagcttctccccactcatatccaaagttatccaaatacattccaacaagctgcctcatatcactttcatcatctacaactagcactctatatttattcattgtccttcccttccctctctatgagttgaaacggtccttttccgactttaattgtttgttttattttcatactcttcatatccatgacgcacacttcatcactatcataacttgctacatatccttctgctccgcttttcaaaaatgcaaatggatttgagcctatttcaacggaagctacctctttatacgtactaatatcaaattttctaagcatattcgaaccgtggcttaatgcatatacgtacttattatctttcgttatgttcacaggcataaatggagcgtgtaaagaacgtaccatttcaccgctctgtaaagaatacactaatactttctcattcacttgatttccatcaccatgcccgccaatccatatttctttcccatcaggactaatcgtcgctcctgttgatgctggcggaatcataaaggattgaacaacttcttttttcttcgtatcaattgtcgttagtttcgtatcataaaagtttagtacagataaccgattctgatactctaccatcgttataggcccttttcctgttgaaacatttcctgtctctttcccatttatcgtaaagaaccttaccttttgaacattttgatcagcagcaaataattgttttttatctgctgatacgaccacatttacaatgccctttccagttttatatttttccacttgccttccttccgctagtgaatatacatacatatattctaattgcttaccgtatacaagtatttcatcgccatttggaagcagtgtgattccagccattggctcatttagttcccatgtcgtaattaactttttatcttttttatcaataaaactaatactgccttcttttatattcgtagttataataacatttttatctttagcaattggtgtatatgaacttccttgacaccctactaatagaaataaaaaacagagaagaaaaacatactttctcaaaagattccctccaccttcagatgatttcgttataattgtaaaataacaaataaatgtgtggaaagtgtgaaattcccctttcttactcaatttacatatataatgtacaacaaatagaatttgaggtgtgtcaattatgctatttcctgatttagcgaataaaattgtacgagaagtacgcagactaattacagaaaatataattatcattaatatagaaggcgttattatcgcaagtacagatacagaaagaattggccaatttcatgaaggtgcactccgctgcgctaaacaaaagaaaaccgtcatcattacaaaagaagatgaaaggcgattgcaaggtgtaaaggctgggatgaatcttcctctattatttcatgatgaagtaatcggtgtcattgggattaccggagaacctgaaaacatttcacgctacggagaaatattgcgtaagatgaccgaattattaattcatgaaaactactttttagagcaattagaacttgagcaccgttcttatgaagcttttgtctttgattggcttcaaaatacagagtggtccccgagttttcttgatcgtgccaaaacacttggcattgatttatataagaaaaaacaacttgttttgttttctattggcaaaaatgacacaatgctccagcgtaaaatatggcaacatgtacgaaatattttaacaaaagagcatctatttgttcgctggggaaatgatcgttttattttatttacagcgatgagctccaaagaacaaacttatcagtttttaaaacggttaaaacaagactgcgaagctttattttctattcctttatatatcgggattgggcaaacagttaccccaaacaatatgaacatatgttacgaacaagcattacgtgctctttctgtatcattggaaacgaaaaaaattgtatttaatgaagatttacgtttagaaatgtgtttacaagatatttctgccgaaacgcgtgaacaatttctagagcgtaccatcgaaagcttactatcatctcctgagcttatgcacactttacgcttatttatcgattataaccaatcttataaacagacagctaaacaattacatatacacattaacaccttacattataggctaaaaaagattgaagaacatacaggacttgatccaaaacaattcaaagacttaaacgttttatacttcgcactcctcctattagataatcatacaaaaaagaacgataaaacagattaatctttagatgattatacatagaaagaatccctcgacttttttatcattataatgaaagcactgttaccacgttgtttattataactaaacacgttaacagtttgagggggatttccaatgttagaaaaacaaattattcattcattcgtatctattgttggcgaagataatgtagatacatccaatatggggcgtttaacttatagttatgatgccactccaaacttccaagcaatgcctgatgcagtcattgctcctcgtaatacaaatgaagtagctgaagtgttaaaagtatgtaacacttacaaaatccctgtgtatgtgcgcgggtctggaacaaatctttgcgcaggaacatgtccacttgaaggcggtatcgtccttattttccgccatatgaacaatattttagaaattgatgaagaaaacttaacaattactgtacaagctggtgtcattacacttgatattattaaagcggtagaagaaaaaggtttattttatccaccagatccaagctcgatgaaaatttctacaatcggcggtaatattaatgaaaactcaggtggattacgcggtttgaaatatggcgtaacacgtgattatgtaatggggcttgaacttgtcttaccaaatggtgatattattcgcactggtggtaaattagcaaaagatgtagctggttacgatttaactcgtttatttatcggttctgaaggaacactcggcgtcgtaacagaagccatattaaaacttgttcctatgcctgaaacaaagaaaacaatgcttgcattatatgaagatattaatgaagctgcacgtgctgtttcttctattattgcaaataaaatcattccagcaacactggagtttttagaccaaccgacaattgaagtagtagaagagtttgcacaaatcggtttacctacagatgtaaaagcaattttattaatcgaacaagacggtccgcccgaagtagtcaatcgagatattgaaaaaatggctaacgtttgtcactctatgaatgcggttgatgttcgtgttgcaaaagatgaaacagaagcagatgcgcttcgtaccgctcgtcgtagtgccctatcagcgcttgcaagattaaaacctactacaatattagaagatgcaactgtaccacgttcacaaatagctccaatggttgaagctattaataccattgcaaaaaaatataatattcctatttgtacgtttgggcacgctggtgatggtaacttacatccaacttgtatgacagacgttcgtaatgcagaagaaatgcaccgagctgaacaagcttttgctgaaatatttgcgaaagcaattgaacttggtggcacaattactggtgaacatggtgttggtgcgatgaaagctccatatttagaaatgaaattaggtaaggaaggtattgcagctatgcaaggaataaagcaagctttcgatccaaataacattatgaatcctggaaaaatgttcgcgaaagacactcgaaaaagagtggtggttgagcgatgacgacattgaataaagaaaatattcaaaaagaatttaaagaacgattaagtgaagatgaattactaaactgtatgcgatgcggtttttgtttacctacttgtcctacctacattcaatccggatataaagagtcacattcaccgcgcggacgtatcgcattaatgaaagctgtcgttgatggtttaatcgaaccagatgaagatgttgaagatacattaaacgtttgtcttggttgccgtgcttgtgaacctgtttgtccatctggtgtaaattatggccatttattagaagaagctcgtgatattattaatcaaaataaaaaattctcggtgccagtgaaagctgttcgaaaagtcgtttttgaaggattattcccccatcaaaatcgaatgagaacattaactggactaatcggattttatcaacgttctggtttacaaacgctaacacataaaacagggattatgaagttattccctgaaacacttgcaacgatggatctcgttttaccaaaagtccctaaaatgaaagcgatgaaagatcgtccttcatttttacctgcagaaagtacaaagaaaaaacaagttgcattcttcacaggctgcttaatggatacgatgtttttagaaacaaataacgcaacgatgaaacttcttcaactagctggttgtgatatcgttattccaaaaacacaaagttgctgcggtgcattacatggacatgctggtgaaaagagtggagcaaaagaattagcaaagcgaaatataaaagcattcgaagatttaaacatcgactatattattaccaatgcaggtggttgcggggcttatcttgtagactatgattatcttttaaaggatgatccggattgggctgaacgtgctaagcagtttgtttctaagattaaagatattactgctatactagtagaactagacttccataagcgaactgacttacgactcacgccgcaagttattacgtatcaagactcttgtcatttacgcaatgttatgcgcacatcttctgaacctcgtatgttactagaggctatccaaggtgcaacatatcgagaaatgaaagatgccgatcgttgctgtggctctgctggtatttacaatattgttcattcagagttatcaatggaatttctagattacaaaatggaccgtgtgcatgaaacagaagcagcaaccattgttactgcaaatccaggttgtttattacaaatgaaattgggcattgagcgagaagggctttctcataaaatgagaggaattcacattgtggatttattattagaagcaattgaaactaactcgtaataactcgtaacatacgtaataataggaaaacggctatctccttcgtctatgtaaagagatagccgcttttttgtctgctacaacattaaaaatatgttactttattataaaaaagaacaacagaaacattacagttttgtaaaaatcaatccattatattcctcaaaaaatcgttcaaaccattgatacaataggattcttcattttctatttaggtaactttatccaaaaaccccctcttaaaaccaagtataaaaacactataaattccttttatactctatatttctcttatttttgctcccttcttctcttaggataaattaggtaattttaaagtctatgaatttttttccatcttttttctcgcaaattgtatgctacgatgaatttgtcagtcagacaggctgtcaaaaacaaatcgtgtgaaaacaaattaaaactttatatagggggacacacatcatgaaaaagcgtgttttattatctgtagctgctgcaacagctcttactttaggagtatcttctctagatgcacaagctgcaacagtacaaccatctaacgtaaaggttcaaaatattcagcattcaaaagtgatgatgaaacaaatgaaccaacaagaattacaagcattcttacaatctatgggagttgaatcattagcacaatggcaacaaggaaacttccaaccaaactgcttcattcctggtcaacaacctactgaaaatgttgtaactgagcaaccaacagctaagccagaaactcaaaagccagttgaacaaaaaccagccgagcaaaagcctgctgaagaagttcaaaaaccagaagctcaaaaacctgctgaaaacaacaatactcaaaaacctgctgaacaaaaaccagctgagcaaaagcctgctgaagaagcaaaatctttaagtgagttcgaacaacgtgttgttgaattaacaaacgctgagcgtgcaaaacaaggcttaccagcactaaaaatcgatactgaattaagcaaagtagcacgtattaagtctgaagatatgcaaaaaaacaactactttgatcataacagccctacatacggatctccgtttgatatgatgaagaaatttggtatttcttatacatctgcaggtgaaaacatcgctcaaggccaacgtacacctgaagaagtagtacaagcttggatgaacagcgctggacaccgtgcaaacattttaaataacggcttcactcacatcggtgttggttatgtagaaagcggcaactactggacacaacaatttattacgaagtaaatagattaaaagagtcttctcataatgagaagactcttttttaagtttcatagctttctattatgtatgaatagaaaatatataacataaacaacatagatccacagcttattatactaagcaatacataaaatccccactctaagttcaaaaacaatgaaaacaatatgccccatgccatcacttgaaaaattcgtctactcactaaacgaattttttgtaatttaattgggtctttttctttttctttttctttgccttttatgttcttaaattctttactcagcataaaaagaaacatactaatcccaatcgttaatcctgtttgaaaggatatcaccttcctaaaattaataaagaggataagcatatgaataaacaacataaataacgtaattttctttataaagccgcctataataccatgccctctttcattaaacttaaatatattatgtgaaataatatacaaaaatccatatgaaaaaataataaaacagggaataaatgctacaacaacttgtttactcataaactcgtttggctcaccatttacattccaatgtactgccatacgatttggtaaatagggatagagaaatagagtaagtaaaagacaagcgaaaaatattccaagtacatacttatatttgatcaagtgattctcacctctcttttctcttaacggcttcgcttcttttagagaaatccctgcaaaaatctacttttttcaagttaaaacttatactttacgcattttctttttgaaattcttttatttttttatttaactttgtaggaaacggcacatcaacttcaattgcttctttcgtaattggatgcaagaaatttatcttcatcgcatgcaatgcttgactggacatatattttgtttgtccaccatataatacatccccaactagtggattaccattatgactcatatgaacacgaatttgatgtgttctacccgtttctaattgtaacgttacgaaagtcgtgttttgcttcttaaaatacttttctactttataatatgtgatagcttggtcaccttttggagaaatacgacgccttgtagcatgatggcgatcccttccgatagcagcatcaatctttccttgtttcttctttactttcccttcaacgagcgctgcgtacgttcttttaatttttctttccattaatagacgatccataattgcaccagcaattctatgcttagcaaacacgacaccacctgtcgtatctttatctaaacgatgaatatgacgcaccttcgtctctaaaccttgcatttgaaaatgaaaagcaacaagatttgcaagcgtcccggttccacctctttcagcagggtgtgtgtccatttgctctggtttatttacgataagtacgtgatcatcttcgtatactacatgtaattcaccatattctggatctacaccgtactcttcctccgcaaacatatggacttgtaacttatcgttctcttttaaaagctcattccatcttctttgttccccgttaaccgtaacacctttttccatacgaagctgatgtaatagctttttcggtatttcccattctacttttaataccgattcaatacttataccattccatttagctggaacgataatttcacaccattcgccctttttctttgtttccatactgtttatcaccttatttctattgattctctcattgtaacggaaaacacactttgatgcactgtcaaaaatagaggacagtcttataatagactgcccctcaagctctaagtcttttcatttctaataatacttcttcagctttttgttcatacgataaatctttaaagaaatccgccaaccttttataatcattgtaagcatctaataaatcgtccatcttttctattttcatcacttgttgtttttgtttcatttttactggatagcgataacctgatacttcttgtattttgtaatactcatcctctacttgaacgacctttacaagttcttcctcttctgcatccatcgtatacccgtcaaattctctaagtagttcataaatgatatgagtccattcatcttttggataaaatcctttttctaaccgataaccgacaatgcgatacatatgcccatcgttctcggcaaactgtactgtatcatttaacttaaacttaaaataacgaaacattgccttcacctacttattatgtaatgttcttatcacatactatttgcaaaatgtaggctttgctattcataaaaaatgttcatcatattgatgagcattttttacgatgctttttctcgtttttttcgaaatggtaaccaccagttccagtctccaaataacttcattaagcttggtacgagcataagacgaataattgttgcatcaagaaatattgctaatgcaacgccaagacccatctgctttactggtaaaatatcagtaaatgcgaatgcaccagttacaacaatcattattaaagcagctgatgtaataattctacttgttgaaacgagcccttctaacgttgcttgatcgttatctcctgtttcttcatagagctcatgaatacgtgaaataagaaatacttcataatccatactaagcccaaatacgaggccaaaaatgaagattggtaagacaaacagaaccggactcgcttctaaaccgaaatgaccaccttcaaataaccaaacaacaattccaatggttgcacttaaactaagtatattcataacaattgccttaattggaatgagcatagatcggaatgcaaataataatataacaaaggtcgatccaaatataacagacataccaattacaactttatctttaatttcatcttctaattcttgttgaaacgtcgtcattccgcctagataatacgtaacatccgtttctttatagttctttttaaagtcacgtacccactgttttgcagtctctgtacgtggttttgttttcaaaaagatttctatcgtcgtcttattcccttgcgtgtatgcttcaaatacaggagttagtttcgctgattctggcgactgcaatattccaacaacttgatctgctttcattccagttaacccgtcgtataaacttcttacttcatgtactttcttatcatcttttaacttttgaacgacttcttctatcttttgtagactttctttttctttcatatcttttttcgtctctacaactaacgtaacatcagcgtgtgttttgacagtttcattaaatgcttcttcatacttttcatatgcaatccttgtatcactcttttcaggtaaagcttcaataccagggaactgcaaattagctgtacgtaacggtaataagcaaataacaataaatgttgtaacaacaataatcattgcaattggatgtttcatcacaaattgtgcaaatttacgccatgcttttgccggcgtatgtgctacttgattcttttttaatattcttttaccgattaacgataatagtgctggaagaagtgtgagtgagaataaaatgctcataatgacaacaatcattccgctaatcgcgacagattgaatataatctatcttaaagaaaaacaaaccagataatccaacaaatacgcataatcctgaaaatacaatcgcacgtcctgccgtttgatatgtaattgttatcgcttcttttaccgttcgtttagcaacttcctctcgaaaacggttcacaaataatagcgcaaaatcaatagataatgcaagtccaatcatcggtgcaacatttaacacgaaaatagatagttctttatcaacaccgatgaaatacaatatccccatcgtactaataacactaagcgccccattcaaaatcggtaaaattgatgccaaaagactaccaaacgaaaatagtaatacaagaaacgcaattggtaatccaatcatttctgctacttttaaatcattttgcgttctttcattaatctctttattaattttcggaaatcctgtaggtgttacttttaatgctacattactttctttctcaatctcatcagcaaattgtaatgtcttttccattctttctttatttgttttcccggaaaataaaattgtcgcataaccgatgtcatcttgtagcatttctttattttggattgggtgatggaaagattcatagttctctttctcttgaacattctttacaatttcatttattcgctttttaaattcctcatgcgaagcatctttatttttctcaaaaatgagcagcagcgtatcttgagacttcttaaaatctttatctaaaatttctttcgttttttgatagtcgccttccgtttggaaaccgtcaccacctaatactcccggtagctttggagcaaaaatcccaagtgcgattgcgagcaacagtaacgttacaattacggtataacgaaactgatacaaaaaggctcctaacttcccccacttatcaactttatgtacatttgtcttcacacattttcacctactttaaataattcaattgtcacttatactgtatcacatcttgatataaacaaaaaacgtctggaaaaactataataatagtttttccagacgtttttctatctctctttattaagccctaatctctcagtaagtaaacgatggtagtaaatcgcgataattaacaaaataccacctacgcagtaaccagctaaaatatcagttggataatgtacatttaaaatgactctacttaatccaatcgataaaattactatacccatcaaaattgttgtgacacatttcccagctacacttttcaaattagcagcaatgatataagtaagaaatccaaatgtcataatcgatagcattgcatgtccactaggaaaactatatccaagtgcatctagcgcttcatttaatgacggacgttctctctttacactctcttttatccctttattcacaagatgtgttattaaaattcccattggatatacaatcatcgcagcataataacgcttcttccaaaaaacaagcaaacttataacgagcgtagcgactatcccaattgctgatcccaattttgtaaagtacgagaaaaatgtaagagaactttccgtttgtagccctcttactaatccacggacatatgtatccatcactgtaacgccacctgcatgtacgcgccaagcaacaataccaaatacagcaaataacaaaccgatacacattacctcatactgatgtaacttcttcttcaaacgatttcctcctactatgaaaaaatgcgatttctactttagaaaccgcatttccttacttatttaccttttgtttttagctctgtccagtaacgatcatagtcttttaacttatcgtctacatcaacaagccattctgtacgatctaactcttctttcgttaagaaaatcatgtgattatcacggtattctttactatgaagaggatgagctttttcatttggattactgtaaccaattgactcgtagtttttcacacttactttttcatctagtaagtagttcataaatttctcagcaagctctttatgttttgcaccttttggaattgctaacgtatcagcccaaattgtgccgccttctttcggtacaacatattctacatctttattatcttttgcgataaatgctgcatctccagaccaaactgttccgatccaagcatcttctgtaatgaatttttgtttaatgttatctgtatcaaatgctaataagtttggaagcagcttctttaaatcatctgctgctgtctttaattgtgcatcgtctttcgtactgtttgagaacccgtgcttcttaagacccactcctaatacttcacgagaatcgttcaataacgttacatgtcctttatatttctcattccataagtccgcccagcttgtaggtgcttctttcacatactttttattgtatgcaatccctgttacaccccaagtgtacactaaagaatatttattctctggatcaaacgcaggtgttttgaaattagaaaccatattttcgatattcgggatattctttttatctaacggcgctaataagtccattttcgccattgttttaaccatgtaatccgacggctggattaagtcatactttgcgccaccagcttgtaatttcgcaagcatttcttcattacttgcgtacttgtcatagttaattttcacattatatttcttttcaaaatcttttagcacttgctcatcaaaattgtcagcccagctataaatatttaattcttctttcttttcaccacaaccagcaagcacaccagcaacaaggctaaaactaattgctgcgccagctattcttttcattaatttcatcggtttattacccccttgtactttctatatcgttcgtattataaaggaaggtgtcctccagagttttcttcaccatctgcacctttattccggaagatttcagatagaaccattaatcctacgatagcaacaattaaaattgtagaaagagcattgatttctggtgatactccgcgcttaaccatactgtaaatgtatagtggcaatgttgttgatcctggtcctgatacgaagaaactaattacaaaatcatcaattgataatgtgaatgttaataatgctgccgaaataactcccggtgcaattgctgggaacgttacataacgaaacgtttgccaaggcgttgctcctaaatcatttgcagcttcttctaagtcacgtcccatacttgaaagacgcgcagctaaaataacaacaacaaacgaaatactaaatgtaatatgtgcaataataatcgttgtttgtccaagttccattcctaactggctgaaaagaattagtaaagataatcccattaaaatatcaggaattaaaattggtaaatatacaaggccattaatagccccttcaaaacgatatttataacgatgtaaagcgattgcaaagaatacaccaagtaccgttgtcacaatcgttgttataactgcaatcgtaatactatttacaaatgcatcaataacatcttgtttttgaaataaatctgtataccaatggaatgtaaaaccttcccactccgcattaatgcgagagtcgttgaaagaatagaccattaaaaccatcattggaaaatacaagaataacaaaattaaccaagaataagaaactaaaaacttcttcatctttgcctattcccctccgttctcattatatttatatactttcgttgcacgataatataagtaaattaacagaacagagaatagaacaacgat

SEQ ID NO: 1330 - DNA, 10864 bp, Bacillus thuringiensis
tcgtgatgtcgcttacgcaggcattgatgcctctgtgtcccaatctgttcaatttgaagcctcaggtacgtctatatccaaacgtggttcttctcatttgcgtagagccttattccaagcggctattacagcgcataaacatgaccctgtattaaaagctttttatgaaaagaaacgaaagcaaggaaagcactactatgtttgtataggggcggtagctagaaagctgtgttacattatctatgccattcttaaaagcaataagccttatgaagtaccacctcacacaacagaaacatgaccttttcattttttttgaaaatccttaggtttatttggcacgcccttttttagaaaaacaccccctatttatataaaaaactccccttgacttctcatagttggtcttttttagcaataaaaaaagaccagctattgctgctcctgctctgtttgtgtgttattttcattagttggtgttggcggttcttgagatgggtaattccctgtaagtgatgcataacactctaaacaaatgttctttttcgcaaatcccatatctagtgagtacaaacgcgctccgcgtttacatatttcacacagcgtagcaatccgaaactttactgtcccatccatttctctccatacttcaaccctgctaacaccgtttagaagacctgcattatttaacatatcggcaggtatttgaacaaaaatccctgtatctgtgcgctctgcatccaccaacctccccataaaaggaaagctttcacctgcttgaagtggcatcatttgattctcattcattcttatcgctcctttctatccaagtgcattaaatttccaaccgcttggagtactcgcataaaaacccgctcccatattaccgtctgtaaaacgaatatgaccccattgttggaatccaccgccacctaagttaattccctgcattgctcgtatattcctaaagattttaacttctttttcagtacttatatcaaacgtctgtccgtctggtgctggagatatattgttatttacaccgcctacagcgagtccgttaaacggctgaatgccatctgctctttctgctgcagcacgatcccaattatacatagatgcatatttcccactgtacagtgttacaccacttacacaaatcgctgtcccttgtctcatgtcagcatttccagaacaaactttaataatcaatgcgtgttgttgcggaatatagtttgttggcactttgaaagtaaaagaataccttctgatttctccataataggtagatggctcagggaagtccatcttttgttcactcaatatgtcgtaacttacgttatctccgaatttaacgcagcatacgtgtattctcggttttcctgtcttacgcacgccatttatcatggcagttctaaaatgagcggatgctgtatattcgttaccaggatgtataccgttattcacgatcgcttccggatagttatacatatctacccttgcagcattcaccatctgctcgtaatcgaatatatgtgtattcttttctattacgacatttccccaggacttccaagtaaggccatatccaccttcaaatccataataatcgttatgtccaatgtttttctttgtaacactagaaaagtctggatctgctattagatttcgtcttgataccgcagttgtttttgtaccccattcgtcttgaaataggaagtctagcattttaacagttacaccatctttatcaatagtgatcttatcaccatcaattctaataagattcgtatcaatgccttttgcagttaaccatttcaccattgtatcggcattaatattcagtttctccgcatcgattgtaatcttaccaggtgacatattaatagaagtaatgataccgtcttttaaaatctgcgctaaaatcccctcatctaacacttctaacttagattctgttttctttacataggcattataagtctcatttataaacgtttcttgttttccagagataattgaaacgcctttttcagtagcactaatacttctttctaactctgtaactttctgattgtatttctcagtagctactttattagcaatatcatctatcattttatcaatatccgtttgatctttgggatgtagccaaaattctgtagctattttaccacgctgcaacataggtaacgcaatccataacgttccattccttctcaaccaaggtttataacgcgctttaacagccccaactggaactgttccggcaataacagatctaatccaattagaattcgcagttacattgataccgattgatgattgtgaaactcggctaccttgggcatttagatactcaatttctaacacgaaaccttgtcctatgttattggacataaagtaacccgaagctacaatgtcttcaccagcagttacgtctatcgtttgatgaaggctataccatttatcttcagtcaatccagtcgcatgtaatttagccgttgtatagcctctgtatgttacagaagagtcaataacagcactattaccattttgtgtccagtatttgaagccctgagcgaatgcagcgttccgtagatcatttatagaacccaatccaccaacataatcctcaacatctttctttttcattgttaactttaatgcgtcagaatgttgacctattgttgtagtagcctcactaatcgtctttccttgcgcagtttgtgtttcctgtaatttcttaacacttgcagttgttccttctgcattcttttctacagtgttaacacgttcatcaaaaaaggtttgtgttttttctaccgttttaatactttctttaataccatccacacttttttcaatctctgttgttttcttagtgaattcatcattcgttacttgattttctggagctggtgtccaatcctgtggcttattccctttatataaagccacccattctacagttgcctttgtagcattatttggataattatataagtttaatctccgttcattcccacttgtagttgcaacagctttgaaagttacataagttattccgttagcatagacacttgttgcatatccaacattatttgaaccaccattctgccaaattccaaattgttgaccctgcgggacacttcctttaattacaaaagtatattcctcacctgcaacaaaattttcagttagagaatatggattgattagataatctgttttttcgtatttagcatttgaatctaataacagattacgtcctccagatttatcattattaacctttgtttctactcttgttaacttttcactaatcttccctgctgcttctttgatctctgttgttaccttggttaaaacattcccatctgcaagatcttcaggagctggccgccaagaatatcctttgctacctatagtcaattgtggtgaactttgctgataccaacaaccagcaggaggattcacgtcaggttctacacgaaaatgactctcgttatccgttcctgttgatgccatcatgcccgctgtcactacgaacgaaacacttacactttgccattgattagtagatttatttggacggatgccggtagcccctgctgcaaaatagaaagtgtgttgtaagtcttggccgttcggtaaaccttttacacgagtaaaaattgaataggttactttatctcctacttttacaacttttcgatctactaaatctttgaagttataagctaaagcggtccatgatgattgagtttctacgactgtattcccttgaaaaacatccttcgaaattttgactttatctgctgacttaagccaccaacgattgtccgcttgcgcagaggtcaaagcaccatcaaaagatttggaaccgattaacaagtttcttacatcgtcattaatgtttgctacactttctttaacttcagaaataactctcttatttccgtccacatcatttactaaggtgttgattttacttgtagtatcagtactatttttcgttaatgtttcaatagaagttttaaatccctcagaatcctgttcaaacttggttacttttttatcaatttcaccttgatctctttgtacatcagaaatagttctcgtaactttttgaaggctttctgttacttgattaaattgcccagtggcttcttcttgcgcttcttccactttcttatttaattcttcttttgtaagtttaatatccttattaacctgctccagtgtatcttttttaattgattccacatcaggaataagaagctcccaccctttaccattccacacttttaacataccaggtttaccgttactaatatctcgccataatgttttacctactataagattatcaattggtgggtttttagcttcaataatatttaccgtattattttttagattttcttgaactttttctgctaactctttagctgcttgagattcttttcgtatggtttcaattgttttttcattctctttcaccagtttgtctagctgatctagcatttcttgtttactacctaacgaactaagaatttgattgtaaatctttcgtaattcttcgttaggatctacaatttctcgataatctccaaatacatattgatcttgtgtaggatcagtaaaagattcgtctccagctattgctcttgcttctaaataaagttttggtgtaaatcctgtatctttaattcggattgtgtcaccctcattaatcaattcatgtgctaatccaaatacacgtcctatggatgccgcttttacctcataagaaacagacgcatttacacgtttcttcatttctatttccattaaagttttcaaacggtcaggagacatgttttcattgtcagtttctggactataaaaaccaaatttatgtttacctttttcattccatcgttgaaaagcatcaatattagtaatataaggaagaccattattaattttttctatcgtaataatgttatcgccttcacctttcacaaaaccaattaaagctgtacagatattttgcgagttctcaattcgcttaattccaattaaatctttccctaattcaattgttttccctgtatcctgcccgcgttttttcatcatatcaacataccgttcgatatgattccctacaacttcagttcgatattgaatttctagttcaaatagagaagcaatctttttcaaaaaacttaatggatcaataaattcatcaacggtcatagaacggaaactttcataagaaatatttccttttttccatttcgttcccttaagagctatatctacatactcccctactgtttttgcttcaaatttttgtggatcaatataatttgctttaccaagtaaaatccattcaccagacgcgtaagttgtaagggatctattattagaatctttttctgtttcagtaattgtgtatggaacaattcgtccaccccttacctcttttaaaaccaaattttgttgcgtaagcgctgcggcttcttttgtaccatcaaaaaccgtaaaatctagcttatcaacattatttttaatctcccaatgcctattgtcattccaataatcctttgattgaatcgctccgataatttgatctgtttgtgaatcaacaacatgtaatattccacttggtgttctcatctaaatcgctccctatatgtaacctttgctgttcctatatcggaaggtatgatttcaagtttattcgtccctttattgataacaggaaaattactaaaaatatcttttatgttaatagcgtttttcccttcaatactgacatgactgctttctgtatcaatcacaactttgtcaccaacatcgactatataaggtggtgtattttgattatttaaattcactttccaaaatttcaaatcagaaactgtcatcgcttctactggcggaacatcttgccactgcatgatactaatttgtatttgagctgctttttccatatgtttattgtctttatcagtccatcttgcaaaacgctctgcatcatctttttctgttccaggaagaaactttgaaatatacgcctcccaatcattacccgttctagcgatccacaacctaccataatactgattccacgtattgggataatcaccactctcataaattaaacctgtttttccaggcttattatcatatccaattaccatcgttccaaaattttgttcagcttgccaatagaggtcattcatggcaatctttgaaagaactttgctattttcatcgagtatcgctatctcaactcgtcccatttcattaatgtttttactcttacatgtaacatgggcttgcataataaaatcttctactggtccaccagggatgctctttttaacagctgccccatgccatccattacctgagccatagtccgaacaatagaattggtaactatctgttttcatttcaccaaccggattaccatcttccatagaactaaccttactccaccctacagttgtggacatatcatcccatataagacgttgatttctttctacaggcaattgctccatttttaatggcagtccaatacgaaaataatctggttcctttgcatatttatcttcaaaccatacatctaaaaaagtatgtggctttttaatatcaatttcaataatcggattggaatgcacagagcctttgttttggacattggcaattaacccctggccgtcattttcaaaatcaaccgttttctcatttcctaacttataaggcattgggcaaacaaagttcaaaatacctttacctaacgtaacaaaatcctctgaatcaaaatcttcatcaataaccgctaagtatgtcctatcaggtgttacatcaaagactaattcaacaggtttttccgtaattaaccactctgctatttcttcttttactgtttctaagtctgatccatcaggaacgataattccgactggaacaggtaaaactcgcatttcagtttctgtcgttaataatcttgcacctggataacctggaacacttaaaaagttccgttttaatggcgcccacgctggttttttccaacctttttcgatttgaataaaatccttgcgtatattgttaaatgtaaaagagctcacgttgccacctcatttcttttcaaattaaaagagactcaaacttaaaagtctgaatccctctgtgtttctctttcttgatattcggttgtatagcgatacgtaccacgcgctacatctcgtccctctaaaacaacaggaacctccacaactaaatcgccaccaagcgttggaatgactccaccgccagatgatcctgaagaataattaatcacttgattcgcaacaccagctgccatagcttgtctactatttgacatatttccatacacaccactcataacactctttaaccctgataattgactcattgaactagccatcatccggctcatatcactcattagttgattcatagttccagtgataccgagtgatctttcttttgaagataacggcgtaactgtgatagaattccctcttttagtaaacagttcgggtcctttttctccagtaataaatgagccatctcctacaggcttcccgcctttagcgagcattggtacatgtggaatagtcggcgcgctaactcctggtatattgtttaataattctgctggtgtattaaaaccatctataaatttatttatgatacgaataattccattgatagctgtacgaataccacttttaataccatcccatacacctaatactgctgatttcatgccttcaaatgctccactaacggcatctgttacccaacgaacaggcgtcataatggcttcttttaatccattccagacagaagatgcggttgacttgataccttcccagatgtttgaaagtgtagatttaataccattccaaatgctactacttgtgctactaatcatgttccaaaccgttgaaatcgcttctttgatgctattgaatacagaactcgctgtggaaacaattgcgttccataagctagatagatagcttttaatcgtattccatactgcacttgttgtggagctaatcgtattccatgtattcacaatccaatcttttattgaggtgaatattggtgttacaaaagctactaacccgttccagcacgattgtaagaaattcttaacagcattccatacagacgttgttgctgaactgattgtatcccacacagcaatgatccaggacttgatttgttcaaaaatcggcataacaaacgctacaagcccattccaacaggaaactaagaaattcttaattgtttcccatacaagacttgtagtagaactaatggtattccaacattcagaaatgaaattcttgatactttcaaatattggcgtagcaaagtataaaatagccgtccaaatcgcttgtaagtattgtgtaataaaattccatacagtttgaatcactgtggaaataccgttccaaatcatagagaagaaatcagcaattccttgtaaaataggagttagaaaggcaactagtccattccaagtattaacgaaaaactcactaatcgctgtccacacttcggaagtggtttcgctaatactattccaaacttccgataatgtttcaactactccatcccatattccagtcaaatactccacaatggaattccatatttctgtagtagtttcaacaatagaattccatatttcagataaagactcaactatcccattccataactctattaagtattctttaatcgaattccaaacttccgatgtagattcactaatactattccaggtttcacttgcccattgtacaattccatcccatacgcctactaagaattccccaattgcattccatgcatcaatggtccattgtttgatgtcgtcccaatttttataaatggcaacacctaaagcgacaacaagtgctactattatcggaataatagcaaccaaccctgtcatcgcccatcctatacttgttataacagcaactattggcgctaaagccatgaatgctcctgcaattacaccaatagcaactgcgatagctgccaaagtagctgctaattcaggattattggaaatccattcagagaatttagagacaagatctgctataacttcaagaacaggctgaagagcaacttgtaaatcttgcatggcttgttgaaatttaaccgctggagatgcatctattttagaagtagcaccctgtaagtcctctactcctttttttaaatcgacttgtttaccttccgctttcaaaatggtgtcgataattttcttcccttggtcttcccaaagagtaccgaacatcttcgtgccaagtgcatttctgtctgttgcattttcaacaccggctaaagctttggtggcttcaagcatcgctttttgtccaccttcgccaccttgagcgatagcttgaccccatttttcaaactgatccgccgaaatttttgttttatctaaaaccgcttgcatagatttatctacacctgcaccaaactcagccattttgatacgtccttctttaacaccgtctaataggttatcgatattccaactcttagtatctactcctgctgacataattccttggacttctttagccgaaaatccagcttgaatcatttgatccccatattcagcgataatatctaattgttctggtggaaatcctgtttttaataatgtattaactagccccaatgcttcctcgttcgtaatacctaacgttgcaccaatctcattggtttcttgtataagttcattaaaatcaattccagcgtaggaggctgcaatagtcgctgctcctttaactatagcggcatttgtttcgtcagaagcatctttatttaatgcccactgtcggcgaactccttctaatgcctcttcagcatcaataccatacgtactaacgcccctaatcgcttcttccactgattttttcgaagactctggaacatcgaaagtgatatcaatcttagttttcaattttgacatatccattgctttttcaactgcactagcaataccgccaccagctgccattccaccaatgacgttttcaagtcctacttggagcccttcaaacttcttctctgttctctcagcttcttgttgtaaatctctcaactcatttcgtacttgctgaattgaattcccagcatccacagatcgtagcgcacgttgtaacttttcaatatcagcttctgttcctaatgcttcgcgtccaataatcccaattgcttgttctaattgcttacttgttgctgcaccgtttcgaattgcatttacaagacgattacctaatgcgcctgcaaaatcatcaacgctttttcctgtagcactaaacaacgtttctaattgtcttgttgaactcgctacattctcttgttcagatttcatattaccaagcttatttttcagcccatcaagtgatccttgtgtaaattcaatttcacgcctaaacgcgcggtactgttcttcagaaatttttccattttgaaattgtgcttgcacttgttgttcggctgccttcaatttatctagcttttccgttgtattttcaatttgttgcgtcaataacttttgcttttgagctaaagcttccacattaccaggatcaaatttcaaaagacgttctacatcttttaattcatttgttaaaatattgctgcggttattcacatcctttaatgcattttgaagacctgtggttttcccacccaatttcaatggtgatccctttaattcttccgggcataatttaacccctttcttagaatgaatcaaagtcttttgggtttgctttctgccttt

SEQ ID NO: 1331 - DNA, 10287 bp, Bacillus thuringiensis
atggagggtctatatgtcaaacagatttgcagtgattctagctgcaggtaaaggcacacgtatgaagtctaagctatacaaagtgctgcatcctgtatgtggaaaacctatggtacaacacgtagtcgatcaagtatctcaattaggattgcagaaacttgtaacggttgttggacatggtgctgaaatggtacaagaacagctagggaacgtaagtgaatttgcattacaagcagaacaacttggtacagcacatgctgtagatcaagctgcaagtgtacttgcaaatgaagaaggaacaactttagttatttgtggtgatacgcctctaataactgctgaaacaatggaagcattacttcagcaacataaagaagcaggagcaatggcgacggtgctaacagcatacatagaagagcctgctggatatggccgtattgttcgtaatgagaatggtcatgttgaaaagattgttgagcataaagatgcaaatgagaaagaattagctattaaagaaatcaatacaggtacgtattgttttgataataaggctttatttgcttcactttctaaagtttcaaatgataacgtgcaaggtgaatattaccttccagatgttattgagattttaaaaaatgaaggtcatatcgtatcagcttatcaaacagagcagttcgatgaaacgttaggtgttaacgacagagtcgctctatcgcaagcggaaattattatgaaaaaccgtatcaaccgaaagaacatggtaaatggtgttacaattattgatccaagtaacacttatatttctgctgatgcaattatcggtagcgatacagttcttcatccaggaacaattattgaggggaacactgtaattggttctgattgtgaaattggaccgcatacagtaattcgcgatagtgaaattggagatcgtacgacaattcgacaatctactgtacatgatagtaagcttggtacagaagtatcggttggtccatttgcacatattcgcccaggttcagttattggagacgaagtacgcgttggaaacttcgtggaaatcaaaaaaactgtctttggtaatagaagtaaagcttcacacttgagttatatcggggatgcacaagttggagaagacgtgaatcttggttgtggttcaattacggtgaactatgacggtaagaataaattcaaaactgtgattggtaatggggtatttattggatgtaattcaaaccttgttgctccagtaacagttgaagatggtgcttatgtggcggcaggctctacaattacagagaatgttccatcaaaagcattatcggtagcacgtgcacgtcaagttaacaaagaagactatgttgatcaattgctgaataagaaaaaatcataataatgtggagggttaatctagatgtcgactcaatatctaaattctaatttgaaagtattctctttaaactctaataaggaacttgctgagcagattgcaaagcatattggagtaggactaggaaaatgttctgttgatcgttttagtgatggagaagttcaaattaacattgaagaaagtatccgtggttgcgatgtattcattattcaatctacaagcttcccagtaaacgaacatatcatggaattacttattatgatcgatgcattaaaacgtgcatctgcgaaaacaattaatattgttattccttactatggttatgcgcgtcaagaccgtaaagcgcgttctcgtgaaccaattacatcgaaacttgtagcaaacttgcttgaaacagcaggtgcaactcgtgtaatcactctagatttacatgctccacaaattcaagggttctttgatatcccaatcgaccacttaatgggtgtaccgattctttctgattactttgaaacaaaaggtcttaaagatatcgtaatcgtgtctcctgatcatggtggtgtaactcgtgcgagaaaaatggcagatcgtctaaaagcgccaatcgctattattgataagcgtcgtcctcgcccgaacgtttcagaggtaatgaacattatcggtaatattgaaggcaaaacagcgattttaattgatgacatcattgatacagctggtacaattacattagcagcaaacgctcttgttgagaacggtgcttctgaagtatatgcttgctgtacacacccagtattatctggtccagcaattgagcgtattcaaaattcaaacattaaagagttagttgtaacgaactctatcgtattaccagaagagaagaaaatcgacaaagtacatgaactttcagttgctccattaatcggagaagcaatcattcgtgtatacgaagaagaatctgtgagtgtattattcaattaattggatagaatgagacgtaaccaaaattggttacgtcttttcgtatcgaaaaaagaaagtagtggtacaagaatgaaattgatagtaggacttgggaacccaggtagagaatatgaattaacaaggcataatattggatttatggccattgatgaacttgcgaagcgttggaacatttctttgaatgaacaaaaatttaaaggtgtatttggtgcagggtttgttaatggagaaaaggtaatcttattaaagccgctaacatacatgaatttatctggggaaagtattcgtccacttatggattattataaaattgatgttgaggacttcgttgttatgtacgacgatttagacattcctgtaggtaaattgcgtcttcgcatgaaaggtagtgctggtggacataatggtgtaaagtcaacgatttcgcacttaggaacacaagaatttcaacgtatccgtatgggaattgatcgcccgaaaaatggaatgaaggtagtcgattatgtattaggacgctttacatctgaagagattccggatgttaaccattctattgaaaaagcagcggatgcatgtgaagagtggctaaataagccttttcttcaaatcatgaatactttcaatagttaaaaatgagattgggaatatttctcttttgttttacccatactagtagtaattgaatttttaggaggctagtatggaagggtattattattgcagacactgcggaggtaatgtaggctccattaacgcagaaaaagtatatagcgacgttttatttcaactaacggagcaagaagtagtagaaatgattcattttcatgagaatggaaatatatatataaaaacgatttgtgaatcgtgtcaagaaacgctcgcatcttatcctgagtattatgagtatgaaaaatttctgcaataaaatgttgtcgctttggcatgtccaaagcatttttctgttttccttttccaaaatatttgcataaaatagaatgacttgctctttatgttgagaggagttttaaaaatgataggtttattagagcaattttataaaaatgaagagatacaatcggttattaatgggttagaagatgggttaaaagaacaacttatatcagggatggcaacgtcttctcgttcattattaatggcggctttatataaaaaaacaaaaaaatcacaattaatcgtgacacataacttataccaagcacaaaaagtacatgaagatttagtggcgttacttggtgaaaaagatgtgtggttatatccagtgaatgaactgatagcatcggaaattggagttgcaagtccagaattgaaggcgcaacgtatagaagtgttaaatcgcttggctgcgggagagaatggaatcattgtagcgccagtggcaggattgcgtagatttttaccaataaaagaattgtggaagcaaaagcaagttgaaatcaatctagggcaagagattgatttagatgcgctcttgcatactttacatcatattggctatgaacgtaagtcgatggtagaagctccaggggagttcagtttgcgtgggggaatattagatatttatcctttaactgaagaactaccatttcgtattgaattctttgatacagaagtcgattctattcgattatttgatgtggatgaacagcgttctcaaggtaaaaaagaaaacgttaggtttggtccggcaacagagtttttattttcacaggaagaattaaaatcaggaattcagcatcttgaagaaggcttgactaagacgatgcaaaaactttctgatgataaactaaagactaaagtgcttgagacggtaagtcatgaaattgagatgttgaaaaacgggcaaagtatagaacagatgtttaaatacttatctattttctataaagaacctgctagtctgatagattatttaccagaagatggtgttgtaattttagatgagatttcccgtattcaagaaacagcatcacatcttgaaacagaagaggcggaatggtatatatcacttcttggtgaaggaacaattattcaagatttatctttctctcacccattcgaggggtttcttcatcataaaaaaagaagttttgtatatttaacgttattcttgcgtcatatcgcacacacacatccgcaaaatattgttaatgtaacatgtaaaacaatgcaagatttccatggacagatgaatttgttaaaaacagaaattgatagatggaatgaagggcattttacgactgttgtactcggaacagatgatgaacgtgtgaaaaaattacaacatattttaagtgattatgatattgaggcagatattgtagaaggtacagatattttattgcctggaaggttacaaattgctgtaggtgatttacatgcaggatttgaaatgccgatgcaaaagcttgttgtcattactgaaaaggagctttttcataagaaagttaaaaaatcacaacgtaaacaaaagctatcgaatgctgaacgtattaaaagttattcggaattaaaagttggagattatgtagttcatgtaaatcatggtataggtaaatttttaggtattgagacattagagattaatggtgttcataaagattatttaaatattaaatatcaaggtaatgataagctatacgttccaattgaacaaattgatcaagttcaaaaatatgtaggatctgaaggtaaggatccgaaagtttacaaattaggtggtaatgattggaaaaaggttaaaacgaaagttgaaaaatctgtacaagacattgcggatgacctaattaaactatatgctgagcgcgaagcttcaaaaggctatgcatatacgccagatacggcagaacaacaagagttcgaatcatctttcccataccaagagacagaggatcagttacgttctattgacgagattaaaaaagatatggaacgcggacgcccgatggataggctcctttgtggtgatgtagggtatgggaagactgaagtggctattcgtgcggcatttaaagcgattatggatgaaaaacaagttgcaattttagtaccgacaacgattcttgcgcagcaacactatgaaacaattcgagagcgttttcaagattatccaatcaatataggcttattaagtagattccgtacgaggaaacaacaaaatgaaacaattaagggcttaaaggatggaacagtagatattgtaatcggaacacatcgtattttatctaaagatgttacttataaagatttagggcttcttattattgatgaagaacaaagatttggtgtgacacataaagaaaaaattaaacaattgaaggcgaatgttgacgtattaacattaacggcaactccgattccgcggacgcttcatatgtctatgcttggtgtgcgcgacttatctgttattgagacaccaccagaaaatcgtttcccagtccaaacgtatgtagtcgagtataatccagcgttaatgcgagaggcgatagagcgagagcttgcaagaggtggtcaagtttacttcctatataaccgtgtagaggatattgaaagaaaagcagatgaaatttcgatgttagttccagatgcccgcgtaacctacgcacatgggaaaatgaacgaaagcgaattagagtctgttatgctatcatttttagaaggacagcatgatgttcttgtaagtacaacaattattgagacgggtgtagatattccgaatgtaaatacgttaattgtatttgatgcagatcgtatgggattatcacagttgtatcagcttcgtgggcgtgttggacgttctaatcgtgttgcatatgcatactttgcatataaacgtgacaaagtgctgtcagaggttgcagagaagcgtctacaagcaattaaagagttcacggaacttggatctggtttcaaaattgcgatgagagatttatctattcgtggagcaggtaatttgttaggggcagaacagcatggatttattgattctgtcggatttgatctatattctcaaatgttaaaagatgcaattgaacagcgtagaggaacagatggggctgaaaatatagttaatgttgaaattgacttagaggtagatgcatacttaccagatgcttatatttcagatagtaagcaaaaaattatgatgtataaacaatttagaggtgtttctgcaattgaggatattgaagaattgcaggaagaaatgatcgatagatttggcgattatccacaagaagttggttatttattacaaattgcaaatattaaagtgttggcaatgaaagaacaaattgaattaattaagcagaataaatttgaagtaacattcctgttttctgaacaagcaagtcaaaatattgatggtggaaaattattcatgctcggaaatagttttggacgtatgattggtttaggaatggaaggatcacaattgaaaattgttatgaaaacaaatggcttagagacatcgaagtggttaacgattgctgaaaatttattaaaaggcttaccagatgtaaaaaaagaagtaataaatgcctaaaataagataaaaaaatacaattcgacgtgcatagaagaactaatgtgtaaaatactatatctaacagttggtgatttttacatgaacaggtaaattcaccactttgatcatcagtagaaagtgaggcagcattagaatgaaagcaactggaatcgtacgtcgaattgatgatttaggcagggtcgtaatcccgaaggaaattcgtagaactttacgtattcgagaaggagacccactagaaatatttgttgatcgcgatggagaggtaattttaaagaagtattctccaattagtgagctaggtgattttgcaaaagaatatgctgatgctttatatgacagcttaggacataatgtgcttgtgtgtgatcgagattctatcatcgcagtatcaggcgtatcgaaaaaagaatacttaaataaaagtgttggcgatttaattgaaaaaacgatggaagaacgaaagtctgttattatgacggatgaaagtgatatttccattattgatggtgtaacagaaaaggttcattcttatacagttggaccaattgttgcaaacggagatccgattggagccgtcattattttttcaaaagaagctattataagcgagatcgagcataaagcggttaatactgctgccagtttcttagcgaaacaaatggaacagtaagggtatattgattttagaagtagcaatctttcctaattatgatctttctttttgagaaatcaattatttggagatatatgtatattgaatgaaggtagcactttgctaccttttttcgttgaatatttttaacgtgtaggaactcattattacccgtgttgggaagggagtttgttcttttctttatgatataatacgagaggtgagaatagaaaaaggagttttcttgtatggaagcgaagaagtatcaagccttttggcgtggggctattatattaacgattgcaagtttcgttacaaaagtattaagcgctttttaccgtattccatatcaaaatatagcgggggatattgggttttatatttaccaacaaatttacccgttttatggattttgtttaattttagctacttatggatttcctgttatcatttcgaaaatggttgcagaacgattagagcggggaaaacaaaaagaagcagaagaaattatttgtgtatctttttggttcttattaggaattggttttataggcttctttacattgttttttggggccgaaacaattgcggtagctatgggcgatatacacttagataagttactacgtgttatttcattttcattcttattgatgccatttttgtctgtagcaagagggtattttcaaggatttaataatatgatgccaacggctgtttcgcaagtaatagaacaaacaattcgagtttctattattgtatttttatcgctattcctaattgctcacggatttgatttatatacagttggtgcaggagctatgttaggctcaattgcgggtggtcttattgggattattgtacttatattgtatatgcgtcaagattttcgttctatattcttcaaaagtgcagcgagaattaagggtaaaaggaagatagttaaaatccttttttggcaggggttagcgatttgtgttagtaatttagtgcttatttttatacagatggctgattcagtgtccttttacagcttacttattggtgcgggagaacaggctgaaaatgcaaaggtattaaagggtgtttatgatagaagtattccgctaatgcaattaggtactgttgtgacgacttctttctcgttgtcacttattccgattattacagcggcgaaggaaagaggagatctttcctttattcaagaaaaggtaaagttagcagtgaaaataacatgtgttattggacttgcagcagctattggactaacttgtattattcaacctacgaatattatgttgtttgaaaacagtgatggatcagatgttttatctattttatcgttatctattttatttagttcattgtcaattacgacagcttctattttacaaggattggggcaaacgtttaagccagcattatttgttgtatttggaggttgcttaaagttagcgttaaattatatattcatgccttattttggtgtgaaaggtgcagcctttgcgactttatgtgcgttaattataatctctggactaaatactttgttgcttacgagagctgtatcagggtcacttatcaataagcgaaatatgttagggatagtaattagtggtatctgtatgggatttgtattaatgatgttcacacgtgtgttacagatgtctggattagtaattgatatggaacatagaggaagcgcgacacttgaagcgttgttaggtgtagccattggcggattgacatatatgttttttattttgaaattacgtgtatttacaaaaaaagaattaggaaccgttatgaaacaagagaaaaaagaaggttcattgaagaagagtggatagaggtgactggttgtgagtggaatcattactattttaggtttaggagctggtgaattagatcagctaacgatgggtgtatatcgaaaaataaaagaagcagaccatctgtttgttagaacgaaagaacatccagttatagaagaattggagaaagaaggcgtacaatatacgtcttttgatgctgtatatgaagcacatgatacgtttgaaattgtatatgaaacaattgcgaataaattgctagaacaagctgaaggtacagaaattatctatgctgttcccgggcatccacttgtagcagaaagaacagttcagctactgttggaaaaaggagaagtttcaaatgttgaagtgcgaattgagggtggacaaagtttccttgatcctatgtttgcaagtctaaagattgatccgattgaaggattccaattacttgatgctacatcatttgaaagagggcaattagaactgcgtcaacatttaatcttttgccaagtatatgatgcattcgttgcatctgatgtgaaattaacattaatggagatgttaccagatgattatgaagtgtatatcgtaacagctgcaggaacttcatttgaacaagtaaagaaggtaccgttgtacatgttagatcatgaaacggaattgaataatttaacgagtgtgtacgtgccgccagttcaggagcgtgcgtccttgtatcaacagtttgatgttcttagagaaattattgcggaacttcgtggtccaaatggttgttcgtgggataaaaagcatacacatcaatcattaaagaaatattaatttgaggaagcttatgaagtgttggaagcaatcgatgaagaggatg

SEQ ID NO: 1332 - DNA, 17853 bp, Bacillus thuringiensis
cggaaccgccatcttttttaattttatccactacactttctgcttcttcttttcttttactatagtgaacaacgactaacgcaccagcccgtgccaaatgtaaggcaatacttcgacctatccccctactagcccctgttactaatgcaattttccccttcaatttattcatctcatcatcccctggtttaaaaaaatctacttagttatatcacaagataccctttgaaatgttgctcactaatttgatatccataaaaccaaaaggcccactcataattataagagtcggccttttcacttcacatattcattagctttacatacagcatccccaactgttatgtactttgtactaagtataataaagactctaaatggtattataggtaaagccaacttaaactaaagttaattcatatacattttgcttagagtctctgcctttaaacagttcgtttaggattctatgcatatattcaataaaatttcagcaatgcctgtatttttcatctttcatatttttctttattagctatgagtatacttaaaaaactaaaaactatttgataatcttttagaatctaactttcttttaatactatttgctatttcttcaatattttcatttagaaagaaatgattaccttcaaaagaatgaaaagtacacgttttacttgtgtatcgttcccattttattaccttgatcatatgtagtaaattcatcattttccccattaaatataagaaaatcaatatcacatggttgtgtatttttgtcatgaatatacgtctcaacgattttaaaatctgctcttagaatagggagaaaaatctccattaattcttctgattgcagtaccccagatggtgtacctcccattgcaataacttctcttttaaattgctcattagaaagattatgtcggatattttttattttactatttggatgatttctaccggacaaaacaagaaattcaggcgatacgtttttagaatcttttatttttctggctaattcataggcgatcaaacttcccatgctatgcccgaatagaatgtagggcgaatcatctatctgcataactattttattgtagacatcatttactgcctcttccatactttggtacaagttttcttcaattctatatcctctaccagctagctctatcgggactacctcaatatatggattaaagtgatttttccattttgcgtaactaaacgcagatcccccagcatgtggaaagcaaaaaagtttagtcttctgcattgattttctccttactttcaaatttgtatatattttggcaaattgcataaatgtctttaattattatctcttgcggaaattcatcccttgttgcacaagcagataacttataatttggatcaatgttatattgtttaaagtaaaagtttttaggtatattcttgtatgaaattaaagttcgtgattctttttttatagagaatgaatttaatggggtataaagcccttttccaatcgtttttatatagctttcttttaatgtccataaatcaaaaaaacaattaatttgttcatcagaattcatattagatatatcataaaattcatccgctgaaaaaaattcttttgctaatttaagagcctctatctctgaagtcttttctatatcaatacccacattaaaattagcagtagtacaaaccacccattctcctgaatgtgacagattaaaatgaaagtcagaaaaattttcaacaaaaggttttccatactcattatatttaaatctaatttcttcattattaattttatacttttggcagattagagatcggattagtaaatcccctatcagggtcctattaacgtcacatgagtttaataaacgcttcattcgttctttcttctcatttgaaaccaagttactaagttgcttaaacaaatgactttcaatattctttggtattttcacagcttgaatgtgtatgataaatcacttcctttttttaaagatggcttcatatatgtgcgttacataaattcaaattaactttattaaattgcaaatacaatagaaaaggtgcatatttacatatcaatgaaaatatacacctttcctcaataatatcatcaaagcattagtttctattacaaaaaatagagaggatttacatcattctatgagcaactcatataggtttctatgtctctatcaagtaaattttccattatcctcttaaaaattaatactcttgatatattcattattgcctacactttatttgcagttattggtctccccttttcattcatagcgttgcatcttttgcactctctacttttcagttaatgaaagggatgtttcttttatcccttcaaattcatttaataggtacttaactatcttttcaactgcggggaagtctactatttcctcatgtgatccagggactgaatacctatttactcttccttttaataaaggtccccaatctgtaaacaactcttttccttcctcagcactaaagtagataacttctccaaagtatggtatcaaatcattctctgccattaagttcaggcatttcctatgagcattgataacttgcttcaaattcataagatttgcatcaggcgggagtactccttccataattaatcgctccacaagcatatcttgcttatgaacgagcccttcttcctgctcagtaagatctctaggaatgaaatgttcagatatatatgagagcatatcctcccttgttttacgatcttgctctgaaggtactttagtatccattagtatcaacaactcaacttcctcaccttgattctttagcacagttgcgatttcataagcaattgcaccgcctaaagaccatcctccaagacgatatgggccttctggctgaacacgtttgatttcttcaatgtaaagttgaattagttccggcaaggtcaattcatcaatttcttccttttctataagaggattctgtaaaccataaaatgaacaatggttcttaagtaatcttgctagttgaatgtaacagaatacattccccataaacggatgaacacagaagaaagggcttttttctgattcttgtagtggaactagcgctgctactgatttcgtcatatcatgcttatcacgaataaggcatgcgattccttccaatgttggattcttaatcaatgttgaaaccttaatctcttttccaaacttctccctaatttttgaaactaatttaattacaaggagagagtgtcctcctctattaaagaaatcatcatttacatagacatcttctatctgtaacacatcctgccagattttaatcaactgatattcaatttcatcccttggaatgattggtgtagagaagttattttctctatgaatagttaaattgttcaatgcctttcgatcaactttgccattcgttgtaagaggaatctcgtctaccttaataaagtgtgcgggaaccatataatttggtacttgtgtcttgagatactcacgccactcatgcatactaccatctccaactacataagcaaccaatctctgctctcctaatttatcctctgttgccaaaactactgcttcttttaccaatggatgcctctctatactcgcttcaatctcttcaagttcaatacgaaagcccctaattttcacttgattatcaattcttctcaagtaatctaaattaccatcaggtaaataacgaaccaaatctcccgtacgatataaacgctcttcttcattaaatggatgacagatgaatcgctctgctgttaattctgggcgattcaagtattctctcgctatacctgcacccccaatatatagctcacctgttacaccaactggaacaggtaacaaatttttatccaatacataagtttgaacgttcggcaatggacgtccaattgttactctcttactatcttttttgatatgatagcatgttgcatcaaccgtacattctgtaggaccgtatacgttataaaaatcaatcttttcagtctctactagctgttcccataatgacggcatgattgcttcaccaccgaccaatatcttgcttggtacatgaacatcagcacttatttctagcaatcctccatctattagtaattgaagtaatgaaggtgtcatatcaaacatttccaatttattctccctaatataggacacaaattgttctgggttagtgcgaacttcacttggaataatatataaacttgaaccataaagcagcatttgtaattgctgaatagatacatcaaaggcaattgatgcattcaaaccgacgcgcatattactaggtatctcatgtgagaaaacttctttttgtaaaccatatgataggtttattacagaatggtgctgtactaaagctccctttggattccctgtcgaaccagaagtgtagataacatacgctaagttttcccctgttacctcacatattggtgaaagtttgctttcttgagaaagcattgcttggtccctatctaggcaaactgtcttaatgtctttaggaatccagcctagtaatacttcatttgtaactaacactttaattcctgtgtcttctaaaatatattgtaggcggctttccggattcgatggatctaatggaacataggctgctccagccttccaaattcccatgagaccaacaaccatctcaactgaacgctcaaagcaaaggccaactaatgactctgtcccaattccacatttctgtaaatgatgggctaattgattagctctttcattcagctctcgatatgttagttgctgtttttcatctaccactgccaacgcgtcaggcgtacgatttacttgctcttcgaatagttgatgaattgcattctcacgtggataggatatagtattattattccattcttccaatagctttctttgttcagcttccgtaatatatactagctccgatagattttgatcaatgtttttgagcatttgcattaacactttgtgtaaatgacccagcattcgttcaatggttactctattaaacttactacggtcatacattaactttaacgataactggattcctggaactacagctaaccctaatgggtagtgggtttgttctaccccttccaattcaccaatttccagattttctgaagactcctctttcactggataattttcaaacacatataaactattgaacagcggtattcctctaggaacttcactccacccctgaatctctgtcaaagaagcatactcatattgtcttctttctatctctccctcttgtatcttctgcaaccaatctattaattttatatcatccatcaattgaattcgcgtcggtgacgttgtaatgaaaggacctacgatgttttcaacatcaataatctccgtagaacgtcctgagcttgttacaccaaaaacaatgtcattttctccactatatcggctcatgagatatgcccatgcaccttgaattactgtactcaaagtaagtttattgcgtttcgcccatccttgtaacgcttgagtctgctcttctgataaatacgtaaccttctctgtgtaacctttttcttcctctttactttctaagcccagcaaagttggcgcagtaaaaccttttagcttctctctccagaattgttccgcctgctccttatcttgctctcttaaccattggatatatttcttatatggtgaggacttaggtaacttcacagcttctccattcattctcttctgatagactgtaagtaattcattaaatactaatggtaaactccatccatccagtaaaatatggtgatgggtccaaacaatccgatattcttcctcaccttcttgaatgactgttacccgcatcaatggtgcttcatcaaattggaaggcttgttttcgatctaatgccaaaaagacttttcttttttcctctatctcttcacttgtcattgtacgccagtcttctttattcactttaaatgggatattttcatacaccacttgtacaggttcttcaatttcgtcccatacaaatcctgtacgaaaaatttcatgccgctgaattacagatttccacgcctgctcaaatgtaggaatattcatttttcctcgaatcataaaactcaattgcactatatacggtgcaacatgttcatccccttggtcatgcaatgtgtggaaaatcataccttcttgcaaaggtgatagtggatataaatcagtaatctgattgttctttccgcgatgcattttgtttagtacatttgtcaaaccttcttggctaagattagccattgcaaaatccgaaatggtcagtgcagattctctatctgaaaattgaatcaatgtactcagttgatatagcatattctgtgcaatactttgaatcgttgatttggaaaattgtccaacattgtatacccaagtgaactgaagttttccatccgttacaaccccaattacatcaattacatgcgatcgcttggaaccggcagcatgatctaaacgcttaaattcgttctccggaataaacattgcatcgctagaaaacatttggtcaaattgtccaagatagttaaaactaatagacggtgtatattgggagcttaattgctcacacattgttgcgttcatgtaacgcaacaccccataatcaacacccttattaggaattttgcgaacttgttctttaactgcttttaatgcttcaattggcgtattagcactagtaatatttaaatgaactgggtaaatacttgtaaaccatcccacagttctcgataaatcaacatcttcaataatctcttctcgaccatgtccctctaaatctacgctcaatatcggctgccccgtacatgctgccgtagcttgtactaatgctgctaataatacttcattgatttggacacggtgagtgcttaaagtctcttgcaataacatacgggtctcattctcatttaacaccacagtaatttcctcagttactgcgcttactggattacttatagtaccatctaccggcaatttaactacgtcttgttcagcctgctcctcccagtaatgtagcacttcttttgataggccagtttcagcgtaatgatgtaatttctccgaccattctttaaaagatgtactcttcataggtaattgaattttctgcccttggactacttgcgtatatgctgtttgcaaatcttccaataaaattcgccaagaaacaccatccacggctaaatgatgaattgtccaaaataatcggccagcgtgctcaccttcatcaaaatacaccattctcattagcggaccatcatgtaaattcaaactttcttgtgcaatattaatctctttttgaataacctgatgccaattagcttccggcacttcgtctaatgaaatgacagtaagcatcaattgttcttctattccttcattccactgtttccaaaccccattaggtaaacgttcatatcttaaacgcagagcatcatgatgaagtagaaggttacctgccgccttttccagtgatcctatgtccaatttctctttcgttctaaagaacatggattgattccaatgatgtgggttaggatgattttgtgcaaaaaacctttgctgaataggtgtaagtatcgtctctccagttataattccctgttcagcttgtacaccttgttcttctttgactacttgcgccaactcagcaattgtttggtgttcaaatatttgttttggtgtcaattgtaaaccaacttgcttcgcgcgcgagacaatctgaatgctaagaattgaatctccaccaatttcaaagaagttatcattcataccaatacgttttgaacctagcacacgttcccaaatgatagaaagcttatgttcacgttcatttcttggggccacgtatccttcttgtgttccttgataatctggtataggtaacaatttccgatcaatctttccatttatggttagcggtaattctttcatttcgacaaagtaggaaggtatcatatggattggcagttttgttttaagatactctcgccattcttctaaactgccttcgcccactacataagctaccagcctcttatctcccgactgattttccctaaccattacaactgcctcttttactaagtcatgctcttgtaaagtcgactcaatctctccaagttcaattcgaaatcctctaatcttcacttgattatccattcttcctaagtagtctatattaccatcaggaagatatctcacaagatcacctgttctatataacctctcgccttctttgaatggatgagaaataaatcgttcggatgttaactctggacgattcaagtacccccttgctagacctgctcctccgatataaagttcccccattacaccaactggaactggcaacctatttctatctaatacataagtttggatgttaggcaatggacgtccaattgttactctcttactatctttcttgatatgatagcatgttgcatcaaccgtacattctgtaggaccatatacattataaaactggattttatcagtctctactagctgttcccataatgacggcataattgcttcaccaccaaccagtaccttacttggaacatgaacgccatcgcacgtttctaacaatccgacatctataagtaattgaagcaatgaaggtgttatatcaaagatttctaacttgttctccctaatataagctacaaactgctccggatcacttcgtacttcgcttggaataatatacaaacttgaaccataaagcagcatttgtaattgctgaatagatgcatcaaaggcaattgacgcatttaaaccgacatgcatgttagatggtatctcatcttcgaaaacctctttttgtaaaccatgcgacaagtttattacagaatgatgctgtatcaagacaccctttgggttccctgtcgatcccgaagtatagataacatacgctaggttttctcctgttacttcacattttggtgaaagaatgctttcttgcgaaatcattgtttgatccctatctagacaaactatcttgatttctttaggtatccaatctttcaatgactcgttcgtaactaatacttgaattccagtgtcctccaaaatatatcgtaggcgactttctggatatgatgggtctaatggaacataggctgctccagccttccaaatccccataatactaacaaccatctcaattgaacgctcaaagcaaagtccaaccaatgattcattcccaattccgcattgctgaagatagtgggccaattgattagctttttcattcagctctcgatacgttaactgctgtttttcatctaccactgctaccgcatcaggtgtacgatttacttgctcttcaaacagctgatgaattgtactttcctgtggatatgctacagcaccattattccactcttccaactgtttttgctgtaatcctgataatataggcaacttagctaatgatttatcaggattctccacgattacattcaaccagttcccaaaatgttcagccatggattcaatagttaagctgtcaaataaatcagttctataaacaaaagtaagtaataaaccctcttccacttctgcagcagttaaacttaaatcaaacttagcgatcggagcattactttccattacttctatatttcttccatgtaattctggtagcttctgtcccgtattttgcaaagtaaacatggtttgaaaaatcggagaatggcttgtatttcgttcaggttggataacctctacaattttctcaaacggaacatcttgatactcatacgccttcaatgcttttatccgtacttgagataacaactcttgaaatgccggtgcattacttaaatcagctcgataaaccaaagtgttgacaaagaaaccaatcagcccctcaatttctcgataatttcgatttgcaattgggctaccaacaataatatccgtttgtcccgtataacgagcaaggaaactttgatacgatgccaataaggtcatgaaaagtgtggccccttcttgacgacttagttcgtttaatttatccagtaatgagcgtgacaacaaaacattatgagttaatccatgatgggtttgcactggcggacgcggacgatccattggcaacattaagactggtaactcaccagataattcttccttccaatatgcaagctgttgatatagtacttcatctttcaaccagtctctttgccactgagcaaaatcggcatattgaactggtagtggttccagctctgcttgtttttcaccaatcgcattctcataaaatgccatccattcttgaagcaagatttccatcgaccacccatccgagataatatgatgcatattacacagaagaacccattcttcttctgaaattcttatgagtttcccacggaataatggcccttgttctaaatcaaatggagattcgacttcagtttgaatccattgctccagctttctttctcgctcctctaatgaaagcttagttaagtccatttgcagaagcggacggaaaacgtacggttgaatctgctgcacaggatggccatcctcttcataaaatacagtccgcaaagattcatgacgctctatcaactgattccatcccaattccaatgcttcaggtaaccaattccctgtaaggcggcatgccattggcatattataaagggcactattaggtgcaaattgatcaataaaccataagcgctgttgggcataagatagtggaatattatttccacgttccatcggcaccaatggtggaatttctcgtttttcattccccttacgtaactgatccattcgtttcgctaatgcctcgatcgttgaatattcgaacagttcacgtactggcaatttgatttgaaagacttcctgtaagcgcgagaccacttgtgtagcaagtagagagtgaccaccaagctcaaagaaagaatcctgaacaccaatgtctcctattcctagcacttgactccacactgaagcgataagttcttccagcggagttcttgggtatacagtattttcagcggattgttcactaagtataggcaatgccttcaaatcaagttttccattcggtgtaagtggtaaaaattccatctcaataaagtttgttggaaccatgtaatttggtaaatgtgtttgtagatgttctcgccattcatggacacttccttcaccaactacataagctactaatctcttatcaccttgattatcctctcgtaccaatacaactgcttctttcacagaagaatgtgcctgcaaaacagcttctatttctcccaattcaatccggaaaccacgaatttttacttggtcatctatacgtccatggaactggagattaccatcagaaagataacttgctttgtctcctgtataatagagacgttctcctgacttgaaaggatgtggaataaatttttcctttgtaagatccggacgattagcatatccacgtgcaagactcttccctccaatatagagatctccaattacgccaattggtactagctgaagatgagaatctaacacataaacttctgtatttgcaatcggtcgaccaatcgatggcgtacctgttgtcactcctacaggtacataacaatctgtggtaacaacggtattttccgatggaccatactgattaattaccgcaaaaggaatatcgttagatgggtactgcgttaattgatccccaccagtaatgataaaacgaagatccgttttatctggccaagataatttcaagagcctttccagaataggcgtaggtgcaaagctagctgttattcgtgaatcaatgagccagtcccttagtgcttctggattaattctcagttcctctgttgacaagtagagtgctgcgccagcagttagatacggccaaatctcctgcacagccgaatcaaaagcaacccctgcaatctgagtcgcacgatcctctgctgaaatatgataaacttcctgatgccaagaaaccatattcattaatgagcgatattcaaccatgacacccttcggttttcctgtagaaccagaggtataaacaatataggctaagttctctggatttatttgacgtgtaggtgcgattacgctttccaccgttaattcttctaacctcaccatttcgacgtgtgcgaaatggccttcttgtccttccgccgtcactacaaattgaatccctgcatcttcaatcatgtattctaaccttgattttggatacaacggatctaaaacgacataagctccaccagcttttaaaatgcctagtaaacttaccattagctcagctgacctcggaagataaacccctaccactgactctggggctactccctttcgctgtaaaacatttgccaactgatttgcttgtgtatccagttcaccataagtccactgttttgtttgatcaactatcgcaatcgcatcaggacgccttgctacttgctcctcaaatttgtcgcaaataagaccctgatgagacatttctattacagtgtcattccatgtttctaataacaaagtacgctcgggttctgatagcatgctcagatcatgcaacggattttgtgggcgatgagaaacttcatgtagccatttctcaaagtgtcctgccatccgttcaatagtagtagcattgaataaatccttattgtactcaaaagtaaaaagtaatccctcttccgtctcaactgccattacacttaaatcaaactttgcaattggactatggctttctatcatttcaatacttctactagataacaccggtaacccttgtttcatattttgcaagatgaacatagtctggaaaattggcgaatgacttgtacttcgctccggttgcacaacttctacaattttttcaaatggaatatcttgatattcatacgccttcaatgccttttgacgaacctgatacagtacatcttgaaatgtcggtctaccactcaaattagctcgataaaccagcgtgttaacgaagaaaccaattagtccttcaatttctctataattccgattcgcaattgggcttccgaccagaatatcttcttgtcccgtataacgagatagaaagctttgatatgcagctaaaagcgtcatgaagagcgtagccccttcttttcgactaagttcattcaatttatcatgtagcgtgcttggcagaaccatagtgtatgtcgacccgtgatgagtttgtattgcgggacgcgggcgatccacaggaagttggagtacaggaagctccccagacaattcttccctccaatattggagttgttgatcaagcacctcctcctttaaccatcctttttgccactgagcaaagtcggcatattgaaccggtaatggttcaagttccgctacctttccatccgttgctttctcataaaatgccatccattcttcaagtaggattcccattgaccatccatctgaaatgatatgatgtagagtacaaaggagtatccattcttcctctcccacgtgcaaaatacttgtcctgattaatggaccctctgttaaatcaaatggtacttctgtttcttgttgaattaaacgtttaacttcttcttcttgatcttcagaagaaagcatagttaaatccgttttcggaattgattgaaaagcatacggttcaatttgctgtacgggttgactattcacctcttgaaagaccgtccgcagtgattcatgacgttctattagttgattccatcccgtttccaatgcttcaagtagccaattccctgtaagacggcataccattggcatattgtaaagggcactattaggtgtaaattgatcaataaaccataaacgttgttgggcataagatagtggaatagcatctcctcgtttcattggtattagtggcggaatctctcgttttttatctcctttacgtaactgttctaatcgctttgccagtgactccaccgttgtatattcaaatagttcacgtactggtaattcgatttgaaaaattctctgtaaacgtgacactacttgagtagctagtagtgaatgaccaccgatttcaaaaaaggaatcctgaacactaatattttttattcctaacacttggctccaaacggaaacgatgagctcctccactggtgttcgtgatgaagtaatatcttcacttatgaactgttcttctaattccaataatgctttccgattcactttaccatttggagtgagtggcataccttcaatttggaaaaagtatgccggaaccatataatgtggtaattgcttcttgagatattcacgccattctccagcatccccttcacccactacataagctactaactgcttatctcctggtcgttcttcctttaccaacacgactgcctcttttacagatgcgtgatcatgtaaagctgcttcaatttctcccaattcaattcggaatcctctaattttaacttggttatctattcttccaatatattctaagttacgatcattcatatatctcaccaagtcacccgttcgatataatcgttccccgtccttaaaaggatgcggaataaaacgttcagcagttaaatccggtcgattgaagtagccacgtgccaatcctactcctccaaggtaaagttcccctgccacaccaatcgggaccacttgttgatattgatctaacacatacaactctgtattatcaatcggacgaccaatcggaataagcattgcttctttttctaaatcacaatcgtaataagtcacatccacagtcgcttcagtaggaccatacaagttaattaactttgtttgctgaacattgtaaaagatccccttaaaccggcgaacctgctcagtgtttaacgcttctccactagtaaaaacttgaattaaagacgatacatcccttttcgaattatatagttccatataatctaagaaagtagataacatcgacggaacaaagtgcatggtggacacgcgatatcgttcaatatactcctcaatcaccgcaggatctttctctcctcctggtggaagtaaacaaacacgtgctcctacaaatgaccaccaaaataattcccatacagaaacatcaaatgaaaacggtgtcttttgtaggattgtatcctcctcggacaatgggtattttctctgcatccactgtaggcggttgataacggaatgatgttcaatcattaccccctttggatttcccgtcgaacccgaagtgtatataatataggctaagttatttgctgttactccacttaccggagctaaattactctctttagaaatcatcacttgatcccggtctaaacaaattgcttgaatatctttaggtaaccagtcctgtagtgcctcttttgttaacagcgcttgaatttgtgaattctccaaaatatatctcaggcggttttcaggataacttgggtccagtgggacataagccccacctgccttcaaaatcccaaagagaccgataatcatatcaggagaacgttcaatacatataccaaccaatgattcaggtccgatacctcgtttttgtagaaaatgtgccaattgattcgatttttcatttagttcttgatacgttagctttccaccctcataaactaccgccactgcatcaggcgtccgtgcaacttgctgctcaaatagctcatgaatcatacaatcatgaccataaactacgtccgtatcattccattcttctaggagttgattttgctcagtatccgatagcattgacagctttgtatatgattcatctggatgatacgtgatttcatttagccagttctcaaaatgtcctgccatacgtgcaatggtactactatcaaataaatccgtgttgtattcaaatgagacgaatagaccttcttccacttcataggcagttaagctcaaatcaaatttagcaatagacatattactttctaccatttcaatacttctatcaggcaaatctagtcgttcttgttttatattctgtagcgtaaacatggtctgaaatataggggaatgactcatgcttcgttcaggttgcacagcttctaccactttttcaaatggtatatcttgatattcgtaagcttttaacgcctttttctttgtttggttcaaaatctcccgaaaagtaggggtgccactcaaatctgatcgataaaccaacgtattaacaaagaaaccaattaatccttctactcccttatggttccgatttgcaatcgggctaccaactagaatatctttttgtcccgtataacgagcaagaaagctctggtatgcggccattaaagtcataaataaagtagatccttcttgtcgacttatatccttcaattgactgagcaatttataaggaaaaatcacatgatgcgcagccccagagtaagtctgcttaaccggtcgaggtcgatccactggcagttgtaagataggaagctcaccagacaattcttcctgccaatacgtaagctgacgatttagcacatcaccttgcaaccaccccttttgccacttcgcaaagtctgcatattgaatagataatgaacttaatttagcaggatttccgcccgtttcttcttcatagaaagcaaggaattcattcatgaatataccaatggaccaagcatcagaaataatatgatgcatcgtacacagtaataaccattcatccttctctaattgaacaagctgattacgaattaaaggaccattcattaaatcaaatggttcttgcgcttctctcgcaattaaactatctacctctttttcttttacttctagaggaagttgagagtaatcccttacaggtaatgctctaggaaggaattcgacaatttgttgcacaggctgttctcctatttctttaaaaacagttcgtaatgattcatgacgttcaatgagtcgattgaatcccttctctaatgcttcaggtatccaatttccttttagatgccatacggttggaatattatataaagaactgtttgggttaaatctgtccataaaccacaaacgttgttgtgcataagacaacgggagtgcttctttattctcctttttttgcatttgcttctgaagccatgctctcttctcaggagaaagtgaactcagctttgcaagtaaatcacttctcatttttttaccccttcctcaatcaaattactctcaaatatcccttgtgcttcttcctctgataactcttctaattgcttaagcagttccagtaattcttcatcattactcacttctgcttctttttgaatataatcttgaaggcttatattctccttactatcattctgcatttcttgatttttgttatcgagcaattgatcaatctgttctgccaattgctgcaccgtatgaaacataaataaatcatgcaatgatatctcgattccaaaagcctctttaagattggaaacaacaagcgtagcaagtaatgaatgtccaccaatttcaaaaaacgaatcttgaattccgatgttttccatgcctaaaacttcatgccatatcgaaacaattgttttttccgtagacgtacgaggagcaatataacaactcgctatctcctgcttctctggtgctggtaaagccttcctatcaatttttccattaggagtgagtggaaatgcatttaatccaacaaaataggatggaatcatataatttggtagttggtccttgagataatcacgccacttttgagcaccccagtctcctacaacataggcaatcaaacgtggatcgccaagataatcttcccgcacca

SEQ ID NO: 1333 - DNA, 11501 bp, Bacillus thuringiensis
tagaagagactgcggagtaaatgaatttaccaaaatcgtatattgaagagttaattcagcaaaagaaaattcgtgcgctattcgatggagagcaatatttagtaaataaagaacaatttaatacacatttagaacaaatggagaaatataagcaattagtggaagaaatattgaacgaaccaattccagaagatatggatgttaaagacgaagattaaactatggaaaatcccttatgaagatatgcagaaatgtatattcataagggattttttgtttgaagatatcaaaaacataaggagttcttagcctttcttcaaattttgataggtagtagtctaccatgttaaaagcatatttttttctagctaggacaaacatagagaacgtaacctgtacagatacatatactatcagtgcaaaagcttataaattaatggaaggggttttctcgtgagtttatttcattgtgattttctgaaagacttaattggatcttttgtgagagtaaacaggggtggtccagaatctcaaaaaggaacaatagtcgctgtatgttcggattactttgtattaaagaatgaaaaaggagagctctattactatcagattcgtcatctgaaaagtattacaaaaaatgcgaaagattgtaaagcagatgattgcagatggttggaatgtgaatgtgaagatgactttgaaaagttacttcaaagcttcaaatattgctgggtgaaaattaatcgtggtggcccagagaaagttgaaggtattttacaagatgtttcttgtgaatttgtgacactaattgtaaaagaagaagttatattagttgcagtatctcatattaagagtgtcgcagtagcttgtagagaaagcgaagaaagcgacagtgaaagcaatagtgaaagtgatgattcgggtcgagctcgcgcacaaagacagtcaagaagaggaagataataagaaaggaggatacaaatttggaaagtatattatgctgtgaacaaattaaaggcttagtcggtgagactgtaaaagtaaatcttcgtggaccagagagtcgagtgggggtacttgtatcgttaggaagagattaccttacattacaacttcctcttggtgaattagtatattaccaattgaaacatgtgaagagtctagttaagaaagtgaaagaaagtaaatgtggcgatggctatgtttcatgtttctgctctgatgatgatactttcgtcgatgtattacgtgacttgaagtataagtgggtaaagattaatcgtggcggcccagagtgtgtagaaggcctattaagtgaagtgcatgaagaatgtattacgctagtaaacggtgatgaagttatttatatcattaattatcatattaagagtgtgagtcaagtagtgaaatgtaaaaagaatgaagatgaataatgtttaataaataagaggggcattatgagggaaagagaagaacaatttcttatttcgatagtatgaaaaggaattacttactattaagacagaacattgccctgattatttttttgaaatggaagatagtaaagctgaaattcataggaaggaggatatagatgaatgagttaaacaaaagtattggggaaaatatatatgttaaattaatcggtgaaaaaaggtttaaaggtatattaatagacgtaggaaatgacattattgttctttacaatggacaagactatgtatatatatctttatatcatgtacaatactataaatttttaagagcacatgacgaagacatactaaaaccagatgttgattctgtaattaagagggaatccccttcaatttctttgagaaaagtattaagtacttctaaagggatttttacagaagtttatgtagcaggaaatgctccaatacatggttatgttacaagtgtgatgaacgactatattgttttttatagtccggtttataaaacggtatatatatctttaaagcatttaaaatggttaattccgtataaagaaaaccaagtaccgtatgccctcaataaaaatgaactccccgtaaatccgttaaatattacgttagctagaacgtttgaagaacagcttattaaaatggctgggaaaattatggtgttcgatttaggtgaggagtccaataaaattggaaaaatggcgaaaattgatgaaggtcatattgaaatatcaaaagcacgtgatgcaaaaatgtatgtgaatattcaacatgtaaaatccgtccattgtccgtagattagttgaaagggctggctttttcttttatccggagaagaaaaggtcgagcctatttgttttagtctaatttggatatgaggggaaaatgaattgaatataaacatattatagtgtgattttttaaaaggtaactgtgcactaacttataaaaattgtgtacgagctatcttattatgtattcaatttattttttgaggaggagctgctcaactaatttattaaaggggttttgtttgtggagcagtttccgaattcgttatcaattacattgcttggtagtgctggtggagcagcaaaagcagttttagcaattttaaatcaagcgatagtaaatgaaaaagatccaatttataaagtattaaagaatgccaaatttcatttggtggatataaaacaaaaagataggacttattatgatgagctgttttcgaatttgaaagatcaattatatttatatgaaataaaccttcaaaatgtagtggaatttaaaaaacatttaaaagaaaaaagaacgagtgttgtgattgatgtttcaggggcagatacaattagagtattaagctgttgtaatgaactaggaatttgttatattaattcagccttggaaaatgaagcagtagatcaggacgacagcttaatcggctttcagcttacggaaagatatacaaggtttgagaaggagaaagagaaatttacaaatacaaaagcgattataggttcaggtatgaatccaggtgttgttcaatggatggttgttgagcttatgaaggaacgaccaaatgaaaggccaagagcatgttatattgtagaacatgacacatcatttttgaatgatacggcacttataaagccacatacactttatgcttcatgggcagtagagcgatttttagatgaagcgatctggagttatccgatgtatatgagttatcatcgtcctctttacttttatgaagatgtatatgcttcagagtataaagtgaagttaggagaaaaagaattatatggttgcttaatgctacatgaggaagtattaattttagggaaaaacttcaatatggaagttggttttctttaccgaattaatgagtatacaacaaatataattagacagaacttagatcaagtagaagatttatggaactggaatcgtaaagtgtttaatccagcggaagaagaggttgctggagaggacttggtcggtgtgttactcgtttatgaaaatagtgagacatatatgtataatgtaatgaatagtagccaagtttttcgtaaatataaaacgaatgcaacgtattttcaggtagggtgcggaatttatgcgggcttgtctagtttacttttagatcaatttgaacaaggtgcttattacgtcgaggagttgttattaaatacagaaagtaagtacggtgagtatttaaatttatatatgaaggattttgtaatagggcataataattttactgatggattgttacatgatagggtaaggtggatataagttgttactaaaaggaaggagagatctccttccttttagtattataagtttaaatattgccctgaaagcaatttcatacttatactttaaggagataacaatgaaagttttttgtatcgatcaaggggagtttttatatgaacaaatacaagagcttgatttatgaagaaagaagagccttaaaggtatttatattattattttatattatattctttttatatgacgctatatattattttgtatatcctgctatgaatattagtggaacagcggtagggtggccagaaggtagtcttgggataggtgtgcctatatttgtaatagcattatttcctatttctatatatcttcaaaaaagagggtatgtatattctgtaaaatatttatttttatttggatacatgtttatcaatcttgttaataatttaatgatttatttgcgaacggatagaccttttgaacatggtagtatggtagaaatgttgttaattttatttgccccagttttcgtgaatagaaaatacttttatttagtttcctttagtgtaattggaaagtacgtatttttcacattgctattacaagatttaaaagtgataattccacttgttttatgtgtattttatttcattatttcacattctttattaaaacgatttcaatcttatgtaagaacagtggttgaaatgatgaacaatatgaaagagacggaaaatttagctgtgattgggactatgtctacaacaattgcccatgaaattcgaaatccattaacagcgttaaaagggtttacgcaaatgcaaaaagaaagaaatccaactgatacgatgagctacgacattatgctacaagaaattgaaagggttaatggatttgttagtgaattgatgttgttagggaaaccaaagccaacaaattatgaaaggtgtaatatacgagacacccttctatatgttgtgcatctaatggaaagttatgcaacgcaatatagagttaaatgtcatttacaagtagatgggaatttaccggctataaacggtgatgataagcaattaaaacaagtgttattaaatatcattaaaaatggaatagaatcaatgccagagggtggagaaattcatatccgtgcatatcaaaaaacgcaaggatatttgtgtatttctgttgaagaccaaggatttggtatagagaatgagaagttagaaaaaatcggcaaggctttttacacaacaaaggagaatggtacaggacttggattaatgattacatataaaattattaaggaacatcaagggagtatcacgatccaaagtagtgtaggagtaggaacgaaagtagaaatttttctgccgaccgtttaatgtatttgagaaaagatttttcagaaaagtgttcttgttgtgtaaatataaacattttataaaatgtttcaagaagggttttttttataaaatacttcgtttataatgaaggaaaatatcgacatgagattgattgctcatgtaacggttcagtagtgttatgaaaagataagaaggggtgcacgcgcatccttttttctatgcagatattatgaaagaggtggtatgatggaattaacattaaattcgactgtatgtttacacacgattcaatttcgaaaagagcaaaagaattatactgtaaaagacacaattacaggagaaaaatatgaaatgccgccactttggattgatgcattggcaatgatgcgtgacggttttttattgggggaaattgaggagaaattaaaagaagagtatccatccgaagaagtgaatatgttagcattcacgaagcaactgttagaactagaacttgttgaaatggtagatggggaagaaatagcttgtacaaagaagaaagagaaggattatttagcttggttacgtcctcatgttgagcaattctttcttaatttaaataaaaaaaatagaagcaaaggtcaatgatgatctttgcttttttgtatagtttgtttaaaaaattacagcaaatgctcttgcaaaagcaccgtcgctatctttaatttttaaaggtgctgctgagaagaagaaacgtttcgtgtgaatggcatctaagtttgttaagttttcgattaaataaatattattcccaagtagtatgtgatgaattggtgatgtttctgtcgttacctcatcaggagaaataaaatctaaaccgacagattttacttttaattgtactagttcctcggctaattcttcagaaagataaaaagcttctttctcatacgcctctgtattccatttagtagatagattggaatggaaaataacaatatctccttcttttatatcggcatcgtccagtacttctttaggtagttttcgttcttgtacatgagttacatcaataagaaccgcttcgcctacaaattgatttaggggtaattgatcgatggtcgttgcgcctgaaataaaatgcgcaggagcatcacaatgcgtgccaacatgaacgacagaatgaaaatctgtaacttgatagcctgattcttcaacacttgtaacagcttctagttgtattttaggtgttccaggaaattgagacatattattttcaaatgtttgcgataaatcaattactttcattttacatacctccaatatatgtttttcaaataataaaaagctcacccttcaatatcaagaaaggtgagctttacatgctagttgagttttatcttccaaaatgcaatgcattttgcaggaattagcacctattcagttcgtataaactgaggttgctgggcttcaaagggccggtccctctgcctctcttgataaagaagtatttaattttgaaatcggaattttccgatagttaaattgtaattcatttcctttttgcgtgcaatacaaaataggtattcacccaaataaagctacgcgcatattgtagcttatgtaaatacaatgctgcgaaggagtgagtgcagtgacaggaaatgtattgaattattatgctggtggtaatacagctaggggatttcataatttatatgaagagaatttaaaagggttagacagattatttatcttaaagggtggtccaggaacggggaaatcttctttaataaaggccatcggtcgtgaatgggttgaaaaaggatatgatattgaatttttacattgttcttctgacaataaatcggttgatggtgtaattatcccaaaattaaaagtaggaattgttgatgggacatcaccacatgtaattgagcccaaaatgccaggagttgttgaagagtatataaatttaggaattgcttgggactcagataaattaaggaagcagaagttagaaattgaaagatttgtttcagaagcaagtaaagcttttcagtctgcttacgcacgttttaaagaggcattgcttatacatgatgagtgggagaagatatatattgataatatagattttaataaagcaaatgaactaaccgatcagctaatccagaaattatttgcagataaaagcgggagaaaatcgcttgtaaaacatcgttttttaggagctgctacaccgaaaggagcagttgattttgttcctaatttaacagaagggttaccacatcgttattttataaaagggcgcccaggttctggaaaatcaacgatgcttaaaaagttagctaaggcagctgaagaaaaagggtttgaagttgaagtatatcattgcggatttgacccgaatagtcttgatatggttatcgtaagagaattaggctttgcaatttttgatagcaccgcaccgcatgaatattttccaagtcgtgagggtgatgaaattattgatatgtatgcccttattgttacgccagggactgatgagaaatatgcgaaggaaattcgtgatgtttccattcagtataaagcaaaaatgaatgaggcaatgtctttcttagcgaaagcaaaatcggttcgtgataaattagaacgaatttatattgctgctatggatttttcaatagtagatgcatataaagaggagattcaaaaagagtttgaacgaattgctgctactgtaattgaaaagcaacaatagaagttttattaggctgtcagtaatttctgacagtttttttagtatgtagtaaaattaatagtgtattgtcgaatttccaaggaaataatcaaaaaatggagatgttatgaaatgagagagaaaatcgagttggagttagaaagaattgaaaaagagaatgatgtgaaaattttgtttgcggtggaatcagggagtcgtgcttgggggtttccatcgaaagatagcgattatgatgttaggtttgtttatatacatccggtagaatggtatttatcaattcatgacaaacgagatgtaattgaatatccaattagtgatgatttagatataagtggttgggatattaaaaaggcgttgcaactattcgcgaagtcgaacccagctttacttgagtggattcgatcaccaattttttattcgaaaaactctaattttccagaactacttcaacagatgagtgagaagaattttgatccaaaagcaacgatatatcattatttacatatggcgtcgaaaaattatcgtgaatttttgcaaggtgagaatgtaaagctgaaaaagtacttttatgtattacgtcctattttagcttgtaagtggctagaagagaaagcaactttaccacctgtagaatttgatcgattgattacagaattaccattagaacgtagtgtattagatgagattgaaaagttgttaataaagaaaaaagcaggtactgaattagatgttggattgaaaattaaggtgctaaatcaatttttagaagaacaaattcattactatgggcaatatgtaaaaggaattgaaaagggatcagggatcgatattgaaattttaaatacactatttcgagacatgctgtttgaagcatatgaaaaagagcacaagtaagtttgtgctctttttattttgtaggaatgaagaaaacagatatagctgcgataagacctgcaaaggagaataagtaaaaattccatgctaagtcatattgtattgtcataataataccgacgagaatagggccagcaattgcaccaactcggccaagtcccagtccccagcctaaggaggtagctcggatatgtgatgggaagtattgtgttacatatgcatttaatatttgagtaataccgaccgatccaataccagcaaggccaattaaaagataaatgattgtaacagatggcttgattgttaatagtccgatacatatggctgccataagataagagatgctaataacaatttttgcgcctatacgatcagcaattgctccagcgaataacgcaccaacagctgcggtaatatttagcataagtagaaaagacagactagatccaagaggatatcccgcctggcgcatcatctgtggtaaccaagtatttaaaccgtatattaaaaacattcccattatataagtgatccaaaaaagtagtgttgcttttatgtattcttttgagaataaagtaaaaaatccatttttctttcgtatagtagatggagcttgatgagttttattttttacatgaaattcaatttgaaaacgattaagaatttggttcacttcttcttggcgattacgtgataataaaaattgaatggactcaggtaaatagcgaataatgaaaggaatgaggagtagtggaatcattccgataccaaacataattctccatccgaaatcttctaacataaacatagacaaaatagcacctaatacgatacctaaaggatagccagtaaacataagagcataaataaaagattgccttttttttggtgaatattcaacagtaagtgctgaagccgttgggataacaccgcctaatccgattcctcctataaatcgagataatccaaataactcaggagaagaagcgatagccgctaaacccattgtgatagaaaaaagtgctaaacagcatataagcgtccatttacgcccaattagatctgtaatcgttccaactagaatagccccaataaacatcccaaataaagcatagcttgcaattgtaccagcgtgcgctggtgatagcgcccagcttttgtcttctaggagctttggtagaacggcaccgtaaatacctaaatcatatccatcagctaaaatggctagccaacaaataaaaacaacaagttttgtaatagagcttgaaaagatagtttctgtagattctagatgaggtggagctaaaggttgcataatattcaccccttttaatttgtagatgaatatattattttatttaatgttaatattttccttcctgtgtcgaaatttatctgaacaggttttataacaaataaagaagttcaaccgtaattctgttgaacttctttatttgtttactcattatcaacgcgttttaacggttgatctgctgggccttcaagaacgtctccctcaattgaaaaacgagaaccatggcaaggacaatcccaagtacaatcaccattattccattcaacttcacagccgagatgtgtacaagttgtatcgacgatatgtaattttccttctttgtccttataagcacctgctcgtttaccgttaacatgtacgacagatccttcaccaacttcgagatcttctggcttacgtaatgcggtttcaatctttccttcaattaaatgtttcgcaacatcaatgttctgggagaggaacgtttttatatctggatttgcatggaagcgtgatggtgcatacagttctttatagggactgtggacttttaggatggagtccttcagtaggtgagcggcagcagttccagttgtcatgccccatttgcgatatccagttgcaacaaatatatttggatttctttcgttaatatgtccgatataaggaagcttatctagagtgattaaatcttgtgctgaccatctataaggaacttcgtctattccaaaagttgcttcagcaaaagaataaagtgcttcataatgaagcatcgtatttattccttgtcctgttttatgactctctccgccaatcaaaattaatttttctccattgtttgttatatagcgtaaggagcgctttggatcatcaatacttaaatacatgccacctggataatccgtttttgcttttattgcaagagcgtaggagcgttctgcgtacattcgcgtaaagaaaaagctatttgcatcataaaaaggaaaatgtgaacaagagacgacatattcacaagtgatatgatggccccatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggatttccggccatttttctttagtagggtaaacaggcggattaaaacctttgttattatacgggtgtttctctgtatcgcttgatataacagggatagatgatcttgaatcatcccaattgctttatattcgcttagttctcttttgtgcttttgcaacagaagttggcgcatcttaaacatcgtggaagaacatataaaaatggcaatgagt

SEQ ID NO: 1334 - DNA, 10585 bp, Bacillus thuringiensis
cattccgcttttccgtggtgagaaaggacgatgtgttgaagaattaatacttcttctgcatcgatttgcaattcgtctgctgctttaccaatttcgttcaccataatagaaatgtggcctagtaaatttccttctaacgtatacgttgtagaaattgggccagatagttcgattactttaccaaggtcatgtaaaataacgcctgcatatagtaagtctttatctaacgatgggtatagatttgagatagctttcgctaaatcaagcattgatacgacgtgataagctagtccagatacgaactcgtgatggttctttgtcgctgctggatagtctaaaaattcgttttgatgcttatttaataaatgtcttgttagacgctgaatgttcgggtttctcatttcaaatatgtattgcgtaattttctcaaccatatcttcttttttcactggtgctttttctacgaagtctgagatatctgttacttcattttcattcgcaacacgaatttgtttcacacgtaattgaatacgtcctttgtagtttaaaatatcaccagctactttcacgattgtttccgctacatattgtttctcaacttctggtgatacgtcccatagcttcgcttcaatgtctccacttggatcttgtaagattactgttaaaaatggctttccattgcttgcgataccttttgtcgctgttttaattaacaagaaaatatcgacttgttcaccaacttcatactctgcaattttctttttcattcgaattcctccaccaaatcagttacttttagtatagcacactacaactcattttctttacgcatatgtgttaattttataatctgtttttctggaaaatacgcaagtaaatgcgcatgacatgtaaagaatatgacttgtctatcctttgcaatttcctttataagttcaatcgttcgattcgtccttaccgcatcaaaatgcacgaaactatcatcaataataaatggataatcatgttcgaatgttttcgcgagcgcaaatctcagcgataaatataactgctccgctgtcgcttggcttagttcatgactgtaaaaacgcataccatcgttacgttcaacgataaacggttctgcctctgacggtgaaaagattttactatagcgtccgcctgttaaatagacgaaatactcttctgatttttgtaaaatacgaggaagatgaacttcatgataatagtgcttcgttttcgttaacactgtctttgcggccgcataagcagcccacttcttcacttgttcacgcacttgcgcttttttcatttcccattcatgcattaaatcgccgtacgtactaccttcttctaaattcgcaatttccatacgatgtttcgcaatacgctctgtcagttctttctctttcgtaagacagttttggacagttgtaatttcttgctttaattttccttcataaccgtcagcttcataatgttcagctaatgataaactcgttaaacgttgttctaacagatcaatttgcggcaataaacgccccacttgcttctctgcatcctcacgtttttccgctaatttacctgcttctaaaaacacctcttcatctatagactctgcaatatgccataaaccatctcgttctattagtaattgctttaattgttcttgcataaactcatattcttcttgccattccgccagtttttcttttaactgcttacaagtttggcgcttctctttctcattttgcatacggctttgtgcctcgtgtagcttactatactccgcactaccgataacagtttctagtttatgttcaaattgcgaaatcatttcatataatgaagattttcgcgtaccttgcttctctaactcccgatataattgctgcattttttcaatacgctcaaacgccggcaagatgtgtgcatacgtataaaattcaggaaacatatagcgcgttttatatgcatcgacttgttctcccgcctggaacgtttctctctcccattcctcatacgatgaaacgactttatcatacgctcgttccaattgctgtaacttataagactcgcgctcaaataacttccgaatctcttcatctttttctaactgatagcgaacagacatcgcttcttcactttgtctcccgccagcactttgctgaagtgtaaggagctcttcttgtaatccacttgatggatctttatataaaacaagggcgagaacaatccctacaaaaacaatgacactaataaataagagcgctcggttatctataaataagcttgtgaataaaacgcctgtgttaataagaagtaaaagaagacaaactctttgccactgctttttcttttgcttagctgctcctgctttctcttcatacttgcgcttcattctctctgcgcccataccgataaacgccgcatcttggaacgatttctctttctcaactaacacatttctctcttcatccgctaacatttgtttcttaatctgccttatattttcttcttgttcttctaattgctcttgcgctactttaaaacgatcatcgagctgtgctttttgcgtttctaattcgcgcgccttttgcactgtttgcgtaattaactctttcgttgccaaactcatatcaaatgaaagaactgtttccttttcaaaagtagcaccaatttgttgttctagttctgcgatttcttcttttatattcgtaatacttcctgtcatatcacgcatttcttggcgtgcattttcgtaagacatatgctgcatacgaagttcttctacataactttctttttgtaaaaactcttcatctatttgaatcgaggcaatttccgattgcactgtctcaattttcttgtggagcgaatcaacttgtaattgaagcggctccatcttcgccttaattgcttcataacgcgccattccgtttacaggaaactgcccgctctcgttctctaacactttctcgtgcgcacgcttttcaataacgagaggctcaagcgctgctaatatttcataatcttgcttccgcttttctgcattctctttttccacgcgaacagaagcaagtttctcttcactttcttttaactgctccacttgcttttcatacgtgccaattttcccttgccactctttcatcttctcttcaagtttcttcatctcttgcaatgacacgttaatttctggtttacgaccactcggcttgaagcgctggtccatttctttttctagctttttatctaactgcaatagcgcatcacttccgactgcacttgccgaaaataaataattgccaatatctgcttcgccaagctgatgaatgttttgaaggccatgcatatcaaatgaaaagacagattcaaataaattttcattcatcccgcttaatatatcgtttaaaatttcttctccgcccgttttcccgtcttcaaaataaacggtcacctcgccagctgccgtctttggcaatcgctcaattttcaaacgaccgtactgctctgtttgcacagtgatcgcaccgccatacttcccgccttctttcggctcataacggcgctgtcctctcgtcggaaaaccgaataaaatacttttcataaatgagcgaattgtcgatttccccgcttcattttcaccgtataacactgtcagcaaggaaagatccatttccacattttctaattttccgtacccataaatatggagtttttcaattctcattttttatccctctcttgctggaataattgttctaaaataatattttctgcttccttttgaatctctttcttctcttcttctgtaaaagattcaatactattacgcgctacaggagatgtccaaatagtgcgcaatactccgtccatattagtgaaagcttctaactcctttagcacactaccgacgaaatgattttccgctttcaaacgttcgatttccgcaaaagaaaccgtctcatttttccacttcattgcatatacgaaatcttttcgctcttctccagatgctaaaatgtgaaaaatctcttccacacgcttttcgtcgcgcaaataaggtgaaagtgggccttgtcctgtaaatacgacagttaatagcgtaccttcctcttctcttcggcattcattcatcgcagtagatatgcttgtcataagttcatcaacagtgtcaagtccatcaataccaacctcgatttcgtcccatacaacatctgccgtatggaaaaatgaacactgcgatccttttttcgtaagttcaataaggtatgcacccttctcgcctgtttccttacgatgacgaccttgtatgttccctggataaataatgtatggttcttctgataaaatttcacgtttatgtatatggccaagagcccaataatcaaactgtttttctttcaactcacgaatttgaaacggtgcatagcgattatgctctgcatctccttccacactaccgtgaagcataccaatatgaaaaggcgcatcactcattttcgtatactgcgctgtcatattatccgttaccgcttgctgcaaataactaaacccgtaaatagaagctaacaattcaccatttttataaaatgatttctcttctacataaggctccgtaaatacatgaacattttctggaaactcaattgctgcccagcttccccctaaatgatcatggttaccgtgaataataaaaacagggatatcgtattgcgaaagtctcttcatttgctcacgcacaaacacttgcgccctcaaacttctcgtctccgcatcatacaaatccccagctagtaatacgaaatcaacgcgctcttgaatcgctttatcaacaatacgctcaaatgattcaaacgtactttgcttcattctctcccaaacagactgggcaacattcatctccatccctttaaacggactatccaaatgcaaatcagccgcatgtataaactttacttgtttcacaaataacgatcctttctatctttcaaaagtttcatcttatcaaaattaaaatcgctgaaaactaataatcaccgagaataaaaatattctcgatgattaaagtttcattctattttaccacgcaatgtcatatatttctttgcatattgtagcgttttatgtcaaaataattataagattctgattttaaatattggagggaattttcatgggagtatacgttctaacagtctttgaaaaagatggttcaaaagcattagacgaatcattcgaggcggcaactgaaaaagaagcgaaagcaaaaggtgaatctatcttacaagaaaaaggattgtatgaaaaaacacatcgctgtacatctactgcaggtaagctcgttttattccagcgctaaaaaaagaagcgtcatccgcttctttttcactctactatatcttcgtcacaccacgtaaacaccacatctagaatgcgattaccgatacgtacgcgtttatcccatttacctgtttggatctgatgttgcaattctgctttcatcttttccgtccagtcgtgaatcgtttcactaccgtcgtacggatatacgcctggaaactcttcctgcagtaaatgcaagctctctgcatcaaaatgaaaatggaagaagtagtttgctgtaagcgatggttcttgcaatcgtaaaaaatgatcatcaatttgctttctatttcgatagaaagtaaagatattcactttaccgctcgtaatttggtcaatttgaatttcgtgcttctctataatcacgtcttgtccacctcgttgtatactatctttagtatatatgtcttttgcaacaaagttaaccattttcgcgcgaaattcatttccttcattataattcctgtacctccatattcaatcaggataaataaaaacaaagttgaaggggagcgatcacatgtatttcggaagcaaaggttggtatgtaaaagaacttaaaaaattaggtatccgtacttatgaaggtaaaaaactagaatcttatcgtacgcatgtgttgtctagtttacttgagagaatgaagaaggcttcggcttaatagaatagcaagaagtaaacctgaatattggtaaatgataaaaaacacctcctaaattcgcatactaagtatgcaaattaaatggaggtgtttttattagtttcactttttcaggggcgcttcagttttcataaaatattttttgtttccgctgaaacggataagttttaatctcagctgtatctaaattttcatggaataaatgaatagctataatttgtctacaatcgtaagtatggtaataatatgttccagattccatacacattgcactcgtatagatggtattatctaatgttccgtcttctgttattactgaccctttaggaacctcacaatttgataagatatgaaaaatagcagatatcccctcttcttcgttctctataccttgaatgttttgttttccatatgctgcccgcacaaatcttgatggcggggtaaaatctccaggaagtcccatcgttcctgaaccttggccaaaagcacttaatggtacatctccccactccgttggcgcaaatggctgcgatttaagtccaatatattgtcttaaattttgtaaatgccaattaaactccggactattagtcatcactcctaatggattgtcatacatttttagtccatcagttgtcggctcaagtacaatacactctccccatttatctgctaaaatccaatgtagcggcggagtaattcctaaaactggtaatggtatatctataagggaaatgttatcaacagatttttttaactcttcaacagaattaaattgcgtgaggctccaagctacaaaatcaaatggcgctaaattcgttttatggttatctatactgttactataagtagcgaatcccgggaaatagagagtggcacacgtcataccagcttcatttactccgtccgccataatgacccttccttcatgattaattcccattccgacaacagcctttttcgctcggatagtttcaccagttatattgttccactgataacgccgaggaatgattattacttcctgattcatatctaatgtgaaatccattgttctcgcaaaaagatgttggaaatttttagtttgtaacgtcaaactagtacacatgaagaaatccccccattttatagttatatacacattttataaaattctgataaatacgtaaattaaaaaccctatttatcactaacaaagtaaccatccaaactaaaaatgctataataaacccaatcaaactaagggggcaaattactttgcttggaacatgcattcaatttcataagtttggcaatccaaaagacgtattacaagttgaatataaaaatatagaaccactgaaagataatgaagttttcgtccgtatgctagttagaccgattaatccatctgacttaattcccatcacaggagcgtacgctcatagaattcctttacctaacatacctggctatgaaggtgttggtattgtagaaaatgttggcgcttttgtttctcgagagcttatcggtaaacgagtgttacctttacgcggggaaggtacttggcaagaatatgtgaagacatcagctgattttgtagtccctattcctgattccattgatgatttcacagcggcacaaatgtatattaatccccttacggcgtgggttacttgtacagaaacgttaaacttacagcgtaatgacgttttattagtgaatgcttgtgggtccgctattggacatctatttgcgcagttatcccaaattttaaatttccgattaattgccgttacaagaaataataagcatacagaagaattactgcgccttggtgctgcatatgtaattgatacttccactgccccgctttatgaaactgttatggaattaacaaacgggattggtgcggatgctgcgattgattctatcggaggaccggatggaaatgaattagctttttccttacgtccaaacgggcattttttaacgatcggtcttctatcaggaatacaagtgaactgggccgagattgtcacaaaagcaaaagtgcacgcaaacatatttcatttacgacattggaatgatgaagtgtcaccatataaatggcaagaaacgtttcgtcacttaattcgtttagtagaaaatgagcaattacgttttatgaaagtccattctacgtatgaattagcggatgtgaaagcggcagttgatgttgtacagtctgctgagaaaacgaaagggaaagtgtttttgacgagttattgaatgccataaaagaatctcttttagtatctcggcttcaactacctaaaaaataacattgtcaacacaacttaaattggttatcataaaaacgaatataacaggagatgagcagatgaatatgaacgaaaagaaatccttttcaaaagtttctcggcgaaaattagtcgatgaagtattggaacgtctacaagagaaaatcttttctggcgagtatgaagttggtgatcgcctccctacagagccgcaattaatggaagagctaggggtaggacgttcaacgctgcgagagagtataaagatattagtacatgctggcgtattagaagttcgacaaggacaaggcactcgtattgtctcattaaatacaacgcaagattcatttgaaaaaagactgcaagcagctaatataaatcatgtgtatgaagcacgaaatatgttagataaagaagtagcaatgttagcggcacaacgccgaagcgaagaggatcttttatatttaaaaggacatttgaataaaagaaaaaatgcccttcaagaaggaaattatgtagcatacatagatgcagacattcagtttcatctagccattgcaaaggcgagcaaaaacgaagttctatttgatttgtatcaatctttcgtacctgcccttcgccatattttaagtcaattaatattacatacagcgaactatgaagacaactctggcattcatgaaaagttattccaagctattttaaagcaaaataccgaagaggcgcgaacatacgctgttcaaaatttggagctgaaataagctccttatctattacacaaaaacgtcagatgatatactcaataacatctgatgtttaagaaaggagaaaatgaaattgaaacagcaagaacgaacttatttgtatatactagcactattttttgtttccattaatttacgtatcggaattacatctgtttcacctttattagaaacaatccgacaagacttaaatataagcaatttttccgttagttttttaacagctattcctgttttttgtatggggacattcgccttactgactgggaaggtaattaaaaaatacggggcagaaaaatcaattatgacttgtcttattttaatcggcttggcaacatgtatgagagcttttaccttttccatttccacattattcgcgagttctttatttatcggtattggaattgcacttgcaggtcctttactatcaggttttattaaagaaaaattccctacaaaaattggcttaatgattggcatatattcagtaggtatgggaactggcgcttctttaagtgcaggtttaacaatccctttacaacatgtattaaaaagatcttggaatatggcactcgctttttggggtgcactaactattatcgctattatgttttggtatcctgttatgaaacgaaaaaagaagacgaacacacaaaataaaagaataataaattgcctttaagaaataaaaaagcatggttatttacaatccttttcgggctacaatcaggaatcttttattccattacgacttggcttgcgccggcaaatcaaagtatgggtgtgagtagtaagcaagcaggtactcttataactgtttttaccgtgatccaaatgatatgtagctttttaattccgacattagcggatatttataaaaacagagcactttggttattagggagtatatgctttgtaatcgtaggtttatcgcttatgatttacccactaactacaccatggatcccttctattttactaggtatcgggctcggcggcgtatttccactcgctcttatgctgccgctatatgaaacaaaaacttcagaagatgcaagtgcatggactgctatgatgcaatcaggaggatatattatgggcggattcattcctgtcctagctgggatagctcgtgactattttgatagttatacgcaagtttttattataatggcacttttaagcttaattttactcctattaactttagtcatgaataaaaggagaagaaatgcagaagaccttttctccgcttaaatttaaaatgttaatatatggtataatttaattaaaaaacgaatggagcttctaacatgtggttcatttcggcaatttggcctattatactagtcgggggaattgtagtatttgtaataaaaagattggaacataaatataagcacggcaaattaggtaagaaaaaatcaaaaaacactcaaattttattagacagtttaataccaatggcaatgcttttagagtgtttgatc

SEQ ID NO: 1335 - DNA, 11918 bp, Bacillus thuringiensis
tgcgccaacttctgttgcaaaagcacaaaagagaactaagcgaatataaagcaattgggatgattcaagatcatctatccctgttatatcaagcgatacagagaaacacccgtataataacaaaggttttaatccgcctgtttaccctactaaagaaaaatggccggaaatcccatcgatatgagaagaaaactatctttgatattatgggtgttgtctatgagtataatggattgagaaaacaaaagaaagctgcataagaaaaaaatgaaacccgttagggtttatttcgtatgctcatttttaagaggattatactgtttaaaagtttgttcatttcaattaatggaaaaccgtagagtttctatccttaagttgatgggcatggggaaagcacaccaatgaaaaaagcatgtccctcaattactttgggtcatgctttttttgtcgtaacatgatttacaatatatctcttgtgctgtttttgccaaacacacatcaaaagggccaactaatatacttctttctttcggcaactttacaaaagcaacaagctcttcttcatattgaatttttttctgacatgaaatacatattaattcttttcttttgaacatttcttttagcataccttcactctccccttcatctatctatattaatatactctcataatagttaagacttgtaaaaaaatgacacattccgaatcgaatgattcatatactatgtacaaaaggaggtctacagcttatgcgtgctttcgttattatcgctttaacttttttaagtgtgattagttgggatgcgtttttcaaagataaaagtgatgaaaagaatacaacggaataaaacctttttttcttacttattggacaaaccgttacaaactgtccaatcctccgaaataacttaggcttttctacaaaaatatttaaacataacattttttgtagattccctccgtttattgtcggtttccatccgcatacattttttaaaagtatgatataatagtataaatcttgaaggaagggattttgatatcatgatcgctcgaaggagcatgtggcatcgtattgacgaatcatacacgtagcgtatttttcagctcagatactttagtctagcgaaaaaaatacgagagtggggaaattatgattgcccgaaggataatttggcaaaaaaaagactcttcttacacatagcgttttgtttaggacttaattgttactaactaaacaaaacaaagaagagcaggattgctaaatgaagaatcctactccacgttttgtttagtcgttttaagacttaaactaaaacgaaggtagggagaattgatggacgagaggattattcgttatttcttcagcgacatatagcgtagttagttttttcgtaaactaactgaaagctacatgtgagctcgtagttagtttacaacacaaaaaggactactaactacggaaagaaggaataacgatgaggaacatccaaagtcggcaaattattaaagaaatttttatggttttaatcggttcatttattttagcagcagcgctatatcacattcacttccaaaaccacttaacagaaggtggctttgtaggaattgcactattcattcaaaacttttatgatatttcaccatctatttcaactgtattaatggatatcccaattattttactgtgtgcttcatttttaggtagaaaaatggttggctattcattcctaggttcaatttcattcggagtattttattcctttatggaaaattattctccatttacggtagatttatcaaataacttatttatagctgcagtagttggcggtgcgttagctggtattggactcggttttatattgcgatttggcggtgcaaccggtggagacgatattttaacaattgtattaagtaaacgaactcgttttacaattgggcaaattttcttcgtctttgacgcgattgttcttgcgctttcattatattatttaaattggacagaaattgcttttactattctttcgattgccgtacaggcaaaaacattggatttaatttattatccaaaaacagaaaaaacagcagaaaagcagccagtatctgttccaatgtctaaaaaacatgcaacaaattaaaaaagcgaaaggcttcggcctctcgctttttttatgctcttttttctttctcgactatatggcgcacttgataaaatctatttgcaaattcagtaacgtttcttgttaaacgataattcactgtagatccaattgccattccaattaccggtataccttggaataatttacgacgaagagcataaatcgaaaatgtcttcaaaatttgttttaacacaacctcagtagaagctgtttgtagcactgcttcgtctccttcgtagaagaacgaatcttcttgctccagctcttgcaataaattgtaccatgcgtattgctgaagtcttcctggtagtaatgacgcatgaaacacctttaacgcaagcatcatttcatacggcttgttcacatcatgtccaaatgatgttgcaataagttggactgccttcacatttaatgcgatcataaccggaaaatccgccgttaataataataaacctccagcacctgttgccccgccttgtacaaatgaatatagacgatgacgtgctgtttgctgctctgctatgtatgttaattgatcaatagataatgctttcaaatcttcaagctgttcaatcgattcatcaaataatcttgatgttcctaaaatccgattacgtgcatctaactgtgcttgtgaactttgaataaatgcatgcaaatgaaagagccatccatctgctttcgtgaagaattcttttcgctttttctcaggtaatttcgcaactgtagtatgtaaccatttatcaaacactttttgaaaatcggtcgcttcttgctcaactaattgcgcttcccattcttttatattgtctaaaatggcttgttctcgcttcgatcgcatcgtaacaaccacctcgttcgatttttttctattgtaacatatttctgcttattctttgcaaatatgcttgtctatctttattcacataccatttttgaatggcataaaatattaacaaaaaggatgagataaatcacatgaatctatccgatataaaaaaagaatataatgcggtattcagcttaggacaaaactgctggcctgcttgggcattatatcaattagaattatcaccattttttggcgttattgattttatgctaagcccctcattagaaaaagtgaatgtattattacaaaatcgatttgaccgctttttaaatttcgaaaatttatccttcatctcattttgggatgatgatgcaaaattaagattaagggacaacctttatgaaattgactcctgtcatgactttaaaacagatgtaaacacaccaacttcttggccttcttatacagaaattaagttaaattatgaacatcgtattaatcgttttctagctacaattgaaacggccgaatccatattatttattcgaactggaggaacatatgaagaagcatgttccctagaacaaattttatctcaaatcgttacacatacattctctgtcctgttactaattcctgccgatataccaactatcacccaagaagattggggattacaacgtgtttgcgttatgaaatgtcctattatggatgtataccaatacaatgaagcattttggaaagacttatttgatggaattacgattagaccacattcttaaatacatgacacctttactacaaaacatattataatcttccttatacaaaaaaataaggagtgattgtatatgtatccacgtgcaaaggcttttggcattgctatacatcacgggcgtcttctcgtacaagaatatcattcagccgatgaaacattttaccgacctcttggtggttcaattgaacttggtgaacaatcagcacataccgttattcgtgaatttagggaagagcttcatacagaagtggaaatcaccaattatttaggctgtttagaaaatgtctttcatctagatggagacattggtcatgaaattattcaactatattctttgcgtttattagacacgtcactatatgaaatgaaaatattaaatatacaagatgaggaaacagtagcatatgcgaaatggattcctattacggcattcattcagaaagaaaaaatattatatccggatggagttttaaaatacatctaaaagaaaaaagacgaaatcctataggatctcgtcttttttttcatatattaaccaatatctccaagacgtagtacgtcacgagcaatcataacttcttcgtcagttggaattacgataatttttactggagagtgtgggaagctgatgaatgcttcttcaccgaatacgttattacgttttgcatcgaagtatacgcccatgtactcaaggccttctaatacgcgctcacgaataatcgcactgttttcacctacaccagctgtgaagatgattgcgtctacacctttcatacgagcagtgtaagaaccgatgtatttgtggatacggcttacgaatacatcaagtgctactttcgcacggtggtcgccttcttcttctttcgcaatgatgtcacgtaggtcactagagtaaccagtaagacctaacataccactcttcttgtttaatacgttaactacttcttctactgtttggcctgttttttccatgatgtatggaattaacgcagggtcaaggttaccagaacgtgtacccattgttacaccagcaagtggagtgaagcccatagaagtatcaatagatttaccgccttctactgctgcgatacttgcaccgttacctaagtgacaagaaagtaagcttaagctttcaattggacgacctaataattcagccgcacgctcagttacatatttatgagaagttccgtggaaaccgtatttacggatgccgaatttttcatagtactcatatggtaagctgtataggaatgcagattccggcattgtttggtggaatgctgtatcgaatactgctactgctggtacgtttggtaatacttcttggaatgctttaataccaacaacgtttgctgggttatgaagtggtgctaaatcgcttaattcttcgatatcagctaatacttcatcagtaattaaaacagagtcagcaaatttttcgccgccgtgaacaacacggtgaccgataccgccaatctcatctagagatttaacgattccgttttcagttaactttttaagaagcatattaactgctactgcgtgatctggaatgtttgtaatttctttttgtttttcgccatctacagtaatagtgaagatactatcttctaaaccgatacgttctactaaaccttttgttaatactgtttcacttggcatttcaaataattggaattttaaggaagagcttcctgcgttaatcgcgatgatttttgacatctagtctttcgcccctttttctcttggtagttgtgtggatgtttccacaaaccgctcgattttatctgatcaaattcactaaatatgaaaacgtttcatcattagcaaattttatactcacgattttaatttaaacatcgtccgacatatatttcaagtgaaaaaattgtaacaccaagaaaaaatatatattacagatttcaaaaaaattcagttaaatcttgtatatatttaaaaatatgacatattatataaaactgtactacataaatcactaatgctgttacatatacctagctttatttatgtgttgcaaaccaagtatttaattgatccataatgtcttccatcgccttcatattagagaatttaggcaactccactaataacgcctgttttggcattgttacattagcgcctttcttttggagaacaaatatactttttgcatttttctcgtttttaaacatggaaacaggaagctgtaataacccttgaataaagcatgtttctttaataaatgcatgtaatttcggtgcttggtcactttcaaaaatgaagtttggtactaagaagaataagtaaccgccctctttcgtatgtttcacactttgttcaataaataagtgatgggcatacgacattccttcatctgcttttaatttatattcacttgcaccgatttcgtttggataataaccaaccggtaagtctgaaacgactgcatcaactggatcgatataaagtggtgctagtccatcttgatggaagaattcgattgcatgcttttgtaaatttgcatttactaaagcaagtttaattagcacttcatccacttctacaccaaatccactcattgttagtccttctttagcgctattaaacactgtagtcattaagttacctgttccaattgcaggatctaaaactgtaatttcattttgaccttgcataaatttatggaataagtaactcatgaacatcccaactgcatcaggtgtcatttcgtgattcgcttgtacgccttctttcattccttttaagatggctaactgaaatgctttacgaatttcttcacctttatatgtttcttcattaaacgtactatattcacgattcagcctttcaattgctgattcggataattcctcttgtaaaatcgctccctcaaacaagttatcacctgtttctacaagcgcctctaaatatgttacatctaattctttacgtaaaactaccgcagaagaatcaaaaatagaaaataatgtttctactgtctgactcacgtacattcctccttctctcttttacacataacttatatcataccacaaagtgattttttccaaaaagaaaaagcgacctcctgtaaagagctcccctttagttatatatgatataacgttttttctcatatatcgatgccgttacagagcaatatatgagaaaaaacgacctctttataagaggtcattttcttcacattacttcgcagatttagctgcttctaatgctgcttcatagtttggatggcttgtaccttcgcttacgtattctacgtaaactactttgtcattgctatctactacgaatactgcacgagcaagtaaacgaagttctttcattactaagccgtaagcttcaccgaatgaaaggtcgcggtggtcagaaagtgttacaacattttctaaaccgtttgctgcacaccagcgtttttgagcgaatggtaaatcagcgctaattgttaatactttcgcgttttcaatacctgctgcatcttggttaaaacgacgtgtttgtgcatcacacacacctgtgtcgattgaaggtacaacactaattaatttcacttcgcctttgtatgtttctaaacttactggagataagtcgtttgctaatacttggaagtttggcgcttgatcgccaactttaacttctgttccaactaaagtcattggattacctttaaaagttacgtttgccacttgaaaatcctcccttatttaaacaaaatatgtacaatgtaaatgatagtttgtccctatcgataatgcaaataaaatcgctttatttacaaaaaaattaaagaagctaacctattgattagcttctttattcgttaaatttgaaattcaggatcatcttcttttcgtttatccatcatttctttcactttatcaacagcttgtggcgctaattcaattattttatcgatgacatgtgtttgtttatctaagtgcaatactttcacaccatctccatttataacaagaaaggcaacaggattaatagaaactcctccaccacttcccccgccaaatggatggcggcctgaatgttctactttaccaaattcacttccaccagcagcaaacccgaaacttactttcgaaacagtaagaattacacttccatctgccgctttaattgggtcaccaacaattgtatttacatcagtcatttgttttaaatgctgcattgctgttgtcattaaaccttgaattggatgttccattctatatcccccctatgcttgaacagatttttctgtcataccagatctttgcttcctcataaatatgagcaatttcaccgctgtttttatagtgcggaatatacgaaaagatgctgttaactcacatcttgatgcaaatccttttccttgaaaaactggggtaatttcaaattctggtacgtcgacaatatgcatatattgtccgacaactccagcagccataccttttgtcccccatgcatatccagtgacaattccagtactagctgcgtcgcctgctccaatttgtgtatgccatttccaaccattgattttcactcgtttgagaaaatctttaacaatagtatgaacttcttgaagcttttttatcagttcaccaatgctgtcaagttgcgccataattttattatcgagtccgccgtcctcttcagctttttcgattttctgtcctgtctttttctgctgtttttcaattctttccaacacatcaaatgtatatcgaatcatccatattttcacttgaagcaaacatttcttttccatttctgaatataaaaatgtcaccttaagctttatttttgacaatagtataaacaaaataaaaagaagaagaattattattccaattacgagccacttcatacgtatcatcctttcactccgtacccattatcgacaactttattcatcattaaacagagttctataagattgaatataaaaatttttctaaaaataaaaaggtgttttgacattttatatcgaaatatattatttgaacatatcatcagggaacggactctaatgatatgtagcacgaaaaacagaaaatttaactgcagtggagggatacataatggcagatcgtcgcaatttatttttcttttatggtgatgacaaagcaacgctcgttgaaaaaatgaaaccaatctatcgtattttagaagagaatggatttaccatattagatcatccaaaaaatgcaaacgctatcgtcagtgttggagatgatgcaaccttcttacaaaccgttcgtaaaactggttttagggaagattgcttatacgcagggatttctacgaaagatgaaacttcgttctactgtgatttccatattgatcacgttgatacagcccttcaagaaattacaaaaaatgaaattgaagtgcgtaaatatccaacaattcaggtagatgtagatcacagtacatctttccattgtttaaatgagttctcattacgttctagtattataaaaacattcgttgtagatgttcacgttgatgatttatatttcgaaacatttagaggtgacggtttagtagtttctaccccaacaggaagtactgcttacaataaatcattgcatggcgcagttgttgacccacttattccatgtttccaagtaagcgaactagcatctttaaacaacaacacttaccgtacgctcggttcacctttcattttaaatcacgaacgtacattaactttaaaactaagaccagacggtaacgattatcctgttatcggcatggataacgaagcgcttagcattaaacaagtggaaaaagctgttgtacgcttaagcgataaacaaattaaaacagttaaattaaaaaacaattctttctgggaaaaagtacagagaacgtttttataggattaaaataaccgcagaattatggaattccataattctgcggttatttatttaccccgattggcgcggacaatactctcttactatccacccgttattcttgtcagtttttgtcggtaagtcgatatattttaataatcgctcatatatttcgagttacgatagatatatttcaataatcgcttatatatttcgagttacagtcgatatattccgaaaatcgctgatatatttttacgcattttttctatagacaacttggccatctattacggtcatttctgcttctacttcttttatttcttctgcctcaatttcaaaaatattgcggtctaatattgtaaagtctgcttcatatccttttgtaatttgccctcgcttcgcttcttttccgattgcataggaacttcctgttgtaaataaagaaacagcctcatataccgttaatctttcctcaggcatatagcatacaccgtcaataaaacttctacgtgtaacagcgctatatatacctagaaacggatttacttgttcaatgggggcatctgagccaccattacaatgtagccctgcttccagtaatgtcttccaagcatacgcataacgaagacggcgctctcctagtttttcaatgactgacggaaaatctgatgaaagaaagactggctgtatatctataatgacttgcaagtttttcattctttcaattaactcctcacgagcaagctgacaatgaataatgcggtcacgtaacccttttgctggtggatataattcgagtgcatcaatgacatattcaagcgataaatcaccgatagtatgaatcgcaactggcatatgtaaatctcgtgctttcttcactaattctgcaagttcttcacatgagaaaatcgcaaccccattcgtttccttcgcatcttcatacggttcacttaataatgctgttcttccgccaaaagaaccgtcagaaaaaattttcattgccccaaattcaatataatgttcattttcatattcttttcgttcatgtgctacttcatggtgaacgagcaaatgggctttaaatggcatttcttttatcacatgagaaaacgcattatgcgtttttctaaaaccaccataataatttaaatcttccgtatgcccgccaacaagtccgtatttccagcaatctttaatcgctgtttgcagagctctttgtaaataagcttcatcaatttctggctgaacatgtttaattaattcttgcccttgttcatataaaagtcctgttaacttatttgatgaatctctgccaattttcccgccttttggatcttctgtcgcttctgttatattcgcttcttgcagtatgtatgaattcacccatgtaacgtgacgacaaactctctttaataaaataggatggtctttcgaaatttcatctaaatcacgcgcgtgaacatctttcgtatctgtaaagttattttcattccatccttctccaataatccaagagccctttggagcttcttccactcgcttctgaacaagagtcagtacttcgctataagatgtacaatttgataaatctagacggagtaatctctctccatgcccaataagatgcatatggctatcaacgagacctgggatcattgtttttccttttaggtcatgtaactttacgtttgaatatctgctttctaattctcccttattaccagcatcaacaattatgccgttttcaacgtaaacagcgtccactttttcattttcttctctcattgtgtaaatggtgccgccataccaaatttctcccatatatcccatctcctcgtatgattaagttaggtttttagggacgggatgtacctataaatccaagggtatctatttttatgagatactaatatttgtagatagagtgttgccgaccatctccctgaatctttgtattcgtaaaaaagagcggtacctctgtctaataagtagtttacgaatgagttggatgttgatgaccattggtcattcttcgtatctcttacgaggtagtagcgcttattagttcaggggaggaaagcactatctaacactaattaatataggggtgtaagctatgttctatttaggtattgatatcgctaaacataaacattatgcgtccattatcgatcaaacgggaaaacctattactaagccatttccttttcagaatcacaaagaaggtggacaaacccttttaaatcagatctaccaa

SEQ ID NO: 1336 - DNA, 16875 bp, Bacillus thuringiensis
catccatactaattcttcttcagtaactgaatcgtaatctccaaacgcaacagccggggtaatccctttctttaatagacggtatactcccctatcaaccgctgcccacactacttcctcattctcgtatcgagcaaaatctgcgcaatattccgaaggtcctcctgccaaaatatgaataatcattttttcttctccttccattgtaaaaaggcaatctgccattcggtagattgcctttttacatatttttatcctatcctataaatgccttactaggataaaagttcatcactacccacgaattacgcgaattgcttcaccgcggtctttttgattgtatactgctgacccagctacaagtacatttgctcctgcttccacacaaagtcttgctgtttcagcatttacaccaccatcaacttcaatttccacttctagattgcgctctttcaccatgtctgcaacttgtttaattttcggtaatacagaatggataaacttctgtccaccaaatccagggtttactgtcataagtaataccatatctatatcttctaatacatgctcaatcactgaaactggcgtatgtggatttaatacaacgcccgctttaataccatgagatttaattaactgaattgtacgatgtagatgcggacacgcctctacgtgaacagtaataatatccgctcccgcttgtgcgaaagtcgggatatagttatcaggattttcaatcattaaatgtacatctaatggtaatgatgtaatcggacggattgcttctacaattaacggtccaatcgtaatatttggtacgaaatgtccatccattacgtcaacgtgaatgtaatccgctccgcccttttctacatctttaatctcttcccctaattttgaaaaatctgctgataaaatcgatggtgcaattttaatcataactaatacctcggctttctctctctaatttcttctacgaattgtttatagttcttatagcgatattctgtaatcttcccttcttcaaccgcagctttcaccgcacatttcggttcagaaagatgtgtacaccctctaaatttacagtattggctcgcttctttcaactctggaaaacaatatgtaagatcttctacttctatatcaatgaaatctagtgaactaaaacccggtgtatctgctactagtccactcccaattgcaattaattctacgtgtcttgtcgtatgcttcccgcgtcctaaatgggaagaaatatcatttgttttcagctctaattctggacgtagcacattaagcattgaagatttcccaacaccagattggcccgcaacgacagaaacacaattttctaagtatggttttaatatatcaatactttctgaagtattaatagaagtaaataaaacatcataacccatctcacgataatcattcgcataagcttcaacagttgctttcatcttttcatctactaaatccatcttgctaatacaaataattggcttaatgttatgatattcaatcagcactaaaaatcgatctaacagtccaggattaaaatctggttctactgcagagaacacaaggatcgcttgatcgacattagcaataggaggtctaacaagttcattttttcgatcaaacacttcaagcacataaccttcagttggattatctgcctgaaaaacaacttggtctcctacaagtggtgtaattttattttttctaaatacacctcgcccacgacattgcgtaaccccttcttcatgctgcacgtaataaaacccacttaaagcttttataatttttccttctggcatagaattctccttttttgtataaggtgatgctgaatttaaaaatgaatggatttaaattttccaaataacgatttcaaaacctaccatatatactttcgctaatatacattgaatttcccattaaatgcaaaaaaatatttacagctgcatcactttactagctttttgaatcatatatttttgcctgctataccgtccactttgtagacagcataacaggcaataataataagtagactttcactattattgagttggatatggtacttctttatcaataatcgttactccatcccgtacaattttatagtgtccctttgaaccttcttgaattacaaattctaaagaaatagtcgctgattcagtaattgttctcgtttcaaccggtctatccattttttgctgcatgtcttctttataaatttctattgtttgcggctttttttcacctgttacagcaggctcatatgggatagagatattgtccacttttaccgttttagtcactttaggcttttgaccatcagagataataatagttactttatctccctcttttaatggtgtacctggttttggaaattgcgaaattacaagtcctttttcgactgtatctgaatactctcgttttatatctgacgttagttttctctcattcaaataaccagttacactattttcagtccaccccgaaaagtcacctggtctaatttgataaggccctttacttacccagattttcagttcttgctccgcttctataaccatctgatcaggcgtcggaatttgttctacaatttcacctttcggcttatcattttcaatataatttaccgtaacttgtttatatttttcttctaactcagcttttacactctcaaagttttgacctgtgaaatttgccatcttacttttcttttttccacctgattgatagatagtaattttagcgttttcttttacgactcttcctgctacagggtccgtttttattacatccccaacttcaacatcatctgtatatacaatattaggctccgtcacctcaaagcccttttctactaatgtatttacagctgtcgtgtatttcataccagccacatcaggaactttcacatctttcggaataaataatcctggaataaccgtaagtgctaatgttattcctattgctaaaaataaaaatgttgaaattaaaactttaagccacttgttactccgttttttcttcttatctaactcagctgcttctgctcttatcggttcttccaccttactcccttttaaaacaatcgtttcatcacttacattttcaaataattgttcttgttgaataatcggaatcgctttcgtcgcttccatatcttccggtatgtaaaatggttgctcatttatcctctctggatatagcgcagtttcaatatctcgcttcatcgcattggcagattgatatcggtgaaacggatcttttgcagttgcctttaatataatattttcaacactttgcggaatattttcattccatctttttggtgatgggatttcactttgtaaatgttttaaagctatagcaacagcagattcgccagaaaacggttgtcttcctgttaacaattcaaacataactattccaagagaatagatatctgattgtttatttgctatcccgccacgtgcctgttctggtgataaataatggactgaaccaagcactgaatttgtatgtgtaattgttgttgcacttgtagctgtcgcaattccaaaatctgttacttttattattccatcagctcgaattaaaatattgtgcggctttatatcacgatgcacaatttcaaaatgatgggcatgtgccatagcggatgttaactgctccataatatcaagagcttctcctataggtaacatccctcgctcaattatgtattgcttcaatgtttgccctggtacatattccatgacaagatagtatataccatcttcttctccgacatcatacatattcacaatatttggatgcgacaacgttgtaacagactgcgcttctcgatggaaacgtttaataaactcttcgttatttgagtagtcgagtcttaatatttttaccgctacatctcggccaagtatatcatcatgagctaaatatacattggccattccgccaccaccaatcattttcagcagcttataacggtcatttaagcgttttccaatcagcacgttgcacttcacctactttcgtttgtcgaacccgcataatcaataagaacaagtgtgatattatcttctccaccgcgatcatttgccaattgaatgagacactgccctttaccttcaagctgttcatttaactgtaaaatttgtcgcatatcatcaatagaaactttgtttgataacccatcagagcaaagaagtaattgatcatcttcctcaatcaccaacgttttaacatctaacccaactttttcttctgttcctaatgctcttaataacacattctttttcggatgatactctgcgtcttcctttgaaatttcaccatgtttcacaagctcatttacaagtgaatgatcttccgttactagcgtcatttctccttctgataccatatagcaacgactatctcctatatgccctattgtcacaaagcttggtgtacaaacagctattataagcgttgttcccataccattacattctgcattttgctgagcgtattcatatatacgctcattaataatcccaacactagtatgtaaccattgttctacttttttcggctcattcatattatgtgtttgcttccaataatcatggaataattgaatggccatcgagctagctacatcaccagctcgatgacctcccattccatctgctactaccgctaatacatttccatctaaattgtgaaaaactcctgcactatcttcattatgttgacgaacttttcctttatccgatagaaatacggctttcatctcgtcacctcgtctcttctttgcgctccttcgcacgcaactgaccgcaggctgcatcaatatcatgaccttgttcacggcgaatcgttacattcactccacgatcttttaacgttttctcgaacaagaaaatttgttcacgtggcgtacgtacataatcacgttcaggtacgtagtttaccggaatcaagttcacatgacattttacaccttttaagagcgcagcaagctcttcagcatgctctacttggtcattttctcctccaaataatccatattcaaaagtaatacgacgccctgttctatttacatagtatttaatagcttccattaaatctggtaatttataagcacggttaatcggcattaattttgaacgtaattctgagtttggagcatgcaatgaaatcgcaaaattaatttgtagatcttcttcagcaaacttataaattttcgggataattccactcgtcgaaacagtcatatgtctcgcaccaatatgaagtcctttttcatggttaatgatgcgtaagaatcccattaaattatcatagttatcaaatggttctccaatccccataacaacaagagaacttacacgttcttccgtttcatcaagcgcacgctgaacttctactacttgcgctacgatttctccagcttctaggtttcgctttaatccaccaagtgtcgaagcacagaacgtacacccaatacgacaaccaacttgcgttgttacacaaatggaatttccatattcgtgtcgcattaataccgtttcaatagaatatccgtcatataattggaataagaatttaattgttccatccgaagacgtttgttttactaacgtgtttaaagtagtaatatcaaaggaattcgacaatttatcacgcaatcctttagaaaggtttgacatatcctcataattttttacacgttttttatataaccaatcaaaaatttgtccagcacggaacttcggttctccttgttcctttaaccaatcttgcatttcatgaagttgtaaagagtaaattgatggtttcttcgtttctaaatttttcttttgttttcttacagtcgtttccatgatgctacaccttcttccttaaacaagcaatataaaagccatccgtcgcaaaataatgcggtaaaatttgtacttgaccttcatcaatatacggagttaatttttctggcatacgctctttaagcgtagtatcccattcaaattcaggatgttcttgtaaaaatttctctattacttgttcattttctattttctcaattgtgcacgtactataaacaagacgaccgccttgttttaataatggtgctattttttctagtattgcaatttgaatcgtcgataatctttcactatcgcctttatcttttcctaacttaatatcaggcttacgtctaattacaccaaatccagaacacggtgcatctaccaatattttatcaaacgtttcatttgcaaagtgctcttgcacttttctagcatctagcgctttagtttcgacattttctagaccaagtcgctctgcttgctgtttaattaaacgtactttgtgtgcatgtaaatcaagggacatgaccttaccagttccctttaatcgttccgcgatatgcgttgtttttccgcctggagcagcacaactatcaagaactgcatctcccgtattcggttctaaagcgcgtgctacaagcatagaactttcatcttgaatagaaagaaatccttttttaaacgcttctgtatgcgctacatttcctctttcaatctgaattgcatcatctgataagtcaccactttttgcttctataccttcacttgccaacaactcaatcgcttcttctaccgttaccttatcaacattcacacgcgctgttggtacagggggtaacatgtttacttcgcacattttttctgcagtttctaaaccgtattctgaagtccactcttggacaagccaaactggatgacttgttgtaattgcaagacgttctactggatccttgatttcatctacagaaggtacaccttctctctgaatcgaacgtaatacaccgttcaccataccagcaattcctttatgcccgcgacgctttgcaatctcaaccgcttcatgaatagccgctctttctggcactcggtctaaataaatcatttgatataaagataagcgaagcaatactcttacccacgcctcaaccttcttttttaaaaaaggctgtaaataataatctaatgtgtcacgacgttgaatcgttccatatacaatttcagttaataaaccaatatcttttctatcaattgcacttttttcaattagattatttaaaagtaagttgctatatgcaccacttttttccacttgaattaaaccatcaagagctaattcacgaacattttgtctcatgcattttctcctaacttcgttccaatttcaggttttgttccacgtaaaaattgtgaacaactcatacgctttttaccagaaggttgcaattcagtaattttaacacctgtttcattactcgttgctacaacaaaaccatcttcttcgattgcaacaatcgtacctgcttcagccggttcagttataggcactttttctccccaccatactttaacaacttgtcccgctaaagttgtataagcaactggccatggattcaatccgcgaatgtgattgtatacttcttcacctgtttttgtccaatcaattttctcttgctcacgttttatattgtacgcaaacgttacttcttcttcgttttgtttaatcggttctaacttaccttggattaataaaggtactgttttagatagaaggtgtgctcctgcttcacttaatttatcaaataatgagcctgtcgtttcacgctcttcaatttcaacttccacttgcgttaagatatcaccagcatccaatttttctaccatatacataattgtaatacctgttttttctttaccttccataattgcataatgaattggtgcaccaccacgaagttcaggaagtaaagaagcgtgaacattaatacatccatacttcggtgcttctaaaatttcatttggtacaatctgcccaaatgcagctgttacaattaaatctggctctaatgccaatactttttcatattcatctttttcacgaatttttaacggctgtaacacagggataccatgtttttccgcttcaactttaacaggtgtaggtgttaatactttttttctacctactggacgatcaggttgcgtcacaacacctactacctcatagccatcttcaataagacgacgaagcaccggcactgaaaagtccggtgttcccataaacactacttttatcatttaaaaaccgctccttttaacacctattctagttcgttttcttcataatatcttgtcactttcgatgtaaataaaacaccgtgtaaatgatcaatttcatgttgaattgcacgcgctaaaaatccttccgcttctaataagaatactttcccacggcgattttgcgctcttactttaatataatcggcacgttctacttcaccataaagtcccgggaagcttaaacagccttcgggacctacttgttcaccacgtttttctaatattgatggattgattaactcgattttcccagtatcatcatcgacatcaacaaccgctacttgcaagcttacacctacttgaggcgcagctaaaccgactccgtccgcaattaacattggtttaaggctatttttcacccatttcccttacctttttattaaaaggtaaatttcttttttccgatggggttctaacacttcaattgggaggtttattatttctaaaactgccatatttccctccgctacattaacattgttggattaaaatcaattgagatttgtagctctttttgcatttctgcttgataatgttcatttaccattttgagcacgttctttaagtttggttcccgtttgtattttatcatgcattgataacgatatctatcttttatccttggaatcgctgaagcaactggtcctagcaccattgtttgctgtgagcaatgcgttcgtaaatacgaggcaattttttccgtcacttgtaccgcttttaataattcaggatgagatacagttacgagtacaacatagtaatatgggggatattgtcttgttcgtctcatttgcatttcttggtcaaaaaacacatcatattgttggttcttcgctaactctatactgtaatgttctggcgtatacgtttgaatcacaacttcccctggcaattcatgtctacccgctcgtccacttacttgcgtcaatagctgatatgtcttttcactcgcccgaaaatcaggtaagtgaagcatcgtatctgcagttaacaccccaacgagcgttactttcggaaaatctaatcctttagcaatcatttgtgttccgagtaatatatctgctttttcttccccgaacgcctttaataatttttcatgcattccttttcgacttgtcgtatctacatccattcgaatgactcgtgcctctggaaatagttttgtaatttcttcttctaccttttgtgtacctgtaccaaagaaacgaatgtatgtactttgacaagctggacactcagttggcatattctcttcgtaactacaataatgacattttaaacgatgattcattttatgatatgtcaatgaaatatcacaatgcggacattgaacaacatacccacaatcacggcacataacaaatgtagaatgacctcttctatttaaaaagagtaccatttgttctttcttttctaatcgatctgctattttttcatgcagcgccttagaaaacattgatcgattcccgtcacgaagttcttctcgcatgtcaacaatctctaccgttggtaaagcttgttcattcatacgtttttccattgttaatagttcataaacaccttttttcgcccttgcaaacgattcaagtgttggtgtcgcactaccaagaacgataggacatttatgatattgtcctctccagacagctacatctcttgcatgatacctcggattatcttcttgtttgtaacttgattcatgctcttcatcaataataataatccctaaattctcaaaaggcgcaaaaacagctgaacgcgcaccaactacaactttcacttcttttcttaaaatcttacgccactcgtcatacttttctccaacagacaacgcactatgaagaactgcaacttgtgagccaaacctacctttaaaacgatccaccatttggggcgttagtgcaatttcaggaacaagaacgatagcttcttttcctttcttgagcactgctgctatagattgtaaatatacttctgtctttccacttcctgtaacaccatatagtaaaaatggattataagtttcatttgtaattgatgataaaatcggtgtaataacttgtttttgttcctccgtaagtggaaatggttttgtttgttcaaaatcatcatcgtcatacggatttcggtatacttccacatacttttctgaaatgaatccctttttaacaagtgcttttattggagcatctgttatttgtaactcttctgtaattactttcaacggtgcacttttataattttccacaaaataataaagtacatcttgttgttttttacttttcagttcaaatgccgctaattccaatttatcttctggcaactccggctgaaccactctttgcttcttcttttgtactttatctttcacttgataaacgacttcaaccgtaccatttttaatttcttgttgaatagttcggtataaatgtggctgttgctcgattacttcaaaatcaattgcttctttatcctgaaataaatatagtatttcaggtgctatttcttcctgtttacaaagttgtagacgttttttatacgttgcttttatcgcagttggaagcatcacttgaaaagctgaaatcatgtagcataacgtttcacttgtaagccaatatccaagctttaataattcatcatttaaaaccggtgttacatctaatatttcatggattgtctttaacttcttactttctacatccaccgaatctttaatcccaataataaaaccttgcaattttcttgggccaaacggaactactacacgcattcctgtctgtacaatatcttcccattttttagggataatgtaatcaaatggtcgatctgtctgacgggcaggtacatcaacaattacacttgcaaatttcataaacgatcatcttctaacatcatttcaatttgcttcaatatttcacgagctacctcttttttcattaaaattggcaactcaataacttttccatcttttctatacattgttacaatattcgtatccgtgccaaatccagctccttgcgcttttacatcattcgcgacaatcatatctgcatttttctcacgtagttttttcgttgcatattcctctacatttgtcgtttcagcagcaaaaccgataagtaactgtttatcctttttctgacctaacgtttttaaaatatccaccgttctttcaagttcaatgacagcatcaccattttgctttttcattttattctcatgaacatatttcggacgataatctgcaactgctgctgttttaatgacaacgtctacgttttgataatgttgaagaaccgcttctaacatatcttgtgcagattccacttgcactgtcgttacatgtaacggtgtatttaatgctgtcggtcctgaaacgagtataacatcagcgcctaaattcgctgccacttccgcaatcgcataccccatttttccagaagaaaaatttgtcataaaacgaactggatcaaccttttcacgtgttgggccagcagttattaatattctttttccctgcaatggtttgtgttctgagaaagcttcctctaaccgtgcaataattgcttcaggttcttctagtcgtcccttcgccacatatccacatgctaaaaagccttccccaggctcaataaatgtatatcctagcgttttcaatgtcatcatatttttttgaactattttattttcatacatatgcacattcatagcaggcgcaatccataccggagctgtagtagctaacaaagtagttgtaatcatatcatctgcaataccaccagctaactttccaatacaattggcagtagcaggtgcgacaagtacaacatccgcccaatctgctaaatcaatatgagcaataacagctgagtctttctcatcaaatgtatccgtatatacatcatggcgagaaagcgcttggaatgtaagaggcgtaacaaacttcattgccgactcactcatcattacttttacaatcgcgccagattgtgtcaatttactcgttaacgcagctgctttaaaaaccgcaatgcctcctgttacacatagaagtatctttttcccttttagcatatgactcgtcctctttctttttcaaacttataatactgaaatagaattctcagctcgtcagtaccaatatttcattcctttcgtaaaaaaataacaacctacttgtaaataggttgttaccgttacatagaaaattataaagtctatgttttattttgtcgaaggcaaaggcttattcagctactttatcttcacttggtacgtagcttaatgcttctgcatcgatttcttctaatgctttacctacacatttatgagaaacaggtttttctacaacacagttattagcaagttgcatttcacgcgcgcgttttgcagctactgttactaatgtgtacttagaatcgattttttgtagtaatgagtcaattgatggatttaacataattatagaccctccgtcatttctttataatattttgctaccctttcgcggcggcaatgttcgccaaccacaattgctttaattctatcacaagctaattcaacttgatcgttttctactacatagtcgtaagcgtccatcatctcgatttcttctttcgctacagttaaacgattttcaataacatcttcagtctctgtaccacgtccgacaatacggctctttagttcagataaacttggaggtgctaagaaaataaatacaccttctgggaaagctttcttaacttgaattgctccttgcacttcaatttctaagaatacatcttttccttcttgtaatgttttttcaacatagtcaatcggtgttccgtaataattacctacgaactcagcccactcaagtaatttttcattacgaatcgtttccacgaattcttctctttctttaaagaaacagtccacgccatcgacttcaccttcacgcggcttacgtgtcgttactgaaatagagtactgaaaacgtgtatcctcatggctaaacagctctttacgaaccgtcccttttccaaccccagaaggccctgaaagaacgatgagcaatcctcttctacttctcataaatatgtaaaacctacccttcctcacttaaatcttctttattattcaaacgatgtgcaatcgtctctggttgaattggacttaatacaacatgcccatcatccataacaataaccgcccttgtttttctcccatacgtagcatcaagcaaagcattatgttcgcgtgcttcctgtactgttcgtttaataggagctgactccggacttacaatagcaataattcgatgagcagatacaatatttccgtatccaatatttaaaaaccgcatggccatagtttgcgcctcctagtaagtctatccgatttctccaccacgtataactttatatattttttgaaagctactcaatattttgtacttgttcacgaattttttcaaggttatttttcatttctacaacatattttgaaattgttaagtcatttgccttagaaccaatcgtattaatttctctatgcatctcttgcacgatgaaatccattttccttccaacaggctcttcaatctgcaatgtttcacgaaattgctctaaatgactttgcaaacgaactaactcttcatgaatatcacaacgctctgcaaagattgcgacttctgttagcaatctttgttcatctagatcttgattatgtaattcttttaagcgattttctaatcgttcacgatatttttgtgtaacaattggtgcatgtggaataattgcatttacacaattgctaatctcttgtaaacgatacgctatatctttatgtaatcgttctccttcgccatctctcatcgttttcaacatatgagcagcttgacgaacagcctcatataaactgttctcaaaatgctcatttacattttctatttcttcaattgctgttacttctggcattgccattaattgctgaagtgtaatagaatcttgtaattgaaatttcccttttatatcttccatcatcgattggtactgctcaagaagtgaccaattcacacttaattttctttcaacaagtccttcacccgctatactaatagacacttcaatgcgtccacgtcgaacttgctgtgcaattattttacgaattttgtcctcaaataccatcatttgcttaggaagtcgaatactcatctctaaaaaacggtggttcaccgatttcatttctactgtaatttgaaaagtatcactttctactttcgatcttccaaaccctgtcatactagaaatcatttttatcacatccaagccataaaataactcaatgaaaaaggtaatagagacaaggctctactaccttctgtaaattatatcacattttcataacattgactatttcaagtttaatcccttcttatataatatcggctttttcttcttagcctttttccctgttaataaagaacctactagtaagaaagtcggaattgatgacaaacctccaattaataaccaatctcttgcttgtatcggcattgtgctaaagattggttgtaacggtggataatatataaccactagcatgagtagtaacgaaataataaccgcccctactaaatacacgttcccaaatggattacggtgaaagacagaatgctcactacgacaatcaaatacatgaataagctgagcaagtaccaacgtcgcgaacgctacagtttgtgcatatttcagttcatttggatgttggttatacgcaataataaacgccactaacgtcactgctccaattaaaaaccctcgacttattattttccacgcaagccctctagcgaataccccttctttcgggtgacgcggtgttctcttcatcacatctccttcagccttatccaaacctaatgccatcgctggtaaaccatcagtaactaagttcacccataaaatttgaataggaaccatcggcagtggtaatgcaagtaacatcgcaaataacataactaaaatttctccaacatttgacgccaataagtagcgaatgaacttacgtatgttctcatatatatttcttccttctttaattgctgatttaattgtagcaaaattatcgtctagtaaaacaagtgaagaggcttctttcgcaacatctgtccctgtaattcccatcgctatcccaatatccgctgtttttatcgctggagcatcgttcactccatcacctgtcatcgctactatatgtccttgattttgcagtgccttaacaattttcaatttatgctcaggtgatacacgagcgaatacatacgtatcttctacaacattttctaattcctccacatccatattcgcgagttctactccttcaacaacgcgtccatctggtggtaaaactcctaattgttcagcaatcgccattgctgtcactttatgatcacctgtaatcattactgttcgaataccagcttctttacactcttttaccgcctgcgccacttctggccttggcgggtcaatcataccttgtattccaaccaacataaaatctttttcaacgtctctttcatgttcaatagaatccgtgacttttaaaggtttaaacgcaactgcaattgttcgaagcgcttgactacctaagctatgaatagccgcctgtacttcttttctatatagctcacttaacggctgctgcttatccccccataagattgtttgactcagttgcaaaagaacatccggtgctcctttcgtaacaataaactttttcccctctcgatctcgtacaataacactcatcatttttcgagttgaatcaaaggggaattcacgaataattttaaatttcccttttaatgcctcacgtgttatcccagctttcattgctgcagctacaagcgctccctctgtcggatctccatctaatacgtacgcctttttcttttgaataatatttgcattgttacatagtgaaccaaatgtaagtagctgataaagtgattttgtcttagctggattcacttctttttcacctttcataaaagagccattaggttcatatccttgccctgtcactttccacaattctccgcctgaccacatatgtgttaccatcattttgttttgcgtcattgatcccgttttatcagagcatataacagaagcgcagcctaacgtttctacggccggtaacttccttacaattgctctcttttttatcatacgctgtacaccaagtgataaagctactgtaacaattgctggcaatccttctggaatagccgcaacagctagcgatacgccagctaaaaacatatgatatacttcattcccttgatacacaccagccaatacaacgagcgctgtcaaaataagagctacaataattaatatttttccgagctgttctaaccttctttgcagtggcgtttccatttgctctgcattttgcaacatatttgcaatttgccccatcgctgtattcataccagttgctacaacaacttctgtaccagatcctcgcgtaatcattgtccccataaaagccatatttttttgatccccaattgcaacatcttgcccttgaatgcttttacctttttttgacaggtacggacttccctgtcaaggcagactcttcaatttataaacttgat

SEQ ID NO: 1337 - DNA, 10003 bp, Bacillus thuringiensis
tttttcttccccggtaatggttttagctgaaaaatcataaactgtcattgtctttgcccctctcttcactatcattctatgtttatactatactacattcgtgaatatacatctcttattacgtacttataagatataatgataacgctttatttccgttcaaaattcgacacatactactagacttttatgatggaaagttttacaattgaaatgtgaacaaaatgtgacagtttatattccattataaaagaaaaggatggtgtccattatgaaaactgcacaacatgaaacgatttcaaatcgcgagttttatttcgtactatatatgatgttattgtatgttactggctgggtaatcgatgtaaatggtttattcttaagctcctactttaatttagcaggagagattatgcttccattagtaggcgggattgttggactgttcattatgtctattaataaacaacaaacgaaataataatattacaaaaaggcagaagacgagcttcgttttctgccttttttctattttatcgtataatagaaacatgcagtatataagacctgcggtagtatgtcaactgaaaaacaaaagaatttttagttatcaaaggcctatttactaaaaaaagacatcacgaaactaaaccagtaacgtatgtaatttactggaaattaattgaaaggtagcgatgacaagttttatgtcacactttcacgcacctttctggcgtaaagagttggtgactacgtagtagcgcatccaccaatcgcacaagttttcttgcggttagaacgagtgcacgtttgtgttgatgttttggtacttcattatatttttttacgtaatattcttgataatcagatacgtgccttcttactgagttggcggcttcaactaagtaataccgcaagtaatgatttccattacgggataacgaagtgttttctgcggtgaatcgaccagactggtgcgtacgccaatataatccggcatattttgctaccttggtttcatcatcaaatctttcgatttgaccaatctcagcgataataccggcggcgaatacaggaccaattccaggaatggactcaagtgtttgcgttaatccagccatgattcgcttaatggatttttctagttctttgatttgctgttgataggtacgaatcaccgcaattgatgttcctagaagaacatcgattgagtcttctacgaccttatccaaacgataggaagagcgaacagccttttgaatggtcgatgcgatacattttgggtcaccgaatcggtttttccctttcttttgtaggaactcagcgagttcctctaaaggcatgtcagctaattcttctagactgaatttttcaagaaacagttccatcatggcgttgccaaagatagaagaatccacttcttgtgagaacgtattacatttataacttaggtgttggagaaaatgttgtttttcctttgtcaacattctaacgagctgataacgagatcttgttaattgctggagtgccacatactgactttcttttacgatggacatttgattccgtccaaatcgtaagtaatcagcgatgacaaaggcatcaatctcatctgttttatccatgtcagaatagcttttcttgaaatttgcaatttgttttggattcatcagaaatacctttgccccaaaccgttgtaagtcttcatcataatgaagaaacatagatggatgaaaactataaacagatgtggattctagaccgattttaaaagtttcaatttcttggttggctatacactgtaacactcgctctttgagcgctgtggcacctggcaagtcgttgttgaccgaaaaggaatctagctttttcccttcaccatttaaaatacaagcttttatatcaaacgaacttacatctaaaccaacaaataatctcatgtaagagacctcccttctatttagaatcattcctcggacgtctcgagatatctctagtgtgcacgccgaccaacaacctcgtgtatgagagctagtcctgaatcgaaagccgccctagagctactaacatctaggttcgagggtcaggctgctcagcctgcgagtagggagtcccgcacgttcactgagaaacactcttaattatgtggtaagtccacaggagcggtaagaattgtcccaaatgatcctaagaccattatctagaaatatcttgagacgtccaagagttattttacaggtctctcatgaaagtaaaaaaattaagtttaaacatactatacgaggagtggatgttatgaaaaactatacaaagcaattcgtcctatcttattcttttctttttcattttcttaaaaaggaacaaaggcattcgcctttgttccttttttattgcgatctatatagggggaattgttatgaggccatataaacgtgtcttaattaaattaagcggcggtgcacttgccgatcaaactggaaatagctttaactccaaacgattagaacatatcgcaaacgaaattttatccattgttgatttaggtatcgaagtatccatcgtcatcggtggcggtaatatttttagggggcatctagctgaagagtggggaattgatcgcgtagaagctgataatatcggtacactaggtacgatcattaacagcttaatgcttcgcggtgttttaacaagtaaaacaaatagagaagtacgcgttatgacgtccattccatttaatgcagtagctgaaccatacattcgcttacgtgcagtccaccatttagataacggctatatcgttatctttggaggcggaaacgggcaaccgttcgtgacaacagattatccaagtgtacaaagagctattgaaatgaatagcgatgccatattagtcgcaaaacagggtgtcgatggcgtttttacaagtgatccgaagcataacaaatcagcaaaaatgtacagcaaactaaactataatgatgtcgttagacaaaatatacaagtcatggatcaagcggcattactgcttgcccgggactacaatttaccaacgcatgtctttaactttgatgagcctggagtcatgaaaaaaatatgtttaggtgaacatgtggggacgttgattaatgatgatgttacgatgcttgtgcatgaaaagtaatgatttcccaccaaaaaagggtgccttttgtaggcaccctttcctaattcatcatcacaaatagaactcaaccaatcccgccactttctccttacaacgctcccaaaaagataacttttcaaaaaactctttcgtcatttctttcgaatcatgaaaatcctctgttaacgccttattaacttgtcctacaataggaccaccataaatataaaaattcatttcatcatttatattgaagctacgcgaagtaaagtttgttgtaccaataacggttaattcattatcaataagcattaatttgccatggaacattccttttttatacccatatacagtaatcccattattaacagcttgacgtatgtatggatacgccgcttcttttataagaggtagatctggtttatatgaccaaagtatttttactgtaacaccacgcttttgtgctgcgattaaagcattcatggactctttattttttgctataaaatacggcgttgcaattacaatggagtgctgagcttgttttatgagctctatatatttttcagcaacgtaatgcccattgtaactagtcatagtatgtaatgtattccctttactagctttattcgtactcctctttatctcttctttcgtatctcgtttccaatctaaagcgaattgctgttctaaatcttttgctccttctcctttaagccgtacatgataatcacgccaatatccaaatcgcttatctttccctaagtactcatctcctatattaaatccgcctgtatagccaatctccccatcaatcgtcgtaatacggcgatgattacgatggtgaaatgaataaaatccgaatggcaatgcaggttttctactatatgtaaaatgcacaccactttcccgtaattcatttatcatctttctttcaaatgataaatcattaatgcgatcaactgataaatagacgtttactccttcttttgccttctcttttaataagtttaaaaaagtatgactacttttatcatccgacaaaatgaagaaataagtgtagatggagcttttcgcttttttaatatcttcaaatagctgctcatataatgatttcccttctacatataattgaaaatcactataatgaggcgcatactctgtcggcatgttttttccagcttccattttcctacctaaggtaacatcgatatgcatacaaattaaaataaaaacgaaaatagcaataataatagaagtaactcttaatattttttttatcattttggtttccttccaatcatattccttactatttcgtagtgtttcatttaaatatgttttcatacgaaatgtatttcttatttttattgatactgaacagttaaaggagatacgaatatgagaaaaggaaaaactcctattgtttttatcccaggtcttttcggttcaatgagcaatattattattcccggcactggtaattggagttttggactttctgcatttgtttacgaaccattcatcatgatgctagaaagtatggggtacgaacgaaataaagacttgttcatctgtttttatgactggcggcagcgtattgttctttctacacaaaaatatttattacaaacgattgcttatgctaaaaagattacaggttgcgataaactaaatttaatttgtcatagtatgggcggccttcttggacgttcttacgttcaaagtgacgaatataaaaatgatgtgaatcaacttataatactctgcacaccaaacgctggatctccaccaaattatagttattggactggaggcagtctccctatccatgcctcttctaaaataaatatcgttcatttttatatggaacaatatatttgttacttaagcatcttacataaaatcaataaagttgaggcgatacacatttactttccaggattacaagatgttattccttgtaaagattacggaaattatttatttataaaatccgactcttctattacatttcttccttatagtaagatgaaaacgaaaaaccctttcctcgatatattaaatacaaatagatttattatacaaaaaagaaatattgaaacgacactcattgccggagatggagaggaaacaactcaatatttacaagtcgtcccttcacattccaaactgaaatggacagacggcaaagtcgtcggtgatttacttacaaaacatggtgacggtaacgctgttctacatagcgtttttcttctagagggaaataaatatgttttgcatgcttcacataacgaagtgctctacaaaagcattcctatactacaaaagatactctaagtttcaaacaaaaaaggtatggcattaagccacaccttttcacattaaacaaaatttctcgcgtcattatttcttccaaacttataaatagcaattaagaagaatgcaattgcgaaagcgaataaaattaaaatgtttaaatacaactccgagaatggtattccctgctgcagttttgatatcgtatctaacaaccagcgctgcggaagaaaattagctactttttgtactgcacttggcataatgtcatatgggaaataacatccagcaagtaagcatgttggtacaatgatcatattttgcatcgcatttgccgatgctgagtttttcgaaaaagctacaaggactaatgatattccaattgcgattaatgcaaatagcattagtacgcccatcatcactatgaaaggcatattgatattcgtatgaaaaacattcgttaggaataggattgtaatcaaaatttgtactgttagtattatgatatttactccgacattagataatataaacttcttcccatctatcggcgttgataatagtctaaagtacgttctattctctttttcttttaaaatatgacctgataagttcgctgctgaaaacagcataaacataataaggtaacccatcgtttgatttgtcatatctttatttttcgaagtatcttctagcgtctcagttttcattttaaatgaacttttttgataccctgcgtacatattgtcgaatgtgctttgatctgttccggctactttactaatagctgctatattatcaatataattatataaatatgattttataaatcctgttacttgatcacctttaatcgatgaaatttcaatatgctctggtttcccttctcgaacactttttgaaaaaccagaatctaatgtaataactccatcaagttttttggaagtgagtttatcttctatttgagactccttaaccttactcacattcacatgatttaatccttctaaaaactttatcgtatcatttgctatcggctcattttctttatttacaatcccgatatttaacgttccttgccctgcatttccgtatatcgagaaggaaatgagcgtccctattatcggcaagctaattataattagtaaactttttttatttttcaaaagcacagataacgttttttgtatgagccataaaatatccttcatactatagcccctcccgtctacgtaatgcaataattgcaattaataaaaagagtgctgaaattccaatgtttaaagaaatgactggtagtgctgcccctacatcatttgcataaataattttcataacagctgtatttgcccaagttaatggcgataaattcgtaacgaaattttcttctactacgaaatatgcacctccaaaaatagaagctaattgcacaacaaccataataattgccctagacgcttcagctgttttcgtgatatatccgattcctaaaccgaagctaattgctagaaagacttgtgttaataaaataagaaatatgattccaagatggtcgccccaattcgcttgaaaaacaaatttactaaataacatgacgagtaatatgcacagggcatttgctactaggctaccaagtacttttccaatgaatatttcagctttacttataggtgcagcaatgagacgatctcctgttttacgtattcgttctcctcgaattaaagaactcgctcccatcgcagcatacagtgcaatcatcgttgtcattacaaccgcgtagtaatccatagaacctggttttttcgcagcttgtaaagatgtttcttttatataatcattatggtttccgtttgaaataactgtgctcaccttagtaggatctacttttgcaacttcgaccgctacattgtacttatcaacaaatgttgtaagcattccttccacaatactcccctcaatactacttttgtcacttccgtaaaattttgcaccatctttatttaactctacataagcagcatatttatttttcttcacttcttctttcccatctatactgccggaagcttttttaaaatgaatacctgatttatccacttctttcgtaaatgctgcaaatgattgagaaaacgtgctactcgcttcatctttatatagcacttgtatatctttaatcgaatgactatcactattaaatgcgttggttaacgctgttcctaacacaagcataagtacaatcggaaatgctaacataaaaactaaagttcttacgtctctgaaatctcttttaatatgcataattgcaatattgaagatgttcaattgatgaacctccctttaccttttcttcatttaccttttatatatcaggtaagtttcttccggttaccgaaagatatactgtttctaagttgggagcctactccctctaacgaacgaattccaatgtcatgattaatgaaatgcggcattatttgatttaaattatttaatccggcatccgagtttaccttgattacgtttctcttcaatttgaacagctttcacaccgtttatctcttttaacttttctgcatctaaattttctactgacttttctttaatccaaatatctttcgtatctgtaataatcgcttttaactgttctttcgtaccttctgcaatcactttaccatggtcgacaattgcgattttcgtacaaatctcttctacttcttccatgtagtggctcgtgtaaataatagtgcttcccatttcatttaacttccggacagactgaagaatatagtttcttgactgcggatcaattccaactgtcggttcatccataataattaacttcggtctatgtgcaattgcacaagcaatattcaatcttcgtttcatcccgccagaaaagtttttcggataacttttatgtttatcgctaagccccacaaattgcagtgcttcctccactctcgcttttagctcaactcctcttaatccgtacaacccagcaaagaatttcacattttcataggcagttaactcttcataaatcgcaatatcttgcggaacgataccgatattcatcttcgcaaatcggttatgtttctttatattttttcctagtatgctaatttcgccttcattacttcttaacaaaccagcaatcatattaatcgttgtactcttaccagcaccattcgatcctaaaaagccaaatatttctccttctttaatagataaagacatattatcaactgcgatgaaatcaccaaattttttcgttaaatttttaatttctaatgtattcatcatttcacccctatttcggtttctctgcttttagtataaacaaaaagaatgaacctgctcagtgcagaagttcattcttttcacatgagattattcacttttttcatatgagatgattcatcctcatatcggcaacaacattgttactgcaaaaccacttgttccatctacaataatttttccgtttactgacgctgttcgctcctccatccccataatcccgagacctttcttaacgagaaccgcaccttttccgttatccttcacttgtactttcaccatcttgttaagtacatgaatatcaattgagatgactgtcgcatcagcatacttcatcgcgttcgttaatgcctccataacattttcaccaataattttccactgtatcggagaaatcatatctaagttccctttataaacgaaaggaatattcacatcattcttaccggcaaattcctctatgaataatttcatacgatgaataccaatttgctcagttggtggcttcatatttttcaatgtaatgcgaatactttcaattccatcttttgaaatgtgaattgcattttgtaataactccgcagatttttttttatctatttccattaacctctttgctgcctccatttgaataagtgcacccgtcatcgagtgaccaattttatcatgaatttcttgcgataaccgatttctctcttctagcttaaatgtgtattcagattgtcttatgtactctttattttcatgtaagcttttcgtaagtcgttgcatatcttttcgcatcttatcattttgcgattcaagctttactacacgcgatatatatcgatctgcaatagttaaaacgagaaaagaaaatgcaacaattaatccataagtcattcgaatactttcatctgcaatcgtaattgggagcatcataacgacaaagcgtggccaattcttttctatgtaatagaatgtaatttcgtataagttcaaagataaaaacaaaataaaaaatggatgaaccctccatgtaaataacataactacgccaatggatatacagattaatatttttttatacgtatcttttttaaatatagaaatcattacgtttacagaaaggtaaataagtaaagtaaatataacccacggtaaatttgctacatttgcgtaaatataactgaacacaatatataaaaagacaattaatttacttacagttaaccaaaattccatatcattaatctactttcc

SEQ ID NO: 1338 - DNA, 13253 bp, Bacillus thuringiensis
cggttgttcacacgattgtcagattcataagaggaaagctgtattatgatagtagataaagtgataaccgggtgaaggggaacatgttgcgtgcatattattgctgttagtgtaaattatagaccagcccctgtagaatttcgtgagaaactcacatttcaggcagcagaactagagcgagcgatgactacattacaaaatcaaaagagcgtgttagagaatgtcattgtatcaacttgtaatcgcactgagatttatgctgttgtcgatcaattacacacgggacggtattatattaagaagtttttagctgattggtttcagcttgaaatagaagaagtcgcgccatatttaactatttttgaacaagatggtgcaatagatcatttattccgcgtaacgtgcggtttagattctatggtagtcggagaaacgcagattttaggtcaaataaaagatagctttttagaagcgcaacaagttaaagcaacaggcacaatttttaatgaattgtttaagcaagtcattacattagcaaaacgtgcccactcagaaacaacaatcggggaaagtgcgatgtctgttagttatgctgctgttgagcttggaaagaaaatatttggcgagttaacagattgtcatgtgcttattcttggtgctggtaaaatgggcgaacttgcactgcaaaacttatatggaagtggtgctcgtaaagtaacagttatgaataggacgctttcgaaagcagaagtaatggctgagaaatatatgggacatgcaaaatcgttaagcgaattacaatgtgcattattagaagcagatattttaattagttcaactggtgcatcggagtatgtcattacgaaagagatgatgacgaaggtagagaaaatgcgctctggtcgccctttgtttatggttgacattgcagtgccacgtgatattgatccagcgattgatgagctagaaggttctttcttgtatgatattgatgatttacaaggagtagtggaggcaaaccgtgctgagcgtttgaaagaagcagagaaaattcaatttatgattgaagaggaaattgttctatttaaaacgtggttaagtacacttggtgttgttccattaatatcagctcttcgtgataaggcacttgcaatccaaagtgaaacgatggtaagcctagagcgaaaaataccaaaccttagtgatcgtgagaaaaaagtcattagtaagcatacgaaaagtattattaatcaattattaaaagacccaattttagtagcgaaagaaatagctgctgaagagggagcgagcgaaaaattagcgttatttgcgaagattttcgatttagaaacggaagacgtagagagttgtgcggaagaagtagaacataaaaaagtgtggacaccatccgttccatctttataatttggaaggatgatcggatgagttttttaaataacagtattatttatcatattgcaattattttatatgcttgtagcattagtttatattttatagattatttccaaagtaaccgaaaggcgaaccgatttgctttttggttacttgcgattgtatgggtcctgcagtctatttttatgttgcttagggctacagattcagaaacgaatcctattttaactttattatcagggatttatttttatgtttggttattgattacgatgtcgttagtcattaatcgatttatgagaatcgactttttagtcttttttacaaatgttgttgcatttggcgtaagcgctttttctatttttacaccgctcggaaagatgtcgccagtacttgcggaacaattagtttcagaacttgtatacgtgcatgtcggtatggcaattatttcttacgcaacgtttactgtatcgttcattttttctattatgtacttattacaatatcgcctattaaaaaagaaaaaatggaatgcgagattaagaaggttagggaatttaccgaagctagaatctatgtcttacggattaaatttattttctgttccatttttcttactagcaattttattaggatgtatatggggatatacaaaattggataatttccattggtatgatacgaaagtaatcggatcttttgtcgttctatttgtgtattgcacaggtttatatttacgagcggcagatgtgttgcaaggtaagaaaattgtacagtggaatatcggatcgtttctcgtaatgctagtaaacatttttctattaagcagtttatccaatttccacttttggtatttataatgaggagagagaattatgcgcaaaattattgtaggatcacgaaagagtaaactagcattaacgcaaacaaactggtttattgatcagttaaaagccctaggtctaccatatgaatttgaagtgaaagaaattgtcacaaaaggtgatgttattttagatgttactctttcaaaagtaggcggcaaaggcttgtttgtaaaagagattgaacatgcgctacttacgaaagaaatcgatatggctgtacatagtatgaaagatatgccagccgtacttccagaaggtttaatgattggctgtacaccaaagcgtgttgaccctcgtgatgcttttatctcaaaaaatggagcatcgtttaaagagttagcggaaggtgctattttaggtacgagtagtttaagacgtagtgcacagctactcgctgcgagaccagatttacaagttaagtggattcgcgggaatatcgatacacgtttacgtaaattaaaagaagaagattacgatgcgattattttagcgacagctggattacaaagaatgggctgggatgatgaagttattacagaacatttagatgaagcgttatgtgtacctgctgtaggacaaggtgcattagcgattgagtgtcgtgaggatgataaggatttattacaattgttagcgcatattaatgatacgataacagaaagaacagtggcagcggagcgagtatttcttcataaacttgaaggtggatgccaagttccaattgctggatatgcaacccttacagaaaacgatgcaatcgaattaacagctcttgtcggctctatggatggctctgttttattaaaagagacagtagtgggtactaatcctgaggaagtaggattagaggccgcggaccgtttaattaagcaaggcgccaaagaactcattcttgctgcaaataaggagcaacaataaatatgaacgctctcgctggaaaaacggtattgattacacgtgcccagcatcaagcgaaacaaatgagtgtagcagtgaaagaaaagagcggaattccattggaaattccgcttttgcgtatggaaggtatgtctcataggcaaattcaacatattgaagagcagctacattcatacgactgggttatttttacgagcagaaatggtgtagctttttttatagatagtttaaaaaagaaactaccactaaccattaaaatcgctgcggtaggtgtgaaaacaaaattagagttagaaaaaaggggctatcaagttcattttgttcccacttcatttgttgcagaagcatttgcagaagagtttctaaaagaattaagtggaaatgaacgtattttatttccgaaagggaatttagcaagagaggtaattccggttgccctacgggaaattggtatttctctagatgagctaaccgtatacggtacgaaagtgaatatagaaaaaaagcaagagcttatagcggcattgaagttagggaaagtagacattattacatttacgagcccttcaactgttactagttttgttcgtttacttaagggtacaaactggagagaatggacaaaaaaatgtacaattgcttgtataggacctattacggaaaaagaggcaagtctttattttccgtctgttattgtgccgaaagagtacactgtagaagcattactacaatgtgtttgtgaatctataaaatgaaagaatggggatagaaatctatgaactctttacaatttaatcgtcatcgtcgtttaagacaaagcgggggcatgcgtgcgcttgtgcgtgaaacgtttttacatacggaagattttatttaccctatttttgtattagaaggtgaaaatgttcgtaatgaagttccttctatgccaggcgtatatcaaatgtctttagatttattgcaagctgaaatgcaagaagttgttgatttaggtattcgttctgttattgtatttggtttacctgctgaaaaagatgaagttggatcatcagcatattgtgatcatggaattgtacaacgtgctattcagcaaattaaaggtgatttccctgagctagtagtagttgcagacacatgtttatgtcaatttacaagccatggtcattgcggtgtaattgaagatggtattattttaaatgacgagtctcttgcagttcttgcgaaaacagctgtaagtcaagcgaaagcaggagcggacattattgcgccatcaaacatgatggacggcttcgtaacagcaattcgccatgcattagacgaaaatggttttggacacgtgccagttatgtcgtacgctgtgaaatattcatcagcattttatggaccattccgcgatgctgcgcacggtgcaccgcaatttggtgaccgtaaaacatatcaaatggatccggcaaaccgtatggaagcattccgtgaagcagaatcagatgtaatggaaggtgcagacttcttaatcgtaaaaccagcgctttcttacttagatatcgttcgtgatgtgaaaaataactttaatttaccagttgtcgcttataatgtaagtggtgaatattcgatgattaaagcggcagcgcaaaatggttggattaatgaaaaagaagttgttcttgaaaaattaattagtatgaaacgtgcaggagcagatttaattattacgtatcatgcaaaagatgcagcaagatggttacaagaaggaggcgctaaataatgaaaaagtttgataagtcaattgcagcgtttgaagaggcgcaagacttaatgcctggtggcgtaaatagcccggttcgtgcctttaagtctgttgggatgaatccgttgtttatggagcgtggaaaaggctctaaagtatatgatatcgatgggaatgaatacatcgactacgtattatcatggggtcctttaattcatggtcatgcaaatgatcgtgttgtagaagcgttaaaatctgttgctgaaagaggtacaagcttcggtgcaccaacagaaattgaaaataaattagcaaaacttgttattgagcgcgtgccatcaattgagattgtgcgtatggttaactctggaacggaagcaacaatgagtgcactacgtttagctcgtggttatacaggtcgtaataaaatcttgaaatttatcggttgttaccacggtcatggtgattcgttattaattaaagctggttctggtgtggcgactttaggtttaccagatagtcctggtgtaccagaaggtgtagcgaaaaatacgattacagtagcttataacgatttagaaagtgtaaaatacgcgtttgaacaattcggtgatgatattgcttgtgtaattgtagaaccagtagcaggaaatatgggggttgttcctccgcagcctggatttttagaaggtcttcgtgaagtaacagaacaaaacggtgcattgcttatttttgatgaagtaatgacagggttccgagtagcttataattgtggccaaggttattatggcgtaacgcctgatttaacatgcttaggtaaagtaatcggtggtggtttaccagtaggagcatacggtggtaaagcggaaattatgcgccaagttgcgccaagcggaccgatttaccaagctggtactttatcaggtaacccacttgcaatggcggcaggttatgaaacgttagtacagttaacgccagaatcatatgtagaatttgagcgtaaagctgaaatgttagaagctggattacgtaaagcagctgaaaaacatggcattcctcaccatattaaccgtgcaggctctatgattggtattttctttacagatgaacccgttattaattacgatgcagcaaaatcttcaaacttagaattctttgcggcttactatcgtgaaatggtagaacaaggtgtattcttaccgccatctcaattcgaaggtttattcttatcgacagcacatagtgatgcagatattgaagcgacgattgcagcagctgaaattgcaatgtcaaaattaaaagcgtaatgtattagagaaaatcgctctccataaggggagcgatttttttattcataaagtaagctttccgcacataaatctgtaatgacatatagtttgggagggggaaaagaagtggctgcagatcattcattacgattttcattaaaagaatctgtgtggttccaaaaaggacaggaagtcgaagaacttttgtcaatttcgttagatccagacgttgagatagaagagcttgatcatgaagtaatcgtgagaggacaattagatttaacgggagagtatgttgcacgaaaagatgattcagcgtattcattaagagaactatcgccagcaaagtcaattgattatgtagaaacaagagaagatggggttaatgaacttgttcattcctttccacttgaaatatcaattccgagaaatcgagtgaaagtaattgaagagctatatgtatcaatcgaggaatttgattatgaattaaaggaaaatggttgcttacaattattagcggatatatctattaccggtttgtgtgatgaagagagaagcgaggatgaagttgaagaggaagaaacggtgtatgctgagttagaagaagattcagcgcaagaggatgaaaatagaccggcgccgcatgtagaagaaccagcatataaggaatcagatgagtgggaagattacgcatttgaaccgttccaattagaggaaagaaaagagcaggaattagaagaagagaaaatagaagaacatgaatttgtggaacgtgaagaggagcaagaaacaacgccgcaatttgaactgttcggacgaaaagatttcaagaaagaaaaagcaaaaaagcaggaagaacaagaagaagagtactcacagcgagatgaaaatgcgctttatttaacaaaactatttacgaaagaaccggaagaagaatttacaaagttaagaatgtatttcgtgcaagaaggggatacaattgaatctattgcagaccgttatgaaacgtctgtacaaaatttacaccgtgtcaatcaaacagaagatatatttttaaatacggggcaaattatttatattcccgtttcaagggtaaagacgaaataaggaagtgagtgttttcactcacttcctttcttagaggctatgttttgaatagaaagggttattcgtatggatattgagttgcgaaatcactatgaacctatcgtgaggcaatatagattggatacgcagcatatggaagagcacggaaatgtaatgaaaatttatacgaatcaaggtccatatgcactcaagaaaatagaaggcagaaagttagagcggaataactttctgcatcatattcaatatttgaaggagaaaggtttttcaaattatgtacctatatatcatgcgacggatggaagttatattttaagtgacgggacgtataattattatttaatgccttggttagaacgtgcagaaggaaacggtgatgacaatgatcaataccataaaatgtttcagacacttggaacgttgcatcaaaaaactgtgaaggaagaaacgtatacggaagaagatttagaaaaacattatacaagtatatccgatcgttgggaaaatgatggtgagatgttagaagagtttctcgtagaatctgaatcaaaatggtatatgtccccgtttgaattgcaatattgtacgtactatcatcatgtaatgagagcgcgtgaatttgcaacgaagcaattaaatgagtggaacgatgcgatgaaagaaaaagagaaaacgcgtattacttttgtgcatggtaatgtgtcacttaatcattttttatttgactatgagcggaatggctattttattagtttagaaaaatcgaagtttgcaacgcctgtgcaagatatagtaggtttttattcacggtctttaaacacatatccaatcgcaagaagtgatcggtttgaatggtttcaaatgtatcaaaaaaatttcccttttacgaaagaagagcaactacttatgtttgcgtatatgacgtatccatcgcaatttattcggcaaatccagtcttataagaaaagaagagataatcgcaacgaggaaaatgaactgcgcggagtaaagagtttgcaacaatcgcattggctcgttagcaatatagaatatttcctgtcgcaattacaagctgcccagcaagggaacggataaagtaaaggcattctccgctgatgattagccttcaccaattgggcgtttacgggcagcagggctcccatctaacttctttgcttcagctgagttttgaggtggaggtcttactgcccgcaaatagcgggggaaagaagataagtagaggattctacttatcttcttttttttgcacgaaaagctgtagttttaaatttatcttgacgaataaggtttcgttttttacactattgtatataataattaacaatcatataaatgccttgaaggggaagagtataacatgaaacgtcttcagagaggagaatcattagctgagagattctctagatagttatgttagaaggtagccctggagcatcttttctgaacggaatagttcttattaggaaaagacggatttgtccgttatcaaattaagagtataagcaaattatgaatttgtttgtaaataaaggtggtaccgcgatgtccctcgtcctttttggatgagggacattttttattttaaggagggaaaataatgtcaaacacggaaaagaatttaccaactaaatatgatcatatgtccgttgaagaaggcctttatcaatggtggcttgaaggcaaatattttgaagcaacaggagacgagaagaaacaaccgtatacaattgtaattccacctccgaacgtaactggtaagttacacctaggtcatgcttgggatacaactcttcaagatattttaactcgtacgaagcgtatgcaaggatacgatgtactatggcttccaggaatggaccatgctggtatcgcaacacaagcgaaagtagaaggaaaacttcgtgaagaaggtatttcacgttacgatcttggccgtgaaaaattccttgaaaaagcttgggagtggaaagaagagtacgcttctcacattcgtcaacaatgggggaaagttggtttaggactagactattctcgtgaacgattcacattagacaaaggtttatcagatgcggttaataaagtattcgttcaattatacgaaaaaggcttaatttaccgtggtgaatatatcatcaactgggatccagcaacacgtacagctctttctgatattgaagtaattcataaagaagttcaaggtgcattctaccatatgaactatccgttaacagatggttctggtcacattcgtcttgcgacaactcgtccagaaacgatgcttggtgatacagcagtagcagttcatccagaagacgatcgttacaaacatttaatcggaaaaacagttacacttccaatcgtaggccgtgagattccgattattgctgatgagtacgtagaaaaagatttcggaacgggcgttgtaaaaattacaccagctcatgacccgaatgactttgaagtaggtaaccgtcatgacttaccacgcatattagtaatgaacgaagatggaacaatgaacgaaaaagctggtaagtataacggtatggatcgtttcgaatgccgtaaagaattagtaaaagacttacaagaagctggcgtattagtagaaatcgagccacatatgcattcagtaggtcatagtgagcgtagcggtgcagttgttgagccttatttatcaacacagtggttcgtaaaaatggctccacttgctgaaaaagcagtagcgcttcaacaaaaagaagaagaaaaagtaacgttcgtaccagagcgttttgaaaacacatatttacgttggatggaaaatattcatgactggtgtatttctcgtcaattatggtggggacaccgtattccagcttggtaccataaagaaactggtgaagtatacgtaggtacagaagcaccagcagatattgaaaactggaatcaagataacgacgtacttgatacatggttcagttcagcgttatggccattctcaacacttggttggccaaatgaagattcagcagatttcaaacgttactattcaacagatgcactagtaacgggttatgatatcatcttcttctgggtatctcgtatgattttccaaggtttagagtttacaggagagcgtccatttaaagatgtattaattcacggtttagttcgtgacgagcaaggtcgtaagatgagtaaatctcttggtaacggtattgacccaatggatgttatcgagaagtacggtgcagatgcaatgcgtttcttcttatcaacaggaagtgcaccaggtcaagatttacgtttcagcatggaaaaagtagaatctacttggaacttcattaataaaatttggaacgcatcacgtttcgtattaatgaacatggatgatatgaagtatgaagaaatcgatttaactggtgaaaaatcagtagcagataagtggatcttaacgcgcttaaacgaaacaatcgaaagcgtaacacgtaacatggataaatatgagttcggtgaagctggtcgttcattatacaacttcatttgggacgatttctgtgattggtatattgaaatggcgaaacttccactatacggtgaagatgaagcagctaagaaaacaactcgttctattttagcttacgtattagatcaaacaatgcgtctattacacccattcatgccattcgtaacagagaaaatttggcaacatttaccgcatgaaggcgagtctattacagtagctgcgtggccaacagttcgcgaagatttacaagatacggaagctgcggcagaaatgcaccttctagttgatatcattcgctctgttcgtaacatccgtgcagaagtaaatacgccaatgagcaaaaaagttcaaatgcaaattaaagcaaaagatgaggctgtacttgctcaacttacgaaaaacagctcttacattgagcgtttctgtaacccaagcgaattaacaattcaaacagacttacaagcgccagaaaaggcaatgactgcaatcgtatcaggtgcagagttattcttaccgttagctgatcttatcaatcttgatgaagagagagctcgtcttgagaaagaacttgagaagttcgataaagaagtagaacgtgtacagaagaaactttctaaccaaggtttcgtagcgaaagctcctgcagcggttattgaaggagagcgtgcgaaagagcaagattacctagaaaaacgcgaagcagttcgtcaacgtctagcagatcttgaaaagtaaaaatgtttttagagactcactatattggtgagtctcttttctttgcgtataatagaactatgaaagttgtctattgaaaggggaaaaacatacgtgatacatacatacgaagaagcgatagggtggatccatagccgattgaaatttggaattaaaccaggattagaaagaatgagatggatgttagaagaacttggaaatccagagcgtcatataaaatgtgttcatcttgctggtacaaatggaaaaggttcaacgttaacatatatgcgttacatgttagaaggcgcgaaatataaggtaggaacgtttacctctccttacatcgaatcatttaatgaacgcattagtgtgaatggaacaccaattgcagacgaagagattactgaacttgtaaagatggtaaaaccagtcgttgaaaaactagatgaaacggatttaggggaagcgacagagtttgaaattattactgttatggcgatttgctatttcggtaaagtcaatttctgtgatgttgttttatttgaaacagggcttggtggacgttttgactctaccaatgttatacaccctgtcctcacgattattacgaatatcggtcacgatcatatgcatattttaggaaatacactaggggaaattgcatatgaaaaggcggggattattaagtctggcgtgccggtaattactggtgtacaagatgaagaagctttgcaagtcattcaaaatgttgcaaaggaaaaccatgcaaacttatacgaacttagcaagcattttacagcgttacataaacagtctaatgaagatggggaacagtttgattttacttgtcctttttccgcatttgaagatttgcaaatctcaatgaaaggcattcatcaagtaggaaatgcagcgttagcacttatggcagtaatgtatgtaaaaacatatttatcatttttaattgaagaagaggaaataagaacgggattactggaagcatattggattgggcgctttgaaaagttgcaaagtaacccggatattattatagatggtgctcataatccagaaggtatcgaaagccttgtgaaaacagtagaagcgcattacaaagataaaaatgtaatagtgttatttactgctcttggtgataaacaattacataacatggtaggccaattagaaaccattgcagatgaaattatttttacaacattcgcctttgatcgtgctatttctgctgataagcttgcatcatattcacagaaagaatcaaaattagtttttgaaaattggaaagaggcaattgatacaaaagttgaaatgatagcagaaaatgatgtttttatcataacgggttctctttatttcatttctgaagtacgaaaatatattcgcgagaaaaactagatagtctttgctatctagtttttttgttctacaaatgaagtcaaatgcatacatataagataaatatatagggttatttggcgaattcctctgacaaatatctcgtttttttatgaaatgaatatgatatgatgcggacaccgataagaggtgaggtgtgagtgtatggacaagcaatcacgaacgatatcagtgaaagtgaatggaacagaagcgatgcttgaggaaaaaat

SEQ ID NO: 1339 - DNA, 13116 bp, Bacillus thuringiensis
aaactatgttgaaaaatacccagggcaagtaaaatacgttcatcaaaaaaaccaaggtgtttcggtagcccgtaatacaggtatcgaaaatgctagcggagaatatatcgctttccttgatagtgacgacttatggcatccaactaaaattgagaaacaaatcgagagtatgcataaaaacaacatggacgcgtgctattgtggttatatgaatttctacgaagaaacaggcgagaaggttgaacatacaacaaactttattaaaggtgatatggcaaaagcattcctaacacatcaagttgttgctcaaacaagtacttggattttcaaacgatccatcgtaatggatcataacattcgttttacaccaggatgtagttggggagaagatttagagtttttatttaaacttatgagtttgacaaatgtatgttatgtcgatgaatacttaacttattatagaatcttatcagaaggaaatctttcttctaagtataaagattatgaattaaaaacaacaaaagagctagaagtattcaatcgtatgaaagattgggtacataataaatctcaagacttcattacgaaagaccctcagtcactgattgagattcttgagacttatttattcccttatacagtcatcaataacgcttgtatatatattaaagaaaactctcgattagataaatcacaagttcaattaatcaaaaaagatataaggaaatattgccgtaaaatctattcaaagaatggaaagcgtagtaaaaaactatatgcaatgctttggtttgtacgaattaaatttctgttttcttaaactgaaaatataacgatactctctctttctgtgaacaaattaaatttacaaataggacaaactaaccgggtcctaaagaatagaaaggtcttttctcatgaaaacaaataaaattctaaaaaacgcatcctacctctttgtaggaaacattactgtccgctttgtactggctattgcaacaattttctttgcaagatatgtttctccaagtgattacggtatgtttacaactgcgttagcagtttcagctgttatttgttactttacagatgcaggtttaacacatacgtttatgcgtgaaggaacgagaagcgatgctaatattagtgtgctaataagtagttatttacgtattcgtttaatattagctatcgtaatttctgtacttttcgctatttttgcccagttcttctatcccgatgcttacttacgtgcgatggtatattgggttgtcctaccaacaatgttcggagcaaccttacaaggtgttggtatggcttacttccaagtaacagaacgcatgcaatttacagctattatttctgtactacaaggtgtaacagctgctgctgccctattactagggatgtctttccaatggtcacttatgatggttgctgccatgtacggggtatctagtcttgtaacaggtgttatcgcctttataatgacaatacgttacacgaaagtccataagggttgggataaaggcattttagatcaactacttattttcacgatcaacggaatcattattatgctcttaccacaattgggccctattatattagaaaaggtttcaacatataagcaagttggattctttggtgctgcatctaaaatacctgctgtactatatcaaatacctggagtaattgcagctgctttttatccaagactttttgcttttggtaatgagaaaaatattgaagaacatagaaaattatcaagttttgaattaaaacttatgtcttttttaggaatgggaatttctatcccctttattgctgatccaagtttctggattgttagtttattaggagaaaaatacgctcccgctggtgacgctcttgctattctagcgtttatggttattttacaatcaattaactatccactagccgataatttaacaacgattggccagcaatggaaacgtgcaacaacaatgactattggattagttgttgccatcataggttatattgtattaggtagtaaatatggaatgatgggggcagctgccgcagccatcattaccgaaattacactattaattggatttaccctctttattcgtaaaggcatgcaattattagttaaaggaattatatttaattccttagcctttattattagttacggtatataccgaattgcattaatcaacttaccaccattagttgctttaactcttactggtatactatacggtataatcggaattgtaattgatcctcaaatacgtggattcgttttaggatttataaaacaaaagcttattcgcaaacatgcttaaaagcaaaaagcttttcctatttaaaaatggaaaagctttttgcttttttatataccatcatttttcttcagtaaaaaaatgctatatattccagctcaaattgacttactttctgaaaatgccttatactaaattacatgtaaactatgaacttcaacgcttgtaaaaatatatatgcttcaacaaaaatatatattttctcatgttaaaactaaagaacacacctttaaaaattggtgtgtttttatatgctacctaaaaactagttgctacatgtaacgactttcaaaggaggattatcaatttttatgagcataaagccgaataataaattcttttccaagaaaacaataataattatgccaatattattattgtgcgcttttgcttttcattatttctttttaacatctaatcaagccttttctggtacaggggatgcgttacgtcaatttggtttttttacgtttcttctacaacatgcctttaaagatggcaaccttttttggtcttttgattatggattaggtggagatttatttggagagtttagttattattacagcacatcaccgtttttctggattacactgttactacctaaactaagtcttgagcaagtatatgacgtgaaattatacatgagtattttaaaaaactttttagctatggtattcatatatggttctttacgttaccataataaaacagcattctcatcttttgttgctgctattatatatggtggttgtattactttcatccgccactctttactatgggatttcatggctgatgccattgtatttttaccattagtaatatggggacttgataaatatattattgaaaagaagcgcggacttttcctaatcgctgctactttaatgttagcatcaaacttttattttgcttttatcacaagtattttcatatttatttatgcattattccaatactttgcgacacaacaaaataaaacgattgtctcttttctaacttattatattagaatcggtttattgtatggattatcactcggtttagccgccgtttgcttcctcccatcagttaatgccgtatttagtgctgatcgactatcaaaaaagtttgagataccattattatttgaagataaattttataaagatttaatggaaaatattttcttcatgtataatgctgaaaatcatcaattagctttaccagctttaattttattcttaatcgtatttggaatgtttatacgtgataaactcgttaaaaataaagtattctttacgttattcatgttcattctgtttatgcttccatatacatattctgtgtttaatggtttttcagcaatgcaatctagatggttctatttatttgtatttgtaattgcccaaacaattgcatacattctagattggatgattattcataagaaagactacaaattaccttatttaataagtttattagtgtctattggattattcatttatgcattttatagaaaagcaaatataaatgtaactgataaacctttacaagacgttgataacattttactcggaactgtcgttctttctgttattacagtatgtttatggcgttatatttccaaacctttcatacaatttttagttgtattgaatgtactcgttagcacaatttctatgaattatatgtatgcgaataatatacttagcaccgtttacggacagagccagatttcaactgaaaagttacacgaaccaggctatgataataaagaagaaattgctgcaattcgctacatacaagaaaatgataaagacttttatcgtattcttaatccatatagcgaatataacacaccaatgctacaaggttatcatggcttaagtacgtatcaaagcttagttaattattatgtccatgactttatgaaaaataaatatggtgtattccaaatgtacgatacaccttcaatgttttatcaagctgatagtcgactactacttgaaaatatgctaggtgtaaaatatcgcgtattaagtgctgatacagattcaaagaatgtgccttatggatataaactattacagcaagtaggaccgtataatatttacaaaaatgactatgctttaccgttaggatatgtatatgattcggctataagtgaggaagaattttctaaattaaacttcgctcagcgtgatcaattattattacatgctgttgtcgttaataatacaaaagaattttcattaaaccattttaataaacaagaccttaaatcaaaggcagtatctattaaaacggaaaaagcaaaattcgaaaacatagaaaaacaagaaaataaactaattgttcatggctttggaaatatgattgtacctatcaattatcctgatacacctggtgatctactgatagaattaaaattaaaaaatgcaggcacattcaatgcaactgttaatggaaaaacgataggaaaaggggacgatgctggtgcatactcttatccgttagaaaggtttgtttacaatttgggcaatgagcgtccagaaaacctaactatctctattgatatggcaggtgagtatgaattaggtgacttgcaagcaaatattgtaaactatgaaagtgtacaaaaagaaacaaaaaaactaactgaaaataggcttgaaaatatttattataagaacaattatttaaaaggggatatcaaatcaaataaagacgggctcttatatttatctgtcccatatagtaaaggctggactataaaaattgatggaaaagaaacagaatttacgaaagcgaattctgcctttatcggtgttcccattacaaaaggttcacatgtaatcgaaatgacttacgttacaccttacttcaaattaggtatgattatatcaatcatctcactaattatctgtatagctttactaattttcaaaaatccaaaagcacgacgaaaattttcttttaaaaagcaataatgagcaatcaatgaatcatgaatctatccaattggatagattcatataaaaacgcataacattgttttaacccactacaaacaaggagtgtcaaaaatgactctttcaatcgttgtaccatgctacaatgaataaaaggtgcttcgagccttttattcagagacttctcttgaaattcataaattaactaccgattatgaatttgtttttgttaatgatggtagtaaagatgatactttaaatattttacgtgatttagctagttcagattcgtcagtacactacatatcatttagtcgaaacttcggaaaagaagctgcaatgttagctggtttaaaatatgctacaggcgatgcaattgttattatggatgctgacttacaacaccctcctacgttaataaaagaactgttagaaggatataacgacggctacgaccaagtcattgcaaaaagaacaagaactggtgattcacccgttcgctctttcgtctctcgtctttactataaagtgatgaataaatttgtagatattgaattagtagacggtattggtgactttagacttttaagtcgaagagcagtagattctttattatctttaagtgaatacaaccgattttcaaaaggcttattttcttggatcggttataacgaattaatcattgaatatgaaaatgtattacgttctgatggagaaagtaaatggaccttctcgaaattattaaattacggaattgatggtgtaatttcatttaataataaaccgttacgtctatctatatatctcggattactaacaaccattttaggacttttatacgtaatcactacgttcgttcaaatcatccttggtggtgtggaagttcctggttactttactctcatttccgctatactatttattggcggtattcaactcatattcctaggtgttattggtgaatatatcggtcgtatttattatgaaacaaaacgtagaccgcattttattgtagctgaaaagaaagttagtgaagttaaacaaaaggcataaccaaaaagttacttctgtaggtagaagtaacttttttatatactaacatttacaaacacttcttttgaaaaaatatacattttgaaatgatggcattatatgaaagaatttagtatcatgattcaaggtactatttcaagttggacggaggatactatgagcttattaacagttgaaaaattaggacatacatttggtgatcgtacattatttaaagatgtatctatgcgattattagcaggtgagcacgttggattagttggtgcaaacggtgttggtaaatcaacattcatgaatatcattactggtcagcttattcatgaccaaggtcgtgtagaatggacaccgggcacacattacggctacttagatcagcatactgttttaacgcctggacgtacgatccgtgacgtactagcggatgcatttttaccgttattcgaaaaggaaaaagctttaaatgaagttacagaaaaaatgggaactgctacaccagaagaactagaagaacttcttgaacaaatggcagaaatacaagatgcacttgaagcaggtggtttctatttactagatatgaaaattgaagaggctgcacgtggtcttggaattgatgctattggtttagatcgtgatgtttcagcactaagtggtggacaacgtacaaaggtattgcttgcaaagctattacttgaacagccagaagtattattgcttgatgaacctactaactatttagacgttgaacatattcattggttaacaaattatttaaaagaatacccacatgcattcttattaatttctcatgatacggaatttatgaacaaatgtgttgatgttattttccatctagaattcacaaaaatgacacgctatacagcgacatatgaaaaattcctagaactagcagaaatcaataaaaatcaacatataaacgcttatgaaaagcagcgtgagtttatcaaaaagcaagaagacttcattgcaaagaacaaggctcgttattcaacaacaggtcgtgcaaagagtcgtcaaaaacaacttgatcgcatggagcttattgatcgtccggaaacagcaattaaaccggaattctcatttaaagaaagtcgcgcaagtagtcgcttcgtctttgaaggtgaaaatgtagaaatcggatatacacatccgctactaccaaagctatcaatgacgattgaacgtggtgaaaaaattgctattgttggatgtaacggtgttggtaaatcaacgttactaaaaacaatcttaggtaaaattaaacctttaagcggtaaaacaagccttggtgacttcttagagcctgcatactttgaacaggaagttaaagctgataatataacaccaattgatgatgtatggaatacattccctggtttagaccagcatcaaattcgtgcgatgttagcaaaatgcggattaaaaaatgaacatatttctcgcccattaagtcaattaagtggtggagaacaagcaaaagttcgtttatgtaagctaatgggtgaggaaagtaactggctactatttgatgagccgacaaaccatcttgatgttacagcaaaagcggaacttaagaaggctatgaaagcatataaaggaacaatcctccttgtatgtcacgaaccggacttctatgaagattggatcacaaaagtttgggatgttgaagaatggtctcaaaatagtaaatagtctttaagaaaaaactccttgtgtacacaaggagttttttacttgtttctattaagaattttttatattgtagtatcctataaggcgtaatcgaaattcttttaattccggatacgcctctaaatttgctaacatacctctaattaccggaattcttggattaagcaatcgcatttccgcctctaaaacatctaacgttactaacaactcatcatcctctaattgatccgctaaattacgcttaaatacaataatttcttttaaaaaatgctctttaacttgttccttaatgagctctgatttacaaaggaattctccaagcttttcttcatgtaaaataggttcttctgaagattctaccaaaccatttactaaatgatctactctttttaaaataaaagcagcgacatacgataaatcaatttctggtgcttgtaaaataattaattctaaataaccacggcatatgccttctactataattactaaatccaataaatatggcataatcttttcaccataaatggacaataaactattccgataaaatgcatgagactctaacttcatccgcatcataaattcttccacttctttattaaacggaattgcattttcccttgcatgcataataataaattctttatgtttttgtatatcattaaactgacagtgtaattgttttgcaaatttttcacgtggtaataaagactcttgttcaatatccagcattttcttttggattttgtcataataatatcgaagtgtcgctaataaaagctcatcttttgatttaaaatataagtaaaaagctcccttagatataccactagctgtcacaatttcctgcactgatgtcgcatttacacccttagtagcaaataacttcatggccgattctataattaaacgctctttttctttcatatcttctctcctaaatttaatctcgcatctgattataaatgtattataccatctctttttattgacgtttgaccgaacggtcagttatattatgtattagactgaccagttggtcaatataataaaaagggagcgcaaacatgaacaaaatcatcaatttctcgttaaaaaataagttcgcagtttggctactaaccattattgttactattgcggggatctactctggactcaatatgaagctggaaacaatccctgatattacaacaccgattgtgacagtaactacggtctatcctggtgctacaccagaagaagtagctgataaagtttcaaagccgatggaagaacaactacaaaatttaagcggtgttaacgttgtgagctcatcatcttttcaaaacgcatcttctattcgagtagaatacgattttgataaaaatatggaaaaagcagaaacagaaattaaagaagctcttacgaatgtgaagctcccagatggtgttaaagaccctaaagtttcacgagtaaacttcaatgcttttcctgttatttcgttaagcgtagcaagcaagaatgaatctttagctaccttaactgaaaatgtagaaaagaatgttgtaccaggattaaaaggacttgatggtgttgcatctgtccaaattgctggccaacaagtagatgaagtacagcttgtcttcaagaaagataaaatgaaagaactaggactaagtgaagatactgtaaaaaatgtgattaagggatcggatgtatctttaccacttggcttatatacatttaaagacacggaaaaatcagttgttgtagatggcaatattacaacgattaaagcattaaaagaacttaaaatcccagctataccttcctcacctaacggtcaaggtagtcaaaatgccggcgctggtgcacaaacgccgcaaatgaatccagctgctatgaacgggattccaacagttacattagaagaaattgctgacattaaagaagttgggaaagcagaatccatttctcgaacaaatggaaaagaagcaattggaattcaaattgtgaaggcctctgatgcaaatacagttgatgttgtaaatgcagtaaaagataaagtaaaagatcttgagaaaaaatataaagatttagagattatttcaacattcgaccaaggtgcacctattgaaaaatcagttgaaacaatgctaagcaaagcaattttcggtgctatctttgcgatcgttattattatgctgttcctgcgaaatattcgaacaacgttaatctctgtcgtttcaataccactttctttattaattgctgttttagtcataaagcaaatggatattacacttaacattatgacacttggagcaatgaccgttgctataggccgcgttgtcgatgactcaattgttgttattgaaaatatttaccgacgtatgtcgttatcagaagagaaattgcgcggaaaagatttaattcgtgaagctacgaaagaaatgtttatcccaattatgtcttctaccatcgtaacaattgctgtatttttaccacttggactagtaaaaggtatgattggtgaaatgttcttaccattcgccttaactatcgtcttcgctttattagcatcattactagtagctgttacaatcgtaccgatgctagctcactctttatttaagaaagagagtatgagggaaaaagaagtacatcatgaagaaaaaccaagtaaattagcaaatgggtataaacgcatacttgcatgggctttaaatcacaaaattattacatcaagtatcgctgtccttctattggttggtagtcttgcacttgtaccagttatcggtgtaagtttcttaccttctgaagaagaaaaaatgattattgcaacatataatcctgaaccaggtcaaacgttagaagacgttgaaaaaattgcaacaaaagctgagaagcacttccaagataataaaaacgtcaaaacaattcagttctcattaggtggagagaatccaatgagtcctggtcaatcaaaccaagcaatgttcttcgtgcaatatgataacgacacgaaaaactttgaaaaagagaaagaacaagtcgttaaagatttacagaagatgtctggcaaaggcgaatggaaaaaccaagacttcggagcaagtggcggtagtaacgaaattaaactatacgtttacggagatagctcagaagacattaagcctgtcgtaaaagatattcaaaatatcatgaagaaaaataaagacttaaaagatatagattctagtattgcaaaaacatatgcagagtacactttagtcgcagatcaagaaaagctgagtaaaatgggcttaacggctgctcaaattggaatgggactttctaatcaacatgatcgccctgttctgacaacaattaaaaaagacggtaaagatatcaatgtatatgtagaagctgaaaaacaaaattatgaaacaatcgatgacttaacaaatcgcaaaattacaacaccacttggtaatgaagtagctgtgaaagatgttatgactgtaaaagaaggtgaaacatcgaatacagtaacacaccgagatggacgtgtttatgcagaggttagtgccaaattaacatctgatgacgtttcaaaagcatctgctgcagtacaaaaagaagtagataaaatggatcttccttctggtgtagatgtttctatgggcggtgttactaaagatattcaagaatcatttaagcaacttggcctagcgatgttagctgcgattgccattgtatacttcgttcttgtcgttacatttggtggtgcccttgcaccattcgcaattttattctcgctaccatttacaattattggggctcttgttgccttattaatctctggtgaaacattaagtgtatctgcaatgattggtgcgcttatgttaatcggtatcgttgtaacaaacgcaatcgtgcttatcgaccgcgttattcataaagaaaatgaaggactatcaacacgtgaagctttattagaagctggtgcaacacgccttcgtccaattttaatgactgcaattgcaacaatcggtgctcttatcccgcttgcattaggatttgaaggtagtggcttaatttctaaagggcttggtgtaacggtaattggtggattaacaagttcaacgttattaacacttcttattgttccaatcgtttatgaaatattaagcaaatttaaaaagaaaaaaacaaaataataaaaaataacctcgctaactgcgaggttattttttatttccaaacaagattaggaaatcgccatagccttctttctctaattcctcttttggaataaatcgaagagctgcggaattaatacagtaacgaaggccatttggtcctggaccgtctggaaatacgtgcccaagatgtgagtctccttctttactcctcacttctgtacgtgtcatattatgactcacatccatcttttctttcacacttgctgacataactggttttgtaaaactaggccatccacatccactatcaaatttgtctagagaagtaaatagcggctcacctgaaacgatgtctacataaagaccttcctctttatggttccaatactcatttcgaaatggtggttctgtaccattttcctgcgttacataaaactgcatctcattgagtttttcttttaaatgagcagtatcctttggccaatgttgcttaataaaagcatctcgtcctgagcctttacgatataactcatagcggaatgtgtttttcttatgatatccttggtgatattcttcagctggataaaatgtagctgctggtagtatttttgtcgcaattggttttgaaaagcgtccactctgctcaagcccttcttttgaggcctcagcttttttatgttgttcttcattatgataaaaaatcaccgtttcataagactgcccgcggtcgtggaattgccccccaatatcggtcggatcaatttgtctccaatatatatttaataactcctcatacggcattttatttgcatcaaatgtaatttgtactgcctcataatgtcccgtcgtttcagaacatacttctttatacgttggattctctttatg

SEQ ID NO: 1340 - DNA, 2951 bp, Bacillus thuringiensis
tgtatggttttttaattcaaagaaatggatatttaattattaaattactcttgcatattttggaatatgattatacaatatcgatatgcgatgtatcgtaagtcgatatatcataaggcgatgtatcggaggtagttataatgaatgggaaggcgcaaaaatatattccgttaactgaggcgacatattacatattattgtcactcgtgaagccgttgcatggctacggaattatgcaaatggtagaagagatgacaaatggggaagtaaagctcggccctggtactttatatggaaatacgacgaaattactaaaagagaagttaattgttgaagttgcctctacagacagaaagaagtgctatgagttaacgccgtttgggagagaagtgctggaactggagtacaatagattgcagagatctgtaaggaatggaaatagtatattaggggagtgaatgggaaatggagacaaagaaggtattcaaaccttttgcgatgtaaatgtcaagataaacatgtacattttcgcttgtttaagcatgtacaaaatcaatcattttctttgctaaaatgatctttaattcgataggattgtcctacaatactgaccaccgtggcatgatgtaagacacgatctagtatggcattggcgagtttagggtcctggaatacttcgtcccaagacttgaagttgatattggtcgttaggatggtactacgcttttcataacgcatatcgattaattgaaagaataattttgcatcctccggatcaataggcaagtacccaatttcatcaataataagtaatttgtattttgtatagtgctttaaacgagattctaggcgattctcaatcttggcacgttttaaattttgaagtaaatcatgacatttaataaaataagtacttgttcgctttttagctgctgctataccaatagacgtggccaaatgggtcttaccaacaccactaggtcctaaaaatactatgttttcttgttgctctaagaaacgtagagaaataaaatctaagatttgttgtttattaatactcggctggaattcgaaatcaaactcatcaacctcctttctatgaggaaatgcgcccattttcaccatagaatgaatcatattttgttctcgtacatcaatctcatagtttgtcagtttaacaagtgtctctacgaaggataattcattattaatgctaaaatcgactacgtcacctaaatgttgtgccatttgttttaattttaaatactctaggtttgttgttaattgttgatagctattcttcatttctatatacctcaccaattactgataaattttgtttcgccaaattgtcaatgttcggatatttaggtagtgacttagccaatgcttttttataatgttcttctttataattgagcttagattggctgattttatgttgtacaattaacttcatgttatgataaacatatatttgattatcatatacttgtaaaccgacggttttaccttgatattcagctggaactgagtattgattcgatttgtaagatatcatgcctgatgtattaacttttacaagtttatgcttaatcatataggaatctcttatcgcgctcttcgggagtggttgtaggagattcttttcctgttttagggcaaacactggaatcttaccagtcccttgatgaaatgtttgattaattcttgcacataatttttgcacaaattcatgtaattcttcaaaagtgaatcttccttgataagcatgaatttcgtctagaagtttcattggcgcttctactttccctttggtatttggtcgccctgcgatacaaggttgtaccttaaatccaaaatcttgagcgaattgggcaaacttattgttaatcgttcctgtaaagtgttctgttcgagcttcatccattaccgtcttcatattatccgtgacaattaccttcggtacaccaccaaacatttcaaatgcctctgtcataaatgacattaaaacactttgtgattttgaaatattcaaatgaaaaactttaaatctcgagtaggacaataaaagtacagctacattcacatatacgatttcgccacttttggtttcaaatcgtatgctttctttccaatctaattgagcttgttctcctggaggtgtctcataacggacacccactgaatgacctgataaaatacgcttcccctcatcaaaatatgttctaaattcaggctttctattaatataagcacgaaatgcagactgtgaacattttaaaccgtgattgtctgttagatactgccataacactcgtttgtagtagaagatttgtttagaatcactagataaaagagctgcaatcacttcataatatgtatcgattttcgatgttttattttttgtcccttttggtgtaaaaccattcaaatacttatctatggtacgccgatccacattcaattctctggctaattgacttttatttatcttcatttttaagttccccattagttttttaaaatttggtaagtctgaaagacttttaacctcaaattctgtttgaatatctagcttaatatacatactaaccacctcagagtcagtatggagaatccaattgaaaatgtacatatttattcaagcgttaatgtacatatttaagttagcatttatagacggtgtagaagatacaattcaaaaaaagaaaatagcatataaagttcaagattatgatggggaaaacttgcgattatttaatgagacgtcatttaatacaattaagtatgtgaagcaaagttaaagttatgaaggactaggtttaaatggcctagtccttcattaaagtgcgagtatgtaaataatatgttatctttcgttctgtttacttagtatcatgttattctttaatagagtaataaatggagttttgcattaaatatatgag

SEQ ID NO: 1341 - DNA, 14873 bp, Bacillus thuringiensis
atcagtaagttatcaaagaacaaagctatgtatcatttcttaagtggttacactagtaaactagcaggaacagagcgcggtgttacatctccgcaagcaacattctcaacttgcttcggttcaccattcttaccacttgatgcatctcgctatgctgaaatgcttggtgaaaaaattgagaaacacgatgcgaaagtattcttagtaaacactggctggactggtggcgaatacggcgttggtaaacgtatgaacttaggttacactcgtgcaatgattcaagctgcattaaacggtgaacttgcgaaaactgaaacagctaaacatgacatcttcggtcttgaagttccacttcacgtaccaggtgtacctgacgaagtgttaatgcctgaacaaacttgggctgataaagctgcttacaaagcaaaagcaatcgaacttgcaaatgaattcaaagctaacttcaaaaagttcgacagcgtatctgaagacattattaacttaggcggtccaatcgcttaaattaaaactttctgttggaataaccctttactcatatgaataagtgtcgtgtaaccgtaaagtttcgcgtactcaccgacaaaacccaatgcggcttaacggttacacacacttacataaaaaagaagcttacgtgaaaacgtaagcttctttctatatcttatataaagtgaaacgctaatctcttcatctatgacctagattataaaattacagcttcgaatatatacattatatccctactgggtttcacatcgtatggggctaaaaaaggccctgaccgcttctatccgtggctggatcatctattccatctaaaaagaagtcttttatcttttttagctctttgttagttctttctcatctttcatgctatagtatcctaaattaacaacaattaagaaatacccacccaaaatccctactgcaaatgcccacataaccatgtggtgctcaatttcgtacataataatagcacccaaaattgcagctgcaaaacggttaaacataccgagtgtcggtgctttcgtcttctttacaatactatctccaagcttctcaattcgtctccctaaaagccaaacgcaatacatacttacaataagcccaattccagcacctagaaaatgagctgaaaacggcgttaacatccagcctagtaaaagaaaacctagtaaataatacgattgaattttaaacgatcttaatgacatactaatcatgctgttctcctcttcagtaatttttatctatccaacaaaaaatttctttcaaattcatattccttacatccatttcactcaaattaaaaacaacataaacagtatgtttatgttgtttaaatatttttaggaaataatattatacaagatttaaaacatcatattctcatattttgtgacggtttttcaaacttttttcgtccatttatgaaaaaaatgatatcaatctatgaacatacggatatgatgtaataagcacacaaataaagggggcgtctaatgatttattttttaatggctctcattcacctcattatccctgcacttattggactttcattgtattggtacacgaaaaaccatagcattttttacgctgtcctcggtgttcttcttccaggtattattcttattacactcttccgtattccatttttaaacttaattccacttattactgctatcttatttctcatcttcttaccaaaaataaaaaaataggaaagcagatcataggtgatctgttttcctattttgatataggttcccctgcaatagaatgaacttttactttctccgatttcacaaaccatagaccgacaaaaatgataattccaccgatgatttgttgaaacgatacatattcatttgcccagacagctgcaaataaaacagctacaagcggcgttatatacatatataccatcgtatgtgacgccccaattttttgaacaccaacataccacattactagaccaaatactgttacaaagaaaatagaatatagtaaagcaaatagtgtcattccgtgagtaatgtgaaatggcatgacaaacacatgtggaccacttaacaataatagcggaatcgcacccactaatgcagaccatgctgtaacacgtaatgctgaatattttttaattaatggtcctgctaaaacaggataaagcccccagcatattgatgtaataagtccaattccattgccataaaaagaactagtaagcgaatgtcctgctactaaaactaatgctgcaccaacaaaggcagtcatagaaccgattaactttcgagaagaaaacttttcttgtttcaagaaaatcgcaaatgcagttgtaaaaataggtgaaatagaaatgagtaaagaggcatttgtagcagatgtatatttgacagtttccataaataacgtttgatacagtacaatacctacaatgctaacgataattaatctaggtatatcctttcgctccatataaaccgacttttcaataaaaaaggtaaggagtaacagaagcggtgccgccgccatcatgcgaagtgcagtaaactcaattgctgtaaattctaaaagtccatacttcgcaattgtatagttaatcccccaaataataacaacacttaaaattaacaactcaattccccatcttctcatgcgtatcccctccgcaaagaagattatacagaaaattcaatcacatgtacatttcattatgtgaaaaaatctttttacttttgaaacgttttggtaaatgaaattatatcggcgattttctgaatatatcggtgcaactccatttatatcggcgatttcccaaatatatcagcgcaactccatttatatcagcgattttttcaatatatcgacttatcaacaaaaatcgacaataatagcgacttataaaataaaaaaggtgattccaaaatacattttggaatcacctttcctttactatattcgaacgtgtaacttcatatttggattataaaactggcttgggctcttcaactgaaaagttcctccaccttcatgccaatcaaccgttaacttatcgtccataaatacaagctttgtacgatcagcgataaagttcattgtgcttgattcaatatccacatcgcgctcatctttctctgctacagctactaaatcgatgattccgctcatgacacaaccgcaaccctcattatcgtaaaataactttatatatttcgcttcacttggaatcgtatccataatctttttatatgctgcttctgttacagtaacgtacatatgttaatcttcatcctctcttctcttatcattcatatattgtatcatcatttttcttaaaagttatatacagaaaattaagactaatatacaatgtatgtgataaagtttcagtaatcgagcttttatgagtagttcatgcaggagaaaggatgtttactatccgtgttcaaactacaacgatatcccatgttattaggtctatttagtagtttcttcatttctagcggaatgctattacagcatgtacttccctattctccttctattagctggatcctaggttttatttgtttcctatccgcttcttattttgctacgaagaatacaaacaactcataaagcaagaatcatcttaaggaggattatcaaacatgccagccttaaaaaaaatagagcaatcactcgatcacttattccaaattgaaaaatacggaaaagatagtgcctttagtcgatttatcccagccatatatgatcctatcaaatttccttggcaacaatttttcgaagcaaattttgtagatttatttaacggccttatgatgcacggatctgaaaatgtaaacaaagtatttttagctgtattccctacagatgacattcttgaaacattcatttcacaatccacacctggtgatttactctttatgcaccatccccttgtaatggagtgtggtgatccgcttggaagatcaggtcgcggtttcataccaattcctgaaaaatatttgcaaggaataaaagaaaaacaactttctatatatacatgtcatgtaccaatggattttcatcaaacgcatggaacgagtatttcaattgcaaaagcattaaacgctactgtagtggacgactttgcatatggaggtccagaacaagaaccaattggccttatttgtgaaatagatgaaacatcaacagaagcactccaaaaacatctaaaacaactcttccagattccttacacagacttcgaaggtaaacgacatgattccattaaaaaaatcgcaattatcgctgggtgtggcgatgttgtatctttaatgaaggaagcagaagaaaaaggtgctgaagcatatattacaggagaaatccactgccatatcgacaatgattacggccgacataaatactcgctcattatggattatgtaaaagaaacgaatatgtctctaattggtgtgtcacactctgcctctgaatatttagtgaaagagacattgatgtatgattggtttaaagaaaattttgatgtggatattattttgcttccgcaggagaaatggtggttataaatttttaaagagatagccaatttagctatctctttttactaaacttaaaatttcatgaggcgtttgaaaaatataatcagccacctcgaatcctttccttgttttcgctccccacagggctaaaccaaattttgctcccgcttgttttgcgcattgtaagtcatatactgaatcacctatgtatatcgcttcttgtgcatctatattcaatctttttagacatgtcacaagtggctctggatgtggtttatgttttattgtatcttctacacaaatagagtgttcaaaatatgaatgtaatccaaatggcttgaaatcattgataaactcttggcgtgtttttgaagtaacaatacctgttcgaatcttatatgaagatactatttcaatcacttccgcaattcctttaaatactgtaatttcattcttaaaatctgccatattacgtatccatttctcatgaactgctttcatattttccacaccaatttcttgtaacgcagccataccaggaatacctaatgcaaaatgtagcttttctaatgaataattcatcccttcatctcgcaacgttctctgtaatgaatataaaactgctttttccgtatctaacattgttccgtcaatatcaaatataattcccttcatttttgcgtccccctttacttcactccagtgattagctcaattccatattctttcactactctttctaaattgccgggaataacatcattcgtaataattgtatctattgattctaatgacagtgccttaaagttttgacgttgattcatttttgtctcatcggcaagtaaaaacactccattcgtttgtttaacaatttgacgcttaaaatgaatatcttcctcatacgcataataaacaccatcttctgtaaggccgggtgatccaataaaaactttatcaaaatgataatcttttagtttctccattgcagaaaaacccgccatataacgtgagtgtttatttaattctccacccaaaatatgaatatttacattctccatatccattaaatgatttactgtatcaattgaatttgtaacaaccgttatattacttgctgtcaaaaatgaagccatacagttaacagttgttgaaacatcaagataaataatttcattatctcctacaaaagaagcagcttgctttccaatagatatcttatattcaatttctttttcctcacgatttacataatccgatattttacggtggaaagatgataaagctacaccaccatgagttcgtattattgttgtttcatttgttaactttacaatatctcttcttgctgtatctctggaaacttgaaatagctcacacatcatcttcaaactcatcgtcctatgttcattcaaataatccattatttttattaaacgttcctcttgattcatactctcacccattttcatttacttttaagtacttttaagttattttaagtatatcacaacaaaatctcttaaataaaccttaaaataacttaaaacggaagtgagaaaatgctacgtacaattatttttgattttgatggcacactagctgatactttacctttatgttattactcgtttcaaaacgttttttggcaatttgataataaagaaattactgaagcagagattctttctatgtttggtccaagtgaagttggtattattcatgagaacttactttctgaagaaaaagaagtagcagttgaaagatactatgaatgttatgaagaaaagcatcatgattacgtaaagcgaaatcatgaaatagtagaccttttaatacatttaaaaaaacaagggtttcagttagctatcgtaactggaaaagcaaaaagaagcctggatatttctctaaaagcattaggattagtttctttcttcgactgtatagtagctggagatgatgtaatgaagccaaaacctgaccctgaaggtattcttcttgtattaaatacattaaatgtaaatgcaaacgaagcaatttttattggggatagtgatgctgacatacttgctggaaaacaggcagatgtacgaacgattggcgtacaatggttaccaaactatcaatctgctacatttactgtgcaaccagatgattttattaagaaaacagatgattttctcatctcattaaatactagattttcaaaataagtaatggatattttataactacttattattctgtatttatagaaaaaaattcgatatacaatacactctcaccctatttttgaaatctagacacaaaatacgatccgccacacaaaaatatagaattcataatatatatattaagttatattttaaatactagattttcaaaatatagaaaggagaacgtatatgtaccacttaattgctttagttgcgacggcagacgcaacagcagttctaacggaaacaccagaactatggtattttccattaaaccaacggatagcggagtaggacaaattcaagtatttaatcctactccggcagtaggttccgctactgtaacttggactagtattacaactggaaacccagttgcaagaggagatgctatatccctttatattacccctggaattactgcaagtgctgtatattctatttttctaatcactgacatatagcaattcatttcataaaaaaaagacccgagattcgggtcaacaaatagaaatataaatgaactacaacaaataacagacaaagccattatatatttttcatagtaaaacatccattattttctttttacactatcaatatattatttttcgttatcgtcctcttttttagaacgtctacctaagaagaacacaaaagcattacttccaaataagtgatgttttttctatttaatgcagtggtaacataacctcaaccgttgttccaaccccaacttcactttcaaaactcattttaccattgtggtctttaataattttttctgtaactactaaacctagaccagttcctgtttctttcgttgtataaaaggcttcatttaactttggaattttatcttttggaataccacatccctcatctttcacttgaacgatgattccatcttttacagtaactttaatcgtaatttttcccccaactgacattgcttcaattgcatttttgattaaattaaaaaagacctgttttaatcgtttttcatcacatgtaatggacggtaagtctttactgtaaataccttgtatgtggactccttgttttaaagcaggcttttccataactcgaataacataagagataatttcttgtatgttatgagtttctgattctagtgatttagatttctcaaatccactaagttctgtagcaattatatgaatccgatctacttcttgtttcataatatcactataaattttatcctctggatgcttgtcggcttgtttattcacaagtttttttaagtttgctaaaggtcttctaatcttataaccaataaccgttgccatttttccaacagctgctagtttttctgtctgttttatttctttgtccatcatctcaagcgtacgaacgtaagactgaaccctcaaaaatataatccaacatataatagtaaatacactatataatgccattgggattaaaacgagagaagattgaataatgattcctgtaagagcgtacttcccgacaagtatcgctggaactaaccagaaatatcttttgttcacaaagattggtgcaaacaaaataaaaaatacttctactatatttccaccgtcaaattccgcatcgctaccataataaatcataatgttatggatacaatctaatacattatagccaattagaataatatactttaccacaaaaacattcttccatttcataaagtatattccactgcaaaacaatactaccgtcaaaaagtaaagccataaacctaaaccatcttcaaactttcctacgccttcttgctctcccgcgattaaaggtacgataaattcataggcaagatcatacacaaaaaatataataaaaaataaacttaaaaatactttcaatgcctttatttcttcatttttaaatatatagcctttattcatatggtaactcctagcttttcttccacttggatttcagtatttccacacttccttgggagaatgatgtctattctcgttccagtatctctttcacttgaaatatgcagctcaccaaggtgctcggcgacaattcgattcgctaccgtaagtcccagaccaattttatcttgtttcgttgtataaaaggcttctgtaacacgggttaagttttcttgcttaataccatgaccattatcgattacgctgattattatatattctttccctttattctctaattgcaaatgtaatatgccaccttgttccattgcctctaaagcattttttatcgtatataaaaagactcctcttatttttcgttcatcacattcaacttctattgttttttcttccacattagaaataaactgcacgtttaattcattcatttttccgcgaagacttgttattacttgtaatacaatttttcctacatcatgtttcttataaatagaaggtttgcatgtagcaacttccatcaactcgcttatcatattattcatattttctatttcaaaaatcatacgtttataaataggatcctcttcatgcttctctcgttgtaattgcgtaaatccttttaatgaagccagtggatttttaatttcatgtccaacagtcgctgccatttttccgattactgctaatttttgtgattcactagcaatcgcaatactttcctttacggctgaaagatattgtaaaaatcgatttaaaatgatatatacaactattaacataagtgtacacataataaggaacataaatgcttttatttcctctaatacaaataaataaattaaatattttcctacaatagaggaaagcaaaaacacataaaattttttatttaaaaatatgggtacaaagaaaatgagaataatttctattatatttgtcgcatcaaacgccgccttattataaaaaatatacgaaactatattagcgatttctatccctatgtatgcaaatatccatgcatatttaacaaggtttgccttctcttttttcagtaaatatatattcacgcatagtattgctactccgcaaataacttgccatattatgttgtatcccttatccattattgatttatcttctaatacgattgcatagaaaatttgatatacaataacaatgacatataacacccataaaaggagttttgcattcctttcttcttctttatatgatagaaaactttctttcacttcaacaccccttcaaaataacatctcaaagaataccatttattataataaatgattttcatagacaaacaaagataaatcgaacatttgaggaaaatcgtaccaaaaacgcaatatatttagactatatacagagcataaaatctatgatcattaatacgtatattatggaggatgttttatatagacggcctaaaaagtaaaacaaagcttttagaatggagcctattgatagaacagggggagttttatgtttgttactgtcgagaaagatgtgcatatttttgtgcaagacgttaatcctggtccaggtagtaagactgttttcttcgttcacggatggcctttaaatcatcaaatgtatcaatatcaactcaatgttttaccagagcatggctttcgttgtatcgccatggatatacgagggaatgggcaatctgataagccatggactggttacacgtatgatcgattagccgatgatatcgcaattgttctagaagcactccaagtagagaacgctacattagtcggtttctcagttggtggtgctctttctattcgctatatgtctcgctatcatgggcgccgcatttctaagctcgcattaattgacgctgtctccccctctttcgttaaaaatcaagagtccccttacggtgtaccgaaagaacaagcagatgctctcattaatcaaatgtatgctaatttaccaaaatttttaaatgacgtatctttatcctttttcaatagaaacttaggggctgcaacccttgaatggttttcttatctcggtatgcagtccgcttcttatgcccttatcaaaattttacaagcagctgcaaatgaagatgtaacgaaagatttaaataaaattaacgtcccaacaaaaatcttccacggcgttcacgaccaactaattccttacaaaagtgctgagcttacgcaacaacgaattaaaaattctcagttacatgctcttacaaatagtggtcatggttcaccaatcgatcaagcggatgaattaaataaagaactgataaaatttttacatgcataacaactgcaatacaagaacgaaagttaatataatagatttttcacaaaacataaaattcacatatttctcacaaatacacaaataaaacgattacattttcatatatactaaatgtacaggtaatactccctaaacccagcttgtctggttaccccgttaaatactatgaaaaaagaacttgtatcgttatacaagttctttttgtttcttttatttaaagaggatatctgtactatattgatttccaacgagtaaatcatattggagcattttatattgctctaacatttctttttgtttctttgttaaatcattgattacttctccatttttatcaacttttaattcatctctaagcactggtatttccttgtaaagttccgataaaaattgataaaataaggatttatttaatcctgcataatcaaaaataagattagaaaaatgaattgggcttactaaacctaaattatcatttggcatatcaaagtttgcatacattaatagcggcgtttgcgccatcgctaaacgttcactcggtgttttttcattcgttatatacccgttttctttataaaaagatttatttgttcctagtgatggaagatgatctccaaagaatactaataatgtaggtctatctaaattatctagttgctctattaaatattgaagtgcctcatctgaacgtcttaacccttctgtatacgtctctaattctccctttgattcttcattttctagcccgctaatttctattaggttttcaccaaatcggccctctgtaaatggaaaatgattttgcatcgtaactgcatgaataaatgtaggctgtttttgttcctctaactcagcaattatctctttactcatcgctaaatcactaatataatctccatcaatatccacatttttcatcgtgtcctctgcattaaacttatcaaatcctaacaccttatatacatcatcacgtttaaagaatgtgcgaccaaatgaatgaattgcacttgtgtaatacccttcttttttcaacgccgtagggattgatggaatttctttcttatttgtaataacctgctgatatggtatagaacctggctttaacaaactcattgaataacttgttaatgcctcaaattcaacgttcgccgtatttcccccaaatgtaggagaaatagtttgtcccccaggaaagttttctatataatgatgtaaatttggtacaggatcttcactaaaagaaaggttggttactttcgtcggatcccaaaacgattcactcattacaaaaataatattcggtttctcttttttcttttgactccctatatttccactatattgtttttttatatcgtttgctatttgaagcatattttctttagaataattttttggtttttccataactgttgtatctaaattgctaataaacccaagtataaaaccatttgaagcgtagttctcattttgattccacaaaacaaaatctacacctgatttttgaaatactttattcataaatgtattcgcaaaattgccatacgcatatagaacaaaaatagatcctactactaataaggctcttattcctagatgaatctttacattttgaatataccttctcatatatatccctgctacaatacaagctacgatacttaagataatgacaaaaatataactccaactaaaatagtccatcaccatcggtataacagattgcatatgagtaatttgtgtgaaatcagaaggatataacggatcacctctaaaaataagcttcaaataattcacaatacataaaatgactaacgtacagctcgttaaaaccatacttagaaaaaccttacctattaaattatatacaagaatatatatcgcataaattactacaaaacttaatataaactgcatattataaaagtaaatccaattcattgcctctatgaaactcatattaacttgcatgacaatataaaataacgctactgtatgagctaataaaagtaatataaaatgcactcgcagggatgctctaagtatagacatctcttttttaatgaaatgcgtaatataaaacgttatgccccatatgaacatcatcataacacttaaaacaagcttttgatttaaatgatctttcatcatgtctaaattaaaaacctttaaaatcataaacagcatagttattactaataaagtcaccatactacttataatgctagaaattaatatatttctttttggaagatgaaaaagtgtagaaccatacttcaattcattccctcgtttctatgtcttaatttccccgcatcgaaagaactatttctattaaaataacatatattacatatttcgtcagcatacttgcttctaccataaatgtattgtcttaatcttcccttaatcaacagttaaattgtggtatacaaattactcattcttgaaaaacttaatttcagcattccactttatgatataataactatgttttggaaatccttaatactattaaagatttcacataaaattacgaaagaattaataaaaaaggagttgctcatttttgcttactaagtttaagagtttgcctaaagcggtatatgcaattttggcgctttctttcctgttgcacgttttttgtttagtaaaacagccaggattagatggagagttagtcaaagtaacatatggtgcaaatgatgcctttaactattcgttaacagctgaacaactattaaaacatggtgtatttggttatgtgtatttagaacctagtgaagttccagggaaaaatgcatatattacaccaggtcagccattactattagctggcgctatgattatttctgatattacatcaattccttactattacgtagcaactgttattaacatgatcatgaacctttgcacagtgctattagtattcttaataggaaaagaattgttcgaaaaaaacatttatggaattgttgcaagtattttatatgctatttatccaagtaactatacatacttccgtacattgctaacagaagttccatccatattcttattggcgttatgtgtatatgtatttgttctcgcatggaaatacaataaagtgaaattccatatatggtttggaattgtcgtttcaattttacttatgttccgtccaaatccagctccaatgatgctcattcctgttcttgttgtgttatttacatatggatttaaagaatccattcgaatcggattgttatggtttatcggacctttctttattattggcgcatgggttgttcgtaactacttagcactcaaccaatttattttattctcaacccaaggtgcagatccactaattgccggtgcagatccatttaataaaattggatatgaaaatatagtaaatgaaatgagagctaaaggcttagatgacaaaggtgcatacgcaaaagaattaattaagaacggatttaagacggacttcacttattggttctcttggttcactgtcggtaaaacaattgaattattcaaaacagctcctgctgtagaccaatatcgtattcacaactttatgcaactatgtcatagagtgtttatcatcggtacattcttgagcagcttctgcttcatgctaaattcatttaaacataaacgcgttatgatgctagtagcaagttcaattatttacattatcttctcaaacttattcttagcaattaatcgctatggatttttcattaatcctcttatgtgcttaattcttgcatacggattaattcacattgtgcagaagcttccattcttccgcactaatcaagcataataagaaagaggtcgtcctctcttctaccttcctcgctcgctggctc

SEQ ID NO: 1342 - DNA, 12760 bp, Bacillus thuringiensis
tcgtgattaaaaaaactcccgcctctactgtttaaacagtagggacgagagtattatacccgtggtgccaccctaattgaagcacgtatgcttccacttttttaataacgcttaaatgtgcgttcatccctactaagcgtatatgccgttcaagttgaaacctctagagtgtcattcaatcagtcatcatgcataaatgttttcagcctaagacattccttctctttccatgtgtgtctcatttactcttctctatcaacggttatattcatatgtaaatataaaattactatacgtttgttaagtaggattgtcaagtgctctaagaacgttcaatctgcttctttaaacgctttacatcttgaagagaaatcccaaactcggaagcaagctccattgaagtattgttttgctcttttgaaataaaatcatgaaaattcacgttaaatagttgatttgcaccatttgtaacagaatgccctttttcattcatacgcatacgtatatccctcacattcaatatggatgttttactttttattgttccatattgatgggagagttatacataaccgaaactgctattaattccaaataaatgaacaaaacatacaacaatgtataaaaaagagaggattatataaccctctcttttttatcaacactatttactttctacaattaaggtcaccggaccatcattgattaaagaaacatccatcattgctccgaacttccctgtttccacatgtaatccttgtttacgaacttcttcattaaagaaatcgtataaacgctctgcataatcaggtttcgcagcatccataaagtttggacgtcttcccttgcggcaatctccgtataatgtgaattgcgaaatagatagaacttgtccttctacatcaagtacagaatgattcatctttccgctctcatcttcaaaaatacgtaagtttgcaattttttccgcaatgtaagttgcatctttttctgtatcttcgtgcgtaatgccaactagtaatgttaaaccgaacggaatttgtcctacgatctcaccgtctactgtgacagacgctttctttgatcgttgtaaaacaactctcatctttctacactccctattaatgcatcatgcgtcgtactgcataaatttctggaacgcgtttaatgcgttctactacttttttcaagtgttgtaagttacgaatcgagattgacatattaattgttgccatcttattacggtcacttctaccagaaacagctgaaatgtatgttttcgtctctgtaacagcttgcagtacttcatttaataaaccgcggcgatcgtaacctgaaatttcaatatcaacgttatactctatttctttttcagggctaccttcccactcaacttctaataaacgttctatcgcttcttctgtatgaacatttacacaatcacggcgatgaatcgatacacctcggcctttcgtaatatacccaacgatatcatcacccggaactgggttacagcatttcgataaacggattaataaattatcagcaccgcttacctttacaccagaatcccattttcgaattttcatcggtttacgaacttctttgacttcaacaatttcttcttcttcgcgttgcttgcggaacttgtccgttagtcgcgtaacaatttgcgaagctgtaattccgctatatccaactgctgcaaacatatcttcttcatttgcaaagttaaatttctccgcgacgcgttttaagttatcaggcgctaatacttctttcatctcatactctagaccacgtacttccttttcaacaagttcacggcctttttcaatattttcgtctctacgttgtttcttaaagaattgacgaattttatttttcgcatgagatgtttgagcaagttttacccaatcttgacttgggccatatgaatgtttcgacgttaaaatttcaatgatatcgccggtttttaatttataatccagcgtcaccattttcccgtttacttttgcaccaattgttttattcccaatttccgaatggacacgatacgcgaaatcaattggaaccgatccaagtggtaattccattacatcgcctttcggtgtaaagacgaataccatgtcagagaataaatcaatttttaatgactccataaattcttctgcattagaagcttcattttgccattctaatatttgacggaaccacgtgagtttcttctctaatgtacctgttgtttctgctgtttttccttctttgtatgcccagtgtgccgcgatcccgaattctgcaatttcgtgcatttctttcgtacgaatttgcacttcaagtggatcacctttcggtccaattacagtcgtatgaagagattgatatagatttgcttttggcattgcaatataatctttaaaacgacctggcatcggcttccagcacgtatgaataattccaagcactgcataacaatctttaatactatttacaacgacacgtacagctaataaatcgtaaatttcattgaactgtttattttgcagtgccattttacgataaatactgtaaatatgtttcggtcttccagagatctcaggttgaattgcaacttcttttaatttctcacgaataccagtcattacttcgtctaagtattcttcacgttctgcacgtttacgcttcattaaatttacaatacgataatattgttgtggatttaaatagcgaagtgacgtatcctctagctcccatttaatagtactaattccgagtctatgtgctaaaggtgcaaagatttctagcgtttcattcgctatgcgacgctgcttctcttgaggcaaatgtttcaatgtacgcatgttatgaagacgatcagctagtttaattaaaataactcgaatatcttgagccattgcaataaacattttgcgatggttttctgcttgttgttgttcgtgagatttatatttgatcttcccaagcttcgtaacaccatcaacaagcatagcaatttctttgttaaattcccgttcaatatcttctaacgtaatctctgtatcttccactacatcatgtaagaaacctgctgataccgtagctggatccatgtgtaaatcaactaaaatacctgcaacttgaattggatgaataatatacggttcacccgattttctgtattgttcgctatgcgcatcgcgtgcatattcataggcacgtgctactagctcaatatcttcatccactaaatattgacttgctttctcgagtacctgttcagctgttagtacctgctcatttgccatcgaatcaccttttattgaaaattgactttatctttatttaatagaataaattatattctatcattataacccaatgattgtgaattgtgaaaaggaaaagattttactgacatttcaccatgattttttgttcaattatacaaaagtacccgctcctctccaagagattcacgggtactttttatcaccgtagttttacctatatagtgattagtatttttctaatactaatacatcgtaaccatctaacattttacgaccatctaagtaagtaagctctactaagaatgcaatccctgctacaactccgccaagttcttcaactagcttaattgtcgcttcgatagttccacctgtagctaataggtcatctgtaattaatacgcgttgacctggcttaattgcatctttatggattgttaaaacatctttaccatattctttaccgtagtcaactgtaattacttcacgtggtaattttcctaatttacgaactggcgcaaatcctacttctaacgcataagaaactgggcaaccgataatgaaaccacgagcttctggtcctactacaacatcgatatctctttcttttgcgtattcaacgattgcatctgttgctgctttgtatgctttaccgtcattcattaaaggtgtaatgtctttaaacacaataccttctttcggataatccggtacaattgcgatatgttgcttgaaatccatatttctgaatcctcctcagatctaaaaggtttgtaaatacaaatcctttaccctaactgttctacttctttatgattacgaatcgtttcaaaccatgtatatagttgctgatatgtgctataaaccaattctttttctaattgtaagtggttcattttctcacgatatgtgttcgattcaattaaatcacgcttttgttttttgtctgccataaaaatgacgccatcttttattgtaacaaattctaactcaaaaaacacctgtgtcataaaatttactgtatcttttgaccaacctttatgacgacatagttgttctccatattgtcttaaagaaaatggtgttttttggtttaagaaagaataataccatttaaagtgttctctcgtaggaactgtactaaataagtggttattctcttgataaaatagcgtataaattcgcgctgggaatcctgccttaaataactcacgtaattcatcggttccttttggtaaatcaagtaacacgatatattgatcatctaaatgcgttacttctgaagcatgcatgagcttttctttatagctctctaaagaaaatttattcaatacctcttcagaaaaatacaccattgttattttttctttcggaagttctgctaaatttgcttctgcattacgcatactacgccaatcaaataattgccacgcctctacagcaatatcttgtaccattagttgtggcttcttaaaattattccattcattgatggatgcttctcctattacagatacttttgcaactggagagatttctttagcatatgcaccaaaaccaaatccaattgtatccagtgttgcttgtccatcacgaagagccatttttaaatgagaaccatctgatccgattgcgcgaatgctttctaactctgcatcttttactgcaatacgtggtttcggatttccaataccaaacggggctagtttttgcatatcttcaattgccgctagcgttacatcctctactttgcaaaaaacatcaactgctgtaattggaataaaatcttcttctgttaaaatcgcatctgcttgttcatttaatcggcgacgtaattcatctacatcattcatatgtagcgtcattcccgctgccatcggatgccctccgaagtgtggcaataactctctacaatctgataagtttgcaaacaaatcaaatcctgcaatactacgtgctgagccttttgctgtttcttttataggatcgatgcttaatacaatcgtcggacgataaaaacgttcaactaatttagaagcaacaattccaattacccctgggttccagccttcttttgcaagtactaatactttgttttcttctggcgggaatttattttcaacttcagcgatagcttcttctgtaatttgctttacaatatcttttcgcagtttgttcagctcatcaatttcttcggccaactctttcgcttcctctggatcatctgataataaaaggtgtacagccggcgcagcatcttctaaacgcccaaccgcattaatacgaggtgcaattgagaagccaatactctcttctgtaatttcactttgcgaaacgttagcaactttaaacaatgccttcaaaccaatatttctcgtcatacgcatatgttttaaaccgcgtttcactagcaacctattttcaccatgaagtgatactaaatcggctactgtaccgattactgcaatctctaataaatgttctggtacacggcctaatagtgcatgcgcaactttaaacgcaacacctacaccagctaaatagtgaaacggatatacgccaccttctaatttcggatgtataatcgcaagcgcttctggcaattctggcggtggctcatggtgatctgtaataattagatctattccaagctctttcgctacattcgcttcatgtactgctgcgatgccagtgtcgacagtaataatcagtgagaaacctgcactatgcgcccaacgaaatgcttcttcgttcggtccatacccttctgtaaaacgatttggaatgtaaaattctacttctgcacctaattcttgaagagcaagatataaaaccgtcgtactacttactccgtccgcatcgtaatcaccaaatattaatatttgctctccattttgaatcgccttatttacacgttctaccgttctatccattccttctaataaaaatggatcatgaaattcttgattttctgtatttaaaaaatctaaaatcttatcttctgtatctagtcctctaccgaggaataatgaaacgacaagtggcgataactgtaatttacttgctaattcactcactcgctcgtcattatattctttttctttccaacgcgtcttcggttgtaacacgaaatcaccccttaacctgttcattatacaagacagattaaggggtgacaatataatgcaaactacgatgcaatatctatatactaaaatgttaatgatgtttaatttggagaatacggatttatatgtacgaatacattttgtacattatcttgtttcataagtatttctttcacatgttttccaatacggtgtccttcttctacggtaatgtatggatctacagacactttaatatcgacaataacataatgaccatgctcccgtgcatataaagaaccaatttttttcacaccatctacttgaagaacggcctctctaagcggaataacatcctcctcatgaagaacatggtcaagcgttgcatgaattgcttccgctccaatgctccatgccatttttacaacaagaagcgaaacaactaatcctgcaatcggatcagcatatacaagccagtctataccaagcttaccaccgagtatagctgcacaaataccgattaaagctgcaattgaagaaaacacatccgaacggtgctcatatgcatttgcaataattgcatcactatttacccttttccctaatcggaatttatattgaaacattccttctttcacgacgattgaaagaacaacagcaaatatcgtaattcctttcggcggttctagttcttgcgaaaaagcttttatagatgaaatcgcgatttcaagtcccacaataaataataataccgcaacaataatcgctgaaatcgattccgctttaccatgaccatacggatgatcttcatcaggtggctgctttgccgctcgcaatccaaaaagtacagctagcgaaccaattacatctgatgcagaatgcacggcatccgctaatagcgctttactgttcccaatataaccaattaccgcctttacaatcgctaatataatattaccaacgatcccgacaatggcaccaaactcggcctgtttaaaacgttcatctttttccataattaaaatcccttcttttcttaacctatctttttattttaacaaaaacagcgataacaccaccactttcttccatcttctttctgttaaaaagttgctatcttattgtatccacaaacgaaaaaagagatgcctcataaagagacatcatcttttctatacttgcggttcagattctactttctcaaccttcttcttgttttttccctttttcaaacgacggttttcaagcattaaccaaatttgagaggcaacgaaaacagaagagtacgtacctacaattaatccaacaagtaacgcaaacgagaagttacgtagtgactcactaccgaagataagcagtgcaattactgggaataacactgttaatacggtattaatcgagcgaccaagcgtttggcgaatacttgcatttacgatttcttctagatcttttatatcgcgcactcgttttttctgtttgtataattcacggtttctatcaaatgtaacaatcgagtcattaatagaataaccgatgattgttagtactgcagcgataaacgttaagtctacctctagttggaaaatactaaacataacaaccataacgaaagcgtcatgtaataatgcaagtactgcagataacgcatacgtaaatcggaatcgaatacttacgtataaaatgataaccgcagaagcaatcagtacagcgataaatgcatttcgtgcaatttctttaccgattgtcggtgaaactgtacttatgtttggatctgtaccatatttatcgtggaagaatgtttttgttttcgcaatttcatcttttgataaaacacctaatgtacgaactgcgaaacctttattgtcatctccagtcggtacaatattttcttccttcacatcaatgttcagttctttaaaatctttatgaacatcagacaccgtaacggcttgttttgattgcaagtcaatacgtgtaccacttgcaaagtcaataccaagattcaatttgaaaattggtaagataattgcacccgcaattacaactacaatcgagaagataaggaatttatgaccgatatttacgaagttaatacgatcaaatctcgttggcggatgtactacaccttttgttaatggaataatatccttttgtttcacaccaaaatatcctggttttttatcaaagtaacggctctttacaagtaaacctagtaagaaacgagtaccgaatacgttcgtaataaaaccaactaaaatacttacgattaaacttgttgcgaatccttttacagagctattaccataaacgaataacacaccagctgccgcaagagttgtaacgtttgcatctagaattgttgctaatgaacgatggttaccagcgcggaatgccgacatcatggacttaccaattttcaactcttctttcagtctctcgtacgtaataatattcgcatcaactgcgatacctactccgagcactaacgccgcaatacctggcaacgtaagaactgcatgcatccagttaaagacaagtaatgtaacgaaaacgtataaacctaacataataaccgctacaagtcctggtaaacggtagaatacaagcataaataagaaaataagagcgataccaatcgcactagcgaaaatcgtttgctctaacgcttgttgaccaaacttcgctccaacagatgttgaatacatttcttttaaatcaacaggaagtgcacctgcatttaataaagatgaaagttgtttcgcactttcaactgtgaagtttccacctacgatagatacttcagcttggttaaatacttggtttactgttgctgctgataagaacttcggattcggttttgcagattctgctttgtacgaatcttttccttcttcaaaatcaagccaaattaccattaaattcgttggtggtggcatttttgaaattttttcagttacttcacggaatttttcagcgctctttagtgtaagacctacgctcgcacggccttgctcatcaaatgtttgcttcgctccgccgccttttaaatccgttccgtccataagaagattatcatctacatcacggaatgttaatttcgcttgtgttgataacatttcacgtgctttttgctgatcttgtacaccagcaagctgtacacgaattcgatcttgcccttcgatttgaatgttcggctcacttacaccgagaacattgacacgattctcaagagcacctactgtacttacaagtacgtctcgatcgattttgtccccttttttggctggttttacttcatacagaatttcaaaaccaccgcgaaggtctagtcctagactaattccttttgctatgtcttttcctgccgcaccaattactccaccgattaataaaacgatgaggaaaaaggcggcaattctcgtaccacgctttgccatatgtaccctctttccgctactaacactttaaataaatctcttacgattcacttttacacgtgtgtatacgtctagttagtagacttcctttctataattttgctagctcatcactagctgtgccggtacgttttcacgatacctgcactttcattatttgttttctctcttcactacctcctttatatatgatcttagacataattatttcctgattatcaatacctatcattatactgcaaaaggaagaacaaaccaattgcagtcggttatttattttcatattcatcaaatgaccaaagtggcgcttgatatgcttcaacagttaaatatgtcatatattcattagcacttactgttaatacgtcattaactaattcatacaatctaacatcgctgtctatcttcttccactttttcactttaagaaacttccaaatgtcatcatctgtcactctgtcgtagccgaacatttgaaactcttctactatactttctaaaacgactagagactgtgcgcggtgtgattctaccaaagcctctctatctaacatctataacatctccttcttatttcgcacgaaaagtcgcttttattcccgctctaatggacagcaataactactttcaagagcactatcatatttcactctcttaaatgcttgtcattcttgtctcgtacgtgcatataaattattgtaaatcattccattgattttgagaaggtaggagaagaacatgacgagacaaagctttttaaaaggcgcatttattttaatgatagccggctttattacaaaaatactcggctttatcaaccgcatagtaatggcacgtattttgggagaagaaggcgttggtctttatatgatggccgttcctacattcattttagcaattacattgacacaaattggtcttcctgtcgcaatcgcaaaatttgtagcagaagcggaagctgtgaacgataaacaaagagttaaaaaaatattaaccgtatcactagctgttacatccgttattagtatcattttaacaatcggaattatgttcctcacacctattttagcaaaaacattattaaccgacgaaagaacgtactatccattaatggccattttgcccgttgttcctgttattgctgtttcttctgttttgcgtggttattttcaagggaaacaaaacatgaaacctagcgcttatgcgcaagttctagaacaagtcgtccgcattaccattatcgctatatgcattcaattatttttaccttacggcatagaatacgctgcagccggcgctatgttatcagctgttctcggtgaagttgcatcgttattatttttactcacgttatttcagcgagaaaaacatttatcaatacgctctggatttttcactactgtaaaggaaagcaaagggacattttattctctgatggatattgcccttccaactacaggaagtcgtttaatcggctccgtttcatatttttttgaacctattgtcgttatgcaaagcttagcaatcgctggtgtcgctgcttctgttgcaacccagcaatacggtatattaaacggttatgcattcccgcttctatcactacccgcctttattacatacgctctctctacagcgctcgtcccttctattagtgaagcaatggcaaaaagacaacataaattagtggagcaccgtttacaacaagcacttcgaatttcattaattaccggcggatggtctgtcgttatattatacgtattcgcttctcctgttttaactcttatgtatggatcagacagcgcaacagcattcattcaacttcttgcgccttgctttttatttcattatttccaaagtccacttacctctgttttgcaagctttaaacttagcaagagctgcaatgatgaatacatttattggagccatcgtgaaattaatcgttatttttgtactagcatccaggccagaatttcaaatgatgggggttgctctcgctattgcagcaaatattgtaacagtaacatttcttcactacgctactgttttaaaaaagattacatttaccatttacgcaaaagactatattttcggcggacttgccatcggtatcgcaggcgccttcggtttttatcttcataaatatattattttctctcatgcccttggcatacaaacattatgggaaatcactttaacaacaattgtttatatcgtacttctcttcactttcaaactcattcgaaaagaagagttaagtcgtctccctatcattcgtaaactttcatttttgaaataaggtgaaactttaatcagtggggtaatctccactgattattagttacactaatcattcttactctttcaaagaataagtctctaattttcttttacatcaacaaaaaattttccgttttgaaaactacagtataaaatttgtgttacatcgttataacctaagttttttaatttctcaataagccatgcatctgtatgttcaatcatttgtaaatgactagattgaatttctccatcaataataagaggaagcgtaaactgcaatgtatcttgtttatttttttgtttttgaaagacagataacttcccagacggttccaaaatagcatattctacatcccgaatatctccaactccttgttcccttaattgcatcattaaatcatctatattataacgttgctttctcatcttcttttcatcaatctttcccgcgtttacaagaatagccggctcaccttctattaaatgccgaaagcgttgatactttagggaaatgactgacaaaataatttggatgcacataagaaaagtcatcggaactaattgatgccaaagtgatttatcggtattttcaattgccactacagccatttctccaagcataataaatacgactaaatctaatacac

SEQ ID NO: 1343 - DNA, 15053 bp, Bacillus thuringiensis
agacctttgcaattccccaaaatacattactttcttctaaatctttaaataagaacataatcataagaggaacaattagtacaaaaacacccatccagccaagagcatatacttcaccaataagaagtaataaaaagataattgctgctaatatatatgtttgcattgtcgacaattgcaatacaggtgtcccataccatttattcataaacatcaataacaccaataataaaataggaaccattactattacataaatcattccaaattctactaatttacttttaaaagaagacattctaaatgcaacaatcattccaataatcgtaatgattaaaacgataggataaccaattaactgtacatttgttaacgtaaattgttgatcggggcttccaaataaaatatttgtcagtaaccaatatccaccaataccaataatcatccctaaaatactttttatgctcccgcttttatccttctccatctctttcgctaattcttccgcatactcttttggtgagtcaccaaatatgtcacttactgtctttccctttttttcaccttctattaaatgaagctctgcatcttctagaaaagcgtccacatcttcttctttaatcccttttgttattaaatatactttcgtatcgattaaaaacttttcaccttctttagaaatcttcattataactcctcccttatttaatcatttctcttctattcgtcttcatcataatttcaaggaagattaaaataaacaaacttccgtataaacatataatttgaaataacattggcacgagatcttctgatgtaaatgttttaaatagtaacataatcgaaagtggaataattaaatataaatttttaaaccatccatcaaaatacatatttaccgctactgtaatgataaaaataccaccagccaataaataactttgcatttgattgaatataaacatttttgtaggatatatcacatctagtaccataataactcccattaaaaacattggcgctatcattactaaaaaccacatagaaaaccacgtttttgaaaaacttgttacaaaagtcattttgcgaagtagaaaattaggacctataacaactaaaataaatgaaaaactataaccgatacactgaataagtgaaatctgtaacattccatggttcactattaagatagaagcaataatccaaaacgatacgatattcattactgtaaaaccaatttgcttccacgtttcctgtctatccctttccatcacttttacaagttcatctgcatattctttcggtgagcttccgaaaatatcttctacactcttcccctcactctcagcttctattaaatgcaactctgcatcttctaaaaagttttcaatatcactttcttttacactctttgccgtcaaaaataatctcatatctaacaaaaactttcgcgcttcacttgatagcattatttttttctccccttcccttcaagtagacgctctacactactttgcatcgcttcccagcgatccataaattcaccaagtgcttcctcgcctttttctgttaatgtataatattttctctttggaccagatggagattccttcattacgcttgttattagtccttctttttgcattcgtattaataacggataaatacttccctcactcgccattgtaaaaccatacttcgctagcttttcactcatttcataaccgtatatttcgccttcagaaataatagcaagtaagcatccttctaaaatccctttcagcatttgacttgtcgacataatttaaatcctcctaacgatatttttttccaaatgtttgcaggaatttcattatagcttctctaaatagagcactatgaaaactttattatgaagggatgtttttcatcatggttacaaatcgagttgtctttttaacaggtgctgcaagtggtattggttatgaaatgggaaaggcttttgcaaaagaaggtgcaaaagttgtgattaccgatcgacttgaagaacgtgcaaaagaagctgctgaacaattacaaaatgaaggttttcaagctatcggtttaaaatgtgacgttacatctgaagaggaaattacagcagcaatttctcaaacagttgatcatttcggttcattacatatattaattaacaacgcaggaatgcaacacgtttcacccattgaagactttccaactgaaaagttcgagctactaattcaaattatgcaaattgctccgtttatcgcaattaagcatgcctttccgattatgaaacaacaaaaatatggtcgtattattaatgtcgcttctattaacggccttgtcggatttgctggaaaagctgcctacaatagtgcaaaacatggcgtaattggattaacaaaagttgctgctttagaaggtgctacgcatggtattactgttaatgccctttgccctggttatgtcgatacccctcttgtacgtaatcaactacaagacttagctactacacgaaatgtaccacttgaaaatgttttagaagatgttatttatccactcgtcccacaaaagcgcttattacaagtacaagaaatcgctgattatgcgatgtttttagcgagtgaaaaagctaaaggtataacgggacaagctgttgttgtagatggtggttataccgctcaataaaaataaagtttgctcaagaagagcaaactttatttttattcccgaggatcttcgtactttagtaattgccgcgggagcttctcaattgcaacaattaccccctctagtttactttcaatacggtggagtaaatataatgttacaacaatcggaaaccctacattacctatcatcttgatccactcttccatcctcttcccctcctttcattatataagtaagagaaaacactgcatttaggcataaaaaaacaagctattaatatgtaatactgaacctaagataattaaataaatatcattattactacacgacgacgcatgttgtttaacaatgtagttttaaggcgtatcaacactttgcttgatacgtctattttttatgtttttatcattacattcaacctctttatgaccacttttattactacatttatcaagctggcaaattacttattagataataaaaagcttatccgtctgttaactagtgataaagaggatccaacctttctaagtaaaatcggaggaaaatttgaatcaatttggatcgataagaaagtagtaattattccaaacataccaaaaagatatgcatttgccgttttgtcagggatgttaacgagtttaatcggtgaatggattagaagcgattttgaggaaacaccagagcagttctctcaaattgctgtttatatgaccaaagaattaccgaaaagtttagtagcaaaatacgagaaaaaagactagccacttagctagtctttttattatttatctgtcatgtttctgacaattaattgaatggagtgtatttttttatctttatataatttctttacttaacagtgcaaaatctaccgattattgtttatacttcctttttgtgggacacactagaacgtataacctgtttaacagcatgacaaatcaagtgatactaaagggggatttatatggagaagtgtttcacggttaaagaagtagcagccctaatgggctataagaatgaagaaactataaaaagaaagataaaagatggaatgtttccaaaagcctttcaaaatagtcgaaaagaaggttggaagatacctgcaagcgatgtagcaacgttaactggctcttccctagcaaaagttcaaggtaaaaagaaatctctatctccggattacaacaaatctgaattagtcaaattggcatatcaagtgacaactcttacttcccctccagaagaagtacataaaattcttatctctttaccattggagcgtgtgcttgaaatttgtctcattataaggcaacaaagtagaccgattgatgaaccctacaagtttgtcaaagcagctaaaacgaagaattggatgccagatccaattgcagatggagaaaaaaagagattagtggatttgacacagcgtgactatgaatctttggcattaaaggaacaacagacagaaacgattcctctctacaattggctggaacaggaataaaggtggttatataaagatgggaagtttgtatcatcacgtaaaatgccccgaaggggtaaaagctaagaaatttaaattaattgtactggacaaacaccttaaaccattctttccccttacagttttttataaggaggcattgggtggaattacagaaagtagtgcagaatcctatctaaaaacactctatacttttttcacctggttgcatactgacagtaattatcaaggaagagctgtaaattgggatgatgaaccccacattgtacggatagccatagaggattttttgatgcataaagctcattgcaaggttacaacaagcgatagcaaaacgtattacaatgtaaagttaacaaatataagtcctaatactgtcggtaggatgttaagtgttttaaaatctttctacaaaatcatgatacgtatgaaaatatacctttctcccaatccacttattgatgcacacgctattttagacgagtatgaaatgcaaatagagggtgttagggaaggcaaacctagaatgcctaaagaagcaggtacagaagaacctttatctaaaagaggtcgaagattaaccaactctttttttaaaatcataaatggcgagtggaagccagagattattgatgatcctcacctcccctttatgatttataaggctggaaaggatagtaaatggaagcttagagatgaaattattacaacgatgctatttcaaaccggagctagagcgacagaagttatcaaacttacatttggagactatcgtgctaggtatgataagggtgagttttctacatttaataagggaagcgatggaataagaacaaagtttttgaaagtagatactgacacgttaaaactacttgatcgttatatccatggtgctagaaagaaagttgataaaagtggtttgaaaatgaatgaaatccctgatgaaatcccaatatttcttaatcagtatggcaatccctacacttatgatgcctttttaaaaaattggataaacatcatgaaaaaagcagaaataaaaatcaatattcataaaacacgtcattggttcgtgacccgtagtattaggatgattcgcgaaaaatacaaggataaagtagaacaggattatgcaattggacgattacggatttatatgaattggagcgaaaaagcagacacaataaaagtctatgaacatcatgttgatgagaaggattatgtggtagagcaacacaataaattgttagaaatgatgaaaaaggatcaggaggagtatttaaatcagctaaaacctcgtaagagatttaaacaaccttcggttgaacctcgaaataaaattgctcaaatgtctgaaaaacaacatgaattaatggattttattaatgaattgaatagttaatctataaataagcctaagggtgtgggaatgtgattgatgaattaaaaagcaaactatggtatcaagatttaaaaggaaaagttgatgacaacgtccttacatatcaggataaacaaggctacttttggaataaggttaaccctgtgcatttgcgttacttcaaaaacaagtgctgtggttacccttttacaaaccacttagcgctaggattgatggtaatatccaatcaaaacttaaagcctaagactattcacacaaatattgcaagtataaatctctgccttaagcaactctttcaagaaaccaaattggcaagtcttaatgattttgaggtagatatacatctgtccgattatctacgaagggagattcttccctcccattcagataacaagagaattcaactctttactagttataaaaatgttgtaaaaaacgtgcataagtggcattcgaccaagttgacaagggagcaacaagaaatgttcgccccttttttactccctcaaacacacctagatagtagagattttaaagttaataaagcagcaaaggacgcttcgaaaaggaaaaggaagtctgaaacggacgcaatttccaaggaatttataaaaattcgtgccgaaggtgggtttcgtttaaaccaggttaggcgtttgcgacagaaatatcttgaggttgtagaatttgtaaaagataacggatatcctcttccttttgaattttcttatattgaaaacaaggaacgcgaagatagatcaaaggagcttttcttgtttcgattatgggataaaccttctttcgtacttcatcatagtaaaaattattcttacgctaccattaataatgcaaaggggcgaagagctacttttttagatgaaaacaacgaatacttcgtcgagtttttaaacgctgcaatattagatgatgaaactggtaaacccgcagaagaaactgaaggtttttggtttatacccattttagaacatcaattaatcggaagttggtaccgatctttaaataaagaacaaataaatgaaaggttgaaagtacttgaaacctatggatatagggaacccaattcaaaagaacttaataaacctttccaacccgatcataaaggtattctagcacaagggacttttataactaactcccaggaatatgccgagggcattttaatgaacgttgagattttgtatataacagctttgtttggtgcgacggcactagatatatttacgtcttcaggtgcaaggttaggtgaagtggcgcaagttcatcttggtattgggtgtttagaccagataaatatcactgctcccgaaataaatgaaggaaaaacatcttatatatttagagctattccgaaaggaagagatgagttagcagttttttatacgacaaaagatacttttgatttaataaaggaaattgcttttcaccttagaaatcaacattataaaggctcaattccaagggtggatttccgttattcgaagcaatcaggggaatcgcgaccagaccaactctatttatttcagttccatggtaaacattttggagaggtgacttttgcatgtgttttaaatttcatctgttttggattgatctatgaaacacaagacaagaagttggtaaaattgaaaccacacttattacgccacggttttgcgacacacgctgtacaagcagaagaccttccaattgacgtcgtagcaatgattcttaatcaaaaggatttagacgttacaagatattactctcaacctacccaaaaacaagtagccgatgttatttccgagtttcatacttccatggccgctacaactgacatgatgaaagaagttttaagacaaccagaagagatacaagccctttttgagcgtcaaagagagatcagcggcccatttagtaaaaccgttgggggtacatgtgttactaacaagatttgtccaacaaaacttgcatgtgtaggatgcagcactaaaatacctgagccagaacaaaaagatgaattacttgaatatctagattgggcagaaaaatcgaagaagtatcacgaggaaaaaggtttcaaactggaagttttgaaaatgaaaaaaacgatacatgatgcgaaagctgaattgaaagaaatagcattaatcgaggagtataggagagataaggaaaatgagccaagacttatccatagaaaaccataaaagtggtctagagcgtgattacgaaaaaagaagggttaactccttcgaactaggtaaaaaagcaatagataccctccttgcggagggcaaagaagttaccttacacaatgtatctaaaaagacaaaagaactcgatgaacaaggcaaagggattcattttaatactattagaaatcatgaagaactctatgcgtattataaagaaaagagtaagagctataagaaaaaacaaaaagagctagaaaagcatcttccctatcgcgaaaatgaaaaaaatacttttcatgagttcgagcaattaaagacggacagaaatttaaagaatgtgtacaaacaatatatgcgtttaacaaagactgaattagcaacgcgtttgatagaagctgagcaatatatagcagaaggaaatctagagtatttggaaaagttatttgagacatacgagggataaaaattgaattgaaacaataatttgtcgttgttcccacataaaaaataatgtactacaaagataattaatgtattacataaagagacacgaattagagctaaaaaagcttcaaaatgataagtgctttataccgttaataatgtatactggaggaccaattaaataagtgatattaataaaatcaccggtgaaaatataagagtattcattgaatctagtgaattaaagaattcatttgtaatggatattgtataccaaaaataaaaaaactccctaatgctaaaaggagtttttttatcaacatatgttcaattgcaatgttttgcaagtcaagctattttgtgaccttatagatgaattccacgatagcatcatgcatttgatctaacgcgggttgttccactggataatgacctccattttctaacataactattttcacatccactttttttattttgtttaggaatggagtacttaaatgcaacggtgtccatctatcttgttcaggttgtgttaaaagaataggacatacatcaaaatcttctggttccattgctggcttgtaattaccataactgtctaggaatctcatgcttgctttatttgcagcagaggttttatcacgattaaatatttccatcactttctcattattacataaggcactcattttagaagctgtactcattttcatcttaaagttttcaagtcctatgttacttgcaacgcctgccataggtattccaacacgactcataaagagatttttagctgtttcgtcacgaacttgttgatttttttgatccaagaatgtcataccaatgattcctttaactttcttgttttttgcagcaacgtggtaagtttccatcccacctgcacttaaaccatacagtacaatgggtctatcatcacgttgttgttcatagtcgatataatcacttgctaaatccacccagtcatcatactttactacagaacctttttttacttttgtaactccataggtaggcatgtcaatagcaatcgtttcgaatccgtcttttgaaagaggacctcctaaaatcatggacatctgtctaccgtttgtacctactccatgtaataaaataactttaacgggtgcgtttttatttcgaaaacagtctaaatgtacctcatgtcctttccaattccaccattcttctgttggatgataattatctgtaaagtgatattttttaggtaaataagcttgtatttcacgccatgcactttgttcactgtatttcatttcgtttcctccttaaaatgtttaaaataaatttctaaaatcattacgttctaatgttcgaacactcgaacgctttgcaagtaaaatattatttgactcttttatctttgtcaataaatattttttaattcactttgtagaaaaagtagcattgtaaaatactacttttatcattgtgcacactattttttaattatttctttaattgattatcggtttctaatgattcaattagttgttttaataatacaatggagttgtcaagagaaagggcataatacctttcagtagcacgtttttgaacagtaactagatttgcgtttaaaagatgcttcaagtggtgtgaaatagctggtctagataaagaaagtcggtctactatctgatttacagacatttctccttcatcataaagtaacaccaatatatcttgacgatttagatcctgcagaattgaaaaaataggagtgcattctcttaatatgcctattgtttttttgctcatgatatctctccctgtttaattattcgaacccttggacgtttatttagtatagaattttaccaatgtttctgtcaaagagtctttactctcctatttagagatattttgaactcttatgctttaatgtaatcttttgagttgcaattacatatattccttgcttgtctttactataaccctctgctacaaaataatttaacaaatgattattgcagtaatgttatctaagcatcgtatcacaaatacttttaatttgtatatgtttagcccatgaacttattttaatggtctccactttctttcccgatgtttttttctttaaataacatgttatgattcaatcgttcgaatgattaaacaaaagagtaaaggaaatgtgcgcacatgaaaaagcaaaagaaaatagatatattagttttagaaatctttgtggatgaatcaatgaaagttaactttataaaattacttataaactaaattgaacaaattgaataacataggataaattattgggctttttgataagagccaaacttagaggcggaggaattatggtggttaatgtatataatttttatgtaaatggagaatggagagaaagctcttcaggagaaacaattgaaatttcatctccatatttacacgaagtaattggacaagtacaagcaattacttgcggagaagtagatgaagcaattgcatctgcaaaagaagctcaaaaatcatgggctaaagcttccctacaagatcgcgcaaaatacttatataaatgggctgatgagctcgtaaatatgcaggatgaaattgccgatatcattatgaaagaagtcggtaaaggctataaagatgcgaagaaagaagttgttcgtacagctgacttcattcgttacacaatcgaagaagctttacatatgcacggagaaagcatgatgggcgatagcttccctggcggaacgaaatcgaaacttgcgatcatccaacgcgcaccacttggtgttgtattagcaatcgcaccatttaactacccggtaaacttatctgctgcaaaacttgcaccagcattaattatgggtaatgctgttattttcaaaccagcaactcaaggtgcaattagcggtattaaaatggttgaagcacttcataaagctggccttccaaaaggtcttgtaaacgtagctacaggacgcggttctgcaattggggactatttagtagggcacgaaggcatcaatatggtatcgttcacaggtggtacaaacacaggtaagcatttagcgaaaacagctgcaatgattccacttgtattagaacttggcggtaaagatcctggtatcgttcgtgaagatgctgatttacaagatgctgcaaaccatatcgtaagcggtgcattctcttactctggtcaacgttgtacagctattaagcgtgtacttgtacacgaaaacgtagcagacgagcttgttgacttattaaaagcgcaagtagcggaactatcagttggatctccagagaaagatagcacaatcgttcgattaatcgatgacaagtctgctgacttcgttcaaggtttagttgacgacgctgtagaaaaaggtgctacgattgttatcggtaacaaacgtgagcgtaacttaatttacccaacattaatcgaccacgtaaaagaagaaatgaaagttgcttgggaagagccattcggtccaatccttccaatcatccgcgtttcttcagatgagcaagcaattgaaattgctaacaaatcagagttcggcttacaagcaagtgtcttcacaaaagacattaacaaagcatttgcaattgctaataaaatcgaaactggttctgttcaaattaacggacgtacagagcgcggccctgaccacttcccattcatcggtgtaaaaggttcaggtatgggtgcacaaggtattcgtaagagccttgagtctatgacacgtgaaaaggtaactgtattgaattttaaataggcaatcaaaacaagtggcaataaaaagaggaagcatatcctatttttagagtcacttgtttttggattagattcataaaacttattacttcaagcaaagctaattttaaaaataattgtggaaacttactgtaaaaattgggaatgaaattcaatggtctccattttctttcccattgattattcgtgaaataattatgataagatttgaatggttcaatcgattaaacgaagggagatgcagtggatgaagaatgtacaaaaattgaataaattaacagatgattttaaagcatgccaaactgtcttaacagcgattggagactccacacgacaatcgatcattgttaccttaattgaagcgggctgtggagatggaatgagagtaggcgaaatcacacgtaaaacacatttatcacgtcctgctgtttcccatcacataaaagtgctaaaagacgcaaaggttgtcaatgtaagacgtgttgcgacgatgaatttttattacattgacccggaaaataatagtttaaaaatggtgaaaaatttacttcaacagatggatgattacattgatgagcattgggagccatcaaataaataaagaaaggatagaaaaaatgaaaaagactcttttaaatacgacgatgaatagatcaactacattcactgtgaaaaaccgcttttataaagctgcgatgagtgaaacaatggcaacaaaaagcaataatccaacagaagaactagtaaaactatatggtcgttgggcacaaggtggggctggtttactcatgactggaaatgtcatgattgatcgtgaggcacttggcgaaccgggaaatgtcgttattgaagatgaacgtgatttagatatcttaaaaagatgggcaaaatctgggacgcaaaatgggacacagctttggatgcaaatcaatcatcccggtaaacaatctccgaaaacattatctaaaaatccggttgctccaagcgccattccacttactggtgatattaaagatttcttcaataaaccaagagaattaacatcagatgaaatttggcagttaatcaaacgatttggcaatgccgctcgtattgccaaaaaggctggttttactggtgttcaaatccatgcagcccatggttatttaatcaatcaatttttatcccctcatcataatcagcgccaagatgaatggggaggagatttaaatgggcgtatgaaatttttaattgaaacctattatgaaattcgtaaacaagtcggtgagaaattcccaatcgggttaaaactaaattctgctgactttcagcgtggtggtttcaccgaggaagaatcgatgaaagtactaaaaaaaatggacgatttgggtatggatttaattgaaatttctggtgggaattatgaaaatcctaaaatgtttgagggagtacgtgaaagtacaaaaaaacgtgaagcatattttttagattatgctcaaaaggctcgaacactcgtacaagcggtactggtcgtaacaggcggtttccgttccgaagaaggtatgaatgaggcaattgaaagtggagctgtagacatggttggcgttggaaagctatttgcattaaaccctgattttccaaaccagattattcatggcaattattacacagttacgatcaagccaattcgaacaggtgtgaaaaagctagataaaaaaatatcttctatgttagagcttacttggtatgaacatcaatttaaattgatgggcaaaggaaaagaaccaaatcctaatcatagtgtatggaaaacagtactacaaatgataatcgaaaatggaacaaatgcatttcaaaagagacgtgcataaataaaatatagtgtattgttatattattggctcaatacatttcaaaatatgttttgaataaaagtagtaatagaggctataaaaaataggtgtatcaacactttgcttgatacacctattttcatggttttaatcgctaattgtgttaataaaaaacatgtcgtgataaaaggagtggattccccaccttttttattatcatataattgtttaacaacatgccttcgtggctagagttagccctaaaatccattattcttgttcttcagtaaaatatgtattagcttgtttttcaaataatgatgcaatttctcgtttatagtccccgcgtataatacctttctcagtaataattcctgtaattaattcattcggcgttatgtcaaatgctggattataaacatccgttccaattggtgctacttgttttccaaagattttcgtaacttctgtttcatctctttcttcaataataatttcagctccagtttctttcgtaacatcaaatgttgacagtggagcagcaacgtaaaatgggatattaaagtgctttgctaaaatagctaaattcattgtccctattttatttgccgtatctccatttgcgacaattcgatccgcccctacaataattgcatttatttctttcgtttgaatagcatgagctgcagtattatctgtaataagggtcacatcacatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaagttttcaggaaatgaattagctaccatatgtatctgggtcagtcaacgtacagcgagtgattctctcgttcgactatgcagtcaattacacgccgccacaggcactcttatgagtccagaaggactcaataaacgctttgataaaaaagcggttgaatttttgaaatatattttttctgcattatggaaaagtaaactttgtaaaacatcagccatttcaagtgcagcactcacgtattttcaacgtatccgtactttagaagcgacgattttccaagcaccgcaccattt

SEQ ID NO: 1344 - DNA, 12719 bp, Bacillus thuringiensis
ggaatgatgaaaaatacgtggcgtgagttaagggagatggaccgtaacgtatggattcgatttattggagagacgttaaatggaattgcaatgatgatgttaatgcctttttttgcattatatttaaaagataaggtagattcgttgttggaagttggggttattatggcgctttctccaattgctgcaagctttggatcacttataggagggagaattgctgacatatatggaagaaagcctattatgatattttctatggcaagtaatgcattattaatgctcggttttctatttatagaaggatttattccatatgcaattttatctatttttttagggttgagtaattctttatttcatccagctgcatcagctatggtcgcggatgtaacggcaccagaaaaaagaacagaggcatatggtttattacgaatgggacacaatataggtgctgcgattggtccgataatgggagcatcagtagttgtgttgtcaaagaaccttgtgtttattattgcctcttctacaatgctattttatgcgttacttgtattacttcttattcaagagacgatgccaaagagcatagataaggaagaacataaagaaaaggaatctggggcagtttggaaaattgtaatgcgagataaggcattaatgatttacttattagcaggtattatcatttcgatggggttttctcaaacggaaggcatgctgccactacattttgataatgaaatgaagcgtatttttggaacgaataatccatatccatatttaatggcgttaaacggactattagttgttttattccagtttcaaatttcaaaatgggctacggataaaccagttgggaagacgatgttatatggtgcatgtttattcgggattggattattttttatagggtggttaccgaagtggtttggagaatttaatacaaatgctacaattattttaataacactactgttcgtttatgctatatatacgttaggtgaaatgattatgtcgcctgtacagatgacatttgtagcaaatttggcccctgagcatttgagagggacttatatgggagctgcaagtttgcagtggattacaggaagcgcatttggcccacttttgggaggttttttattagatcggttacttggtcaccttctatttacaattttagctgtaggatgtgtagttgcaggtattgtatatgtttctttagatcgccttgttgagcaaaggcaaaaagacacactaaccaaacaatcttcttagtgaataggtgacatacacaaaaaaggggatttctacatattttaggtacataactagattagattgccattttattttgtgtacctatatagaaaatgaaatgaaaaaccaataagtgatgttatttaattatttatggaagttacattttatttcaaataggaactacctatttttataaaaagtgctaaaatagaaaaatgaaaacaattggttagggtgatttcattgacgaaaattaaattaggtttattatatggtggaaaatcagctgagcatcaagtttcgctacagacggctcttgctgctattaaagcgttaaatcaagataaattcgagattcatccaatttatattacagaacaaggtcaatgggtacgcggtgagcgtattgaaggcgaagtaacagatgttgaagctttaaaaatgagcggtgcagaaaatgcgatttctccgttatcattaagtacagaaattatcccatctgcagcttctgaggagaacgctattgacgttattttcccattactacatggaccaaacggtgaagatggaacggttcaaggactattagaattaatgaatatcccttatgtaggaaatggtgttctagcatcatctgctggtatggataaagttgttatgaaaaacatctttgcagaggctggtttaaaacaagcaaaatatgcatccttcattcgtagtgcatgggagaaaaatcgtgaggaagcttattctaaagtagaagataagttaggatatccttgcttcgtaaaaccagcgaaccttggttcaagtgttggtattaataagtgtaaaaatcgtgaagaacttgaggatgcatttgtagaggcattccaatttgatcgcaaaattattgtagaagaaaatattgtaggtcgtgaagtagaagttggggtactaggtaatgatgagccgaaatgttcagttgtaggtgaaatcgttccgaaaaaggacttctatgattataagtcgaaatatatcgatggtgatacggcgctaattattccagctgaaatgacagaagaagaatctaatgtaattaagcgtgatgcgattattgcattccaatcattagacggtgcaggtttaacgcgagctgatttcttcttaacgaaagatggagaagtgtatattaacgaagtaaacacaatgccaggatttacaccgttcagtatgttccctctattatggcaacatactgggttaccgtatccagaattaattgaagagctaattcgtttagcgattgaacgtcacgaagaaaaacaaaaaattaaatatacaatctaacaaaaaaggaggaagcactattcgtaggaatagtgcttcctctatgtaaggagcgtttctatatgataaagcgaatgttaaagcaagtggaacagatggtaaatggtactggattagcagagcaatatgagggaattactattcaaggcgtgtctattgatacaagaaaaattgaaaaaggaaacttgtatgttccgattcaaggggagcgcttcgatggacatgcttttgtagataaagctgttgaaaatggagctgtggctacattatggatgaaagatgtagcgaatccacctgagaatcttccggttatttttgtggaagacacgctatccgcattgcaaatgttagcgaaaaactatcgcgatcaattggatgttaaagttgtaggtgtaacgggtagtaatggtaaaacatctacgaaagatattgtaacaagtcttcttgcgactaaattcaaagtgcaaaaaacagaagggaacttcaataaccatatcggattacctcttaccattttaaacttagaagaaaatacagaagtagcagtattagagatgggtatgtcaagccgaggcgaaattgaattcttatctaagttagctcgtcctaatgcagctatcattacgaatattggtgaggcacatttaatggatttagggtctcgtgaggcaattgctgaagcgaaattagaaattgttacagggttacaagaaggtggcgtgttcgtatataacggagatgagcctttattaacgaatcgtgttcctgaaatgaatttagcagcagaaacggttacgtttggtgatgcaagagcaaacgattattatccaacgactgtaacattacaagcaactgggacacatttcaaaatgaatagagatgaaaatatttcattctacttacctgtgttaggaaaacataatgtgtataatacacttgcttcaatggcaattgcgaaacattttggtgtaacgtgggaagagatgaaagaaggtttagtaacacttcaaatgacgggcatgcgtatggaaattgtgaaaacaaatagtggtttaacaattatcaacgatgcttataatgcaagtccgacggctatggaagcagcattccatttaatgaatggtttagatggttttgctaaaaaaatcgttgtgctcggtgatatgttagaacttggagatcaagaagtacagttccattatgaggtaggaaaattaatcgatccagcaaaaatctcgcatgtattcacatacggtagattaggggctcaaattgctgaaggagcgaaaattaatttccctaatgaacgtgtaaaggcgtatgataataaagaagagttagtaaaagatttacaagcagtagtcgatgtgaaagatgttgtattaataaaagcatctcgcggtatgaaattagaagaagtaattacgatgttgaaataattggtgtatataaatagggatgatagttacgaaaatagaagaaacttataataagcgcttacagtaaatataaaaaaataaaagtgaagaaaaaaactctgaatatgaaaataaggtaacagttgggtttgctttttacacatacaaaacttataattgataaagtgtaataacgtttagaagtattttcgtgaagaatatacgcccgtttatatacgtgagcattcaggaaaagggcttttccgcaaattcggaaaacgcctttttttaaatgataagtataggatagaaaaggagaagtaacattgacaacatttcgagaattaggattaagtgattctttactgcaatctgttgaaagtatgggctttgaagaggctacaccaattcaagctgaaacaattccacatgcattgcaaggtaaagatattattgggcaagcgcaaacaggtacagggaaaacagcagcattcggattaccactattagataaagtggatacacataaagaatcggttcaaggtattgttatcgcgccaacgcgtgaattagcaattcaagttggagaagaattatacaaaattggtaagcataaacgtgttcgcattttaccaatttatggtggtcaagatattaaccgccaaattcgtgctctaaaaaaacacccacacattattgttggtacgccgggtcgtattttagatcatattaaccgtaaaacacttcgcctgcaaaacgtagagacagttgttcttgacgaagcggatgaaatgttaaacatgggcttcattgaagacattgaagcaattttaacagatgtgccagaaacacatcaaacattactattctcagcgacaatgccggatccaatccgccgtattgctgagcgtttcatgactgagcctcaacacattaaagtaaaagcaaaagaagtaacaatgccaaacattcagcagttctatttagaagtgcaagaaaagaaaaagtttgacgtgttaacacgcttattagatattcaatctccagagcttgcaatcgtattcggtcgtacaaagcgtcgtgttgatgaattatcagaagcattaaacttacgtggttatgctgcagaaggtattcacggtgatttaactcaggcgaaacgtatgtctgtattacgtaaatttaaagaaggttctattgaagttcttgttgcaacagacgttgctgcacgtggtcttgatatttcaggcgtaacgcacgtatataacttcgatattccacaagatccagaatcatacgttcaccgtatcggtcgtactggtcgtgcaggtaaaaaaggtattgcaatgctatttgtaacaccacgtgaatcaggacaattaaaaaatatcgagcgtacaacaaaacgtaaaatggaccgtatggatgcaccgacacttgacgaggcattagaaggtcaacaacgtttaatcgctgaaaagcttcaaagcacaattgaaaatgaaaacttagcatactacaagcgtattgcagaagaaatgttagaagaaaatgactctgtaacagtagtagctgctgctttaaaaatgatgactaaagagccggatacaactccgatcgctttaacatcagaaccacctgttgtttcaagaggcggcggttctaaaaaacgcggcggtaacggaggcggataccgtgatggtaaccgtaatcgtagtcgtgatgcacgcggcggtggcgatggacgtaatcgtgaccgtaaccgtgatggacgtaatcgtgacggaaaccgtgatcgcaatcgtgatggtggtagtcgtggtcgtagaggtgaaggccaaggtcgccctggttcttcaaatggacgcggcgaaagaaaacatcatagccgtccacaagcttaataaaaaaagagaatgccctttgcgggcattctctttttttatttctataattgtgcatactacataatagttatgatagaaaaggggctgttatatgcttgtaaggcttggttacgttgcgatgagtgtacatttgaagaatgcatctccatctcaaacgatgacgtatgcacagtttcagaaattaaatgatcgtgctgctgcaattcgtaaacttgaaagaattgctaattccaatttagaaaattgtttacgtttattaaagcataataaagggcatgacatatctttctttcggctcagttcaaagctcattcctttagcgaatcatgaggaattgctagagtggaactatattcgtcctttaaaagaaaatttaaaaaaactaggtgaatatgcagttcatatgaatatgagaattgatttccatccagatcattttgttgtactaaattcacctgaggagagtgtttttaaacaatctgtaaaaacattgcagatgcacaaaaaattattaaaaggcatggggattgaacataagcaacgatgtgtactgcatgtcggaggaggatataaagataaagaacttgcattagagcgctttatagagaagtggtctaatgtcccaaggggtattcaagaaatgattatattagaaaatgatgatacaacctttacgttagaggaaacattatatttaggagaaaaattagatattcccgtcgtatttgacttgcatcaccatatgatgaataatgagcaagaagattggtatgaagattgggcacgtgtcgttcatacgtgggaaacgtctttgttgccggttaaaatgcatatctctagccctagagagggaaaagatccaagagctcatgcagattatattaatgtagaggcatttttatcttttttaagaaggataaagggaagtgttccgcaaattgattgtatgattgaggcgaagatgaaggatgagtctttatttcaattaatgagagatttaagtgaacaagtagatgtagaaattatcgatggtgcaagcttttatattaaataagctttgcaccatcgttttttttggttaaaaaaggggttaaaatgccaccggttattaaacctgttaaatgactgatcggattggcagaagggttaaagaaagtaaatagtagtaatagaagaatcataattgagaaaatggcaatttcttttggttttgaagagcggtattgattgtacaataaaaataactgtgcacctaatagtccgaaaataccacctgatgcacctgcgtgaatatattcaagcggcataataatataagaagaaatatttccagaaattccagagagaaaaaatagaataaaaaaagaaaagtgtccgagttgcttttcgatagaagaaccaagagcaaacaaaaaaatactattagaaagaaaatgttgtaagtctacgtgtacgagaagagaagttatgacacgccaccattctcctttagcgatatattcattagaggctgccagtggtaagagaaaaaagtcgcctaatatcatcatgactaaatgaataagaagtaaggtaagaatagtcggttgtaaagaaatatgagtggatcttattagcatacggttactttcaccccttttgcatcagaaagattctctgttattcttatcaatatgaaagaagaaagttaaatagaagaaggggatttcgaaatgattatagggattggtatcgatattattgaattaaatcgtattgaaaaaatgctagatggaaagcttaaatttatggaacgtattttaacggaaaatgaacgtaatgttgctatggagctgaaaggaagtcgccttacagagtttgtagctggaaggtttgcagcgaaagaggcgtattcaaaagctgtaggtactggtatcggaaaagaagtgagttttttagatattgaagtgaaaaatgatgaaagaggtaagccaattctgattacaagtacagagtatattgttcatttatcaattagtcatagtaaggaatttgctgttgctcaagttgttttagaaagctcgtcacgctagtctgcatattttatatctttgtctcatatatttgaggtagcgataaggaaggtacatcttccattcatttataggggcaaaggggctgaattgatgaaaaggcgtctgtttttagttcttgtcggtttgttgaccgtttttgtgttggcgggttgtgtggaaaagaagcaagatgatgtcgtgagagatttagaatcaaaagtaaaagggatgaaaagttatcaagctgaggcaaaattatctattaaaacaggcaatgagcctcaagagtataacgtagagatttggcataaggaaccgtctttttatcgtgtgaatttaaagaatgcaaaaaaagatcagagccaaattattttgagaaatgaagaaggtgtatttgtattaacgccagcacttaataagagcttccgttttcaaagtgattggccgcaaaatagtagccaggcttatttatatgaatcacttgtaagagatattttgcaggacaagaaaaaccttacttttgagaaaacagataagtattatatttttaaaacaaaaacaaactatcaacatcaaaatatgttgccgagacaagagattacattgaataagagcgacttgactccagtttcagtgaagttactggataatgatcaaaatgttcttgtgaaagtagatttctctaaagtgaaattcgatgcgaaatttgataaaggtgcatttgatacgaaacaaaatatgtctagagcacaggtagatgttcaaacaacagcgaaagaagacaaaccgtttgctattttgtatccacttgatacaccacaaggtatgactctgaaagatgaaaaagagttgaagacagacagtggcaagcgtgcgatactcacatacactggaaataagaaatcctttactttaatacaagaaaaggcaaaagttgcagaggcatcatcagcggtaagtgtaagtggagaaccagttgatcttgggtttacgattggtgcattgacgaaagactctgtaacgtggtcgcataacggagtagaatatatgctcgtgtctaaaggtttagagccgaaggagctgttaatggttgctcgttcagttacagcgaagcaggtgaagtaaacttcttagacgtggtgatatatgtgcaccacgtcttttcttagtttgaaggtggatttcataaaagaagcatataaaagaataagcttcgcatatcgtgtataaggaagtgtatttatggaagaagcaccattttaccgtgacacttgggtggaagtggatttagatgccatttataacaacgttacacatattaaagagttcatcccaagtaatgtagagatttttgctgtagttaaagcaaacgcatatgggcacgattatgtaccggtggctaaaacggcattagaagcaggtgcaacaaggttagctgttgcttttttagatgaagctttagtgcttcggagggctggtattactgaaccgattttagtgttaggtccctcgccgccgcgtgatgtaaatgtagctgctgaaaatgatgtagcgctaactgtttttcaaaaagaatgggtggaagaagcaattaaactttgggatggttcatctgtaatgaaattccatattaactttgatagtggtatggggagaattggaatacgtgaaagaaaagagctaaaagaatttttaaagagtttagagggtgcaccgtttttagagttagaaggagtatacacgcattttgcaacggcagatgaggttgagacttcgtattttgataagcaatataacacgttcttggagcagttaagttggttgaaagaattcggagtggatcctaagtttgttcatacagctaatagtgctgcgacgttacgttttcaagggattacatttaatgcagtgcgaattgggattgcaatgtatggattatctccttctgtagaaatacgtccttttttaccatttgaattagaaccggcgctatcacttcatacgaaagttgctcatattaaacaggtaattaaaggtgatggaattagttataacgtcacctatcgaacgaaagctgaagaatggattgcgactgtagcgattggctatgcagatgggtggcttagaaggttacaaggatttgaagtgcttataaatggtaaaagggtaccgattgtagggcgagtaacaatggatcagttcatgattcatcttccttgtgaagtgccacttggtacgaaagttacgcttattggaaggcaaggagatgagtatattagcgctacagaggttgcggaatactcagggactattaattatgaaattattgcaacgatcagtttccgtgtgccaagaatatttatacggaatggtaaggttgtagagataattaattacttgaacaatatatagaaggtagtatgattgcttcttgtcattggagtgactgttcattgctggataataagctctttttgatgagaagctttttacttataatcattttttatataagttgcacgtaagttttgaagaggagttctattgtttttagttagttatgagataaaaaatttaagaagatgaatgttttgtttgtgaattggaaaacataagcaaggaataaggaagtctttgcaacaggctccatacaatggtattattacaataggtgtcatatatatatttgggtgtgtagttgacggtggaggtgtatttttgtgtccgaatcaagtgtaactactgaaatcgtggttcggttgccaaagcaaatggtaacggaattggacggaattggaaaacaagagaataagaatcgccatgaactaatttgccaggcaacacaattgttattgcgtcaacataagacgaagaaacgctaccaacatgaatcaatgcgacgtgggtacattgaaatgggaaaaattaatcttggtattgcatctgaagctttcttagcagagtatgaagcagctcatacagtagaacgcttagttagcggggggtaatattttgattgtaaaacgcggcgacgtgtattttgcagacctttccccagttgttggttctgagcaaggaggcgttcgtccggttcttgtcattcaaaatgacatcggaaatcgttttagtccaacggtgattgtagcggctattactgcacagattcaaaaagcgaaattacccactcatgtggaaattgatgcgaaaaagtatggttttgagagagattctgttattttacttgagcagattcgaacaatcgataagcaacgcttaacggacaaaatcactcatttggatgaagtgatgatgagtcgtgtagatgaagcgttacaaattagtttaggactaatagatttttaaatcggcagtttaagttgctctctttgaagggcaactttttttattatagaggaggttacggttgtatatggaaatggtagataatcgacaagcgttaatgaaaatgttagtgaaagaattaggctttaccgaaaagcaagttcgtcatgttattcaattaacagaagaaggtaacacagttccatttattgctcgttaccgaaaagaatggacaggctctttagatgaggtgcaaattcgtacgattttagagagatggcaatatatgatgcaacttgaagataggaaggaagaagttcttcgtcttattgatgagaaggggaaactgacagaagagctacgacagcaaattgttaaagctacaaagttgcaagaagtagaagatctatatcgtccatataaagagaaaagaagaacgaaagcgacaattgctaaagaaaaaggattagaaccattagctgaatggttattgttatataagaaagaagatccggctaaaaaggcagtggaatttattaatgtagagaaagaagtgcaatctgcagaagaagctttacaaggtgcacaagacattattgcagaaatggtttcagatgaagctgcgtatcgtagttggattcgaaatgttacttttagaaaaggtgttatgtcttcgtccgtgaaagatgaagaaaaagatgaaaagaatatatatgaaatgtattacagttatgaagaaccattgcaaaaagtagtaccacatcgtgtattagcaatgaatcgtggcgagaaagaagatatattgagagttgctgttgttccgccagtagatgagatagtaacttttttaaataagaaagtaattcgtgataacgattcgaaaagtgcacattatgtacaattagcgattgaagatggttataaacgattaattcaatcttcaatcgaaagagaaattcgtaaagaattaacagaaacagctgaagaacaagcgatacatattttctctgagaacttacgtaacttattattacaacctccgatgaaagggaaagtcgtgctagcggtagatccggcatatagaactggttgtaaattgtctgtagtagatgatacggggaaagtactacatatcgatgttatttatccgcatccacctgttcgtaaatatgatgatgcaaaaacgaaagttctttctattatagataaatatcaagttgaaatgattgcaattggtaatgggacagcatctagagaaacagaagagtttatagtagatgtattacaaagtgtgaaccgagatgtcttttatattattgtaaatgaagcgggtgctagtgtatattcagcttctgatttagctcgtgaggaattcccaaatttacaagttgaagagagaagtgccg

SEQ ID NO: 1345 - DNA, 15270 bp, Bacillus thuringiensis
cgttatatgttgcatttcggcataaacgatcacaaattgtttctaccattaattcaggctcttttgtaataattttaaatgcttttgaaccacttaaaccaacttcaacgatatgaatcactttcgaagcgataaagtaagcaattgccgaaaggatagctccttgaagaccgaataccgttgatacgaaaataaatacgaacatgtttaagaataaaataaggtcactcgttccaaatggtaacttacgagaaagcaatacagcaagcatatcgatcccatctaatgccccaccgttacgtaatgctagtcccataccaaaaccgatgataataccaccaacaactgtaactaataatgtatcgccttcaataatagctggtattccgtgcatgacaacggtacctactgctaatgaagcaattccgataatagaataaatcgcaaagcttttaccgatttgcttataccctaaccaaacgaaaggaatgttaataactgcgattagagctcctaatggcaatccaaataatcttgaactaacgatacttaaaccagtcacaccaccgtctgatacgttatttggaattaatactgcttctaatccgtacgctgtgataaatgccccaataataatcatcaaagcttttgaagcaatttttagcttattgggcttgtttttgataattttctccatataatttcctcgtttcaaactagtttcttatttgttacgtaattcacacctaaattttattttaacatttaatttgaaaaaattctcctttaatggatgtatgcagggaatattatcaccatattatctttaaaatatttttgaaatcagtataagaaatcccatcctttcaaaggatgggatgctattaagaaaatataaaactaagtactgatacgaataaagcgaaacctaaaatagttccacatattttcatatggcgcttacgtcccattacgacaatcgcaacatattcgcgaatcattgcgttaggccagtaataaaatgcagtttttgacccgattccttggctattaagaccagcttgtctagcgtatatgccagcgcggaaaaggtggaaattatttgtggtaaaaatacttttatatttaccttcaggttttaaagaatccataatttctttagagaacaacatattttgatatgtgtttacagagcgattttcttgcaccgtatgttcaagaggaattcctttttcaacagcataattttgcattgcttctgcctctggaagaccttcatctggaccttgaccaccagagaaaataattgttggtggtgtatttacagctgcttgtttccaatagaagtcgatagctttattaatgcggcttgcaagtaatggtggtactttatcattaattaagccgctaccaagaacgataatgaaatcttgattacgtcttggtctgttgaattggtataaaaaatatgcgcttaagaagttagataagtgtataaagaaatagaagcttataagagaaatagctgcaaaaataggctctaaatgcgatgagaccaaacttgctgggtttataatagggagtaacataaagaataacatccctaaagcagcaaggagtgttaaacagttagtgaaccgtcttccttctcgcttcattaaaattctagcattaagaaatagcccaaacattaaagcaacaataccgaaaggaagcataataagaagtgctaaaataggtaaaattataatatagcgtaggacatcactacttgaatttacagatataatcacacaaaaaagaaggaaaaaacagacaaaggaattaaataaaaagccgtttattatttttcgcggatcttttaaatatgagataagaaaaataataaataatataagaggaataattccgaaatacatcataaatatagtacacctcaatttgtataagaatttgacataccttttatattacatgattttataagtgaaaatgaaagaaaaaggattttgaattttctcaataaaatatatggatacatatgttacaatatattcaaagcgatatattaaaagtaaaatggttgaaaaggcactcaatagagtgctttttctttttgtatgcaattgtgcatattatattttttttcaaatgaagaggattacaatataatttgtagacagactttataaagcagaatttaatacaaacatttccctctactttttgtatctaacaatcgtataacaataaataattctgttttatagtgtctgtttttgaaaggtgtcttttttgaaggcacctttttttattagtatagatagttttcactgttagcatagtgtaaactatctatactaaacattagcaatcttccgtataaatattatcaatttactatatattccagtggtgttaacctacatatgaaaggctttctttttcaaaatattacccctaataaaattttgaagaagtcaactgtctccaaacttgtctttatgcttaaagaaaaagcactcaaattgagtgctttttcttattgaaacatgctatttttctaggcgattttcataaaataaaagtaaagaaatgaaagtgggtgacaaaatgccggcagttgtggaaggtgttattattgaaaactgcaatggaacaattaatgtaggggataaatataacgtacagccgattgaaaagacgaaagcttataatggatcgggatcatcaaatacaggaatgaaagtacaaacgtttagcgggattagtacggcggatgtaagggataatgatgcgtatgatcaagttattcaatcaacgttataattttaaaatgcaaaattgcataaagtaacatgtttgttgtatgttacactctagctgtgagctgttaatgattcttctgtattatagttgttagattagaaatataacatcttatcgaaaatcatacgtacaaaaaaagacacttcaaacgaagtgtctttttttactttagtgataccctttagcagagtctttatgaattttatttttaaaaatactgtagctccaaagctgatatccaataacgattggtaccataaccattgcaacgaagaacataatttttaagtttaattgactaccagctgcgttatataacgttgtactgtatgcatcgttaatacgagatggtaacattcttgggaacatacctgcaaagccagttgtcataaacattgcgattgttaggcaaacgaatgtgaatgcaaggccaattttatgtttgtacaccataataagtgcgagtacactcattagcattgcaagtactggaagaatgaatagtaccggatattccgtaaagttttggaataagtttgtccgattagcagttgctacatagaagatagctaaaataatagcagctgccattgaaaatggtcttgcgattttataagcacgatcagatacttcaccagtcgttttaatcatgacccaaagggcaccggatacgacaaatatagcagtgaagaaaagaccacctaatataccgtaatggtttagtaagctaagtaaatttccttcatagccattttttccgatttgtagtccgtaataaagattagcgaatgtaacaccgaataagaaggcgattaggaaactgccaattgcaaatgcccatttacaagttttttgccaaattggtgaatcatctttatgcatgaattccagtccagcggcacgagcaaatagtgcaagtaatactaagaataacggtgtatataaataactaaacatattagcatatgtgactgggaaggcagcaaatgttgcgccaccagctgtaattaaccatacttcattaccgccccagaacgggccaattgcttcttgtaattgatttcgttcttgtcgatctttcgtaacgaaaggaaaaatcattccgttaccaagtgcatacccgtcaagaatgaagtaaactgtccaaatcacgccccataaaccgaaccagatgattgcaagcatatcatgagacatgagctacacctccctcagtagcaggttcttctaatgcggcaggtccttttttcgcgaacttcagcattaagtatacgtctgcgattaaaagtaaagtgtagaataaaattaaactaattaatgagaaccaaatttgcgggacagatataggtgatacagattctgctgtacgcattagtttatatactgtccatggttgacgacctacttcagcgacaatccatcctgcgttaattgcgatataaggaagtaagacagaccatattgtaattttcaaataacgttttgagttttctagttttccttttcggtttaaatagaagccataccaagttaatgccataaagaacatgccgagtgcaaccattaagcggaagctataatacacgaggttaacatttggacgttcatctttcggaatatcttttaaaccaacaatttcgccattaaatgaatttgtgtagaagaagcttccgagttttggaatcgtaaggaattcaaagttcttctcattttttacatcaggaatttgaacaattgagaagccttgtccttttccagtttcccaaactgcttccatcgcagcaccttttgcgggttgatatttagctgctgatacaccagattgatgtcccataaacggtgtaattgttgcggcgaataagcctaacattaaaccaaacttaaatgattttttgaagaattctacttcatttttacgtaataagtgataagcactaattgccataacgaagaaagcacctacgatataacaaccaactacagtatggaagaacatgttccaagcgtatggattcgtaacgagtgcccagaaatcatttaattcagcgcggccgttacgcacgacgtatccaacagggttttgcataaagccgtttgctgtaataatccaaagggcggaaatgtttgttccaagtgcaaccatccacatacagaaggcacggaactttggtgaaattttgtctttaccgaataaccatattcccatgaaagtagattctaagaagaaggcaacgagtgcttcgattgcgagaggggatccgaaaatgtctcccatatatttggagtactcagaccagtttgttccaaattggaattccatcgtaatcccggttataatccccattacgaagttaattgtaaataatttaccccagaaatttgccattttacggtatgttggattcaatgtgcgggcgtattgagtttccatacatgctactaaaatgacaagtccgattgtcaaaggtacaaataaaaagtgataaaaaatagtaattgcaaattgaaaacgactcagtaacagaacgtcggacataataaatattcactccttttttacattatctacaatcagtttatagtgaaaatacgtttaaagtatgtgaaacttgttacaaagatgtgtgtatattttgaaagaattatgtcgattatctgaaaatatcttatttttactataaagcgatatcctttttgagtttttcatattttggtacactatttatgtagtgtaaacgagagaaaagagggtcctttactatgaagtcattagaagagattttgcagtacaatgagaaatttgttgaagagaaaaaatatgaagagtttgtagcggggaaatttccaaacaaaaaaatggtaattatttcttgtatggatacacgacttgttgaactattaccaaaagcgatgaatatgcgtaacggtgatgtgaaaattattaaagtagcaggcgctgttatttcacatccatttggaagtattatgcgtagtattttagtcgctgtatacgaacttggcgctgatgaagtatgtgtagttggtcaccatgattgtggtatggcaaaaattcaagcaagtagtacgattgagagaatgaaagaacgcggtataacagaagagaaattagatatgcttcgttattctggaatcgatttagaacaattcttgcgcggtttctctagtgtggaagaaagtgtagaacatagcgtatcagtacttcgcaaccacccattacttccggaagaagtacctgttcacggtcttgttatagatcctgatacaggaaaattagatttagttgtgaatggttacgacaattaagaatttactttgtcatcctttttatctgggacaggatcaaatcctcccgggtggaaagggtgacattttaatatacgcttacaagtaagccaaaagcctttgaatgcaccatgtttttgaaacgcttctaatccataatgagaacaagttggataaaaacggcatgttggtggtgtcatcggagaaatgaacttttgataaaagcgtataatcccaataaaaatctgtttcataacggtctccttttcagcatattcttaaagtattatagcacgactgtacataatactttactaatgtgcatttccgttatatcatattggatataacggaattaaattaaaagcgggagagatgttgtatgccatcagtagaaagctttgaattagatcatacgattgtaaaggcaccttatgtaagacattgcggagttcacaatgtaggtagtgacggtattgtaaataaattcgatattcgtttctgccaaccgaataaacaagcaatgaaaccagatgttattcatacgttagagcatttattagcatttaatttacgtaaatatattgatcgttatccgcactttgatattatcgatatttcaccgatgggctgccaaacaggatattatcttgtagtaagcggaacaccgacagtacgagaaatcattgatttattagaactaacattaaaagatgcggttcaaattacagaaattccggctgcaaatgaaacgcaatgtggtcaagcgaagcttcacgacttagaaggagcacaacgcttaatgaacttctggttaagccaagataaagatgaacttgagaaagtttttggataaaaagaaaaactgcctgtgaaagggcagtttttttattgtgctaagagcgactatactcttcttttgtatgaaaatatattagatactccaacatataaaataaaggcagaacagagaaaataaacaaatgctttcgctttttgctgcttctttatttcatcgattccaaaaaggatacacataatacttaaaaggatagacacgtaaggtaaaagaatagtgaagtttgcaaagaagctaaatagggcgagagaaagagcgatagtggcgattataatttgaatgttttttaacatggaatcccccttaagtagaaagaaatagttactgagagaaaataattataaatgctaaattggtcaaaatttcattctacatataacgaaagtagtttgatattaaaaagaagaatatgagactggaaacgaaaaaatacgggatactcattgattttcgtccggatttcaattcattaattcctagaagaataaagaaacaactgagaataaattgtacgtatgggagaagtgaaaaattatcggtaacatggatataagtgcttagaatgagtaagagaagcatgagaaatgctaaaaaactccgtaatatagttagagttagcattgtatagcctcctttagaccatttactagaatatttctgtgaaaccaataaataaagcagcggcccctgctagtagagcgagcagactacctcctgtttgtcgttttaatatttcctctaaacttatggtgagggccatacctcctaaaaagatgaacatataaggcattatttctctactaccagtaaaaaatccatagattgctatagataaggcaataagtgataaagtaatccgacccccttttagcataaaagacctcctctattttatgtaggtaataatgagaactatccaaatgaaagcaccggcaataatacaaataaatccagttgctaattcctttttctttatttgttcaaatgcgatgagaaacattaaagcccctaatagaaattgtgaaagaggtaaaaaattattttgacctgtatataatccaattgccgacataacgatcacagtgagtgctactatgatgcgaagtatacgaagcatattaggaattctccttattcttttttgtataaggattgtcttctagtttatcgacggaatgtttataagcatagcctttattaattgtcatgatggagagtacgaggatgattaggacgatgataataccgataattaatattttgaacataaaatccctccttttctttattttacataattttgtaattgatgaaaacaatagaaaataaaaggatgaaagaagggtgttacatggagacgaaaaaaacatattatatatcaataggaaatggtcaaatttcacaagtgaagacggcggatacgtataattttgagatttccgcaaatgatgaggaaattacggaattaagagagcactttgatcaagcatatgtagaagatttagggtcatttgtacgctcccacgttccatttgttgagtatcatcacgattcaaataatgaccgatatgatgaacaactacaaaaagcatataaaatgatttacgatttaggaaatcatgagacgaaagaattagtcgcgcaaatgggaataatcaatggattgtaattggataatattatgcagaaaagcgagaatatgctacaatttgtggtaggaaaaacttgtaaccatcaataggggagtaatggcatgtacaaatttaaagattattaccacaacactgtacaattatcgtttgaacgttatccattttctcctgagccaaagcatgtttgggttgtatgccggtacggggatcaatggttattaacgcatcatttacgtcgcggtcttgaatttccaggtggtaaagtagaactaggggaaacaccggaagaagcggcagttcgagaggttcatgaagaaaccggcggcatagtttctgatttaacttacttaggacaatacaaagtatctggaaaagacaaaataatcattaaaaacatttattttgcaacaattagtgcggtagaagaacatacgcattacgaagaaacgaaagggtctgttttattaaaagacattcctgacaacattaaaacgaatagaaaatttagctttataatgcgcgatgacgtattagcgcgtacgatgaaacatatagaagaaatcggctgttttacgaagtaaagtagccggtttcttttttttgtatgtaagaataaatgtaaatatatctttatattattttgggtatattatacaattttgtaaagatatatttacattttaggaggggaaagatggataaaagaaaagaaacgactgttactgtttcgatggttaaattaaacttttctttattttttataataattgctttgtcgtttggaattggttatttgcatatatttctttcgggtgggggcggattaaagtttcactttatctccacctctaaaaacgaaagcacctccaacaaatcatctacgatacgtgaatgcttaaaattcccccaaaacgaatcttttttccaaacaccaagaatccctacttgttcagaaccaagcacatcgttttctggatgatctccaacataaagacattcttctgccttcacatctagtctttgcaaagcacgttcgaaaatttcaggatgaggttttttaattccttcagcttctgaaacgagaatggtgtttgtatacgtatgtatatgtagtgctcgaaggttgctcatctgaaattcagtaaaaccatttgtaataataccaattttaatgtttcgctgttttaactgttgaagtagttcatgcgtgtttttgaaaggaatacaatgatgttggaagtttgtaatatagtcgtgtagtagttgttcttgcgttaaagtagtaatgttgtattcggaaaggagagtagcatatactttatccttccacgtatagccattattatcgagttcaagaaatcgagaacaatactttgatttctctatgctcttcaaatgtgaggcgaagcgattatattgctcacaaataaattgttctaaagattggcgccgatctaatagtgttccatctaagtcgaataagattgcacgaatcatgggaagcctccttgcagtttttataattaattatcgcatattcgtaaaaaaatgattatgatattttgtagaatggaataatgggggattgtatgaagaaactgtatggcaagttagtgtgttgtattatagcaagcagtttagttgcaggatgcgagagtgctatcgaggttacgaaagaaaaagaaatttgtaaaacagaagaagagtgcacgcaaataggagataaaacattacaaaaagtatataaaaagatagagggactttcagaacttgaaaaagtagaggattatgacatagaagagtatgaaagtatgaatatgaaagaggcggaacagaaaaaagaagaggatgacaattacttctttttagcttcttattatatcgatgatgatgaaattgtagatccttattttgagaaattggatcgtaagagattgaataaagtttttgcagatgacaaagtagcaaaagatgatttgttaagccagcggcaagatagagagtatcatgaaacgttatgggacatgtaccgcactctcattccagtgaaatatcgtgagaatataacagggttggatttaataacggatggttatgacggcgttgttgcccatgtcatgccaagtatggatgacccgagagattggttgcttagtttagacgtgctcgattctggggtgaatatagatgaagtgatgaaaacattaattcatgaaacggctcacgtattaacgattgggcataaacaagtaccagtggataggaaatatttagaggcgtttgatgaagagaaagacatttcatcatatcgaaataaatgtaaaacggtgttcttgaaaaatggatgtgcgagaaaaacttcgtatattaaccaattttataatgaattttggaaaccaattgagcaagagtggacagaaaagaaagtagaagaaagtgaagaggcacaaattgaattttataaagaaaagcatgatgattttgtatcgctgcatggaataacaaatgtaacggaggatatcgcagatacatttacagcgttcattttacaagattcaaaaaaggtgaaagaaggaacagagttaaaatataaaaaaattgctttcttctatcagttccctgagcttgtaaaaatgagagcggaagtgctgtcgggattatatgatgtttcaaaaacgatagaacaacaaagtggagactaatgtgaggtatgctttcgatatagtttcgttaaagaaaagcgtgaagaatttttaattctttgcgtttttttatgttgataaaattgaaaattctgtatttttattaaaaagaagaaggaactttcggtataaaatagaattagtataaaaatgtcacaatttagacacaattataatgcgcgtgttgtagggactataagtttactctcgaggaggtaatgaaacgtatgaaaacgattcttgctgttgctggtctcatttgggtaatgtctcacggttttccgatttttgaaggggagcaaattcgtagtgctttgaatgaaaagtttaatgattatcatgtgatagatcgaaaagataatgtcgttacagtacgtgtgaaagactgtttccatacagttacggttgcggatggaaacattacaaatgaaacgaaaatgtgtgataaaaggtaaaagaaagaagctgactatagcgcactgttttgagtcagcttctttttctttttccaattagaattttttcaaatgcctcaacaaatacatacataagagttgcaagaacacatgtgagtagtacgctaagtaagacgagtgtgaagttaaagacttggaatccgtagctaattaagtagccaagtccttgtttggaaacgagaagttctccgaaaataacaccgacccaggataaaccaacatttacttttaacgttgagataattgctggaaaggatgcagggagaacgacttgcttataacattgccatttatttgcgccaaatgtgtccatcacttttatatagttagaatcgacttcttgaaatgcactgtaaataacgagaatggtaatgatgatggaaatgattactcccattgcgatagaagatgaaatgtttggaccgaaaataacgatgatgattggaccgagtgcaacttttggcattgcatttaggacgacgaggtaaggatcaagtacgcgggctagaagtggcatccaccaaagaaatgtggcaataatagcaccgagtaccgttccgagaatgaagcctactcctgtttccagcaatgtcgtccatatgtggacccaaagtgaaccgtcgatccatttcgttaagaagagatcccaaatactcgaaggagaactaaagagtaaaggatcgatccattcttttttgctagctatttcccatagtgcaaagaaaagaataagtagtaaaagctgtaatgagcgagcaatccaagcacgcctgcgttctttctttcgaaattgttcatgtagttgttttatattatccaagtcgttccagctccttccatatatcttgaaagagggctgggaaatcgtagtgatggcgtgcttctaacggtgataaagaacggatactttccgggacgataaaggtttttgcgatttttccaggattcgcttgcagtaaataaatacgatcactcatcgcaatcgcctcttcaatatcgtgagtaacaagtagtgatgttttcttatatttatttagtaagttgaaaacgagttcttctagttttaatttcgtttgataatcgagtgcggagaatggttcatctagtaataaaattttcggatcagttgctaacgttcgaacgagagcagcacgttgacgcataccgccggatagttcacgaggatattgtccttctaccccatgtagaccgacttgttttaaaagatttaaagtatgttctttcatctgttcatcataaatctttcgaatatgaagtccaagcataatattttcttcaattgttttccacgggaataagtaatcttgctgcaacatatatcccatagatgaagttttcgttgtaattggttcaccatctaaaaagacgataccatcaattggatcaagtagtccagcaatgattgagaggagcgttgttttaccgcaaccacttgggccgagtatagaaataaattcgccttcttccacttgtaagctcatatcttcgagaataagtttggcattctcttttgcgaaaaaacagtgagaaacgttacgtatttgtaaaaaactcatacacttcgcctctatttcttaataacgctttcggcaatttttgtattgacgagcgcttcatgtgggacttctttttgtaattcaccagcatctttcataatcgtttggagctgtttccattcttccgcatctagtagtggatttgtcgcataagaatgttgttttttataccgttcaattacttttactgtaatgtctttcgaagtgtctttaaatagcggagaaacagcatcagcaatctcttctggactatgtgtatcaacccattgctgtgctttatagagcgcacgtgtgaacttttcagcagcagctttatctttctttaagaaactttcttttgccatgaacgttgtataaggaacagtaccagattcatttccgaatgaagcgacgatataacctttaccttctttttcgaatatgcttgcagtcggttcaaagagctgcacaaactctcctgtaccagatgcaaaggcatttgcaatattagcaaattcgatattttgaattaagttcgtatctttccgaggatcaatgccatttttctttaaaacgtattccccaaccatttgcggcatgccgcctttacgctgtcctaaaaatgtaacaccttttacgtcattccaattaaaagagtctagttttttacgtgaaactaaaaatgtcccatctgtttgtgtaagctgtgcaaagttaatgacagggtctttcgctccttgttgatgaacgtaaatagacgtttcagaaccgacgagagcaatatcaattccgccagataatagggcggtcatcgttttatcgccaccagctgttgtttgtaggtcaatatttagtccttcatctttaaaaaatcctttttcaatcccgacatataatggggcatagaagagagaatgggtaacttcgccaacgcgaatgttttgagtttgttctttcgtactttcttttttactactacaagcagcaaaagtaaaaacagctagtaacatgatgcaaaaaatcgcgattaattttttcactatataacacctcctagaagtcactctacaagcatgatatgtaggtaagtgcccatatgtgagtgtagatagcaggaattttttgggtggtaaagaagtacaaatataaggggtgataaaatggagtacgaatacgatgatagcgtacatttacatcttgattatttcgggacagaatgtgatatggaatcgatcgcttataagaggaagaatgaagacgtatgggatgtgtattttaattttggagtatacggtattcagaaagacgatgtagagttaggtaggtttatggacgaatatgccggttattacgttttttctgtacatgctcgcgatcttagttgggaatttggaagtgcccagtttgaagagtgggttttgaaaaatcggatagtagaaaaaacgctacaaaaataggaggaattttgtgattggatttctcatcttattatttatttttgtggccggattttttattatgcaaatgcttatttaccgatttgcaaagaaaaacatccataaatatacaaaaataaaatggtttcatatgtggctacatatgaatatgaaaaaaggaccgagattagatttttttgattttgtagttatagtgctcgtatgtatcgtatggaaaatatggctgctcccttttatataatacacatactaatcattttctcttttcgttatagtaatagttgtaaaaaacttgcatttatacgtaaaacagtgagtggtgttgtgaaagatattttgacaaatacagacacacatacatacggaattaaagtgtgattacagaatggacaaattggccgtgtgtaaagtgtgggggaataagaaagaggtcgtc

SEQ ID NO: 1346 - DNA, 10830 bp, Bacillus thuringiensis
ttgataacgaagcctgtcgttttcgcagcttcctcttccagcttttccaagcctccataaggaaaatcaacaatcttaccacatttttcgcaaatcacatgataatgttgacttgtaacataatcaaatctacttgaagcgtctccataagttaattcctttacaagtccaacctctttaaacacacgtaagttattatagacagttgcaacactcatatttggaaacttaccttctaatgctttataaatatcatccgctgttgggtgcgtcattgattccacaaggtactctaaaatagcatgacgctgtggagtaatgcgtacacccgtatttttcagcatttctagcgcttcttttaattcttctttgaccaccgtcatgcaccccgattctatacggattattattttataattcttataaagagtgtactccttttcttataaatcgtcaatatttctactataagtatgtagtttatttttatattcaggacttgtttttatgtatctttcccttttttcttcatatattccatagaaaaaagtgcgacataatcgcacttggaatactatcatctgaggaggtatgccctacacttccactttatgtaaggcagtaaaatatgtatagacatttgccttgtttctgcatattttatccccaatgtagatttattttatataagaaagaacatcctcaatatgtcctttcactttcactttacgccactcttttacaagttcaccgtctttattaataaggaatgtagaacgctcgattcccatatactctttcccaaagttcttttttaacttccaaacatcgtataactctgctactttatgatcttcatctactaaaagtgtaaatggcaattcatgtttctcaatgaatttcaaatgtctattcgctgaatcaggacttactccaagaataaccgtatccttctcttgaaatactccatacgcatcacgaaaatcacatgcttcagttgtacatcctggcgtcatatctttgggataaaaatagagaactacatttttaccgcggaaatcagctaggcgaacttcttctccattacttccctctaatgtgaattctggtgccatttctcctactgtaatcatagttatcactcctactcttttcctttactataacaaatgcttccttatttttcattgtctattacagacctcatcacaaaagcaaaagggagtgtatatccaattagcgcttctgcgattgcaatccatcgcccaattccaatcggagatatgtcaccatatccaacagacaataaagtaactgcgctaaaatataaacaaacttccacgagttgaaaagaatgagcgttcaaactttctccgtcctctttcaaaactgcgaaacccatttcctctaatacaacgtaacttaatccaaatgcgattacgtactgctgtatagattaaaaataatgtggccaaattatagagcgaaaaaaaacgcgttgaatccgaataggaactccataataattggacacttttcaaaatagcgattgctgcaattaatagaataaatccccataacatgtcctccacctcattttatatgtatgaggtggagaactgatttatcccttagaaacgaacaagcttctataattaattacccgcgcctcgatacctttttaccccttggttccagagggtgattgcaatcgtaaaacagataataccaacaattggcgtcgcaaatgcataactattccattctgtttttcttaaaaagtatgctgctggatatactccaacaaacgcaaacggtaaaacgaacgttaaaatgaaacgaattacacgattataaatattaacaggatagcgcccgtaattacctatgttatacataagaggcataattgaacttttcgcatccgaccaaaaaccaaggctcgccaacgtaacaaatatccctccatatacaagtgctcctcctcctaccatcaatataaataagaagaaatcataccagtaaaaagataattgtaactccacagctgcatatcccattacaacaatccctgtaatagctccaattaaagattcaagttccattctttctaatataatttgaaataggctatggatcggtcgcgttaatacacgatccatctcccctttaataatgtatcgatcattaaaatcccatatattaaagaaagctgaaaagatggcaaatggtactaaaaagaaaccataaataaagattacctcttctcgactccatcccttcaatgcttgtgtatgcccaaatacaacgagaataaatattaaattaactgcttgaagcgataaatcagaaagtaaaccaacgataaaatcgcctcgatactccaatttcgtttttatatattgacttgcatattgtaaaaataagtttatatatagcatctcatcatcccccttgtacaattagacgttttctcgccgttctccacatgagtacaattggaataataagtacaatcgcccaaatcacttgaaatactaaagcctcatacaacttactcccctgtataccttcagaaaaaatcatacttggaatataactaatagcctgaaacggtaaaaacatcattgctttttgggcccataacggataaaaactaattggtaataatagacctgaaaataaatcaataacaacgcgttttgcatacataattccactattattaaataggaaaaacgtaagcattcccgtcattaaattaatttgtgtattaataataaagctaaatattaaagataagaagaaatataaccaagtttgaaaattcgttgtaatttgcaacgaaaataataacgtaacgataaccatgcctggaatggaaaagaaggcaaaacggaatattccctcgccaagaccttgcataactttcattcccaaatagttatacggacgaattaattctacagccacacgtccttcttgaatctccatcgcaatttccctatctatattattaaaatagaaggcacgtgccatccacgcgattgcgatatacgtggtcatttgcgaaatagataaactttcaatattctcttttccgctataaattgcttgccataaaaaatagtaagcaccgatattaatcgtataaattaaaatcccgctatagtaatttgtacgatacgcaagcatcattaaaaagcgaattcgaatcatttcaatatacttacccatgcgtaataccttcttcataaatgttacgaataatttcctctgtagacacttcgttaatttttaaatctttaatttgaaatgcttgtactactttagaaataagcattgaaataataacttcttcattcggaatttttgcaacccatgcattttcctctttcgctttcgaccaaacgacatgattatctggcataaccattgataaagcctgataggaaactggtgcaacaaactgaaagtgaatttccttctctgctccccactgcgtacgaagattacttaaagaaccgtcatacataatattcccttcatccagcatgataacgcgctcacataaagcttcaatatcagtaatatcgtgtgttgttaataaaattgttgttttataacgttcattcatttcttttaaaaattcacgtattttcaatttcacaagtacatctaacccaattgttggctcatctaaaaataataacggtggattatgaattaaggctgccgctaattcacaacgcattctttgaccaagagataattttcgaactggtttatctaataaaggccctatatctaacgtttcaattacgtgctccatatgctccttatactgagcgtctgatacaccgtacactttctttaataaacgaaacgattcttgtactgcaatatcccaccaaagttgcgaacgctgtccaaaaacaacaccaattgttcttacaaattcttctctttgtttatgtgggttcattccatttactgtgatttgccctgatgtcggagttaaaatccccgtaagcattttaattgttgttgatttaccagcaccgttctcaccgatataaccaaccatttcaccttgctttacagtaaaagatacatcatttactgctggtactattttataattacgatttaataaatcgcgaaatgcaccctttaagcccggacgacttgaataggctgtaaactctttacgtaacccttgtacctcaattaccgatttcataatcggacccccctcctaaatgtcacaacgaatagtttacccaactgccttcgctatcacaaacaatacgtcttttcgaaaaacatgttagaataatacatagatttttgtaaggagatgaattgtagtgaaattcacaaagtcagaagcattacataaagaagctttagagcatatcgttggcggtgttaatagtccttctcgttcttttaaagcagttggcggcggcgctcctgttgctatggaacgtgggaaaggcgcttatttctgggatgtagacggaaataaatatatcgattatttagcagcatacggtcctattattactggacatgctcatccgcatataacaaaagcaattacaacagctgctgaaaatggggtactttatggaacaccaacagcgctagaggtaaaattcgcaaaaatgttaaaagaagcaatgcctgcattagataaagtccgtttcgtaaactctggtacagaagcagtgatgacaacgattcgtgttgctcgtgcttatacaggtcgcacaaaaatcatgaaattcgctggttgttaccacggtcattctgatttagtacttgtggcagctggatctggtccttctactttaggaactcctgactcagctggcgtaccacaaagtattgcacaagaagttattactgttccatttaataatgtagaaactttaaaagaggctttagataaatggggtcatgaagtagcagctatccttgtagaaccgatcgttggaaacttcggtattgtagagcctaaaccaggattccttgaaaaagtgaatgaacttgttcacgaagctggcgcattagtaatttatgatgaagttattactgctttccgctttatgtacggtggtgctcaagacttacttggtgtgacacctgacttaacagcgcttggtaaagttattggcggcggcttaccaatcggtgcttacggtggtaagaaagaaattatggaacaagttgctccgcttggacctgcataccaagctggtacaatggcaggaaaccctgcttctatggcatcaggtatcgcttgtctagaagtgcttcaacaagaagggctttatgagaaattagatgaacttggtgcaatgcttgaaaaaggaattttagaacaagcagcgaaacataatatcgacattacattaaaccgtctaaaaggggctttaactgtatacttcacaacaaatacaattgaagattacgatgccgcacaagatacagacggtgaaatgttcggtaaattcttcaagcttatgcttcaagaaggaattaacttagcaccttctaaatacgaggcatggttcttaactacagaacatacaaaagaagatattgaatatacaatcgaagctgtcggcagagcatttgctgccctagcagacaataaataatcccgtcattaaaaggaaaaaagaaagctcacctttcttttttccttttttctatttcataaattccgtattaatagtataattattcataattatctgttttatactcttttacagcattactatctctgtgtacaaggtgattcgcaccttaaatagtaagattattctaacttttacaagaggggggattgacggatgctcaataaaaaaaatacatggacaccgtctttatttcgagattatagaaatgcagaacatgatgcgtgtggaatcgtttccgttatggagaaacgaaaaattgctacaaaagaaaacattgacctttgcatacaatcactcgtcaaaatgaatcatagagctggtttcattaatggtgagggcgatggcatcggcattcacattgatataccaaaaacgctttggaatgaaaaactaaaaagtagcggatataatccaacgattgtggatcatccccactttatcgttggacatttttttctaaataaaaaagaagacattactgccttaaaagattatattcgtacgcaattaaacaacaaaaactttactatcattttcgaaagtgatgatgtaacaaactcagatgcactcggtccacttggtaaacaagaagaacctttattttggcaagttgcccttatcgcagaaaacgaaattacaaatattgagcaaacattattttctgtcacaataaaaatagaggaaaacgaagcaattcatgttgcttcattaagtcgtaatcatgttgtatataaagttctaggtgctggtgatacgcttgttgcctactataatgatttacaacatccgcttatcgcttcaactatgacattaggacataaccgctactctactaatacattatctaatttttttcgtgtacaaccatttagcattctcggacataatggtgaaattaacacaattgcgaaattacgcgatcaagctgaaatgattgatgtaccacttactgcaggaggcagtgactctcaagatttaaaccgcaccttagaaaccctacttgttcaatacaactacagcttatttgaagcaatggaaattctattcccaccaattattaatgaaattaaactttatgaaacacctttacaagatttatatacgtatatacgtgaagcgtggggacattttgcccaaggaccagctggcatcatttcccgttttaaagatgaagctgttttcagcgttgattcccttggattacgcccagtatggaaagtagagacagagagctcttatattttctcttctgaacctggagttgtatcaccaactaaatatgtagcagaaccaaaaccactcgctcctggagaaaaagtcggattaaaatggaatgaacaagatgaacttgttctttatgaatatgacaaatatcaaatccaagtatataaccgttttaaaaagcgaattgatactaccaattaccatttaaatttatctatccctgaaacgaaaaaaatccaagggctatgtgattctgttcaagttgaaacgaaacaatacgtcgctttcggatgggaccgagaacatattcaactccttgaacagatggcaacaaaaggcgttgagccaatacgctcacttgggcatgactcaccacttgccgcacttgatactgatagacgaaatatcgctgacttcattaaagaaagtgtagctgttgttacaaaccctgcaattgaccgtgaccgtgaaattgaacacttctctacacgtactgtacttggagagcgtccaagtttattaagcggcgcaaaacggccatttctagttgaaatgctttcaccaattattttagaaggcagcgtggcacaacctattgcagaggaattacacacaattacgtacgaacaactcatagagctatttaaaactcataactctatcgccacaatctctgctacattcagctcgtcagaaactctacaatgtgcattaagccgcattagttctgaagcgatagctgctgttaacaatggtgcttccctactagtattagatgacgtaaaagcccatctaaatgaaagattgtggattgatccacatttagttactgctaaagtacatcaagcattaagtgaaaataaattacgccgcaattgttctctcgttatacgttctggtgcccttcgctccttacatgacattgtcacgctatatggattaggagcagatagtattaatccatatttattattcgcgactgtaaatgatggaacaaaaacaccaattacgaatctgtataatgcacttaataaaggattagaaaaagtcatttcaacaattggaattcatgagttacgtggttacggacgtctctattcatctattgggttacatgaagaaatcgcaaatatattacagattacaaatttcttcggttcaaatgatttagctttttcacttgaatcacttgctgaagatgcaaaaatgcgagcggatgattataacaatcctaaaattagaatgcgaaaatcatttcatatattcccgcgaatttggaaagcaatcggcgatgttgcaaaaggaaattcttatgatgattaccgtgacaagttaagtgaactagaagagaataatcccatcgcaatcagacaccttgttcaaacgaaacaaacaaaacatgtcgttccaactgaagaagtatctatcggcattaaaaatcatgattttccatttattattagttctatgtcatttggttctcaaaacgaaattgcctttcgcgcatatgcagaagcggccgatcagctaaatatgattagcttgaacggtgaaggcggcgaaattaaagatatgattggaaaatatccacatacacgtggacaacaagtggcatctgggcgatttggagtaaatgccgaactactaaactcatcgaacttaattgaaatcaaaatcggtcaaggcgcaaagcctggggaaggtgggcatttacctggttcaaaagtaacagccaaaatcgctgaagcacgtaatgcgacaattggctcagatttaatttcaccttctaataaccatgatatttattcaattgaagatttagctcaaatgattacggaaattaaaacagctaatcaacttgccaaagtagccgtgaaagtccctgtcgttcctaatatcggaacaattgctgtcggtatcgccaaagctggtgctgattttattaacattagcggattcgatggcggaacaggtgctgcacgtattcacgccttgcaacatgtaggtcttcctgtagaaattggtgttaaagccgctcacaacgctttattagaagcgagcatgagacataaagtagagatttgggcagatggtggtattcgaagtgtaaatgatgccttgaaaatcatgcttctcggagcaaaccgtattggatttggcacactatcaatgattgcaatcggctgcactacttgccgtgggtgtcatctagatacttgccatgtcggaattgcaacacaaatcgagtctgaagcacaagcaaaggaacatgggttacgccgcttcgtcccacgcgaattagaaagcgcagttactggcctgctaaatttattcacctctttcggtatagaactaaaacgattaacaggacagcttgggtatacaaattcacaagcaattgttgggcgttctgatttattagagcaagttcgaggcgaaaatttattaaacttacgtaatttattacaaataatagaacatccatctgttacaacaacagatggtgtaccagaaaaacaatttaagacagttcattccgctgactcaaaagaattagtaggcgttggtgtagagcaacgcgttatgggtggtctagaatcatgttatcgcgttcgcagtaaactatatgaagctactcaacttgaaccacttacattaaagtatacgaatggttctattcccggaaatgggttaggcgcttacaatagtgaaaatttatttatacacgtaaatggcggcgcacaagatggcattggtaaaacttcctttggtggtgggatttatataacgaaatcaaaaggaaaagacggagtatattataacggttctgtcggaaaaggatttggatatggtgcacaaaaaggggcactatacgtgcaagggaacgctgatgctcgcgctggcattcgcctttctggggcagacatgataattggaggtagaataacaaaaccactccgtgaaaaagagcaaggaaatatagggtcatactccaatattaaaggttttgcttttgaatatatgacaaatgggcgagcgcttgttttaggtgaccctggtccatggatttgcgctggcatgactggcggtgttgtttatttgcgtcatgattcaaacttaggcctaacagaacaggccttaaaaagaagaattgcaaaaggcgcaaatgttacattacaaccaattagtaaaaatggtttgaaagatgtaactgaattattgctagactatattcgtgtactaaacgaacatgagcaatatgaggaagttgctttattaacagcattattagatgatatacagaaccagttttttgagattatcccgaaaaaagaacaggcagacccatctatctcaacagagtaaaatgagtaattttcattattaagaaaaaattgacgaagtacgcttctcatagtaatctatagtaacaatttgagacctgctgaaattcagcaggtttttttactaaaaactgatgtttaaaaggaattaggaaaaattataaagtgaaactttaattagcctacaccaatcgagcgtttaccggcatctagcttctaatttttgaggcaggaatcttactactcacaattagcgggataaaatgaacactaatttcttttaacgtcactaaaatatcacttgctaacatattgtaatgaatgtatagtatcatgttgtacattcattatgacaagagaaaggatcttattaagggtatgaaacttggtgctcgcattttaaaaacgggtattgccatcacgttagctttatttgcttgtattttacttcaattaccgagtccggtatttgcgggaatttcagctatctttgctgttcaaccgtctgtataccgttcttatttaacagcacttgaacaaattcaagc

SEQ ID NO: 1347 - DNA, 15965 bp, Bacillus thuringiensis
tgctttaaaatcggctgcgcttaccacgacctcgctatgttctgcaaattcgcaaataaaactgtaaataatagaatgagagaaactgttatattaaaccaacctggtatactactagaactacttggaagaaaagataaaatgaacgtaaatgataaatccaatttccacaacgaaacataatcggattctttatcatgactttcggattcaatttcgcaatggattgcttcatcgcatgtgttacgatatcacgatccatcgttttcgcttgtctaacttcatcttctacagcatgtatttgtgactcatttaattgtttttcttttactactaccggtctcatcatttaccctccattacttcaatgtaagaaattctgcaattggtccgagtactaacatcgggaagaatgttaatgcaccaacaattacaattgttccgatgaagatgccaccaaataaactattatctgtacggaacgttccgactgtttctggcactaccgttttttctttcaacgaagctgccacagctagcatcgtaattaaactgaagtaacgtcctaaaaacataactaaaccagtcgtaatattccaaaacggtgtattatctcctaatccttcaaatccagatccgttattcgcagctgacgatgtatactcatatacaacttgcgttaaaccgtggaaaccggaatgagaaatagcatccgtccctaaatttgttgaaagagctaatgccgaaaagcctaaaatgagcaatggatgaaataaaatcgtgaccgcgattaatttcatttccttaccttcaatctttttacctaaaaactctggtgtccgtccaaccattaacccagatataaacaccgcgataattgcatacataataatgttcacaaagcctgctccaacgccgccatatactgtatttaacatcatatttacgagtggtactaaaccaccaattggtgttaacgtatcatgcatcgtattaacagcacctgtttccgcagcagtcgttactgtcgcataaagggaagaaaatactgttccgaacctcacttcttttccttctgcacttccttgtacatgctggatacccatttcatttaatactggatttccatgtaattcagatgtcgtaattgtgataaatcctagtaaaaacatcatgaatagtgatacgaaaaggatacgaccttgctttttatttcctaccattcgtccgtacgtaaacggaagtgcagttggtaataacatcataagcatcatttgcaaaatattactcatttgccctggattttcaaaaggatgcgtagagtttgctccgaaaaatccaccaccgttatttccaagttccttaatggacacgaatgatgcaactggtccgcgtaatatactttgctttgcaccttcaatcgtatgtgctgtaacagccccatctaacgtttgcggtacaccaagagcgacaaagattaacgccgtaataaaagcgataggaagaaatactctcgttaacgctctcgtaaaatcaacgaaaaagttaccgagttcttttccagcgagccctcttataaatgccataacgagcgctaatgttgttgctggtgctgcgaacattaaaaatgtaatcccgattaattgtgataaataagataagccattttcaccgctataatgctgtaagtttgtatcagccataaaactaattgctgtattaaaagcgagcgtaggctccattccttcaatatgcgctggatttagcggcaatacaccttgtaatctgaaaatgaaatatacaataacaatcataaatccgttgagtaaaactaatgataatgcgtactgtttccacgtttgattgtattcttttacacccgtaattttaaaaataattttttcaaaaggcccgaatactttatctagctttttgctaccttgaaaagctttttctaaataaatccccgttggctttgctactaaaataaacaagagcattgtaataatgactgcaacccaaatcataatgaatgattccccctaattaaaacttctctggatttaataatgcatacactaaatacactgtaattgctgcgacaataaccgataagacaatcatcatgattgctttccttctttcacaactttatctgaccaacttgcaagacttgccattgatgcaactaataaaataaaaatcccgaccattacaacatctaacatagctatccctcgctttgtttttgttaaaatttaccatttaaatgttaaaaaagaacactgagctctactcagtgttcaaaaaatgaacaacaaaaagtaaacctcctctctaaacgcttacgaggttagctgtcggattcgggcctaaagagtagccctactttcaaaactgaaagattcaccccaagtgacgatgcacaaaattggttcccccgctccatttctggaactcagcgattttaggtttttttggaaattttatgaatgatttatgagagtaaatatactcctctatatttcacttgtaaaggggtaaattactgaaaataataatatttacatccatttaaacgcttacattaaaggttattactattatttcatctattttctttatttctcttctcttttcttaaaaatgaccttttaaatatgaaataaaaagagcgaatgagatgaagtgcatagcttgttgcactcagcattcgctctttttattcaacctttattctcctcgtaaaaatgcacgtaaatttctcccgcgaatataaacttgtgtcaattctgcatgtagctgctcatactcggtaatatccacctctaaatacaaagcatcttttgatggtaatataatatacggccctggaaaaaggggatcgatctgaaccaattcttgaactcgctctaccgatactgcccaacgatttgctatatctccaagtaatagtaccttcatcatttcttcccccgccctattcaaaaaataaaaaagaaatattatcacaatttgtaaacacgacaaacttagctccaattgtttcatagagcctcgctggatatcgtttattccttgtaacaatagtaataggtgcttgaaaagaaaagcgaatgtgttctgtgaaaaaactaacgattgaaagctcatcccctagtaaaatcaccttcttaatacactcacaaatactagtaaagtcctgctccttactgcagctataagtccaatcaaacccacaattcctaacttcagccgctatctcttcatttgctgtaaaaataattaactcatgttgaaatgatactagatctcttaaactatctaccttactttcttctccaacacaaataagtgttagttccatgtacctcatcctccttagtataaaagaaatcaaacatagattgatattctcctatactaatcagatcgatgaagtgatgtatccatcatggcaccgtcctctctcaagacgcttacgaagttagctgtcggattcggactttgagagtagccctactttcaaacttgaaagattcacccctagtgcctacgcacaaattggttcctccgctccatataattggactcagcgtttacaaaaaaatgtattctggctgatatattactcctgtattttgaaaaagtaaacagaaaaaaagccagttataaaactggcttttcacttacctatgcacgcattctattcactttatatgcaaaatgattcgtcggcccatggccactaccaatattcaatggctcttcaattgctatactaataaatcgttttgcttcttgaacagcatcttcaatcgagtatcctttcgcaagtcctgctgtaaccgctgaagcaaatgtacacccacttccatgcgtttgctttgaaggaattcgctcgcttctaaactcaataaatttttctccatcaaagaggaaatcaattacttcattcccttgatattctgcatgtccgcccttcataagcacatatttagcacctaattcatacaatacttttgcagcttccttactatcttcaacattatgaatctccatcccagttaacacttctgcttctgggacattcggtgttataacagttgctactggtaataaatattcttttaatgcttgaactgcttcttgctgtaataatgatgcaccgccttttgcaatcataacgggatctagcacaatattattccagccaaactttttaatttgttctgcaacaatttgaattatttcactactaaataacattcctagcttcactgcatctggtgttaaatccgtaccaattgaattcaactgttctgtaataccttctaacggaacaggatataccccttgaacgccaagcgtgttttgagcagtaatcgccgtaatagccgtcattccgtatacaccaagctcttggaatgtttttaaatctgcctgaattccagcaccgccgccgctatcagaccctgcaattgttaaagctttattcactttcatcccactcatccttttctatccaaaatagcgatgataaatcgtttttgcttcgcttatatctttcgttccatgtacgagcacacggccatctttaaaggcgactaacctcttgtcttcaatagaaaatgatagtaaatatggatttatatttaaatcattcacacgaccttccaacaactctttatattgttcaaaatttatttcatctttatgaggtggtctaatttgaactgtatttcgcccgcataaaactgctgtttttgatgtgttctctttatttaaatacggatataatgcattctctccgcatgaaggacaattatgctggcgaagcttttgcacattcatacatgaatactcattcttccacatatcaaacgatacaagcccatctcgaagtgattcgtaatcttctactaacagtttaagagcttctgttacttgatgagaaacgacaagagatacagcaggtgatataatacccgctgtatcacatgttgccccgccaagcggaatcgactgtaataaacatgataaacatggtgttttactaggaaggattgtgtaagaaagaccgtaactacctacacatgcaccgtaaatccatggaatagaatatttttgtgctatatcatttacaataaagcgtgtttcaaaattatcagtcgcatcaataattacatcaacatttataacaagttcttctagctcttcagctgttacatcttgaacgagagcttctattgttacatcgctattaatctcatctaaacgttttttagccgctatagcttttggaagattattctttacgtcgctctctgcatacaattgttgtctttgtaaattactccaatctacataatcacggtcaacaattgttatcttgccaacacctgctcttacaaacatctctgcatttgcactacctaatgcacctgcaccgataataagcacatgcttttctcttatcttttgctgtccttcttctccaattggagaaaatagttcttggcgagaatatcgattattcaactacgctcattccttctaaaggactacttgcagttgcacaacgcttacgtgcaatacgacctgcttcaaatcctaaacggcctgcttcaatacttaatttcattgcttgtgccattttaataggatcttttgcacctgatacagctgtatttaataacacgccatctgctcctaattccattgcaaatgccgcatcagctgggctaccaataccggcatcaacgataactggtactgtcgcttgttcaataatgaagctcaaatttaatggatttacaataccaagtcctgatccgattggagatgctcctggcataatcgcatgcacgccaagctcttgtaatttacgtgctaatacaacatcatcagatgtatacggaagtacgataaatccttcttccagtaacatttcagatgcctttaacgtttctaccggatcaggtaataacgttctatcatcaccaataacttctacctttatcatgtcacaaagcccagaggcttttgctaattttgcaatacgaacagcctcttcagcgttttttgcccctgctgtatttggtaataacgtatattttttcacatcaagtttctctaataaattaggttgctttgcatcaaagatatccatacgacgtactgcaaacgttaaaatttcagcttcagaaacgtcaattgccttttgctgtacgtcaaaatcagggaatttacctgttcctaataaaagtctagaatgaaatgaaaatggtccaatgtttaacataatcaaccgcctcctacgaaagttacaatctcaatttggtctccatcaaaaacagatgtatctgtatgatcatctttttgtaaaatatctttattacgctctactacaacaattctgttatctaactctaaatgtgtaagtagctcagctactgtttttacactcgctggcacttcaatttggttaccattaatttttaaattcaaacttccatcccctttctaaacgcttctagaaagcaatgaatctagcaaatgattctcttgctttccttctattaaatcagccatatattgaccagaaataggacttaataaaataccgtttcgataatggcccgtgcaagcatataaaccttttatttcttcatgctctcccatataaggagcttcatgattcgattgtggtcgtaatcctgcccacgtgctttcccattctgcttcttttaaagctggcaatattgtataagcacgctctaatatagaagttatactttctggctgcacagttttattgaacgtatgtggcttcattgttgccccaattacgtaacgtccaccgcgctttggagtaatgtaaaatctttcttgaaaaataggtgcttttaaaagtttttttctacttcttaccgcaaccacttctcctttaactggatatgtaccccaatcacggtgaaaataacctagtaacttcgtgctccatgaacctcctgcaataacgactttctcacatgtgacaataccttcacttgtaataactccagtcactttattattttcaatacggatatcaaatacttctgtctgttcatatatatcagcaccggaaattgccgcagaatgtgcgaatgctttcgtaagctctggtgcaataacatgaccgtctttcggataatatactgctcctataatagattcggatagatatggctctttttcccgcacatggtctcccgttagaaaataagaatcttcacctgttttctgctgccaatccataatgtgaagtattctttccttctcatcttcattttgagcaatacgataaattcctttttcttcatatccaatatcaatacccgtcttttcacgtaaaactgctgcaagttgtggaaatatagctcggctttctctagcaagttcaaatagcggatcatacgcatcccattctgcctgaacaccaagtaaaccagcagctgctttggaagcttccgatgcaatactttgcttctccacaatcgctactttatgtcctctttctgctagaaaatgtgcaactgaactgccaattacaccaccaccaataatcgctacatcatacttctcacacatgtttttccgcccactttcttattgattccttataagatttcgctttgctatacgggttactactacttacaattccagacataactgctataccacttacaccgttagtaagaacatccactgtgttttgtggggtaattcctccaattgctgtaatcggtatagataaacaccttgcaatgtctgaaatttcttcaagccctctcgctggcacaccttttttacaatctgtcggaaatacatggccataaacgagtgaatccgctccatttttaaaagctactattgcttcatctagcgaatgcacagaataaccgacatgcaaatacgaaaacttttctttcactgactttacatctgtacttcgatatcctagttgaacacgaggaatatttaataaaattgcaatatcaattcgatcgtttatgacaattttagaagccggaaagccctccattaatagactttccacaccttcatataattccttcgtactcttctcacgctcacgaatatgcaaataatcaatctcactctcaatttgcatcgctacattcactaactcttcgaatggcatatggccatttgagattacgtggagctcatttttcatattcattcgcctactttaaaatattttcgaatagttcatcggctgggacggtttctttcgtcattcctttgtccttcagccacttattttgtttctcccaagattcttttgaatctgataaaaatggctcatctttcgtttccatcttctctaataaaattttcatactttccttttcaacttctggcacaagtgggaagttttctttttcttgatgatttaataaaatattcaatgcttcatctgggtttttcttcatgaaatcatagccttttttcgtaccgcgtaagaaagcttgcaacgcttctttatcttttttcaacgttttatcacctgttacaaacacaagctcatgatagtttggtactccgtaatcagctggattaaagtacgctggttcatggccttcatgacgcataacaggtacttcatggttaatgtatgcccctgttaccgcatctactttcttcgtaattaatgctggtactaaatcaaagccaacatcaactactttcactgtatcaggattaccaccagcttcttttaccatcgtttttaaatacatctcacttaaaggtgttccagagtatcctactgtttttccttctaaatctttcggtgattgaatgcccgctgatttcagtgatacaacatgatttaatggtgaacgtacgacagctccaattgatttcactggaatttgctcattcgctctcgccataacaacatctggctgataatacaagccaactgttaccttccctgctgctgccagcgttaatggatcagtcggattagaagggaatttaatatttacctttacaccttcttctttaaagtatcctttttcaattgctgcatagataaagctatgtaccgcatttggataccaatctaacatgactgttatttctttctcttttttacttttgtctgatgctgaattactcgaacatcctgcaattattgcaattaataatgtaaacacaaagatgcgctttaaaaatttcatgaatacttcctccaactaatgaatttcttttctaatatggaaataattacgacgaagaaaatagctaataatgataacaatacaataggtgcaaatacgccagctccatctaactgcgtcatcattctcttactgaaatatccaagcccagcttgtgcaccgagccattctccaattgctgctccgataacactaagcggaactgcaatttttaaagctgagaaaaaataaggaagagcagacggcaactttaatttaagaaaaatatctctttttgttgctccatatgtaactaagagctcctcccattcttttttcgtactacgcagtccatcatacgtattgaccgcaattgggaaacacgtaattaaaactgtgacaacaaccttactccaaattgtgtatccaaaccataaaacaaatagcggagcaagcgcagtaatcggaatcgtttgtgaagcaactaataatggataaaatgctctctccatccatgtactcgcattcattaacatcgctagcccaacacctaatacgatagagataacaacacctattaaaacgacgtataacgttgcaggtaaatgaactgtaaataatatgtcttttagtttccatatcttcattacaatcgcagaaggtgacggtaaaatgtacatctcatctacaattcttgctcctatttcccacacagctagtaaaatactagaaagtgtaatagcaggaactaattctttcaatcggttcatcacacaagtacctgcctttgtaacatactaagaagctcatctttcagcgctaatacttccggtttatataaatcttttcgtgttctgttatgatcaagcggtacagtccgctcagtcaaagtcgttatcggctgctgttccactactaaaactcggtttgaaagaaataacgcttcttcaacatcatgagtaatgaataaaattgttttttcccactcttgccattgttcaaacaaccattcttgcaaagaggtcttcgttaaagcatccaacgcactaaatggttcatctaacagcaatatttccccgcctgttaataaagttcgaataaaagatacacgttgtctcataccaccagataaatctttcggatattttttctcatacccttgcaaaccaaatttatgtaacagttcctttgcctttacttgtgcttctttcttctgtacaccttggcactctagcggcagggcagcattctcaataattgttctccacggcaaaagcatatctttttgcggcatatatcctacaggatggtgctttgtttctgtcagttctatctgtccagtacttaccttttctagacctgtaataaggcgaaataaagtacttttcccacatccactcggtccgataatactgacaaactctttctcatgtatagaagcatttaattcatggatgattggtttctcatcgtaatgaaaagaaacattatgaaactgtagtatgttcttgctcctcaaatccccacatctccttacgataggacatatcccagaataaatattcaaatcgactggaatataagaaaatctcctctaatctttctagttctgtctcagactttcccactgccatttcatttaataaatctattaaccaaatacacagattaccgtattcttccgaactatatccttgaatccactcaccaaaaaactcatgatctcttgctccaggaatatcatttaaacgctttccaatttcccaatagctccacatacatggaagaagcgctgctattaattccgcaagtgtgccattttgagatacagacatcatgtaatttgtataagctaaatttttagcagatggtttcgcagactctatctcctctatagaaattccaagtctttttgcatattgtttatggattgtcatttcgccatttaatattccatcaatttgttcagcgaactttcccattacttgtggattcgttgcttttacaacaccaatcgcatataactttgcataatctagcagatataaataatcttgaataatataatactggaatttatctttttctaacgtgccatctcccatacctactacaaacggatgattatgactcatctcccaaaccggttgcacagtttctaataatctatcgcaaaatttcatttctctatcccctttcaatatatgtatctaaataaaaaaccacttctatatataagaagtggttacagcaaataaagttatacatttattcgatgttccacttcccttcgctagtattacctagatcaggtgttgtaagggttaaggattattcctctctcagcaaatcaagcacccctagtggtttcaatatgaaattttcaaataaaaaagccccgtttctatacgcaaagaaacggggactcattgttagtgtccgaattgcttccctacgctagcataatctagatcaggtaataaaaaggatcaaaggcttacggcctactctcagctggcaacaccagctctcctagcaaactataaaattatcactgtcagtataacaccctaataagacatcatcaacttttttaattttcttaattattaacagaatatcaaatttatacaatacatacattctattttagaaaataaaaccccaattaattgcataagaaggaatcattatcctcaaaaaatttatttttatattgatttcatattacatttatgtgaatacacccactatattatatctttatactataataaaattacaactatacaactagaggaggtctctattccatgaatatgaaagctactgctttaacagcaactactgtagcgattgcttctttacttccttctatgggtgaaacaaatgtacaaaaagcaaacgctgaacaattatctaatattaaaactgggtatgtcaaagtcgatcaagtagcattacatacagaagataacgtaaaaagcacatcaattgatacaattcgctttaatacaaaagtgaacatccttgaaacaactaatgagtggtataaagtatctgttcataataaagtaggttatgtacaaaaagatgctattttactaaaaaacaaacttcattctaatgatcaatacatcgttaatgctaatgcattaaacgttcgctctgaacctaatttagaatcttccattttagatgtattaccaaatggcaagtttattaccgttcaagaagatcaaggcgaatggtataaaatatcgcataatggccaaacaggttacgtacaaaaagcattcatctctaatggttcacaacccttagtaaaaggaatcaccgttcaaaataatacaaaatatactgttgcaacacctaatctaaatgtacgtagcaacgctagtacaagtagcgctctactcggttcattacaaaacggtacacaagtacaagtagtagaaactgtaggaacttggtataaaattcgttttggcacaggatacggatatgtagcaaaacactatgtagtacaaaatcaaccacaagctaaaactgatcaaccttcatcaattccagctgctttcaaattccctgctcaaggaagaattagctcaacctttgatatacgctgggaacaaatgcattatggtatagatattgccgctccaggaaacgtctctatccaagctgctgctgcaggtaaagttgtgaaatcttattattcagctagctatggcaatgttgttttcattgcgcatcaaatcaatgggaaattatatacaactgtttatgctcatatgaaggatcgcactgtacaagctggtgatcaagtacaaactggacaattaataggtcatatgggaaacacaggtcattcatacgggcagcatcttcattttgaattacataatggagaatggaattttgaaaaaacaaatgcagtaaatccactgccatatttagttaggtaaattgtatgccacgcaatatacctcttataattgaatacgtagcctttttaggtttaatctgttgtttaatcatttacaatacaaacattgtatttttatctattattattgcttttgttgcattagaaattatgatggaatcatttcaagtgcaactaaaacaaaaaattgcccatatttataatgctatttttcttttgagtgctctcataacaaatataattagtaatggcttttatttatctactgtatttccagtattctttatggctgttttattatttgtagctagatatattaatgtcccttataaccaaaaacaaaaacaagaacaagaagcttagaaagaggagacactgtgtaccaatctttcaaagatactccaataaaatacatattgaatttgtataagaaagccaatactttttttgatatacaaggaagttatactgaacaacttctcctatatggaatgttttttcttgtcttaatcactttctctttgttttactaacaaaaaaggatctcacataaactggagatcctttttaatttatattaatttttcatatcgaaaatattgtttatccacaagcatatttttcataaataaagctcagattatattttttctctaagctcattcgttgttcgtcatcgcaccaatagaaaagaatatcatgaatcgttgcgtaacgcttatttttaagaaatagcctaaagaatgatggtaaacaatcatgtaattgtataaatatataattgcgtagtgtttcttctttatattcaatgcccttacaaatatacagtaattcttcacaataatatgcatgctgtggaacttgtatcatttcgaaaaatggcacataagatagtagctttccaataaaatgaccgtatcgatccattactcctatcgtcatatgctccatcatttctttcatcacatataaataatcatctacatgcgttgtctttaatgggtctaaacgatcggaaatttgagataatacagctctttgacatgctaaaactgcctgactaggtccataatatgataggaaatctgtacacttacgatatttccgtaataaatcatgtgtatacaaatcatatacaaaagtattacaatacattgctaaactcatcatatcactatttaattgctcttttgataatgatttcgctctcttgcacatataaaagaatgtaaattccaatacttctttatgagataataaatgtttacaatcggttatacacttctcattaaatttaactctatcccaaatttcaatatccctatctgtcaattcacctatacgatatttaataattaaataatttaaagcaactgattgcgtcaaaagatcccatgtttcatattccaatgaagtatgaacaaactcagctaatccttgcgctatcataaaatcatttgcctcttcataccaaccaatctcttggcataagcgaagaatacgcactaaagttggaatttcatctttatgaaactgcggtaatttctttgctttattcatgccatatacgataaatgccgctaaattttcttctttataaaattctttctctttccatactaatatagttcgttctttcccctcaccttttgggtgacaaggtacaagcaaagaaaataattcagcgaaattatttggttctatatatgtatctgtaaccaaattccaatttggatcgccctgtacagccttcatataattccccttcccttttcatctatgtaggaaatattaatttattatcgcaccactaaaaattaatattgttatattcaaaatctatcataatacttatatctatcagtatatcatcttttctcttattaaaaattaagaataacaaattttaaaaaaatgtcgaaattattaaccgtatccttattatataatgtctcagatacatcacgctaacatattagtttaatccatatatgctagaataatgtatctgaaatttatatataatttagctctttatgagtgaccattaaactctcggttaattaaagtttcaatttactctgtacgctctgagatttcactcaaggcaaatccagcttgatcatctgctgattcccttatagctaaatctcctagtgctaacatgccaataagttgaccactatcaactactggtaatcgtctaatttgatgctgtgccattagctctgtagctttttcaatagaatcatttggagaaactgagataatatttgttgtcattacatttgtaattttattagatccaggatgtttttcagcaatccctcgaacgactaaatcacgatcagtaacaagcccaacaacttgctcattttcaacaacaggaattaatccaactgattcttccttcattttaacagctgcctcatatacattgtctagcggtgtacaatgtacaatatgggtactcattaagtctctaactcgtgtcattatttatttcctcctttttatacataccatagcttttccaaaattcctttatttatttctggaaagtaacgtaataaaaaggattaacaaaataaaaaagagccagcataatgctgactcttttttgtatgacccgtacgggattcgaacccgtgttacccccgtcaaagggcggtgtcttaaccacttgccctgcgggccacgaaaaataaaacggtgagccatgaaggactccccccttggaccctctgattaaaagtcaaaagaactaccaactgagc

SEQ ID NO: 1348 - DNA, 12007 bp, Bacillus thuringiensis
  unsure (1)...(12007): unsure at all n locations
accgtcgccgctacttcaaagagcaagctcttatccattcgctcgacttgcatgtattaggcacgccgcaagcgttcatcctgagccaggatcaaaacttccaataaagttagtttgtctagcatctaaaataaaaattgacgtttcacgttgnttgtttcgttcagttttcaaagaactacttcgtcgctcagaggcgactttattaatataacatttcgttatattttcgtcaacaacttttttcaataagttgtttttcgtttgttttgtttgttacctttcgtggcaacgaatataaatataccagtttgattattaaaatgcaatagtttttctaataaaatttttaacttagtaaaaaagtataaaaacagcacatttcttctatataaatataatttctcgcactatcaagatttactatacccacgcaactcatgctcaaataaaaaaagctttggagaaatctccaaagcttagtcttgtttatggcgcatagcagggaataataatacatcacgaatagatggtgcatttgttaataacataactagacgatcaataccgattcctaatccacccgtaggaggcataccgtactcaagagcttcaatataatcgtcatccatcatgtgagcttcgtcattaccttgttcgcgctcttttaattgcgcttcaaaacgttctttttgatcgattggatcatttaactcagtgaatgcatttgcatgttcacgcgcaacgataaataattcgaaacgatctgtaaatcttggatcttcatcattctttttcgcaagcggcgagatttctaccggatgaccgtaaataaatgttggttggattaatttatcttctactttttgttcgaagaattcatttataatatgaccaacttccattgtatctttaatttctacattatgttcttttgcaagttcacgcgcttcttctacactcatcggattccagaaatcagctccagagtattgcttaatcgcatctaccatatgaagacgtgtccattctggttctagattaatttcataatcaccatactggattgttgttgtacccagtacttttttcgcgatatgagcaaccatatcttctgttaacttcataatatctttataatcagcgtatgcttcatataattcaatcatcgtaaactcagggttatgacgagttgatacaccctcattacggaatacacggccgatctcatatactttttctaaaccacccacaataagacgctttaaatgtagctcaattgcgatacgcatatataattccatatctaacgcattatggtgtgtagtgaaaggacgcgcagaagctccacctgcaattgcatgcatcataggtgtttccacttcaagataaccgttgtcatctaggtatcttctcatgtcacgaatgattttactacgagtaacgaacgtttcacgactttccatacttgtaattaagtctaagtaacgttgacggtagcgttgttcaacatcttttaatccatggtatttatctggtaatggacgaagagatttcgttaatagcgtaaagcctgttgcttttactgaaagttctccaacgtttgttttgaacactttaccttcaatacctactaaatcacctaaatctgctgttttaaataattcgtactcgtcatctccaacagcatctttacgaacataaatttgaacttgtccatgtaaatcttgaacatgtgcaaatccagctttcccttttccgcgttttgtcataatacgaccagcgatagaaacagcgatttccttctcctctaattcctctttagagaactctccatatagactcactaagtcagttgttgaatttgtgcgttcaaatcttttaccgaacggatcaattccttgttcacgtaaattatgtagcttttcacgacgaacaatcaattggtcgtttaattcttcgtggttcatgttatccatgatattgatatcactccagctctatttaattttacaatatatacagtatagcattttctactcaactagaaaaactgccagcaactaactggcagctcttctttctttcacgtaattataggaagtgtatagaagaatgtcaatctcctatgtccattattaaccaacgtaaattgtttgttgtttcgcttccacttcttctacaaatgtacctaacacattcgcaaggtcttcccgtgtgttacaagcattaataccattacgtacactcgcattaccacgaacaccttttaaataccaagctgcatgttttctcatctctcttacagcgacactttcattctttaagtcgataagacgatctagatgcaacatacatacatcaattttctcgcgcactgttggttccggcattaattcacctgtctccaaatactttaccgtacgataaatcatccacggatctccaagagcagcacgaccaatcataacaccatctacaccaatttcatcaagcatacgctttgcatcttgcggcgttgcgacatcaccatttccgataaccgggatatttacagattgttttacttgtttaataatatcccaatccgcttttccttcatacatttgcactcgtgtacgtccgtgaaccgccacagcttggccaccagcacgctcaacagccctagcattttctattgcgaaaatatgttcttcatcccaaccgatacgcattttaactgtaaccggcttttcaacagcatctacaaccgctgctaccatttcatatattttattcgggtctaaaagccaccttgctccagcatcacatttaacgattttcggcactggacaacccatattaatatcaattatgtctgctgtcgtatatttatctacatatttcgcagcatctacaagagtttctttttctccaccaaaaatttgtaaacttaatggcttttctctctcgtcgatatataacatatctaatgttcttttattattaagtaatattgccttatcacttaccatttcagcacaaactaatccggcaccaaattcttttactgttaaacggaatgcagagttacacactcccgccatcggtgctagtacaaccggatttttcatctcgatatttgcaatctttaacaatcaatctactccttcctgtacaatcactttggcattaattcctctatcgaaacatttaatgccttagcaacttctactacaaaatcttgagaaggcgatctattccctctctcaacctcacctaaaacagatacagatacccctagtgctttagcaaaaccttcttgtgtgtaaccttttagctttcgaaaagcacgaatgcgccttccccatttttctgcttccataccgttactccctctcgccttttcatttcttctacttgtgaacatgaaatgttttgttttatgtcttgattaatttctaacaacggaacgataacaaaagctctttcaaacatccgcggatgcggaacaataagattctctgcttcaatattctcttgattataaagtaaaatgtcaaggtcgatagtcctcggcccccacctaatttccctttttcttcctaggtcattttctactttttgtgttactttcaataattcttgtggtgataaattggtagaaatttttataactaaatttaaaaagcaactttggtcagtatagccaactggctcagtttcatatacagatgaaatatcatcaacctgaatataaggatttttatttaaaaactgaatcgcttcggttagatacgtataacgctctccaatatttgatcctaatgcaatgtaagctatattgttcatggacgttctctcgtaatttctactgctacagcacgataatgacccggtatcggtggatccggcttaattaccttaattgtacagcgcgaaatactttcatattgttttaatatatctgcagcaatattttcagcgatactctccacaagcttatactttctatcctcaacaacttttctacataattcgaaaagctctccataattgaccgaatgctctaagtcatcactttcccctgcacgctttaaatccaactccaccgttaagtcaactttaaatctctgacctaatttattctcctctgggaacacgccatgataaccataaaactccatatcatggatataaattttatccaattaccttacccccttaccaatcatcgcatccatcattttagccatacgcgccatttctttcacatcatggacacgaacaaactcacagcccttttcaataccaagacaaacagtagctcccgttccctcaaggcgttcctctactggcaaatctaatacgtgcccaataaaggactttctcgaagtacctaagagaaccggataacctagcacatttaactgttctaaattacgcatcgcctctaagttctgctcaggtgttttagcaaaaccgatacctggatctaaaataatattctcatctcgcacaccagcatttttagcaattttaatactgtcatacaaatcagcaatcatatccgccattaaattacgataattcatgtcatcgcggttatgcattaaaatgatgggtacatcgtaatgagctgcgacttcagcaattttcggctccgccttcgctccccaaatatcattaataatatgagcaccagcctcaattgcttgctttgcaacttcagctttatatgtatcgatagatataggcaattttacttcttttgaaactgcttgaatcatcgggacaactcgctttatttcttcttctactgatactttagcaaaacccgggcgagtagattcgccaccaatatcaataatatgagcaccttcaccttgcatttcttttgcgtgacgtaccgcagcatctacctcgttgtaactcccaccatcagaaaacgaatctggtgttacatttaaaatccccataattaatgtcttttcatttaaattcaatgtatattcgccgcagcgtaaatcataatcccacttcaaactacacatctcctcttcgtaattcatttttgctccataatttctctctttgcattccataaaggtacattaaactttttgtaaccactcctactttacccgggaaatcctgcgcttctatacgataaagcggaacaatttcttgaatggagtttgttacgaagacttcatccgctgaaagcagctcatcttttgtaaagaaaccttcctttacttctatatttaattcttcagcactctttataataaacgcacgagtgataccatttaaaatccctgtctctaacgaaggtgtatataaaacatcacctttcacaaaaaatagattggaaacaataccctctgcaacataacctgcttcagtaagaaaaataccttccttactcacaacatttccaatttcacgcttccctaaaatattatttaaataatgatgagacttcagacgaaatgttccttccggtgtatttcgcacttgttttagaataacaccttctttttccactacatctcctggagctgttaaaggttttataaaaacaataaccgaaggctcttcatacatttccgtttgtaatcctatttcatctatacccgctgatacattaaaacgtacatatgcatgcttcaattcattcttagcgagtaaatctttcaaaataagcatcacgtcattttttgtcattgtccatttaatttgcaatgtatccagcgcttctattaaacggtcataatgatcatccaataagaaagggtgaccattataaatacgaaacgtttcaaaaactccaagaccatataaataaccatgatcataaggagaaattttcgcttcacttgcttctacatactgaccatttacgtaaattaacataacgttgcacttggactgtatttacaaatgaaattctgtaacaactctttcccatgagaagtcataatagattccggatggaattgcacaccctctatcggcaatgtcttatgacgaagtgccataatttctccttcctctgtccaagatgttacctctaagcaatcgggtaacgtctctttcttaacaataagggaatgatagcgcgtcgcagtaaacggattaggaatatccgaaaaaatcgtctttccatcatgatgcataagcgacgttttcccatgcattaatcgttctgcacggacaacctctccaccaaacacttgtgcaatggattgatgccctagacaaactccaaaaatcggaatctttccagcaaagtatttaataacttccatactaatccccgcttcattaggactacatggacctggagaaatcattagaaaatctggtttcatattctcaatatctgaaatggtcacttcatcgttacgtttaacaacgagctcttgtccaagttctccaagaaactgcactaaattaaatgtaaaagaatcataattatcaatcattaatatcatttctctcacctaaccgtttcttcgctacgttcttttgcacgccataaagcaatcgccttttttaacgactctttatattcattttctggatttgaatcaattacaattcccgcccctgcttgtacatgagcttttccatctttagcaagaagtgttctaattacaatattcaattctgtatctccagaataaccaatccaaccgattgaacctgtataaatccctcttcgaacaggttctaattcctcaataatttccatcgtacgtattttcggggcaccagtaattgttcccccagggaatacagccttcactaaatcaaaagcatctttatcttcttccacctcaccacgcacattagaaacaatatgcataacatgtgagtatttctcaattaccataaattcatctacttctacagtgccatatttacaaacacgtcctaaatcatttctttctaaatccacaagcattacatgctctgctctttctttttcgttctcaattaattctcttgctaattcttcatcctcttgctcatccgcgcctctagatctcgttccagcaattggtcttgtacttacttcagttccttgtttcttaattaacaactctggcgatccactaacaatttgaaaatccccaagctccaggtaacccatatatggagatggattaatttcacgaagacttgtataaatttctagtgggtgtgtctgtaacgttctttcttgtctcgtcgacaagtttacttggaacacatcacccgccccaatatattcttgaatacattcaactgccttcataaagccggcttcagtaaaagcaactgcttcacttttcttttcaggactttcaaagggcacagtcacttcaggcgcttctgtcatccaaagactcttccactcatttagccgttcttttgcctcttcatatttatctacataatgcgtaataacccataacacttgttctttttgatcatagacaaatacgtcatcaaataataaaaagaagatgtcaggtatattaatatcatcttccgcaagagaaggcagcttttcaatataacggatacagtcataactgaaatagccaattgcaccaccttgaaaaggcggatactctgggttatagtccgtcttccattgttccatatattcttgcattaaatctaacggattccctcgttttattgtttccttaccactttcacttatatgtaacgtttcatccttccctcggattaccgctactgggttcagccctacaatgttataacgaccgccacggccactttctaacaaaatatgttgcgatttaccctgagaaagaaatttatattgcttaaagaaatctaactgatatggaatagaaagcgctaaagattttcttcgttgcatatcaacaccccgtcttcttttatcccaccctcttagattaaccagctcaaactacataagttatttatatagagattgattatactcgaaggctagtgaaaataatttaattatactacctcttattttacatgaagttttctagtcattcactcttttcctatttccaatcccaaaagaaaaagcaccctttttcaaggatgctttttcaatcgcgtttaattatgattcaaattgataaagtggtgtacttaaataacgttcaccgttactcgggataataacaagtacctttttccctttacctaactttttcgcaacttctgttgctgcataaataactgcgcctgaagagataccaactaaaataccttcctctttagccactcttctcgcatattcaaatgcttgctctgttttcacttgaataatttcatcatatacttctacatccaacgtctccggaacaaatcccgccccaattccttggattttatgtggacctggtttcccaccagataatactggtgaatctgcaggttctactgcataaattttaatatctttatacgcttccttcagtacttcaccagcaccagtaatcgttccacctgtaccaatacctgcaataaacgcatctaattggtcacccatttgttcaataatttctggacctgttgttaaacggtgaatttctggattcgattggtttttgaactgttgtggtataaagtagccatgctcttttgctaattcagtcgctttacgaattgctccacccattccttcaggccctggagtcaatactaattccgcaccgtaagcacgtaataaattacgacgctcaatactcattgtttctggcattactaagattgcattatatcctttagcagccgctaccatcgctaaaccaattcctgtgttaccacttgtcggctcaatgattgtatcgccctcttttaataatccatttttttcagcatcttcaatcatagctaatgcgatacgatctttaacgctactccccggattcataaattctaattttaagtatatatctgcgctgtctgattctacgatgcggttcaacttaacgatcggcgttttcccgattaattctgaaactgattgtgccactcgcattcctgtcactcctaacaccgagtatttttattggttttatctatatttagattttgtcagaaaattccctgtttgtcaattcatttggaggattgctcctcttaattcccttattacaaattctcgattaaatttgtaatatcttctttagagaacttgtatcgttcattacagaaatgacagtgaacttccgtctcttcctcttcttcacgaacttgctctaactctgttttacctaaactaattaacacactctcaatacgctcgcgtgagcatgtgcaattaaattgaacatccattgtttctaatacttttactttatcttctccaagaactgcatatagtagctcttccggagaaagtccttgttcaatcaacgttgatacaggtggaatcttttgtaaacggtcttcaataaatgaaatcgtttcatcttgcgcacccggcataatttgaaggatgaatccacctgccgctaatatgctatcatctccatttacaagaacaccaacacctacagaagaaggcgtttgttcagaaactgcaaaataatacgtaaagtcttctcctaattctcctgaaacgattggagattgaccaataaacggctcacgcattccaatatctttaattacagttacaaacccctctgtacctaccgcttgatatacacgtaacttcccttgttctgttccttcaaaatcaacatgcggattcgttacataaccacgtacatctccatttgcatgagcatctactaagataggaccaatcggaccgttaccttctaccttaatcgttaacttttgctcaccttttaacattgcgcccatcattgtacccgcagttaaagaacgccctagtgccgctgaagctgttctccatgtatcatgacgtctttgcgcctcacttactgtatttgttgtacgtacactatacgcacgcacttctccatcaaacgctaacgcttttactaaataatctttcatacgtatttattcacctttctcatgctgtaaatttgcattacgttcatataacatgtataaaccttttaacgttaaaaatggatctacaatatcaattacattcgattcttcggaaattaattttgctaatccacctgttgcaataactttaggttcttgtctagcttcttctttcatacgcttaacaataccttccacttgtccaacataaccataaagaatacccgattgcatcgcacttactgtatttttcccaactacactgcttggttttgtaatttcgatacgaggaagttttgctgctctgctatataaagcctctgctgaaatcataattcctggcgtaataactccacccatataatgcttttcttcgttaatataacaatatgtagtagccgtaccaaaatcaacaataataagcggacttccatataagtggattcctgctactgcatttacaattcggtctgcgcctacttcacgcggattttcatatttaatatttagccctgtttttatcccaggccctactacaagcggtttaattttaaaatatttttcacacatgcgctctaaagcaaacataattggtggtacgactgaagacacaataatacctttcacatcttcaaacgaaagaccttcatgctcaagcaattgctttacaagcattccatattcatcttctgtcttatgacgatctgtttccatgcgccaatgctgacgaagttccccctcttcaaacacacctagtacagcatttgtgttccctacatccaatacaaaaatcatattctcaccacttatcttatttaatctatatttgtgcagtatgtataaaacttataaaaacatcatatcacacatacttatataatcagctttcctatcctcatcattttacaaaaagattgctctctatttcaatttttaatactagttttacttaaattactttatccactaagttctcaatagtaattaacaaaggttttaacaaacaaaaaaggagtgacgatagtcactccttcgtttcttacttatcttctttatcttcatcgtctttcttcatgttgatgtttactttcacatcatctgaagatgttggacgttctggcaatctgccgtaatcacataaatgattgatttgctcagcatctaacgtttctacttcaagtaacgtttttgcaataagatctagcttatcacgattttcagtaagaatgtcttttgcacgagcataacattctttcataatcgtttgcatttctacatcgatatcgtgcgcaattgcatcactgtagttttgctctgaatggaagtctcttcctaagaacacttgaccaccttgcgaactaccaaattgcattggtccaagcttatcactcataccgaattctgtaaccatacgtcttgcaatgcccgtcgcacgttggaagtcgttgtgagcacctgtactcacttcaccaaatacaatctcctcagctactcgaccaccaagtaaaccagtgattttatcaagtaactctggctttgtcatgaagtaacgatcttctttcggaagcattactgcatatccaccagcttgaccacgagggacaattgttactttatgaacgacatcagcttcatcaagaacaacaccaattacagtatgacccgcttcatggaaagcaacgatattacgttctttttcagagataacacgacttttcttagccggacctgcaataacgcgatccgttgcttcatcaatatcactcatatcaattatcttcttatcttgacgcgcagctactaaagcagcttcgtttaataagttttcaagatcagcaccagagaatcctggcgtacgagttgcaattgctcttaagttgatattctcatcaagcggtttattacgagcatgcaccttcagtacagcttcacggtcttttacatctggacgatctaactgtatttgacggtcaaaacgacctggacgtat

SEQ ID NO: 1349 - DNA, 14802 bp, Bacillus thuringiensis
agtagccccgaattcgtgaatgtgccggtgaagatggactggtgacacaattctttaacaatcgcggtgctagccccaaggattgcaaatgctttcttcagcagatttattgaagcagctcgatattgctgcttctgaacataaatataaactgattatttgtcaaacaagatatttaccggaaaaagagatggagtatttacaattattatctacgaaacaagtagatgggattattctatgttcactagaaaatccgtgggaagatgtagagccatacttacagcacggtccaatcgtgttgtgtaatgaatatattgaggaagcaaatattccaacagtgaagtttgatcatgcgcaaggagcatacatagctgcgaagcatgtgttagatcaaggatatcgtaatcttattttttgccgtggtaacgaaaccaaagtcgttagccagcagcgaaaaatgggctttttacgtgcaataactgagaagagccgccaagtagaagcgattgactttcttgaaaacgctttctcttgggaagatggaaaacgaatattccatgaagtattaaaggacaaaaaaaatcctaccgcgattttggcaggaggcgatgaggtagcagctggaattatctcagaggcgaaacgccataactggagcattccagatgatctcgctgttatcggttttgataatcaaatattatcgcagattacagaaccaggtattacgacaattgaacagccaattgatgaaatggcccgaaaagttgtcgacctgatgatggataaaatccatacgaaaaattatcgaaaaaaagaattgtatgagtttgaactggagctcttggtgaaaggttcaacgatgaaggataagatgttattagcctagtagactatgtctgctaggtttttttatgttcacaaactactattcttcgtgaacgcaatcgtcacatttgttatggtatgcttcgtgttgctcatcaatttctttcccgcagtgcgcacaagttttcgtcggtaaatttctgaaaaactccattggttgatcgatcatgtcaatccctccatttccatttcttactatcattgtattagtacaaaaaataaaagtcaacaactgttttataacaaaattgaaaattaatgaaaaagtttaggaaatggattatagttaacaatgtaggatgtaagtaaaacatgcatttctactcggttttagaaaggatggatacatatgaaaatgactgttgtcggcttttggggcggctttccagaagcgggagaagcaacgtcggggtatttgtttgaacacgatggttttcgtttacttgtagactgtggtagtggtgtactagcacagcttcaaaaatatataacaccatctcatatagatgcagttgtactgtcacactatcatcatgatcatgttgcggatatcggggtattgcaatatgcgagattaattatgagcggggcgaaggggcaactaccggaattaccaatatacggccatacctttgacgagaatggattccattctttaacgcatgaaccacatacgaaaggaatcgcgtacaatccagaagaaacacttcaagttggaccattctcgatttcgttcttaaaaactgttcatcctgttacatgctttgcgatgcgtattacagctggagatgatgctgtagtatacagcgctgattcaagttatattcctgaattcattccattcacgaaagatgctgatcttttcatttgtgagtgtaatatgtatgcacatcaagaggctgcaaaagcagggcatatgaatagtacagaagtagcaagtattgcaaaagatgcgaatgtaaaagaacttttattaacgcacttaccgcatacaggcaacccatctgatttagtaacagaagcaaaacaaattttcagtggccacattacgctagcgcatagtggctacgtatggaactcatgaggtgatacgatgttatttattgataataaaggaattacagatcctagaataaacttagcgattgaagaatattgtgtgaaaaatttagatattaacgaaacatatttactgttctacattaacgaaccttcgattatcattggtaaaaaccaaaacacagtagaagaaattaatgcagattacgtaaaagaaaaaggtattcatgtcgttcgtcgtctatcaggcggaggcgcagtatatcatgatttaggaaacttaaacttcagttttattacgaaagatgatggagacagtttcagcaacttcaaaaaatttacagaacctgtaacgaaagcgcttagtaaattaggcgtaaatgcagaactaagtggtcgtaacgacattttagctgaaggtagaaaaatttcaggtaacgcacagttcgcaacgaaaggtcgtatgttcagccacggtacgttactatttgactctgaaatcgatcacgtcgtatcagcgttaaaagtaaaaatggataagattcaatcaaaaggaattaagtcaatccgtagccgcgttgcgaacattacagagttcttaaacgaagaaatgacgacagaagagtttagacaacttcttctagaaacaattttcgaaggagaaacagaaatcccaacgtatgaattaacagaagaggattggaaagcaatccataaactttctgaagaacgttaccaaaattgggattggaactacggaaaatcaccgaagttcaacttacaacattcacaccgcttcccagttggacaagttgacgttcgtcttgaagtgaaaaagggaacagtaacagaatgtaaaatttacggcgacttcttcggttcactagatgttcatgatatcgaagagcgtctaacaggcgttcagttcgataaagatgcattcactgcagctttagaaggcgtagatatcgcacgctacttcggtaacattacaacagaagatttcttacatttattcttctaaaaatgagggaggcttccataacgggcagcctctttcttttttgcgtagattgtcaggttttgtcggtaagtcgatataactgaaaaatcgctgatataaattgagttgcgctgatatatttggaaaatcgccgatataaaccgagttgcgctgatatatttgaaaaatcgccgatataaatcgagcggcgctgatataactgaaaaatcgctcatataatttcatttaccacaaaacataaaatcacaggacatttgcccctcgtaaaggaatatatatattcaaaaggaggcgaatcgaaatgaaaagggtaatgtacgttgtattattactcagcttcgccgtcggaatgacagcgtgtaacagtggatcgccctcaagtcgtacaattttgtctatcggaaaaccggctgaggataatgttatatattttacgcatacagataacaaacgaaagatacatgatatacaagacatgtttcaaaataagaagtggaaaagaaatgaaacattcagcactgttaataaaacaccagatgtcatcttatcaatagatgaagacaatatagggttaccggcattatatgttacagtttattttcatgaagatggagcggacgctcttaacttgtttggaaagcatacgacgttacataaagaggaacttgataaacttagagaaaagatgagtgcatattatcctaaaatgatttttggtctagtgttataaattacttgtaaataaaatccccttatttttccaaagtaaactaagagaaggtgatctgtctatatgcagttaatagaatatcacttgccactttaattttcttttaatataattaatttagaatttttaaatattctaaattttataaaggtggggtttttgtgaatctcgttcaatctttggctgaaacggcaaaaaagaagggggaaaaaccggcttatatatttatggatcagtcggtctcatatgaccaattaaacaaaatggtcacaaggttttctagcaatttagcagaaatgggcattggaaaaggggacaatgtcgcattagttgttgggaactcaccacattttttggtcggtttatacggaacaatgaaagccggagcaactgttattccagttaatccaatttatacagcagacgaaatgcattatattttacaaaatggagatgtaaaaacaatcatcgtactcgacgtccttctacctgttatacaatctcttacaacaagacttccttcattagaaaacatcatcatatgcgaaacctcatcagattttaaccatacagaaaccgaaaaaatgaaaacgtttactagttttgtggggactggagatacaacttacgaaggtcctgaactagatgaagaagatgtagcggttattctatacacatcgggcacaactggaaaaccgaaaggcgctatgttaacacataaaaatttatatagtaatgcgaacgatgtggcgtcgtatttacaatatacggctgatgaccgcgttgttgcggcactgcctatgttccatgtattctgtttaacagttgcggtaaatgcaccgattgtgaacggggcaacgattttaatgttaccgaaatttagtccgaaagaagtattccgtatttgtcgcacgtacgaaccaacgatctttgctggcgtaccgacgatgtacaattatttatatttatttgaagaagcaagcgcagaagatgtgaagacgcttcgcctttgtatttccggtggtgcatcgatgcctgttgctcttctgcaaaactttgaaaaacgttttaacgttattgtttcagaaggatacggtttatcagaagcatcaccagttacttgtttcaatccgctagatcgtcctcggaaaccaggatcaattggcacaaatatttggcatgtagaaaataaaattgtaaatgaacttggggaagaagtacctgtcggcgcagtcggtgaattaattgttcgcggacctaacgttatgaaaggatactataatgcaccagaagatacagctgcgacattgaaagacggctggctatatacaggtgacttggcgaaaatggatgaagaaggttacttctatatcgtggatcgtaaaaaagatatcgtcttagttggcggttataacgtataccctcgtgaagtagaagaagtattatatacgcacgaatcagtagcggaagttgtcgtaatcggtgttcctgatgaaaacttaggagaagctgtgcgagcgtacgtcgttttgaagcaagcaaacgtaacagaagaagaactaatgcattactgtacgttacatttagcgaaatataaagtgccgaaaagcattgagtttttaatagaattgccgaagaatacgacgggtaagttgttaagaagagcattgagagagaaagcgatgcaagtgtaaaaatgaggcaaccatctttggaggtggttgcctcattttttttgtattgattaagctgtggtgccatatatttaaacctgtatatgaccaacaaggaggggacatacgtagaacagaagaaattaacgcttacgtcgggtgcaatatcttatttgttaaattatggatgaactctgaaagtgataagaacggtaattttaatcaaaatggagtagtggactgtgaatcaatggctacggtgttagtaaatgcatataaattagaatggaatgaaaatagtaagttaccaaaagaatttgctgatttgaaaaatcattgggctcaacgtatgccaatattttagtttaataagaaaattcaaattccaagttgacacatgcgaattacagaattaaaatgaaaagaaatcgaatagaatacattagaagctaatcagataaactgaaggcgcacaatgttcacatttgtgaatatattgtgtgcctttttctattgtataaactaagggggcttaacgatgaaaaagtggggtaagacagcgtttatgaaaagtacaggtgttttattatcagcagttgtacttttatcagggtgtggttcggcaacatccactagtaattctgaaggaagtggagataaaaaaacagttgagcttttaaatgtttcttatgatccaacgagggagttatatcaagatttcaataaagattttgcgaagtattggaaagagaagcacgggcaaacagtaaatgtaaaacaatcacacgggggatctggaagtcaagcgcgctctgttattgatggcttagaagcagacgttgttacactagcacttgcttatgatattgatgcgattagtaagaaaaaacaattagcagaagattggcagaagcgacttgcgaataattccactccatacacgtcaacaattgtatttcttgttcgaaaaggaaacccgaaaggtattaaagactgggatgatttaacgaaaaaaggtgtgtctgtcattacaccaaacccaaaaacatcaggcggggcacgttggaactatttagcggcgtggggatacgcactgaaaaaatataataatagtgaagataaggcgaaagagtttgttagccaaatttataaaaacgtagaagtattagattcaggagcgcgcggagcaacgacaacatttgttgaaaaaggaattggtgacgtattaatcgcatgggaaaatgaagcgttattatcccaaaaagagcttggaaaagataaatttgaaattgtaaccccttctattagtgtacttgcagaaccaccagtagcggttgtagataaagtcgttgataaaaaaggaacgaaaaaagtagcagaagggtatcttgaatatttgtactcagaaaaaggacaggaaattgcggcaaaaaacttttatcgtccacgtaatgaaaaagtagcagaaaaatatacatctcaatttccgaaagttcaattatttacagtagatgaactatttggtggctggaaaaaagcgcaggagaaacactttaatgacggcggcgtattcgataaaatttatcaaaaataatgcgtactgctaaagggggatgaggtgaaagaggatgaggaagaaacgtgttttaccagggtttggattatcgcttggatttacaatgttgtacatgagtttattcgtacttataccactttctatcgtatttattcaaacttcacagttaggttggaagaagttcgctggggttataacgaacgagcgtgtgttgcattcctatcaagttagttttacaacttcatttgcagctgctattgtaaatgccattttcggtttattaatagcatgggtgctcgtacgctacaaatttccaggaaaaagactattagatggactcattgatttaccgtttgcacttccgacagctgtagctggtattacacttacaacgctttatgcggaaaatggatggattgggaaaatatttagtctgtttcatataaaagtagcttttacaccactcggaattatcgttgcgcttacttttatcggtttaccatttgtcgttcgaatggtgcaaccagtgctgcaaaatattgataaagaagtagaagaggcagcttcgagtttaggtgcatcccgcttacaaatatttgtgaaaatcattttaccagaaatctttcccgctcttcttgccggtttttcactcgcatttgcaagagcattaggagaatacggatctgtcgttttcatcgcaggtaatatgccgatgaaaacagaaattgcaccactgatgattatgacgaaactagaacaatatgattacgcgggggcaacagctgtagcgaccgtgatgcttattatttccctccttttccttcttcttattaatatgattcaaagctggagtagaaggcatgaactaaaaagtgaataggaggagagaaaatggaaccaacattattagaaaagaaaatagtaaaaagcgtatcagctaaaaaagaatctaagcttgtaccaggcgtattaattacgattacagttttatttttatctctctttctattactgccactcataactatttttctaaaagcctttgaaagagggatggatgtatacattgccgctattacagatcaagaagcattttcagcaattagattaacgcttctcgttgcgttaatcgttgtgccgcttaatacgatatttggggtagcggccgcgtggcttattacaaagtttcagtttaaaggaaaacaagtattactctctcttattgaactgccgtttgctgtgtcaccagttatcgcaggattagtattcgtcttacttttcacaccgaggggtgctcttggcgaatggttacttgaacatggagtgaaactcattttctctgtaccaggcattattattgcaacaatctttgtaaccttcccgttcgttgcacgtgaattaattccgattatgcaggcgcaagggaaaagtgaagaagaggcagctttatcacttggcgcaagtggctggaaaatgttttggcgcgttacgcttccaaatatcaaatggggtcttttatacggcatgattctatgtaatgcccgtactatcggtgagtttggagccgtttctgtcgtatcaggtcacgtgcgtggcattacgaacacgatgccgctccatattgaaattttgtacaatgaatatcaattttcagcagcatttgcagtagcgacgttaatgtcattaattgcagtgtgtacactcattataaaaaactggattgaatggcgaatggaaaaacgccaataagagggggattacggtgagtattcaaattcaaggtgtatcaaagcaatatggtacatttcaagcactaacagacattcatttggatattccaaaaggtgaacttgttgccttattaggcccgtcaggttctgggaaaacgacgttattacgcattattgcaggattagaagaagcggatggaggctctgtttcatttgatggggaagatctaacagacattcacgtgaaaaacaggcaagtcggtttcgtctttcagcactatgcgctctttaaacatatgaatgtatttgagaatgtcgctttcggtttaaaagtaagaaagaaaagcttaagaccgtcagcagaagcgatagaagaaaaggtaacagaattattaaagctcgtaaaaatggatggctttgctaaacgttatccagcgcaattatctggtggacaacgtcaacgtattgcactagcccgggcacttgcagtcgaaccgaaaattttattacttgatgaaccgttcggtgcactcgatgcaaaggtgagaaaagaattacgaagatggctccgaaaattacatgacgaatttcaaattacgagcgtattcgtaacgcatgatcaagaagaagcgttagacgttgcagaccgcatcgttgtaatgaatgaaggctgcattgaacaaatgggaacaccggaagaagtatatgaaaatccagcaagtccgtttgtatatgactttttaggaaatgtaaatttatttcacggccgcgttcataaaggaaagctaaatgtaggatcggtcgaactagaagcaccagagcataagcacgtttcaaacgtagacggaatagcctatgtaaggccgcatgacttatcaatctctcgtacgaaacaaagtgtagatgcaatcccagcaaaagtatcttattctcacgcagtcggaaatatcgtatatgtagaattaaaacgagacgaaacagatgaatatttagaagcagaaattacgaaagaacagttcaaacagctgaacattcaagcgggtgatttcgtatacgtacagccgaaagaagtgaaagtgtttattccggaggattttgtaatttaagagtgtttactcttaaattacaaaatctattaataagaaaaggtctcctaaaagatattttaggagaccttttctttgtttatcgtaataactttttctcatatgaaatgtagtaggaagtttgtatatataatagcggagcgtgttcaaacaactatttgatatgagtagtaatgaagatattcttcctactttcttacataaaatttttaattttggatatttgtatcatatgtttctgcaacaaacacaaagtctacatgctctttatcaataaaaatacttgttttagatggaagacctgttatggtagaaacaatatcaacctcaacaaggtcaaatcctacacgataagcatctgcaatttcaattccaccagttagaaaatgcaatccatccccaaatgacttaaatacaaatacattttctttcaaacttttattatccatttcaatccattcttcgttaatataaatcttaaatgtcgtgcactttggaacacactcgatgtgatgtatccctttataactattaagcgaaaacatataggtatgagtttctttaaagttaatatctatcccgtatttaaaagcaaaggttttatataccatctcataaaacaatggcattacaatatcatcccatgcgtcataggcaaaagcatgaattggtattagatgaggatataaacttacaatcgctttttgaaaattaagtaagatggttgtatctgtaatttcttttaaagaatcatctatttcatggtcataatctttcgaaattctgttatcaatcatatgacaaactccttacatagtcttctatatactacgtttttccgcatcatcagtttgttccttctgcaactaaattgcaagtttaaccgatgattccaaaaaagcccttttcttattttatcaatcattaaatggggtgggatactacaagcattaatgagaaaagaaatcgtcttttctttttttatgatagatgtatttatttttaaactgcatttactttactctttatttcatttagatttgaatatgtaacattattgtgttgaaaaatatttcagcgaggtgagtttatgaaaggaaagaaatggtataggcaattagtcgtgatggtgtaggagtatcatctaaggccattttaaatgttgttaaaactggtaaaaaagttatacaaagtggcggtagaactaaatatactagtaaacaggctgtagtagttttaaataaaaaaggtaaagtaattacaacttttgctaaaggttcaaaatacataaggaaaggaaaaaataagtttgtttaaattaaataaagagatgcagattttattgaaacagacattagaatcacaaaataaacatttactatggttaaatgcttatgaagacttacgtatgatagaaactgaaaaaataaataaattgagagatattatagaagatgaattaatggagaaaggttttgatgaacgagacaatataaacgatttgggaagagcattagaagagctaattgatatcttaggaaatttaataccttagaaaatgttaagctgtatggcaacgtttttagcagatggaaagttccattaattacagaatgaaagattatataacttttaacaatgcgcttaatacgagtgtagctatgattagagggttttgtatgtgtaaaataacttcaaaaatataaggatatattttgagggtgtatgattatatagtatatttattgattcgaatctttaaaaggaggggaaacatggggaaaataatagggattattctgattataggtggtatgattccattaatttatgcaatgatgcaaatctatcgtcaatggaaagaaaaagggccttcttttgctcttaaatcaataattttcctagtcgtaagcattttgctagatactgcaacaactattatattgtgtatagtaacagtattcattggtatttgtttaattatctacacataataagttcaagaaggctaacttatcgattgttactaattggagggattggatgaacttcattttacatggatctaaatatacagttttagcttccgtttttgactcatttcaaggtagggaaaaagagtttaattggcttataacagacatggagaatgtcgcacatcaggaagagaaacttatccgagattatcctaaaatgtcgcatccaatagtttggatagcaggtgaagatctttcaaatctcgtaaagaaatataatcctcaatttatttggggtgtactatctgcgtttgataagtctataaacattgatattaataatttgcttgtagaaccctatgcaaatggaaatgaagggctctgggtaccaagtccaaatattcagcaccctcaagcaaaacttgaaattgtttgttgggattcgtatgtaacgcttttttttagtaaagatgaggacatcgatgataaatttcaagactatttcaagtccgctaaaaaattggatttttaaataggtcgtccttgagtaataaaatgaatgtatgaatagtaatctctttgatgattattggaatattagctagtatttttgaaaaagtaacttgtaaaacttcggagtgaattgttaacttttgatgcgataggaaatcgtaaataaatttatgaaggagaatttagagttgatagagttttttggatatttattaattttggttttaaatatgctagtagcatctatcgtatttttacaagagtactgcataggtagtataagactgtctcattataggagaatctttgctacggtcatggctatacgttcattggtgagtatatggatcatttaccctatgacagctactctgttagggacgctaaatattttagtgattcaatcaattatattacttttcctttgggggcttatgcagtgtgtaaagaagtacagaggaaagtggtatattacaatgattgcacttattatttatgctcttagctgttattttcatattatgtatgcgaaaactgtatagataatgagagggtatttgtagacctagttacatgatagtaagaatctttaatgaaaattataataaaatgatgtcaaaagggagactaaaagtgcttatagaatttttagaattcatttctatcttggctttagtagttgtattaacattaactgttatgttgcaagatatattttttataaatataaataaacaatatactgaaacacgtattggggcgattattttttgtattcggatgttgttcgggacatgggtagtatttgttacggaaactactataattgctgtctcaaaagtgactgcaattcaattaattattttacttcttttttgggcatgttcgaagtatgtacaaaaaactcgtgaaaattggctaattactatagttgcttttgttatttatggtgttggtacatacttgtatattcagtttgcttttagaggctattaatatatcaccagaaaagttagtggttagaaagatgcatttgttaaatgtgtatatgaaggaagagcgaatataggctcttttttctttatatataggataggacatgtatctaatcctcgtgggacaaatcaaaatagagagcggaaggaattatatgaacaaaaaagaattaaaattaaagctactgcaaggtctaggtgaagagttaaaagaagacggttataagactataactacacaacaagacctggtgaaaaaatttgataaaggaaaaatcggtatacatttagcctttatcaatcacctagaagattttgatgtgacggtggatgtgggaattcgttttgatgaattagaaaatatgaaaaatcaatgggctgacggtttaacaattagagagaaaaaggagacctatacaattggagttgatttagggaatttagtctatagagagcaaaaaaggtggcgtgttgaaaaggaagaagatattttacctgttactatggatattttaaaagaagttaaggaatacttcattccatatattgataagtatgtagatatggaaaatgtatttgatttatgtgtaagagatgatgatgaggctggattaatagggacaatatttgatgggacgcgagcacaaaatgctattggattagccttgttattaaataaagaagagatattagaacaaatcattgagaaaaagagagagtatttaaagacgagggataaatttgaattggagttatttgaaaactttctttctaatatgaatctaggataaacaaggttagttattcattttcgtgattatagtggggttaattgtttatatctggtttttctggttggaaaaacattaaactctagattttctattaatcataaatattggtaacccctagaaggaaacatttgacgtttttatgattagatacaaacttcgaatgtaacttataggggtttttatttacaggttttataatactggaaagcccatatcgaattttagccggtttgagatagtgcctgcgagtgatgatggtgcactgtaaccttgagcagtagcgatagacttagcctttggaagcaaaaaccccacagagtctagtcaacttacctttttaaaaagtgtatcaaagaattatttatttgagctcaattatattatgtgaaataggagtgagaatcttgttccaaacaataatttacgataaagctaaatatcattatgaaggagatttcccacaagaattaccgatggagcaagcatttgtacatactggaatgttcttaggttggattattgataataatttatttagtgatgaatttttagaagagactgaagaggaaattaataaatttaagcttagaaaaatgactggaactcaagtttatatgttctgggatggggttttaagcgatgacatgttaaatgatgaagggaatcaatttgcaatagattattttgattttgaaaaaggtttatatttagatgattatgatgatgtatttttag

SEQ ID NO: 1350 - DNA, 17461 bp, Bacillus thuringiensis
tttaattaaatcgttcattatttcgttcatgcaatcttcgtggaaatcaccatgattgcggaaactaaataaatacaactttaaagatttactctctaccattttttgctctggaatatagctaatataaattgttgcaaaatctggttgtcctgttttcgggcataaacttgtaaattcaggacaattgaattttacaaaataatcacggtttggatgattattatcaaatacctctaatatttctgggctatattcaaataaatattttgtattttgattccctagtaatgttacatcttttaaatcttcatctaatcttcctgtcattttaaacatcccttctcgttatacgccgcgcttatttccccatactaacgcatgaagctgaggcaatactttggcatcattcatctctttacaatttacagctttatcaatcagccattcatacttatctaataaattttttataagcatcgcatcatccactgtttttgtatcatcgtttcctacttgtaagaaaaatggtacctttggataacgttcgtgcatcttaactgcatattcaaaatcatgatcatcgaatactactacttttaaactaatatcttttcctgctagtttctcaataatagcatctaacttatgaaaatctgttttcatcgttgaacttggtggttttggagaaattgttacctcatcaatttgaagtaaccaatcttgccatttactcccttgcgtttcaattgccgttcgcattccattttcttttaatatagaaagaagaaactcaatatttttcagcaatgccggatttccacctgaaatcgtaacatgagaaaaattttctcctccaattgcaacaagctcatcccaaatatcttctggtgtcatctgtctaatttgatctttagctgatccatcccacgtaaaagcagaatcacaccaagcacagctataatcacaaccagctgtacgaataaacattgttttttgccctacaaccattccttcaccttgaatagtcggaccgaatatttctaagacagggattttactcatcaagcatccactcccgtcttacttccgcataactagtcggcgtctcaaatagacgaacaaattcaacgcgagctcctttatattcgttcactcgattctcttttgttagtgcttctgccatcttttcataaatccaaacgaccatattttcagcagtcgtattcattgcaggtaacgtttcgtttaaataacgatgatctagataaatttcgatttcatttttccaaatttcttttatatctccaaagtcaattgcaagacctatttcatttacatatccactaattccaaatacaactttatatgtgtgaccgtgtaagtttttacatttcccttcataacagtgtaaatggtgtgctgcatcaaatgtaaattccttgctgaccattactcttttattatggtatttgagttgtttacgctgaatatccttgtccattttttgcaaattctctacgatgcgaaatccaaaaaagttatccattagttattcgctccttcgcgttcttgtaggtacgtatctaatcctgctttacgaagttgacatgctggacattcaccgcaaccatcaccaatgattccgttataacatgttaatgttttttctcgaacaaactcaaatgctccaagttcatctgataatttccatgtttcagccttatcaatccacataagtggcgtgtgaatgacaaacgggtaatccatagataaatttaaagtaacatttaacgatttcacaaacacgtcacggcagtctggataaccactgaaatcagtttcacatacacccgttacaatatgacgtgctccaacttgttttgctaatacagcagcaaatgataagaagagtaaatttcgtccatctacaaatgtcgatggcaattcaccttcttcatgtgtaatctccatatccgttctggttaacgcatttggagcaagttgatttaatagactcatatctagtaccgtatgctttattcctagttcttttgcaatttccgctgcacaatcaatttctagcttatgacgttgattgtaattaaacgttacagcttctacctctgcaaactgctctattgcccaaaataaacatgtcgtactatcttgtcctccactaaaaacaacaactgctttttcttttttcatttcactcattctccttctctactataaataagaagaaagaacgttcttgaactgtcacaataaaaaaacaaaacaatacctaaggatattgttgtttccatagttttttatagagggagttcgcgaacctctcccgcgcgatgcacggaatttcttctttcattgacacagcttattgtaacatattgtatactagcgtaaaaatttctgatttttccgctatttattatttcatttctttcattctatagtatgattaatttaatctaagaagagaggaggcatcccactgaaatcctttattatttatctctttttaaatatattattcatcctgattacaatgctcgtatatcatttattttggaatcaaaaagggaaacgctctcctaaattaaattcagctatattcattgtactctgttgccttgctaccgtactctgtattacatttgcagcaaaaacaaataatggttttcaatttgatatgcgccatattgtattaattgtcggtacattaacgggagggcctattgctggtggttctatcttagttgtattaaacatatatcgcttattattaggtggggtaggtgttttcccatctcttatcggttctgttcttctatttattgttctactattaacatataaattttttaatcaaacttctaatcgtataaaaataacacttgctattatctacagtctcacatacggatttagttggatacccttcttcctttcaaaggttacaaataagactgattatatactgcatattattgtgtatgagttatgttcaatgcttggtacgattctaattttatatttactgcacatattacaaactcaagttcgtctccaaaacgaacttataaatgctgaaaagtttcatttaattggtgaaatggcagcgtctatctctcatgaaattcgcaatccattaacttcaacgaaaggttttttacaactgttacaatcagatacctgtactgagcaggaacgaaaattgtatatcgacattgccattaacggcatcgaacaagcaaatcatgttcttacagattatttaacctttgctaaaccaagcattgaaaaagaacaaacattacagttagaagaagaattactacatgcattgtcgttaattacaccgcttactaatttaacaaatgtacgtactcattatataaagcaaagcacttctttttttatcgctggtgaaaagcaaaaactaaatcaatgtttattaaatattttaaaaaattgcattgaggctatgccaaaaggcggtgatctttatttcacattagttcctgatcataagcatattcagttatatataaaagatacaggagtcggtatggattcagaacaagtaaaacgtcttggctctcctttttattcaacgaaagaaaaaggtactggacttggaatgatggtcgtattcagtgttgttcaagctatgaatggaaaaattgatattataagtgaaaaaggaatcggtacaacctttttattaacttttccactcatacaaaaaacgtgatgaaatactcatcacgttttttctgttccttcaactaattcagcaaaagctttcacttttccgtgcggttgttgattttctttacgtgctttccaggcgcgctcttcttctcgcttcttcttagacatgttttttcaactccttcttttctttctccatgtagtattccaaaataagaaagaaaactatgcacgtatcaaaaaagaagtggtttcccacttcttccactttagcgttgcaaaattgcatgtttcgcctcttttaactgcgtaagatgtctttgttcatgcaaatcaagaaattgaacccattgatacaaattcagatcattaaaaacaggatgctttaatccattttcaaataaatctttttcatctataacactatgaagcgcgtgtaatagttcttggcgtgaatgttctagcaattgaattccttgctgttttttcattaaagtttctgttggttgcatttgctgaggagcttctcgtttatgtgtgcgatcaagcgtaagttggaggtctttaaatggagtcatgtttctttcctttttttgtaaagcatatacaagggcagacgtgacagattgttcaactaaatgcaagtggtgtaaaatttgaataatgctccatttatcacggcgtggctttacattcacttctgtgtcatttaacatttcaatttctgataatagcgtgcttcgagtagactgtaatgagtttactaaactttctaaacttacatccatattagattgaagcatacttgttccccccttttgtttgtgaaaagaggtgctccttattagaaacacctctttagtattctgaattttcttttattatctcatcattttcccattatgtcgatgttaaacatgtgaaaaaaagcgcatgttttttacaattttgtgtcgtcaatcgcatgtaaccatgcttcaatttctgtaataacacttttcacacagccttcagcaaatggtgatgttaaatttgcaacttctactaattctaagaacgatttacttccaccttgttggcacagattcacataatcttcccaagcctcttgtctattatctcttgcacgtttccaaaattgtagcgcacaaatttgagcaagcgtgtaatcaatataatagaacggtgagctataaatatgcccttgacgttgccaaaaaccaccgcgctctaaataatcattatcctcataatcacgatgtggtaaatatttcttctctatgttacgccatgctgtcttacgctcttcaggtgatgcttcaggattttcatatacataatgttgatattcatcaacagatacaccataaggtaaaaacagaagtgctgaacttaagtgagagaagtaatatttatctgcatcttcttcaaagaatagcttcatccatggccatgtaaagaattccatactcatagagtggatttcacatgcctcatatgttggccaattatattctggaatttcaaatttacgactttcatatacttggaaagcatgacctgcttcatgtgttaatacatcaatgtcaccagatgttccattgaagtttgagaaaataaatggcgctttataattctcaatatatgtacaatatccgccaccagcttttccttttttcgcaactaaatctaataaatcattatctagcatgaaattgaaaaattcatctgtttcaatcgataactctttatacattgtctttccatgatcaacaatccaatccgcatctccttttggagttgggttacctgtagcaaactcaaagttttcgtcgtaataagctaacttctctacaccgatacgtgcttgttgtcgctttcttaattccgttgtaacgggaacgatataatctagcacttgctgacggtaattagccaccatctccgcattataatctgtacggtacattcttgcatatccaagttcaacaaagtttttgaaacctaaagattttgcgattttcgttctcactttaacaagctcatcataaatacgatctagttcttcctcaattccagctaaaaatccgtagtatgcttcacttgctgctttacgttcgcttctttcttttccttgcataaacggaatcagttgcgataacgttctttcttctccagcaaagtcaatttttgcagatgctaataactgtgtatattgcgatgataatttattttctaattgtaaatctttcacgacttcatctgaatatgtttttaaatcacattctgctagagcaaataattgttttccataatacgcctctaattcttcacgaaatggagaattaatgagtgccttataatattttgtaccatatccttgtacaactggagagaattcatcaaagaaatcctgctcctccttataaaaagtatccgtcgtatcaacagaatggcgaatgtaacaaaggtttcccattgtaccaaaatcgttgcgaatctcattaattgaatgaatgacttgtttttgttcttctacagtttttgcgttatcaaacttctctaaagcaacagtaaatttctcttttaactcttcaatatttgggcgtttatattcatagtctttaaatgacatgaacgagcctcctctccattacatacctttattataattcaatacgtattctcgaatcccctcttaatttccaacaaatttcggcagtgactgccatgagttcattacaaataaaaaagccttggatttatttatccaaagctcctttggaacatattatttttcatacttcccaattttttttaataaatcaagtaattcatctttttcatctttcgttaacatttcaaaagactgatgtataactttctcatgccccggaaaaatagaagcaataaagttctcgccagactcagttaattgcgcgtaaataacacgtctgtcattcggacatgggattctctttactaatccctttttctccaacttatctacaacatatgtaatgctgccactagctattaaaatgcgctcaccaatttgctggagtggttgaccgcctttatgatatagcagttctaatacagcaaattcagttggatttaacccgttactttgtatagatttatttgtagtatccataacagaacgatgtacacgagataatgcaataaatacttttaaagattgagaaatatcttctcgttcattatttgatgtcatacaactttcaacccttcacttaaattctcagcaataaaaagaaaataccacttcatacttcatgtgaattccgaatgagcattcactcatccatttcctctcccctaatatattaaaaatcattcttgaataaaaacatgacaattttaacatagtttatatataatgataataaaaaaagaaggagtaccacatttgaaagtcaaattccaaagcataattatatatatattgcttgttatcctaccgacaatagggattggtgctacattttattcgtatcatacatataaaatgaaacaggaaaacaaattatctgctcatacagttctctttttatatagagattatttggatcatcatcttggtgaagcaatttctgctttagacatgcttgcaaaagttgtaggcaccgagactggtaatataaatggcattaaacaaattgtacatgatacagatggaaacgatgcacgcttttctggtctatattacgctacaccagaaggagtcattacaatcgcatctgaagatgaatcaaagcctatagatgtttcagaccgtaaatatattcaagacgcgctccaaactaaaaaaaccactgtatcatcagtcattactgatcgcgttcttggacataaagctattatgattgctgcccccatatttaataaacagaaggagctctcaggattattattagctagtttacgctttgattacatttcctcttctttaaatgccattaaaccacaataccattttgaggtaactgataaacatgatgtagtttttctaaccgatgataataacgacacaagtgatacgcattctaatatgcttactaccccactccaaagattaaattggaaggtctctgtttctccattacccattcatcaaaaaaccttataccagtgggttgcaatagagtgtatagctactttatttttaatgtctattttatttttgcttgctcaatatatgttgttaaaacgtcaaacaaaacttgaaagacaacaaaatgaactacagaaaattgaattagttggaacttttgcagcgagtacagcacacgaaatccgtaatcctcttactggaattaaaggactcgtcgctctattaaaagagaaatataaagatgaacaagatcagttctacttttccgtaattgaacaagaaatagagcgaatcaatgaaattgtaagtgaatttcttattctaggaaagccaaccgccatcatcgaacaaacatatgatgtaagaacaattctaaatgaggtagcattaattattcaatctgaggcgaatttacataacattgtattccatttacatttgccagaccatcctgttcatatccgttgttcgaaagaccatatgaaacaagtggttttaaacattaccaaaaatgcaattgaggccatgacttctaatgatacactaaccattgtagtaaaaaacaatgaaacacacgcacaactgcatattacagatactggaaaagggattccgcaacatattcaaaaacacctctttcatccgttctttactaataaagatactggaacaggtcttggacttgtcatatgtaaacgaattgtagagatgtataatgggcatatttttatcgacagtacagaaaatgaaggaacgacagttcatatcgaaattccgttacacatagtataattatccttatcctataagggtaattatacttatttcataaaaccagccacaagcattcgccaaaaattatttgattttccttcatacccgatttggaaaataggtatttttataattgaaaaccatttcggtgtttgtttttctttataacattgatattgtaaaataagcttgtccaattcttgactaacttgaattgtctccctactatttagcccacttgttaatcctagttgaatcatttcttcacgtttcatatgaatatcacgtgaaagcttttctaatgtgtacttcctttttacagtaaacatccatatcccccttattatacttccatgctcttaacttcacttctccattgactttttttaactacttaatcatatgcaaatttgaagaatcagaaaatttaacattttctccctgtaatttacaaatctttaccctcactttgagaattattacaaattattctatctttgtaaatacattcgcaataatagacatttttttcatcttctttttttataaattctacgtaaaccggggattcttaattttccacctacttttcttcgacattttttgtttaatttatataaaaaagcaaaacataatgatgattgataaagtgaaactttaatcagtgtttttttgttcagcccccactgataattagcattcaccaatcgggtaggcagttaatctcccacctatccagcccaatgttgaggtgggagtcttactacccacaaatagcaggataacaatagaaaggaaatatttatatgcgaaaatatacgattgcattattcatcattgttttgtttttaccgtctttcttatttcctattcaagcaaatgctcatacgaataaagttgctattgtcattgatgatttcggtaataatatgaaggggactaatcaaatgttatcacttcccattccactcactgttgctgttatgccttttcttccttccacaaaagaagacgcaatagctgcccataagaaaggccatgaagttattatacatatgccaatggaacctataaaaggtaaaaaagaatggcttgggccgaaagcaattacaactgatttaagcgatgaagaaataaacaaccgacttgaacaagccattcaagaagtaccgcatgcaattggaatgaacaatcatatggggtcaaaagtaacagcggatgaaagaattgttcgccttatacttgctgcttgtaaaaaacacggtttattttacttagatagtaaaacgaatcctaatagtgtcgtcccaaaaatcggaaaagaattaggagttcctattattgaaaaccaactattttttgatgatgtgtatacagcaggacatatttcaaaacaagcccaattactcatcaaaaaaattcaagaaaaacctattatggtagctatcgggcatgtgggccccccaggtgaaattacatcacgcgttattgaaacttctatccctaaaattcgtgagcatgcagactttattttcttatctgatctagcattatccccgcctcctgtttcaaaataaagttcattactcacatataatcagcctcaccaattgggcttttacaggtaacacccgcccacctaacttctttgctttcaccaaattttgaggcgtggattttactacccacaaatagtgggacaaaaaagtacctatctatatataacagataggtacttttctttttaacttaaatataatctacgtgactcactctgaatccttttttctctatttttccgattaattgctttaattttgtttcatctaactcatctgatatatttacaataacgcggcggatatattgatcaccgttatctagcgtaaataggccaccgatattatatgcttttaacaatgtcccaagctctttaatcgttcccttacaatcttgtgttgcaattgttaatatataaccacctgttcgcataccaaatgaatcttcaataacatcaaatatattcgaatgcgttaacataccgacaaattcattataatcatttagcacggctaaaaacggaagccgacgaattacataaaaggctctgaagaaggaatccttttcaaaaataaatgcattggaatcgtagagcatatcccctgcacttacatgctctaatccgctattgcattttttttctaataaatctactttataaataatccccgtgaatttcttctcatcttctgctaataccgggatggctcgaaatcccgtttcgttcatcatttgcagtgcctcttcaccagaatcatttattttgcaaaatgttacttgctgctttggcagaaaatgatatttaactcgcaaaatatgttcctccttacatgtcaacatgtaatctatatataataaggagacctatattttatgagtgaaattatttttaaaacgctttcatttatttattaacttgtagctatatcacatccatttttatataacagagctccttgcccccttaatcattaataactttacatgatagttcattaaatattctataccctctagccattttttcgcctcttctggcgtttttccccacacaatcatgccgtaattatgaacaagaactactcctccaccttcaatgaaattcggaacattcctttctaataaatcagcgaattttttttcatcttctacaattggaattgtcatttctgttataccttcttttccgaaaacacgctccacactgcgtttatcgaacgttacttctccttcttccccatataactctgatattaaatgactatctacagtctgcacttgtaaaatacatcctgcactactttttttataaatatccgcatgcataaatgactctgcagctggtttttcttcattttcaaatactgactcgcacatgcaatttacgacaataaaatcttcttccgaaaatagccctttatctcttccttcaacatttactaagaatgttaacggctcttttgacgtacatagcgataagctaattttggtaccataaaaccaatcacgaagtgccaattcagatttcacatcttttaattcattccatttcttcagaaaaaataacatttcgtcacccccggcataatattcatataaggttcgaatcctttctatgtaaaaggaatattttttgattattctaaaaattaattgaattatcacatgagaacgcttttttgtcaatatagtttcgtggttcttctttaaaataggctattcatatgtctatactcctatctatttcctatttcattttgtacataaaaatacgctactctttaattaaagaatagcgtattttcctcattttttattccgcattaacgggcagcccgattagtgagggctaataatcagtggggaatgaacaaaacccccactgattaaagtttcactttatttctttattgcattatataaaaactgtgcatattgttcacgtgttacgaaattatctcctaaaaaattcccttccccatcgccttttgatattttattatccactaaagctttcacatatcctttcgcccaatggtcatttggtatatctttaaaattctctgcactattttcattttcttttaactgaaatactctttgtaatactactgacatttcatatcgagttaatactccatctggacggaacataccatttccatagcctgtcataattccagcttgaaccactgcatcaatagccgtttcatacatatttcctttcgtatctgtaaatgccgtttttggtactagattattttctaattttaaatacctttgtattagaagagctacttgtccacgagtaatgttatcaccaaatccaaattcaccatttccatagcctataaataatttttctttcgctaagtaattaattgcttcttctgaccaatgtccctttggtacatctttaaattctaccacttctgttttctcatcttctttagacgtattaccgtctttactttctactacattttgaataacagaccctgtaaagaaaattcctgtatccgcgaatggatctttcacaccaaattcatatattttctcacctggtgtactccatttcactacaccattactatacgtaccgttatcgctcttcagacggattttcgtagaaacctcaccatctttttcatatataggtacttttacttctttatttacttctgtttcctctaaaaatactttttgattttggacattaatataagccgtcttacttagttctataactggtcggacatcacggatttcatttgcaacaaaacttagaaatactaattttttcaaattactaactggtgataagtctgaaatataattcgcttctaaatcaagcttttgtaagtttactaaacttgataatggcgtaatatcctttaactcattgttaggtaagtgtaattgttttaactgtgtcatcttacttagaggagtaacatcttttatttcatttttcccgatccacaattcttctaattgcttcatttgctcaatgccggataaatctttaactttattacgtgttaatactaagtctgttaaaggtaatgaatataacgctttaatatcttcaatttgattacctgctaaagttaagtatgttacatttttcaaagcgcttaatggagcaacgttcgtaattttattatttgctaaattcaagtaatctagttgttccattttcgctaatgctgttacatcttctatttggttgcctgatagaaataaactttttacatttttcatttcagttagtggtgcaacgtttgtaattttattattacttaaatcaagagattctaaattatccatcttaacaagtggcgttacatctgaaaattcattaccacgcaaagctaaatgacttaattgctttaagttcgcaaagaacgacggatcttttatcttcgcattcgcaactgttaaagattttaaatttggcatatattttaatgcactataatcaagtatctcattcgtatttaaaaacaaatcctttacttgtaataaatcttctttcgtaattggtgtatttaaatcttttctattaaatacttttttattaacaagctctcttaatttcttatctgttatcatattttgattatcaactggattatccgtttccgtattgcctgaattagagttatcatctggtttctctgtttctttgttacctaaagttggatctttaatttcaaattgaacttgatatttgtgatcatatccaatagctggaataagtatatgcatttgcatattgtgcttcttctcaaactcaccaatttcaaattgaactactttcgttccattcttcctcttatcttctgacaaaaccttcacatcatgaaatacaccaggctggtttctatcttctattctaagatattgaaaataatcactatcttgcattgttacagtgacaatttttttgccagctgcaatcgttactttaggatcttttatatattgagaaaccatagatggctcatctttttggtccttatatattttaatctcagtatcatacgtgcgattactcgctgctgctaccgattgatttgcttcaacttttaatgccgctaatgctggagtagagtacgtagcaaatggaattgctaatgttgtcgctactactagcgccttcatgtaatttttttcaaaataatatcccctatcatatataatctttacaattgataagtattatcaattttccacaaataaatgataatgaatatcattatcattgtcaatgagaatattacattaaatttatatttttaaagatataaaaataaaaaagccctttattcaaagggcttttttacctatcgtatgaagaatttcacttttttccttctcattgatgacaccgattttttgcaaaatattcgcgtacaatacaagtttattatatattcgttctgacatgttctcccttctttccttcgaccaactttttttgtattggtaaattatatgaaagaggtgagaaaatgtgtccactttttgcataactgcaaatcttttattttacgatttacagataataaaactccctcctaaaaattaggcgggagtttatgtgctttcactgtatttaacaaactgtccactgaatattatgcttcttaagttcttcttcaaagctatatggcatttttttatcacaaattacgtgttgaatacgcgaaattgctgctatacgataattccctttcacgcctaccttcgtatgatcacataaaatatatgttttctcagctaatttcatcatcgcctctgacaatttcgctttctctaattcaaagctggaaactccaaaactaggtaataacccatcaatcgaaacgaacgctttatgaaaatgaaattgctgtatgacttgctgagaaatagaccctgatacacgcgaatgctttggagatacttttccacctataaacaaaacttcaccgtgaaacatctttttattaatagaagaaattaattgtgttgcgactggaaatgaacttgttacaatcgttaagtttttacgatgaacaaggtatggaaccatttgaagcggtgtacttccatcatcaattgcaatgacatcaccgtcttctacaaatgtcgctgctttataaccaattcttttcttctcttctatatgtagcatttctctttctaacattggtgcctctactccagcgcctggaagttgaacagctccaccatacacttttttcagcttcttttcacgatctaattcttctaaatatcgacgaatcgtttctgttgatacagcaaattctctcgctaattctgaaacctttactttccctttaaattctaccttttcaagaatggttcgctttctttcttctcctactacagacatagcttcacctcatttatatctcccttataaacgtccttacttatacaaagctataattttctttataagtagaaacttcttcatgaatatgaataccgcgctttgctagctcatcaaaaatcaattgtggattttcaaaggcttcttcaggcgtaacaacacccaccctatttacatttccatttgcaattaactctgcagcaatcccaaatggaataccgacgtttctcgtatacgctcttaatttttcccatcctacaacagaaccatcagataacggatgtgtatgatataacacatgtctttgcttctcattatttttcatacctattacttctacatgaagtgcataaccataaagctctgtttcttgcccttctttcgattgcaataaatactgtgaaatacaatccataatgcctatttctttcccgtttatttcaatctgatcattacgcaatatgccgtaatcatataaagcacgtacaagttgcatattttgctgtggccaagttcctctcgtctctatcagtttgacacctttattttctaatgcctttgctagcgtaatcgtttcagaatgcggaatgatatactgcgttgccttaccataaggctctggcaattctatttctctcggacgcgcaaacggaggtacttgcttaaattcaccatcttcatacactgtacgcgatggtaaatatggatcatattcatatgtcgttgtctctgtaattgatgcagaaaaagcaatcggacgatacgaaccgtgacttacacggacagactctacagtatccaattgatttgctgcatgcattgccatcatttgcgttacacccggcgtcatgccaaatccaggtaaacatatcttttcattttcaacaaatatagcatgcgattcattttcttcaccaaatccatttaagttcacaccgtgacatcctgcttctgcaatacagcgggtcgacaatctgtttaactttatcgtcgtaccgtccattacaatgtcataaccaatcatttttgcaaccgtatcctcgtgatccgttacatctacttttacaaaatcaacacgagggtcgttgagccattctactactttacggccctctacctcgttaaaatcagctactgtaattgtctcaaaagatgaaaattgaactaaatccaaaatagcttcgcgacaaattttacctgctccacctaagcaaaatactttcacccaataacagctcctttagcaatactatcaactaagcgattaatatcttgttcatgtacatcaccgatatttccaatgcggaacgtatctactttcgaaattttcccagggtaaataacaaatccataacgctttaattcgttatataactgttgaaactcgaatccctcttttggataaatgaaagatgtaataataggagattggtattcctcatctactagtggcttaaatccgatttctcccattctatttactagtagtttttgattgttgtaatatcgattgtaacgcgctcttactcctccctctttttctagttcaagtagtgcttgataaaaagcatgtacaacatgtgtaggtgaagtaaaacgccatttcccattttgtttttccatcgtttcccattgatcatataaatcaagagataaagagcgtccttgccctttacacttcaataattcatcacgttttgcgattacaaattcgtatccaggaaccccttgaatacacttattcgtactacttattaaaaaatcaatttgttaattagcaatgtctatttcaatctccgccgaaactactcattgtatcaacaattgtaacctttccatactgttcttccaatttacaaaca

SEQ ID NO: 1351 - DNA, 20161 bp, Bacillus thuringiensis
agcgattcttattctagacgaagcgaatcgtgaggctgaagcacttaagaaagaagcgcttttagaagcaaaggatgaaattcatacacttcgtacagaagctgaattagaaattcgtgaccgtagaagcgaattacaaaaacaagaaaatcgtttaatgcaaaaagaagagaaccttgatcgtaaagacgaaacgctcgataaacgcgagcagcagttagagaagaaagaggattctcttgtagcgagacaacaacagattgaagagttggaaagcaaagtgggagagttagttcaaaagcaacaaacggaattagagcgcatttccaatctgacacgcgaacaagcgaaagcaattattcttggtaaagtagaaaatgaagtttctcatgaaatcgctgttatggtaaaagaaagtgaagttcgcgcgaaagaagaagcggataagaaagcaaaagagattttatctcttgcaatgcaaagatgtgcagctgatcatgttgctgaaacaaccgtttcggttgtaaatcttccaaatgacgaaatgaagggacgtattatcgggcgtgaaggtcgtaatattcgtacgttagaaacgttaacgggtattgacttaattatcgatgatacaccagaggcggtaatcctttctggattcgacccaattcgtcgtgaaacagctcgtatcgctcttgataaactagtacaggacggacgtattcacccagcgcgtattgaagagatggtcgaaaaatcaagacgtgaagtggacgagtatattcgcgaagtaggagagcaaacaacgtttgaagtgggtgttcatggattacatccagatttaattaaaattttaggtcgtttaaaataccgtacaagttatggtcaaaacgtcttaaaacactctatggaagttgcatatttaactggacttatggcggcagagcttggcgaggatgaaaaactagcaagacgtgcaggtctattacatgatatcggaaaagcgattgaccatgaagtagaaggaagccacgttgaaattggtgttgaacttgcaacgaaatataaagagcatcctgtagttataaacagtatcgcatctcaccatggtgacacagaaccaacttctatcattgcagttttagttgcagcagcagatgctttatcagctgcaagaccgggagctcgtagtgaaacacttgaaaactatattcgtcgtcttgaaaagttagaagagatttcagagtcttatgaaggcgttgaaaaatcatttgcaattcaagcaggacgtgaagttcgtattttggtaaaaccagatacaatcgatgacttagaagctcatcgtttagctcgtgatatccgaaaacgtattgaaaatgaactggattacccaggacatattaaagtaactgttattcgtgaaacacgtgcagtggaatacgcaaaataaagtggtgaaacaccactttatttttttgtgttggaattggataaaataaagacagttagttatatagcataaaagtgaagcaaacttataataaagatattataaggaatttacttgatgctatagcaataaaaaatgcagtacatagaaagggtaagacatatgagaatattatttgttggggatgtagtaggatctcctggtagaggtatgattcaacaatacgtaccggcattaaagaaaaaatatacacctacagtaacaatcattaatggagaaaatgcagcaggtggccgtgggattacagaaaaaatatatcgaaactttttagagtgtggggcgcaggcagttacacttggaaaccacgcttgggataatcgtgaagtatttgaattcatcgatgatgcaaaatatcttgcaagaccagctaacttcccagaaggaactccaggaaaaggacttatctttgtgaactgtaatggaacagaagttgcagttattaatttacaaggacgtactttccttcctccaattgattgtccattccgtaaagtggatgaattaattaatattgcgaaaaaacgtacgaatattatatttgttgatttccatgcggagactacaagtgaaaaacaagcgctaggttggtatgtagatggacgtgctacagcagtagtaggtacgcatacgcatgtccctacagcggataaccgtattttaccaagcggaacggcatacattacagatgttgggatgacagggccgtatgacggaatattaggtatggacagagaagcagtattgaagaagtttttaacaaacttaccagtacgatttgaagtaacaaatggcagaacgcaattaagtgcagtgttaattgatgtggatccaaatacaggaaaagcaaagagaattgaacgtattttaattaatgacgatcaaccattttttgagtaaatttccgtcaaattttagataagttattatattttaattttttagaaaaattacgaaaatttagcaggaatacgcgccattcctcgtgaatataagttaaagtgaaataattgctaatactttttaaagaaacgaggaggaaacgcggaatggaaatattaaaagttaaagcaacgtcggtccctaattctgtagctggtgcacttgcaggtgttattcgcgaacgcggaacagcagaaattcaagctattggtgctggtgcattgaaccaagctgtaaaggcagtagcaatcgcaagaggatttgtagcgcctagtggtttggacctgatttgtatcccagcgtttacagatattatgattgatggcgaagagcgtacagcaataaaattaattgtagaacctcgttaagtttaaacaacctgtttgcagtatgcaaacaggttgtttttataatggaggaatgaaaatgaaaatttttgatgctcattgtgacgtgcttcttcagttatggagtgcacaagggaaaaggaattttaaagatgattcacaattacatattacatttgaacagttaaagagaagaaaaggaagtatacaatgttttgctatatatgtaccagaaacagtggcatatgaaaaccgatttgaagtagcattacaaatggtagatattttttataatgaaattttatccctacaaggtgtgaagtttattcagacaaaagatgatattaacatattaaaacaggacgagattggagcgatattaacaatagaaggatgcgaaacaattggaaaagatgcaatgaaattacggttgttgtatcgcctaggagtacgttcttttggactaacatggaattatgccaatctcttagctgatggtgcgctagagacacgtggggcgggtttaacgacttttggtaaacatgttgtacaagaactgaatacgttacatgtatggactgatgtgtctcatttgaatgaaagaagtttttgggatgttatagagattgcaaaaaatcctattgcttcccactcaaattgtatgaaactttgcgagcacccacgtaatttaaacgatgaacaacttaaagctcttataaagcgaaatggcatgattggtgtcacttttgtaccgcagtttctaacaaatgaaaaacaagcgaatgtagcagatataataaaacatatcgaatatatttgcttgctaggtggagaaaacaatatagggtttggttcagattttgatgggattgtagatacagttgtaaatgtatcagcgtatcgagattatgaaaatgtaatgaatgagctttgtaaacactatgctgcatctactgtagaacgatttttatatgataattttgtagaacatatgagtttttaaattctgatttaaaattcagaaaaattaaaattaattcatttgattttattgctttttttaagacctaatactagaatgaaaaacaaaatagctttatactaaagattcagggaaatcagaagaggcataatttgcgtccgttgtagtttatttgcataaaaaatgctaaactattactgtaaaaaaatacactacaatgaatgcagccaaaaggggtgtaggagatgattagtcaactttcatggaaagttggaggccaacaaggtgaaggaattgaaagtacaggagaaatcttctgtattgcattaaaccgattaggatattacctatacggttaccgccacttctcatcacgtataaaaggcggccatacaaataataaaattcgtgtaagtacaacagaagtacgagcgatctcagatgatttagatattttaattgcttttgaccaagaaacaatcgattttaatttccacgaactacgtccaggtggaattgtagttgcggatgcgaaatttaatccaacaatacctgacaatacagatgtaaatctatatgtgataccgtttacagatattgcttcagaattaggcacatcattaatgaaaaacatggttgctgttggagcatcaagtgcagtattaggattagatgaaacagcttatttagatgttgttgaagaaatctttggtcgtaaaggagagcaagtcgttcaaaagaatatggacgcaattaaacgcggctctcaatatatgaaagaattactaggtgagaaagtaaacatgatgcagcttgaaaaagctgatggtaaaaaacgcatgtttatgattggaaacgatgcaatcgcatttggtgcggtagctggtggtgctcgttttatgtcagcatacccaatcacacctgcatcagaaattatggaatacttaattaaaaaattaccgaaagtcggcggaacagtaatccaaactgaggatgaaatcgcagcttgtacaatggcaatcggtgcaaactatgctggtgttcgtacattaacggcatctgctggtccaggtctttcattaatgatggaagcaatcggtttagcaggtattacagaaaccccattagtaattgttgatacacaacgtggcggcccaagtacaggattaccaacgaaacaagaacagtctgacttaatggcgatgatttacggtacgcatggtgaaattccaaaaatcgtaatggcgccaagtacagttgaagaagctttctatgacattgtagaagcatttaacttatctgaagaatatcaagttcctgttattttcttaacagatttacagctttcgttaggaaaacaaacagtagaaccacttaaattagataaagtagaaattcgtcgtggtaagcttgatttagaagcagaattaccagaacgtgaaaataaagcatacttcaagcgttatgaagtaacagaagacggcgtttcacctcgtgttttacctggtatgaaaaatggtgttcaccatgttacaggtgtagaacatgatgaaactggaaaaccatcggaatcagcaataaaccgtaaagatcaaatggacaaacgtttccgtaaaatggagaacttgaagtttaatacccctgtttataaaaatgttaagcatgaagaagcagacgtattgcttgttggatttaactcaactcgtggtgcgatcgaagaggcaatgacgcgtttagaacaagagggtatgaaagtaaaccatgctcatgtgcgtttaattcacccgttcccaacagctgaaatcgatccacttgtgaaaaaggcgaagcgtgttgtagtagtagaaaacaatgcaacaggtcagcttgctaacattatgaaaatgaatcttggtaatggtgagaaaatttctagtcttttaaaatatgatggaaacccattcttgccgaaagagatttacaacgaatgcaaaaaaggggttgtattaaatggcaacatttaaggactttcgtaacagtgtaaagccaaactggtgcccaggttgcggagacttctcagtgcaagctgcaattcaacgtgcggcagctaacgttggcctaaatccagatgaacttgctgttatttctggtatcggctgttcaggccgtatttcaggttatattaattcatatggtgtgcatagtattcatggtcgtgcccttccaattgcacaaggtgtgaagatggcaaatcgtgatttaacagttatcgcttcaggtggtgacggtgatggatttgcgattggtatgggtcatacaatccattctattcgtcgtaatatcgacattacgtacatcgtaatggataaccaaatttatggattaacaaaagggcaaacttcaccacgtagtgaagctggatttaaaacgaaaagcacaccacaaggttcaattgaaccatcactaaatgtaatggaaatggccttgacagctggtgcgacatttgtggcgcaaagcttttcgagtgatttaaaagaattaacacaaattattgaggctggtattaaccataaaggattttcattaattaacgtatttagcccatgtgttacttacaataaagtaaatacttacgattggtttaaagagaacttaacgaaactaagcacagtagagggatatgatccatctaatcgcatgatggctatgcaaactttaatggaaaataacggtttagtaacagggttaatttatcaaaatactaagcaaccatcatatcaagaacttgttaaaggctatagtgaagagcctttagtgaaatctgatttaaatatggatcagaaaatgtttgatgagcttgttgctgaatttatgtaatgtaagaagaggaggttgccgatttggcaacctttttttatatacaaaaatatagggtagtcttatttacttggaaaattcagaatgataaaataatatataaatcgttgtatgaaaatggcaagttcattgcttatgaaatgtaagataataaagggcctctttattgttaaaattggcgaaacacgtcgtactatggtaatgtttatagggataaagcaatatgcttttgggtaggacaacaagaaatgataaaaagggaatgtctatttgcgtggggaagacttcattcttatgaatgattagattgattactcaagtttcaaaggacaagttatctctcaagctatctaaccatttttgaggtgagtctaagcgcattaaaatggactatagagtgtgtatagttaagggtgaaaggagattaccgatgaacgagcaacaacgattagcaagtcaacaagcaaattcctctacgaaaaaagaagagaaagattatagtaaatactttgaaagtgtatatcaaccaccttccttaaaggatgcgaaaaagcgtgggaaagaagaagttaaaattgaacgggattttggcttacctgaagagtttcgcaattttggtacaggaagaaagttctatattcgtacatatggttgtcaaatgaatgagcatgatacggaagtaatggcaggtattttcacagcacttggatatgaaccaactttttcaactgaggatgcagatgtagttttattaaacacttgtgcaattcgtgaaaatgctgaaaataaggtgtttggtgagctaggccatttaaagtcactcaaacgaagaaatccagaccttttaattggtgtatgtggttgtatgtctcaagaggaatctgttgtaaataaaattatgcaaaaaaatcagcatgtagatatggtatttggaacgcataatattcatagattaccgtatattctaaaagatgcgatgttctcgaaagagacggtagttgaagtatggtcaaaagaaggtgacgtaattgaaaaccttccgaaagtacgtcgtggtgatattaaagcgtgggtaaatattatgtatggctgtgataaattctgtacgtattgtattgtaccgtatacacgcggaaaagagcgaagtagacgtccagaagatattatccaagagattcgtcatttagctgcaaatggttataaagaaattactttacttggacaaaacgtaaatgcatatggtaaagactttgaagatatagaatacggtcttggcgatttaatggacgaacttcgtaaagttgatattgcccgtattcgttttacaacgagccatccacgtgatttcgatgatcacttaattgaagtgcttggaaaaggtggcaacctagtagaacatatccatttaccagttcaatctggaagtacagatatgctgaaaattatggcacgtaaatattcgcgtgagcattatttagaacttgtaagaaaaattaaagaagcaattccagatgtagtattaacaacagatattatcgttggttttccaaatgaaacagatgagcaatttgaagaaacgatgtcgttatatcgtgaagtagggtttgatactgcctttacatttatttattctcctcgcgaaggtacaccagctgcaaaaatgaaagataatgtaccgatggaagtaaagaaagaacgtcttcagcgcttaaatacactagtaaatacgttggcaattgaaaagaatagtcgttacaaaggtcaaattgtagaagtgttagttgatggggaaagtaaaaataatccggaagtacttgcaggttatactcgtacgaataaacttgtaaacttcgtcgcttcaaaatctttaattggtcagcttgtgaaagtgaaaataacggaagcaaaaacttggtctcttaacggggaattagttgaagagccgattgaggtgaaataatagatgaaagtatattcgaaagatgacattgttgaacaagcgaaagaattagcaaaaatgatttctgaaacagaagaagttgatttttttaagaaagcagaggcgcaaattcataaaaatgaaaatgtaaagcgcgcaatcgatgaaattaaagcactgcaaaaacaagcagtaaacttgcaacattacgggaaatgggaagctttaaaaaaggtagaagctgaaattgatgcattgcaagataagttagacagtattccagtcgtacaacaatttaaatcttcacaaacatacgtaaatgacttattacagttagttgctagtacaatttctaacaacgtaacagatgaaatattaatttcaactggtggcgatgtactaaagggtgaaactggcgcagcggtagaaagtaaaaaaggaaattgtggttgttaaagagatgtcatattgacatctctttttttttgtggattaaacgtaagttcttctcaaaaaaagaatgacacattccgctattgtcacgcatatgattaagtgaatagtgattgaggagggttacgaatgtccgaatttagagagattattacaaaagcagtggttggaaaaggacgtaagtatacaaagtcaacgcatacatgtgaatcgaataatgagccaacaagtattttagggtgctgggtaattaaccactcgtacgaagcaagaaagaatggaaaacatgtggaaattgaaggtttctatgatgtgaacacttggtattcatttgatggaaatacaaagactgaagttgtaacagaacgtgtgaactacacggacgaagtaagtattggttatcgtgataaaaacttttctggtgacgatttagaaattattgctcgtgttattcagccgccaaattgtttagaagcacttgtatcaccaaatggtaataaaattgttgtaactgtagaacgtgaatttgtaacagaagtagttggagaaacgaaaatttgtgtaagtgtaaatcctgaaggctgcgtagaatcagatgatgatttccaaattgctgatgatgaatttgaagaattagatccgaactttatagttgatgcagaagaagagtaatagaaagctagggagaagttcttcctagctttttactttacataagtggggctgaatgaacatgattctttatgaaatatgttataatgaagaaagactcctgaaataggagataagagtgtccgtgaaatgcgacatatatgaaaatagattatcatgtaagaattatggaggaaaagtatgactcaatatacgcctatgatacagcaatatttaaaggttaaggcagattatcaagatgcctttttattttttcgcttaggcgatttttatgaaatgttctttgaggatgctgtaaaagcagctcatgaacttgaaattacattaacgagccgagatggcggtagtagtgaacgtataccaatgtgcggtgtaccgtatcatgcggctaaaaactatattgaacaacttgttgaaaaaggatataaagtagctgtttgtgagcaagtagaagatccgaaaacagctaaaggtgtagtacgtcgtgaagtagtacaattaattacgccaggaacgatgatggaagggcgtacaattgatgagaaagaaaataacttcttagccgcattaacacattttgaagatggatcatatgcattagcttgtaacgacttaacgactggacaaaatacagtaacgttattgactggttcagtagaagatattttattagaagtgtatgcaactggttcgaaagaaattgttgttgattcttcattttctaaagatgaactaaacaagttaactgaaacattgaaaatgacgatttcgtatgaagatgcaacggcaattccggaaggattagaacatcttgtgaaaaatgtttcacaagcaaaattaattaaagcagttggacgtttatttaactatgtaataagaacgcaaaaacgttctttagatcatttgcaaccagtagaaatttattatacgaatcaatttatgaaaattgatgtacattcaaagcgaaatttagaactgacagaaacacttcgaacgaaagaaaaaacaggatcactattatggttattggacaagacgaaaacagctatgggtggtcgtatgttaaaacagtggatggaacgtccacttatacagaaagaaagaattgaagagcgtttagaaatggttgaaacgtttgtaaatgattacttcttacgtgaagatttaaaggaaaagttaaaagaagtatatgatttagaacgcttagcaggaaaagttgcatttggtaacgtaaatgcaagagacttattacaattaagacgttcattgcttcaagtaccagctattttagaagcaattagtttgttagataacgcttatgcatcgagattaattcaaggtgcagatccatgtgaaagcttaacagaattactaggaagaagtattcaagaaaacccaccgctttcgattaaagatggagatattattaaagatggttataatgacaagcttgatcaatatcgttacgttagtaaaaacgggaaaacgtggattgctgagcttgaaaaaagagaacgtgatattaccggaattaaatcgttaaaaatcggatacaaccgtattttcggttactacattgaagtaacgaaagcgaatcttgcagcacttccagaaggtcgctatgagcgtaaacagacgcttgctaatgctgaacgtttcattacagatgaactgaaagaaaaagaaacgttaatcttagaagctgaagaaaaaattgtacagctagaatacgatttatttacagcacttcgtgaagaagtaaaagtatttattccgaaattacaacatttagcgaaagtaattagtgaattagacgtactgcaaagttttgcgacagttagtgaagaagaacagtttgtaaaacctgtactgacaacgaagcgcgaaatctttattaaagatggtcgtcatcctgttgttgaaaaagtattgaacgggaaattgtatgtaccgaatgattgtattatgccagagaatatggatgtctttttaattacagggccgaacatgtctggtaaaagtacgtatatgagacaattagcacttgtaacggttatgtcgcaaatcggttgtttcgtaccagcaacagaagcagtattacctgtatttgaccaaatctttacgagaattggtgcagcggatgatttaatttcaggtcaaagtacatttatggtcgaaatgttagaagcgaaaaatgcaattgcaaacgcatcagaaagaagtttaattttattcgatgaaattggacgcggtacatctacgtatgatggtatggcacttgcacaagcgattattgaacatattcatgaccaaattggtgcaaaaacgttattctctacgcattatcacgaattgacggtgttagaagagagtttaaatcaactgaaaaatgtacacgtttcagcaattgaagagaatggaaaagtagtattccttcataaaattcaagatggagcagctgataaaagttacggaattcacgttgcgcaacttgcggagcttccagatagcctaatcgctcgtgcgaaagaagtgttagcacagctagaaggacaggaagaaattattattccaaaacgagtagaagtgaaagtacaagaagctactccagaacctgtagttgtaaaagaagaaatagcagaaatacaggaaacgaaagtagagactgaagaagaatcgcaactatctttctttggaggagaacagtcttcgaagaaacaagaaaagcctctgctagatcaaaaagaaacagcagtactggcgcaaattaaaaaaatcgatttacttgatatgacacctttagaagcgatgaacgaattgtatcgcttacagaaaaagttaaagaaaggatgagtaagtagatggggaaaattcgcaaactcgatgaccaactctctaacttaattgcggcaggggaagtagtagagcgccctgcttcagtcgtaaaagaacttgtggaaaattctatcgatgcgaatagtacatctattgaaatccacttagaagaagctgggttatcgaaaattcgtatcattgataatggtgatggtattgcagaagaagactgtatcgtcgcttttgaacgccatgcaacgagtaaaattaaagatgaaaacgatctgttccgcataagaacactcggtttccgcggtgaggcattgccaagtattgcctcagttagtgaattggaattaattactagcacaggtgatgcgcctggtacacaccttattattaaaggtggagacattataaagcaagagaagactgcgagccgaaaaggaacagatattacagtacaaaatttattctttaatacaccagcacgtcttaaatatatgaaaaccattcatacagagctcggaaatattacagatatcgtgtatcgtattgcaatgtcacatccagaagtatcgttaaaactatttcataatgaaaagaaattgcttcatacgtcaggtaacggtgatgtaagacaagtacttgcatcgatttacagtattcaagttgcgaagaagcttgttccaattgaagctgaatctttagactttacaattaaaggttatgtaacattaccagaagtaacgagagcatctcgtaattatatgtcaacgattgtaaatggtcgttacgttcgaaactttgtattaatgaaagcaattcagcaaggataccatacattactgccagttggccggtatccaattggtttcttatcgattgaaatggatccaatgctagttgacgttaacgtacatccagcgaaattagaagttcgttttagtaaagaacaagaattgctaaagctgatcgaagaaacattgcaagctgcatttaaaaaaatacagcttattccagatgcaggtgtaacaacgaagaaaaaagaaaaagacgaaagtgtgcaagaacagttccagtttgagcatgcgaagccgaaagaaccatctatgccggacatcgttttaccgactggcatggatgcaaaacaagaagaaccgcaggctgtgaaacagcctgcgcagctttggcaaccaccgaagcaagaatggcaaccaccacagtcgctcgtgagagaagaacaaagttggcaaccatccactaaaccgataatcgaagagccaattcaagaagagaaatcgtgggacagtaatgaagaggactttgaactagaggaattagaagaagaagttcgggaaataaaagagattgagatgaacgggaatgacttaccaccgctttatccaattggacaaatgcatggaacatatattttcgctcaaaatgataaaggattatatatgattgaccagcatgccgcgcaggaacgtattaattatgaatacttccgtgataaagtaggaagagtagcgcaagaagtacaagagttacttgtaccgtaccgtattgatctatctcttactgaatttttacgtgtcgaagagcagttagaagaactaaaaaaagtcgggctatttttagaacaattcggccatcaatcctttatcgtccgctcgcatccaacatggttcccgaaaggacaagaaacagaaatcatcgatgaaatgatggagcaagttgttaaactaaaaaaagttgatattaaaaagttacgtgaagaagcagccatcatgatgagctgtaaagcatctattaaagcgaatcaatatttaacgaacgatcaaatatttgctttactggaagaactacgtacaacaacaaacccgtacacatgcccgcacggaagaccaattcttgtgcatcattctacttatgagttggagaagatgtttaagagggttatgtagagtgaatagattacatttcaaaagggagcaacatttactgttgctcccttttaatatgtagatttaattgtaaacgagaatatggtggagtaattttgtagtgtatttcttggttgcgttaacttaaatttatctatgtataaaaaagcgctgtatacagcactttttaaaaggtgcatgaattgtatcattactaactaaataactatgcatggccaaatgttgcttcttatttagccaattgtcataaggatctatacaattacttatttttattattattaattttttcagtgtatagaacttgctctttatagtgcttcttaattgggaagttatgtgtacctgtgccgttcttgaattttttgtcaatggggttctttagaggaactgttgtagtttcagtaaattcatatgggtaatttattttagatttatcttcaaacatgaaaatgcctccttttaggatctcctaaattctttactataacatgatatgcatatagatattttttggactagttatttatataggttaatggaatttaattacataactaatgaaacattttaaaggaaaacaatttgagaaagaaatggtatgatagatgttggctcctattgttatttttttgtttaacagcacagtgaattgtgcatataaattcattatagattgtttttataatatggtttatatggggttttcctgataatataatgtggaatattatagtgttattaggttattaggaacatctaatgctgtttcataactgaaagggaattgaaaaaaaactgaaacttttctcataaaaattcaatctaacttgaaaaatgaaaggaaaatgaaattttccaaaagatattctttgttaagataaaaagcatacatacaaaaagcattgacatatcttaaaaatttattttcaagatatagtgggggaaaagatgagattagaaaaacaattaataaaaaagatgtattatgaaacgttcctaatggagaatgaaacaaaaccaactcttgacgtacttggacaagcttatgtaaacgaagaaaaaaatgagatttctgatgggtcttatattcgttttgcacaaggtgaattttattatcgtcatcaagattttgaagcagctatttttaaatgggagaaggttagtaatgaattagcaccatgggcacaaaaaaatattgcggatgcttatttcgaacttaatcaattaccatatgctgaaaatatttatacttccattactactgataataaaatattgatgaccgaaattagattacaattactttctctttacattgagcaaaataattttgattcagctttcggtgttattaaagaagcagtttctttaaatcctgattatccgaacgtcacaaaaattgcccgttccttttatgaggaacagcaagattttgatagtgcagtagagcttgctgtgaatgagttaattcgaatagagtcgtatccgtggtttgaggtgttaaaaggatatatcgataaagggtttactaaacatatttcaccagactatttttatgatgcattagctacattaaataatgtagatcaagtacaatttacacaaatggtttcagcactttggaacagttataaagatgaaccaaattatttattatggcttaatacaataaatgaatttttcttacatattgaaatacattcgtccgatatatggaacaaagtttctgctctttacgaagaaacgtactttacattaattcaaggtcaatatacgcttagacaattagacgatatcataccaaatctgttagcaaactggttaaaggtagtcaatccatcttatgctgtatttccatctgcagctgtattggcatgggatgagattttcccttccaaaatagattcagcaaatatagaacatgcggaaaacttactgtcacattctattaatcatgtaaatggcttagagtacagcttacacctttttgaatctattacacagtgggcacaaaagcagaatatagaaataggtcaccgatttaaatggttagttgacgagctcgcagatttaagaacaaatcgtattttagtaacgggaacttcagggaacggaaaaactacatttattaactctatattaggagaaaatatattagaaaaatcaatttcaaatgtagtagttttaaaaaatgatgctcatatagaaataaacgctataacagactcagcaattacaacaacggaagatgtctctgattaccataatatgatgtctcagcaccatcaaacatatagagatagagcgtgtgttgaatttaaattaccatgcagatttttaaatgaaaataaacttacatttgtagtgacacctggctttaatagaaataacgacactagagatgaaatattcgaatatttaaattctgtagacgaattactattcgtattgaatgcggattcaccttttactgataaagaacgtgatattttattaagtattcaagaacatacgccaaatttacaaattcattttttattaaataaaatcgataacatttacagtgaagcagaagtgaaaagggtattacatgatacggcaacgagaataaacacatatttcccgtatgcgagaattttcccttattcctcgttatatacaagtagtcaacaattaaatggtttaactgagtttattcattttaactttaatcataaaaatatcgatgcagaacgtactgaaaagttattatttttcattcgaaaaacaattacatatcttttggataaacgtgttgagaaagaaaataacctggtggatgctattaattggaatgaagatatgctagtgaaactaaacggtagcattaataaccttactgcatttgaaagggaaaaaattcatttcattacacaatcatatcgttcaatgaagactgaaattacaaatgatcttaccgaaaatattccgaagatattaaagagctgttctaatttaattagtgaagaaagtgatttcgggcacatggatacggaactaaataaagcaatgaatgaaagagtgcataaatatttagaacaaactgtattacctaatcttgctctttctatgcaaaattggattgcaacttctaataatgagcttcttcaaagtcaaacgtatttagaagaacttagtgaagggcttaattcactatttggagaaaataaaatacagttagaatgtgactttaaagtgcttgatgactggcgcagagatactgacaggatgacgactagaatacaaatggatgaagtaaatattttacgtcgatttacgccagcacaatttttactaaaaagtgccggtaaattattggaagttcttcctaaaaataaatctatgctatataacaaatataaacagtatgtagaaaatgaagattatactgaagtaacggcttctattatgaagaaatttttcttgcaatttgagctgtttgaaaacacacaagagagggatattcatatattctttaggaatccatttaactccttaaagcaagctgtagaaaatacgcaattagaaatacaagaaaaacaagagatgttacataaaatgaaatcaaatcctgaagtttatcatgattctatcatgctctttgaattgagattgcgtcaatgtgaagtaattttaaatataggtgatgataatacctatacagatgtagctttagaaacaagtgtagaataaaagtaaaagggagcaactgtaataagttgctcctttttcatatagattatttttctgtttctttaattttagtttgtacttcgccagttttaattttattgctttctgagaaacgtaataaatcgccttcaataattttgtcagacattcgtaattcattttgtgcacgtttaatgagggcttgagcttctttttttggtaaatctacaatttcacctgttatacggtcgtagaaagtgttgtttttgtatgcatacttatctgtaacgaagctaccatcacgtaaaacaacaaagccagtatattcatctgaaaacatatcatggccaaaacggatatcattcgtagaatcaacacctaataaatttagaatcgtaggtttcatatcgatttgtcccgtaggctttgaaatagtttgaccttctgtttgtccaggaatatgaatatataaaggtgtacgttgtaaatttaaagtatcaaattctgttatttgatctttttctaaaaactgtgccattgcacgattatgtttttcggaaattccataatgatcaccgtataacacaataatagaattatcgtaaagcccctcggcctttagacgttcaataaattttttaatggattcgtctaagtaacgtgctgttacgatgtaacgatcaaatacgccattaccagagttgtatggttcaatgaattttgtatcttcatcatacgtaaatggataatggtttgttaaagtaaggaaacgagcatagaatggttgattaacagtttttaatatatctactgattgatcaaagtattcgatatcttttaatccccaatttaaatttgtttctggtgtaattttgtaatcaagctcattatagtaacgatcataaccaagagcagagtacatgatattacgattccaaaatgttgcgttattcgcatggaatacagaagtgaaataaccttgctgacgtaaaatttctggagttgcagtataatcattgttaccgtgtgtgaagaatacagctcctcgatttaatggatacaacgacgtatcgattagaaattctgaatcggatgttttcccttgaccagtttgatggaaaaagttatcaaagtaataactttcatttatgaattcatttaggaatggtgtaacttcttgcccgttcactgatgcgcctattaagaaggtctgcaaggattcaagagtgacgacaattacgttttttcctttcgctgcaccaaacatattagggtttggctcgctttgatttgcttttacgtagttttcagtttcttgtaatttactactatcagcaagtgctttttgtgacccagcttttacttgcagtgttaagtcatatacttggtgagtatataagcctaaatttttgacaagcatgactcggtcgaatgatcttgttaataattcagggcgctctttttctgcaagatgtagattcgcaaagaatacaccaatcgttaaaagaaagtataacaagcgcgtagaatgagttacacgttctgttttaaagaccaatgatttcttttttaataaaataaagaagaaaacaatgtctacgaatgcgagtataattttgtagtttaatatttctataatactgccgcctaattggccaaagtttgaggtttgtccaagtactggtaatgtaacgaaatcactataaaaatcatagaacattacatttccaacaagcacgattgttaataagaaattaatacagagcgctatataatttcgcttttcaccagttgcaaataatgctaatccaacaaatgctaatgatgcggctagagggctaataaacaaaatgagctcttgcgttgaagactcgatttttaaatcaaaactgaatcgcgtaataagatatgtttttaaccatactgctaaagccattattataacaa

SEQ ID NO: 1352 - DNA, 11870 bp, Bacillus thuringiensis
cataaatttcaaattttacgaaaattgaatctgatttctcttatcaagagaggtggagggactgtgccctgtgaagcccggcaaccgtcaacttatgttgaaatggtgccaattcctgcaaagcgaatgctttgagagatgagagagagggataatgttgttatatacgcatataaacctttctgcttctctaaagcagaaaggtttttttattgtttgaatgtggaggacattcaaataataaaagtaatgataacattggactacacgcattaaaaataaaaaattgcggagtcgatccaaacaaaaaaggggtgaacatcatgattctattagagaacgtaaagaaaatatataaggcgaaaagcggtgatgtcactgctgtagataacgccaatttaaaaatagaaaaaggcgaaatatttggtgttattggatatagcggcgctggaaaaagttcgttaatcagattgtttaatcagttagagaaaccgacttctggccaaattacaattgcgaatcgtgttatatcagcaattacaggaagtgaacttcgtaaggcaagacaagaaatcggaatgatttttcaacacttcaacttactttggtcacgaactgtacgtgaaaatattgagtttccacttgaaattgcaggtgttgataaagcgaagagaagaaaacgtgttgatgaattaattcatcttgttggattagaaggaagaggagacgcgtacccatctcagctgagtggaggacaaaagcaacgcgtcgggattgcaagagcattagctaacaatccacaagtgcttttatgtgatgaagcaacgtcagctcttgatccggaaacgacagatcaaattttagatttactattagacattaataagcgtcttggtttaacaattgtactcattacacatgaaatgcacgtgattcgaaagatttgtaaccgagtggcggtaatggagagaggaaagattgtagaaacaggtccagtacttgatgtattccgtaatccgaagcaagatattacgaaacgatttgtacagcagttaacagattctgaagatacaaatgaaacaattgaaaatttaattgaaaaatatccagatggaaaagtaattcgtttgcagtttatcggtgaggctgtagaaagaccagtgcttcaacgattaatgcaacgcagtgatatagaagttagcattttgcaaggaaatattgcacaaacgaataacggttcttacggtagtttagttgttcatttaaatggtgaggaaacagcgatccagcaagcaatagaaggaattcatcaagatcaagtagagctggaggtgattgcacatggataagttactcgcaaatgttgattggaatcaaatgttagaagcaactggtgaaacgttatatatgacggcaatcgcagcccttgcgacatttgttttaggactaattttaggattgttactcttcatgacagcaaaagataatttatgggaaaacaaatcaattaatacggtgattggagcattcgtaaatatattccgctctataccgttcatcattttaattattttattaatcccatttacaaagattcttcttggaacaattcttggagcaagtgcagctctgccggctttaattattggagccgcaccattctacgcgagaatggtcgaaattgcacttcgcgaaattgataaaggtgtaattgaagcttcaaaagcaatgggagcaaaaacaagcacaattattttgaaagtgttaattccagaatcattaccagcattagtatctggtattacggttacgacaattgctttagtaggctatacagcaatggcgggagttgttggtgctggtggccttggaacacttgcttacttagaaggattccagagagggaataacgatgtaacaatcgttgcgacaatttgtgtattactagttgtatttttaatccagtggattggtgatagtttaacgactcgaatagataaacgataataaaaacgggaggatattttaaatgaaaaaattattacttacggcacttatttcaacttcaatttttgggttagctgcttgtggcgggaaagataaagatgaaaagaaacttgttgttggtgcttctaacgtaccgcatgctgaaattttagaaaaagcaaaaccgttacttgagaaaaaaggaattgaattagaagtgaaaaaattccaagattacgtgttgccaaataaatcgttagcggataaggaattagatgcaaactatttccagcacattccatatttagaaaaagaaattaaagataaaaaatatgattttgaaatagcagggaaaattcatattgaaccaattggtgtatattctcaaaaatataagagtttaaaagaacttccagacggggcgacaattattatgagtaattccgttactgaccatggacgtggtttagcaattttacaaaaagaaggcattttaaaaattaaagacggagtagatccagttagtgcaactccaaaagatattgcagataatccgaaacacttaaaattcaaaacggatattgagcctggtttgttgccacaagtgtataacaataaagaaggcgacgctgttttaattaactcgaactatgcaattgatgcgaaattaaacccagaaaaagatgcaattgcaattgaaggcgatgattctccatacgcaaacgtactagtggttcgtaaaggtgataaagataaaaaagcgattaaagagcttgtagaagtattacattctaaagaaattgaagactttattactaaagaatataaaggtgcagttgttcctgtaaaagaataattgctgaaaaagggctggtgtatgccggtccttttttactacataactatagggagaaggggacgtcatatgaaaaagattctattgtcagttgttacagcattatctgtatttacattagctgcttgcggagggaaggaagagaataagcttgttgtgggagcttctaacgtgccgcacgctgttattttagaaaaggcacagccgatattagagaaaaaaggcattaagttagagattaaaaagtttcaggattatgtactgccaaataaagcgttagcggataaagaaattgatgcgaactacttccagcatattccgtacttagataaagaaattcaagaaaagggatataaaattgtaaacgcaggaaaaatccatttagagccgatgggtatttattctaagaagtataaaagcttaaaagacttaccagatggcgggacagtgattatgagtaataacgtagcggagcgtggccgtatgctagcactgttacaaaaaggcggcgttattaaattaaaagacggagtagatgttgttaaggcaacagtaaaagatgtagtcgaaaatccgaaaaacttaaagtttaaaacagatgtagagcctggattgtcaccaaagctgtatgaaaataatgaaggtgatgctttatttattaattcaaactatgcaattgatgcaaaattaaatccaacaaaggatgcaattgcgattgaaggagcggactctccgtatgcaaacatcattgcagttcgtaaaggtgatgagaagaaaaaagaaattaaagagctagtagaagtgctacattcaaaagaaattcaagattttattaataaagaatataaaggtgctgtacttccggtaagtgaataaatataaggaaagggctggaaaattaccagtccttttttctttatataaataagaagaaaggtgtatcatagaaagatgtgaaggaaatacttatatacatttgtgaaaaaacggttactttttttcgtcgtttgcgatatcattttatttgatataaaattagaatgagaataaaatgagaatatgaacgttttaggaatttttaaaatgtatatataggattaatggaggtattgagatggctggttctacattaacggttaaagacttacacgtatcaattgatggcaaagaaattttaaagggtgtaaaccttgaagtaaaaggtggagaaatccacgcaattatgggacctaacggaacaggtaaatcaactttatcttctgcaattatgggtcacccaaagtatgaagtaacagaaggtagcatcatcatcgacggtgaagatgtattagaaatggaagtagacgagcgcgcacaagcaggtctattcctagcaatgcaatatccaagtgaaattagcggagtaacaaacgctgacttcttacgttctgcaattaacgcacgtcgtgaagaaggcgatgaaatttctcttatgaaatttatccgtacattagataaaaacatggaattcctagaaatggatccagaaatggcacaacgttacttaaacgaaggtttctctggtggagagaaaaaacgtaatgaaatccttcaattaatgatgattgagccaaaaatcgcaatcttagatgaaatcgactcaggtcttgatatcgatgcattaaaagttgtatctaaaggtattaacgaaatgcgcggcgaagagttcggttgcctaatgattacgcattatcaacgtttattaaactacatcactccagacttcgttcacgttatgatgaacggtcgtatcgttaaatctggtggccctgagcttgcacaacgtctagaagctgaaggttacgactggattaaaaaagaattaggtattgaagacgaaacaacagagcaagaagcgtaagagaggagcataaacatgacaatcggtacattacctttcgatcaagaaacaatccgtcaacgcgcaagcgaagtaaacgaagctgcttggttgactgagttccgcttacaagctcttgcacaagcaactgaacttccaatgccaacgcctgataaaacgaaaattgacaaatgggactttatcggaaaaggcgacgctgctaagcaagagcctgtaagttctttaactgaacttccagaagcagtgaaaaacttaatcgatgaaaataacagcgtattagtacaacgcactggtacaactgcattcgtttctttagcagacgaagcaaaagaaaaaggtgttatttttacagacatcgtaacagcagcaactgagcatgctgaactagtacaaaagtacttaatgaaagacggcgtgaaagtagacgagcatcgtctaactgcacttcatgctgcattaatcaacggtggtgcattcgtatatgttccgaaaaacgttgttcttgaaactccacttcaagctgtattcttagtagacggcgaagaagctaacgtatataaccacgtactattcgtagctgatgcgaacagtactgcaacttatgtagaaaactatgttgcaaatgaaaatgctaaaggtattgcaaatatcgtagcagaagtaatcgtggaacaaggcgcacaagtgaaattcggtgcagttgatctattagcaaaagacgtaacaacttacgttaaccgccgcggcgttgtaggacgcgacggccgtattgattgggctctaggccttatgaatgacggaaacacaatttcagagaacgttacgaacttaatgggcgacggttcatatgctgatacgaaaacagtaacaattggccgtggcaaccaaacacaaaactttacaactaaagttgttcacttcggtaaacattctgaaggttggattttaaaacacggtgtacaaaaagatagtgcaacatctatctttaacggaattggtaagattgaacacggtgcatctaaatcaaatgcacaacaatcttctcgcgttcttatgttagatgaaaaagctcgcggtgatgcaaacccaattcttttaatcgacgaagatgatgtaatggcaggtcacgcagcttcagtaggtcgcgtagatccagtccaactatactacttgatgagccgtggtattccaaaacgcgaagcagaacgtttagtcatccatggattcttagcacctgtagttaatgagcttccaattgaaggagtaaaggcacagcttgttgaggtaattgaaaggaaagttcgctaatgaatattcatgaaatacgcaaacagtttccaattcttgatcaaaaagtgaacggcaaacaacttgtttatttcgatagtgcagcaacttctcaaaaaccaattcaagtcattgaaacgttagaacgttactataaagaatataattctaacgtgcatcgcggtgttcatacgctcggtacgaaagctaccgacgcgtatgaaggtgcacgtgagaaagttcgcaagtttatcaatgcgaaatcaatggaagagattattttcacgcgcggaacgacaactgcattaaatacagtagcggctagctatggtcttgaaaatgtaaaagagggcgatgaaatcgttatttcttacatggagcaccatagtaatatcattccgtggcaacaagttgcgaagaaaactggtgcaactttaaaatatcttccgcttcaaccagatgggacaatttcaatagaagatgctcgtcaaacaattacaccgaatacaaaaatcgtttctatcatgtatgtttctaacgtacttggaacgattaaccctgtaaaagaaatcggagcaattgcacacgaaaatggcgcaattatggtcgttgacggtgcacaaagtacacctcacatgaaagtagatgtacaagatttaaactgtgatttctacgcattatctgctcataagatgtgtggccctacaggtatcggcgtattatatggtaaaaaagaattgctaaacaatatggagccaattgaatttggtggtgaaatgattgatttcgtagatttacaagaatctacttggaaagagcttccgtggaagtttgaagcaggtacaccgattatcggtaatgcaatcggacttggtgcggcaattgatttcctagaagaaatcggtcttgataatattgaaaagcatgagcatgaattagcgcaatacgctttagaaagactatcagaagtagatggcgttacaatttatggtccaaagcatcgcgctggtcttgttacatttaatattgaagacgtacatcctcacgatgtagcgactgtattagatgtagaaggcattgcagttcgcgcaggacatcactgtgcacaaccgcttatgaagtggctaaaagcttcttcaacagcacgtgcgagcttctatttatataatacaaaagaagaaattgatacatttgttgactcgctaatcaagacaaaggagtatttcacaaatgtcatttaataatttagatacgttatatcgtcaagttattatggatcattataaaaatcctcgtaaccatggcgtattagaagatagtgttaccgttaacttgaacaatccaacttgcggcgatcgtattcaacttacgatgaaagtagaagaaggtattgtgcaagaggcgaagtttgaaggcgaaggatgttcaatctcaatgtcttcagcttcaatgatgacacaagcagtaaaaggtaagaaaattgaagaagcacttcagctttcgaaaattttctctgacatgatgctaggaaaagagtacgatgacagcatcgatttaggagatattgaagcattacaaggcgtatgcaagttccctgcacgtattaaatgtgcaacattagcgtggaaagcgttagaaaagggcttaaacgaagataagtaatgttaaaggttcctaaaaacgaggttatctaaggagggacacaccaacatggcgaagcaactgccagatatcggcgattataaatatggtttcaaagacaaagacgtttcgattttccgtgctggacgcggtttaacaaaagaaatcgttgaagaaatttcacgtatgaaagaagaaccacagtggatgttagacttccgtttaaaatcactggataagttctacgaaatgccaatgccacaatggggcggcgacttaaacgacttagatttcgatgaaattacgtactacgtaaaaccatctgagaaatctgagaagtcttgggatgaagtacctgatgaaattaaagcaacatttgataaattaggtattccagaagctgagcaaaaatatttagctggtgtatctgcacagtacgaatctgaagttgtataccacaacatgaaagaagacctagaagctctaggaatcgtcttcaaagatacagatagcgcattaaaagagaacgaagatattttccgtgaacatttcggaaaagtaatcccaccaacagacaacaaattctctgcattaaactctgcagtttggtctggtggatcattcatctacgttccaaaaggtgttaaagttgatacaccacttcaagcgtatttccgtattaactctgaaaatatgggacaattcgaacgtacgcttatcattgtagacgaaggcgcacacgtacactacgtagaaggttgtacagcacctgtttacactactaactcacttcacagtgcggtagtagaaatcatcattaaaaaagatgcttattgccgttatacaacaatccaaaactgggcgaacaacgtatacaacctagttacaaaacgtgcggtttgtgaagaaaacgcaacgatggaatggattgacggtaacatcggatctaaattaacgatgaaatacccagcagttatcttaaaaggcgaaggcgctcgtggtttaacattatctatcgcgattgctggtaaaggccaacaccaagatgctggtgcgaaaatgattcacttagcaccaaacacgtcttcaacaatcgtttctaaatcgattgcgaagcatggtggtaaagtaacttaccgtggtatcgtacacttcggaccaaaagcgaaaaactctcgctctaacatcgagtgtgacacgttaatcatggataaccaatctacatctgatacaattccttacaacgaaatcaaaaacgattacgtttcacttgagcacgaagcgaaagtatctaaagtatcagaagaacaattattctacctaatgagccgtggtatttctgagcaagaagctacagaaatgatcgtaatgggcttcattgaaccattcactcgcgaacttccaatggaatacgcagttgaaatgaaccgcctaatcaagtttgagatggaaggttctattggttaaatagaaatgcggagccgactgttcagacccgttggctaaggttctttcgcacagaagatgctttttatcttctcgtgcggaaggttcttagacatgagggtctaggaggcaaagctggataatatatgtatgaagaaagcgccctgctgtgcagggcgcttttttgttttgcggatttgtcttggcttgggagaggatacccgggtgggtgttcagttaaatatatcagcgatttttcaaatatatcgtccataactcgaaatatatcagcgattatttcaatatatcgacgattcgacaagggatatcgacttatcaacaaattacgacatagcaagaggaacgaataccccgtacccttcaaaaaggaaaggagcatttatacataaagagggcaactgaaagtaatttagattaaaatactgacaaatgcagcaaagaacttatgggaaaatccccacggctaactttctgacaaatccccgctctaccaacaaatccccacactggcaaaaataaagtttctcatataaaaaggacaatcttttgctttttctcacaatgcgagtacaatgtaaaatagcaagaaaagacgaaaagtatttacaggattattgtgtgcgcatagcgtaaatggcagtaaggaactgagaggaggttttttctctgaatacaaataaagaaacaatcatccacctttatcatacaaacgatatacatagtcattttgaaaattggccgcaaatttctcggtttgttctaggggagaaaaagcgaagacaggaagcgggagagactgttttgacggttgatatcggcgatcatgtggatcgttttcatagtatttcggaagcgacgaatggacttgggaatacgaagcttttgaatgaggcgttatatgattatgtaacgatcggaaataatgaaggaattacgttagcgaaggagcatttgaatcggctctatgatgatgctggatttgaaatacttgtcgcaaatttatttgaaaaagaaggggtacgtccgtcatgggcaaggccttataaattgcatacaacgacggatgggattaccattgcttttatcggattaacggtagcttatccagagttttatcagatgctcgattggcatattgaagatcccattattcatttagagtctattttagaagaagtgaaagatgaggctcatattacggttgtcctttctcaccttggaaaaagtatggatgagtatatggcagagcattatgatatagatgttattttaggagcacatacgcatcatttatttgagcgtggtattctactgaataatactttactttgttgttgtgaaaagtgggggcgttacgttggtcacgtgcagcttactgtggatatagagatgaagaaattgctgaaaaaagacggtagggcgattaagacggaacggttaggtgcttatagcgagccgttatccacaattgaaatactgcaggaagaaagtgagcatataatggcagagtctgtcgttcatttaaaagagtcattaccggttgattggtttcatgagacgccgttttctcacatgttagcaagtgcgctgaaaacatggtgcaatgcagagattggcatggtgaacgctggtgtacttcttgaagggttagaagagggtgttgtaacgcgcggagatattcacagaatttgtccacatccaattaatccgtgtgctttgaaagttccaggaaagatattaagagaagttattttgaaagcacgtaagccgaatatggagaatcttgaggtgaaaggattcggatttcggggaaaagtgatggggaaaatgatttacgctggtgtagaagtcattccagatacgattcccgggaataaaattttactcgaagatgtattaattaacggggaatcgctggaattagatcgtatatatacagtaggaacgattgatatgtttacatttggctacttatacccagagctatccacactttctgacaaacaatattatatgccagaactacttagagatgtgttaacagatatgttaataacttatacatcttccgttaaactataggctagttaacttgtaacactcatttttctcttgtcatacagataagaaagagaggagtgtgaactatggttaatgtggagccaattataattgataattatacgtttattgcagttagcgtgaaacttccaaagacgaatttgctagctgtaatgagcgataaaggatatattatgtgtggtgcattagatgtaggtcttttaaatgagaaattaggtgatcgaggaattattgctggccgtgcggttggtgtaagaacgattgaacaacttcttgaagcgccactagaatcggtaacgactggagctgaagcattaggcattccagcaggtacgattggaaaagaagcattattaaaaatgagataagcatatatcgtccctccttcttgcatagaaatgatataagaaggaggtttttttatgagtatatttcgctcgaaaaactcgcggtttcgaaggggacctattgcctttcggtatatactgcttatgtcgtttattctttttgttatattacttacgcaagggttgtggattgtgaataataatattcagccgaccttaattaaatatggggaagtagagacacataaaatggcgacggcaattatgacgaaggcagtaaaggatcgaattaatgaaggattcg

SEQ ID NO: 1353 - DNA, 13079 bp, Bacillus thuringiensis
aatataaagcattgggatgattcaagatcatctatccctgttatatcaagcgatacagagaaacacccgtataataacaaaggttttaatcggcctgtttcccctactaaaaaaaaatggccggaaatcccatcgatatgagaagaaaactatctttgatattatgggtgttgtctatgagtataatggattgagaaaacaaaagaaagctgcataagaaaaaaatgaaacccgttagggtttatttcgtatgctcatttttaagaggattatactgtttaaaagtttgttcatttcaattaatggaaaaccgtagagtttctatccttaagttgatgggcatggggcatggccatcaactaataaaataataaaattaaaacacccttgcttgcagtaataaagtgaaagggtgttttaatttacgtctacaaacgagaaaaagcagttaaaataaagtaataaggtttacttcaggaaaataaggtatattatatttgttgagtagattctctttagagacaagaaaagtaggtgaacaaagtgggaaaatatcaattggattccaaaagtcaggtagctgtggcaaagttccatgaaaaacagaagcctgccaaatttgataaaaagcagcaacttgaaaaattgcgtacggagtatttgaaaaagaagcaaaaacaaacagataaataatatgttttattttccgaattttttctgtatgtaacgcaaacaaacacaagaaaataggtaagttattcatcattcaaatatatacaggctattttttcaaacctcttacttatgcaactaacgcatgcgtcagttcattaagaataactaaaaaagtcgattccttgagatgaaaaagagtaaacagtgcccttatcaggcactgttttattttgccattataatttcctccactgatttaggtaagcgatacaagctattccccacctccaaaagaatgaatcaagttcctcaccgcatatattaaactataccttttcttaaggagggctaccttaatgcgtactcctttatcctttgataaagaaactgccatactgttagcttcttgttgtgagttaacgtatgaacaatataaacaaaatggtattttcgaaataccagatggttttcaatatgtacaaggttttcaaggaaaggccattcaaacaacagaatggttcggatttatattagaatctgaggatacaattatcgttgccttcagaggcactcaaacagatccagattggattattgattctctcgtcaatcaaaaaccttatccttatgctttaaatggcggaaatgtccataacggttttctctctatttatgagtcttgtcgtgattctattatggatatgctcgtatcattgccagcacataaaaaactgctagctactgggcatagtctaggtggcgcgcttgccacattacacatattagatgcacgtataaatactgccttcgcacagtatggactttatacattcgcttctccaaaagtaggagatatcgcttttcgaaattattataaactacaagtagctagtagctttcgtttcgtcaacttattcgatgtcgtcccacttctccctccccgaaacataaattttaatgatcatgattgggagtatgcacacgtccatcacaacatgacatttacaaaaaacacaaaatccattacaaataatcattccattacaacatacaaaacatgtctgacttctcatttttaaccagtaaacaattggaaataaaatattcgtatactataataatctatgaagttatttttggatgaggggaccttacatgttaaaatttatcttcgcatttttccttattgtaatttttacggttacaggtttctttacattttcatactttgcgacaggagagtatgatggggcaggtatcatatataccactgttccatttctttcttaagcaaaataaataaaacgagcttaattttattaagcacgttttatttattaatatccatttctgttggtaaatcgataatatatctcccaatatagcaacctctttaaaactgtttaactgcattaccaataccccaaatttcattactgtactgcaaaatcgttcgatcgctcgcaaaatgaccagactgtgcaatatttaaaatcgacatttctagccacttcgttcggttctcataagctctaccgacagcttcttgtctttcagcatatggaccaaaatctcgcagaacgaaatattcatcattttgaataacgagagaatcgtaaattgcttcaaattcggctcccgactgtgcaaagaaaccattcgttaactgatctactacctttttaatgtgcccattgtggtgataataatcacttgcacgatatccaccattttgatagtaatgaagaacctcttcggctgttaaaccgaaaatgaaacagttatcatcaccgacccggtcttttatttcaacgttagcaccgtctagcgttccgagtgtaatcgcaccattcatcataaatttcatattacctgttcccgatgcttctttactcgccgttgaaatttgttcacttacatccgctgccgggaatatatcttctgctaaagaaactcgatagttttctagaaagataactttcatatattgactgacatacgggtcattatttacttttcttgcgagttcatttattaatttaataatttttttcgcgtaataatagccaggtgatgctttcgctccaaaaataaaagtacgcggataaaatgtaaaactagcatcctctttcaaacggttatacaaatataaaatatgaagaacatttaataattgtcgtttgtaagcatgtaatcttttcacttgcacatcaaaaatagaatttggatcaatggtaatccccattgtattatgaatacgctccgctaaaatctctttacgctcttgttttacctctgcaaatttctcttggaaactcgcatcatattgaactaattgtagctcttgaagcttaatcggttctttcttccactctgttccaatcgcctctgaaatgagatttgttaactgtggatttgctttcataagccagcgcctatgagcaattccattcgtcttattattaaacttatctggataaaattcataaaacaatcgcatttcccgctgctttaatatttccgtatgaattttcgctacaccgtttacgctatggctaccgacaatcgctaaatgagccattttcacaaggtcatgtgcaataatcgccattgcttcaatacgatcccactcatacggatactgttcccacagttcatgacagaaacgttcattaatctcttcaataatcatataaattctcggtaataacggtttaaaaatgtgaattggccacttttcgagcgcttctgataacgtcgtatgattcgtataagaaatcgtctgcgtcgttatgtgccaagcttcttcccatgctaacttttcttcgtctagtaaaatacgcatcagttccggaattgctaaaaccggatgtgtatcgttaatgtggatcgcaattttttcatgtagttgacgaaggtcaccatatctttctctatgcattcgaacgatattttgcaaacttgctgatacgaggaaatactgttgttttaaacgaagtatttttccctcatcatgcgtatcatctggatataaaaactccgatacagcctctgtttcacgcttatatttcaaaatatctttgcagttttgcgggaaaggaactggttcagcattccaaagtctaagtgtatttacagtactcgtctcatagccaactaccggcacatcatatggcacggccataatgacttctgcatttgtatgcctaaactctaaacgcccgtcaatttctagcggttcaacattgccgaaataacttacttctacagcttgatcatgccttcttacttcccatacgttttcatgaagaagccactgttctggaaattcgacttgataaccatcaacaattttctgatcaaacaaaccatgtttataacgaattccacagccgtgtcctggcaagtttaaagatgcaagtgaatcgagaaaacaggctgctaagcgtccaagcccaccattaccaaggcctgcatctgcttccacttcttctaactcttgtaacgaaatccctagttcagataacccttgctcgcatacatctctaatacctaaattcaagatgttacttccaagcaaacgtccaagcaaaaactcaatagacaagtaatacatttgcttttgctctccggatcgataactctcattcgttgcaatccattgactattcatatactcacgtaccatatggccgagtgtattatattgatcacgagttgtagaatctttaaaacttttaccatacatcgtctctaacttttctagaaaagttgatttaaaactttcaacatgagtaaacattttttcaccacctacatgttattccatgagacttttatacaattccttataagcaagagccgattgctcccagctataatcttcagtcatcgcttgttttacaagctgctcccataccggtttatcgtgatagaattcaattgcacgatgaatcgtatgcagcatgtcatgtgcattaaaattcgtgaaactaaaaccatttccttctccagtttcttcatcataagaatgtaccgtatcgtttaatccacctgtttctcttacaattggaatcgtaccgtatgctaatgcgataagttgtccaagtccacacggttcaaacagcgatggcattaagaataaatcacttcctgcatacacttgatgagctaattcttcattaaatccgatataaacttttaccttctccggatactcatatgccatccattcaaagaattgctcatattccgaatcacctgatcctaaaataatacattgtacatcttcttccattatttcgcggaatacagtacgtactaaatcaagacctttttgcttcgttaatctcgttaccattgaaataattggtgtatcctctttttctggcaaaccaaaataacgctgcaaggcgcgtttattttcactcttttcatataatgactctgcatcatactgagccttaatatacgaatccgtttctggattatatacgctcgtatcaataccatttacaatgccgctaagcttatcattatattttcgcagtaatccatctaacttctcaccgaaaaattcatattgaatttcttctttatatgtcgggctcaccgctgtaatttgatccgaagcgataataccgcccttcataaagttcacattcccataaaactctaactgctcactgtggaaatattcatcaccaagttctaacaagtcgtacattacttcaggaggaaatacaccttggaactgtaagttatgaattgtatataccgttttaatacgctcatataacgggttatcttgatacttttcacgaagtaagaaattaaccatagccgtatgccaatcgtggctatgaagaacatccacttcaaaatcaaggtgcggaatacactctaacaccgcttttgagaaataagaaaaacgctctccgtcatcataatgaccatacagagaatctctcttaaaataatattcattatctattaagtaatacgtaattccgtcttgctcaccttttaaaattccacaatattgatttctccacccaagcgggacgttaattactttatgtaacgtacatccatctcttaacttttgcggaatgaggctataattcggaagtataatacgaacgtccactcctaattttttcagctcttttgggagcgcacccgctacatcagctaatcctcccgatttcacaaacggtacacattctgatactgcaaataaaatattcacttgttgtcccactgcgcgaaaagtttttattactcctcttgcagcttcctcccttcgagttttcatttgaattaaaactttaatcagtggaggaaaaagcccccactgattcttttaagaataactattaatcgtactgttttgtacgcttcctttttctacaacatacggcccatcggcgtttccttttaatacgacaccgtcaccaattttcacatctttatcaataataacaccatctattatacagttatctccaatttggctcttttgcataataatactgttacgaataattgaaccttttccaattttaactgaacgagaaacaacactgttttcgacttccccttcaataatactaccgtttgcaatcattgtatttttcacgactgcaccctttaaataacgagttggtggctcatcttttactttcgtaaagatcggtgcttctttcttaaataattgcttccaaatagcaggttgcaaaatttctaagctatgtttatagtaactttcaatcgagtcaataattgctacatatccagtatgttcatatgtagcaatgtgtaatgatttcccgcgcttttctctcactacatcaaataaactgtattgttccagatctttatatgactcaaataagtctaacaataattgtttctttaacacatatgtttgaagtgaaaccccttcatggcaaacttccgtaatatcagctgccgtatgtatatgtcgctctaacaccgcttgaaaatttaatgctgttacgagatggctattcgtaataacaacgtactcttctctgcttcttagaaaataatcaatatgtcttctaaagtgtgcaaaagacccaaattcatcttggtcacattggcagtttggcgggaataaaaatagtccgtctcgttttctatctaaatcccactgttttcctgaaccaacatggtccattaacgaacgatttttatggcttgtaaaaactgccacactatgaatactagaattcaccatatttgaaagcatgaaatcaatgagtcgataacggcccccaaacggtaacgccgctagtgaacgatgccctgttactttctttaaggaaggaaaacttcccgttgcattaataattcctaacattttttctcccattcatttcatcccccttttctatttcccttcagcaattaatactacatcgtcaacattcttttctggacgaatgattgttccatcctcgataaccatttctgatccaacaatcgctctttcaatcacaacatttttaccaatcttagcccctggcataacgacagaatcaatcaccatacttccttcttccaccgtcactccttggaataacacagaatgcttcacgtccccttcaatgacgcacccttcgttaataagcgattcttctactttcgccttttcagcaatatattgaggcggttcgtttggattgacagagtaaatacgccaattacgatcgtttaaattcagtgatgtttcatcgcgaagcaaatccatattcgcttcccataagctcttcaccgttccaacatctttccaatatccttcaaacggatacgccattagcttcttcccttcatccaataaaaggggaagtacgtcttttccaaaatcgttactagattcagggtttcttgcatccatctctaaatactctttcaaaattgaccaattaaaaatatagattcccattgatgcaagattacttcttggaaattgtggtttctcttcaaactcaacaatctccatttcttcatttgtattcataatgccaaagcgactcgcttcatcccaaggtacttcaataacagaaatggatacgtccgattctttctgaatatggtaatctagcatcttactgtaatccattttataaatatggtcgcctgataaaatgagaacatactccggttcatactgacttaaatagtttaagttttgataaatggcacttgccgtacctgtataccacttaacccctgaagactccgcataaggaggtaagactgtgaccccaccgtttactcggtctaaatcccacgcatttccgattccgatataattatgaagttcgagtggttgatattgcgttaaaatcccaaccgtttcaataccagaattcgcacagttacttagcgtaaaatcaataatgcgatatttaccaccaaatggaacagctggcttggctaaattctttgttaatgcacttaaacgactaccttttccccctgctagtaacattgctacgcacttttgtttttgagccatcttgttttttgctcccctttctcgtcttcactggtcgtaatatggatacgccaaatggtggaattgtaatctctacatgtgctgcttgattatggtacggttctagaatcgtcttaagacgtttcttattcacttgtcccgaaccgccatattgctgtgcatcactgtttaaaatctcgttataatactcgaaatctggtacacctactttatagttttcatatgtagctttcgtaaaattacatacgataactaacgcatcttcttgtttatccccttggcggataaacgagaaaatactttgctcgttattattagcatcaatccactgaaaaccttcaggcgaatgatcaagctgccaaagtggttttgagcgcttatacaatgctatgagctctttaaagtaatcatgcatataacgatgcatttcaaaatcatgtaaattccaatctaaatcttcaaggtctttccactcatcaaactgcccgaattctcctcccatgaaaagtaatttctttcctgggtgagtaaagaaatatccatataataaacgaagctgagcaaacttatcccagtaatcacctggcattttatttaataacgactttttcccatgaacgacttcatcatgagaaaggggtaatatgaagttttcagagtaagcatatagtaaagagaacgtcattttctcatgaatatattttctgtactctggcgcacactccatatatttcagcacgtcattcatccagcccatattccatttgtaattgaatccaagcccaccttcatacgttggtgctgttacaagtggccaagctgttgaatcctctgccgtcataagaaaatcttcatcctctgcaaacactgcttcatttaactcccttaaaaatgacacagcgtactcattactttgctcttgtccttctttattccagtacaacatgttcgcaactgcatctactctgaaaccatcaatatggaaatatctcatccaaaataacgcatttgaaattaagaaattacgtacctctctctttcctaaatcaaaattgacagttccccatactagattttcttgtacatctttatctttatattcataggtcggtgtgccatcaaacaaatataaaccgtgagcatctttacaaaaatgccccggtacccaatctaaaatgacaccgattccatatttatgacattcgtcgacaaaatacattaaatcatgcggtgtaccaaatctactcgtcgctgcataatatcccgttccttgatatccccaagaacgatcatatggatgctcaacaagcggcataatttcaatatgtgtaaattgatgttccaccacatacggaatgagttcttctgccatttccctgtaagaatatagtgttccatcttctttctttttccaagaaccaaaatgtaattcataaactgtcatcgcttctttataaatcggttttttctttttcttacgattccagtttttatcattccattcatatccttttatatcaaaaactacagatgccgtattcggtcttacttctgcatatatagcatacggatctgcctttaaaatgacgtcaccagccaacgtttcaatcgcatatttatatatttctccttcttcaatatgcggtataaataaggaccaaatcccttcttctgtcacttgtagcatcttatgttgctcataatcccactcattaaaatctccaacaacactcattgctttcgcatgaggagcccagactgtaaatcgtaccccttgaatctcatcttccgtcacaacatgtgcgccaaagatgttataactttcatagtacttttctgtatgaaactcatctcgtttcacttcttcacaatttattacactcaatatgttcacctcacttagatgacagaattttttatactttaactatttctgcgaaaaactgcaatatccttgttaatttataaaaaacattcgtttttttcttaaaaatgttagtttttcttcacatttccgtgtaaaatatcgaattttgacgaatattcattgaaaacgctttattattcttctatatttttaccaattattttttctcaacctttattttattatgtttatcctatttttcatgctattttccactcaaaatcaaaacaaaataatctgtcataaaaaaatgtttctcaatattttttgtcacaatgttattgaaatgcgaaatttaatcctgcttttgaaaagctactttccgaaaaaggagtaactgcaaaagtaaatgaaccgaaattagaggcaggttctgttacagttggcggcgctatcgatgacaaaaactttgctggattagatggtgatttcccgttcattgatgtaactttcaaagtagaaaatgatgaattttatgaagcaaacgctcaattagagtcaccaatttttgtttactggaaacaaggtgaatcagaaccaaatagaatgcgtgtacttcaagatcaaacattctcagttatgtccttaaactcactagtagaaggaaatattaaacctggtgcgttcttaaatgaacgcgaatatttagatgaaaagttcgattatacaaagcttggcgtaaaagtatatgcgactgattctttaccgtcataagtttgaaggctcactagataaatacggatacttcaaactaaatggacttccagttaataaacgcgactataacttatatgtagaggtgacaggacatttaacaaaccgcctaacaacgaaacttggtactgaaaaagacggtaagctgcttggccaatattattatgcaagacctgacgaaaaccttgccggcgatgtaaatgctgataaagtaatcgatattaaagatgctgaaattatcgctagcaactatggtaaaaaaggactaactgtaaaagacggagaccttaataaagatggtattgtcgacgaaaaagatattcgcttcgttgaaaggaacttcttgaaaaaaggtccagatgcatctaaatcacaaacacctgtagaaaaatccaaaagcggtacactggcagatattttaaagaaattaggattaacacctaaaaaataataaaatgaaactttaatcagtgggtttttactgcccggcaaatagcggaataataaagagcactctacgtaaaatagagtgctcttttctataaacgacccttatccagcaaaaggggtatattggggatatacaagggaaaccggaaaaggaatttatattaaattatataagttcagaggtaagaagcagtttcccacctctgaattatttagcaattattatagtactggtgccattgtttcttttaatacttttacagaatgagcgaacttcactttttcctcttcatttagctcaagttctacgatttcacgtacaccttcgcggttaattacagctggaacacctacgtaagcatctttctcgccgtattgaccttcaaggtatgcagatacagttaatacgctgttctcgttgtttaagattgctttagttacacgaagtagtgacataccgattccgtagtaagttgcacctttacgctcgatgatatggtaagctgcatcacgtacgttttcgaagattttgtctaagtcttcttgtttgtactgttcgttgttagctaagattgtttctaatttttgtacaccgatagtagcgtggctccatactggaagttcagtgtcaccgtgttcaccaacgatgtaagcatgaacgttacgtggatctacatctaagtagtcacctaacatgtaacggaaacgagcagagtctaaagtagtaccagaaccgattacgcgctctttcggtaaaccagattctttccaagttacgtaagttaaaatatcaactggattagttgcgattaagaagattccatcgaatccgctatccataatgacgcgaacgatttgtttaaagatctttgtatttttctcaactaagtctaaacgagtttcacctggcttttgtggtaacccagcagtgataacaactaaatctgcatctttacaatctgcatagctaccgctccaaacttttgttggtgatggagagaatggtaccgcatggcttaagtccattgcttccccttctgcttttgcttcattaacatctactaatacgaattcttcagctacaccttggttaatcattgagtaagcgtaactacaacctacagctcctgttcctactaatactacacgattgataccttttttcatggtaatttcccctctctattgttcacatatatttttttatgattgtttaagtaattaattaaaatactaatttaatgttgtttaacttctttacattcatattgtagcacgtattattgtgaattacttcacaaattatgacctatttgtgaactttttcacatagagtgtaaagttattggaataggtgtggaatccatttcaatggaggcgttttctttagattgtgaaagggtttttcttgtggttttcatcggtaagtgaaattatatcggcgatttttagaatatatcgaccgtaactccaaatatatcagcgattattaaaatttatcgatcgtaactcaaattatatcagcgatttttgcaatatatcgatttaccgacaaaactcgacaatactgacaacataaaaaagctgtcttcagtagatcacacctgttgagagaaagcagcttcttctatatattatttattttcatccgtttctccaagtgtaggaggctacagccatacagctggggtaaaagttcaacttgaggtatcattttagatagataattccttcatatccatacaggtccaaataaataacatg

SEQ ID NO: 1354 - DNA, 10426 bp, Bacillus thuringiensis
aataataaatcacccttataatttgttccttcgtaatctctttcctctcggtatgttgccgcctttactggctcatcttttccggcaattagtagcatcgatttccttttgaaataacggtgatatataaaagcctacacatgctgtgcatgctataaaaaaagaaataaatacccactttttcatttctagttcctccttaacgtaacttacgtatagaatagaaaaaactattaaaataaaaagtggggtaaagtttaaaatttaattaaattgttaagatctcgtcttttggcaatcgcacttcaaacattgttctatactacattactttcagcagaaattgtaccgttatgctgctcaacaatatttttcgcaataaacagtccaaggcctgtcccgccacggttctcagttctcgatttatcacctgtataaaacatatcaaaaagatacggtaaatcttcttctggaatgctgtctccataattcataacttgtacgacaacttctccattatcgatatacccattcagatcaacaaattgcccatcatatccgtatcgaacggcatttgttaacaagttttcaaatactctagctaacaattttccatcaccgttaattggcaaatgaggatcaatattcaacctagcttgtaaatgatgtttctctaataaaggatacaattcctcatctaactgtataagtagttcacttatatcaatcggctttttatctagctttagcatgccataattcatacgtgtaatttcaaataactcatcaattaaactttcgagcctttgcgatttcgtatatgcaattgtggagaaatgtttaatttgttcttttgttaaattctcatctttaagaattaaatctaaataccctaacacggatgttaatggagttcttaaatcatgagctaagtttacaacgagctgatctttactactttcagcaaagtctcctctttccaccgcttcttttaacttttcactcgcaacatttatttcacgtgcgatatctccaaactcatcgtttgatgaaacttgaactttattcgtaaagttaccgttcgcaagatgatgaatcccgttagaaatctcactaaaatactttaaatacggttttgtcaaaaagaagaaaaagataatagataacggaataaagaaaattaaaaagaagttaatgtctccaacttcccttaccactgacctaaattgcgctaaaggctcttcatagcgaaccatcgttttataatacagctgcaatcctttataaattatataagttacagttgctgcaagcaccatacttaacgcaaataaggcaatcattttaaatcgaaaacttttcatcatattagccattgaaagtataccctactccccacactgtttttattagcttatcttttcttttatcttccccaagctttttccgcaacgtacgaatatgtaccataactgtatttccgccttcataataatcatctgcccatacttgctgaaaaatattttccccattatacactttcttcgaatggctcgctaataaatataaaatatcaaactctttcggcgttaactcaatttgctctccatagacgttcactgttctttgctcaggatcaataataactccgcctacctctaaagcagatttattccccgctactttcggctgatttaatgtaagaaacctacgtaattgtgcatttacacgcgcaactaattcaatcggtgtaaaaggtttcgtcatataatcatctgcacctaatacaagacctgtcaccttatcaaaatcagacgttttcgcacttaagaaaatgattggcatatggtgcttcgcgcgaatttgacgcgtcacttcatacccatccattttcggcatcataatatctaaaaccactaagtcgattggctgcgtttcaataatatgaacagcctcttccccgtctgctgccttcacgacgtggtacccttctttttctaaatgtatctcaattaaatcagcaatttctgcctcatcatccactattaaaattgaaatgcgcttcattttactcccccttttatacgctcgattgtaaactagtctatccaatttgtacaatacgaaaaggttacccgttagagtaacctttgtaaataaaattatatcagcgattttccaaatatatcgaccataacttgaattatatcggcgatttctcaattatatcgaccgtaactcgcattatatcagcgattattgaaatatatcgacttaccgacaattaacaacgaaattcgcccgctactttaaagactcaagttaccgctccaaaacaattcgctgtttcgtgatctccgccaaccttccgcggtctacttcatactcagcttcaacactttgcggcaccataacttttccgcccttaagcgtcacttccggcgaaataatatcctgctcccaatgtctgctagaagcagatatatcgcctggaatcgtaaagttcggcaatgaggcaagcgcaacattttgtgctcttgaaatccccatctccaccataccgccgcaccaaacgggtatgttgtgctccatgcaataattatggatttgaaccgattctgttaatccgcccactcgccctggtttaacgttcacaatttggcagctaccaagggtaatcgcaacgcgtgcatcttctaaactatgaatactttcatctaaacaaatcggcgtttcaattttcttttgcaactccgcgtgatcaagaaaatcataatcggctaacggttgttcaatcatcattaattggaattcatctagtcgtttcagcctctccgtatcccctaatgtatatgctgaatttgcatctgccattagcgggatatgcggaaactcttttcgaatctctttcaataattcgtaatcatgctctggctttattttcactttaaaacgctcgtatccttcttctgcgtacttctcgatttgttttaacataaccggaatcgtattgatcccaattacaacgccgacttcaatttcagacttcgttccgccaagcactgtcgctaacgatttcttttgacacttcgcatataaatcccaaacagccccttcaattccggcctttgccattcggtttctttttatatgttgaaatagacccggtacctcattcggatgagaaatttcagcctttaataaatcaggtattaaaaagtcttgcagtacatgcagcgccgtcttcaccgtttcttccgtataccacggttcagagaacgcaacgacttcgccaaatccaatgtacccatcttcatcttctaattcaataacgatactctcacgcttttcgtaagtcccgtagcttgcagcaaacgggattacgagtggcatttctgttatatgaagtgtcgctttttttatttccacctacatctgctactaaaaatatagacaaatgtatattcttagagtattcctgcttctacgtgccctgcctcgctaatcacttgctactacagtttgctgtgacactccacaggcgtaaattccgatgtagcccaccgtacatatatacaatctatttacgttagtattgtatatttttttgcttgtaaaaggttgatagatgcatttaaatctctatccattacatttccacaatcacatgtatatactcggtcagacagctttaaatccgactttttttgaccgcaacatgaacatattttagaagatggatagaatctgtccacttgccgtagttcaattccatattccctacatttcgttgataaccatgttttaaaagcataaaaacatggttgcgctacagctttagatagatgtttgttcttcatcatacctttcacattcaaatcttctactgtaataaacattggcttggttttcaccacatcatttacaatagactttacatacgctaatcgaatatttgctagcctagcatgtagctgttgcaccctaagaatatttttgtttatattcgctcttttattagtaacaggttgttcacctctctttcttatattttcaaatttgcgtgataaagagcgttgttcacgttttaaccgtttttctatcttttttacttgtactgttttatttatatttttgtgagtttttccatcgctacgtacagcgaagtctttaattcccaaatcaattcctatacctactgcattgagaattgaatttggttttacctctttcacttcacagagtatagacacatagtatcttcctgctctttgatatactgtaccactttttacagttgtattttttgaaatatatccatactcttttaaccttatccaaccaattgtagggacttttactctatgtctttctactgtccaatctgttttgttgtttttcggaaagtagcacttcacatcttgcttcttctttttttatatcgtggaaacttagataaacctttaaaaaatcgcttaaaagctttatctccattcataatcgcttgttttaccgctttgctcgacacttctttaatccactggtcacactcttttgtatgaatgttgtttaaccatttagaaaagtcatagccactaagaaatttcccatccgactcatatgcctctttatttttagagatatacaggttatatacatatcgacacaccccaatagtttgacggattttactaacttgttcagttgtcggtttgatttctattaaatatgctcttttcataaatcttcatcctccgacattttctttttgtattttctcaacccatatattctaccgctaaatacatgaatgatagatattaaatcctgcacaagttcttcttgaggagatagtttttcattgttaacaatcataatttccactcccattttacgaagaaacttttcaaaccactcatatccaaaacgtacaaatctatctttgtgtgcaatgatgatagtcgaaatatttctttccatacaactgtcaatcaggttattccactgttttcttttgtagtttaatccgctaccaatatctttgataacttcatctacaatcatccctcgtgcatttgcgaatgtttttaaaaactcaacctgattttctaaatcatctttctgacctggatttgatactcttgtgtaaataactactttgcctactttattttcttcttgaatacccatatattccttatactgttcttctgtatagtatcatcttcctttttggtttcggtaagcagttaaaacaccttgattgtcccacctttgcaatgtcttaacagagacattaagcatttctgaaaattcttttggtttatattgtttcataattactttttattatatatgcctacttttgtctatgtttttgtttactgtttctttctcctccactaattctcttaactctcgtcttaacaattttttcgaagcgttacgtggtaattcctctaagaaacatgctttcttcggcactttatatttcgctaatttctcctcgcaaaagtgaagaatttcttcttctgttaccgccccgcttttcacaacaaaagcagcgggtacttgtccccatttatcatcagtcatacctacaacaccagcttccgctatcgctggatgggacagcaacacttcttcaatttgagccggatatatattctctccgccagaaataattaaatcactgcggcgatctaatacgtataaaaatccttcttcatctaaataaccgaggtcgccagtatgaagccatccgttttgaattgtctcacgcgtcgcatcttcacggttaaaataaccgcctgttacgttcggcccttttactacaatttcgccttccgcatgtggcggcactactacgccgtctttttcaatacgaagttggcactgaaatagtggctttccagctgatcctactttcgttaacatgtaatctgcggacaacgtacaaatttgcgaagacgtttctgtcataccgtacgtttgatacacaggaattcctttatctacacatgtttcgagtaacggttttggcgctggtcctccgccaagtaacatacatcgtaaagaagaaggatatgtttcttctccaagtctctctaataaatcagttaacatttttgatacgactgaaataatcgttacgcctctcgtttgaagtgctgtatgaataaaatcagcatcatatttcggaacgagtaaaatgcgcatgccgtacataatatttttcattagaagagataacccgccaacatggaacatcggcatacacgctaaccagcaatcatcatcacgaagtcctaaattaagcgaagagccaaccgcgctggcccagtgatttccatatgttaaaataacgcctttcggtttccctgtcgtccctgacgtataaataatcgtcatcgcttcttctaaagagaattcttcttgtatagaggcttcctcttttggtccattcatcacttcggcgaatgaatagacaggaacatctttagcatcaaattcttgatcggtcactaaacaaataacttcagcatcatccatttgccaaagtagctcttctcttgaaagacgcgtatttaaaagcacagctactgctcctacgtacgatagggcgtgaataactgtaatcatctccataccatttttcatcagaacagccaccttttcccctcgcttcactcctacatgcgtgaggtgttcacaaacagatactaccttttcatgcagctgcataaaagtaacttccttttcctctatttcaattgcagtacgatctggtgttaaaaatgcacgttgctttaaccaatttggcatcgtctccatcatacattctcctttcatgaaagaaagagacttgatgtgacatcaagtctcttagttgttttgtttccggtttgatcatttggttgcgactcactttgtgggcgagccgcttccgtctaagaaccttagtcaacggggctaaacagtcggctccgcttttgatttgatcaagggaaacgagggaattgaccgaagtccggactgcgtttttctttgaatgcgtcgcgaccttcttttgcttcgtcagttgtgtagtacaataacgttgcatctccagctagttgttgaataccagctagaccgtctgtgtctgcgttgaatgcagcttttaggaaacgaagtgccattgggctgtttgctaagatctcttgtgcccattgtactgtttctgcttcaagttgttctaatggtactactgtatttactaagcccatatcaagcgcttccccagcactgtattgacggcataggtaccaaatttcgcgagctttcttgtggcctaccatacgagctaagtaaccagctccgtatccaccgtcaaagcttcctactttaggacctgtttgtccgaatacagcgttgtctgcagcgattgttaagtcacatacgatatgaagtacgtgtcctccaccgattgcataacctgctaccattgcgataactggtttaggaattgcacgaattagacgttgtaagtctaatacgtttagacgtgggatttggtcgtcacctacatatccaccatgaccacgaactttttggtcgccgccagaacagaatgcacgtccaccttcacctgttaaaatgataacgccaacatttgcatcatcacgagcttgtgcaaaagcgtcgattaactccattaccgtttttggacggaatgcgttatgtacttcaggacggttaatcgaaatttttgcgataccattgtatgttgaataaataatatcttcgtaattgccttcttttacccattcaatagccattacaactacctccttgtatatttctgatctcatctataagtgtaacttcattcttaactgaaaaaagcatcactgcatagtttttagaaatccctttactattgtatcaaacttttccggttgttccacatgaattgcatggccagcaccatcaattttgacaaatttcgcgtcagagacgcatttttcgatgttttttaatatgcgaaagaacttttcatcatgctctccgttcattaaaagaacaggcattttcaagttgtgtagctcatcccaccatgaaggctgagcccctgttcccatgccgcgcaagctatttgcaagtccttttggattgttagcaagtcgttcttttcgcaccgcttcttgtacgttttttgctaaacgtttttgcgtttcaaacagcggaatattttcccacatcgatacaaaactttctatgccttctcgctcaattttatcggcaagtcgctcatctttttcacagcgttcttttcgctcatcttcacttttgagtccagctgtacaattttctaataaaagagaacgtacatattctggatatagacacgccatcgtaatcgccagtctaccgcccattgaatagccaagtatatgtgctttttcaatatgaaggtaatctaatagttctttcatttgcaatgccacatttcgaatgtcataatgcgcaacatcttcaggactctcggtctttccgtgtccaacaagatccactacaataacttgaaactgcccactccatgaagagataaaagaacgccacgtttccatgcttcccgtaaaaccatgaagaagtagaagtggttccccgcttccgactacttcatattcatacgatacaccttgcagcgttactttcattttgattcaccttgcaatgatgtagtaattacgtcctgtgtttttgcccataacgtacggtgcaacgttaagttttcatcacggttcgtacaaatttctacaacgtgtaaaccttctgtcgttgctcccttttgtacttcctcccggaattgctcccaaccatttacacggctaaatgaaccaccgtacattttaacaacatgctcatagtcaagcccaatcggcgttccaaataacgattcgaagtgttcctttttctcatattgtggtaagaatgagaaaatacccccaccatcattatttacaacgacaatcgttatatttaattcatgtaattttgcagctaatagtccatttaaatcgtgatagaatgataagtcaccgatgactaatacgagcggatcgcaaatcatgctcgctcctaaagctgtcgaaatgatgccatcaatcccatttacaccgcggtttgccatcacttgaatatttttatctgatgtgaagaagaatgaatctgtatcacgaattggcatactattactcgcaaataacgttgctccttctggtaatacgcgtacaatatctgtaatgacttttccttcaaatgcagtttcatatgtttccatttcacgaagcgtttccttcgttttttcgtttatatgttgccacatttgggaccaatcattctttttcataactggcattttttctattaatgtactgcaaaatgcaatatcacttgcctgtacaacttctgtcgcaacaagagctggatctctccattgtccagattcgtcaacaacgatatgaacagctttcgtttgttttttaatgaactgcgttaatgctttcgaaacaggcataccaccaaaacgaattaaaacgtccggcttccacgtctcttttaacaattcatttcgtaaaaatgtatcataacagtcgattaccatcgttttatcgtggtgtccgctacgaatattagaaagtgggtctgctaatattgggtatcccgttttttcagctagttgcgttgcaaacgttgcgatttctgaatgactatcatctccacaaataataagccccttttccatatgtgaaaggcgccctacaagagaatctacatattcactcggcatcaccacgttcccttgctgaactacttctgtatattccccgcgtcctttatcccataaactttctaatgaaaagtccgggataagcggttcacgaactggaaaattaagatgaacaggtccttgcggcgctaaacaagcacttgctatcatgcgctgcgttgtcatgcgagcgtagtggtacatcgcttcactcgcttctggaagtgccatctctgtaaattgcttcacaaacgtaccgtataaattaaattgattcatcgcttgtggtgcaccgacatctcttaattcatgcggtctatctgctgttaagacgataagcggcactcgtgaatggaaagcttcacatacagctggatagtagttcgctgctgccgttcctgacgtacataataatgcaaccggacgttttttcgcttttgcgataccgagcgcaaaaaatcctgcagatctttcatctacatgtaaatatgtgttcattccttcgtgttgttccattagtagagcaatcggcgttgaccgtgagcctggactaatgacaacatcacatacatccccccgcgtcagttcatccacgaacgcgccaggataata

SEQ ID NO: 1355 - DNA, 19830 bp, Bacillus thuringiensis
ttgttttaggtaagattggaattgaaatagtgaaagttgtaccatcttcattactagtcatttttaatgtgccgttatgattttggatgattttttttgttactgacaagcctagtcctgttcccgaatccttcgttgagaagaatggatcaaagatatattcttgaatagctggaggaataccaattccattatctgtgaaagtaatccgaatgaagttattaaggcgataactagtaatttgaatagaaagaggtttgtcgccttgagcatcgacggcattttgaaatagatttaaaaacacttgaacaagttcatgtcgatcaatattgactaaaatatcatctaattcattagagaagttataatcaattgaaatattatgcaaggaaacttcactagctagtaactgttgaatatagtcacgtaaaaatgtattgatgggaaacggttctcttgtaaattcccgtgtttttgaaatggctaaaaattttgtaataatattatttgcacgatctaattcagggataagcaagtttttaaataactctttatttgatggagaaatgctttcttgtaaaaattgtaagtatccgcgtactgttgtaagaggatttcgtacttcgtgtgcaattccagctgcgattcgccctgctaacgaaaacttctctgcatcacgttctgtatttaaataatgaaagacactaataactctaaaaatctccccgttataatcgcgaataattcggttatttataatgccatagtttttgtctaaaacttcttcattatatatttctgttcccgtttttaatgtttcaattgctttaattttttcttccggcaagtttagtaattgttgaatcggttttccgataatatgatttcgtattataccgaaatcatctgcagcaacttgattacataaagtaatattccctttactatcgataaaggttacatgatgtgaaaaggcatcaaaaatatgtacaaagtgtttttcaagttgttcaaataaaaataatgaatcacaagtaagttgaaaatgagcctctttattctcttttggtatttcttgaatggaatgagtcgttctagttttctttattcgtaaaccaatatgtggatttttgtatgtgaaatgatgtggtaattgattcacaagttcttcataaaaacgtactttattttctagttcttcaattcgtttttcatgagatacagtagcatcgtttggaagcataaataaataacccctcattttaaaaattcttccatatagtatatcatatttttataaggatactcttaaagaaaaggctacatgatgcaaagtgtttggaaagtgaattgaagatgaagttaaaagggaggggtatatgtgctgtttattggagtgacaggatggggagatcatgattctttatacataaatccctatgaaaatagaaataaattacgaacatatagcgagtattttcctattgtggaagtggatagttcattttacgcgatgcaacctgcacgaaattatataaaatgggcaatggaaacgccgaaagatttttcttttgtcgtaaaagcgtatcaaggaatgacgggacatatgaaaggtgaaattcctttttctacgttcgatgagatgtttgatgtgtataaacagtctattcttcctttaatagaagctgataaattaaaaacaattttatttcaatatccaccatggtttgattgcaaaaagaaaaatgtagattttcttcgatatacgaaagaaaaaatggaaggtttaccatgtgcaatagaatttcgaaatcaaacatggttttatccagaaatgagagataagacgttacagtttctagaacaggagaaatggattcatacaatttgtgatgaaccacaggctgggataggttctgtgccactcgtgttagaggttacgaattcagacatggcattaatacgttttcacggtcgaaatgttcatggttggcttgataaaggggaaaattggagagcggttcgctgtttatatcgctacaacaataaagaactggaagaatgggttgaacgactagagcaattaaaaaagaaaacaaaggatatatacgtactgtttaacaacaattcaggtggggatgcagcagataatgcgaaacagcttatgaaaatgatgaatattacatatggtgagccgaagccggagcaattaaatttttttgaatgataataaacaagaaaggcactgtacaaacagggggaatgtacagtgcctttctatatgaaaaagaggggtaacaatgttactgagcgtttggttgattcatcaattgttggcttcacaataaatgataatggttatcattatcattgtcaatggtttttctaaaaatatataaaaaactttatatattttaaatagagataaaaaaagaacagcgattaatgctgttcttttccattgacgaattgttgtaaatcaaaaggagttatcgcttggataaattcttttgagataagtgtttgaacgagagtgctctcagagatagaagcacctgtcttcttttcataagcttgttttaataaatcaagtttttcagccgtttcttttggtaattcaattgtaagtgtgttcataatttctcccccttattattagagtaccactacagtataggagagacaagaaaagagaatacgaaatataaaaaaggttaccaaattttaaaatggtaaccttttttatgtataagagttattaagcaataccgatatactttaaagtttttgatggagtactgtgatcaaagaagtgttgtaaaaacgcaatatcaacacctgatttgtatgcacaataaccccaagtttttcgaagtgtatgtgagctaatcccttctaatccaacttcttttgcggctttgtttaaaatgtaccatgcatgttgtctcgtaatagattttgttcctttttgagattttaacaatggttcattacgtttccaagttttacgttctttcatgtagtcttcgattgcgtgctgtaagtcttcatttacagcaaaccatttatgtttcttcactttttcattgtaaaataaaatggaatggcgaacattttcattttcatcgattacatcactaacttttaattgtaagatttcacttacttttaagccagaatttacagctaatacgaataataagccatcacgtttcgaagattgtaaaagtatatttttgatagtttctaattgtttttcattttgaataggttgtcctgcttgtttcatttcacgcactctcctcttttatatgtgtaaaggaaaggattaacttgtttcttactataaagggagagtgtgaatttcatgtgaactcctagtgaaattaagacaaattatttgacttcttttactttttgtaaattgaaatagaatacaacactgttagtcgtattatacacaccatactcggcatgatggaggtctaagatgttttttacaatagataatccgagaccggtacctccggtgtgacggctacgtgatgcatctagacgatagaagcgatcccaaattttttcaagactttcttcagggatagggtttcctgtattctcgatttcgacttttacggtatcttctgcttctataatggagacttgtattttttctccctctggcgtataacggattgcattacttagtaagttcacaactacttgttcaatgcgactgcgatttgctttaacaagtatagaagggtctgcatcgatgttcacttgtaaatgtttttcttccatgctaaataataattttgtgtagacttgttgcgttaattcaccgattgagaacgtcgtcatatctagtttgtaagtaccagattccaactttgctaattctaacatttcaacaatcagcctgttcatattttctgtttcttctaaaataacatcagtataatacgaagtatccttactaacaccatctttaattccttctgcaaaacttctaattacacttagcggtgtttttaattcgtgtgatacgccagaaatgaattcttttcttgttttttctaattgacgttcacgttcaatatcttgttgtaactttgtattagcaacatttaatcgatcgattcgatcttttaaatttacagataatgtattgatactgccagaaagcccgccaatttcatcgtcagctgtaacaggtaatttctcgctgaaatcaaaattagccattttttttgtaacacgatttattttaattaatggcttaacaatgatttttgagtagtagaaggataacaaaataattacgagaaacacgatgattaaggcatagacataataatcttttaaaacgagcatcgcttcattaacaggctgcaaagatgctatcgcaaaagcgtattctgtaatccttccattttctataatcggttttacaaagatactattttttatattttctccgccatctaatatgaaagtacttaattggttcgagttagaagttccctctctaatcatatctgcaaaatattgaacggcttgtaatgtttcaatatcatttgcaagacgaacctcagctttggatgggagctgtaacttagttataacacctgtaaagacgattcgagttgtagatttgtatcggcttgcaagtctgttcttagaagggttaccattaattgactgaaaatccgaatagaaatgttcgttctgccattgattataattcgtccctaatttttgtggtgtgattatattattctcttgtacgactccatcaacattgattattacatctttttttaaacctaaattttcgaatttattatattcttctggtgttaaaagattattgagtggaatggaatactgtttattattgttgggattaaatacatcgatatagtaattgttatcacttttaataataccgttagagtccaaaaactgcatatcggcatttgttttatcatgaaattcttgttttagttttctaacctgctcataatttttatcacttttatcataattatctacgaatttttcaaaagcagtttggactgtttttactttcttattaatataaaatttctctaaaaatagagattgtcctaggaaaaaaagtaggaatatgattgtaaataaagtggatgttaataaaaatagtttaaagacgatacttctgtttttcactacgtcacctcttatgagaaatactgtaaatgatttctttatcccgctttaacgggcaataagactcccacttcaaaattcggcgaatacaagggagttaagtgggaaaacaattgcccgtaaaatccgattggttcaactaataatcagtgggggatggaaaaaacctccactgattaaagtttcactttattataacaaacgttacaagaaagtagaggggagaaatctgtctctttataaagtagttatttataaaaagtcacataaaaagaactcgccagacgtatgacaagttctttagtgtattattgttgaattgctgcatctaaagcgatttcaatcatttcgttaaatgtagtttgacgctcttcagatgttgtttcttcgccagtgaagatgtgatcgctaactgttaatacagataatgcatttacaccgtatttcgctgctaatgtgtaaagagcagttgtttccatttctactgctaatacaccgtaatctccaagttttttaaccatgtccatgctttcacgataaaacacatctgctgttaaaacgttaccgacacgaacgtgtaatcctttttcagttccagcatcataagctttctttaaaaggtcaaagtttgcagctggtgcaaaatcaaatcctgggaatgttaaacggttcatattagaatcagtacaagccgtcattgcgataataacatcacgaacttttacatctttttgaattgcaccgcaagttccaacgcgaattaaatttttaactccgtagctttggattaattcgtttacataaatagaaatagaaggaacacccatacctgtaccttgaacagatacacgttttcctttataagttccagtaaaacctaacataccacgcacattattatagcaagtaacgtcctctagaaatgtttcagcgatatattttgcacgtaatggatcaccaggtaatagaatagattcagcgatttcgccttgttttgcttcgatatgtacactcataaaaaagtcctccttataatgtattgatagaaatcaatatcatttgcattatacactacgaatcctttcaattaaaatctttttattatttgtaatatgtgcaaaataggaggatttcataaatcataatctagaatatatatcttaagaagttttgtatgaatagagacaataaaaatggtaggtgatgttttgaaaaatcttgtcatcgggcttattgcgttagtacttattgtggcaggaggattttacataaaaaaatatcaagaaaacgaagagactgtaggagatgttcaggaagtaaagtgggatgtttcaaatggaaagggaaatgagaaagtagatattgtatttcagttgttaaacaacaagaataatgaaattcgtggtgtaaatgatcaaatgcgggcagtgattgtagatggacagttaaaaaacatacaacaaattaaacccacatttgcagggaacgggtcatataagttatcttccaaaatagcgaaagacgaagaatatacaatatttttatacgaagataaaaataagtccgtagagtcattcgctaggaagaattttggtagaacgaaagaggagaacaataagaaaaaagtgaaatttccaatcgacagtgtacttacaaaaaaaataggagagtatgaagtttctcttttatttggcgcattacatccgaatgaaccagttacgttaacatttcagtttcaagcgaaaaagggtgaaaaattgaaattgcattcagagagaggagaagtagagtcactctatatagtggatgaaacgaaggagaattttttatacgctatgcctgtagatacggatgaacaattacaataccgaattacatttcctgccgagggcacgtataaaatgtgggggaatttctatataaatggtaagaagtatgaaaaagaatttattgtacaagttcaaaaaagaaaaaacagctaagaatttagctgttttttctttttcctattaattttgttacagagagcattgtaattggtaaagaatgattcttcctaaatgctaaatatttaccgctccatgctggtttatatttttctttaaaatgtcgtaatccgctgaaactatacgtataacgaacgttattaaagattgcagcagccactcgttcagaccagaaagactgtgtggataaaccaacatttgaaagtggtgccataccgatattaaaggagtggtattcattttcttttgcccactggaataagtggatgaaaattgcgtccataatgccgctaggcgcatctggataatatcgcattaaatcgacagataatgatccgttttgatatacaggcatgaatgttgtgaatgcaatgatttttccatccgaatcagataatgttgcgataggagcgcgactaatatattcacgatcgaagtatccgagtgaaaaacctttctctttttttccaccaagccatgcatctgaaacttttcttaactcttcatataattcgtcggagaaaggtggctcatgaatagagaatgtatagccttctctttcaaaacggttgaaagtagctcgcatgccagcgcgtttctttcctgttattgtaaaggtatttaaatcaacaacagcttcttcaccaagcttaaagaagttataaccaaaatcgtggtataaactcatccatttactttcaatttgatagaatacacaaatgtatccaaatcgatcagcctcagctaaaaactcttgcaatacagtacgataggaggaagggtccccaattggatcacctagtacaataagtcgttttccagttattgagaagagaatgagtgcttttccatcactactgaaaaagaactgtttatctcctaaaaaacctaaatgactaagtacatttccaccatgttcatctaagaagttttgtaatcgtttatcattagctggttgcccgggaaattcatttcgataacgatttgcaatgagtgaaccaattagtaaaaaagtaggaacaaaaaaggcagctgctaatgcacttcgtttcacttgtgtaatattacgaacgacaaaatcaggtttgaaagcttcttttgcacctgcaaataaaatacctaagtttttatataaatataacgttacaagtaggaatataaaaacttttacgatatcggaaagtgagacttccattttctcacgtacaaaccttttacgaagcatatacaatacagcgagtacgattaataaaataaaagtttcttcaacatcaattccttttagtgtgttaaaaatagccgctccgattaaagaaacaatcgtcatataataagaacgttttgttccgtaatatatcccccgcgaaagaatgaggaggagaataccgaatgttagcgataagctaaaagaaaattgaataagatgttttggagctagaatatgtaaggcgtgtgcccgatttatacttgtcggtagaatggttgataaaataaccattaagccagcaaatactgttaaagcagcagatgcccaagaacctaactttcctagaaagtcacgctgcaaagtccatataacaccagttgtctctaatgcaggcgcaataaaaggtttatcttcaaactttttaatggctactcctgtcatttcaaaagctgcaaaaatgagaccaaggcagaagggcaagatgtaatagacgagacgatataataacatagcagggagtaaaacacctgtatcgatgccgtattgcccaagcccagttaagaagacaagatcaaatgatccaaggccaccaggaacaagactaacgacaccagctaaagcagcaataacatatacgcctaaaaacttttggaattcgatttcaatgccaaataatagtaatatgacgtacataacaataccagcagatacccattcgactaatgaaactaatgagtataaaacagttgggtttttctcctcttcttcttcttgttcctctgtttgcgtcgcttttctattttttaatttagaaaatccgatatatatagggacgaaaagagcgaagaagataagaacaggccatagccatggtttttcatgcaaaataaatctcgtgtctaatattccgatgagaccaagaaatgaaagaatggctaatccattaataaaggcagttgtcatccaagcgatacttttaataagttttccattttcttttatatatggacgataaagcattgtgcgtacgccggctccaacaagaccaccaaacccgataaatccatttaaagtattagcaatccacgagatacggaaaatcttttggacagggatatcagcttttaagtaacgaagcataacatagtcataaaagaacattgttgatacagcgaatgcaccaagtgtaattgctaaaaagactcctccagttggaatgtttttaattgtatcaatcgcttctaaaaaagaaatgcccgctaattctttttttgcttgaaagaatacaattgttaatacaacaaatgggaagacaattttcccgatttgtaagaaacgtttccatgaaaacgacataaatacaactctccttgtataagaaaactgagacaataatattattatgacaaacttcaagaaaaataaaaaggtaaattcctgtataggcgagctattttttatataggtatatttaaaagaatattttgtttatcagaaaattaagttagaataagatgaaagaaggaggaggggagtatatgattataaaaggttatgtaggatatgagttagaaaaagcgaaacctaatacatcagaagatttttttaacagatctgaagtgacatatatattaaatggtaaagagaaaactttttcggttttatacgttcgatattttgaagaagttttacaagaaattactccttttgaaggaaatccagtgtataaagtagaagaacaaaacatatatttgcgtgatattgtagcgatatgttgtttagtgaaagataaggagcttcgtgcgcaaaaacgtttgtatttaaataatatggaagaatttcaacaatattttgatgagggaacggtgtcgaaagtacaagaaatattggctgaattacataaaaataaaagagtagaaatagcgtgaaatggcaaaggagagagaaaaatgtctaatttgatggttgaaaatcaaacagaacaagtttctatatttttagaagatgctattaatttgataaccaattatgtaaattatcatacgttaccttctttattagaggaaacaccagcagggaatgagcaatattataaaggggtattagcatcaatgagacgacttctcgttttttgcgaagaaggacaggatgcatgttttgttttgttgaatagccagccatttcgaaaaacagcagctgaaaaaattttatataagatttaccatcaagtaattgcagagtttttttcaccgaagagtgatcattggtatgaaaatagtcggtctgcatatacagggaaaaattctatcgtttttcaacaaacaccacctgcatctttggagcaagtgatgaagagtttagaaggtaaatttcaattgatgcgtgaagaactagaatattatgagacggattatcagacaaagatgttacacaaatattgattgaggaaaagaagctaaggtgacttagcttcttttccttttgtacagttatataagggattttcattgaatatagttaagtggatagcattagggaggtgcaacatgaatcagcaaggtgtatttacagattactttcatgaagtagaaaattggtgtgaaagtgttcttcacgtattagatagccgcgcaatggaagtgtatgatgtccatatgcttgcttataaaattcagacgttattagagcgtatgaaagagcatgagtatgaaacagatgcagagtttatgtatgaaataagcgatgatgtagaacacattcagcatcacttgcaggaagtatttatgcaagaagaagaggaatatgaattatatgaaagaggggatagtgaacgagctgtcccaattggaggacatacactcccgccattaccttatccgtataatgcattagaaccgtatatttctaaagaaattatgatgttacatcatgataaacatcatcggagttacgtggaagggttaaataaagcagagaagatgatggaagaagcgagaaaaacaaataaatttgatttaattaagcattgggaaagggaagcggcttttcatgggtcaggtcattacttacacacgatattttggaataacatgaaaaaagacggtggtggaagtccaagaggagctttttcacaacaaattgaacaagattttgggagctttttacgtttccaaaaacattttacagaagcggcctctaaagtagaaggttcaggctgggcaattctcgtttgggtaccccggtctggaaggttagaaattttgcaaagtacacttcatcaattatttacacaatgggatacgataccgctccttgtactagatgtctgggaacatgcgtattatttacaataccaaaatcgaaaagatgaatatattaaaaactggtggaatgttgtaaattggcctgatgtagaaaaaaggtttgaaactgcgaaacaaattgaatggacaccatattagacgcaaattctctgcgtcttttttaatggaagtagaaggaagatttcgttcatattttaaaaggccaagcatacacttgtacaaaaagtgccaaaaggacgtggggggaaatatgagacgaatttgtgtaatcattacgcttcttatgatgtatgcaagcgttatgccgattcctacatatgcaaagatgaacagcaatgtcagtgctcgaaatgctgtattaatggagcaacagtctggtcgtgtattatacggaaaagcagaacatgagcctcaaaaaattgctagtataacaaaaattatgaccgctttattagctgctgaatcagggaagatgaaagaaatggtatcagttagtaatgaagcggtgagggtggaaggatcggcaatctatttaaagcctggacaaaaagtgaagttagaagatttagtatacggactcatgcttagatctggtaatgacgcagcgcaagtaattgctgaaagtgtgggtgggagtatagatggattcgtatatttaatgaatcaaaaagcgaaagaaattggaatgaaagatacgcacttctcaaaccctcatggcttagatggagatggatcacattattcgtctgcttacgatatggcattattaacgaaatatgcaatgggaaacgagacatttaagaaaatctttggaaccaaaacatataaatcagattcttgggattacccgtggaaaaataaacataagctggtaacgtcttattatgaatttgcaacaggaggaaaaacaggctttacgaagaaagctgggcgaacgcttgtgacaacggcatcaaaagatggactagatttaattgtcgtaactttgagtgcctctagtgattgggatgatcatatgaatttgtttgataaaggttttgaacgtttcaaacaaacgaaagttttaggacaaggagcaattgctgaaataaatgaaaagaagtatgccaaccatgtttatacgaaaaatagtttttcggtaccgttaactgaagaagaaaaaaagaacgtagtattaaaagttgaactccataaaagtataaaacttacggatggagtaaaggttgggaagacagacatttatgttggtaatgaaaaagttggagaacggaatttattttatagtaaacggaagttagtagctacaacgggactttactggaataatgtgaaagaaattttttcttacatgataggtgttgggaacgatggttaatctcgtatgggtagcgatggctgtcattgggattgtatacgccatgataaatggcacgatggaagaagtgaataaagctgtatttgacggagcaaaagatgcggtaacgatttgtataggacttattagtgttttagtattttggctcggtttaatgaaaattgcagaggaagccggattgttaaaaaaattagttacactttttatgccgatagtaaaaaggttgtttccagaaataccaaaggatcatccgtccatgggatttattctatcaaatatgatggcaaacttttttggtctaggtaatgcagcaacccctcttggtattaaagcgatggaacaactgaaagagttaaatggaggacaggattcggcgagccgttctatggtgacgtttctagcattaaatacatcagccattacattaattcctacgacagtcatttccattcgaatgacgtatgaatcagcgaatcctactgaaattgttggggtaacatttattgcacaagtactttctatgattggagcaatttggattgaccgctatttttaccgaagaaggagtagaaaggggcggaaaaaatgagtattgtaaatacaatttccttatgggtaattccttgtgtaattggttttatccttttatatggcacaataaagaaagtaccgacgtatgaatcgttcgttgagggaggaaaagaagggattcaaattgcaatttccatcttaccgtttatggttggaatgcttgtgtctatttctatattccggtcttcaggtgcgttagatgcaatgatatcggtaatgaagccaatgttagatttgatccatgttccagcagaaattgttccactagcacttatacgccctatttcaggctctgctggtttaagtattacgaccgatttaattgccacatatgggccagattcgtttattgggagattggcttctacgatgcaggggagcacagatgcgactttctatattttaactgtatattttggagcggtcgggattagaaaaatgggtgatgcactaaaagtaggactttttgcagatttaatcgggattatatgctcaattgtgttcgtttctttattgtttcagtaatactattcattttttacgctatttcgcttataatacgtatacgaccactattaaggtgtagcttaatagtggtttttttatgtggtatttttgacaaaatgatgaacttttattgtgagaaatatgaaaaatatggacaataataaagggtaaaaacatgatttgacctttatatgtttattatcatcgctatgttgtttaagtaagatgaagcgaatagccgtaaagcgtatgcggttgccaagtctttctaatgtaaggtaagataaattcgaggtgaaaaaaagaaatggaacgattacaaaaagtgattgcgcaagcaggtattgcatcgagaagaaaggctgaggaattaattcagcaaggaaaagtgaaagttaatgggaaaatagtgaaagagttagggacaaaagtaactcctcaagataaagtagaagtaaataacatccctcttgaaaaagaagaacctgtttattttttactatataaaccaactggcgtaatttcaagtgtatcagacgataaaggaagaagtgttgtaacggactttttcccggaaattacacaacgtttattcccaatcggacgcttagattatgatacgtctggcgtattattaatgacaaacgatggggacttcgcaaacgtattaatgcatcctagatataaagttgaaaaaacatatgttgcaaaaataaaagggccattaacaggtgagaaaattcgcatgttagaacgcggtgttacgttagaagacggtaaaacagcaccagcacgtgtgaaaattatttcttgggacaagcgtaaagagatggctattgtacaattaacaattcatgaaggacgtaatcgtcaagtacgtcgtatgtttgaagcgttagactgtaaagtagtgaaattaaaacgtgaacgttatgctttcttagaagtaggaagcctgcgacctggtgatgcgagagaattgacaccacatgaggtgaaacaattacgcgcgcttgcttctacaaagccaagataagctatagagttaaaaattcaccagtggagtgctctgctggtgatttattcaatacaacatttacagaagataatacataacatttatcgaggagaggagaagtaatatgaagaaaaatcgcttattatttcgcgttattattctactcattttatgtggtgctgtaggatttaccctttatcaaggattctttgctaataaagagaaaatgcaaatcggaaaagaagcacctaactttgttgtgacggatttagaagggaagaaaattgaactaaaagatttaaagggaaaaggtgtatttttaaacttttggggcacgtggtgtaaaccttgtgaaaaagaaatgccttatatgaatgaattatatccaaagtataaagaaaaaggtgttgaaatcatagcgttagatgcagatgaaacggatattgcagtaaagaactttgtgaaccagtatggtttgaaattcccagttgccattgataaaggacaaaagattataggaacatatggagtaggtccattaccgacaagctttttgattgataaagatggaaaagtagtggagcaaattataggtgaacaaacgaaagaacagttagaagggtatttaaagaaaattactccgtaataaagaaagcctttacataaggggtgcgtgtctatagtgcctctggtttaaaaattctgagtattgcggtaacttgaggttagaatatacaatagtacatatagatacaggggcggtgagagtgttgaaagaaattaaatgtgaatgtggacatgttaatccgataggaaccgttttttgtgaagcttgcgggaaaccatttgaaagcaatgaaaatacaaaactattggatatgcgctatgaggggagtgcacggagatctctcacgcagacaaaaacgataatcgataaaatttggagctttttctcttctgtaaaagtgggtgtatggctaatcgtaataactttagctgcatcagcgataggaactatttttccgcaagaaatgtacataactccagggattgcaccagctgaatattataaacaagaatacggatttttaggacaattatactatcaattagggtttaataatttatacggttcatggtggtatatgattttgattgcttctatcggtatttcacttgtgatatgtagtttagaccgtgttattccactttataaagctttaaaaaagcaaggcgtaaaaagacatcctagctttttaaagagacagagattatatgggactggtacaccgcaagaaggtgacctggaaagagtgcaaaagaatttaaagaaaagaaactataacgtgaaagtggaagacggaaacgttttagcagaaaagggacgcttctcgcgttggggtccatatgtaaatcatatcggtcttattatctttttattcggtgcgatgcttcgttttttaccgagtatgtacgtagacgaagcactttggttacgtgacggtgaaacgaaagagataccagggacggatggacaatactacttaaaaaacgagaaatttataaaagaagtttatgataaaagtaaggacaaggaagtttttgatgaagcgattaatcgtgtaggcgataaaatgattgcgaaaaacttccaaacgaatgccgtattatataaagcagtaggagaaaatatagcaggacaaaaaccgaaattagaaaaagtaaaagaagcggaaattcgagtgaatgaaccactgaaatttgatcaatttgcagtgtatcaagtggattataaagaaagtgaatttaaaagtatgtcctttaacttacaaaataaagaaaataatcaaaagtggggaccgattaaagtagatttaacgaatcctaaggaaaaatatgatttaggaactggttattctctagaactattaagctattttcctgatttttattttgatgagaatggaaaaccaaatacgaaaacgaaattaccaaacaatcctgcatttgtatttaaaatgtttacacctgaaacaccagatggcgaagtgagttttgttggtattcagcaaaatatagaaccagatggaaacaacaaatataaaatgtcgtttgcaggtgttgaaatgcaaaatgcaacagcacttactgtaagaaaagatttaacgctttggattctcggcattggaggatttatatttatggttggtgtcattcaaggtatgtattggaatcatcgccgtatttggatacaacgtgttaatgatgaatggtggattgcagggcatacaaataaaaattggttcggtttaaagaaagatattgaaagagtaatagaaggtacaacaattccacagccaaatgataaagtaattgataaaaaaattagttaaggtggggaaacgatatggtgcaaataagtagtaactttctctttaccgcatttattttatatttaattgcgactctattttttggaggagccattaaagaaaagggtcataaatgggcaaatgtaggaataacgattacaattttagggtttatagcacaaacagtatattttgttacaaggtggattgcatcagggcatgcgccagttagtaacttttttgaattcggtacatttttcggcatgatgcttgtaggagcatttattgtcatgtattttatgtaccgtgtaagcataatcggactatttgcattaccagttgcgcttttattaattgcctatgcaagtatgtttccgagggaaatatctccgcttattccatctttaaaaagtaattggttacatattcacgtgacgacggcagcagcaggacaagccattttagcgattagttttattacaggcgttatgtatttattgaaaaatgtagatcaatcgacgagaagtaaacgtacattttggctagagacggtagtatttacacttgtttgtacagttggatttattggagtaacaacggtattttctagtatgaaatatgaagcgaagtttcaatggattgataaaaatgaacaacaactggaaatgaagtacaatcttccggctttagttggaccgcatgaagggaagttactgacagaaaataaattagaaccggcagttgaagttccagcaattgtaaatgcaaaaaaattaaatactgttatttggtcagtgttagttggaacattactgtatattgtattaagactcgttttacggaagcgagtatcggcggcacttcagccgttagtaaagaatacgaatagtgatttactagatgaaatcggatatcgatctattgcaattggattcccagttttcacattaggtgcattaatttttgcgatgatttgggctcaaatagcgtggacgcgcttttggggctgggatccgaaagaggtttgggcacttataacgtggctcttttatgctgcagtactacatttacgattatctaaagggtggcatggagagaaatcagcttggcttgcagtaattggttttgcaatcattatgtttaactttattgtagtaaacttaattattgccggtttacattcatatgcatagagaaataaaataggagagtgcatgtcactttcctattttatttttgtcaacttttcttcttttttgagaaaaacatgacaaagtagcggttgattttgtaaaatgatgtcgaggacattatatacagttcaaaaaaaatacatagttttggaaaaaaattgaacaaaatttattattcttgtgaagcataatatgggaagtgaaacatttagaagattgcttaaataaacgagaatagcgcaacataatagttaaagaagggtaggtgtgaaccgctgaggtgagagtacgcagcgggtagagatggaaaatgaatcaagaattttaattgtagatgatgaggatcgtattcgtcgtttattgaaaatgtacttagaaagagaacaatatacgattgaagaagcagataatggtgatacagctttagaaatggcgttgcaaaatgattacgatttaatcttattagatcttatgatgcctggtaaagatggcattgaagtatgtaaaggggttcgtgagaagaaagcgacaccaattattatgctgacagcaaaaggtgaagaagtaaatagagtacaaggatttgaagttggaacagatgattatattgtaaagccgtttagtccacgtgaggtcgtgctacgtgtgaaagcggtattacgtcgtgctgtaccaacaacattctttacacaagatacaacgacaaaagatgttactgtattccctcacttaacaattgataacgatgcacaccgtgttactgcagatggcaatgaagtaaacttaacgccgaaagaatatgagttactattatttttagcgaaagctcctgataaagtattcgatcgtgagcagctgttaaaagaagtatggcaatatgaattcttcggagatttacgtacagttgatacacatgtaaagcgtttacgtgagaagttaagcaaaaaatcaccagatgcagcgaaaatgattgttactgtttggggtgtaggttacaaatttgaggttgtgaacgactgatgctttg

SEQ ID NO: 1356 - DNA, 16266 bp, Bacillus thuringiensis
tcattttgtactcatttcagacctctcttttcataacactgcgttacattttatcatacttatatggtctttttctatggaagaaaaaaagctattgacgatagttctctgttaatgttacgctacgactaatttaatacggacgatgttacctcatatatacttgataatatggatcgagagtttctacccagcaaccttaaattgctggactatggggaaaactaatgaatattagcctatgcgcaaaaaaggactcatattgattagctttctctcatagatgaaagtgaatccatatgggtctttttttatttttatttttctaaaaggtcagacatcttacgtatgacataaaacctcattcctttatttttagtaatataacgagcgttttatgtacaaactttatacgaacttctgaaaggggcaactacatgcaatatgtaatgagcattatcggtattcttgccgtgttaggtttatgttttgctttgtcaaacaacaaaagtaaaatcaacttccgtgcaattgcaattatgattggtttccaaattttaatcggttggtttatgtttgctacaaagattggtcaacaaatcattattttcattagtaaagttttcaacaaactaattaaacttggtacgacaggtgtcgattttctctttaatggaattcacagagattttgtctttttcttaaacgtattactaattatcgtatttttctcagcactactttcaatctttagttatttaggtgttttaccattcatcgttcgcgttgtcggcggtgctatttcaaaaattactggtttaccacgcgttgagtcattccacgcagtaaactctgtattcttcggttcaagtgaagcattaatcgttattaaaaacgatttacagcatttcaataaaaaccgtatgtttatcatttgttgttctgcgatgagctccgtttctgcttctgttacagcatcatacgtaatgatgttagatgcaaaatacgtactagcagctcttccgctaaatttattctcaagcttaatcgtttgttcgttattaacaccagttgatacgaagaaagaagatgaagtgattcaaaaatttgatagaacgctattcggggacagctttatcggtgcaatgattaacggtgcgcttgatggtttaaaagtagctggtatcgttgccgcattaatgatcgcctttatcggtgtgatggaagttgtaaactacgtaattagtgcagcttcaggcgcaatgggacatgccattactttacaacaaatcttcggttacgtactttctccattcgcattcttaatgggtattccaactcaagatattatcccagctggtggtattatgggtacgaagattgttttaaatgagtttgtagcaatccttgatttaaaagacacagctacaacattagctccacgtacagttggaatcgttacagtattcttaattagcttcgcaagtattagccaaattggtgcaatcgttggtacaatccgtgccctttctgaaaaacaaggaagcgttgtttctaaatttggttggaaaatgctatttgcatcaacacttgcttctattttatctgcgacaatcgctggattgtttatttaataaaaaatcaccttactttaacgagtaaggtgatttttttgattctttatgaaaccgagtgaaattcaactgcttcttctgtattgataatcctatctttatatataccttttattgaaatgtaaatgatagatttgtttatgttttttaactttcctaatgaaaaatgataaagcaatccattactttttaaagtccacatcttcccactccatggaccagtagctttttgttcatccgacgccttgatttcaccttcatattcgcattctcccaaaggagttttaattgtattcttctctgtatcaattcgaatatttttaattagattcaaattttcatcagagagaatttgaatttcatgatctttctttttaaaaaagagttttccgtctttggtatttatatattctgcattatccattttatctatcataaaatcatattcttcttttgtaatacctaagttttgatgataaggaaacgtttttttcggtataatttcttcttcggcatacttcaaataccaatctaaattatttgtaatactatcgctcattttatttccgattttctctaatttctcttttatctcataaggaaattcaagtgtcataatatccgccgtcacttccgcattcataagatgcgatggaatatactcttccacactatttgctttactcacttcactttgacaaccaactataaatagcgatatgaaaaagatatatattatttttttatatttcatttctattctccactccatacattattcttacttagttttatagcggttttcattatagtataaaatctttatattttaataaaatacatatccttatgcaaaattgcatattaataagtcttcttcttactttaaaattagcttaaattactttccaaattatacaaataacaagcattaaatgttataatttgtaaaaaacattggaggaccttatgaaaattcacgcccttttcgatttcttacatttactagtcttaaccctgaaaagctattatgtatggggaatgcctatctatgtcttcattattcctcttatctttgtagtcggttatattattattaattctaataagaaacaaaaaaacacatctattcaaagtcactaatctattacattaataacctcctaaaaatcatattcccctcattttcttcaaatgatatgatgaacaagggtatatccccaccactcttatagcggtggggattttaatataaatatgcaacatactacacaatagaaggtgatttttatgagaaaatacgcagcaattgctttatgtacgtctgccattctagcaggctgtaatactaacaatgtaagtccagaacctaaaaaagagaaaacggctcaagggattaagaaacaagaagagactgtgcaagaacaaggtaaaatctcatataattcagttacacacgaatctacaaacacaagtattcatattacagacataaaagattctttaaatgaagtacaatataaaatttggcgcacagctgatggcaaggaaagtgctaaatctttttcttctaaagaaaaagagaaacaattcacacttccttttgatataaaggaatttgaaggaaaacgcggtgagttccaaattgaagcaacaggaatgaaagaagatgggaaaacaatcccgcttacgaaatctactattactttcgaacaaaaggttcctgttcttatgtatcacgcaattgatgattatcatggtcaaggcattaaagacttattcgtatcaccagctaactttgaagcacaaatgaaacatttaaaggacaatggttatacgcttttaacgtttgaacgctggggcgatataaataaagtaaataaaccgattttcgttacatttgatgacggtatgaaaaataatatgaatgcatttcgcattttacaaaagctaaaagatgatacttttaaaccggcagcaacagaatatatgattgttgataacgttgatgtagaaggagcattgtctacttctgaaataaaagaaatggttgattccggcattttctcggtgcaatctcatactgcaacacatgcagatttaccgaaaattacaaactatgaggaagagttaaaaggttcaaaagaaaagctagaaaaaataacaggtaagcctgttatcgcgattgcttatccattcggtcatgtagatgataaggttgttgcagaaacgaagaagtattatcaatttgcgacgacgacaaagcctgggcaattcattacgaagggtgaacctgatgaattgttaaagatgaagcgcgttcgtatacaccatacaacgactgtagagcagtttgcttcttcaattaagtaaatataagggctcaacacattttgagctctctttttactttatatttatatatatttttagaattttcttgtattatatatagtaagaaatctttcaaattaaaggagattatacatatgtcatttgaacaaacgttagagaaatatgctgctcttgcagttaatgttggtgttaatattcaacctggacaaactttatcaattagtgcacctcttgaagctgtacaatttgtacgcctcgttacagaaaaagcatataaatctggtgcaaaacacgtatatgtagattggaatgatgagacgttaacacgcttaaaattcgatctagctcctgaagaagctttcgctgaatttccatcttggaaagcacatgctcgtgaagaattagcaaaagaaggcgctgcatttatgtctatctatgcagaaaaccctgatttattaaaaggtgtagaaccatcgcgtatcgcaacagctcataaagtagctggagaagcaatgaaagtataccgtgattacgtacaagcagataaagtaagctggtgtgtcatttctgttcctacgaaagaatgggctgcgaaagtattccctgacgtagcgccagaagaacaagaagccaagttatgggatgctattttcaaagctactcgtgctgatttagaaaatcctgtagaagcatggaaagaacatgatgaaacattacatacaaaagtggattacttaaacgaaaagcattataaagctcttcactatacaggtcctggaacagatttaacaatcgaacttccagaaaaacatgtatgggctggtgctggtagcttaaatgaaaagaacgtaccatttatggctaatattccaactgaagaagtatttacaatgccacttaaaacaggtgtaaacggccaagtttctagtacaaaaccgttagtatttgcaggtaatattatcgataatttcacgttaacatttgaaaacggacgtatcgtagactataaagctgaagctggtgaagaagctttaaaacatttagtagaaacagatgaaggttctcacttcttaggggaagtagctttagtacctcatgactcaccaatttcaaacacaaatgttttattctacaatacactatttgacgaaaatgcatcttgccaccttgcgattggaaatgcttacgcatttaacttagttggcggaaaaacaatgtctaaagaagaacttgctgaaaacggcgcaaacgctagtattacacacaacgacttcatgattggatcagctgagcttgatattgacggtattactgctgatggcagacatgagcctatcttccgtaaaggtaactgggcgttttaaatttattaccataaagaaacacattggataatccaatgtgtttctttatttatttggtttcaattcaaattttattgttctattttcacgcgtaaactctggtctatacgtagcgatatacgtattttctttcgctacgtcaaatagcatgatatcttgaattttttcttctggtgctaactttttactaataaagctatcagggttattatattctttaaatcttgtacctttcttatcggtaatctcaaattcataaaatgcaaaaggtatttcctttttactattattttctactttgaaaataatccccaaaatctcctctttctttttatcctcatcataatccgtatatcctaatttaactgaatcgatagttacttgcaaaccatctacgtctactgtctcccctattttatacactttatcttgaacatcttcttgtttactttcattactatctttagtctcagtgcaagcacttaaactaaaagctatgccaaaaattaaaacaatttgactcacctttttaacatactctttcctccacataagacaatatttcatatgtatcataacaaaatgctttacgctttcttgtcatattttgtcgtattaattgctaactgcacaaatagaaaaaagctatcttctacaaaagatagctttcatgatgccgatgaaaccttaagcccaatgacacccaaaacaataaaaagaatacaaaatgcttgaaataaactaatatgctctttaaaaaagtacacactaatgattgtaataagtaatgttccaacgccagaccaaatagcataagcaatacttaaatggatctttttcacaacgatggcgaacacgctgaaacaaattccataaaacacgaaaatcagtacacttggaacgagctttgttaaaccatttgatagtttcatcgcaattgttccagctacttcaaaaataattgtaacaagtaataatagccaatataccatactagaatctccttctctgttaccttatagagattctagtatactacttatagtcccaatgaaatatatttaatttctaaatattcctcgatgccgaaatggcctccttcacggccgataccactttctttaaatccaccgaatggtgcttgtgcaactgatggaagaccgtcgtttagaccgataataccgtactctaacgcttcactaatttggaatgcttggctaatgtctttcgtgaaaatatacgcagctaaaccgtatggtgtattatttgcacgttcgattacttcatcaactgttttgaatttcgcaactggtgccactggcccaaatgtttcttcattcatacaaagcatcgtatcatttgccaccccaattacagtcggttgaatgaaatgtccctctaactctgcgaccttttgaccaccatataaaactgttccacctttttgaatagcatcttcaatatgttcttgtacttttgaaactgcattctcatcaataagtggcccaacagtcgttccgtcaccgaaaccgtctcctactttcaactgccctactgccttttggaacttctctacaaatacttcgtatacttcttcttgaacgaatactcggtttgtacatatacacgtttgtcctgcgttacggaatttcgaaccaattaccgcttctactgctttatctaaatctgcatcattcattacgataaatggagcgtggccacctaactcaagcgaaacttttttcatcgtttgtgcagcactagccattaactctttcccgatttccgttgaccctgtaaaggacacttttcgaacgcgactatcttccatccatgtatcagcaattgcttttgcactacctgttacgatattgattacgccctttggaatatctgcttcatgagctaattcagctaatttcaatgcagttaatggcgtttgactcgccggtttcacaacggctgtacagcctgctgcaagcgctggtgctacctttctcgtaatcatcgctgccgggaagttccaaggtgtaatagctgccataacgccaactggttgcttcataactaaaatgcgcttattcggatgagaagcaggaatcatttcaccatatacacgtttcccctcttctgcataccattcaacaaaactatttgcataatttacttcaccaagcgcttctgcaaacggctttccttgttccttcgtcataatcgctgcgatttcttctttatttttatcaataagcatgaaccacttttttaacttcgtggcacgatctgctgccgttaacttagaccacgttttaaaagcttcatgtgcagcatcaacagcttgctttgcctctgttactccgccctttggtacagttgcaaatatttccttcgtcgcaggattatttacttcaatttgttcttgtagtgtaatccactcaccatttatatacatcgcctttttatctatacttacgaaagtcgcctttttatccaatgttttcttcctcctctatgaacttcttaattttcctagtagcagcagattgactaatttgcaaaaactcagctactttataacttgatccatacgttttatacgctttaagaataatatttctctctacctcttccagcattttataaaggctttgccccgattgttcaactgcagcctcttgcatagagagtggcaaatcctctaccgttacaacatcatcgacagtaataacaattctctcaattacattctctatttctctattgtttccttcccacggatatccaacaaacatttgtaacgtactcggcgctagtttcacatcacgtccgtattttttattaaaatgctgcaagtaatgataaataagcggcaaaatatcttctgttctttccctaagcgggggaattgcaattggaatgacattcaaacgatagtataaatctttccgaaatgttccttgtttcaccatctcgcttaaatctctatttgttgccgccacaattcggacatccactttttttaattctcttccgcctataggacgaaatgttttttcttgcaatacttgcaaaagcttcgcttgaatttcaagcggcatttcaccgatttcatctaaaaaaagagttcctttatgcgcggattctaatagtccctttttcccttcacgattcgcacctgtaaaagatccacctgaatatccaaaaagctctgattcaattaaattagttggcaatgccgcacaattaatttcatagaaactttcattcttacggtgactcacttcatgtaaatggcgtactaatcgacttttcccaactccagtctcgcctaaaacgagaacagtactatccactacagatacttttttgattgtatcgactattttttgcatagctagacttttaaaaataagtccttcatgctcatatgtttctcttaattcttttttatatgtttttagctgattatccatttcctctaccttttgacgtaattgatagagttcagtaaggtcccgagaataactaatcactcttcttaaatttccctcatcatcaaaaacaggccttgtacgaacgtgtaaatactctcctgattttgtagtttgaacgagttcaattggcctctttttttcaatcacttctaatgtcgctgatggataaaagattccatccttttgtagttcttttacatgcttaccaactaactcttcggcagctagttggtagtgcctttcacatgtactatttacacgcacaacgatcccttgctcatctgtaacaaaaatttcgtcaaacgcatattcaaatacatcttttaaatccattaacactcgttccttttctgcaaccatcctagccacccctaacttcaaatccatcgatccacttcactacctttattataaagtgaattttctgcatttaatatagagtcagctagaatgtttgctatttatacttcattttttaaacgcgagcgatgtttgtttgctcataacaagcttgcaatgattcttcaattattgttaaaccttcttcaagttgctcatctgtaataactaaaggcattaacacacggataacatttccatatgttcctgctgataataacagtaacccacgcttatttgcctctgcacatagattagccgttaacgttttgtcaggtgctttcgtcttacgatcttgaacgacctcaaatgcacacattgcacctaacccacgcacatcgccgatgcaatgatatttatttttcatctcttcgaatcggttcattacgacttttcctaattctatcgctctatcatttaatttctcattttctattacatcgagaacagctaatgcagccgcacatcctaatggacttcctgcatacgttccaccaagttcacctggtgcagactcattcataatttctttacgtccaatgacaccacttatcggtacaccagcacctaatgatttagacactgtaattaaatctggaacgacattatagtgatcaattgcaaaatattttcctgtacgactaaagcctgtttgtatttcatccgctacaaataagatgccgttctctgaacaaatgcggcgtacttcttgaacaaatttcttacttgggacgataaatccaccttccccttgaacaggctccattacaacagctgcaattgtttctggtgctacttccgatatgaagaagttcttaaactcttcaataataaaatcatcatattgctcttccgttaatccctctgggcgacggtattcgtatggaaatggcgctttatatacttctggagcaaagggaccaaacccaaatttatatggcttcactttacttgtcatcgtcattgtcattaatgtacgcccgtggaaacctttagaaaatgcgataataccaggtctcttcgtatatttacgagcgatcttcaccgcgttctcaactgcttctgcaccactatttaaaaagaggacttgcttatcgaaacttcctggtgccaatgccgcaagcttttccgctaattcaatatatggctcatacatcatgacattaaatccagtatgaatgtattgatcgacttgtttatggagcgcttctttaaccgctggatgacaatgccctacgttaattgtcccgattgctcctgcaaaatcaatgtactgattaccatcaacatctgttacaagagcaccatttgcagattgtacaaacgttgggatgccgttacttactccttttggtactatattttgacggcgttctaataaagatgccgctttcggtcctggaatttgttcatttactttagcaaatttttttgtgttcattgcgtaccccatccttttctttacattgttttctctttttattgcaaaatgtatgccaactttcttttctagcatttatcctatattctttgtatccaggcataaaaaataagtctataaagactcattaagagtctttatagacttattttccttacacattagacttttctttctcccagaaaaactcacccgattgagaaataaactctccaacagaatctaacactaaatcagcaagtggttctaatgttggacggtctcccgtaccagatagcaccccaattgcatagcaatcgccatttttggctaaatgtaaatcagttggcgtatctccaacaaccgcaacctcacatgatgctaaattaaatttttcacaaaacacttctataatctttttatctggtttttgcgcagggaatgtatccgaggctataatataatcaaaaaagttctccaacttatattgttttaaaaataattctgttggtgcgaaatcatccgccgtgacaacccctaatataaatcctttatcttttaatgcctgtaacactttcggtaaatctgctgtcattttcatatgcgaacgatgctcatacataagggaaaataacttctcacttacccaatgatgcatctcttcttctctagcagactcaatataattacaaagccccttcgctacatcaaggcttgttccagcagctattgcactcctcggattaacaaatgctccctctacaccaatctcttctaataaggtctgccgcattgtacttggtaaatgatataaacttatacattcagctacaagttcttcagctacttttatccatattgaatgaaaatccattaatgtcccatctttatcaaataatatcgcctttaccttctccatagcaccctacctctcatttcttatctcttccagtgtatcaataaagtatggatgtaaaataaaagaattgtaaaaataccataaaaatcaaactaactcccaatttacaattcattttaacaaagtaaaaaggatgcctttacagggcatcctcttgatgttcaggaacaaatagttctaaacaatgatatatattttcgaattccatcggtgcatctccaccatactcaccatctaaattaatcattagtttatctggtgaatgtactttaattcggttcgcttgtgtatataacacttttggattattaatatgttcaccacgttgtgcttgtgttgctgctttaattaaatcagcgatagaaccttttttcagtactaataggtcaaataacccatcgttaatagatgcatacggtgctaccttttcaaatccacctactgaacgggtattcgtaattaaaaacatcgtaatttcttcttgtagtaactttccatcatactcaatttcaacatatgtcggatgcaatgatggtaacatctcgataccttttaggtaataagcaagttgtcctaatactgtctttaacttactcggtacttcgtatgttaattctgtaatacgaccgccaccagcgatgttaataaaatatgtatcgttcgctctaccaaggtctaatggcactgtttttccttcgcaaataatatctgctgcctcttcaatagaacgaggtacaccaattgcacgtgcaaagtcatttgtcgttccaactggaataattccaaatttcggacggaattcatgcccaactaaaccgtttactacttcatttaatgtaccgtcgccaccagccgcaataacaacatcaaacttacgatccgcagcttgcctcgccgccacagtagcgtctccaggacccgttgtcgcatgacaagatgtctcatagccagcttgttctaatttttgtaatacttctggtaagctcttcttaaatagctcacgccccgaagtaggattataaataattcttgctcgcttcatcatttattagcacaggaaatttctttatgtatcgaaaaagaacatactgaacttctattcagtattcccatgcctacctcctctcatcttgctatccttcttttatcccgctcaaacaggcagtaagaacccgattcgtgtagtccatcaaaagtaaatattcatttcaatggttttttatttgacttcaaaatttatcccgctatttgcgggcagtaaatgcccgattggtgagggctaataatcaatggtggatgaacctcctactgattaaagtttcactttatttctatccattcttccataaaaatttacatataacgaataataactatctattatttcatgagatgaaaaaaacctctatgtttagatttatcattattcccacctttttgcaactatcataccatagttgctatacaaacatttttccacttttgacagttaatcaaacgtttgtttaaacgattttgtctcatttaaacaaacgtttgattaacctagaaaaacacccatgtacgggtgtttttctgcttaatctttaaaagtcactactattatcgcttattaatctcttcaagtaagattttgttaacaagtggtggatttgcttgtccttttgtagctttcataatttgaccaactaagaagccaattgcacggtctttaccgtttttaaagtcttcgatagattgctcattattatcaagaatttctgttacaactttacgaagtgtaccctcgtcagaaatttgaacaagacctttcgctttaacgatttcttctgggtctccacctttttcaattaattcgttaaatactttcttcgcgattttagaagaaattgtacctttttcaattaattgaaccattttagataaaccagcaggcgttaatgcaacgtcttttaattctttttgttgtttgtttaagtatgcaagtacttcacccattaaccagttcgatgttaatttcgcatcagcaccgtctgcaacagttgcttcaaagaaatcagacatctctttcgttaatgttaacacgtgtgcatcataagctggtaagcctaattctgcaacgtagcgagctttacgtgcatctggaagttctggaatagaagctcgaactgcttctttccactcatcatcgatgtaaagttcaactaagtctggctccgggaagtaacggtaatcgtcagatccttctttcacacgcattaagattgttttctttgttgcttcatcataacgacgtgtttcttgttggatgatgccaccagataacagttctttttcttggcgcacttgctcatgctcaagacctttttgtacgtaagtgaatgagtttaagtttttcagttccgcttttgtaccgaacttctcttgtccaactggacgaagggaaatgttcgcatcacaacgtaaggaaccttcttccatcttacaatcagatacaccagtgtattgaatgattgattttaacttctctaagtatgcatatgcttcttctggcgtacgcatatctggctcagatacgatctcgattaaaggcataccttgacggttgtagtctactaatgaaccatcagctgtatgcgttgatttaccagcatcttcttctaaatgaagacgtgtaataccgatacgtttctttttaccgtctacttcgatttcaatccaaccattttcaccaattggcttatcaaattgagagatttggtaagctttcgggttatctggatagaaatagtttttacggtcaaacttcgtttccgttgcgatttcacagtttaatgccattgcagctttcattgcaaagttaactgcttctttatttaaagtaggaagtacccctgggtatcctaagtcaattacacttgtttgtgtatttggctccgctccgaattctgttggactcgcagagaaaattttcgaatttgtttttaactcaacgtgaacctctaaaccaataattgtttctaaattcatctatgctcgcctccttacagacttgctttttttgtatgatagtctgttgcttgctcaaacgcatgtgcaacgcggtaaattgtcgcttcatcgaagtgtttaccaatgatttgtagaccaagtggcatgttgttagcaccgaatccacatggaacagaaatcgctggaacacccgctaagtttactgggattgttaaaatgtcatttgcatacattgtcattggatcatcaactttttcgcccactttaaatgccggagttggcgttgttggtccaataataacatcatagttagcaaatacattttcaaagtcgtttttaattaatgtacgtacttgttgtgctttcttgtaatatgcatcatagtaaccagagctaagcgcaaatgtaccaagcataatacgacgtttaacttcatcaccgaaaccttcactacgtgtgtttttgtaaagatctaataagttatttacattatcagaacgaacaccgtaacgcacgccatcaaagcgtgaaaggttcgcagatgcttcagaagaagatagtaagtaatacgttgctagagcgtatttagagtgtggaagcgatacttcctcccaagttgcgcccataccttctaatacttttaaagcagctagtactgactcacgagcttcttcgccaacaccttcgcctaagtattctttcggtacagcaatgcgtaaacctttaacatcgcctgttaaaccagctaaatagtttccaacttcaacgtttgcagaagttgcatccatgcggtcaatacctgaaatagcttgtaataagtatgcattgtcttctactgtacgtgtaatcggtccgatttggtcaagtgaagatgcgaatgctactaatccgtaacgagatacgcgtccataagttggttttaaacctacaacaccgcaatatgcagctggctgacggatagaaccacccgtatcagaacctagagagaatagtacttctcctgctgctacagctgctgcagaaccaccactagatccgcccggaacgtaatctaagttccatgggtttttcgtagcgtagaatcctgagttttcatttgaagaacccattgcgaactcgtccatgtttaatttaccgattgtaattgtgtcagcagcttttagcttttgcacaactgtcgcatcataaattggatcgaagtttgctaacattttgctcgcacaagttgtacgaagaccgttagttacaatgttatcttttacaccaattggcataccgaataataaaccattatcttcagcgccgatttttgcatctaattctttcgcttttgcgcgtgcattttcttcatctaatgtaagaaaagcttttacgttatcttcaacatccgcaatacgtttgtaagattcttctactaaatccgtaacggaaatttctttgttgtttaacttcttatgtaactctgatactgaatgatcaaataatgacatcgaaattcccctcctctattctaatactgctggaacacggatttgattatctttgtgatccggtgcattttttaatacttcttcgactggtaaacctttttctggtacatcttcacgcataacatttttcatagttaatacatgagttgttggttttacatctgttgtatctaattcattta

SEQ ID NO: 1357 - DNA, 17475 bp, Bacillus thuringiensis
gattttcctttatacaacaaaagtttcattcccttgatttttaagttacttattctattaaaaatttccatatcattcaatatgataacattaaatacacaaagctgactatacatctatacttttgtatttattgaaaatatatccattaataaaatttaccgatttagtccttcttattactttaagacagcagtaattctttcagtactaaataaaaaatgttattactcccattaaattgagtaataacattctacttaacaaattcgctgccaactagcatccttcacatcttcactagtcggttttctaactgatccaataaagtgaaactttatatccgcaacatggacaggtgtatttcattttgtcactccattattaacttgttttcccatatattccgactcacaaagaatgtaacagcacaaatcatagttatccccatgaaaaatgtattagaatcttcatatgtagttggaatgcctaccgttacgaaaacaatactaaaagctaaaaatagatataataataaagatataatatagcttagtttaaatcgtaaaatgatacctctaaacaatagctcaccaagtagacagccacctaaaataataggtactccgaaatacaatgtaaggactcccatttgcgcagtagattgaattatctttccaattatgttcggcgaaaccagctcactatcgtttcccatcctatcatataaatcaagtgctgttgctgaaataaagaaacttaatatagaaaatgaatacggtattaaaaatttgctcactctcattcacctcgcttttttctttacatatattattcattatttcctatcatttttacataaaaaaataaccctctatgataaaacatagagggtagcatttctatataaaaatctataccttatcctgaagtgaatcccgaaaataggacaaatatcaaaacacctaaaccatctgctatctgctccctacattctttagggtagatagtttatatgttttattagaaagtagtgccttcttttttataatattcttttgaaatctcttcataaaatgcggctgatgtcgcgtagaaataaggtgctaaccataagaaaccgattcctacagtaagaatacttaaaatgaaccaacctaagaaacttaagcatagtaaaaagtaatccattttatgtccattcatcatatgacgactctcagtaatcgcttgattcgctgtatattctggatgatcattcaaaataaaatatgtcatagaataagaaaatgatttaataatacctggaataataagaagtaatgtccatagagtcaagtatacatacattagtaaatatgttaaaaacgacttcatcaacttacttccatcgctaaaccatctaaatatatgaccaatgcgagcatcagtcccacgaattgcatttaaaacaagataataggcacctattgttaatggaccaataacaagcattactataatacttactgtaagtgaatcacttgcttcttcccaaccccaaaatatcgagaaaatacctgttgttagcatttcaacagctccaataaggattccaattaataaggttgcccctaccgctagtccccatcttccttttaatgcatcaagtgcttctcttttcaactgacttatcatatataacctcctaatactatttccattttattataccatttatatcaaaaatcccacatattttcctaaaacagaagcatattaccttttttcatacgtattgatacatgtgtgctgtagttgtactaatatatggattaaacgactcttttccctataacaaaaaagcctgcctttcataataggcaagctttctcaagttacatctcatttattttcttcttataccaatcctgcattctctccgcatcttctactctcgtatgctctattttataactagatgatgcactcgaaaacttatacgtacataaatccgcacggcgctggaaatatgattgtgtcttctccattgattggacgtgtcttcttctaataagtcctgtatattttccgacgctacgatagacaagtgtaatttgttctccgttaacactgtagccatttgttttaaatgttgcgtatccaagtgtaaagataaggattgcgagcggtagtaatgcccacatgatgtaatacttttcaaagtatatgcttattccagtaagcgggattgcgagcatagcgaaaaagataaaactatcaatgagatagcggcgcaatgctgcttttggtaacgaagtaatacttgcattcagttcgtatggtaattgtaaatgcgcgagtaattgttgcactcgatcttttcgaatgataggatgcagtgtaactttttcttctttcccttcactttgaatgacttctacttgcacagcacaataaccgaacggttggcgtaaaatgccttcttttatcgtaatcccttgaatgcggtgcaattttagtacgagttcttttctctccagtaacccttgcgaaatacggacttcatcattttttcgattcactgtgaagttaccgtgttttaacgcgtagccaattgtagatatcatccaagaaacgacaagtaaaatagctaccatgtaaatccagccatatatatcgtggtccattacatatgacgtcacactattttttatccatttcggaatatactcatctacttggtgataaacgaaaaagattaaagagaacaatactccaaattgaccagatgtaacagacgctattaaaatctctttccacgttaacttgtactctgtcgtttgtttttcctctgtaacaattgctttttctactgtattttctgctgcttcgtctaacgttttttctgctttcacttctggagttggctcatttagcaaagtaataagctccgtcgcctcttctaccgtaattccagctaagctaacttctgcttcatcgcccccgccagctgtttcaatctgaatttttttcaaaccgagcatttggtatagtacgttagaacttgtattaattgtttgaacacgttctttatttaagtagctctcctttttcacaaagagaccttgtttcacatgtaatacgttattttcgacccagtatactttgtaataccagcctacgatagctgaaataattgtgatcaacgcaaaaccaataggaactaaataccaaaatggaaactttccccttaagctaaaaagaaaaataatgagtggtataaaatctgttatttttaattctaataacatcgtgattggatgctgcctcttatacatcctcatcactcactttcgctaattctgcgattttcgttttcaacatttcagcttcatacatcgttaaacctgggatgctatgagaagttgctgctgttgaaatgtgtaattctgctaatccgtattttctcataattggcccttgttcaatcgtaacgtgctgcacacgaatcatcggtactaatacgcgctttacgacgaaaagaccatgctgaatttcaagttcttcttcatttagttggtagctgtaataacgttgacgtagtttcggaaacgtaaagtaatcaaacggtgtatatacaattgttaatccgatgagcacatagaaaatccaagcccaccaattaaacttaatcataaagaaaagatatgccaaaatgactataatactgattcctagctcaattaaagaacgcgctttccacaccttgaccatgtcagggtgaatttcatttttcaatggatccatgtaaccactccaaatctagtaatctaatatatgaatactctcaatctatattttacgtaactttacagaaaattgaaattcaatcttctttcttctcaggaataaaatatccgaaccaaagtagccaaatgaaaccgattaacttcatccaatttccatccgcttgaaaagcttcaatcatacctggtattttataaaccccaataaatccaagaaaaccgagccaccagtttttttgcattttcatctttactcctccttcattacgtttttcacatttcgaatccaaatttctttatactttaactggaatcccatgagcatatagttgctcatattatcaatcacgagtgctagcgtatgagcattttcttccgtttcatgttgtgacactacgtcaagttctacgcctttcttcaataaatcgtggaaaccatttaagaaatcttcttgtatttcaaataagcgtttctgatacttttcatttcgcgatgcagttacgagaaattcattgataacgcgtaatatcccttcttgcccttcatattcagagagcatatgtaaaccatcagcaattaacttttctgcaaagttttctttcgtatattgctctttatcgaaataactcacgaaatgatatccagagaaaatttcttcaaataaaaaatcgattaacgcttctttagaagaaaaatgataataaatagccggttttgaaatacctacctctttcgcaatcatggaaagactcatcttctcaatgccgtgttctgccataagtttaaatgaagcctctacaatgttttgcgatgtttgtaaattcttcgtcatactgtacctcacttatttttacttaccggtcggtaagtaaattataaaacaaaacgaaatgattttcaatttagttagcactacagaaggtgtttatcagaaaatacagaaagttataaagtaaaagcaacatataacaataaggaggatatcatatggggcttggtggtaatggcggtagtggtggtaatggcggcggtgaagcaggacaaactggtaagagcggattttcattaatcattgtactttttatcgtattgattatagttggagttagctatatcggacttggcttctaagaaaaggcgtcctacgttacacatgtaggacgccttctttttaatccctattcagcaatcgcatacgataacaattcatcgtcacttctccgagtctttgcagtagttgatagttcgcatatgcgcctaccggggcaccgattattggtacgagctgcagcattttggctaaatcgatatagtctcggtactctgtttggaacttttcccagtccatatgattttcttcttctgtatcccacgtttcgattgctttccatatttcttttcggtgatcgtcacttgaaaaggcaagctgaaaaacatgaaggataaaaaggcgctcttctttgttgctcgtatcaaatccgtacaatgtcgctgcatcgaataaaaatttaattttaatgccgagtaaaagcggaaagtcagcaagaccgaggagaataccgccagcccccgtccctgccccttctgccgctgctatttttttatactcatccatttttttacgaacttcatcgtcacgtctttgcagtgaccatgtcgtctcttttagcttcggctttataaagtttgacccggcgctgattgtttgcaccatcatacgaatcgtctctgttaataccttttgtactttcgccggaatgagctgttgcaccttcgtctgcactttctttgagaaccgtgtcatcatagaagaatctttcataaatgtagctttccactgctccagttcttttataaccttttcttcatatgtaatcataggttcattcccttcaatttaaacgctcaatgcgcttcgccccgtattggtaaacgaaaccgatactaaataatatgcttacgataagtaaaattcctgtcatcatgaaatctttcgttgctagtgcaaatataactgtaaagattacgctcccgatgattagaatcgcgtttaataaagtaagaaaatctttcttcttctcttctccccctaccggatacaaatcaagccaaatcttcatgcggtgatgtttccataaagttaagagctgataaccgattaagtataggaaaataaggcttacgataaatcgtccatataaaaacggaatgaagtacaaaataactcctccaagagcgagcaaacgcacatataatccaaaatagttacctgatcttaaaaacgttctcgtatataagtataaatatgtacgcttttcaccaatcatcgaaagaatgaaatcgagccattttctgcgtgctactctttcttttaatgctggtacatcaacgaacatgttcgcgatgcggtacagcagcatcatcttcttaccttcttcagaaattaaatactcccagtttagcggctttcccttcaccatttgatgcagtactacgaggtataacaccatgagaaggacgattccaccaataaacataacggaagtacgctctaaaaggaaataaacaaataagccgtttaaaataaaacgaatgaaccaatcagctctttgtatattttgatctgttaaaaatgacttttcccatgctacgaataagttccacgcttttacgatgacaaacgcgagtacaatccatatgtaagccgctcctgtttgtttcatttgctggaagtataacggagcaagcgctgccgctacaattgcgattatgtacaactgaatcataaacgtaaaaagaaacgcctttgtaaagtatggttttaatttttgttcaactggcagcaagtaaacgagatccgcttcttttaataacgtttgaatggatccagccgttaacacgagtccaattaatactgccattacgagcgccgccggaaacgaaggtgttaacgtttgtaaccattgctggtaataatacgctcccgcaccaatgatgaacacgaaaataaatttcaaatgatcattaaatacgtatttactatatgtacgaacttcttttagaaagtgacgaaatcgttctttccataacgctgtgctattcataatcttcttcctttgttagcgcgatgtaaatatcatctaacgttgcacctggcatattaaactgtgattgcagttcagatagcgttcccttcgctcttacttcaccttgatgcaaaataatgaacgaatcacaataacgctctgccgtcgctaaaatatgtgtgctcattaaaataccggcaccactctttttcatttggtccatcatttgaagaagggattgaatcgctaacggatctaatccaacgaaaggttcatctactatgtaaagagatggctccactaaaaatgcgctcataatcattactttttgtttcattccttttgagaaatgagatggaaaccattttaaacgatttttcatacgaaactcttgtagtagttgtcctacacgttcttcatattgtttttcatcaatgccatacgccatagctgttaatttcaaatgctcttctaacgttaattcatcatataatactggcgtttccggaatgaatgaaaagctagaacggtacgctgtcatatcatcacgaattgttttcccattaattgtgacagttccttttttcggttccattaaaccgataatatgtttaatcgtcgtacttttaccagctccatttaaaccgattaagccgacaagttcgcctttattaacagagaacgaaacgtcttttaatacaggtcgtttcgtatatcctcctgtaacattttctacacgcaataactcgctcatacgacaccactttcttcattagtattcattctatattcatcttaccaaaaattatgctgtactacatagtatccatgtactcaaaaaaattttttaaatttattagcatatatttttccgaaagcggacatcataattattgaagaaggaacacattgaaaaagcaaccaccaattgatgagtacaacaacatagtgaagtcatcatgaaatggggtgtccaagttggacaatgaaatttacacataaccagatcatttgtttcattttcgaaacggggtgtctctgaaagagcatatactgttttaaaaaataaacaatttcattttaaaaaagattgcaattcatttcacttgaaaatggggtgtctacggcagaaactttagccgatttaccgtgcatttcttaaataaatgaggtgtctgcgaaacgtaaattacgataatgctttttcaatccctcttcagaaaacaggaagctgagtcagcttcctgtttttcgtgtttgttctcttatataattatggtaaaatacggctaaggatatttgaaaggatgagatcaatgaatcatacagcagacaattgtattttttgtaaaatcattgacgggcaaatcccttgctcaaaagtatacgaagatgaacatgtgcttgcatttttagatattagtcaagtaacaaaaggacatactcttgttattccaaaagttcacaaacaagacatttttgcgttaacgccagaaatcgcatcacacattttttctgtcgttccaaaaatcgcaaatgcgattaaagcagagtttaatccaattggctttaacctacttaacaataacggtgaaaaagctggacaaactgtgttccacttccaccttcatttaattccacgctacggtgaaaaagatggtttcggtgctgtttggaaatcacaccaaaatgaatacactatggaaaatttacaaaacatcgcaagtacaattgcaaatagtgtgaaataatgacactataagaaggcgtaatacataacaagccagttccctgaagtcatcaaattccgcatggcttgtttctttacttaaaatgctcagggatgattgtttgtgcatagcacatataagaaagatatgcatatttttcccatcatgaatacgaacaaaaaataaggaggtctccttttatgtcaaaagctaaatcctttattacaggtgttatttgcggcggagcagttgctggactagctgttcttttctcaactccttcttctggtaaagacatgcgcggcaagttaaaagaaaaaggaaatgatattaaaaagactttagctgatattacagctgatacgaaattattaaagcgtcaaattattgaaactgcttcagaaggtaaagaagtgtttcaagaattaaaagatgacatgcaagacacgctttctaactggaagcaagatatttctcaaaacaagcgccatattgagaaagaaattttggacatccaaaagtcaattgagaaactacaagaagctgttccagaaaaagcgtaaacaaattcctgcttagttttttgcatataacaaatattttttatataaattgaccttgacacggcatatcatatagatatgccgtgtttttatgcatttacaatatatgttatcacttaacatgtaaggacaacgtatgtattcacgactcataaaacgcttccatagttatgcatgatttgtatagaatgtcatttttccgaaaaattttcacaattctcacaaaaagactttattaatttttattttactggcataatagatagtaatgaaaaaagaatgttaaagtgggtgagtaaatgaaaagtggagaaaaagattactcggtaaaagaagcgatgattttcagccaacgcattgctcaattatcgaaagcgttatggaaatgtgtagagaaagattggcagcagtggattaaaccttacgatttaaatattaatgaacatcatattttaacaatcgcttatcatttaaaaggggcttctatttctgagattgctaagtttggagttatgcacgtatcaacagcgtttaacttctcgaaaaagctggaagaacgcggctatcttgtattctcgaaaaaggaagatgataaacgaaatacgtacattgaaattacagacaaaggggaagaattactacttcgcttaatggaagagtatgatcctgaaaataattcagtgtttaatggggctcttgcacttcgtaatttttatgggaagttcccagaaaatatcgaactgattgcaatcctgcgtaacatttacggacaagactttatcgatatttttgagaaatcattagaagatattgaagagaactttacagaatccgatcaaaagttagttaagaaataatctatttattttttcgcaatcatgcttaagaattcattcataagcggcttaaataaaccttgttttgctagcgcttccgcagtttcgtgtacttcgagctgatgtggaagcgctttttcaaattgatctaacagcgcatcgaacaaaagaagcccttctgctttctccactacatattgatcgttcagtttttcacaaagatttagtatacgttcaatatcttttttacgagcttttttctttatgatcaaagaataaaatggacacttctcttcatcaatcattttaaataataagtctacatagtattcagcttgttctaatcttctaacaacgtccattttctccctcactttctaacacaaagtcttctatttctgaattttgtaacacgaacaaaatatcgtgtgatacaatatatgtatatgtattttagccaaaaggaggtctcgcctcatgacacttataacagttgtttttgtcgcattcgcacttcttgttatattttacacgaatttcatgacacatacactgtgtgaacgaaaacaaatagctgcgagccgccagcccggtgtctttcgggttattaatgtatgtataacaattttattaatttctagttatatagaaattatatttcatggaaagtgaggaaggaaagccccttcctcacttttttcctctataagcaaattatacctacaataaccaataaaataaacagtacaagtaataaaataagttgagaattcatccccatcccctcctctattctgtatatgcggcatacgcccaatatggcacactttcaaaatctgacacgtactggttaatttttctttatcaatatgaaaatgcgtcgaaatatgatatattaaattttgtacatattgcttatactatagaacaaaacattcatcaaaactttatcctcagccacggtaagccctgttaagcgcgctttaccaatataaaaaagcaaaagtatcagtgagacttaatcgggctcttatgaatgaaaattcatcggtgtaggataaattaaaaatacataatagtaggagtgtttatcgaatgaagaaagctatgcttgccttagccgcaacaagtgtaatcgcattatcagcatgtggaacatcatcatcagacaaaattgttacatctaaagctggtgacattacaaaagaagaattctacgaacaaatgaaaaattcacaaactggtaaacaaacactaaataacatggttatggaaaaagtacttattaaaaactacaaagttgaagacaaagatgtagacaaaaagttcgatgaaatgaaaaaacaatacggtgatcaattcgatacactaatgaaacaacaaggtattaaagaagaaactattaaaaatagtgtgcgcgctcaattagctcaagaaaaagcggttgaacaatcgattactgataaagatttaaaagcaaaattcgaggattataaaaaagaaattaaagcaagtcatatccttgtaaaagatgaagaaactgctaaaaaggtgaaagatgaacttgctcaaggtaaatctttcgaagaattagcaaaacaatactctgaagatacaggctcaaaagaaaaaggtggcgacttaggattcttcggaccaggaaaaatggtaaaagaatttgaagaagcagctcaaaagttgaaaaaaggtgaagtaagcgaacctgtaaaaacacaatttggttaccatattattaaagtaactgataatcacgcagatgcaactttcgataaagcaaaagctgatattaaaaaagcactagttcaagaaaaaacacaagatgctcaatttatgaacgatcttatgatgaaagaaatcaaaaaagctgacgtaaaagttgacgataaagatttaaaagatcttttcaaagagcaaaaagctgacgataaaaaagacgaaaagaaataatgaagtaaaaagcttgggcttaggcccgagctttttttatctcctcttctctcagtagttaatctagattcggtaaatgaaattatatcggcgatttttcaaatatatcgaccgcaactccaattatatcggcgattttcaaaatatatcagcgcaactccaattatatcagcgattttcgaaatatatcgacttaccgacaaaaaacgacaacaagcgtgactccctcttcaaacacaaaaaaaccttgatccacgccacgtagaaccaaggtttatcttattatcattgattaaatgaaaaaactatgttaaattagaacagaaacacgttttacaaaacaaaaggaacgtatttatccgtatcttaattgtacaccaaaacacatcttcagtcaacctctatttttcacttttaaaggagtgcttaccgtatgaacaaaaaacttgatctagagcaaaaaagattggataccgtaattgaaacaattacggagcaaattgataaactggaaaacgaaactggcagacgccgagcagaagtaatcaatattcgtaaacacttttgggatgatgtgaaagtgaatactgatactttcgatgattatcttgaaacagttatcaacttaagacaacaagctcagtcactagctgtcacacaaattacccataagcacacctttaatcgacttgccgcattaagacgcatgcataaagcaccttatttcggacgaattgatttcaaagaagaaggagaatctgccgcggatcaaatttatatcggcgtcgctacacttactgatgcaagcggagaaaacttccttatatatgactggcgcgcacctatttcgagtgtgtactacgattatccaccaggaccggctgaatacagtacaccaggcggcgtaatccacggtaatgtggagaaaaaattacaatacattattcaaaatggcgagattgattctatgttcgatacgagccttacaattggtgatgaaatcttgcagcaagcgctcggaaaagggacgaataaacatatgcagagcatcgttgctacaattcagcgcgagcaaaatgaaattattcgtcacgatgaaggccgactccttatcgtgcaaggagctgctggtagtggtaaaacgtcagctgccctgcaacgaatcgcctacttactatataaatatcgcgaatggttaaaagcagatcaaattattctcttctcccctaactctatgttcaacagctatgtttctaacgtactacctgaactcggcgaagaaaatatgcagcaagtgactttccaagaatatttaaaccatagactaagtaagtcatttgacgttgaagatccttatgaacaattagaatatatgttaactgaaacgaataatcctacctataaaacgagaaatgcgagcattcgatttaaggcatctactcaatttttcgagatgattagagcgtacagacaatctcttgaatcttcaggcatgctatttagaggaatgaaatttagagggaaactgattgtttctgcgaaagaaattacagaacaattttacaataccgactcctccctccgcttccatagtcgaattgagaagttaacggattggctaaacaagcaaatagatgcacttgaaaaagcagaactgaaaaagccttgggtagaagaagaaattgaattacttagtaaagatgaataccaaaaagcttataaatatttacagaaaaaaggcgagtttgacgacaactcctttaatgattttgaaaaagaaacgagagtacttggacgtatgattgtccgtaaaaaattgaagccactgcgtaaaggcgttcaaacattacgctttatcaatttcacaggcatatataaacaacttttcacagatgcatcatgggttactgagaaaaaaccgaaagagtgggatgacatttgctccttaacagtaaacatgcttgatgaaggaaaactatattacgaggatgcgactccattcttacttttaaaagaattaattgaaggcttccaaacgaacagatcgattaaacacgtactcgtagacgaagcgcaagattattcgccgtttcagttcgagtttttaaaacgtctcttccctgctgcaagaatgactgtactcggagactttaaccaagcgatatttgctcatgcgagtgaaacggttaatttcgatacacttacaaatttatacggtccagacgaaacaaacggcattaacttaactcgtagctaccgctcaacaaaaccgattattgaatttacacgtgctctcgtaccggaaggcaagaacattcacgcctttgaacgtgacggcgagaaacctacagtgacgaaagtatcgaatgtcaacgaactgcacgaacgtattactgccaaagttgctgaactacaaaaagagcagcacaatacgatcgcaattatatgtaaatctgcagctgaaagcgcagctgcatacgaagcacttaatcatatcgataatattaaactcgtgaagagtaactcagccgagtatgagcaagggattgtcgtaatccctgcttacttagcgaaaggtattgaatttgatgctgttattatttacaatgcttctaaagatgtgtacagcgatgagagcgttcgtagattgttctacactgcttgcacacgcgcaatgcatgaattgcaactttatagcgttggcgaggttagtccttttatacttggagctgattcggagagttttgagcttataatgaaaacaccttgataatcatcaaggtgtttttctcattctaaaaggaatatctttacgtcgatatacactcagcacaatccccattataaatgcatgaaacagagttggtatcaagccgtaactaataaagggtaatgatatagaaacacgtggtaatatcccaagaatcatgccaacgttataaacgaaatggaatacaaaaagagttactccaccaacgaggagtaatttaccataaccatcatttattttataagctatattcattattcttactgcaaaaagagacaaaatcaagacaagaactagcgcaagcacatatccataatagtaagtcaaacttgcaaatacaaaatcagtatgagtagcagggatagactttatatttccatatgtaccaaaccaacctgccgatgccattgcctcttttaaacgtaaataccattgatcatgctctgggtttaaaaaccctaaaattctagctatccggtattcttttacagcagaccaggaaaatagatctctaataataagaagaaaaattggtaacattgtaatgagccatgctgttttctttcctatcttactccaccaaagcataacgaataccatcgtcatatagatgaaaattggcaccataatcgatgtcgttaaaaatagatataaagaaaataaatacaacatgaaaagatgtataaactttaatctactgttattaaaaaaagaagcccaggctagaaaaaagaatggtatcgtcattaaacagtcaattttgatgggaccaattttcattaacgcttccccatttatagaaatagtcggaaaacattttatagctaacaagataagtattccaattgtataaaacagccatccaaacctctctagcttccggtaatcaagcaacatcatcccaatggctgttgcaatcccaagaattacaaaaattactttgttcattagtaaatcatccgtatgcccaaaagcgattattggtaaaaaacctaatcccatagcagctactaataaaataagtaaaaaccaatccacctttggcttatgaagtttattaagttcttgccctagtttaatcggacttcccatttgttccaccgctttattttcagcgacttcctcgctcaaacctttttctatccatgtgttcttcgcctgttttaggtgaaaatctagttccgttgctacaaaatctttcgcttcttttgatttaatataattcgtaacttcgcttacaaaacgctccccttttttattcaatttctcctcactcctgtactaagccttttaatataaattgtaccttcgtagcatttttttctgcctttcgcagcatctttctccctttatcgtttaattgataatatttcgctcctgcatgatcccagctagattggatcaaacggttctgttccagacgatgtaatacggtatataaaaacccttcatttccttcgaatttccgaatccctctccctcgtagtagctgtgacaattcgtaccctgttttttcattactgaggagttgtaaaatcgctaaagagatgtcctcttccttctcgtttgaagcattgattttttcgcgcacctgctttcgatgttgatcagaaaaactcaaatgtttaaacgttgtattctccattgattttcgcagaccttttaattgatcttccatttgattattcctccaatcctttcttcaaaagctccttcgcttttttcagtctcgtttttatcgtattttcctttacgtctattactatagcaatctctttaattgataactcttcataataaaatagataaatgacttctcgatattttatcggtaaattcattactgcagaagccagttcacggtcctccgcattttgaatgacagtttgttcgacactaccattttgaacccccatataagcagcttcatcctctgtcacgatcaccttgttgttataccaactttttatatagtccttacattgattaatcgcaattctccataaccacgttttcacattcgacttccctttatatgtatgcagaaatttatagcatttcacaaatatatcttgcgttacatcctcagcaatctctttattgtttacatatgaatacacaagctgcaggacttcttgcccatacttgttcataatttcatcgataaggagttccttatcttctatttcaaacgcttctaccgttaattcatccacatcatttcctccttcccatatattagacgacgcactgtatgaaaaagttttataaatacataaaaaaatacggatggtaatgtccataccgtttttttatgaatatttatttacttcttttcccctgacactaatgctctgcttaaaaacaggaattttcatccatatatcttgttccctattttaaaacataatacaattaaaatgtatcttaataagctataactagtaggtgtggcaatcatctcttccattttgaaaaaggggggaggtgataatataatcgcgatgtttataattaaattagtgtatggtatcctaaccggagctggcgttgtcatcggtagaagatacgtcggtccgtggctaatttctgtatacaaaaaagcgagaaccaccctgcttcgtggaaaaggtaagggcggttctcggctaaaacgttaatgtaattgtcttataaccgcacctactaccaccacaatagcaagtttacgttacacaaggcagaagtttctcag

SEQ ID NO: 1358 - DNA, 14084 bp, Bacillus thuringiensis
tttattttatcgccggttcgaccccggtcgggaccgtcacttttgtttataccaccatcagtggttttatatatagttttggctcggtagctcactcggtagagcagaggactgaaaatcctcgtgtcggcggttcgattccgtcccgagccactctcaggatattaagtgggcccacttaatatcctttatatttatgtaattatacaaaactgagtagttattataaaatagaacgaggagcctctagcagttgaagctagaggtttttctatagatcgtataggatgccgtgtaaaagtggatcatacatgagtctatgagaatagaggagaaaatacttaaacaaaggatgcggtcatataggacatactatgtaaacatcaatatgtttagggattattgaccatatttttataaggaggaaatagacgatgatgggaaagaaaattttagtagttgatgatgaaaagccgattgcagatattttgaagtttaacttagaaaaagaaggttttgaaatagtaatggcacatgatggtgatgaagcaattgaaaaggctaatgaagagcaaccagatatggttttattagatattatgctaccaggtaaagacggcttagaggtttgccgtgaaatacgtaaaagctcagaaatgccgattattatgcttacagcaaaggactctgagattgataaagtattagggcttgagcttggggcagatgattatgtaacgaagccatttagtacgagggaattacttgctcgtgtgaaggcgaatttacgccgccatcaacaaggtggtgctgcggaaaaagaagaaaatacagaaatggttattggaccaattgtgattaatccaaatgcatatagtgtaacgaagcgcgaggaaaatatcgagcttacacatcgtgaatttgagttgctacattatttagcgaaacatttaggacaagttatgacacgcgaacatttattacaaacagtttggggttatgactattttggagatgtgcgcacagtagacgttacagtacgtcgtttgcgtgaaaaaattgaagataatccaagccatcctactttaattgtaactagacgtggagtagggtattacttgcgtgacccagagcaggaatagtatatgaagaaagttggtttttttcaatctattcatttaaaatttgtgcttatatatatgctattaatattaatagcgatgcaagttattggagtatatttcgtaagggaattagagaagagcttagtacaaggttttagggattctttaacgcagcaaacaaacttattatcatataatttgaagcaagagtttaaaaaaagttatacaaaagcagaaacagagtcaacagatgaaacgattaaaacttcaattcgaaaatttgcctctgatcagaagaaagttatacaagaggtaagtgtatttgattcgcacagaaagttactggctatttcagatgaatcaaagcagaataaggtgaatcgaacatcaactgatatagctgttcagcgagtgttagtacaaaaaaagccagaagtgaaaattgagaaggatggtagtacaggtcatcgtgttcaagttatgcttactccgattctagatgataacggtaaggatgcgcttggtgttatttacattgtggcatctatggaagatgtatataaacaaatgaaggatataaatcaaatttttgctacgggaacagtaattgctttattagtaacggccgtacttgggattttattggctcaaacaattacaagaccaatttcagatatgcggagacaagcaatcgaaatggcaaaaggaaattattccagaaaagtaaaagtgcatagccatgatgaaattggacaactggcattatccttcaataatttatcgaaaaaattacaacaagctcgttcttctacagaaagtgaaaggcgtaaattatcatctgttttatcacatatgacagatggagtaattgctactgatcgaaaaggggatattattttactaaatgaccctgcggaaaagatgttaaatgtttctcgtgaaacagcgctcgatcaatctgttttagaggtattaggaatacaggaagaatttacgctcgatcatttatatgaagagccagattctgttttattagattttagtacgagaaacgaaccatatattttacgtgctagtttctctgttattcaaaaagaaacagggaaggcaaacggcttaattgctgtactatatgatgtaacagagcaggaacgtatagaacgggaacgccgtgagtttgtggcaaatgtctctcatgaattaaggacgccattaacgacgatgcgcagttatttagaggcacttacagatggagcatggcaggatccaaatattgcaccacaatttttaacggttacacaagaagaaacagaaagaatgattagacttgtaaatgcgttgttacagctatctaaactggatagtacagagcatcgtttaatgaaagaatgggtcgactttactgatttctttaataatattattgatcgctttgaaatgtctaaagagcaaaatgtaagtttcaaacgatctttctctaagaaatctagatttattgatatggatactgacaaaattactcaagtgctgtataacattatttctaacgcattaaagtattcaccagaaggtggaacagtaacatatcgtttacgtgatcgcggtgatttattagaaattagtgtaagtgaccaaggaatgggtattccaaaagaaaacgttgataaaatctttgaacgtttttatcgcgtagataaagctcgttcaagacaaatgggtggtacgggacttggattagcaattgcaaaagaaatgattgaggcacatggtggctctatttgggcgaagagtgaagaaggaaaagggacaactatttatttcacgttaccaatggcagcagatgaagaggacgattgggaatgagtatggaaaactttaaaacaatagttttaattaacctagttgtaattagcctatttcttacttttaatctatggacgtatgtgccagattctacatccatgcaaaacgcgaaatttgtacaggggaacgaaggaatgaaccaaactaaaatttccgatgttgtccgtcctacttctatcatcgtgcataaagataaaaatcattatgggagcagaagagaggcagatatagaatcaatctataagcctctagaattaggggaactacatgattttagagagatatcaatcactaagggtgatttcctttcatatgtgcatggtgaagggaaagttgaacttgttttccctaccgatatcccatttgatgcagttaaatccatgttcaacatgaaagagaaaagtacagataagcctaaacattttaatcgtattctccttgatccttctagaagtaaggatcaagaaattaaaattaactttgtttctgatggtgataactttaaaatatacgaggcaaaattaagtggcttgtatttaaaagatattgtaaatgcccaaaatcaatttatagtatcagcaaaaccttattttgattatcaacttaatgatatgaaaaaattatttttaccagatggaacgacagagttaagcaatataacatatatttcatctaatttagcagttgatacgtttaagaatgctctgtttagtgatcctcgttatttaagtccgattaccgagatgtcgaaagaaacatttacagatggtattagatccatggaaattgaaaacgatcgtcacatgctaaagtataaaaactcttctgtcttaactgagaaaacgatagataatttaatgcttttacaaaaaagctttgaatttgtaagtggtcacagtgggagtttggattcatatcgtttggactatatgaataaaggagagacagtatttcgcttaaatgaagatggatatccagtattcaatgcagatggattagcggaattaagacaagtatggggatcagaagaagtaatggaatatgaaagaccgttgctgtctttaaatactaaaggtatagaacagaaggttactcttccgtcagggcatgttgtaatagcatccctagaaaataatccagagataaagaaacaagtaattaaggatattggcattggatacaagttatcactagatgggcaagtggttcgactacaaccaatttggtatgtaaagcttgttgaagatgaaacaggtaaacagaaaatctatgagtggagtgagggaggactaaatggattgggatcggattaaaaccatatttattgtgaccttttttgttttggacctctttctcattttccaattcattcaaaagcaagatagtaatcaattggagcttattgcagaaacaaagatagatcaagaattaaaagcaaataaaattacgatgggaaatatccctaaagaaccgaaaaaagagtcatttattagagcggaaaataaagcctttaaagaagaagatatacagtctttgaaaaatcaaacggtgcatatacaaaatatgtacaagatagaaagtaagctaaaagagccttttttaaatacgaaatcattatcaaaagataagtataatgaatttttgaagaactatgtattggatggacaaaagtatgaatttggagcggtgaaagactctaaaatttatttcttccaaaaatataaagataagcctattttctataataatcaggcgatgattgttgtggaattaaatgaaaaaaatgaacttgtttcatatacgcagacaatgctaactgatttaaaagaaatgggcgaaggtgaaaaaacgaaagagcaagaaattattacggctcaaacagctttagaaaatttgtatttaaaaaataaaattcatggaaatacgcatgttaaagaagcgcaaattggttatgccactcttaccgcatctacttctaataaccaagtacttgctccaacgtggaatttaaaaacggagcagaagcaggacttctttgtgaatgcaattgaaggacaagttatggaattaggagaaaaggaaaatcgagtggttgatgaacatactggagtgagaaagaatggggttgcattttagcgtacttgcaagtggaagtacaggaaatatgctatacgtaggaaccgatgaaaaaaaattactagtcgacgcaggtttaagtggtaaagcaacagaggctttatttaaacaagcagaactgaatataaatgatgtatcaggtattcttgtaacgcatgagcatagtgatcatattaaaggattaggtgtattggcacgtaaatatgatttgcctgtttatgcgaatgagaaaacatggaatgcaatggaacatttaataggaaatatcccaactgaacaaaagtttcttttctcagttggtgatgtgaaaacatttggtgatattgaagtcgagtcatttggagtttctcatgatgcggcagaaccgatgttttatgctttccataacaataataggaaattagcgcttattacagatacgggatacgtaagtgaccgtatgaagggcgttattaagggagctaatgctttcgtatttgaaagtaatcatgatgtagaaatgcttcgtatgggacgttatccatggagcattaaacgacgtattttaagtgacgttgggcatgtttgtaatgaagatgctgcattagcgatggcagatgtaattacagatgagacaaagcatatttatttagcccatttaagcttagataataacatgaaagaactagcgcgtatgtcagtatcacaagtactagaggaaaaaggatttggagtgggtgaatcctttgaaattcacgatacagatccaaaaatgcctacaaaaattcaatacgtataattcttcattttagtaaacaataaaggtgaatatagttgttttcaggaagataggtgaacaaatatgtcctttattgatgaagaaagttatcgtatgaaacgtgcaggaaaaaagaagcacaaaggtatagttttttctagtatagcgggaacaattgtaggagcttctttatttgcgtttggagcgcctttattttcaaattctgctgatacgcttccgcaagctgaagcaagcggaagtaatatggctgaagctcaagggattaaacagattagctttgtagatgctgttgatcgtgcatctgaagctgttgtgggtgttattaacattcaacgagataacttttcagaggcagattcagaggccggtacaggatcaggagtaatttataaaaagacagatggtcaagcttatattgtaacgaataatcatgttgtagctggagcgaatcgtattgaagtaagtctaagtgatggtaagaaggttcctggaaaagtattaggaaccgatgtagtcacagatttagctgtattagaaatagatgcaaagcatgtgaaaaaaataattgaaattggcgattctaatactgttcgcagaggagagccagtcattgcgattggaaacccacttggactgcaattttctggaacagttacacaaggtattatttcagctactgaacgtattgtccctgtagatttagatcaagatggacattatgattggcaagtagaagtgttacaaacagatgcagcgattaatccggggaatagtggcggtgcgcttgtaaatgcagcaggacaattaattggtattaattcaatgaaaattgctgcaaaagaagtagaaggaatcggccttgctattccggtgactagagctgttccgattatgaatgaacttgagaagtatggaaaagtaagaagaccttatattgggattgaacttaggtcattaaatgaaattccaaactattattggtcaaaaacattacatttaccaggtactgtaacagagggagtttgtattttggatgtgaaaagtccttcgccaggtgcggatgctggtttaagagaacatgatgttattgtggcggtagatggaaaaccgattcgcgatattattggattccgtacggccttatatgataaggaaattaatgataaaatgactcttacgttttatcgtggtacaaaaagagtaacaacaacagtgaaattaggcattcaaaagtattaaaaacaggagggcctacctcctgttttctattgtagaaaagtgaggtgtagaaaatgaatttaccttgttgtttagaacatgttgaattagcgttagatattattgtggatgagtgtgaagtcgcaccagttatcaacaatgtggataacttagaaaaagagaaaaaaacatgtgaattttgtcaaaatgaggcgacatatgttgtatcgaacacagattcccacacaatatgtgggtagcgtttgtggatatgtggataagttttgtggataacatgtttgtaaggtggaggatacgtgtgaatatctcgattatttcaattgggaaattaaaagaaaaatatttgaaacaaggtatagcagaatacttaaaacgattatctgcatacgcaaaagtagaagtgattgaattgcctgatgaaaaggcgccagaaaatttaagtgaagcagaaatgttaattgtaaaggaaaaagaaggtatacgtatactggataaaatttctgatgacacgcatgtgattgcattagctatagaaggaaagcaaaagtcatcagaagaatttgcggtaagtctagatcgccttgctacatacggaaagagtaaagtcgcatttgtaattggtggatcacttggactaagctcagaagtgatgaagcgttcaaatgaatcactttctttttcaaagatgacattaccacaccaattaatgcgattagtgttgcttgagcaagtgtatagagcgtttcggattaatcgtggggaaccgtatcataagtaatgtattctatgtaaaacactgatattatcatatttattttattatgcctataattggaggctatgtgaatggtaagtgatcagatgagatattctagactcgcaaatataacaaaaataataaatacgaaattagaactacgtgacgtattgcagcgtgtgacaatggcgatatcagaggaaattgttaggtgcgatgctgttggaatttatttacctcaggaagatggaacatttagagggtttgcaggaaaaccagagactataaatggcgtaacgcttgatactcaagtaattgatcctgaaatagacttgctggcaaaagaggttattgaaacgaaaaaacccatctatattcctgatacctcaaaggatcatcgaccagatccgagaccggttaatgcattcaaaattaagtccttattagctctgcctatctcatttgggcaagagttatttggtctagtttttttgtttgattatggaattccgatgaacttaacagattcagaaattcaaagtgttgaagcttatgtaaatatggctgcggttgcaattcaaaacgcaaataatttaaaacaaaaggaaaatcttattgctgagaagcagctgttactaaatgttacacgtgatttatcaatgtgttcctcgatacaggagagttttgataaatgctttttttacctagaacagattttagagagtaaaaatatgactgcccatcttctagatccgctaaacaaaacaacaattaaaacaacgaaattaagtaagggctgtcattggacagaagcggattggacagagaaaagctatgaagccaagatccaagaggttattcaaacaaaaaatatagatagtaagggtctattgatgattccattggtttcaatgggagaagtattaggggtaatcgtcgttggcaaagaaggaaaagctcacaattatgatgattcccaacttcaactagcaaaatctatcgttgatgctacagcccctacgttttcgaatttgttatatatggatcaactagaaagcatagtggaagagcgaacgagagagctagctgctgctaatgaaaaagttacaagtgtgattgaatgtattacggatggattttttattttaaataataaatgggaatttacgtacgtaaataagcaccaatattttccgcaaagaaaaacagcaaaagatgtattaggaaagaatatatgggatgttttcccgagtgaaatcgacacagttatgtataaggaatttcatcgtgcgatgtcagagcgaactacagttcattttgaatttctttctactgcagatgaatattggcacgaagttattgcatacccgtatgatgatggtatttgttgtatttttaaaaatataacggaaaaaaagaaatatgaacaggaattgaaaagattatccaacatagatttaatagggcaaatggcagcaggtatcagccatgaaattagaaatccaatgacaacagtactaggatttttacagttattaaaagaagataatgcctatgagaaacataataagtactttcatttaatgattgaagaacttaaccgtgccaattctattattactgaatttctctcaatgggtaatacaaggaaatcggatttgcagatgttagatttaaattcaattatccacgatattattcctttaataaagattgatacgtacaatcaaaataaatatattcaagtcgatacaaatgacattccagaattacttttaaatcgtaatgaaatacggcaattattaatgaatctatatcgtaatggcttagaagcgatgaatacagggaaagttctaaccattagcacttacaaggaaggtcaaaattgtgtggtgcttgcagtgcgggatcaaggaaaaggtatcaggcctgaagtattagagaaactgggtacgccgttttacacgaccaaagataatggaactggattggggttaggtgtatgttatgccattgctgcccgccataatgcaaaaatagaaattcaaacaggatcggaaggcactaccttttttgttaaatttaattatgaaaataataaaaaataaccttatttagaatagttacgatgaaccgtatcataaataaatttattctttgcatataaaaggataaaaagaccattggacaaaaattaccgatggtcttttaaatattattagatggtatgtagatttcctaaaataagtatgtttctatttccataaaaatatgctgtaatatgaagaggaaaaagtataagtagttagagaagtgaggaattaaaggtgaagaagtttaagaagttttacttggagattacgagtgtatgtaatcttgcgtgtagcttttgtccgccgacggaaaggcagaagcaattcatttctgtggaggattttgctaaaagattagaccaaattaaacctcacacagactacatttatttgcacgtgaagggtgagccgttgctccacccgaaaatagatcaactattagacttaagtcatgaaaaagggtttaaagttaatattacaacgaacggaacgttaattaataagagaagacataggctgttaaataagcctgcgttaagacaaatgaatttttcactgcatagttttgatggacatccaggttcgcaagataaagagggctatgtaaggagtatactttccttcattagggaagcgacaagtcaatcagatttaattgtatcgttaaggttatggaatttaactcaggataataaaacgaatgctgaaatccagaaaaatagagagttattatctataattgaaaatgaatttgatctatcttatcaaattgaagagaagcttacaccaggaaaaggtataaaaattgcagaacgtgtctttattaatcaagactatgaattccagtggccagcattacatgaagaagaggatgatgggaaaggattctgtcatggacttcgtaatcaagcgggtattttagcgaatggaacagttattccttgttgtttagatggtgaagggattattaaccttgggaatattaataatgattcattttctaacattatcgaaggtgaaagagcaacaaacattgtcgatggattttcgaaaagagttgcggttgaagaactttgcaggaaatgtggatatcgcaaacggtttgggaagtaaatatgaaataagccctcataaagcgagggcttattttttatacttgataagaatgctctaatttatcaattaatgaaccaacgtaagaaacagctttacggattgcgtctggttttgacatatctactccggcatgtttcattgtaccaccagcgatcaatagcgggttgtccttcctctttaatcatttgagctactgcagtggatgcagtgtgtgctgccttttttgtagtatttctagtaacgatttacggaaaggttcaagttttgtttcttcagttaaatatttttcaattgttccttcgccgaatatgaggatttcattatgaataaaggatagtgcagtatgtactttcgtccataaagcagaaattttggaagagttcgcttgaatacttggatttgtacgatcagtagattcttttaaatttgcatatgagtacagttttgttaacgtcattaaaagttcttcttctaaaagtaggcaatttaataaagtgtgggagctagtatgtaaatgtcctttaaatgaatcaagtttctgtatatcattttccaatgcgtttaatgcagtatgctattcggcatcagaattatacaaatcggataaatcccatgttagttcagcaggtacctctgcgcaattaagacgattttctattacatttttcaagtcgtatatcctccttattaagactatctaaaaatataatgatagaaaattcggttaaattaaaatatttttcatttttatatacaaaaaagaaggacaagcatgaaaatgcttgtccttcaagttaatttaagaattaatatactttgtcaccattgaaaatcgagtttttcacgacaacataatctacagtacgaatagcatctaattttgttccaccagcgtaagagatagaagattgaagatcttgttccatttcgattaacgtatcttctaaagaacctttatgctcaacgaacattttcttaccttcaacgtttttcttctcacccttttggaattcagaagcagaaccgaagtattctttataaagtttgccatctctttcaattgtttcccctggagactcttcgtgaccagcgaatagagaaccgatcatgaccatagttgccccaaatcgtatagatttagctacgtcgccgtgtgtacgaataccaccatcagcgataattggcttacttgcagcttttgcacaccagcgaagtgcagctagctgccaaccaccagttccgaagcctgttttaattttagtaatacaaactttaccaggtccaataccaacttttgttgcatcggcaccagcattttctaattctcttaccgcttctggagttccaacgtttccagcgataacgaagctctctggtaaatgttttttaatatgttgaatcatgttgatcacagcattagaatgaccgtgtgcgatatcaatcgtgatatattcaggtgtcagttgctcagcagctaattgttgtacgaattcatattcgtcctcttttacaccaacgctgatagaagcgattaatccacgtgattgcatatctctaatgaatgagattcgtttctctggttggaaacgatgcatgatataaaagtagttgttctcagctaaataagttgcaattctttcatcaataatcgtttgcatatttgcaggtacgacaggtaatttaaatttatgttttcctaaagtgacagttgtatcacattcagagcggctatttacaatacattttgcaggaattaattgaatatcttcatagtcgaatacgttttccatcatttacacccctaaaatacgaatattttatttttattaattaaaaatgttcgtccataggataatttacattatttttattaagaagtcaaagaatttcttaacattttttgaaaaagtagattttatacctgaaaaacaacgttaaaaacgaatttaaaacgtttttttatttttattgttcgtttatgaaaaaggttgaaaaattaagataattacacaaggttgtatgtattctttttatttttttggagtggatgtaggatactatgaaaaggttaatgctaacaatgcaagcaaaagatgttatcaagtagttgaacaatatatgaaatgaaaaggtttgtttctatataaaaagatgaatctggcatgattcaccttttatgtaaggtttcaagtataataagtagggtgatagtaacgtatacaaaagataaaaaagaaaataatacagaataaaatgaggttaatatatgagtaaaaaaagtttttctgattataaattaagtaaggaaattgtaagggcacttactgggttagggtatgatcatccaacagaagtacaaggtgaggttattccagttgcattacaaaagaaggatcttgttgtgaagtcccagactggaagtggaaaaacagcttcatttggtattccactttgtgaaatggtggagtgggaagagaataaaccacaagcattagttttaacaccaacgagagagcttgcggtacaggtaaaagaagatattacaaatataggtcgattcaaaaggattaaggctgcggcacatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaagttttcaggaaatgaattagctaccatatgtatctgggtcagtcaacgtacagcgagtgattctctcgttcgactatgcagtcaattacacgccggcacaggcactcttatgagtccagaaggactcaataaacgctttgataaaaaagcggttgaattttttgaaatatatcttttctgcattatg

SEQ ID NO: 1359 - DNA, 20555 bp, Bacillus thuringiensis
tgcagtcactacagcctataaagcatataatcgtttattacactcatcaacatccacataaaaaaagacgggagatccccgcctttttttatgcaaacattttaaatacacctatcgcatttaaaaatacaattattacagttaccggaataacataacgaagtaagaagaaccaaatgttaaataacgttttccccttcgtttccgtcacttctaattctttcatcaataactctttactcattttatttggtacaaataatgaaatagctagtactcctaacggcagcaatacgttacttaccgaaaagtcaactaaatcaaagaatgttttcccgaatattttcacgtcactcataatcccaaatgataaagctgatggaataccgactgcaaaaataagaataccgattaataatgatgctgacggacgctacttctcattacctttcgcaacagatgctactacaatttcaagcattgaaattgctgatgttaaagtcgcaaagaagaataaaattaaaaacataataaagaaaaattgaccaaatggtatttttgcaaatactgctggaaggacgataaacagtaatcctggtccttcaggtgggtttactcctaatgcgaaaatcgatgggaaaatggctaatcctgcaagtactgtaacaaaaacagttaaacttacaatagatgttgctgatttcgctaaatgttcctctttctttaaatacgaactatacgtgaccattactgaggcacctactgttagtgagaagaaagattgtcccatcgcgtataaaatcgtatctgctgtaagctttgaaaaatctggctttaagaagaactctactccagcaaaagcaccatcgagtgttaacgcacgaacaataatcgcaataaataaaataaataatagcggcatcatgtacttacttgccttttctatacctttctctacacctttacttacaacaaaaatcgtacaaagcataaagataaattgtgctccaatcgcacttaatggatttgaaatcgtttcaccgaacaattgtccataatcagctgctccattccagaaacttcctgtcacactataatataaataaagtaaaatccatccacctacaacactataaaaagatagtacactaaaacaagtaacaactcccatacgaccaatccaaggatataatttgctatttggcactagtactttataagctgtaaccgcctctttttgcgtgctacgtccaataacaaactccgctattagaagaggcatacctataaataaagttaatagtaaaaatacaaggaagaatgcgcctcccccgccattacctgcaacatatggaaatttccatatcgcaccaagacctactgcggctccggctgctgcgagtacaaagcctattttcgacgtccattgctgtgtttctttcatcataaattctccttttctgaatatttaaacttttgttaattatacactttcatttcatactcgcacacctcctttagaaaataaaaaagtcccctacacgcaaatatgcatgtagaggacgatatatgtaatgtaaataccgtggtaccacctcaattggattgataaatcccacttgttcaagtacaggaataattccgatactctatccttttaacggcggaacccgggttgcctactacaatgttcaacatacctctcgcaagcccattctgtacattttatcgtaccgggctcccacctaaccccagctctctgaacgcatcaaatatacgtactcttcttgctcatcgatttcatctattgaagttacttgtgattataaattatatttttatatttgtaaagcgcactttatcttttattattttaaaatcttttcctctaattctcgtaaaaaactttctcttttcccctcgttttgcacatatactgatttcaacacttcttggagcaatatatttcgttccctcttttctaactgtaaatcttttaacttcaaccttacttcatataaaaaatctaaatacgattcatatgtctcatcatatttatttgcaatatcatctcgaattttttttgcgagcttcgggctcgctcccccagtagaaactgctatattaagtaaaccacgatgaatcgctgccggaaaatgaacattaccactttctggatttgtaataacatttactaattgattctcagcggcatcttcagcaacttgttcatttaatattgaatcactactcgctgcaacaactaaaaaagcacttttaatatcacttttttcatattctctttgataccaacgaattttcttttcttccacaagttttactaaattcgcatctaattctggacttatcacaactatatccgcaccctgtttgagtaaaggaataattttaaatcctgcaacttttcccccgccaataacaacaacgcgtttctcattaactcgcactgtaagtggatacatactgatctcctttcaataactccgtcgttttctgaattaacatatcttgaaacgcttcattcttccctaaatatggactgatttttatctcttccaattcatattggcgcacttctttctcaatatgtttcataagtaaacctgtaaataacaagtaaggcagtacaacgatgttcttttcttttcgttctataacttcctttaacttctcctcaaattttggctctgcagccgctaaataacaaacttctacttttttaaccttctcttttgtttgaaataaagaagcaatccagtttacatctcttaatacttcaggatcactgctccctcttgcaacgagaagtaacgtcacttcatttttatcttcctgttcgatgccacttccgctatacaccgatttaacaagtgtttccgatacaccaaacggattaccataagtcactttaacattcggatattgattcttaagctttaccaattcacacggaatatctttcttcacatgacctgccgctaataaaaaaacagggatagcaataatctccgtggccccacgctccacacatgtacgaaaaccatcttcaatagaaggattcgctaactctaaaaaacaaacttcttgaatagtcgcttctatacggttcatacacgatgtaataaattgaatcgcctcttctttcgctgtcttcaaacgacttccatgacatatatataagacggctttcattttacaacactccacttacttgataagcattttctgtctgcttctcaaaccaatgaattttttctctaaaacggacaacttctccaattacaatcatgctcggattttgaatttgctcttttttcgcaacatctacaattgtccctaacgttccaacaactgtgcgttgcatagacgtcgtcccctgctcaataatagcagctggcgtacttttatcttttccatgcttcataagttgctcacatatgtagggcaaattactaacccccatatataccgctaaagtctctacacctttcgctaaactctcccatttcacttcttcttcagcaccttctttcctatgcccagtcacaatagcaaaacttgcacttgcatcacggtgcgtcactggaatgcccgcataagcaggagcagctattccagctgaaataccaggaatgatttcaaatggtacaccttgctttgctaatgcttcagcttcttctccccctctaccaaacacaaatggatcgccgcccttaagtctcgttacaacttttccttttttcgcatacttaataagaaacgtgttaattgtctcttgcttcatcgtgtgataattcgggagttttccgcaataaattaaatccgcgtcaggctttgcgtgtgaaagcagctctttattcacaagtcggtcatataaaataacatctgccttctcaatacatttcaaccctttaacagtaattaaatctggatcgccaggacccgctccaacaatataaacctttcccatcatctctcctcatttcttctattaaaatgaaacttccattcgtatataagaatggaagtttttattttttcgtattactgatctctactcatggacaacaaatgccccaccttttcgaatcttctttttttcaaacaaagaaatctcttttacctctggcaacggtaaaaaatgcttttcaagctcaatctccgcaagcttaaatgcctgttcttcactttgagcaacaacaacaatcggaacaatactatttactaacacagcttcaaatcgatataaatccatatcgtccctcctaagacgctattacttcttctagcacgttatttaacgctatttgtaatgtatctacaccaatacgacctacaaaatcataaaatgtttcggctggtaatttattctctttgaaataacttataaatgatgccagtacatcaggtagatcctcgccatctatttttccttttaacttttgattgtaggcaccgccatctaacaatgttccacctacgtatatttcaaacgcttcaacaatgcctttttccttcgtcttcattttcaccccttgtaacccaatgtcagcaatttgacgttgaccacatgaattcgggcagcctaccatatgaattcgaactggaacatcgagtgcaatttgtgtatctaagtattctgcaatttttcgtaatctttctttcgtttctactagtgcaagattacaatattcaataccggtacatgaaaccgcatgaccaataaatgatttcgggctagcagatatcacttcaaacagcggttcactaagtaatccttttacattttccggaggaacgttcggaataatgaagttttgcgagttacatgtacgaatttgtccatttccatattgctttgcgattcttgcaatctcaaacatttcttctgcatgtaaacgacctaccggtacattaaaacctacatattttaatcccttttgtttttggtcttgaacaccataaaaatagcctgcattccatcctttgaatgcactttcccctttactttgtaaagaccctgtatactctattagtttctctttaaatttctctgctccccagtccgcaacaagaaatttcaaccgagctaaatgacgtttttcacgatatccaaaatcacggaatatagtagcaatcgcaatcgccaccgccttcacttcttctggtaaaacgaatacatctaattcatcagctaaatacggtcgagctgataatcctccacctacttttatatgaaaaccaacttttttctcaccatctatttctttcgttgcaggcgtaaatgcaacacagttaatttctgcgtttgctgaattataaatattagaactaatagacattttaaatttacgtggcaagttagaaaactcttcattatgttggaagtaatcatatacttcttttacaatattcgttgtatcaaatagttcatttgcatcaatgccagcaagcggattacctgtaatattccgcgttatatcaccacaagcccccgctgaagataacccaactcttgctaaccttttaaaaatatctggaatttgctgaatttctaaccagtgaaactgaatcgcctgtctcgtcgtaatatctattacatcacgtccataatcttcagcgatagaagcaagtacttctgcctgtgcatttgtaataatccctgacggaatatttacccgcatcataaaataaccagcttctttcggtctttgtaaatacaagcctgcccatttaaaggcatcccactcttctttcggaatagattcgaaaccattttccgcatagtaaggaatatcattaaaaatttctaagccatctttttctaatttatttttctcggtctgatttaatttttcattgttagcccatactttttcataactcattgtttatccccctatataaaactacgctcttgtaagtacttcacgatttgttctgcacattcttcaatagaatatttgtgcgtttctacaattaattccgcttgctctggctcttcataaggcgaatcaatacctgtgaaatccttaatatcaccttttcttgcctttttataaagtcctttcggatcacgtttctcacactcttcaatcggacacttcacaaaaatttcaataaattcatctgccgctaataaatctcttacttgtttgcggtctactcgaaatggtgaaataaatgctgtaaggacaactgctccttgatctacaaataactttgccacttcgccaatacgtcttatattttccatgcgatcactttcagaaaatcctaagtctttatttaaaccgtggcgaatgttatccccatccagcacataatttccaatattcttttcaaacagtttacgagcgaccgcattcgctactgtagatttacccgaagctgataaaccagtaaaccaaattacaaaactatgatgtccattcttcactcttctctcatcttttgaaaccgaagctgtatgccaagtaatattcgtatccatctcgttctctccctattctgttactacttcttttttcaagcctttaattagcacttccactacttctttacgactaaatgtacttggcggaatctcaccgtttcttaataattctcttactttcgtacccgataaaataacatgatcttcttttccgtgcggacatgttttcgttgaagccatcgcttcacatttcgtgcagtaaaaactatgttcaaagaatagtggtgtaattcctaactcttctatcgtaaaatttgtgaagatttcttgcgcttcatacgttccgtaataatctcctactccagcatgatcacgccctactataaagtgggtacatccaaaattctttcttactaacgcatgaaatatcgcttcccttggtcctgcgtaacgcatggcagcaggaaatacacttaaaaagacacgatttttcggataatatttttgaagaagtacttcatagctttccattcttacatcagcaggaatatcatccgatttcgtttctccgacgagcggatttaaaaagagaccatctacaatttcaagagcagatttttgaatatactcatgggcacgatgtaccgggtttctcgtttgaaatccgaccactgttttccacccacgttttttaaatgcttccctcgtttcaattgggtctaaatgataagaaggaaattgattattttcaaagcgttttgttagaataatagttcctccaacgtaaacgtttggtcgttcatataattttttcactcctggatgagcctcatccgttgttttatatacaagtaacgcttctttttctttatctggtacaaaaatatcttctatttgaatgacaccgtatatatttccattgttgacaagctttacttcctctccaaccttcaggctttctgcgactttttctgttaccggtaatgtaatcggtatactccacacactaccatttgctaaacgaagcgtttctacaactgaatcataatcttccttccctaaaaaaccagtaagggggctatatccacctgtcgccaatagttctaaatcacttaacgcaatattgtctaatttaatttctttttcaatttgtgatacgtcatatgtctcatctatacggtttactaattcgtttactatgctcatttttctatatcctctcttagctttatttcaagattcatcttattggtaatgaagaccacattcggttttcactttcccagcccatctaccatctcttgaatcgccaccatcccctacaggtaacgtacatttctcacacccaatacttggatagccaacatcatgcaacgggttatacggcaagctatgtttgtatacatatcgccaaacttctttccacgtccaatgaatgagtggacaaactttaatagattgaaaacgatgatcttgatttataaactttgtatgcttacgtgtttctgattgttcccttcttaagcccgatatccacgctttttccgctgctaatgatttttctaacggtaaaatttttctaatcttacaacaaagattcggattactttcccataatttctcgccatgcaacttctcttgttcatcaagcgtaagttccggttgtttttctataatatttaatgaaggaaatcgcctccgcactttttgaattaattcatatgtttcttgaaaatgaacatttgtatctaaaaatacaactttagcagatggatttacttggtttataaggtgcagcaataccataccttccaccccaaagctacatgcgtagacgatttcatctttatattctttataagcccactttaatactgatagcgcgccttttgtttcatcttcttccgaaaacgaaacaacattttcttcccacgtttcatacgtcaacatgttttttccccctgtaaaagcaaaaagacggttttaacctaatgaaaataggttaaaaccgcctctagtttttctagtcagcgcttttcactttaaacgtactttttcacttttctctaactgaattacttttccatcttgcacaacaattgtaattgaaccatatttcatatcagcaagcatcgcttcaatcttctcggatacttcatcaaaatgttcccgtacacccacgcgaacagcccccctttttattcataaaaaaaatctttcccatttcgaaaagactgttcggtaatatattttaccttatctttcaaaatggattccattttgctggatttagcaccttgctttctataagcaggttgccgagcttcttcgggccagttccctccgcttctcttgataagctttgtatttgtattttatcataattctgatttttttcaatcctagttttccgatatattttaattattttatttttacaaaaaaggaattgcccatccgaacaacccctttttctatttagacaagctctttaatacgtatgcgatcgttcccaataatattttcatatgtttcgcgttccacaactacttgcgatgttccgccttttgcaaagacaacggctggtcttcgaatccgattgtaattattcgccatcgagtacccgtatgctcctgtacaggaaactgctagtaaatcagaagaagcgacttttggtaaatgaatatcccaaatcaacatgtctccactctcacagcatttcccggcaatcgaaacgagttcctcattctcatcattccctcgattcgctaacatcgcttcataacgcgcgctatataaagcaggtcttaaattatctgtcattccaccatcgactgatacatatttccgaataccaggaatatctttcacagatccaactgtataaattgttgtcccagcatcacctacaatgctacgtcctggttcaatccatatttctggcaatggatattcacatacagtaaattgttctctcactgcacttgttacagctcgcacatatgtctcaagagttaatggtgtatctgactctgtgtagcgtattccaaatcccccgcctacatttaacacttttactacatagtttgtttgctctctcacttctactaaaaattggcgaagaacttcaatcgctcgaacaaaaccagctgtttcaaatatttgcgatccaatatgtgaatggatccctagcacattataattggatttttgtaaagcaaatgtaattgcctgcatcgcttgaccgtttgaaacgccaaatccaaatttcgaatcatcttggcctgtcgtaatatattcatgtgtgtgcgcctctactccaggcgttacacgaattaatatgttcacaaactttccatgttgcatcgctaaatcgtgtaaaacttctaattcaaagaaattatctacgacaaaacaaccgatattcgcctgaagagccatcactatttcttcttctgttttattatttccatgaaaatgaatacgtgatgccggaaatcctgcttggagcgcagtatataattctcccccagagacaacgtctaatgacatattctcttcacgagctactcggcacatctccatgcacaagaacgccttgcttgcatatgctacttgataagagaaaccactttctttaaaagcacgatgaaatgctcggcattttcctcgaatagactcttcatcgtatacataaagtggtgttccgtattgctttgctagctgcgtcgtatcgcaccctccaatttctaagtgtccttgcccattaattcggcttgtgccgtgtaaatacatttaaattcctcccttatttcctctaaaactcataaccccaatcttctattcattgcagcacgcttttagatagacaaaaaacgcgcggaacaatgttcacacgcgtttcttattaggaaaaatatatattgaaaaaataaacgagttgttatctcctcaaaataagaaaccgcatcaacatctccaaatagctctccataaaataaatcttatgacagtactacatttattcaatgcagtcccaatatatgaataagatggttattcttatatttcggcaatagtccctttcaacctatgatcacagattccattaaatctcccatagcttactctttcctatcgcggcctctacctttgagagtagatgaggtaagtctatttaattttcaaacatctaattgttgctattaacaataccaaaggaccattttatttgtcaaacaattttttatattgtttttttgcagtttaatttcgtatcgtctggtaagcgctttactaatacctttgttacttcccattcgccttcttcgttattaaatgtaatcgttaccttctcaaatggtggagcaattttcccagcaacacgttcatactttgtcacttcaatacttgcttgaaataaatatgtaccgctatacactttttttaaactaataattttaggacattgataaggtttcaaacttccatattgtttttcaattgctttatttatttttggaaataaaacagaataaagtgcatcttccataagaggtgcatcatattgggctaccgacacactcggtgaagtaaaaagtataacactactgcatgctataaaatataataattttcgcattataacctccgtattatcacgcgattctttctgcgtacaataattatcatacatagaaattctgttttattgtctcccaccactctttttctactcgattattataaaaaagcccacaaccttcttttattttcgtataatgatactcatagtataataatcataataacaaaggactgttcgtatatataaaatgagtcgttaagcaaactgactctcaagaactgtcatgctttttaggagaggagtatattatgctacaacatctgtttccaaaactgcgatttgcactcgttgcagtcgttttactatggattaaaacatatattgtgtacaagctagcatttgatattaaaattgataatttctttgaagaattcatgctttttatcaatccactagctgcgttacttttatttttcggcttagctttacttgcatctaagcaccgaaaccgaattataattggaatcagttttatactgtcatttattttatttggaaacgcaatgttttatgggttctataacgatttcgttactttcccagttttattccaaacaaacaatatggctgatttagggacaagtataaaagaactctttacgtacaaaacattacttttatttgcagatgcaattattttaatgtttatttcgcgtaaattcccatcatttggcgacaaaacaccactttcccgctcagagaagcgaactttctttagcggtgtaacagctttattagcactacaaattgttgtatcagttatttataaaccacaaatgttctcacgctcatttgaccgtcaaactgtcgtgaagaatttaggtttatacacatatcatctatttgatattacgcttcaatccaagtcctcagctgagcgtgtatttgcaagtggggatgggttttctgaaattaaaaactatacagactcaaaagacaaacaagttgataaaaacttatttggagctgcaaaaggtaaaaatgtaattttaatttcaatggaatctacacaaagctttgttattaataaaaaaataaatggaaaagaaattacaccatttttaaatgaatttattaaggatagtttctatttcgataacttctatcatcaaactggacaaggtaaaacttctgatgctgaatttatcgttgaaaactcactttatccgctagatcgtggttctgtattctttactcatgcaacaaatgaatacacagcgacaccagaacaattaaagaaatacggatattcttctgccgtcttccattcaaatgataaaacgttttggaatcgggatgtaatgtatcctgcgcttggatatgatcgttactttaatttaaatgattacgcaggaacggagcaaatgtctgtcggttggggattaaaagataaagagttctttgaacaatctattccaaagttaaaatctttaccgcaaccgttctatacaaaatttattacattaacaaatcattttccatttcttctaaatccggaagatcaatatgttgatgaattcaactcggaaagtggtgttgtaaaccgctacttcccaactgttcgttacacagatgaagctcttaaattatttattaaacaattaaaagaagaaggattgtatgataataccgttattgtcatctatggtgatcattacggtatttccgaaaaccataacgcagctatggcacagttcctaggaaaagatactattacaccattcgattctatgcaattacaacgagtccctcttattattcatgtgcctggccaagaaggaaaagttgtttctaaagtatccggtcaaattgatattaagccaacgctccttcatttacttggtattaaaacaaataaatccgttgaatttggaactgacttatttattaaagagaaagacccgcttatggtaatgcgtgatggtagctttgtttctgaagagtatgtttatacaaaaaatatgtgctacaaaagaagtacgggtgaagaagctgacatgacgctatgtcagccgtatattgaaaaagcaaaaacagaattaaaactctccgataaattaatttatggagatttattacgcttcgatcctaataatcgatataaaactggaacgatgacaacgaaatttgaatagtaaaggaagcaactttatacaagttgcttcctctttttattttcacttaattttcaaaccatccttctatgaaatctttcacaaattggtaatttctttcgtatgaggaataaatttatggtatgataaaataagtaaactttcatacactaattaagaatttattacagaaagcaagggatcagattttgtatagagcagctattccaaacttatttacgctcggaaatttatatagcggatttttatcaatcggctatgcatctttaggatattataaatcagctgctattttagtacttatcgggatgatgttagatagtcttgatggtcgtgttgctcgtttattacgtgttgattcacaaatgggaaaagagctcgactcgcttgcagatgtcgtaacatttggtgcagcaccagctgttttaatgtattacacatctttctcaaactacggaatcatcggattatacatagcgggattattccctcttttcggagcatatcgtttagcacgatttaatgtaacaccatcttctacttcaatgaaatatttcactggagtaccgattacagcagcgggagggcttgttgctttcttaacattattttcacataccattccaaaaatcgttcttattaccgtatttgtaacgttcgcatttttaatggtgagccgcattcgtatcccaagtttaaaagatgtaccaattccacgatatagcatcattattacactatttttagttggaatcattattacaatgtatcaaacaggatttggaaatttttctgttttcttatttattgccattccactatatattttgtacatgttatctcaattcattagacaaagaccgtctaaaaaagcgaataaagaaaaataagaaaaccttccgagtccggaaggtttctttttattttgtaactaataccttttgatttacaggtgttactggctcttcgccgtttaatacagctaaaatatttctgacagccatttcagccatcgcatcacgagtttcaaatgttgcattccctacgtgtggagcaagtactacattctttaattcttttagctcttctgtaattttcggttcaaattcaaacacgtcaagagctgctccttcaatttcattcgtttttaatgcatgagcaagtgctgcttcattcataattggtccacgtgaagcatttacaatatacgctgttttcttcatcattttaaactgctcttcatcaatcatatgatgtaaatttggactataagcacagttaattgtaataaagtctgctgtttgtaataattcttccaacatcacatacgttgcccccagctcactttcagcttcaagcttacgatttggccctgtatataaaacatccattccaaatgctttcgcacgttttgcaacagccttcccgatttctccaagacctataattccgattgtcttaccatgaacttctcgtcctaagaaaaataacggtgcccatccgttaaatccagtcgtacgacataacgtatccccttcaggaattctacgcgccgctgctaaaagaagtgcaaatgttaattctgcagtcgcttccgttgatactttcggtgtattcgtaactgcaattcctttttcgcccgcatacttgtaatcaatattgtcgtaaccagcaccatagtttgcaacaatctttaaatgaggcgctgcatcaataacttcttttggcacctttgtcgaaagtaaacttaacaatgcatctttatcttttacacgctctgttaattcatctatagaaattaactcctctttatcgtacatttctacatcatgatcttttaatagttctaatccaatttccggaatttttcccgctactaatatttttgccactactaacacctcttctatagaaaataagatatctcttatatttcattgtaagaaatccacatataaaaaccaaggaatttgattatagttttaaaaatcgacacttttccatgaaaaaagaggagatgcaactctccccttttcttacgctttttcctgcgattcttttccaagcttcacatcaatcgttccttctgcaaccgtatcgctaatttgctcctcaataaccgattgagattcagcattcgtttcagaagtataagcttgttgctgtgcaccttgtacattttgtttattttgttgtttcgccatttcttaccctccttttcattctttcttattttgaacaaaaaggacggttttcatcaaaaaattgcgtttcattttgaatttgttacttcttcttcaagcgacctcattactcttgctcgcttcgtaaatgttgcaacctgagtaacaccgtgagctagtaatgtttgtacattttcttgtacataattccctaaatcatttggataatgggcatccgaagaaatcgtaattggaacaccatacttagctaatacttgtaaatatagtggacttgggcacatttcacgaacaggataacgatagtataatcctgcatttatttctgttgccgtattcgtttctactaacgcacaggcaatttcctcataataagaaagctgttcattctcatccaatcgataattaaatacctttatattatcaagatgagcgataatatcaaataactcggtacgaatcgcactctcaactgttttaaaaaacatatcatataatgcgcgtaggtcatgcttctcaaaatattctttcgtatctggattatcaaatccccagccatttagaaaatgaacggaaccaattatataatcaaagtctcctagcgctaataattcttttaactctccttcacaaccaataaaataatccgcttcaattccaagtttaagtgtgacacctcttttactccatcgttctttcgcctcttcaatgacctttgtaaaatcatacagtgaaactacccttacttgatctaaccattccttctgtatacgaccgagcttagaatcactaatatctacatatttttcataatatcctttcgcttcatgaaaacgatataaatgatcaacaatcccaacttctgttataccttttcgcacagcttcttctaaatagaggtccatccattctgttgtaaatggcccttccttcacacgcttttgcaaacgctcttgtgttttcataagccaatcaatagaatgcctttcttgaagcggttcataacgttccagcgcttcatttattttagcaagccatcctattgaatacggtccttcttctaagtgaagatgataatctactttcatatacattcccccttataatgtatctatttcccttctatccccaactctcgaaagctttccatttcgttctttcacctctcgcatgacatcttccaatgtaatatttttttcagctaataaaacgaaacagtgataaaatacatcaaccatttctttcactacttcttctttatcattatttttacatgcgataattacttcagcacactcttcaccaattttctttaaaattttatcttctccttttgaaaataaataatttgtatacgattcaggaagtgggctttcctttcgttcttcaattgttttatacagcaacttaaaggcattttccatatgtatccccctatataatttgatagtgaaaacatgtcttctctcccgtatgacaagcaggtcctacttgtttcacattcacaacaattgaatcttgatcacaatctaaatataaagattgcacatattgaagattccctgatgtttcccccttattccataacgactgcctcgaacgagaataaaaccatgttcttttcgtctctaacgttttttcatatgcttcttcattcatataagctagcattaaaacttctttcgtaccttcttcgatgacaattgctggtattaatccttttgaaaaattaggtttcataaccgcacctcaacatttgcatctcttaattttcgctttacactctgcactgtcgcctcaccataatgaaagatggatgccgctaacgctgcatcaactgttgtcttttgaaaaacttctataatgtgatccgtatgaccacagccccctgatgcgatgactggaatggaaacactttttgaaatttcttctgttaaacgaaggtcatatccgcttttcgttccatctgcatccatactcgttaacaaaatttcacctgccccaagtttaacaacacgcttcgcccattctatggcatccattcctgtgtcaactcttccgccgttgacgtatacgttccatttaccttctgctacttttctagcatcaattgccacgacaatacattgtgatccaaagtgttctgccccttcttctataagcttcgggtttcgcactgccgctgagtttattgaaactttgtctgctccagctcttagtaaattgtacatatctttcacacttgaaatccccccgccaaccgtaagaggaataaatactttagctgctgttttttctacaacatctataatcgtttttcttccttcatgagtcgctgtaatatctaaaaatacgatttcatctgcccctgcctcgttatatgcttcagctatttcaaccggattaccgacatcttgtaatcctataaaatttacaccctttacgactcgcccttctttcacatctagacatggaatgattcgtttcgctaacataacttcgttacctgtaacacttcttctaaatcaatcgttttctcgtaaagcgcctttccaattatgacaccatatatattcatatcatttaactttttcacatcttgaatagatgccactcctccagaggcgatgagacgaatgcccacacttttttgaagtatcgctaattgttcaaaatttggacctgcaagcgtcccgtctttcgaaatgtctgtaaacacaatcgtttgaacacctaaactttccatttgtttcgctaaactaacgtaagaaatttcagacagatcaagccaacctctcgttgctacgaaaccatttttcgcatcaattccaacaatgattttctctttatatagacgaactgcttcctctaaaaatgacttatcataaagagctgctgttcctaaaatcactttttctacacctgctgacaataacttctccaccgttacaagtgaacgaattcctcctcccacttgcacaggaatacgtaccgccttgcagattttttcaatgacgggcaaatttaacgactcgccagcaattgcaccgtctaaatcaacaatgtgtagtatttccgctccaagcttttcaaatatgatcgcctgcgctaccggatcttcattcatcaccgtttctttactaaactctccttgataaagtctaacgcatcgcccttcttttaaatcgatagctgggaagatttccatgcttctaccactccttgaaaattttttaatatttgcatgccaatttcgccacttttttctggatgaaactgtgcaccaaatacatttcctttcgcgacaaaccctggtatttgcattccataatcacttactccgcatacaatttcatctggacaatccgcgtaatatgagtgaacataatacacgaaagaaccatccactaatccattccaaagcggaaattctctttccttccttaattcattccatcccatatgaggaattttatacgaaacttttaacttccgaatttcacctggtagtaaacctaacccgctacaatcttttagttcctcacttcgttcaaataaaagttgcatgcccaaacatataccgaggagtggttttcctatgtcacaaacttcttttagtacacacactaaatctctttcttttaatacttccatcgctttcggaaatgcacctactcccggtagaatcacgccatcgcttctcaatatctcttctttatcactcgttacaatgtactctgcctcaatatattttaatgcttgctctacactgcgaatattccccattccataatctataatggcaatcaattacaacatccctttcgttgaatttacaccagtaatgttggcatttttttcgaccgcttctctaagcgctctaccaaaagctttaaataatgcttcaattttgtgatgtgtattacttccgtatagaacgcgcgcatgtaatgtaatattggcagcatgtgcaactgctctaaaaaattcttccgtcaattctgtatcaaaatccccgagcttcggatttgttaattccccttgaaatacacaatatgagcgtccacttatatcaattgcaacaaatcctaaagattcatccatcggtacatacgcggaaccgtaacgattaattccttctttattttgcaatgcttctttcaagcaatttccgagtacaattccaacatcttcaacggtgtgatgtgcatcgacaaatacatcaccttctgcctcaacttgcaatccaaatcttccatgtctagcaaataaagtcagcatatgatcgaaaaaaccaacccccgtttgaatagatacactcgtactttcatcaagctgcaaacttaatttaatttttgtttctgtcgtctcacgtgcttgactggactgacgcattatttttcctcctcaaaccttatttggattgctctcgcatgtgcatgtaacccttctttatttgcaagctctacaatatgatgctgtacattttttaatgcttcctctgtataagaaataaaacttgattttttcacgaaatcatcgactgataacggagaaaaaaatcttgccgttccgctcgttggtaatacatgattcggtcccgccaaataatccccgagcggttcaggtgcatatggcccaaggaaaatagagcctgcatgtttcacataatctagagcattcatcggttcttttatatgtaactctaaatgttctggagcaatttcatttgataactttagtgcctcctctaaagaagcaacgataaagatggctccatttctatttattgattcacgtgcaatttcacttcttggtaacgtttctaactgtctttctacctctttttctacttctttagctagttccatattcgttgtaatacaaatcgccgttgctctctcatcatgctctgcttgcgataataaatccgctgcgatatattttgcattacctgtttcatccgcgacaactacaatttctgatggaccagcaatcatatcgatatttactatcccgtatacttctcgtttcgctagagcgacgtacatatttcccggtccaactattttatccactttcgaatcgatccgtcccgtatgctaagcagcaat

SEQ ID NO: 1360 - DNA, 15232 bp, Bacillus thuringiensis
agaaggagagttataatcgatgtataaaggttacttaattgacttagacggtacgatgtatcgcggcgaagaacaaattgaagaggcaagcgacttcgtaaaagcattatgagagcgcggcattccttatttattcggtacgaataactcaacgcgtaaaccacaacaagtggcagaaaaacttgttcgtttcgatattccagcgaaagcagagcaagtattcacaacgagtatggcgactgcgaacttcatttatgaacgtaaacaagacgcaactgtatatatgattggtgaagaaggcttgcatgatgcacttgtggaaaaaggatttgaacttgcggatgaaaatcctgatttcgttgttgttggtttagatcgtgacatcacatatgaaaaattagcaaaagcgtgtcttgctgtgcgtaacggcgcaacgtttatttctacaaatggggacattgccattccaactgagcgcggattattaccaggtaacggttcattaacatcagttgtagcagtatcgacaggtgtggatccaatctttatcggaaaaccagaatcaatcattatggaacaagctttaaaagtgcttggcatagaaaaaaatgaagcattaatggttggggataactacgatacagacattttagcgggagtaaatgctggcatgcatacccttcttgtccacactggagtcacaactgtggagaagttaacagaatatgaagtacaaccaacgcaagttgtgcataacttgacggagtggattgagaagatgtaatgaagaaagctgttccaaactttggaacagctttttttctaatatttgcgggcagcccccttggtgtgggctaacatttcagtgtgactagtgtcgatttttgcctgtaagtcgatatatttgaaaaatcgccgatataatatgagttgcgccgatatatttagaaaatcgctgatataatatgagttgcgctgatatatttagaaaatcgctgatataatatgagccgcgctgatatatttagaaaatcactgatataattttattaaaaagcacgattcacaacgtctttaacctcttcaagatattgtttacgcacactgtcatccacagaaggaacacttgtatagaatgtatgctcaattgtttcaatgcctgtaaattcaaaaataccaacatccgctgttttcttcatcgcatcaaacatgccgcctgctgtgtatgcttctttcgtattgcccattgtagataataacaatccttttttaccgcttaataacttttcaataccgttttcaccgtaagcataagcaaatccatggctaaacacacggtcaacgtatccttttaaaatagcaggaagtcccgcccaccaaactggataaataaatgtaatgctatcagcccaagagatatgctcttgttcttctttaatatcttctggtgtatttcctttagaaaatgagatgaaatcggaagcgcctaatactggattaaagtttaattcgtatagatcgcgaacgcgtacttcgtgaccttttccttctaattcactttttaccgtttctaaaatcgcatggttgaagctttctgtattcgggtgtgcataaacgattacatgtttcatttttcttcctcctatttgtggatatgtgaatagttatttgtatatctgtaactattatggttactgtttttgtagaagtcaagtaatacatatgtatgtataaaaagacgcccgaaaatcgcctttttataccccgctcatacaaagtacaaagaagacaaataaaataatgacaagcccgatgccgaaattaaatacgagagtgctatccatatatgtagcctccttgtttgaaagtaaaaagcactctagttaagagtgcttttttattttgaatctactttataacttttagaaagtgattcatgcgtgtaatgatttacattattttatgtatttatactttgaaatgagtaagtccttgttggatatagaaaaaaagacactcgttggagtgtcttttaagatgacaaaatgtgccaattgcttgaggttgataagacgctaatttccgtgttaacgccttttctttaatcaagaagtgtagcaacagcgattcaaataaattgtaccacttgtttaattatggtgcgtatgcaattgtgcatattatgatcatggggtaggtaatgaactgtgaataatttgaagtgatttatttacgatttcttctgcagcatatatgccaattgcgtctgtttttaaaatatggggttgtaagttatcatgcattgcccctaactcaccatgaagtggtgcgaaggcatggttcgccttttcaagcatgcataaatcaagtaaagaatccccagctgtaataatcgtatctatttgcaaaatttcttttatatattgcacagcgtcccatttgttaattggttttggtacaaagtatagctttctaccttgaagtgaatgattccagccttgtttgtctaaccaggaagtgaaagatgataattcatcataaggaatgttctcccgtttaataatgcaataatggaatagatcatcggctgttttttgtgatataacccaatctttatgagctatttgtccaaattcctttagtatgtcgtttctctctatacattcaaccgatagtctttcttttactgtcctgttccaagtaccatcttgtttcccgttatgaaggatattaccgccattacttgtaatggcgtattcgggaatgatttcgtcttggaataaagcaatccgctgaaactgctcaatagttcttgttgtaactgggatgaaatgtgagtgcagttgtaatttttttagtagtgaaatggttttatgtgatataaaagaaatttctttcccatctaaagtttcaatgagttgaattgattcatcttctataggggcacgaaacgatttccgggaataaataagcgtctgatcaagatcactggcgaaaatcatatcgttttcctcctaaggggcttaatgagcccgcaacatgaataagccatattctcatagatttcaatagagacattcttttctttagcaagaagtaaaatatgctttaaatcgggattgttttgcttacgtattaaaattttccacggtattctccggagtaatacgcgagttgtttcaccgactcctggtttaattaagttaatatcgtcaatttcaaagtgattttggatagactgtatatcttttaatccttgccaagagggatcagtgtaagttgaagtaatataacgtaattgattatctatatgagaatgaacagaagggaataaatctgttacctcatcaacgaagaaatttgataagtcttcttgctctagctctttataatatttaacaccatgaaaatcatttggaccgatataggtgtcatttagtacagtgcggctaatgagtccagagactgttgcatttaagcaagcgctaggaataagaaaatcttcacgtgtaccgtaaattgaagtacagtaaccgggatcagcaagcacagccatacaatgagaaatgtgtgtattatttcgttcgttaaatgtgtgtactgcatattctaattctttttttattgcaccttttccagtccacccatcaatgaattgaattgtttctttagggtgatgttccaaaatataatggagtgcattttcatcaataccgcgtccgcgaacaatagaaatacaatagtgaggtacatcaaggttgtattgatagcgtatgtagcgtttgataagaatgccaataggtgtaccagcacgagctaatgaaacgaggacaaggttagttcctttagtttgtataatctgttcggcgacaactccaacagcgatggctagtttgtgtttgtattgttgcagggaagaaaagaataaatccatatacgctttagagggtttatattccattggtaacatttcggaataatgtgtgccagcttgaattgcttgttctctagtttccgtggaactttctttcattaaatcactaatatcttttaatagaaaaatagcatcatttggattgtaactactaatatgagaatttacttttaccataattatcaaccttccttttctatgctatttgaaaatgagacgatatgaataaaaggaataactgtttgtaactgctgtagaagaggagatagggcttcttcccctaaatcacgctcaatgaaaacaaatacttcatcgtaatcatgaggtgaaatattataaaagtaatttgtaatagtagaatcttcaggacttggatatgagaaatgattatgaatggcgtagttcacatcatttgaaacagaatggatagggcttcttgttgtagattgatataaaatattttcacccatttcagcagcaattttcattgggatatacataaattcacccgttccgagacagagtgttcgttttccaattctttctctttttaaagtttttcctgcttcttgggcgaaagaatgaatgtgcttttgttcatatgctgaaatgccaaatcgcccagtatattttatataatttgatgtatagggtgattttaggcaggtaagggtatgttttttgaaatcaggttttgtttcttcaatttgaatctctttttttgcaatatttaatggttggccagttgtatgaatactgccttctaataaagaaataacatgaaccttaatttgaagttcttcttctaattgtttaaattgttttctattagtatgagaacgccagtctaacaaagaagcaattatatattcttctcgtgggaatttattttgaatagatctaataatatttaatgctgtttttcctgttgtcatctcatcatctacgagaacaattggattgttgttttgaaaaaagctttcatctacataacaacggtgtgatgttgcatgagaatgttcttcctcaaatgtaatgacagattctaggtggggtatcgattccctagttgtatgtacatactttgcattttgaaagcattgaaacatagaatgaccaagtgatgtcgctgtttcagcgaatccgatgaacaaaacttcttcttgcagaggatattgataacgaaatacttcctctgggatttcatcaatttctaatgaaatgagatttaaaatttctttttgaaatggatgagaaatattatgtagtatttccatatatcttgcagcgagagcaactccacttgatagagagactgcaggtttaataggaagatgctttccaaggattgtactcacaaataaaaaactacgtttcttatttattctcgcagccatttgaaaaagattgtctagcgctaaattatatggattatcacgtacttctacatgaacttgtatattatttaaaacgttatacgtgttgctttgcgtttgtaataaggagatcggtgaattgtttgttttcatgtagcaccccgtaaatattagattttaaaatggttttgcgagcccagccataatgaggttttacttcattcattttgttagaaaaactgctttttagcactccattatacgtatctgcattttgtaaaattaatctcgcatctaaataatcttccattgtgacaatgtgcattgcctgtacaactttaatatgagatgggtgaataactgtctttccgattaagccatttgcatggtcaagtgatacctcttgaataagcccttcttcatgatcattagaaaaatattcccatacacatcctgaaataatatattcatttgttgcccttgagaaaacgttaataatgtctgaaatacaatcacggacaacagtaatatgatagataggtgtgtatttattgcgccgaatactaaatatacttgaaaaatcagtagcaccaatacgtacatttaagatgtaatcgtgataagaatctagtaaatcctttatttgtaataatgattctgcccgtgtttccttatacataatttcgggtgattctaaaatcggcatgccatatagcgataatgagtataactcgtttatatatgcaagctgatcgatataagtctttccgttaatcggtgtgaattttggaaagacaaaaccacataaacaatgaacagcactacctaattcagtaacaattttcttcatttgacttggctgtcgaactctaataaaaagaagtgggatgtctgcttgatttagtatgttggcactgactaagttagcgatttgctgtatttgaacgacgatgttttgctctgcaagttttacttcctcatcgcttatagcgtcctctagacaaagaataattgagatagcatccacatgtttccttctaattatatcttccgcaatcgtttctttcgtgccaggagtatatagtgtagcgcctagtgcgtaagctagttgttcttttcctatattttttgaaaaactaagaggttctttatagaaaaaattttgccgttcttctgaggagagataagaaaagtaattcaaattgtcaccaccttatttataatgattctgtttaatcgtaacataataagaaaaatcttccataaaaattaagcaagaaattaaaaaaatatattgagaaagatgaattataagatgaatatcgaatattgttaatagaaatataatagggggaaagagaaagtggatatacataaattaacagaggaagaagcaaatgagataaatacttggacgtacgaggaaccatataatttatatagtttttcaggcgagaaagaagtaatggaagagctattagatggaacgtattatggctgttgtgatgatcaaggagacctcatcggttatttttgttttggagcaaatgcacaagtaccaggtggaagagatgctcatttatatggtggaagagatgctcatttatatggtggaagagatgctcatttatatggtggagaagatgtgattgatattggacttggcatgaagccggcgttaaccgggaaaggaatggggaaagaattcttccaagctggaatagcgtttgccacgaaagagtttaatgcaaaaatgtttcgattaagcgtagcgacatttaatacaagagcgattacgttatataaaaatatcggatttaagcaagggcctatttttttgagtcgcggaagagaatttatgctgatggaatatgaaagaccgtcagcatgaacctgacggcctagaaaacactattattctgagtgctcagctcggtgcgctaaacggcttgaagcagcggcagcgattccgccaacgatatcatcaaggaacgtgtgcacctttccagttgatttatcatttaagtattctaaaataccaggttttaatttatcaatatatccaaagttcgtgaaaccgatagagccgtacacattcacgatagaaagtgcgataacttcatcaattccgtataagccttcatcacgttttacaatatcttgtaacggttcacttagcattcccttttcagcaaggacatcaagctcgataccagtaatcagtgcgttttgtacttcacgttttgatagtacacgttctacattgtaacggcattctgacatctctaaatttggatgatattttttttgaagaaaatgaacaagttcagcaatatcgtcaattgttacaccgcgttcttgtaatagttttaatgctctttcttgtagttgatttgattctttcatgtttatcacctttttttctttttagtatttgtatacgtttcgttgctttatcatgtgcataggaatgaaaggcgagcacaagctcatatatataaagaaaaaccataggtggcgactgcgatgattcagcatatttatgagcattatcacatgcatgttaaagaattaatcccccttggcccctataaaagcttttggattcgcaacaaaatttatgtacttgttccaattggagaaatggaggaagaagtacttgtagagatgaaaaagctcagtgattatatgaaccagcaaggggatataactgtagcgactttcgttccgactatacacggctactatgtaagtgagatagaagaacaaaattattgcttattaaaaggtatgcgcacgttagaacgacatgctatgtcattaggaagtgagctttctatattccataaacgaggtgcattctttccagaagaaattgagcaattaagccgaattggtgaatggaaagcgttatgggaaaaaaggctcgatcaattagaaaagttttggcaatcacaagtgatgaaccacccttcagatgtattcgatcaattgtttattgaatccttcccgtattacttaggagttgcagaaaatgccattcaatatgttgtcgatacagaaatggatgatacgccgcaactaacggatgcagcaacaatttgccaagaacgattcacacctttattatggcatcaaacgaagcgtctcaaacttccttttgattgggtgtatgatcacccgagtcgagatattgcagaatggatccgccatatgacgatagaaaaaaagaaagactgggagcaaacaatcgttcaatttgttacggattatgaacggaattattcgctatcctcatttggctggcgcttattatttgcaaggctcctgttcccgctgcactattttgaaacggtcgaacgatattaccaaactggaaacgaagaacaaaaaagcatatatagagatcgcttagaagccattttacacgatgtgaaccgctcagagcaatttatgaagcatttttatggttcgcttcgtttaccagtagataagcttgggattagaaaattagattggttatcttaaaaatataaaaaagagaccgagtgaggtctcttttttatataccacaattttatgtaatacattatgcccctacctgctgatctgtacatatatttaaaacgaattgatgcttttcgagcttttcatttactttacccaataattcttgctggatttctttaaataaaaattgatagcttgtattccacgttggtatagcggatgaaaggcctaataaatactcttttttcttttctagttcttgaattgttaaaaaagtgttccccatttttggcatgtgtcgtccccctatgttttttactttatatgtgtgaacgattcactatatagtattaattatcgcattttttgagagggatttccaattttgttttatgatgttaacggataaatgtgatttgaataaaaaaaggagaccaaatttggtctccttttagcaagtgactttgaacgagccgcttccgcttttaattaaaatacttgttctacttcgataacgcctggtacttcttcaagtaacgcgcgctcgataccagcttttagtgtgattgtagaacttgggcagcttccgcatgcacccataaggcgtagttttacgataccttcttcaatgtctactaattcaacgtctccgccatcgcgaagtaagaatggacgtaatttatctaatacttctaatacttgttcttgcatatgtgggttttccatttttatcgactcctttcatcagttttattataatcaagatagaggggaaaatctattttttctcttcttgttttattgtcgaaattttgtatcgtgttttttcagtataggggtatggaataagtttgtaaaatgatgtgcttatgtaataagacatctgaatatactgttgggacaagaagtgggggagaagaaatggttaatgttcaagtgtatgggacgaaagtaatttgtgcgagctgcgttggaatgccatcttcaacagaaacgtttgagtggttacaagcggcaattggtcgtaaatatgaaggacaagaaaataaatttaatttcgagtatattgatttccaagaagaacaagaagatgcggataaaaaagcattcgcagagcgcgtagtggaagaagatttattttatccggtcgttcttgtaaatggagaaattgttggagaaggaaatcctcgtttgaaggatgtttacgaagaaatcgagaaatatttataaaacaagaagtctttgcgaatttgcaaaggctttttttattggagggatagatatgaaaaatggagtgaagcatgcgttaccaacggaagtagagcagttaatggagcggtacacagtagaattaaaagaaatttttttggatgaaaaaatagtcggggtatatatttacggatccatcgcactaggtgcatttcataaggaaacgagcgatgttgattttgttacagtgataaatgattccgtgaatgaagctgaaaaacagcagcttgtggaactacataagaaacttagtgataatatgctaggtaaaagaatggacggtatgtatattccgcttgctgacttagggaaatacaatgatgaaatgaacgagtatgtgtattgtgcagatggtaaagctaatgttggtcattgggacattaatgcggtcacatggtggacgttgaaaaatcaaggcattacagttaccggaaaagaagcagaagatcttccgctgcaaatacaatggaatgatgtagtaaatacgatgaaatacaacgtagaacagtactggagtgggaaggcgaagaagccatatttattctttatagaagaatgggtagaatcagcggttgttacgatggggcgtattttatatacactagaccataaaacaatcgtttcaaaagatagaggactacaatacttgttagaacattcatcggaagaatggggacctttattaaaagaagtagagagaatacggcagaatccaaaagaaaagcgaatgctctcaaggtggagaagggcagatatgacgaagaggtacttactacatttaattgagatgtgtagagagaaatggtagggaagaaaatggacaatacagtggggtgtattgtcttttttattttgtagtagatagaaaagtatttacaagtattgtgtagaggaaagataatagaaaaaatatgtgcatgggggaagatgatgagtaaatataaattacatatagatagagaacaattatggaaaggatgcgttttaaattcgattgcccatgcaattaatgtagcgcattgtccagatttctcacatgaaagttcatgggatggatttaactatagtatgcaagatagccaaggcggacaaggggtaattacgtttcatccgaattatacgattgtatgtcttcaagatgtgaatagtgagagaatggatgagtggattgatgcgaaaagttattttgaaggggcaccttcggaagtaatagatattgcgaaagaagaagcacttcaatacgtattagaagaagtagaaggcgaaacagttccttttattacaactgcattttggattgaggatagtggtgcgtattcaattgattcatttgaagagatggaagagcacggtggattcttattagaaattccattacttgatacagaatcagcaatggaaagactggaagaagagtatgaactgacagaggaacaaatagagcttttacaactcgtgtatgagaaaaaaatccaaaggccaaatgaggaaattaagttgtctaaagaagaagtagcaatgattggaacggaagatagcgaaggattggaagctaataaggagtcatttgcagaaatgaatattacttgggagttgtaggataggatataaaattgtgataaaggactagtagaaagaacaatgtgaaattacattgcactttctactagttttttcatatacatatcaacttcgtgaaagaatatgggctctttttccttagtattcagatgcacggtgcaatgtaaatattgctgtaagtagcgattagcttgttcgtactgttttaatttgtagaaagaaaaacaagtaagaagtagaaacgctttttcttctaatattggaacgacagctagtaccggagtaatggaatgtatatttatttccactaaattttcataagatgtccacgtttgaaaccagtcgaaaatagtagaaaggtaacccggaatgttgatagtttcatgtgaaacattatgcaatagctggttctgtttgatatgtataggctctattctcgtttgtagaatgcaatcgaatattgaaatgttttcttttatttgtaattggtgcgtaataagctgcgggagaccgatagggtggactcctatatttatataaaagtcatctccaaactggcttttttgtatgttaatgagcttataaaatccgttttcagctttgaaaaatgtatgtctttttgtcttaaagccgagtggttttaaagtggcgtgtaaatttgtaataaaatcttgctcctttttagagccaggcttattcttcgtcatattcataagtagttaagttttgtaagaaactttcaaagttaggtgctaattcaataatttcctcaaactcattatcgataaatataactggaggattttcagctacatttcgatagtctaatgcaatccatgtatgtccatcaccagataaaagtatgatattctcaggcatttcccattctcgaattaaatagcggctctctaaaatactagattcattttcatcaaaagaaataccatataaaccagatacattaacgtgatcgtctgcccaagaatttggctttgaagtagggtgaacatcgagacgaagagttcccccattttgttcttttagaaggtttatatatgattctggaagctttacgttcagtacttcttctgcttttttgattagttcatcgttaatgggtgctagttttaaatagtcatcgtctgcccaaattgtactcttcatattcgatcacctcaaataatagttttaagaatcttatgtcatatattatagttagtttagataacatgcaatagagggagggacggagtatggatgtgtatgaatacctcgatcacgtaaattctaaagaagatttattaaaatttcttgtatacctccaaaaggattttaaagtgaatagagatgaatgggagaatgtagaggtagagacttatttagaggcattaaatagttggttaggttcttgtgaatcggtttatataaatcaaggagagaagtttccagaaaatatttcatggaagtttattgctcaaatgttacttgcggcagctcattatgaataaaattagatttttaaaagatagaatggagaagatatcttgattaaccataataaaattaaacaacttttagcacatgtagatcgtgctgatgataatgaaattgagctagagtatgaatctgaacctatgacgatagaattgtttaatagtgaagaaatagaagaagggcaacttggttatagttttgatgaagaaggtcaaagcttagtcgggaatgaagaaggagattggaaagaaggatggattgtaatagggatagattcatatcttggagacccgatttttgtagatagtaacgatgagaactgtccagtttatacagctatgcacggtgagggagaatgggagccggaatgtatagcggagcgtatagaagatattattgagaaagtgaaggggaatgtgcgagaaataaaatagtatttcaatgtgattaagagggaggaaatgtagtatatattcactaaaaaagatgtataaaaatgattttgatgcatcctttttagtgaatatataaaataattaacttagtgtattaaatatatgatacatgattattttaatatatttaaaagtaaaatgaaataagaaacggataattgtcggaatatattcgatttccgttcatttttatgaaatatgtgtactttttgttagattccttcattttgtgcatatacaataaatgtatatagaaataagaaaaggatgatgtacgtgaaggacactgttttacaagaaacgatttctccacaagaattacataaagttgttcaaaagaatacagcttattatgactttaagtgggggaaagtagaaaatccagcgcaagggaatacatggaattgggtagcctttttcttcccaactttttggttagcttatcgaaaaatgtataagttatttattatatttgcgttattggctatacctagtatatttatacccccttttatagatattccagatgggatttatgtaacatttagtttagctcttcaattaggaatgatgatatttactggatggcaaggaaaccgtttatattataagcatgctgttcgtgtttttcgtaagggagaagattcgtctgatcatgagaaggcgtatttcttacaatcaaagggtggcgtaagtattgctggtatgattggtttacaggttatagtcgggattgtgtttgggttagctgcgctcgggctgtcctttttaccaactgaaccgaatattaaaaacgttgttcgttcaagtggtgaaggggttactttagagattatgactgataatccaacttggaagtttgttaagaaagaaaaagattatgacgtagtagagtttactggttatgattatacagagaagaaaaacgtgaaaattaaatttgctgtttatttcgatgaagattatttcgagtggcaagaggtatatgaaaataataagaagttaagtgaagaagaagtggaagaatatcaaatttacattgaagaaaataatttgggtttctagagagaactcgttcattttgaaaagaagaatcttgtgaaggttcttcttttgtttattagggggagagaaatgatttcagcattaatagaagctctaataggatctattagtttaagtacgggtttacacacgaaaaagattgatgttaacatacgttacttgcagcagtatgaatggtttcgaatgatatatgaagacgagaagtatcaaaagttatttattacgaactacaaagttcgctcatatttacaaagtaagctaagagttcgattgctcgtaaaaaataaaaatgcacagcgaagatttttaaaattagtagaagagcaaatagaaaaacggcatacaaattgaaattttgtaaaatacaataaaaaatgagaatttgaggtagggttgtcaataacgtgagactatggcactataaagaaatgctatacaaattttatttatcgagatgtaaacatcaattttgatttttacgtataaataatgaccggaggaaatgaatttatggctactttaccttattatccaaaatgtaattcaga

SEQ ID NO: 1361 - DNA, 14192 bp, Bacillus thuringiensis
taccaattggagatggaggagaagggacggttgaatcacttgttgatgctacaggggggagaattatatcaattagtgtgacaggaccgcttagagaaggtatacaagctttttatggcatttctaaagataaaaagacagcgtttatagaaatggcagcagcatcaggattacagcacgttccagttgaaaagcgcaacccacttattacaacgacaaaaggaacaggagaacttatattacatgcgctagatcaaggagtggagtacataattttaggacttggcggaagtgctacaaatgatggtggggcaggtatgttagcagctttaggagtaagatttataaatgacaagggtgaagtaatagatccatctggaggcacattacattcgattgttgctattgatttttcacaaatggacccccgcttaaagggggtaaagatagaagcggcatgtgatgtggataatccattagtcggaatgcagggagcatctttcatatttgggagacaaaagggtgcaaatgtagagatgatgaaagagctagatgagaatttacaacattatgcgaatatgcttaaacgatatgtatcttttgatgtatctgaaatacctggtgcaggggcagcgggaggaatgggagcggctgttatttcagtgttaaagggagacttgcggaggggcattgaaattgtattagattatacaaatttcgataaacatatagaagatgcaaatctcattataactggtgaaggtagaatagataaacaaactgcatatggaaaggctcctgtgggtgttgcggggcgtgcaaaacgtttttctgtgcctgtaattgctattggagggtctgtatcatctgattattcagctgtgtacgagaaaggaatagatgcggtatttagtattacaacgagaccgatgacactagaagaagcatataaagtagcagaagaaaatattgaaatgacaacaaaaaatattgcaatagtatggaaaatagcatcagaaaaacacttctaaatgtaggagtgttttattattattatttaataatagtgattgcgattgtttcattaagttaactttatacatagaatagtcttgaaatttggttttcagtatgaatataagtgaataaattgtatatgcatacagaaaaatgtcgagttgagtcagactatataaaagatttaaaatatttagtgaaggcataaaagggggatactatctatgaaaaaggaaatctcagttattggagttccaatggatttaggacagatgcgtcgtggagttgatatgggaccgagcgcgatccgttatgcaggggtaattgaaagaattgaagaaattggatatgacgttaaagatatgggagatatatgtatagagagagaaaaagagatagatgaaaatacaaaattaagaaaccttacacaagttgcaactgtatgtaatgaattagcaagtaaggtggatcatattatagaagaaggtcgttttccacttgtattaggtggtgaccatagtattgctatcggtacattagctggtgtagcaaaacattataaaaacttaggcgttatttggtatgatgcacacggtgatttaaatacagaggaaacttcaccatctggaaatattcatggtatgtcacttgcagcaagtttaggttatggacattcttcacttgtagatttatacggagcatatccaaaggtgaaaaaagagaatgtcgtaattatcggtgcgcgtgcattggatgaaggagaaaaagatttcattcgcaatgaaggtattaaagtgttctcaatgcatgaaattgatcgtatggggatgacggctgttatggaagaaacaatcgcatatttatctcatactgatggtgtacacttatcattagatttagacggtcttgatcctcatgatgcaccaggtgttggaacgcctgtaattggcggtctatcttatcgtgaaagtcatttggcgatggaaatgttagcagaagctgatattatcacatctgctgaatttgttgaggtaaatacgattttagatgagagaaatagaacggcaacaacagcagttgctttaatgggttctttattcggtgaaaaactaaaataaatgtaagaaaagcaactgagaagttgctttttttatttgaaaataggcgtataataatgatttatattatactgtacaataaaaatgtttgacatcttaccaatttgagctaaagggggttgtttgtaattgtcgtttgtttcatgtatggtataattaactagttgttggaaatacatacagatagagcataaaacaatatttcaatatatggatagaattgctcgtaagtaggaggaagggatagcatgccttttgaagatacgaccattttgaaatatcttagtacggcattagatattgccactgtatggtttattatatataagctaattcttataatccgagggacaaaagctgttcaacttttaaaagggattacagttattatcgtcgttaagatgatcagtattttccttgaattgcgtacgctatcttggctaactgaacaagtattaacgtggggatttttagccgttattattatctttcagccagaattgcgaagagcacttgagcagctagggcgcggaagtttattttcgcgtgttggaacgcatgaggatgatgaacctgaaatggttgcaacagcgatagcaaaagcaaccgaatatatggggaaacgtagaattggtgcattaattactttgtcaaaagagaccggtatgggtgattatgtggaaacgggtattccgctgaatgcaaacgtatcatcggaattacttattaatatttttattccaaatacacctcttcatgatggagcggtaattatgcaaggaagtacaattaaagcagcagcatgctatcttccattatcagaaagtccgtttatttctaaagaattaggaactagacatcgtgctgcaatgggagttagtgaagttactgatagtattacagtagttgtgtctgaagaaactggtcaaatttctttaacgaaaaatggtaagttgcatcgtgatttgaagacagaacagctgaaggatatgttattagctgaatttagtggaaacgaaaaaacgacttcttcgtctttatggaattggaggagaaagcgtcatggataagttaatggagaatcattggtttttaaaagggatctcattactattggcgtgtatgctttttatgtcagcgacgttaactgaaaaaaatacgacatcagttatattaccttttgcaaatgatacgaaagaaacattaactaattatgctattaatcttaagtatgatgaggagaaatatattgtaagtggtattccggcagagggcgttaaagtaaaattagaaggcccaaaagcatcagttgctacagcaaaagcaaaaaaacaatttgacataccagttgatttgcgagatagtccaaaaggaacttatgagatttctttaaaaacgaacgggcttccagatgatgtgaaaggaacagttcagccatcaacaattaaagttactcttcatgaaaaggcgagaaaatatgttcatgtagatctgaaattatcaaatgaggatcagatgccagcgggggctactctagaaaaatcaagccttaaaccggatactgttgaggtagttgggacgaaagaagaaattgaaagcatttcatctgccaaagcgtatgttgatttaaaaggtgttaataaaactgttacaaaaacgcccgaagttacattatacaataaagaaggaaaacgtttaaatgtaagaacaagtccatctaagattagtgtaacgttgaatgtggcaacgcaaaatacagccaataatactgaaaaaactgttcctgtaacgtatacgaagaaggggagtttagcagaaggattggcggttacaaatatcagtgttgaaccgagagaagtaacgatagctggtccaaaagatattttggataatatacaatcgctagagggggtcgaagtagatcttagtcaattgacagagtctacaacattcgatgcctctgttttattacccaagggtgtaacaagtgccaaaccgaatcaagtgaaggtttcggtgggagtgcaaaaaacaaaacaaacgaaaacaaaaacgattgatggtatcccaatccagaaaaatggactttctaaagatgttactgctcagctactttcgccgcaagatggaaagataagtgttgatatttcaggagaagcaagtatagtagataaaataacagctgctcaaataacagcggtaattaatctgcaaaatgtatctccaggaacgaaagatatttcaattcaagtgagtggtcctggtaatatttcaatagagccaaaacaaaaaagtgctaaagttactattgtgaagaaagaaaaaccagataaagaagtacagggtaacggtcaacaaccggattcaaacaccgatcaagaaaatcaaaatgagaaaccaaaaaatcctgaacctgattcagaaaaagaacaggaaaagaatcaaaaccaaaatcaaaatcaagataaagataaagaaacgagtcaagaaccaacagtagataatcacaatcaaaaagagcaagaaaaaggagcgaatcataatgggtaaatattttggtacagatggagtacgcggagttgcaaataaggagttaacacctgaattagctttcaaaattggacgttttggtggttatgtattaacaaaagatacagatcgtccaaaagtaattattggtcgtgatacacgtgtatctggccatatgttagaaggagctttagtagcagggctattatcaactggagcagaagtaatgcgccttggcgttatttctacaccgggcgttgcttatttaacaaaagcactagacgcacaagcgggtgttatgatttctgcatctcataatccagtacaagataacggtattaaattctttggttcagacggctttaaattaacagatgagcaagaagctgagattgaagctttattagacaaagaagttgatgaactaccacgtccgacaggtactaatcttggacaagtgagtgattactttgaaggtggacaaaaatatttacagtacattaaacaaactgttgaagaagatttctctggcctacatatcgctttagattgtgcacatggtgcaacttcttctcttgctccatacttatttgcagacctagaagctgatatttcaacgatgggaacttctccaaatggtatgaatattaatgagggtgtaggatctacacatccagaaggcttagctgaattggtaaaagaaaaaggtgcggatatcggacttgcttttgatggcgatggcgaccgtttaattgctgtagacgaaaaaggaaacatcgttgacggtgatcaaattatgttcatttgtgcgaagtacatgaaagaaactggtcaattaaaacataatacagttgtttcaactgttatgagtaacttaggtttctacaaagcacttgaagcaaataatattacaagtgataaaacagcagttggtgaccgctacgtaatggaagaaatgaagcgcggaggttacaacctaggtggagaacaatcaggccatattatcttacttgattacattacaactggtgatggaatgttaagtgcacttcaacttgtaaacatcatgaaaatgacgaaaaagccattatctgaacttgcaggggaaatgacgaaattcccacaattgctagtaaacgttcgtgtaacagataaaaaattagcattagaaaatgaaaaaattaaagaaattattcgtgttgtagaggaagaaatgaacggtgatggccgtattcttgttcgcccatctggaacagagccacttattcgtgtaatggcagaagcaccaacacaagaagtttgtgatgcatatgtacatcgcattgtagaagttgtgaaagccgaagttggcgctgaataattagctgaatttatatgaaaaaggagcacaaaaagtgctcctttttcatatgttttatagacgatgaaaaaaatttcattgacggtttatccatgtttgttataagatggtcttgttctttttctcaaaggaaatattgtaaatcataaaagcgccagaactacaaatagtgtagttgacgaggtggggtttatcgagatttcggcggatgactcccggttgttcatcacaaccgcaagcttttacttaaatcattaaggtgacttagtggacaaaggtgaaagtgtgatgagagaagaggaacggatgaaaactagctgtataagtatatacggacttaaacccaatcgagaggaaggtgaaagccgttacaagcttacagggctagcaatatgtaatccgttttttagtataaataaaaatggtatcggactatgtcgttacatgttcgcagagcagtgtaagcatttgtaacggcgactaaacatgtgtggaatcgtaggatttattggagagcaagatgcaaaggaaattttattaaaaggtttagaaaagctagaatatcgtggatatgattcagcaggtattgcagtacaagcagagaacggtgttgttgtatacaaagaaaaaggccgtatcgcaaaacttcgtgaaatcgtagatgagaacgtagcagcaagcgtaggtatcggacacacacgctgggctacacacggtgttccaagtaaagtaaacgcgcatccgcatcaaagtacatcaaaacgctttacattagttcataacggtgtaattgaaaactatgaattagtgaaaaaggaatatttacaagatgtaacgttcgtaagtgaaacagatacagaggttatcgtacagcttatggaacaacaagtgagcacaggattaagtgtagaagaagcgttccgtaatacgctatctcttttacatggctcttatgcaatcggattacttgatgctgaaaatccaaacatgatttatgttgctaaaaacaaaagcccgctattagtaggtgttggtgacaactttaatgttgtggcaagcgacgctatggcgatgttacaagttacagatcaattcattgagttaatggataaagaaatcgtaatcgtaacgaaagaaagtattacaattaaaaacttacaaggtgaaacgattgaacgtgcaccgtttacagcggaattagacgcaagtgatattgaaaagggaacatatcctcatttcatgcttaaagaaatcgatgagcaaccacttgtaatccgtaatataattcaaaagtatcaagatgaaaatggcgaaattgaattaaatcaagacatccgcaatgcgattttagatagcgatcgcatttacatcattgcatgtggaacgagttatcatgcaggtcttgttggaaaacaatttatcgagaagtttgcaaaaatgccagttgaagtacacgtggcaagtgaattctcttacaacatgccattattaacagaaagaccattcttcatttacatttcacaaagtggtgaaacagctgatagccgtgcagtacttgtacaaacaaatgaaatggggcataaagcattaacaattacaaacgtgcctggttctacgctttctcgtgaagctgattatacacttccgttatacgctggaccagaaattgcagttgcatcaacgaaagcttacacagcacagcttgcagtactttcaattttagcggctgatattgctaaagcaaaaggtgaagttcttgatttcgatttaacacacgaactaggacttgtagcaaatgcaatgatagaactttgtgatcaaaaagaagaaatggacgcattagcaaaacaatttttagcaacaacgcgtaactgtttcttcatcggccgtagcgtagacttctacgtaggattagaaggtgcgttaaaactaaaagaaatctcttacatccaagcagaaggattcgctggaggagagttaaaacacggtacaatcgctttaattgaaaatggtacaccagttatcgcacttgctacacaagagcacgtaaaccttggaattcgtggtaacgtgaaagaagtagtagcacgcggggctaacccatgtatcatctcaatgaaaggcttagaaatggaaggtgacagcttcgtattaccagctgtacacgaagcgctagcaccgctagtagcagttattccattacaacttatctcatactacgcagcacttcaccgcgagtgtgacgttgataagccacgtaacttagctaagtctgttactgttgagtaggagattggtaggttaataaatatagttatagctttaaaataaatttacaaatttgcacccctttagatattttatctaaaggggtatttttgtgtcgaaaaagaacatctaaaattgataagcggaaagagccctatagattaaagttttactttatcggattcacttttatttatctgaattttccgttactattttaagtatccgtgaacaatttcctttattacgacaagaagagacggtagattcatggacattacaagggggcttattatatgaaagtgaaagcaaaaacatatttaagtatagaagagattatttcattaccaaccgtatcaagtacaaacataagtgatgatggtaaaaacgtagcatttgttaagaagacggctgattggaaagacaatacatataggaatcatgtatggatatatgaaaaagataagaagcagagttacccattatcaaatggtgatatagatagtacacacccattatggtctccagatgctaggtgtatcgcatatcttagtccagttggtgacggggaaaatcagatatttgttaagtcactagatgattatagagaggttcaaattactgatgagaaagaaggagtcagtacattcaaatggggtcctactggcaaggggctttattatgttacgcagtcaaaagaatgtgaagagataaagaaacgtaaggagctatatggagattttcaacatataggtaaggaacaccagaatgattgtttatattacattgaaatagaaaaggtgatacaaagtgatacagatgaacacgagaacagagttgtttatcaattaacggatggtaaggactttcatatccatgaatttgatatttcaaatgatggtaaaaaggttgtatttataacgacaccaagctcaaatatggcagattatataaatggagatctatacatactccatattaaagctggagagctacaaaagctgaatgtggataagttgttgggagggagtgtttgcttttctcctgacggcagtaaaatatgttacacagcaagcataagagagaaggattactatagaaaccatatacaagatagtacgttagagatatatgatatgaatactggagaggtaattcagcctctaacaaactttgatagtacagttatgccattacagtggacagctaaaggaattttaattagatggcaggataaaacgaattatcgtattggattactagctgaagatggcactgtggaagcattaagcgacaagatagatggctttataatggatgcctctataacaaaggatggaaatcatataacctataataaggctataacaaatgaaacctttgaaatctatttagacgataaaaaaataacggatgaaaatagctttttcaaagggaaacttaaaagtaacagggaaatcatctcatggaaaagtagtgatggtcttgaaatagaaggtgttttatcaacgccagtagagtttgacactaataaaaaatatcctttattagtagtaattcacggtggtccggcttgggcatcttttccgatattttcagactgcttcaatgagaaatatccgattgaacagtttgttgaaaaaggctttatcgttttagagccaaattacagaggaagttcaggttatggtaatgaatttttaaaagctaactatagaaaacaggggattgctgactacgacgatgttatatcaggagttgataaactagttgatcaagggatagtagataaagatagagtaggagttatgggatggagcaacggtggatatttatcagctttttgttctacatttagtagcaggtttaaagctatttcagttggcggtggaataactaactggagtacccattatgtaaatacagatataccttactttattagaatgtatttaggaaatactccatggaatgatccagatatatatacgaagacatcacctatgacgtatattaaatcagcttgtacgcctaccttaattcaacatggggaaaaggatgcaagaattccgattacaaatgcatatgatctatatcaaggattaatggatatggaagttgatacagaattaattatatttaaaggaatggcatatagttctgaccaaccaggagttcatgtggctattatgaagcagaacttgatgtggttttcacactatatgcttgaagagagtatggagggttttaggactttgtaatagatgtttgtacaagacatatgattgaaacggtcttcatattgagatgatttattataaaatatatacttaaactactatcagtacatacatcagggaggactaatatgacaggaaataaaaatgacttactagtagaaaaacgtgaagagttattgaaagtattgcaagctcgttttgagaaaaacatgaaccgccatgaaggtcttgaatgggctaaagttgaagcaaagctgactactaataatgaaaaattgtggtcacttaacgaaatggaagtaactggtggtgagccggatgttattggttatgatgaagaaaaggacgaatatactttctatgattgttcaaaggagagtcctaaaggccgcagaagtctttgttatgatcttgaagcgttagaatcaagaaaaaagcataaaccagaaaataacgctattgatgtggcggccgctatgggtattgagttattaacggaagaacaatatcgagagttacaacaacttggagattttgatatgaaatcatcgagttgggtacaaacaccttcagatattagagagcttggtggtgctctattttgcgattatcgctttggacatgttttcgtgtaccacaatggagcagactcttactatgctgccagaggctttcgtggttcattaaaagtttaaattaggataaataagaaaaagagcctatattcaggctctttttcttatttatattttaaaagtaaattgttactacgcagttttacttaatttatatgttctgtggttgtttttacggaaaagtttagggaaaacatagccatctaatccaatacgtccagcgttctgccctgcaactaaaatgaacatagtcaaaataagcaggtttgggtttacactaacagttccgcttaataaaaatgaaagattcattatgattccgaaaaatgcagctgtttttgttaatccgcctaaaatcaaacctagacctactaaaatttctccccattgaactaaaaagctaaataggtctgcgtttggaaggacaaaatgttgaaggaaatctgcccaccaactttgtactgcagggtggtcccctgatgcttgagcaatagcaccctttagaaagccacttgcgtcaaaagattgtccgaagactttgcctatcccagcagcgaaccatgtatatcctatgtaaagtcgtaaaagtaataatatgaaagtagcacgtttatcagttcttaaaaaattgataaccattgaaatccctccaatattgtatttacacgtttattatatatccaatgtgaaaagattcacaatggagagaatgtgaacaaggataggttgtgaataattgttttattttttgtaacattttatctgctttgataaactaagaatagagatatatgtaaaggagacaaagactcaatatgtggatgaacttgtaatgattagaaactactagatagataaattttgctctcataagcgagggtttatttagttatctgtaaatcattcaaggaatgcatatttggcttgtacatcccttttataaggataggtgcctattttatgtatctgtcttttttgtgggaaagtttatatctcttatataaaatatgcgtcctttaaacttggaggagtatatgatgaaccaattaaaaaataaagtagcagttattacaggggtaagtcgtctagatggtataggggcagcgatttgtaaagaattagctgaatcaggatacgatatattttttacgtattggacagcttacgataaagagatgccttggggcgttgataaaaatgaacaaatacaattaaaagaagagttactaaaaaacggtgttaaagtatcaagtatggagttagatttaactcagaatgatgcaccaaaagagcttataaataaagttactgaacaattagggtaccctcatatattaattaataatgcagcatattctacgaataataatttctctacgttgactgctgaagaattagataagcattatatggtaaatgttcgtgcgactacattgctcagtagtcaattttcccggggatttgataagaaatctggtggtagaattgttaatattacttcggggcaatttcaaggtcctatggcaggagaactagcttatgcgacaacgaagggagctattgatgctcttactagtacgttgtcagcagaggtagctcatttaggaataacagtgaatgcaattaatccaggaccaaccgatacaggatggatgactgaagagataaaacaagggttaaagccgatgtttccttttggcagaattggtgagccaagggatgcagctagactcattaaatttttagtaagtgaagaggccgagtggattactgggcaagttattcattcagaaggtggatttaaaagataaaaaagaaggcatctcaccagggtgagatgccttcttttttaatctttcttcaatcttcgtgcaacaccattccctaaagattgtaatccttgaacgaggataattaaaataaagacggttgcatacattacttcaggctcgtagcgtaaatgtccgaagcggtatgctaaatcccctagcccgccagcacctacaaggccagccattgctgttgcgccgattaagccgatcgttgcgattgttaatccgagtacaagggagggacgtgcttctttcaccataacgtgccaaatgatttttatagtagaaacgcccatcgcttggtaggcttcaatgacaccgcgatcgacttctagtaaagctgtctccattaaacgtgcgatataaggggctgtgaagacgacaagcggtacgataacaccttgcacgccaatggacgttcccattagaaactttgtaaaaggtaaaataaagaataatagaatgataaatggaagagagcgaatgatattaataattgtattaagaataggatagatgattttattttcacgctgcccaccaggtctcgttaaaacaagtgtgacgccaagtggtaatgcaataaggatcgagatgagtaatgagatagatgtcatttgaaaggtttggattgtggcttcccatatgactttaccccattcatccaaaaaggacttgtttcccataatctgttctacctccttctacgatgattccttgctcttgtaaaaatgataaagcacggtggatttcattttgttccccttgcatatgaacgactagtttcccatatgcttcatgttttaactgcgtaatattaccggataaaatattcggatacacttggaaacgttttgtggcaacggctaaggcaggttcccctgaagtagtgccaataaatgaaagtgttacaatttctccagtactttgtagttctttctgtacctcttttggaattttcgctgcaaatgcgctatttacaaatttcttcgtggttacatgttgtgggtttgtgaaaatatcttttacagtcccactttcgactacagatccatgttccataatagtaacgcggtcacatatacgctggatgacattcatttcatgtgtaatgagtaaaatcgtaattccgatttcttcgttaatctttaataacaaatcaaggatagaatcggttgtttcgggatctaatg

SEQ ID NO: 1362 - DNA, 14976 bp, Bacillus thuringiensis
gggatccccattcgtgattgttctaaattcaggctttctattaatataagcacgttttgcagactgtgaacattttaaaccgtgattgtctgttagatactgccataacactcgtttgtagtagaagatttgtttagaatcactagataaaagagctgcaatcacttcataatatgtatcgattttcgatgttttattttttgtcccttttggtgtaaaaccattcaaatacttatctatggtacgccgatccacattcaattctctggctaattgacttttatttatcttcatttttaagttccccattagttttttaaaatttggtaagtctgaaagacttttaacctcaaattctgtttgaatatctagcttaatatacatactaaccacctcagagtcagtatggagaatccaattgaaaatgtacatatttattcaagcgttaatgtacatatttaagttagcatttatacctcttggaaatgcgatgatgaagaaaatcgaaatatacgctgggttaaaggtttacgagaaagcttagatccttatacactaggtgactatgtgaactggcccgatatcgatattaaaaattggcaaactagttattatggctctaactttcacagattacgtaaagtaaaaaccatgtatgatccttgtgatgtttttcatttccaacaaagtattcctccttttcatacatgaaaaaaggggataacataaaaaaatcatccaatataccgttacctcgcagtatgttggatgattcaagttgattttctatatcgtttcaaattcttgctcctactcataaacttttacttacagattaattgtatttcgtatcattttcatgcaatgaatgtaatttaatatttggtactttatctttttcaatacctctattataagaaacaggaacttgaaattcgaattgctttgtctcatgtttttgtaaatagactggtttcggtactggatagctttttgaattctcgtttgcattatcgtataaaacaacttttaatgcttgtgaatgattacgataattttttaaagtaacaatgcacttcggttggatattctctccatttttctccattctacactggctatcttcttttttatattctattgcttctacccctgtttttcctgcgtagtaccatgttttattcaatgtctggaggattgtatttaaaataaacggcatcattacaatcaaaatactaatgcctactacttttatcttattcgtttttctaaatgtactagactccttttttcctagccattttaaaaataatataaatgcaattacatgtagtatgaaagaaacaatcaatatatttgagactttataatccatataaacatacgtatgtatcggaaccttatagacattgaatagtttttccccaattaattcattatcatttggaatttttaataataacaaaacccctatactgtaacaaatagctactaatcgatcatactcaatacgaatcattctttctccccttcactttgtattttattatcgattttagctattattaccatactatacaatctttttatagaggataacgtaaaaaagttccttataaatatataaagaaccttattaatatacactatgaattaaaaaatcaatatacaattttcacatagagatttcttcaaaatatgttggattatgtattgtaatttttttatctaaaattgtaacaatgctatcattttttaattgttttaatacgctgctaactgtctctcgagatgttccagatattttagatatttcaattgttgtaagtggacatgaaattacaatcttttctccactctgttctcctaaatcctgcattaaataatttaacgtttggataacacgatcttgtgcattaggaattgtaatattttgcactcgattttcgttcaattttaatatagatgataattgctgaacaacgtacatcaattgcgttctgctggactttaccatatcttcaaagattaccgttggaatataatatacctccacatccgtcattgcttctgctgtatagttatatcctctgtctgtaaacataccaccataaggaaaaatagaatatcgcttcacatagtcatcgtataataagttcccattttgattaacccgctctaactttacaaaaccatctaacatgaagtaaattctttctcttgaatccccttctaaaaataaaaattgaccttttttataagttcgccaataaacaaactctgttaagcctttcaattttttttctgttaaatgagcaaataattcgaactgctttaagtctttcactacgttccgtctattcataaaattccctctctcttgctgtatgttggagcgaaaaaatcaagaaagcgtattcaatttgaattttatcataattaacttacatattcagatttcatcatgaaaactttatgaacaatgagtacaaaaaatattaataaataaaaagaatgaagttactaactccattcttttttactactaagtagcgtacataagaatttaaacatacatgcatacattctgttttgaaataatagtaccagctttttcttctagtgcttcatatactttttctaaagacgtaataattgtttttctttttggatttgtattaacaaaattaatagcagcttcaattttcggaagcatgcttcccgcagcgaattgttgttcttcaatatattcttctaattgattcactgtgacatgctctaattttttttgattcggttgattataatttacatacacatgatcaactgcagttaaaataacgagcgtatcggcatctactaattctgctaatttctgtgcagcgaaatctttatcgataaccgcttcagttccttttagcccttcttcggaatcaattactggaattccacctccgccaacagctatcactatatttccatcttcgaccaaagaattaatcactttatgttcatgaatacttacaggcttcggtgatggaacaacacgtctccatcctctaccagcatcttctttaaacactgcttttgtttcatccattaatcttctggcctcttcttctgtataaaaaggaccgattggtttagttggatttttaaatgcctcatcttttttatccacaacaacgcgtgttataaccgttgctacgtctttttttatattccgttttttcaatgccttttcaatcgcattttccatccaatatccaatcattccttggctcattgccccacaagtatctaatggcattgcaggtgtcttttccgtttctgcagctttttgctgtaataaaatattccccacttgtgggccatttccatgcgcaattactatatccacatcattttccattattttcacaagttgttctgccgttttttccaacgcttcttgctgcgctcccgcagtagcttctccagactgtatcgcatttccccctagtgcaactacaatttttcttcgtgccatattccagccctccagttgatttcgctttcacagcgctttataaagtaatactgcctgtaattaatccataaatcgcaaagaatgctaaagcaccaattgctacggatgatgctaattccactcgagtaaatatttgcttcgaactcttttgcttttgaacattgtaaaaaataaaaatacctggcgcatataaagtcattgttaataataaatactctaaaccagctgcataaactagccacacgccataaatactggctatcaagccaattattatatttttatttcgatctgcttcttcagactttaagctatgcttcagttgataaaacgctgaaaaagcatatgggattaaaatagctgaagatgctaaagagaatgcaaagttatacgcctgatcagaaacgacgaatgttaacaagaacatttgtattaaaccatttgttatccataatgaatttactggagccttatttttattttcttttgcaaaccattttggaaatactccatctttagccgctaaatatggaatttcagaagcgagcaaagtccaacctaaccaagcacctaatacagagatgaccaaacctaaattaataaaaatagcaccccattttccaacaacactttcaaataaataagccatagccggatttttcaaacctgcaatatctgcttgctgcataagtccaagagacaataatgtgattaaaatataaatgatgagtgtaccaattaagccaataacggttgctttccctacatcacttctattttttgctcgactggataaaacaacagccccttctaccccaataaatacccataaagttacaagcattgtacttttaacttggctgccaactgctccccatgaaaaagaaccagtttgcccccaaaatccatctaagaacgtatcaatatgaaacgcgaagattcctatgacaataaatacaaatacaggtactaattttgcgattgtagttactaaattcacaagtgctgctgattgaactccacgtaaaattaacatgtgaacacaccataataatacgcttgcaccaataatggacgctacattttgcccgccttcaaagattgggaagaaatatcctaatgaagaaaacaataatgtaccgtaagctacattcccaagccaagcagatagccagtatccccacgcactattaaatcccataaaattaccaaatcctgcttttgcatagctaaaaataccaccatctaaatctggccgttttacagttagattttgaaaagataatccaagtgcaatcatcccaattcctgttataacccagccaataataatggctccagcaccagcaccttttgccatatcactcgctaaattaaaggctccaccgccaatcatagacccaactacaagagccgttagtgtaaacaaccctaatttcttatcttcacccattccactcacctctcttaaattgcaataacaatacaaaagcaatagtgaatgatagtgtctaaaggaggagaaagaagaaaggaagactccctttcttctttactccatatttcctaaagtagctgccataaccgctttaattgtatgcattctattttcagcttgatcaaatacttttgaatgtttactgcggaatacttcgtcagttacctccatttctttcaacccatatttctcataaacttcttcgccatacatcgtttcaacatcatgaaatgcaggtaaacaatgtaagaaaatcacgttttcattccctgttgctttaatcattttcatatttacttgataaggtttcaataactcgacacgttcagcaaatttttcttcttcccccatagacacccatacatctgtataaattacatctgcattcgcaacagcttcttccacattacttgttatcattacctgttcattatatttttttgctaaatcaattacttcttgtgcaggccataaagattccggtgtacaaatacatacatccattccaacgattgctccaccaactagtaagctattagcaacattatttcgtccatcgccaacgtaaacgagcttcacatttttcaatttccctagatgttctctaattgttaataaatctgctagtgtttgtgttggatgccacatatctgttaatccattccaaaccggtacaccagaattttgtgctaaagattctacggtttcatgatgaaatccacgaaactcaattccgtcaaacatacgccctaacacttttgctgtatcctctacagattcttttttcccaagttgaatatcacctttccctaaatattcaggatttgcccctaaatctgtacatgctactgtaaatgcacaacgcgtacgagtagaagttttttcaaataaaagcgctacatttttaccttctaaataatgatgcggaataccatttttctttttctcttttaattctgctgccaaatctagaaaatataacaattcttcttgtgtaaaatctttttctgctagaaagcttcttccttttaaatttggtctagtcattaacataattcatccctactttctccgttatttatactaaatatctttacgaacaattggcatactcatgcaacgtggacccccacgaccacgagataattccgaacttagaacctcaatcacttctataccgtgttcccgtaataacgtattagatacatagttgcgatcatatgtaacaactacacctggcgcgattgctaatgtgttcgagccatcattccattgttcacgagcagaagcaattacatctcctcctccacatggaataagaactaattcacttaagcctaatacctcttttaatgcttccattaaagacgtacgatgtgtaattttaagagtttcctcatctgatcctttttctaaaatataaatattcatattcccttttggtccttgaatggctgggtgaattgtaaacttgtcatagtcaaccattgtaaatactgtatctaaatgcataaatgctcgacattttggaatttctattgctaacactttcttaattttattttgtcggctaaagagatttttagctaaacgttcaattgctttagctgaagtacgagcagatactccaatcgcaattgtttcttcatttaaaattagctcgtcgccaccttcaattggaaatttataatcacgatctaaccagattggtacattatgttttgcaaatcttggatgatatttaatgatgtactccatgaataatgattcacgtctacgcgctggttctctcatcttatttatcgttaagccatcgcccacgctagctgctggatcacgagtaaaatataaattaggcattggatctaagtaaaacggatagtgatcttccattaattcatataaatgtgtcttcttacttgtttcaatttcgtttttccgtacaccacccataattttttgaattaattcttcatttgaaaaggaaagtaaatattcttttaaagtttgatgtgcaacatttacgtcggcctgtccttcttttaaaatacgatcaacaaattcttctcgaagttttttatctactaacgcctcagcggctagtttttctaaataaagaacttcaacaccccgattgcgtaacgtttgtgcaaaataatcatgctctttttgaataattggtaagtatggaatatcgtcaaataataattgctgcaaataatctggcgtcaagttttccacttctttacccggtcgttttaataaaaccgtttgtaattccccaatttctgaagtaacatgtatcggatgtttcatttgttgtacctccttttaaatatgtttgatgtcttacaagtacataataaatgctctacactttcatctttgtgaaagtatccacattatcattgtgaaatattaaacaagttatttttttaaaatcatacgaatatgtatttttataacaaactatctcgctttctcaataaaaaatacatatattacgcatatatgttgaatatttaacttccgtatttaaacaaaaatcctgtttttaattttattaaaaacaggatttttgcatctaaataattaaatttaatctttcttctataatctccctatctgatttcgactgtgaaattataaggcatgtatcatttccgcatatacatcctattttttctttccaatctaactcatcaaataaaacaccaataacatgtgcattaccaggtaatgttttaataaccattaattgatctacacaatcaatttttacaaccacttctcgtaattttttctttaactttatatcagtttgtacatgctcttctgagaaaactttatatatcattaatccttcttgagaaggtaccttcgttaagtttaactcacgaatatcgcgagaaaccgtagcttgtgttactaatacatctttttttgctaacaattctactaatctttcttgcttatctatttcatactcctttacaaattgtttaattaaccgttgtcttttttcttttttcataaaagacaccccttttaatattatagctcgctataattttcatccgaaagggacagaaaagaatgttgcggaaacgttcatagtttaactgtaaatattaaatcaagctaaataaaaaagagaagaacagcattctgttcttccttttacattgaaaatcgttcaattgtttgtttcaagtcagttgcttgcttctctaaatcctttaataattgatcgattactatcatatttttagactgttgtagcgtcacacgcgccacttcttgcgaaccagctgacgtttcttcagcaattgctgctacagcttttgtttgtgctcctgtttgatgaatgtggctcacttgttcattcatataactactaatttgctgagttgcatcggctacttccataacacttgatgacatttcttttaaaattaattccgtagcttccccacgtttcgcctcttctttagctattttcacttgttctgtcattttcattgcaacttgttgtacttcatcttgcatattccgtaataactgcgatatgtttcttgcagaatgatcactttcatcagcaagtttccgtacttcttccgcaacaaccgcaaagcctcttccatgctctcctgcgcgagctgcctcaatagaagcatttagtgctaataaattcgtttggctagcaatcgcactcacaacagacacaatatgttctacttgtttcattcgttcttctaacttctgtacattttgcattgaatcttcattttcttttgccaatgtttgaataccttgaattaaagacgtaaagacacgagtactatgccctaaagcttcaaccatttctgaagacaatgtatcagactgcttcgctttttcttctacttcacttgcaatagaagtcgttgtatcaacagcagaaacaattgcttgaattgatgccgctgattgctcagcgcctgaagaaatttctgcaagtgtctcagatacaccttgcgcttgtctcgttgcttcgcctgtttgttttctaatctgctgtacttgattatttgtatacgaaaatgttgtatcaatattttttaccatgccccttaagtttcctaacatcatattaaatgcaacacttaaagatttaatttcatcatctgtcttcggtaatggaacatcttcacgaatatcaccctcagctgcttttcttgccgcctcctctaacttgcgaagcggtttaattaaaaatacggctgctccatatgctaaaattccagaccatactacccctaataacataacgataatattatatacagtttgacttacataactttgaaaataatcgtatatcacgtaaataaaaaagatacttgttgaatatgtaatgaaagctaaaactgtagtgaatagcataagttgtgtacgtaatccaaaagaaaatgttttcctttctttttccatcttccctttccccctttttataagcaatataaatactacctatatattattatccatattttcattatagaaggatatagagattttaaaaaaatattatttctttgaatatcaaattgcacgaaaaaaataaaggattctgacaatttatgactaataacagaaataaggggcaacatttgtaaaatatatttttaactgggggttttgtatgattcaagttcgaaatctagtaaaatcattcggttcacttgatgtgttaaaaggaattgatttagaagtaaaagaaaaagaagttgttgttttaattggtgccagtggttctggtaaaagtacattacttcgctgtcttaactttttagaaatgtacgatgaaggcgaaattcacttacaaggtgagcgaattgatccaaagcattcaaatttaaataaagtccgtgaaaatgtcggtatggtttttcagcactttaacctctttcctcatatgacctcactagaaaacatcatagaagcacctattcacgtaaaaaaattagagaaagcaaatgcaaaggatattggaactcaacttctccaaaaagtcggccttcaagataaagcagatgtaactcctcatcttctttcaggtggtcaaaaacagcgcattgccattgcacgagctcttgcaatgagccctaagattatgctatttgatgagcctacctcagctttagaccctgaacttgttggagaagtattgcaagttatgaaagaacttgctgaagaagggatgtacacaagtatgatgggcttatgcggcgcatcatacatgaaaacgagctgatcgcgtcatctttatggatgatggaaagattgtagaagatgctccgccagcacaattcttttcagctccatcacatgaacgggcaaaacaatttttacgcaacgttttataatgtaacttttgtttcgaacgaaaaacaatacattcatacggtgcacaactaatcatctaaataaaatatttcaataacatactaaaaaaccatccgtatgatcaatatataggaggggttttatgaaaagaaaactattaaccattgttgcgagcattacactatgtacatctttcatactaggagcttgtagcaaagaaagctctactacttcaacaaatggtgaaaaagaatttcgctatgcgatgagtggattatacaaaccttttaactataaagaaaatgacagcaaacttgtcggttttgatgtagaaatcggtgaagctcttgctaaaaagatgaacatgaaggctacgccagttacaaacccatgggaaacgctgattcaaggtcttcaagcgaagaaatatgatgtaatactgggtagtatggcaattacagaggagcgcttaaaagctgttagtttctcaaatccgtactatcgctctggcgcccaaatttttgtagctaaaaagaataacgctatctcttctccagaagatttaaaaggtaagaaaattggtgttgtaaaagctagtacctttaaaaatcttgttgcaaaatatacagatcaaatcacagaatatgacagcgatattactgctcttatggatttagagcctgggcgtgttgatgcagtaattacggatcaaatggttggtctacgtatgataaaagaaggaaaatcgaatataaaagaagccggaaaaccattaaatcttgatgaaatgggaattgctattcgcaaagatgataaagaaatggttgagaaagtaaataaagcgttagatgaaatcattaaagatggtacgtatgaaaaaatcagtaaaaaatggttcgggcgtaatattctcggtgaagaggaaaaaacgaagtaagttagccattcaaaagattcataaacagtgccccactgattaaatgttcattttatgtggggcatttcattctctactaaaatctatacaatatgaggtgaaacacatgtttgaaatttttatctctacctatcccacactcttaaaggctactattgtcacattacaattaacattaacctccctagtactcggttcattaattggattattatttgctttctttcgaatctcgaataacaaagttttaaatagcattgctcatatctatattgctattattcgtggtacacctttaatcgttcaaatcgcaattctctattttggcattacatctgtcattgttttctcccctttttgggcaggagcaatcgctttagcaattcataacggtgcatatattacggaaattttccgaggatccattcaatccgtcgaccggggacaattggaagccgctcgctccttaggtatgccttaccctttagctatgcgccggattatattaccacaagcatttcgtctgtctcttcctcctctaggaaaccaatttattatcggattaaaagactcttcactcgtcgcttacgtaggactgtccgaattatggggatcaggtttatcaattgcagcaggtaacttccaacaattagatacttacataatcgttggtgtatactatctcgtacttgttcttctatttacttattttgttaatcttttagaaaaacgactacaacgaaaagaaactaactccgtccaattccataaaaagaacaaaaaggaagtttctttataagaaaaagcaagcctgagatggcttgctttttcattgcaaaaatatattaatttttactgatttacttttttaatactcttttcttcctctatatgttcctcacgatatgaaatattatgaggatctagtccatttcctaaagaaccatagaaatgctctctatgcggatcaactaattcacttccttgataatacacgcgtggtgtattccatagcgctgccaaagcttttgtcatcggcatctcatgatagcgttccggccacatttctttaatcttctcttttactaacgggtagtatttagaactcatagcaggaaacagatgatgttctgtatgatatgagaaattgaagtgtaaaacgtctacccagcgcggcactgttactgacaaacagtttgctaacggatcatttactggaacaattggatttaagcggtgatttgttgcgatatatgccattacaataaagttagcaattaacaacggaatgacatatgcaaataaccattttccaggtcccataataaacaataaactaatccaaactgtccaaggcaaaagaagttgaagccatacagatttttgattggatgacttgaactcttttataaaatgaaagaacattcgagtcgaatgcaatgtaaattgaattgttagtgacagaaaactaaagaatgaacgtacatgtaaaggcatacgatatacccaactcaaaaacttactcttcttaagtttctcaagtgtcggccatgcatccggatcattctcttcatgctgtgtatgaacatgatgcgttgcattatgccactttctccaaagctttggccctgttgataatggcataaatgcaatcgcgcctaagaagtcacgaagccatgcctttcttacaacagttccatgtaaaatttcatgccctaaaaatccaagtgaagcaaaacataatccaagaacaatcgcaattcctagattcgcccacacattcaattcaaatacaccaatcgatattaaccccgccaatgccacaagcaaataagccagtccaccaaataaacgagtaggcactggtttaaatgcttttttcggcaaatgtggtgatacacgtgctgcataccacccaaacgtatgaagctccttcatccttttgctcctttcttatgccgcgccttgcgcaacttacatatatcaattcttgcttccagattgattttactagatgatccaaaaagcatctattataaggaaaatatactcactctatcgtcacttatttttcgcttttattatcaatgaaaaacatttctctttttactctctatcaacctttccacatgatgaatcataacaatagaatttctatattgtcaacaccttttatgacctagtaataaaaggtggttatatttttataatcatactttatttcactaaagaaaatgtatagattccataaggatttacccactatatatagacattttcttaaacgtcatagactctatctcattcaataactccctatgtaatcaacaaacagaatcacttgaatttagttttatataaatcctaccacttcataatgccccatctaattaattatattaaaataatttataacctcttttaataaaaatagactacttctaaaacaacacacatgaatttcatatattatggaaatattaaaaggaaaattgttctaaaatcaggaggtttccgcaatgacaagtgatacatttccacaactgccgctatcttattggattgaatctactcagtttcctactttccctcgtttatccgaaaatataaagacgaaagttgctattatcggtgctggtattacaggtattactactgcctatttacttgcaaaagaaggcatcgatgttgttttaattgattctggtcgtattttaaacggaacgactgggcatacaacagcgaaagtaacagcacaacatgatcttatttatgatgaattaataaaccatttcggtgtagaaaaggccgggctttactatgaatcaaataatcaggctctacaattcataaatgaaactgttcaaacatataaaatcgactgtaatttctcaaatgaagattcatatttatatacaactaccgataacggattaagaaatttatcgaaagaatatgaagcttatcaaaaattaaatataccttgtgactatgttcaatctctatcgattcctattccagtacaatctgcgcttataatgaaaaatcaagcacaattccatccccttctttatttaaaaacacttttagaaaagtttgtggagatgggcggaaagctctacgaacaaacaacagctatggatgtggaaaagggagatcatccacaaataattacaaaagagggccatcatacatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaagttttcaggaaatgaattagctaccatatgtatctgggtcagtcaacgtacagcgagtgattctctcgttcgactatgcagtcaattacacgccgccacaggcactcttatgagtccagaaggactcaataaacgctttgataaaaaagcggttgaatttttgaaatatattttttctgcattatggaaaagtaaactttgtaaaacatcagccatttcaag

SEQ ID NO: 1363 - DNA, 16102 bp, Bacillus thuringiensis
cttaatgacgtttatccttcactatatcgtgagtttgtgggtggcgatcatttacaccaagagttgtcgtttgtatatgtatgcaagcaagatgattcagcacattatgaagaagtatacgaaaggctgcgagtatacaaagaggaagtgcttcaaggagaagaagctgaagtaaatgcaatacaatccacattatcatttacttccttctataacggaaaaagagttttgtgagatggtagaaattgcgaaagaatatataagagcaggagacatattccaagtcgtattatcacagcgtttacaaagtgaatgtcttggggatccattcgggttataccgaaaacttcgaattgcaaatccatcaccttatatgttctatatcgattttcaagattatgttgtactcggttcttcgccggaaagtttactatcagtaagggaggataaagtgatgacgaatccaattgctggtacaaggccgagggggaaaacgaagagggaagatgaggaaatcgcaaaagaactgttaggcaatgagaaagagcgagcagagcatatgatgcttgtagatcttgggcgaaacgatattggtagagtgagcgaaatcggctcggttacgatagataaatatatgaaagtagaaaaatactctcacgttatgcacattgtatctgaagtttacggaacattgcgaaaacaaatgggcggatttgatgcgttagcgtattgcttaccagcagggacggtttctggagctccgaaaattagagcgatggaaattataaatgaactagagaatgaaaaaagaaatgtatacgctggtgcagttggatacgttagtttttcaggaaatcttgatatggcgctcgccattcgaacgatggtcgtaaaggatgaaaaagcatacgttcaggcaggagcaggagtcgtttacgattcagatccagtagctgaatatgaagaaacattaaataaagcgagagcgcttttggaggtaatgaaatgattgtacttattgataattacgattcgttcacatataacttgtatcaactgttaggcgaacatgaagaagaaattgtagttgtaagaaatgatgaaataacgatagaacagttagaagagatgaatccaagaggaattgtactttcaccaggaccaggaaaaccagaggatgctggcatttgtatcgacgtcatccgtcatttttataagaacgttcccatattagggatttgtcttggccaccaagcgatcatatctgcatttggaggagacattgttagagcagagcgtattaaacacggaaaaacatcgcgtgtgaaacataacggaacgtcaatcttttcatatgttacacagcccctaacggcgatgcgctatcattcccttgttgcagagcaaacgagcttgccaaagtgctttgacatattagcgacagcgatggacgacggagaaataatggcagtccgtcacaattattatccgctcttcggattacagtttcatccggaatcaatcgcaacagaagaaggcggaaagttaatccgtgcctttttaacagaagtaaaagaggaggaaagagtatgaacaactatcttcgtaaattagtggagggtcaacatttaacagaagaggaaatgtataaagcaggactacttttattaagtgaaaacatattagaaagtgaaattgcagctttcttagtcttactgaaagcgaaaggtgaaactgcagaagaaatatacggtctcgttcgagctcttcgcgaaaaggcattgccgttttcgaaccatatacaaggagcaatggacaattgcgggacgggtggtggtgatgctcaaacgtttaatattagcacaacatcagcattcgtactggcaggagcaggtgtaaaggttgcaaaacatggtaatcgtgctgtttctagtaaaacaggaagtgcagacttattagaagaactaggtgtaaatattagtagtacgccaaacgaaattgattatttactagagcatgtaggtattgcatttttatttgcaccagcgatgcatccagcactaaggcgcattatgaaaataagaaaagagttaaacgtgccgacgatctttaacttaattggccctttaacaaatccagtgaatttagaaacacaatttgtcggtatttataaacgagatatgttattaccagttgcacaagtattacaaaagttaggccggaaacaagcgcttgtcgtaaatggaagtggttttttagatgaagcgtcattacaaggggaaaatcacgtagtccttttaaaagataatgaaatagtagaaaagagtattaatccagaaaagtatggtttttcaagagtgaaaaatgaagaaattagaggggggaattcaaaagaaaatgcaaagattacgcttgaagtattgagcggagaaaagagtgtttatcgtgatacagttttattaaatgcaggtctagctcttttcgcaaatggaaaaacggaaacgattgaagaaggaattaaactcgcggcacatagcattgactctggaaaagcattagccaaattaaacttattaattgtagcaagcaacgaaaaattagaaagggtgaactaaagtggggacgattttagataaaattgtagaacagaagaaaaaggaagttgcggagttatatgaaatatatacaccagtaaaaacaaaaagaaagacacattcacttgtagaagcgttacagcagtttactgtcattgcagaagtaaagcgagcatcaccatcaaaaggagatatcaatttacacgttgacgtacgaaaacaagtgggaacatatgagaaatgtggtgcaggagcagtatctgttttaacagatggtcaattttttaaaggatcgtttcacgatttacaaacagcaagagaagaaagtaacattccgcttttatgtaaagatttcataatcgataagattcaaatcgatagagcgtatgaagcgggagcagatattattttactaatcgtagcagcgttaacgaaagagaagttaaaagagttgtatagctacgtgttagaaaaaggattggaagcgattgttgaagttcataatgaacaggaattagaaactgcgattgtattaaatccgcacgttattggtattaataaccgtaatttaaaaacgttcgaagtagatttaagccaaactgaaaagcttggaaaaagattgaatgaggagaaattactttggattagtgaaagcgggattcattcaaaagaggatattattcgtgttaaaaaagcaggagcaaaaggtgtattaattggagaggcacttatgacatcatcttctattagtaacttttttgaagactgtaaggtgaatatatgaaagtgaaaatttgcggcatcactgatatggaaacagcaaaacgtgcttgcgaatacggcgcagatgcactcggatttgtttttgcagaaagtaagcggaaaatcactccaaagagagcggaagaaatcattcaggagcttccagccaacgtgttaaaaatcggtgttttcgtaaatgaatcagtagaagtgatccagaaaattgcagatgagtgcgggttaacacatgtacaactacatggagatgaagataattatcaaattagaagattgaatattccgtctataaaatcactaggagtaacttcagaaagtgatatgaaaaatgctcaaacatatgaaacggattatatattgtttgatagcccgaaagaaaagtttcacggaggaaatgggaagacattttcatgggaactacttgtgcatatgccagaagagttgcgagagaaaacgatattagctggtggattaaacgctcttaatatagaagaagcgattcgaactattcagccatacatggtcgatgtaagtagcggagtagagacagaaggaaagaaagatctaaagaaaataaaacaatttattaaacaagcgaaggagtgttccaaatgaattacgcatatccagatgaaaaaggtcactacggtatatatggaggacgatacgttccagaaacgttaatgcaatctgtattagaactagaagaagcatataaagaagcgatgcaagatgaagcgtttcaaaaggaattaaatcattatttaaaaacgtacgttggaagagaaacaccgctttatttcgctgaaaatatgacgaagtattgcggtggtgcaaagatttatttaaaacgtgaagatttgaaccatacaggagctcataaaattaacaatacaatcggtcaggcactacttgcagtacgaatgggcaagaaaaaagttgtcgctgaaacaggggctggacaacacggagtggcaaccgctactgtatgtgccctactcggattagaatgtgtcatctttatgggagaagaagatgtgagacgtcaaaaattaaatgtgttccgaatggaattactcggagcgaaagtagaaagtgtagcggcaggtagcggcacattaaaagatgcggtaaatgaggcgcttcgttactgggttgcacacgtgcacgatacgcactacattatgggatctgttctcggaccacatccattcccgcaaattgtccgtgatttccaaagtgtaattggaaatgaaacgaaaaaacaatatgaggagttagaaggaaagttaccagaagcagtcgttgcttgtattggcggtggtagtaatgcgatgggtatgttttatccattcgtacacgatgaagaagttgctctttacggcgtagaagcagcagggaaaggcgttcatacagaacagcacgcagctactttaacgaaaggaagcgttggggttttacacggatcgatgatgtaccttctgcaaaatgaagaaggacaaattcaagaagctcattctatttcagcagggctcgattacccgggtgttgggccagaacatagcttactaaaagatattggccgtgtttcttatcattcgattacagatgatgaagcgttagaagcatttcaattattaacgaaaaaagaagggattattccggctttagaaagctcacatgctgtcgcatacgctttaaaattagcgccgcaaatgaagaaagacgaaggacttgttatttgtttatcaggccgcggggataaagatgtagagagtataaaacgttatatggaagaggtgtaaaaaatgggagtagaaaaaattaaagcagcgtttgaaaatggtaagaaagcatttattccgtacgtaatgggcggagatggtggctttgaaaaattaaaagaaagaattcgttttttagatgaagcaggagcgagcatcgttgaaatcggcattcctttttcggatccagtcgcagacggtccaacgattcaaagagcagggaaacgagcgctagatagcggtgtaacagtaaaaggtatttttcaagcattaatagaggtaaggaaagaagtgcaaattccgtttgtactcatgacatatttaaatccagtacttgcattcggaaaagaacgattcatcgaaaactgtatagaagcaggtgtagacggcatcatcgttccagacttaccgtatgaagaacaaaatattattgcgtcgttacttcgagaggcaaacattgcgctcattccactcgttaccgtaacgagtcctattgaaagaattgaaaaaattacgagtgaatcagaagggttcgtttatgctgttacagtagcgggcgtaacgggagtacgtcaaaactttaaagaggagattcatagttacttagaaaaagtaaaatcacacgtcaacttaccagtagtcgctggatttggcatctcaacaaaagaacatgtagaagaaatggttacaatatgcgacggagttgtcgttggaagtaagatcattgagcttttagaaaatgaaaagcaagaagaaatatgtgaattaatatatgcaacaaaacaaaaagaagaggcgtagtctcttctttttgttttgcgtaataaatgttaaaatatacagaaaatacatataatttagagggtgagaaggcatgctaagacgtaaactactatatctatttttaactgtaccgctatacgcttggctcattagcatgacgaaaatagagttaatggctctatttttagggtatgtattcatcttttccaacttaaatcgcattcaagaacagtctattttagaaatatgtctattttcgattagtatagaattatttagtatcgtttcgattgtattattaaacgaattatttctacggattcattcatttacattaatgaaattttggaatattatattgcaagcaatatgtacttacattgtgtttgttgtgttgaaagaaatagtcggaaagcagaccgtttttcaggataatagaaaatgggagtgaatgaaaaggagccgtttggttccttttttgaatctgttgtaaaaacaattgaaaattatagtatctgttatataatagttaaaaattgtattttaaacgaaatgagatgataacatggccatattgttggcacttatcccaattatgatgattttcatttgtttatttttatttaaacaaacgtcattaaggtcctcgttaatttcttatgctgtgtctgttggaatcgttttactctcgccaatgtttcaattagggataagtgaaactgtgcacgcaacgattaaaggatggttaatttgttttattgtcgggtacgttttatttttcggtatttttttatttcacctcatgaacaaaatggggtacatcgatcaagtagcacgttttctagaagcagttactcaggatcgcttattacaaatgctgcttatgtgttttggcatttgcccgcttattgaatcagtaagtggattcggtattggcttcatggttgcagcacctatttttctttcactaggatataaaccatttcaagctgtactactctcattcatcggcttactagctagttcatggggcgcaatggcaactggtacgattatcggttcgcagctaataaatatgcctcttacaacatttggcacaaatacagcgctattaagtattccgatgtttgcttacttcgttattctttctttacacgttgttggcggctggcaagcggttatagaaaagtggaaagaaggagtagggttctttctattattttctctcggaatctatctttctaatgcgtacgtaagtgttgaactagccgggatattaagttctatcgttacgattacctttggcttttttatcattaaattaaaaggaaaaagtgggcaaaatcttataacagaacatgcggctgcaacggagagagaagtatccattataaaaattattagcccttatatatttctaacagtttgtattttactttctcgcctcgttccagcattacatgatttgttcagatcatatgcggttcttgatttgaaatcatactcttacaaactagagttactatattcaccaggattttggctcggtatgacttgcttatttactattattttcttccgcatcccgtctaatattattaaacaatcactctcacaaacgattaaacaatggattccatttgctattacgacgacaatgtttatcgccatttcagaactaatgggtgcatctggcatgcattcattactcgcaaagacagctggtgaaacatttggaacctttttcgttttcgttgctccgtttattggcgctattggtggatttttaacaggtagtaacgcaggatcaaatgcaatgtttataaaactacaaatgcaaaccgcacaaaacgtagcactcccgtggcaatatgtcacaacacttcaaaacaccgcatcatcagtagcgacaattgcttgtccatcacggattacactaggtgcttacttatgtaatatcccttaccgtgaaaatgaactattaaagaagacgacgttaatgatctttggtgcgattttgcttgtagtggtagaagttattgtttggtatatgttgagaaattaaaaatcctcctaacataggaggattttttttatgagtggataatgatttaaatatgaatagcttctactaaatgaataggagatgaaatgtatgcccctaaaaaactacggtgtgttaaaaggtacagttatacaatcaaagattggaaaagggaaaacacctcattatcaagttcatttacagggcgagacaggagtaaattatcgtattgcaattaacgtaaaatcgcaaagctatccgtcagaagttttatattttgcgagtaacaatattaagtcagaggcgattcatattttaccgacattaccattcgattttacagaaataaaaaacaatgaaccgaaagtagctttagattatgtaagaggaaatctatttgactcaaatcaaatgattcctttgcctcccgaaaaagcaggagcagataatgatttaaatgaaaaaatagaacgttatataaaacgagcaatagaagaaaaagcaattatttacgcgtttggtgaaagatggggaccagaagaaaatacaccagattcctattttcatttcaaaccaggaaacggtatacatgatattcatatgaatcaagggaatgtagaaaaatggcaaggtgatgatggcatatggcaagatggaggaatactcattcactttgaaaaggaagaagaatggatcggtatctttcttgccttccaatcacagtcatggtgtaccgatgaagaggggcatgctcgtgtgcctgttgagcattgtgattataaggggaataattaataagaaaagggcgttcaaaaagaacgccctcttcttattttataaaacgaaaaactaacgagtgtagaaagacaagagaacagcagtgccacactagaaaacgcaatgagatacatattatatttcataacctgtccaattagctgattactgtcgtattgaaacagtcctgctattatgttgaataaaaataacacgataaacatgacgacaacaccgtctattgatcctttaatgtctggtttacttaaagcgatatgcgcggaaatgcaaatggcgataaataaaaataaccaaaaggaaggattcaataaattgccgattgtaaataagcttttcaataatacaaacgtcgacaagagcatgttttggatcatttctacattaatagaagtagaagcaatcgttttttcgagagttgtattaaataaaaaatatgattctggtacgaaatagcgcattaaaaggattaacgcagtaataccagaaataataggcccaatgccgatgaagaaattcccaatccgttgatacacacttttttgattgtattgatgttgtacgtaacctaaagccccttgacttgtatctgtcgggaagaactgcgttgctacaatcttatgacggaacagcacgcacataatggcatgtccaagttcgtgaataggaacaccaatccaagccgttaataggaatccttttcgtccaaaagctctcgaccaatacatccgtgtgagagattctaaatagcctaatagaaatccaattacaatgataacgccaattaaagataataattggattacgcttgtaaggagtatttgaaaaattgagtttaccaattccattgccagtcatccaatctgttaaaaatattatttattctgtttcataatagcattttttttcaagattactagcacatatattttctttcggaagaaggatttcagaatctttttcttgtagtcatgttttatgtacaaattcatatattgaatttgtaacaccctatacggtatatccttaaggagggataagagaatgaaatgtccgtcatgtcatacagaaaatgcagcggaggcaaaattttgcgggaattgtggacattcgttaacggaagaagtagtggcaagtagtggccaagaagaagggccggaacaagcacgtgcggcacaagcaaaggaagctcggcaaaatgaaacggtagagcaagcgaagcggtttgcgagcggctattttcaattttttaaacatgcattacaagcaccgacagcgattatgcaaagcggcgctattgaagtacgaaatggaattgtaagtcttgttcttatttgttttttaggagcatgtattttttatagaatgatgagtgcagcatcagcagttacgagaacatttgcaccagatatatctactcccacgttttttgtagaatctataacggtctttttctttttattaattttaactttatttgtcggatttattatttttgtaagtggtaagatgatgaaatcatctttttcgtttcttgaagtattcggtatatggggaacgatagcgacgccggctattgtcatattagtcctttcttttctttttagtttcttattaatctttttcttaccgatattattatccgtagctgcaacttatatagggattagtataactgtagccgtattaaagctagacaatggcggattagatctcgtttacacacttattattgcaaatgttttaattggaattgcaacattcattgtactttggtcttacattagcacgataattcaagccttaacacagggaataactggcttctaatgaaaaggtggttgactggatgaatgtatgtacaaagtgcggagttcagtttgaagatggtgtgcagttttgtcaaaactgcgggacgaagaggggacgttctgtagtaaagaagaacatgagcggtggtgtaaaagttggcattacactgttagcgctatttgttatagcgattattggattgtatttgtacggattgtcgtattatacgcaggtggcacaagtagaccggatgattacgattttacaagagagggacggagagaaattagctgagatcgttacggcagatgatccatcggttatgataacgagagagagcgtaacgcctctattttcatatataaaagaaaatccatcttacgtgaatgaattaaaagaatatttgagacaaggtgaaaaacaacgggacggaatagaaagagctgatttttcattaacgaaagacggaaagtatttctttatatttgatcgatataaattgaaagcgaagacgtactatgcaactttgctttcaaatgaaaaagacgtatcgttaaaaatgaacggaaaagaaattgataagacagatgacaaaaagtttgagaagcaatatgggccatttcttccgggaaatcaagtgtttcaatcagaatataaaaatgactacgtaaaactatcacgtgaggaaaaggttgtacttatgaaacaaagccaaaataacgtaacgatagatttaacgttgcaaggtcaatatattacagttcaaacgaacgcgcctggtgcaacattgtacgtaaatcaaaaaccagttacagcgctcgcaggagaagaaattacatgggggcctgtagcgactgatggaagcgcgaaaatttatttagaacgaaatggagaaaatggacgggaaacgacaaaagtagagacggtaacggcactttcgtcttataatcttccattccaaacgaaaagtgcagaaaaaacagttgtttataatgttactccaacgcccgcaactgggtatgtatataatggtttcatctttcctgatagtgatattcgaaaattaacgagcacagatttaacatatttatcgaaagaacagttgaaaattgctagaaatgaaatatatgcaaggcatggacatatttttcaaacgaaagatatgcaagcgtattttgcaaaacagtcttggtatagagaaaatccttattttacaggaaagttaacagatatcgaaacttataatattgaactaattaaatcaagagaatagagcgcgggaaaaaggtacagtgtatattactgtaccttttctatcgttatttggctggacgaggttccctagagaaaaagatatgaaagagaaatgtgactttacttgcccctcctgatgtactggcttgcacatcagataaagaactagacgttaaagcagcttcagaatgaggagggacgattattttaagagcatcatctgattctgaggatgcagtaactgttattgtatcgtcagaaaaatttaaaattttaacagtaccgactggaaagatggccttgcgagcatgtgatgaagaagcgaagcgggtagctttccagatagtttgtgagaaagtgtcattgtcagataaccaagcacgagcactgtataaagttacactaaccgtaaactcctgttcaagcgggagggcgggtttcggttctatcggttcctctggaagctggacgagaaggccggcgcacatgtatgtttcacctactttcaactggttactgttataggatattaaacatgttgtttataagacacgacagttacctattcaggcataagtttgtgcacaaaatttgaagatgaaattctctttctttacaatggaagtaggtgttatttctataaaatatggaaaacgtaaagagtatgtaaaaaagaaggagtggtaaagtgaactatgtcattattggcggagatgcagctggtatgagtgcagcgatgcaaattgttagaaacgatgaagatgcaaatgttgtaactttagaaaaaggtgaaatttattcgtacgcgcagtgtgggttaccgtatgtcattagtggtgctatcgcttcaacggaaaagttaatcgcgcgtaatgtaaagacgtttcgtgataaatacggaattgatgcgaaagtacgacatgaagtaacgaaagtagatacggagaagaaaattgtgtacgcagagcatacgaagacgaaagatgtctttgaatttccatacgatcgtttattaattgcgactggcgtgcgtcctgttatgccagaatgggaaggacgggaattacaaggtgttcatcttttaaaaacaattccggatgctgagcgcatattaaaaacgctagaaacgaataaagttgaagatgtaaccattattggcggcggtgcaattggacttgagatggcagaaactttcgtcgaacttggtaagaaagtaagaatgattgagagaaatgatcatatcggtacaatttatgatgcagatatggcggaatatatacataaagaagcagataagcatcatattgaaattttaacgaatgaaaatgtaaaagcattcaaagggaatgaacgagtagaagcaattgaaacggataaaggtacgtataaagcagatcttgttttaatgtcggttggagtgaagccaaatactgattttcttgaagggacaaatatacgtaagaatcataaaggagcaatcgaagtaaatgcatacatgcaaacgaatgtgcaagacgtatatgcagccggtgattgcgcaacacattaccacgttataaaggaaattcatgatcatatcccgctcggaacgactgccaataaacaagggcgacttgctggactgaatatgctggataaacgaagagcatttaaaggtacgttaggtacaggcattattaaatttatggatttgacactcgcaagaacaggattaaatgaaaaagaagcgaaagggctacacatcccgtataaaacagtcaaagtagattctacaaatatggcgggctattatccaaatgcaaaaccactttacttaaaattactatatcgctccgatacgaaacaattattgggcgggcaagtaattggagaagaaggggtagataaacggattgatgtgatcgcaatggcgcttttcaataaaatgagtattcacgatttagaagatgtcgacttaagttatgcaccaccatataacagcgtgtgggatccaattcagcaagcggcaaggagagcagaatagcactttttaaagtgctatttttttgttaaaggggaattatcatttttgtcgaatgaagaggatcgggaaatagttacatatgaggaaggggagtttttttatgattgtagcacttcaaaaggttcaagaatcagaaaaagaaatattacgtaatttgtacgctttatatcttcatgacctttctaagttcactatgaatataactatcggagcgaacggattttttgaatacgaagatttgcatatgttttggaaaaatgacggaatcacgccgtattttataaaagttgatcatagtattgtaggattcttattactactggaacgtccgtttttgaagaaggaaaatgattttggtattaatgatattttcatattgaatcaatataaaggaaaaggaatcggtaaacaagtagttgagaatttactagaagagaaaagaggacaatatttcgttatcgaacttctaaaaaatgtaccagcagtgtcgttttggaagaaagtatataaagaattaaacattgaatttgatgagagagcgcagctaattgatgatgaagaatgtcttgttcaaacgtttaaaatttaatgaaattggtgttccttttatattactttgaaatttaactttatcctgctatttgcgggcagtaagaccccactgattaaagtttcactttattttgaatataccgtttccccttgaaaacatattacgtatcgcttatattttcatatagtatttattttttaaacgaagcaatgaacgaaccagggggcgcagtatggcaattaacatgaaaacaatcgaagaatggattgctgaatcaaatgcaagacatgaagaagactttggacacgttgtggaagaaatgaaagaagtatgtgtcggacttgataacgcgacattaatttatacgaaaaatgtattttgtttcggtaaaaaagtagaagtctttttcttcttccaagaccatgtcgtgattggacaagaaaaagacgaatatgttgagattgaaaaattaaagtatgatgacattacaaatagtaacttaaaaacaaatgacaaaaatactacgttagaattaaagtttgctaacggacaatctatcaatttagatagtttaaatgataactacggtacgaaaaattggttatttgctagacaaattaagagtatttttaagttaatctagtaaaaagagcagacctcaataaaatgtaccctatagaatagacacttgaaaaaagtctattctatagggtatttcttgtataataaaaggaaaattgggatcggagaatgttgaaaatgacaaaaaaactatttacagaaagagaaattcaaattctatcaaataacctatacgtaaaatctgtaagtcagaaaggtatcacttatacagaggaatttaagcatatttttattgaggaaaatgaaaaaggaaagctacctcgaaatatttttgaagaatgtggttttgatatagatatgattggaatgaaacgagttatgtcatcgggaagtagatggcgtgctgcttatagaaaaaatggtgtattgggtttaagggatacacgtatcgaaaacgctggaagaactcttgagagagagcttacgttagaagaaaagtatgcccgtttagaagccgaacgaaacttactaaaggcggaaaacgaattgctaaaaaaaatcaaacttatggaagggaggatgagaaggaaataacactaccacctagtcagaaattcatcttgattcgttctgtcatcatgaaatacaacttaaggaatatggtcagtcatttgtgtaaagtagctggtgtatcccgttcgggatactataattacttttcagtttcatctcaagaacaacggaaacaaaagagtgatcgagatgaaatcttgaaggaaaccatattaaaagcacttcgatttagaaatagaaacaaaggggctcgtcagataaagatgacattggcgggtcagtttcaagttgtctacaatttaaagcgtatccgtagaattatgaagaaatacgagattatctgtccggttcgcaaagcgaatccttataaaagaatgcttaaagctacaaaagaacatcgaatagtaccaaatcaattaaatcgggaatttaaacaaaataccccagggaaaacacttcttacagatatcacctatttagtttacggtaagaatcaaagggcctatttatctacaattttagacg

SEQ ID NO: 1364 - DNA, 18534 bp, Bacillus thuringiensis
gctcataattaccatacctataactgctaatgaaataagcgctaataatttatatttcacttttaaattttgtaaaaaatacatttttccacctttattcctttatatatagatttttagaattttatagcttattatttacaaaatcgtaataaaaagcaatgataaatattcccaatatgaaacttatatctctataaaaaaagaagtagctatcatgctactcctttttgctttgtttctcatattgttcaaacgtatgaattctttcaaaaattggtgggtgcgtgtataagaaaaattttactaacgcaggcggatttacttggcttaaacttgtttttgataaatattgaaaagttttcacaccagatttcccatccttcgtcatatttaaagcatattgatctgccgctctttcttctatacgtgaaacgtagtttgttgctggttgtgctgcaaaagagaggacagaagaaattaagaaaaataaaggtaaaatggagaaacatgctacttttgaaatttgcaatgtatctccccatttgcgaatacacatatttataatacgactaattaaaaacatacctataaacgatagcaatacataacttgcaacgccaaaatatatatgtttcataacataatgccccatttcatgggccattataaataaaatctctttatcttttaactgcttaagtgttgtatcccacattacaatacgggcgttagggccaattcctgttacgtaagcatttaatgcattcgttttttctgacatatttacttcatatacgtgtttagcaggaatgtccgctttgtctgctatcgctaaaattttcgtttctaattctttatttttcagcgtcgagaagtcgttatacagtggatcaataacgacaggctgtatgaatgttaaaaagattgtaaatggaacagagagcgcccatcctgcgagccaccatctcttcggaaatttacggataagccataatagaacggtaactacgattaacatagtcgcataactttcccaaaaaccgataacatgatcttttatccagctttgtgtactttgtgttgaaatgccgtaatcaacggacactttccggccaatccattgcatcggtaaggcaagcactgttgtcaataatgataaataaaagaaataaatcgcaacttgcaaaacacttattttagtcgtttccttcgaccatttctcaaactttcttgaaatacctagcacaagtacaaataataaaataatccattcaagaggcgtcgctaaaaagtatagtaaatttttcacgcgcgaataatcttggcttagcgtaagctctctcgtactcataaacgtttctggatctgcactcgttcccttatacatgtccggaataagttcatgattccatccaaataaataccaatatataagtaacgcaaatccaacgtacaaaaaaagcgaccaaccgataaccttcttcacgctattccctcctctatgctgcctgtctattattattgtaagttcgtacacgctaaattagaacaagcttattatgtgaattgctctggatctttttatttacataaaaaaactcttctacataagaagagttttacctatctttaaacactttcttcggttcacaatccgtacacttacaaaccaacacgtaccctacttgctttttagataaaataaaaagcctctttaaggaagtacatctattaataaactaaaatcttgtaaagagaaagaactatatttcataataccctgtacagctaaaagtaaaaccagaccgatcacacacatatagttaacgctttcttcattctttttttcagtaaccactccaccacttatacataaaatccctagcaaatggagcgctaaatacatgaaaaaataagcttcctcccagcgcaaaataacattcactgtcgttattaacactagactaagtaaaatcaaataaaaaaacttatttgatgatatcgtttcattcatataattttatacatccctttcaaatttcgaattaatgatgtttcaaagctataaagtaaatgattgtttttataccataaaacaaaaggaaagccaccattactttctcgaatactttatgaatccacatatacttctcttcattctttttgaagatgcgcttcatcatttcttctacaattagaccaaatgttagtaaaaccccgaacacaataagaagagaaataatattttcttttaaatgagtactagaaaatacgtaatactctggaaacacaatcgtatctactacaggttgaagccaatgacaaacacttctatcacacatatctgtaatagacgtagaatctataatgtcttttaatattttttcaaccgtcttcttcatcttatttactcccgactacatctgaaaagctcttttcctgctctgcatatataaccggcacttctttactccaatatttgcgattaacaaataaaaagataagtactaagtttaatcctgttataaaaataataagtccaggaaagaatgtcgtataatttgagaaatcggcaaaactaataattttttctctacttattagaaaagacgcacctattacaaatgcattgtttaacatatgtattgcaattggcatgagtaaacttttcgtacgaatatatacgattgacaatacgatgctgaatatggctgcaccgaggaaatcaacatgtaacaacgcaaacaatattgctacaacgatggtcgctatgctcgttccccattttgttgcaaaacgttgaagtaaaaatccgcgaaaaacaatttccccgataattggtgcgatgaatacgaccctaatgacttgagatacatatcccccagtactatctacaattggttcatgcagggcgttcataataaagtccggtgtaatccatgcaaaactatacatatacaaaataagatacccgtaactaaacatgcataacataaccgtaatgtataaaacttgtaccaagttaaatgtttcatttttattaacaaataatgaaaatgaaatgtggtgctttctatactcataagaaatccataccatcggaaggatatagaatataaggatatttataaaagaagaattttgtatatgaaatatacttgttagcaaatcgccactacttctcgctattaaaattaatagtgcaaatacaattaaaaaatatctagctcgcatcacttgaaacgggttcacactcatctcctcccctatgttacttttatcatatcatttgattcttaattttttgcgaaagaaaaccttaaaatttccttaaaaattccataagttacaaaatgatgatatgatattcgagaaaattaggagggatatttatgtaccaagcaaatattttactcgttgatgatgaaacagcaattttacaattactaactaccattcttgaaaaagaaggcttttctcatattacaactgcaacatcagctgaaatagctttatctctaactaagcaaaacaattacgatttaattattttagatgtaatgcttcctggacaatctggttttgatatttgtccaatcattcgccaacaaacagattgtccaattttcttcctatcagcaaaagcatctgatttagataaaatatccggattttcatacggtgcagatgattatattacgaaaccatttaatccattagaagtagtagcacgtatgaaagcacagcttcggagacatatgaaacaaaccgtaccacacgaacaaaaaccacactcaatttcatttggaagatttgaaattgatcagcactctgcagaactaacagtagatgggcacattgtcgaatgttctgctcaactctttcaactactactcttcttttgcgagaatccgaactacgtattttcgaaagaggaaatatatgaaaaagtttggggagcacctgcctataatggcgatgacaacactgttatggtccacattcgaaaactacgtgaaaaaattgaacacgatccaagtaaaccagaatatataaaaaccgttcgcgggcttggttataagttcgttacaaagtagggtgacgatatgaattttaataaacgacttattattcaatttatcatgcaacacgtttttgttttagttacattacttatcgctgtagttgctgcttttacttatttaatttttcttcttactagtactttatacgaacctaacattccggattctgatagttttacaatttcaagatacatctcttcagaagatgggcatatttcgttacaatctgaagtgcaagatttaataaaggagaaaaatgattggctccaagttgtagatgaaaacggaaaaatcctctaccactttaatacaccaaatgatgttccggatgcttatacgaagacatctttagtcgcatatatacagcatcatatcgaaagcaattataaatttacatattgggaaattgaattagaagaaaagaaagcacttgttatttatggtggtatgttaaaaagcaatgcgttactgacagcaattcaaaaggatcactcctctttaacgatggattcgttcacattaacagatcaagaaaaacagttactgtctaaagaaaaagcagcacttcaaatatttaatcaaaatggcgaagaggttttttcctatccaactggaaagaaaaaaacattttcagcaatacaaatcgcccttaatgaaaaagagccgtggaatcataaagaaaatacgtctagcttttacgatgcaaatagtggcaaccttctcgttgtgactgcgaaaaatgatcactactatccagatgacgaaattgaagatgtatttactaagaagtttctcatcggatgcggattaatccttcttatcgtatttgtttatttagtcattctttctatttggtacggtaataaattcgggaaaccgttattacatgcgatgcgctggcttaaaaatatcgctggcggaaagtatgaagaacctattagtaaaaaaggaaaacctgtcaggttccggcgatctggtaaagaaaaatggtcattccgtttgtttagagatgtaacaagttcactagaacacctttctattacactcaaaaaaaatgatgcgatgaggcaagtcctccagcaaacacgagaagaatggattaccggtctaacacacgacttaaaaacaccacttagctctattatatggctacgcattattactcgaatcggatcaatataactggactgatcgtgatattcagcaatttggtagtgttatgaaagagaaatctcaatatatgacgacattaattgatgatttaagcttaacgtatcaattaaaaaataacagccttcctgcccaacacgtaaacattgaaatcaatcagttcgttcaaaaagtattattgcagtttattaacaatccaacactacaaaatcaaaatattgaattcgtaccgagctcaaataaaattcaatatttcattgaagaaaaatggtttcagcgtattatcgaaaacttactcgtaaacgcggtaaaacataataatgaaacgactaatgtcatcgtaaaactatcacaaaacgctaattcctttacactctccatttcagatgacggaaaaggaatggatgaaaaaacgaaagaacttctatttgaacgatattaccgcggaacaaacacagaagaaagcaacatcggaactggacttggcctagccattacaaaacagctcgttcatgctcataacggaacaatttccgttgatagtgcactcggaaaaggaacgacgattatccttgtatttccgtttcgttcgtaagaaagatgctatgtggcgtctttttttcttttctgggagagttttgcggtaattgaaattatgcagatcgttttttttgaggtgttttagcggtatatgaaattatatcggcgattttttgaatatatcggcgcaactcgaattatatcagcgattttttgaatatatcagcgcaactcgaattatatcggcgattttctagatatatcgacttaccgacaaaaaccgacaatactaacctacttccctactatacaaagtaaaaataacccttcataactcactatgaaaggtcactccatatttcagctatttccctactaacacaaacacattctcatcaggtgcttccattactgcaacatgtcctgattctgttggaaatggttcgcgaatccactttacatctttattatcttttaaactctcatacgtttgttgtacatcttctactaatacttcgacttccgtaaaattaatatccggatgattgcttattactaactccgaacttttctcatctggaaatttcaatcctattaacgtccaaatagctccttcttctagttctctttctatcatccagttttgcttcattcccatttctttatagaaagaaactgatctttctatatctttcgtatgtatagatacacattctagttttttgaacattttcccatttctccttttatgaaaaagcgaaccatctcccaatgattcgctcttaccttattattttttcttcaccggtatccaaagctctacttgtgcaaactcactcttatcttcgtggcaacgctcatcgtacagttcaaactctgtaactccgcaatgttcataccctgaatgcggaaaccattctgagaatactgcattccaagtttggtgaatagacgataccatttctttatgaggaactttcggcgttgtaaatactgcatatgttgctgcagggaaagtacgctttgcaatttcatttggtacattttcaaagtctgtaacttccattccaataatataagtgaagtcccctgtttctaaattaaaatcagtacataatccaagctctacccattggctcgtatctttacgattcggaatcgttgttccaagatctttttgtaaatattcttgccaaaatgctgggatgtcttgatggttcttcccctctttacttgtcgtcttcagttcataacctgccattaaaaattctggtttatttacaatacgatattccatttgtatgcctcctaaatacggatttaattttctttgctttacattcactctgtaatacatcggtgtttcgatttcttgttttcgatattcactcggtgtcatttgaaataattttttaaaggctctcgtgaacgtttcgtgagattgaaagccatgctcaaatgcgatatcaataactttttcatccgtatgagaaagttgataagctgcccgggctaacctcctctttcgaacatactccattactgtatcacctactaacgcctgaaatacacgatgaaaatgcgactcagaaaaacctgcaacccgcgctaaattacgcagcgtttgtttttccattacatcttcctcaatataatcaattgacctttgaatttgtgtttcatagctttccatctctgttcacccgccttatatgtattatgataaaagagaatcctatccaattcttgacgttttttactataattccataaaaaattgtaacttttttatatgtatttcgttgttatgtatgaagggagggaaatgtagtgaaacgcaaacaatcattagaagacatttactccgagcatatgcaagatttatttcgctatcttctctccctaaccggagattcccactatgcagaagatctcatgcaagaaaccttttaccgaatgctcgtccatattgactattataaaggagaagaaattaggccgtggttatttacaattgcctacaatgcctttatcgattggtatcgtaaagaaaagaaatataaaacaacagaagttgcagaattccatttaccaaacgttccaagtacagaacatgaatatttcgtaaaacatgagattgctagttggttagacagtttatcttctcttccgctcgaaagacgaaatgccctgctactacgagattactatggattctcctataaggaaatagcagaaatgactggtctctcattagcgaaagtgaaaattgaattacacaggggacgaaaagaaataaaaaccataaaggagtgatacagatgggctgtgcagaatttaaaaaactatggaagaagtatgaaaatggaacgctcacgcatgatgaacaagaactgttagaaagtcatattgagtcatgtgaagcttgtgaagcttacttagatgagctgttaacaaaaacagaaccaattaagaaaaagttacctccaaaagatcttaaaattcctttttggagaattaagtggaaacatcgtttacaaacgtttggttttatattatcaatttgcatcgttatctatataatcggcggggtattatcagccttttattttcaagctaataatgataaaaggctaaaagaaattagagaggttccttctctggcacttgaagcaactattccaaatagccgcgttatgggaggcggaacaagtgtagaagcttttttccgtacgaatagccaatttgatttagtaagaaccatcggtaaaaaagaaatgcccctcggtacaatagaaacaaaaagcttcttatcatctgtagatatcacgaagcaaacttggatgaatccgttctatcaaccaaaactcttctttgttcatcccaaaacagagcagggtgattatttaaaggattcatcaaaaaaagtatgggatacacttgcaaaagtacatgatggaaccgttgcagaagtagcaatttcttttgataaagcttacactttaaaagaattagaaccgcttttatatagcatattcgaggcacaaaaactccctccaactcctgtatggtacgctttagatacaggacaagaaagaaaaaatgtagatgactatatcctacatggcggagaagctataggatttccagaatatgtaagattcctcgataatgaaactgacgggcagaaaacgcaagaagacaaagtaaccgaaatgatgcgcgtcctttctatccataaaaaaacagtaagcaaaatagcagcgctttctgagaaagaactaaacttagataaacgttatcaatatgtaaaggataacggtgtaaaagtatacggaattgttattactggcccatcgaaagagttattaaaattacaaaactccccgcacgtacgttatgcgactcttggagatattgagatttggaattggtttgattattaataaaaaagaagtagcgctctaaaaacgatgcactacttcttttttaattcgaaatcactttcacatacatccctctcaccgctttttcataagcaatatcactcatctgtcttatgttttctgacacaacagacgactgaacgattttcccttcacgaagtaacggcggatcaataagacgcactttatttttctgatgtaaatcataatcgtttctatcttcttttacctttacatttcgatgaactttgcttaataaagcttctacttcggggtcattacattgctgcaatttcgaaataagctcctcatcttcaagaagaaaatcatctgcatgaataatccttttatgaagagctacctttaacgttttcgctaacatatcatttccgtaaatattcattggttccataaagaaatcgattacttccttgtaatacgtttctgtaaaccattctgccatttcgacactttgaacaaccattttcccatctacagcgatgacatcttctaaaaaactgtgaacttcttctaaagaaacatacccatatgtatacatatctcgtaatgtataatccactctgtctgcgcataattctggtgctgacctttcgagtaacgtccatttcgaatcatctaacaaaatatcttcatagttataaccatacttcgcaagaatcgctggaatttctgagtttttcacaacagaactaaatatctcttcatgataactttcatcttcattatgaaaaacgtaatcaatcacgtgggaaaaagcagtatgcgatacgtcatgcagtaaactagcgatctgttcttctactgaaccacctagttttttcactaacaacataacaccaactgaatgatcaaagcgcgttacattccatttctcgttcattaagtaacttgcgcctgcttgatgaattccctttagtctttgcatagatttacttgaaattaattcttctactacttgatccacttcaaattctccgtatagtacatctaatatgatcacttacaatccccctttattttgatcgagtcttataatcttatctcttttatgaaattagcaccaacataaatatttattgttatttgtttttattaaaaaaaatagagagccatcagctctctatttcataacccctattcaaatgtaacttctacctgcacaatctccgacctactaccaagtctaagcggtggtccccaaaacccaaatccagaagaaacaattgcgtggaacgcgcctttttgtgcgtatccccagtctagctcgtacattcttctcgttacaatatgattgggcgccatttgtccgcggtgcgtatgaccggataataataaatctacacctgccgctgctgcttgtttcaactcaaatggctggtgatccattgcgataacaggcatcgatttatctaccgtactcattaattgttcaaagctttgacgatctcgctctgttttatctcttcttccaacgagataaaagtcatcttcaattgtaattacttcatctaaaagaatacgaatatcaatcttatccatctcttgtaaaaactctggaaccgctctaccgtagtattcatggttccctaaaacaccatatacgcctaatggtgctttcatttgtttcatgattggtcccatattcttttgaatgaacacacctggatgatcatcgataatatcacctggcagtaaaataatatcaggttccatctcatttacatgacgaacaagtctttttaaatgcgaaacgccagacagtttaccgaaatgcatatcagaagccatcgcaatgcgtaaacttttacgcccctctacctttttcggtatgtgcacctcgtactttcttactaccggactatacgcattaaatactccatacgcaaagataaagataaatgcagctatcacagccgcccctgtccaaataattgccgcttctttctctactgaaaactgtaaaagaaagaccataatattagctaatggcaacaacataagcgcatattgtataactgcaaaccaaatcgaacctatcgttcgcagaaatggcaaaaacttaaacacttgcacgagaatgtacgcatatgaaataaatgcaactatgaaagcataatatccccaagattcccagccaaataccgcatgaagccaaacccatccgttccagccaatgtaaaacataagtagtgtgtatataattaacatggtaaatatattgagataacgaagattcttcacagccagcctccttattgatttcttttattataacttgttatgcacttataacgtaaatattaagcacttcgctcatcatagtaaaaacctatagttgttagacttgtatctaacaactataggcaccatttatatcaacattgtttttacaaatgctctttataaaaacttgttaatttttcaactgcaatttttactggttctggttggtcgtataaatcgtaatgactcgcaccttccacaacaagtaaatcttttttctctgaagctgctttctcataaagctcatgaccatctttataagaaccaaatgcaccttgcttactgccgacaataatttgcagcggctgcgttaataacgtatctgctaaatggaacgcatcaaaaccaattaccgatcccatgctcgtaaagtttagcttatttggagagttaacactttgccctcgtggcgttgtgtaatactcaactgcttctacaatatctatatcggtcatacccgctgctactaactcttcctgatttttaggaatccaatttgtaatcagttcctctgctccgcgtgcttcagcagtacgttgtttaccaatcgcctctaacaccccaattggatcagcttcacgatttaatcggccaatatttgcaccaacaactgtgccaactgctttaatgcggcgctctgtcattgcggcatttaccgcataaccaccgcccgcacaaacgcctaacacaccgatacgttcttcatctatataagaaagagtagtcaaataatctaccgctgagcgaatatcttcaacgcgcgcagctggttcttccatatatctcggtgcaccttcactttcaccttgatacgatgcatcaaacgcaagcgttacatagccttgttctgctaacttctctgcatataatcctgccgtttgatctttacagctactacctggatgcacacaaacaatcgctgcattttgtttctttccctcagcacctacaggaatatttaaaatacctgcaacttgtaatcctcttgcataaaaacggacatttcttttcgtaactgccatatataaaaccacccttacttcatttttaatttacacttgtgagagttaatactcacgtgtatatttataataaagcgagcaaccacttgtttcaatgaccacatttacgcatttgggtgataatacacacgtaacgaaatatgtgtatcaataacggaggaacacgatatggagaaaatcgatagaagaattataaaatcacaaaacgccattcaatcggcatttatagaaatgttaattacagatggatttgatgaaattacagttaaaaacattaccgaaaaagcaaacatcggaagaaaaacgttttacttacactatctagataagtacaatttattagataaaattgtggacgatcatttagaccaattaaaagaaatatgctacgagaagcaaaacaaagaatttatagaaggaacaatcatatggtttgaatacttcaaagaacacaaaccattttttgcggcactatttagaagtaacagcaccttatcatttcaaaaaaaattactaactttcatcatgggtgaaatagagaaaaaattaaatacagacacatcagtaaataaaaacatcgataaacatatcgtcttaaaatttttaggaacagctgtaatgggcattttagagtcttacgtgttggatgaaattgatagtgatgttgcgtttgttgcgacgcaagttggagaattgattaggaggaatatataaaatgaaactttaatcagtggggatttattcatcccctacctaacttctttgctttcgctgcattttgaggtgggggtcttactgcccagcaaatagcgggataaaataaaaccgcatcaatttccttaataaggattgataaaatgctattatcgttatccttcaaaactcatctatgcaattatgcataaccatccattccgttttattttcatgttacgatataaatgtaatacgacatatatcgacaaagataaaaggaagtgattgtatgaaacgttctaaaacatacttaaaatatttagcattatccgctgtttttgctagtagtgctataactctttcaacacctgctgcttacgctcaaacaacatcacaagttgtaacagatatcgggcaaaatgcaaaaacacatacgagctataatacatttaataatgatcaagctgataatatgacaatgtctttaaaggtaacttttatcgatgaccctagcgctgataaacagattgccgttattaatacaactggtagttttctaaaagcaaatcctactataagtgatgcacctattgataactacccaatccctggcgctagtgcaacattacgttatccttcacaatatgatgttgcatttaaccttcaagataacagcgctcgtttctttaacgtagcgcctacaaatgctgtagaagaaacgactgtaacatctagcgtatcttatcaacttggtggctctgttaaagcttctgtaacgcctaatggccctagcggtgaagctggtgcaactggtcaagtcacttggtctgactctgtaagctataaacaaactagttataaaacaaatttaattgaccaaacaaacaaaaacgtaaagtggaacgtattctttaacggatataacaatcaaaactggggtatttatacacgtgactcctatcattctttatatggaaaccaacttttcatgtactctcgcacatacctatatgaatctgatgcaaaaggtaatttaataccgatggatcaacttccagcgctaacaaatagtggtttctctcctggtatgattgctgttgttatctctgaaaaaaatacagatcaatctaacttacaggtcgcttatacaaaacacgccgacgactaccaacttcgtccaggctacacattcggaactgcaaactgggttggaaacaacgtaaaagacgttgatcaaaaaacatttaataaattgttcacactagattggaagaataagaaattagtagagaaaaaataaagtgaaaaaacgaagggactatttagactcttcgttttttacttactcataataagatcctgcgagtaataccgtcgctatgaaattccatgatatatttttaggcatctcttcacctttattttgaaaagcaccatcacaatcatttagccatgcttccattgattctaaataatcttctaatgttatattctcccactcatctttattttctttgaaatctttttgaaaataaaacaggaattctactaatttttcttttgaatctacaccattagccaactcataaatatccatattattactcctttcaaatacaagtaaaatcctcgatctcttcaacacaaaaacattcttttttataaaatgctatatttctcttccaaccaatcttctataacatattgtcctgctatccctgaaggatttttaattttcttcccttcttcttcactaaccatttcaaaatcgattaaaggaccatctgctctccctcggcttacaaaataagtcccctgatccttattctcaaacacaaaatctggaagattatactcccccggatcaaacaattccattggtaatccaccaataattttccaatcaccatctaaccaaccagaccaggcagtatacgccgtaaataatacttctttttgattcttgtaatagtttttaaactcgcttatccgtattttttcatctgtaaataaagaaaaatattctatatatgtttccccatcatatggccgcgtaacattttggcctttcactaacatgccgtacccatacttattaatatttttaagatttatcgcaaaaactatccctggcttaaatgattttttgcgacgcttttttaatttaaacttacaatctactacttcttgttcctctaaagaaaaactatcactctgcatttctaatgcattttttaacattatctctaactcatttatatttggtaatctgtgaggcccttcattatatatcttttcaatctcttgaaaagcatccattaaaatatcaatgctttcatcacttataatcaatttatccccttttatttcctctttataaaaagacatattttctctcctttactctcttatacatatcccttgaagactctctttttctttctatcacactaaaacacgcaccacttcttctaataataaacccaaccattcatccaatttgtttcaaaacactctaatacattcagccttctttccatagtactatttcaagatcatactcattctttagaaaagtaaagccacttctcatagatgcatctactacaataaggctagaataaattaatgatctttgagcatcatcatatccaatgaaatgtaatacttcttttatatataacatgaaatcttccaactctatttgcacaccaaagtcccaattttcatgtgcataccatagaataatcttcttagacaataaactagttaattcacgttcaaattcttttatttcattgataacttgttcagcatttaatttactcataactttaataggattcggtgtttcatcaattaaaaagtttactaatgaagcaattttcttcccgctaataatctcaaattcttttatagacggacataacattaaaaacttttctctagtagccttttcctcgaccttttctcttaacattgctattttctttaaacgttcattcacatttatcacctcatacattcagtaaattaacataataaagcgtatcatccgtttgaaaatacataaccgatccacagctataataattaacaaattgaatcggctctccaaaatgttcatagtactttttctgaatgtcacttaatttattttttcgaaaaaaattcatttatgctctacaaccctctttctactatacaaccttgttattaaagatagatttcttctttccaactactggatttagattgaactactattagattttcactttcccattttaaggtacccaaaaatcttgcatacaccatttcatttcctacttcttccaccaatagttgatctcgaatctttaatcccttttcatcatacacttcacatcgtagttggaaacctttaacacgatgaattccttttaatatcgctatcctcttacggcttgggcttttcttaggtgtcttcccaactaaaaatattccttcatagttttgcttcacaatttcatctaaagattcctctatataccctttaacaacagatgatgaaagagtagagttttcttcaagtccagggacaacatattggcgtactaatttgcaaaactctttgtatttctcttcaactgaatttaatgctaaaaagtccataaaatcatatggaacatatatacgaatttcacccaaagctctattcacttcatatgaaatatcagtgttttcgttagctaaacaaaagacagttactttttcaatctctcttaatcccatctcaaactcgctaactttctttgagaaaattagctcaaaaattctaatttcatgtacaagcaaataatgttttttaggacgtttttttttccaatcgtaaaactttacttcaagcaatataattcactcctttaaatttatcaccatgcatcggggacctatgataccttttattaatttattaaactgtactcctttttcattctatcttatctatatttttaatatgctctactcacaacgcacacggtgacataacagccataaatacatcacttctctcacctggtgctatatacactccttctgcatctaaatattcaatggaaaaggctgctagctcatacgccatttcttgatcgcattcaaaaagtggatttataaaaacctcacttcctgtaatcttttgtaaatctttcaaacagttagacttacttcttgcataatcagccacattctcattagcccaagaccacatccaactgttactcttttcagaccaagaacctataaaaacaacactaaattcaagtaatacttgaccattttttttaaactgtaatatacattgatcttgatcataccaatactcatcaaagttatagatattataatctgaaatgaatttttgctgtttactttctaatttgtcataacacataacaagataattttcgaattgttcatccgtcattgccaattatcacacgctcccttccttcaagatctccgctacaaacaatatatcttactctctcaaaacctatataaagtgaaactttaattagcccttaccaattgggcttttaccagtagcccccgcccacatatcatatacgtttctattactaagatatcttaatatatacaaagaaagaagaacttatataagcccttctttccgtaaatagtttctttacttcgtctaatttattttatcacgataaataaattcaacattacacaaatgcaccccaaccatctgtatatccaccaaactcttcacccagtttattcaattccttttgcatctctacaatatcctcataaattaagaacatttctttagaacaagtacacgtccaatcttcaaattcttcattataatctaattcacaatttaagcccagctcttgtagtctgccaattattttttctccattaccttgatcaggaattgcaataaagaaatctactatatgttttttattaaaatctataccttgcttgtataacatatttaatacttgtccatcttcatcttttgggaatttcattatttctccccttttctatagcatataataaaccttcatttggaacaaaaaatattccattacttaaagtcctctttacccgttatttttaagttttttccattctgtatacctaatatcaatcactttttttaatttaaagtgattttcccaagtatcttgcacttgatataatgtatcacactctaaaaatacatcatcataatcatctaaatat

SEQ ID NO: 1365 - DNA, 13305 bp, Bacillus thuringiensis
gaacaatcatgattcaaactaaggatattatcgaacttacagacacatacggagcaaataactatcacccacttccaatcgttatttctaaagcagaaggtgtttgggtagaagatcctgaaggaaaccgctatatggacttattaagtgcatattctgcagtaaaccaaggtcatcgtcacccgaaaattattaacgctttaattgaccaagctaatcgtgttacgttaacttctcgtgctttccatagcgatcaattaggtccttggtacgaaaaagttgcgaaactaactaataaagaaatggtacttccaatgaatacaggtgctgaagctgttgaaactgcaattaaaacagttcgtcgctgggcttacgatgtgaagaaagtagaagcaaaccgcgctgaaatcatcgtttgtgaagataacttccacggacgtacaatgggttctgtttctatgtcttcaaacgaagagtacaagcgtggattcggtccaatgcttcctggcatcgttgtaattccttacggtgatttagaagcattaaaagccgcaattacaccaaacacagcagcattcattttagagccaattcaaggtgaagcaggaattaacatcccaccagctggttacttaaaagaagcttttgaagtatgtaaaaaagaaaacgttttatttgtagcagatgaaatccaaactggcttaggccgtactggtaaagtatttgcttgtgactgggacaatgtaactcctgacatgtacatacttggtaaagcacttggcggcggcgtattcccaatctcttgcgtagcagcaaaccgcgacattttaggcgtattcgagccaggttctcacggttctacattcggtggtaacccacttgcatgtgctgtttctatcgcagctcttgaagtgttagaagaagaaaaattaacagagcgttctcttcaattaggtgaaaaattagttgggcaattaaaagagattgataacccaatgatcactgaagttcgcggtaaaggtttattcatcggtatcgaattaaacgaaccagctcgtccttactgtgaacaactaaaagcagctggtctactatgtaaagaaacacatgaaaacgtaattcgtatcgcaccacctctagtaatctctgaagaagatttagagtgggcattccaaaaaattaaagctgtattatcgtaatgatagagaggttgtccgacatgttgggacaacctctttctttttatattcatttacattaagataattttgtaattttctgtattttaaaatcgtaaaggaggtgcgatatgctattaagatatggtaaacatattaactatttagctacatcttttattttagttacattctttggcttcctactttccacaacatggcttactcactactcaactcctactacattcacactactgaaagcatcattttggactgctgttattcttactatcattggttttggacgagaaaaaagcgcacttacggttatactatttggcatttgtacacttgcattcattggtctttacactttttccgttattgattacctctataacccaaggccataaaaaagagctatcttttaacaagatagctcttttcttcacttcactacatttcgcaaagtaccaattccttctactgtaataaccacttcatcaccagcatgtaaaaacttcggtggtgtgaaaccttttccgacaccagccggggttcctgttgcgataatatcgcctggttctaaagtcattcctttacttatcgttgaaataatttcttctattgaaaaaatcattttatttgtgttggaagtttgccttacttctccatttactaccgtttcaatgtgtaatgcattcggcgcattaaccaccgatttatgaattaaatacggtcccatcggacaaaatgtatcgaagcttttcccaaggaaaaactgtttatgttttctttgaatgtctcgagctgttacatcatttataatcgtataaccaaaaacatgctcaagcgctttttctttttttatttgcttccctcgcttaccaataatgatagctaattctccttcgtaatctagttcgtccgttgcatgagggtgaccattaatttgctcatttatgccaataactgttgttggtgctttcgtaaaaatcattatattttctggaatagactctattccgcccatttctatggcatgctcacgatagttttttccaacgcacaaaatattctttcttggccttggaatcggtgctaatattttcacctctgttaacggataatacgccgcttccccgttctcttttgcccaatttacaatttcacatactttctcaaagcattcagttcctctttcaatacactctaacattgtaatagggattgtaaccttttcccctttttgtctttgcgcttctcttaagtgtaatacctttttttcttcttcatccacaatacctacaaataccttttcttctttcttcgccgttacaaaacgcaatatttccactctccatcctaaaactcatgccctttaattgtattcgcatccgtaagaaaaaaaccttctcatacacgctaatttttacaatattcttctcataccctattcgttacgcctttatatttggcataaaatgtagaaattttactttttttagcgaaggtatttcttttttatggagtttttgtataatatgtactacatatatactaaaaatttcatttagagatggagccgatttcaatgtttgagcaagcgattgaaaaaaaacgtgaaaaaatgatttattttgctgaacgctatggaatgacttctcaaaaaacagtggattgtagccaagaactggacaggctcttaaatgtaatttggcatgtacatacggattttcacccaaatcaaacactcgacacacacacgcaatagcgtgtgtgtgtcttttatttcaaaaaaacacacattttattgaaaacgcccatacaatagtagaaaagaaaattttaaaaacgaagggtgttttatatgccagctatggtcggacatattcgtatcgtcaatattggatcaagtggtatttttcatattggagatgtatttgcgattaggcctattagttactcacgtgctttcgccggggccggctctttcaacgttggagacaatgtttctgtctacaattatcaaagtgcaacgactgtcaacgattcagatgtaatcgatcaagcgataattggctcaacttaaaggaggcaattgcattgaatttttatgtaaaccaaagtatcatcatcaacagtattaaaattgatagcattacaacctcttctgtgttccaaattggtactgccggaagtattaaagccctatctaaattttcaaatacgggcggatttacggagccgcttcgcccattacaggcgaaaggacaaattatttctatcaaaccatcaactagttcttcttaagacatccttgtcataaatatatagcaggaatatttttaccctccctattgaaaaggaggtttcacaaatgaatcaagatatatatacttacttacaccaacttcaacaagctcttcaaacacaacaagcagccatcctgaatttagaagatcaagtgcgccaactccaagaagagcttaacgaattaaaaaatcgcccctcctcttctgtaggaaaagtggaatacaaattcgatcaattaaaagtcgaaaatttaaatggtactttaaatattggtttaaacccattttcagcaaaaggacaacaaattgaagattttcaagtggatacagaaacattgaaggtaaaccctgaaactgaaacaaacccagacttttatcaaggtatcctccaagaaatgcatcgatacttagatgaagaagcatataatcgtattctccattttgaacaagaagagcgaacaccgcttgatgaaatgtatcgacaaatgatggtggatgacataaaaaaacagatggagcatcgactcccttattatttatcacaagtgcaatcatatgaaggtatttcaacagatccagattatttacgagatatcattattcaggcaatgaaacaagatattgacaaagcctttctctcctttattcagcacataccgggaaatttccgaaaggagtaagtatgtatgaaccttaacgttgtaaaccgtgagttaaaagtcggacagattaaaatgaacggtgtatcgtcgtccgcactctttttaattggagatgcaaatctcctcattctatcttctattctcgatacaccatttgaaacagttacagagggtccatttgtaccattagtaacagatgtccctcctactccaggttaaggagactgagaaattatgttgcatcatgtgtctattgtccaaaatgtttctattatttctttagggattgctgctgtatttcaagttggagatgcaaaccaaatggaattaaaaagtagagctattgccgtccaccgtgaaattcctttttatatacggggagaaggtcgctttgatgcttttgaaatctttacagatgaacacattacaattccaaaacgaacgacagatgtaaaattaaacattgtaaatgaatgcccttttattgaagttaataacgttgaattacgcacacttttaaattctggttgctttcaaattggaaatgttgattatggttttaataactctcgtattatacaaatccgccaatatattacggatgaaccttccgcacaataattcatatagtaattaaaaagcttagtaaagtaggtggatggtatgccttcggttgtaggaaatctcgtcgtgcaaaacagtaacggctctttcaacttaggagatttttataacgtatctccgaaagaaaacacgaaagcctataacggatctggagcttccaatgttgggtttgtcgtgaatacgtttaacggtgttagtgcaacgaatacatttgattctgatgtggcagatcaagatcagattggaacagcgtaaaaaaagtaggagatattctcctacttttttcttttatctaattcaaaattattaaaataaaattttaataagcaagagctttactgtccacaaatagtggtataaacaagtaagtagtgaagaggcactatttcattttatttaaatgataacccgctctcctccaaagccctcctaagcttcggcaaagacgcaggtcccataccatgcagttttaatatttctttttcactatattttgagagttcttctacagtttgaattccatggtgttctaatgcccttcttgctggcgctgaaagaagagagagaaaaccttcttttggttttctctctttctcacagactgggcaagttggacaatcgctacttttatagtactcgtgtccctgttcacaagttcttaacgttttttccgttaccattttcaagcccctctattcttcaatatttacaacgtgattcccatcaaagaagtataaacatttctcttttacaggatgttgtaagcttttctccagtgcttttgcatataacgaaagctgcactttatatcgatcttctaaaattggtttcgcttgttcaaatccgcctggaaatttcccttcaatcgtatctgttttgaagtcgattaacgtaatgccatcttcctcttcaatcatgcagtcgataaccccttggacaagaatcgattccccgctattcccttgccaatcttgatatgcttcttctgctgcaagcatcatcgtaaatggaacttcacgctcaacacttttcgccgctaatacccttttacctaagtcactgtcaaagaatgaaattactttttcaatcgctatttcttccgcctgctcgaatgttaataattccttatttaccattccagcaatttgctcttgaagaacttcaaccgtaatcggcttcttcaaatcaacatgctgcataacggcatggactgctgttccgcgctctgcgtacgttaacccttttttctccataaagcgcggacgtgttttaattggtgcacgtagttttttaataaaggcgttatcactaccatcttctgattgataatttctctttatttctgtaacagattgcttcgcacggtgagatgttgcttcctcatatccgtacttccacattaatctgtcgtacacttcatcttttcgttcactttctaacggcacagcctttttctcacgaagcgcttctaacaattcttgtttctcttcttgaactggctctggtgcaagtagcgtattaccgtccacaacttctactttccagctagtgtcatacccgtaaatttcatctggaatacttccttgtcctaattcaagaagcatttcactatcacggtgtctatataatgaaggggcaatccagtctaaataacaagacgccccggcacgtatgtgatctggtaataaccattcactatgttccctcgcatcaagccatttttccatttccttatttgcatccttaactgttccgattaaaattaacttctctttcgcgcgcgtcaacgctacgtatagtacgcgcatttcttccgcaattaattccattttcattttacgcttaatcgcaagctgtgataatgttgtatatttaattcgtttacgcggatcgataaattgcgaaccgaaaccgaaatctttatgcaataagaaacgtttcattaagtcttgtgtattaaaacgacgaccgagcccagctacaaatacaaccgggaactctaaccctttacttttatgaatcgtcataatgcgaacaacgtcttcttgttcaccgagggccctcgccgtacccatgtcatcaccgcgttctaaaatacgttcaataaaacgtaagaagcggaataatcctctaaatgatgttgcttcgtattgtcttgcgcggtcatatagtacgcgtaagtttgcctgcctttgctttccagctggtaaaccgccaacgaagtcgtaataacctgtctcaccgtacactttccaaattaaatcagaaagtgattgttgacgtgcaaattcacgccatccttgcagtaagttataaaaccactctaatttatcatgaagttcttgctcctcttcaagtggtgccccttttaagaatgagctcattacttcataaaacgagcctttctttccatgagcacgaagcgttgcaagttcttcatcgctcaatccaacgattggagaacgaagtacagctgcaagcggaatatcttgcatcggattatcaataacgcggaatacgttcatcataatatttacttccgtcgcttcaaagtaaccagtcgcaaggtcagcgtacactggaattccttgtaattttaactcttccataatttgcggggcccacggcatggagcgaagtaaaataacgaagtcgcggtattgtactgggcgcatactatcatttttacggtcatacacttcataacctgaatcaaccatcgctttaatgcgctgcgccataagacgagcttcaagctgtgctttttcgacttctgcaccttcttctccgtctattacttcttcttccgtttgctgaatgcacagtagttctgccgctacatcttcaccttctggataggtagcacctaactttaattcagcgtctgcatcgtagtcgatttctccgacttcttcacccataatttgtttgaagataaagttcgtacctgctaacacttcatgacgactacggaagtttttcgctaagtcgatcttcattccaccgcccaatccttcttgtgtgaagcgtttatattttcctaggaatagtcctggttcggctagtcggaaacgataaatcgactgctttacgtcaccaaccatgaacaagtttccttcactctcagaatctttcgttacgaatttaataatagattcctgtacaaagttcgtatcttgatattcatcgactaatacttcagcaaatttattacgatattggagcgccactgctgacggattcatttcaccattttcactttgttcacttaaaatttgtaaacagaaatgctctaaatctgtgaaatcgaccattcctttatctcgcttcatcgcttggaaacgctctgtaaatacttttacaagttgaacaagcttttctaatactgggtgcatatcttgaaaatctcgtaagaaactttcaggttttcggctaaataactcttcttgtaatttcttcacttcatctttcgctttattacgaagagagtctacttgttttacaacatcttcattgtaatcacttttcttaatacgctttaacgtttgccacgatacgttttgcatcgcttcatacaaacttgtccacgactcctgagcagctgatgatagcgttccaagtaaagctacatctgcttgcagggtttcaatgcgaggcgctggaccgtcaggaagcattgcgagttcagttgccttacgaatatgctgttccgctgtttcaagctggaatttcacatcttctaataaataagaagcatatactaaatcttcaattgtctttccttctacgtcatatgcttctactaatttatcaagccatttttccggatttggatgcgctcttgactctgtatgaagcgctaaaatcatacgttgtaagtcatcatcactacggtcactcgtataacgatcaacaagttcaaagaagattgtattatcttcgattccgtactcttcttctaatatgtcatctagcacttcttcttttaacaattcattttctgtttgattcgcaatacggaaacgaggatcaacatcaagcatgtagtaatatcctctaattacttgtaaacagaatgagtgaattgttgaaatggaagctttatttaataggctcagctgctttcttacgtgttgagagcctggttcatcaattaataccttttctaacgcttccccgattcggtttttcatctcttgcgccgctgcattcgtaaatgttacaacgagcaggcggtcgacatcgactggattctcttcattaataatctttttaataatacgttcaactaatactgctgttttccctgacccagctgcagccgcaactaaaatatcacgtccattcgctacaacagctttccactggtcatctgtccattgactaccttctggtttttcaggccaattttctatcattctccgccaacctcctctcttattttctccatcgcttcgctatctttcatatcttttaacgatcggaactgattatcttcaagtgactcatcaaattgacaaacagatttgaagttacagaacgtacatgctgctttatttcccattttataaggagcaatatcgataacaccttctgtaatatcttttccgatattttcaaacgtatggtgtacatatttttgcagtacgttaaactcttgctcacttgcaatacttgaacgcgcactaaagctaccgtcttttttcaggccagcagaaataatatctgaacttcctgttgaaagtttgttatccattaaacgaacaacgtcagcatctcctaatacgagtcctttcattttaaatttctttaaaatttctttttcaatttcagcttcagatgcgtcacctttcatctcaacgattgggttatgaatatggaaatacaatacaccagctggtgatgctgcgtgaccttttttcatccacgtctgcgcattcgaagtaacaacatctaaatacgttaacatttgaagtgctaatccgtaatacacttccgttaaatctaacgcttttgaacttgatttataatcaataatacgtaagaacgtcccgttttcatcttctgccttatcaacacggtcaatacggccgacaacttccatcttcacaccatttggtaatgagaattccatcggcggaagtgatcctgtaccacccataccgaacggcacttctaaatcaactggtacgaatccgcttgacttcgcatgttcacgaagaatgattgacgtacggaaaatgatttgttgtagtttttgttttaaatagaaatgacggtttgaacttaataaaatttgtcgttgtaataacggtgcgatttcttctattactaaaacagaaagatgctcacactcttttatggataaatccgcccaagtacggttttcacgcaatagcttgtccgcaattttctttaatgccgcatggaataattcgccgatgtccggcgcatcaagcttgaaaatatcacgctctctaagcgataaaccgtgctgcgcaaaatgagcgtatgcacaacggttaaatagttccatacgagagacgcttcctttaattatatctccgtataaatctctacttactgctgtacttagtttcttcgcacgatttcgatagaataaacttgataagacgcggctacttttttgtttccattcatctgaagttacgtagaaattatatacgtcccaccaaaagtctaaattcccttcaaatccgtatcgcttccacgtttgtagttgctgcataacgtaagataacgttacttctggcgttgctacgtatgaaatttgttctgaacgtgataaatcgtttacgtcattggtaataaatgaatctttcacattagggaacattctttttattttcttaataaagctagacgcaagtaacgtctttccttcttcatctgcaagcgggcatgaaatatataacttctcagatgctctcgttaccatttgatacataacgaactgttcttctaacaaagtttgtctcgtcgttggcgctaattcaatccctgctgcaccaagaacttctctttcttcatcagaaagcataccttcgtccataggtgctgctggaataacaccctcatttacacctataataaacgttgctttcacgtcagataacctggagtgatcaatattagcaattaacacttggtctaatgacggcggaatgttagcaaattgaagtgcctcaagacctgtcgacataacgtccgtaaacatagaaagagacattttctcttcaccaagcatctctacaaacgtatcaagaaggctcattacttcttcccatacttgttcatgatctgtcgcaaataagaaatctccactttcttctgcacgtatacgtaattcttctagttttttcggaacatccagctcttctagaaataagtaaactgcttcacacatttgcataactgttcctgcacgctttaaccttttttgcatgcgaataacaggtgttcttacaacgtcacgcaatcgatttattttctcttccatttcacgttcactatctgtgatcatcccgttcgtatcatcaagagaacgataacggcgatacatccatggatcctctgaagtccacctctttccttgtacaccgtacgctaaacagtaattttcaaattcatccatttcttcacgcatcgtttcttttcttacgtctaatggatataaaagctctgttttcacgcagcggaacaccgcatcataacgccaattcccactaataatctcgagtgcagaacgaatacattctactaatgggtggtgtgacatcgggcgcttttcatcgatgaagtgtgggatattataatctgtaaataacgttcgcatcacatcgtaataactttccccattacgaagaagaaccgcaatatctcggtaacgatagttttcctccgccacaagtttacgaatttcacgcgcaacaccttctacctctgctcgtaaattcgcagctgtactaatcgttacactcgcttcaccgttaaatttttcattcggacgcgcttcataatgagcttctaaatgcgctaatgccggagaatgaaaacgcggctgttccataagtggaattgttttttcaatttctattttctcttcacgcgctacttgtttgattttttcatacgttaacgtcgtttcataaaataaatcgagttcatttactggctgtgctaacgttttttcatctatcgttaacgtgatcgtaactctcgctccgcaaatcataagctgtcttacaatctctaactcttgcggggaaaatgaatgaaatccatctatataaatttccgcaccatttacatattcagactgcggaagcttttccactagcaattgtaggtagtcttctgaatctaaatattttccaattaaagcacgttcaaaatcatcgtataatagctgtaaatcatacactttattcgctagtaacttttgttcggcactgctactatgcgcatccaattgttgccacatttcatatacgttagatggcgttacattgtaacgtttaaactctgcaatcatactgccaagatgttcaaagaaaccgttttgctccgctgctttttggaacaccgataatccatctttacgagactctacaattttacggagtaacatatgtacacccgcttcatcaatatgaagacgactcgctccgccaacttcttgtagtaccttccacgctaatcgtgaaaaactaaaaacttgtgcccgaatagaacctcttacatcctcacttccaattaacgcctgctgcgtctggaatgtcatctgttctggcacaagatataatattgttttccctctcgggcgttgttttaactcttcttgcacttcgcgtaaacaaagtgtactttttccacttcccgctctaccaatcacaaatcgaagtgacatgtaaccccacctttcacttacataacgaacgttagtttgctactataattgtattatagtacacgaaaaaagacaaactgagttgtttgtcttttctatacttctacttcattatatcaaccttttgaaaaattcgtttgcacctcttgaattggccaatatcgcaaatcaactttaccgacaactgtatcagcttttacaaagccaaagtgtctactatcccagctcccgagccggttatcacctactacaaaaataaacccgggtggcaccagcttttctttcgttaactcttctaatgtaaagtcgcctgttagttgccttccatttatctctttcttatacttctctaaatacggctcatcaataaattgaccgtttatatataacttatcctgcttatattcaatatgatctccaggtaaaccgataacccgctttacatagtcctcttttttattcgcatgaaataccacaacgtcaaatctgttcaagtccccaacttgataactcaccttatttacaactagcatattgccatcttgcaatgtcggcttaaatgacaccccctcctcaacatgcgttgtggagaa

SEQ ID NO: 1366 - DNA, 18080 bp, Bacillus thuringiensis
ttcttctcataataatagcaataaaatccatctaaatcaataaaaatatccccgtaataccttatgcatcttagctaaaagcatataaaatccattccacccctaaattttccaatcataaattctccccaactcacaaattataatctttgaattgatattccaaagggggcttcattcaatgactgtaattacaaaattaaagcagactgtttctggattaaaaagtgcacaagctagcttagagggattcgctcttgatacggataaccaacaagctaagcaacttttccaaacagctgcgcagcaaacacaaacgattatcgattctttaaacccacgtgttgaagaagtccaacaagaagaaccacaatactcacagcaataacgaatcagtcttgctgtgaaatagaaaaaggatgatatgcagtcatcctttttctatcacattacatattgcaatagaaatggaatgatgattatgcgaaagattggacttataaccgcgttatttatacttctatttagttcttttaccggttgtgatcatagcccattagataaaaaggtaaagaaagaagaaacaaaacgaacagaaaaagaaaagggtccaaaattaacaaagatgagtacagaatcctttaatcaatctatatcgcaaggagctaagaaaaaggccctcgctatggatgaaattataaaaagcgcagcagtgaattcaaatttagatctctacatagcggttatacctgagcatcatgaaaggtttggattaaaacctttgcgcaagaaacttcaaaagcaactaagtgatgaatatcctactttcgatgttcgtgttagtacagataaaaaaatctttatgttactcgaaaagcttgcaaacaaaattaagaaaaaagaagtatctaaagatgagatcaaaaaacagttaaagctaatcggatcagaaatggaatctaacacttaacgctttcgaatagaaaaggaaggattgcaatgtcaagtaaagataaaaacttaacccctgtacaacaggaatacaaaaaatttgagcaagaacgcgaaccgaaacgccctgttctaaaaaattgtttaaaggcctttttcgttggtggttttatctgcctaatcgggcaactgatatcaactttttatattacgtatttcgattttaccgaacgctcagcaggaaatccaacagtcgcaactctcatttttatctcaatgttgctaaccggattcggtgtatacgatcgtctcggtcagtttgcaggcgctggaacagctgtacctgtcactggatttggtaactctgttatctccgcgtgtattgaacaccgaacggaaggttttgtactcggtgtcggcggtaatatgtttaaactagctggttctgttattttatttggtgtattttccgctttcgtcatcgcacttattaaaactattctcgttcaatggggagggctataaatgttacaaggacaccgaacgtgggtatttgaaaacaaaccagtcattatttcaacaggggttgtcggtggaccatttgaagcaaaggggaacatcccagaagacttcgatatccttcatgaagatttatggctcggacaagattcctatgaaaaagcacataaaattttattcgaagaggcttgtagtcgcgctactgaaaaagcagaacttcgtaaagatgatattcagttcgtactcgcaggagatttaattaatcaaattacccctacaagctttgcttgccgcacactgggcactccttatctcggattattcggggcttgttctacttctatggaaggtttagcacttggggcaagtatcgtaaatgcaaaaggtgcaaaatatttattaactggagcttcaagccataatacagctgtagaaaaacagttccgctaccctaccgaatacggtggacaaaagccgcctactgcacagtggacagtaaccggagcaggagccgctatattaagcgatactggacacggtccaagagtaacctctgcaacaatcggccgagtggttgatatgggattaacggatccgtttaatatgggaggcgcaatggctccagctgcagttgatacaattgaagcccatttacgtgaacgtcaaattgatgcctcttactacgatttaatcgtaacaggcgatctcggacatgtaggacgcgaaattgcttatgacttactacataaacacggaacgaaagtaacgagcgaacaatttcaagattgcggaattatcatttatagagaaggacaacctgtcatagctggtgctagcggacctggatgttctgcaacagtcgtgtacggtcatttattaaaccgaatgaaaagaggagagttcaaaaaaatacttgtcgttgcgacaggcgctttactatctccacttacattccaacaagaagaaacgattccgtgtatcgctcacgccgtttcgattgaatttggaggtgcaacgcaatgatttttttctgggctttcgtcattggcggactcatatgtgtaatcggccaacttatgtttgatgtcggcaaactaacacctgctcatacaatggcaacactcgttgttgctggagctatattagatggatttaatttgtatgagccattaattgatttcgctggagccggggcaactgtacctattacaagctttggtaatgccctcgttcatggcgcaatggaagaagctgcaaaacatggcatcgttggcgttattaccggcatgtttaaagtaacgagcgccggtgtatcagcggctattattttcggcttcattggagcattgttattcaaaccgaaaggataagaggtgtttatatgactgttatcgctagcgtaaaaacttgccttgctagtgtaaggggcgctcaagcaagtttaagctccctttcattaaattcacaagacgaagaatcaaaacgcgtatttcatgaatgtatgttagaaatggacagcgtcatcgctgatttaaaggatagaatttcagtattagaacgtgaagaacctcaatataaagggttttaagtagactggaggaaacgactatgtctcacctgccggaatggacacttgtcattcttcgctctgtattcatattaattattttattcgctattacgaaatggttagggaaaagacaaatctctcagctttccttttttgaatacatagccggaatgacgattggtgacatcgctgcccaagtatctacagggctcgattcaaaattttttcacggcgtctttgcgatactcattttcgctgtggtaccttttttaacaggaatcctctctttaaagaacaaaacagctcgggacttctttgaagggaaatctaccgtattaataaaagacggaaagatactcgaagataacttaaagaaagaaaaatatacgagtgacgaattactggaacttctccgtggaaaaagtgcgttcagcgtagctgaagtcgaatttgctgtcttagaaccgagcggagaattaaatgtattattaaagaaagattcccagccacttacagcaaaagacatcggtttaaaagtaccaaacgagaaagaaccacaaactgttattatggatggaaatgtactagatgaacctctttcagcaagcggacataaccgcgcttggctacattcagaattagaaaaactcggtgttgttattgaaaatgtcttcctcggtcaagtggattcatacggacaacttactatcgacatttacaatgacaaactccaaatgccttctcctcaaaacaaacctttattattagcatctttaaaaaaatgtcatgctgatcttgaactattttccttagaaacaaagtcgaaatcagcaagtgaaatgtatagtaaaaacgcgaaacaaatcgaaaagattttaaataaagtaacctatcttttaaaagactaattatcgaaagaacgcttcagttaaaaggcgttcttttcttttttctccagttttcataacgtttaaatttatgtaattcggttatgatgttgaagatacataagcagggaatttcgaaaacatagcgaatatttcatggtacaactacatatttttttgatttaaagtggtttcgtttgacctttattgaccataattgtattataagactaagaaagctttataaggaggaaataacagatgaatttaattcctacagtaattgaacaaacaaatcgtggagaacgcgcttacgatatttactctcgactattaaaagaccgcatcattatgcttggtagtgcaattgatgacaacgtagctaactcaatcgtttcccagcttttattcttggaatctcaagatccagaaaaagatattcacatctacatcaacagccctggtggttctatcacagcaggtatggcaatctatgatacaatgcagtttattaaaccacaagtatcaacaatctgtatcggtatggcagcatctatgggtgcattcttacttgcagcaggtgaaaaaggaaaacgttatgcacttccaaacagtgaagtaatgattcaccaaccacttggcggagcacaaggtcaagcgactgaaatcgaaatcgctgcaaaacgtatcctattcttacgtgaaaaactaaaccaaattcttgctgaccgcactggtcaaccacttgaagtactacaacgcgacacagaccgcgacaacttcatgacagcagaaaaagctttagaatacggtttaatcgataaaatctttacaaatcgttaataactaaaagcgaaagcggctcgtttagaatcgcaggtcgctggagctggatacaactaaaagtggaagcgccctataattgggcgcttcttttatatattgttccccgctcacataccccatccagtatctctctaaatatatcagcgatttttcaaatatatcgaccgcaactccgattatatcggcgattattttaatatatcgacgtttcgacataacttatcgacttaccgacaattctcgacaagcacgtaccccttaaatacccctcctcgctaattcgcacagacaacaaaaaagctatcgcatatacgcgatagctttttattgtacatatgcagctaatgcttctaaagcctcttctgcatctgaaccttctgttgtaattgttatcatgcttccagttccaattgctaagctcataatccccattatgctctttgcatttactgtctttccatctttctcgatgaagatatctgcatgaaagcgatttgcctcttgtacaaacaacgcagccggacgtgcttgtaaaccgttttttaatgaaacttgaactcttttttgaaccacagctccatttcccctttaacctcttatttttttgctaccgtttcccccgcgcgtaatttctctgcaatttcatcgattttacgcaaacgatgattaatacccgacttactaatcttccccccggataccatctcacctaactctttcaatgttacatcttgataatctcttcgtaattgtgcaatctcttgtagtttatccggcaatatatcaagaccaactgtctcatcaatgtagcgtatattttcaatctgccttagtgctgcaccaattgttttatttaaattagctgtttcgcagttcactaaacgatttacagaattacgcatatcacgtacgattcgaatatcttcaaatcttaaaagtgcattatgagcacctataatatttaaaaactctgtaattttttctgcttctttcaaatacgtaatgtacccttttcttctctccagcgtcttactatttaaatcaaatccgttcatcagttcacatatagcatcattatgttccttatataacgaaaagatttctaaatgataagatgatgtttctgggttatttactgaaccacctgctaaaaatgctccgcgtaaatacgatcgtttacaacacttcttctcaatcaattcttgtgatatatttcgaataaatgaaaagtcatctcgaacaatatgaagatcagctaatatttcgcgagacttctcaacaagccgcacaatatatacattatttttcttcaatcgcatttttttacgaacaagtaattctaccgtcacgtcatatccttttttcaaaagcgtataaatccttcttgcaattgccgcattttccgtttgaatatcgatagatagacgacggtttgaaaaagaaagcgacccgttcattcgaagtagcgctgataattctgctttctcacagcattccttcatctcaagattcgtcaactctttctttgtttgtgatgcaaatgacacagtcaacacctccttatacgattattgcggaacaaaattcttgtcctatatgaatgaggagcgctacctcaaacgaggcaacgcatatttataacaatgaatataaaatcgaagctaactttaacgtatcatgccttacaacatgatcatcatacttcgctaatccctcttgaataacatcaatattattttcaacaaaacgttcttcatccactacaactggtgtagacatttcttcatcatataacttacgtaattcacaaggaatctcacggttatttacaattgcagtattgataaatggttgccctaaatgatcgtgtaacgcctgcacatgatcaaaagcagtatatcccatcgtttcacccgcttgtgtcataacgttacatacatataccttcttcgcctttgcagcaagaactgcgtctccaattttgttaacaactaaattgggtaatatactcgtatacaaactttctgggccgaaaacaagtaaatcagctcgtttaatctcagccaacgtttcatgcaatggctctacatcttctggagttaaaaagacgcgattaatcttctttccgtaataaggaatctttgattcacctgttacaatttctccatcttcaagttccgcatgaagtaccgcactttgattcgctgctggtaatacacgtcctctgacatttaatactttacttgtttccgtaattgcatggaaaaagtctcctgtaatcgaggtcatacctgccaataatagatttcctaacgcatgacctttcagtccgtctcctgttgtgaaacggtgctgaaataaagcttccaccagtggctctacatccgataacgcaacaagtacgttacggatgtcacctggaggtggaatttctaactcatcacgtaatcgacccgaactgccaccatcatcagcgattgtaacaactgctgtaatatcaacaggatattgctttaatcctcttaataaaactgagagtccagttccgcctcccatgatgacaattttaggttttctctcttttttcatcccttaatggccctttctcttctccacatcacgatgagatacatgaacactatactctggtttcaaatgtttcccaaggtattctgtaagcgtaacagaacgatgctgtccacctgtacatccaattgcaattacaagttgacttttgccttgtcttttataatgaggcagcatgaaagtaatcagatccgcaacttctctaaaaacttatgatgatgatgaaattgcaatacataccaagagacttattcatctagtgactgaaatggcttcatgtgtggaatgttatatggatttggtaaaaaacgaacatcaaatactaaatctgcatcaattggaataccgtacttaaatccaaatgacataacatttacacgaaatgcttgctcagtttctgttgagaacaagtgaacaattttttcacgtaattctttcggttttaaatccgatgtatcaagcacaatattcgctcgtgccttcatatctgttaataaattgcgctctgcttcgattccctttaacggcaaaccagttggtgcaagtggatgcgaacgtctcgtttctttataacgagttacaagcgtactatctttcgcatctaaaaataaaatatgaggaataatccatgtacgttctgataaatcatcaagtgctccccataaatgttcgaaaaactctcggccacgtaaatcaataccaagtgccactttattcattttcccttttgaatccgccataagctcaataaactttggcaataacatcggtggtaaattatctacacaaaaatatcctaaatcttcaaaactttgtaaagctactgtttttccagctccagacatccctgtaataattaccatttttatatcattattctctgtcatcgtatcctctccttgacggtttaactcggatctaatcgatatgaaagcaactcaaaatctggggtatatacaaatgtaccgtagattatgccatttcctttaattaaataatcaataatgtgataatctcctggcgccattgctaaatcatcaattttatcaaatgtatgccaaccaatgatgccttcttcgctctctagtttgttttctcctgcaaaatctgtcgctaaaaaggagaacatcatccattcagaaacaactttatcaccttcttggatgacaaaggtgaagaccccctttaacgctgggtttttcaaataaatacctgtttcttcgcgatattcgcgaacaacggaatctcttacagtctcaccacgctccattttcccgcctggtgcaacccaccaattccggcgaggtttttggagtaagagtacttcattatctctaattaacacacagtttgtcactctttgcatgtttcttcacctcagctacttgcagtaaaattcctcactgcatacttctttcattatactatcaaaaacagtttgctacaacgaaggagccagtcctctttcgctaagcatatgctactcagcaattttaaaaaagctttctataacaagcaatgtaaatgcttagacttttaatgaatagcatgaaaaatccccttaacgctttttatcgccaaggggattaaagtacttatttcttaccgaaataagtaacaatcgcaaatcctaaaataaaggtaatgattgaacttataattgaaaatccaccagtcggaatcccagggaatacaattacaatcgaaccgattacaagtccaataattgccgcaaatgtcatacttttataacgatctaataaaaaactaatgcctttactacttacaacaaatccaaccataacaccagcaccgataaccacgattaaaggtaagttaagtgtagttaaagcgttaattgctgttggatacacaccaataattaataaaataaacgatccactaatcccaggaagcagcattgccatactagccatccatcctgcgaaaaataaaccaattgcatttacaattgttaaagtcgtaattggatctgctgccttatctggtttaaagaaagctgtaatcgcaacaagaattgctgcaactattaataaaacgatgtgcttacctttaaacgacgactttgcatcagcttccctcattaacatcggtaatatactaataattaaaccgaggaagaaaaattgagtcggttcataatgatttgcaagtaaatatttaataacgtgacttaacgttaaaaatgccgctgccacaccagctgcaaggggaattaaaaatcctaaatgttttttccattcacgactaaagaatccactaattgccgcaagcaattgttcataaatccctaacacaacagcgattgtaccgccgctcacaccaggaattaaatcactaacgcccatacaaaatccacgatatatattacgccattccatactgaataaattcctcatttcttatagtgattttttccgtaaagtccagtatatcaataagaaagcttataatccttatattttttgacaaaactttgacattttcacacaaaaaaagaagaaagctcctgtcggtagctttcttctcacaaggtatattatcccttatttttctgatacagtttttaattcctctaataattcttctacgtaatgttgtgcactttgcgctgcaatactaccgtcacctgttgcagttacaatttgacgaagcattttttcacgaacatcaccagctgcgaaaataccagggattttcgtttccatacgctcgttcgtttcaaggtaaccattttcatttgtaatacctagttcaacaaatggttttgataaaggtaacataccgatgtatacaaatacgccgtcagttttgacttctttctcttctccactatttacgtccacaagtgttacacttcctactttaccacttgcttcgttgatttcttttatagtgtgattccaaatgaaatctactttttcgttttggaaagcacggtcttgtaaaattttctgtgcacgaagcgtgtcacgacggtgaacgatcgttacttttgatgcgaagcgtgttaagaacacaccctcttcaacagcagaatctccgccaccaattacgataagctcttttcctttaaagaatgctccgtcacatactgcacaatatgatacaccgcggccgccaagttctgtttcacccggtacaccaatttttttatactctgcaccgcttgcaacgataattgcacgtgctttatattcttttttaccagcaataattgttttgtattctttaccatcgatgacttttttcacatcaccgtatgcatattcagcaccaaatttcttcgcatgctcaaacattttatttgataaatctggtcctaaaatagactcataacctgggtagttttctacatcttccgtgtttgccatttggccacctggaatacctcgctcaagcattaatgtgcttaaatttgcacgagatgtatatactgcagctgtcataccagctggtcctgcaccaataataacgacatcataaattttttcttctgacacactattcactcctatccattcctacacaattaagttaccctcattatactgttagcatcatttttttcccaatgatttgcttatcttatgtgtgcgtacgcttaacagcttgcacatactttcggacagtcgctacagatacattatatacatctccaagctccgactgtgtcattttatttccttgttcgccgcgtacaatgtattcaatcgcagctgaccagccgtacacatttgtaaatatgtctccagatgtatataaacgtatgaacgtacaaaaccaaaagtgtaaacactcttcgattaattcatcatcttttttcgtataattgtataatgcatccgcaattctcgcgcactgctcaaattgctgtaaatcagctggaatactcttatgactattaagtaaaaagaagtactttgcaagttgcgatacgatgggaacaccgttcttcgcttgcgttatatcaaagaagaatccaaccttctccggcgttgacaattcattcattaaatataaagctagcatttgttcttctagcgtcgcactttgctgaaatgattttcgtaattcttcaaataacacattttgcccttcatctgctaaattcagcgcattccacggttcttttccctttttatcaggatgtaattccacgacatattgccacattttttcagctagttgctggtctttcaccatatacgcagaatatgcaaaccaataataaaaactaacgtctccctcatatccttgacgctttaatagtttgaaccacttatatgcatgctcgaaataaccaattgttgcgagtgtagttcccagtttcaaacgatgttcaaatgaaatcggatataccgaaactagctgtcccgctaatgcctctacttgtttatgctctccaattgaatatagaaaaataagcgtattacaaagcgcatgtatattgccaggatttttctctaaaatcatttctgttaacttcagtgctttgtctacattaccagattgaaaatgtgcaatggctaaattattatgacctgaccaaaattccggataatctttcgtaacaatttctaatgtagcaattgcttcttccaattgtccattacgaatatagcgattcgcttcttcctgcataacaattaaatcatcttcatcttcaatctcttccgcacccattgcttcttcttccataatctcaagaagttctaacgtatcttctacgaattccttctcttttgcaacttctaaataacgatctgcatatttcttcgcctgttgaaataaccccatatatgcataattatttgcaataaaataatagcactgttcaagttctggattagatctaactaactttaagaagatttgattcgattcttgatattcaccagcctcagataatactgatgctaattgacataaaataaacggctccttctcactttgtgccgctcttcgaaaatatttaattgcatcttgcaatttttgtcctttgtaagctctcatcccttttttataaaagaagtccgctaattgattaaaagagataacttgtccgttctccttatatatcctttgatttttccccatatatcctccagttttttgttttcttcgttcacacattcttctatctataagtataaacgattccgtaaaaaacaaaacagtatattatactcaattatttcctttttattcataaaaaaagaggagaaatgttacattttcaccatgaaccttctcttgcggtcatttgctctttcgtataaataatacgcattggatttccacctacgaaagcaccgctcggtacatctctatgaacaagtgtgccagctgagacagtcgcaccgtctccaatgttcacacctggtaatattgttacattcgctccaatcattacttcatttccaatgacgatttcgccaagtcgatattcacgaattaaatattcatgtgctaaaagcgttgtgttatagccaataatcgaattctctcccacagttatcttttctgggaacataatatccggcattaccataagcgcaaatgatgttttctttcctactttcatccgtaaaaaagtgcggtacaaccaattttttacggataaaaatggcgtgtaacgcgcaatttggataataataaagtttttcattaccttccaaaaagacactgttttatacacattccataacgaattttctcctgaaacaggatagcgcgttgtccgtcgcacttagctcgctcctctactaacttacttgaacctttatgaacggttcatgttagacaaaatcggtagcaaatcactcattttatctagcataaagtccggcttgtaagcctctaaatacgctctacctttcaacgtccatgaaaccgcagctgttttcgtccccgcattttgaccaccgacaatatcatgatgattatccccaaccatcaatgcctcttctggttttgcatctaataattcaagcgctttttgaagtggctccggatgtggtttcacatgctctacatcatcaattgtcacgacaacatcaaaaaattcatcaagctttgacaactgtaatcccatctcaacggtttgtctcgctttcgttgtaacaataccaactttataaccttgcttcttcaactctcgaactgtttcatatacagtttcatattcttctactaattcatcatgatgatcatggttaaatttccgatagctagtaatcatctcttcaaccttactttcatcaatcttgctgaaagtatcatgcaaagatggaccgataaatggcaacacatcttcacgcttatattgatttggataatatgtatttaaagtatgtaaaaacgaagaaataataagttcatttgtattaattaaagttccatctaaatcaaataacacggtatttattctcatcgccttagtcctttcgccttcctgaatatgaaagaagcagcatcttataataagatgctacttgtctctaattttctaaatatcttttatcagcttgccccatttttcgtctcacaataatgaaaataatagaaataacaacaagtccaattgacattacttgtgcaatacgaagtggtcctagcattaaactatctgtacgtaagccttctacgaagaagcgtcctactgaataccaaattaaatatgtgaagaataactccccgcgacgtaaattcacttttcttaatgcaagtagtaaaattacgcctgcaaaattccataatgattcatataaaaacgtcggatgatagtacacaccctcaatatacatttgattaataatgaaatccggtaaatgaagaccttctaaaaactgtctcgttacttcatcaccatgcgcctcttggttcataaagtttccccatcggccaattgcttgtcctagtaaaatacttggtgcagcaatatcagccagcttccagaaggaaaccccgcgtcgtttcgcaaaaagaacacctgtaataacagccccgattaaaccaccgtgaatcgccaaaccaccttgacgaatattaataatttgactcggattttgtgcgtaatattcccattcaaaaataacatagtacattctcgcaaaaagaatagcgatcggtactgcaattaatacaaggtcaacaaatgtatcttttggaatacctagcctttctccctcgcgagttgccagccaaagacctaatagtacacctgtaccgataataatcccgtaccaatacacaggaaacggcccaagttggatagctacacggtcaagctgtggtacagaagctaacagcatatgtatatgacctccctctccaaagtttactcctgatttcctaactcaattgcactcattaatcgttcagagaactgctgtgctgcattgactcccatacgtttcaaacggaagttcatcgctgctacttcaataataacagccaagtttcgaccaggacgaactggaagtgtaatcttcgtaagttctgtatcaataattttcatcttctcttcatcaagacctaagcgatcgtaatttttcttttgatcccaaatttcaagattaataacaagtgtaatacgcttataatttcgtactgcccctgcaccgaataacgtcataacgttaataatacctagaccacgaatttctaataaatgctcgattaaatctggtgaacttccgactaacatgtcttcatcttcttgacgaatttccacactatcatccgcaacaagacggtgaccacgctttacaagctcaagagctgtctcacttttaccaacaccactttgacctgtaattaaaacaccaacgccgtaaatatctactaacacaccatgcacagctgttgttggtgctaacttaccttctaaatagtttgttaaacgacttgataatctcgttgtcgtttgagaagaacgtaataaaggcatacctgattcacgtgatgcttgtaataactcatctggtacatcttgattacgagttacaataatacatggcgtctcctcagtacaaagcgctttcattctctcttgtttttgctctgacgttaacgtgtcaaagaaagtaagctccgttttaccaagaagctgcacacgatctgctggatagtatgtaaaaaatcctgccatttcaattccaggtcgtgataaatcacttgtatcaatcggacgatgaatgccttcttcaccactgattaactccaattgaaattgttcaattaaatcttttgttcttactttcggcatatgtataaacctccactccgctgcgggttcagtctcgtttgatgtaaaattccattctatcggatattgtaccatttttttctgaaaacaagaaatacggtttctaataaatagaaaaaaacatttcatacgaataatgaaatgtttttctttttgtcactttctctttttttcatatagaggctcaacaattgccttttcaattatcatattaaaaattgaaatacaaattgccgcaacaatcgctacaccaaatcctgatatattaaaagcatctcctaataatgaatctgctatttttaacgtaatcgcattaataacaattaagaagaagccgaaagttacaacagtaattggtagcgtaattaaaattaaaaatggctttacgaacacatttaaaaccgccaatataatactcgcaataattgcagtttgtatatttgctacgtaaaatgcatctggtgcaatcccttttaaaagtcccgatacagcgattaacacaacgctatttacaagaagtgatacaatccatctcatttcgttacacatccttttaaacatatatatttcatcatacgctaatagataagaaacgcaagtatgatacgaacacttatatcaacttattctatctttcatgcttgtatacctactaacatttcttagtaaaataagggccgcaccatctatgttcatgagtttttacaaaagtccaagtgaactccttatctacaatatagatatcacccttatacatatcgtccctctcacacaatatatcatccatatgtaacaaactcgcatcctttattaacagtacctcatcacagtgttggtagaaaatgtagcaatcctttttcacttcattatgaaacgcgttctttgcttctttaccctctaaacgcttctttttctcataactaaatatgtgccaaagatacccacatccatacttatctccataaagaaaaatgtcttctttttcttcatcacttaaatgatttgcaaagtgatcctcccagcgctttcgaaaatatacaccccaattttgaaactctcttaccttcatatttttcttccttaacacctctaaaaacttcatcttctccccctatacaataaaaaccgagcgtcatttccacccggttttcatcaataaacttattgcgataattctacttcttttattttctctttcattcttgctttatcacgatttaaaatctcttttaaatatttacctgtgtacgagcgctcttctttcactacttgctctggcgttccggaagcaacgatttgtccacctttatctccaccctctggtccaaggtcaacgatataatcagccgttttaattacatctaaattatgttcaattacaagtaccgtctcaccgctctcaacaagacgttgcaacacttctagaagacgtgcaatatcatgcgcatgcaaaccagtcgttggttcatctaaaatgtataacgtacgtcctgtagaacgacggtgtaattcagaagctaatttcacacgctgtgcttccccaccagataatgttgttgctggttgacctaatttcatataaccaagcccaacgtctacaagcgtttgaagtttacgcttaatttttgggatattagcgaagaactctactccatcttcaattgtcatccctaacacttcagaaatattcttatctttatatttcacttctaacgtttcacggttgtaacgtttaccatgacaaacttcacacggaacatacacatctggtaggaaatgcatttcgattttaataattccatcaccacggcacgcttcacaacggccaccttttacgttaaagctgaaacgtcctttttgatatccgcgcactttcgcttcattcgtttgtgcaaacacatcacgaatatcatcgaatacacctgtatacgtcgctggattagaacgtggtgtacgaccgattggtgattgatcaatatcaattactttatctaaatgttcaagacctttaatctctttatgagtacctggcttcgctttcgctttatataacttttgagctagcgatttatatagtacttcattaatcatcgtacttttaccagaaccagatacccctgttaccgctacaaacgtaccaagcgggaatgacattttcgcattctttaagttattctcttttgcgccgacaatctctactttacgtccatcacctttacgtctttcaagtggaactggaataaactctttaccgcttaaatacttccctgttaatgaattatcatcttgcatcacttcagccggcgtccctgctgaaacgacctgtccaccgtgaatacctgcaccaggccctatatcaagtaaatagtcagcagccatcatcgtatcttcatcatgttcaacaacaattaacgtattacctaaatcg

SEQ ID NO: 1367 - DNA, 21390 bp, Bacillus thuringiensis
tctcactgattattagccttcaccaaacggacgtttcatgcgggataaataaaagataaaggagaggggaattatgggcgattttaaacaaggcattttaccacattgggattatatgtggaaagatagagccggcaatcgatttatgggaatggttatgtatccagagaaacgaaaatgttcagcaaaaatgcttcagaaaataaaaagagcatatgaagaagcaatagaaattaaagtaactgtacaagttcaacatacatatcagtacgtagaaggactgattgtatactttgatgaagaggctcctgtatgtacaatgcttgataaagatgaaaatccacatcatatatttgtaaaagatattttgcgcattgagtactctgaataaacttttcataaataaattgaagttccataataataatctttttctataatagttatcttttagtatgtaacgaaaaacgaaagtatatgtataatatatttaataaggtaaatttgataaatgtaatcgttttttagagcagattatagtttcatatctgttcttttttgcgtgatgctggagaaatatatttcttcagcatctaccgttttatgacaaaatatattgttaacttttttaaaaataaggttaaattcgttgacaacttttttgaaaagcactttattgacatgagttttagaatgttgtttcatagtcattgtattgaaaaaaaacggctatcatgtcgaaaagtaaaagttaaaaaaagaaagaatttatacatatatcttgtgtcttattttgaaacgtaatacaatatatagagaaatcaagaacaacatatagagaatatagatttgagagggagggtcggaaatgttagttgcatatgattctatgacaggaaacgtgaagcgtttcattcacaaattaaatatgccggccgttcaaattgatgaagatctagtaatagatgaagactttattcttattacgtatacaacaggttttggaaatgtaccagaacgtgttttagactttttagagcgcaataatgaaaaattaaaaggcgtatctgcaagcggcaatagtaactggggagacatgttcggtgcaagtgctgacaagatttctactaaatatgaagtgcctattgtatcaaaatttgagttatctggaacaaataacgatgtagaatattttaaggaaaggggtcgggagattgcgacacattgaactgaaataatgaaatcacgcaaatgcaggacggtttttatcagcttcataaagataaagaggcattagaagtctttatggaagaagctagagagaataccgttccttttaatagcgtggcagagcgaatggagtatatgaaagaacatgattactattacaacgttctggacgagtatagcttggaggaagtagaggaagtatataacatcgcttatggtgaaaacttcgagttccaatcttatatggcagcatctaagttctacaaagattatgcgttaaaaacgaatgatcaaaaacaatacttagaaagctatgaagatcgtgtagcaattgtttcattatacttaggacgcggtgatgtttcgaaagcaagacaattcgcaagcatgattgtaaaacaaaactaccaaccagcgacaccaacctttttaaatgcgggaagaagcagaagaggagaaatggtgtcttgtttcttgttagagatggatgatagcttaaattcaattggctttaacattaatactgcgatgcaattatcaaaaatcggcgggggagtagctttaaacttatctaagctacgcgcacgtggtgagcaaattaaaggtatcgacaacgctgcaagtggcgtagtacctgttatgaaattgcttgaagattcgttttcatatgcgaatcagcttggccaacgaaaaggtgccggtgcagtatatttaaacattttccattgggatattattgaattccttgataccaaaaaaataaatgccgatgagaagagccgtattcagtctctatcaatcggaattatcgttccaagtaagttctttgagcttgctgagaaaaacgaacctttccatgttttcgcgccttatacggtttataaagaatatggcaagcatttagatgatattgacattgatgaaatgtacgatgaattaatgagcaatccgaaagtgaagaagaagccactagatattagtgcacgtgatatgcttattaaaatcgctatgattcagcttgagtctggttacccatacttaatgtttaaatcaaatgcaaataatcaacatccattgaaggatattggaactgtgaagatgtcgaacttatgtacagaaatcttccagcttcaagaaacttcagaaataaatgattacggtacagatgacattatccgtcgtgatattaactgtaacttaggatcgttaaatattgtaaacgtaatggaaaataaagaaattcgtgaagcagttcatgcgggaatggaagctttaacagctgtttctgatatgacgattattccgaatgcaccaactgtgaaaaaagcaaatgacgagcttcattcagttggacttggagcaatgaacttacacggatatttagcaaaaaataaaatcgcttatgaaagtgcagaagcgaaagaattcgctcgtacattctttatgatgttaaattactattctattgagaaaagtatggaaatcgctacagaaaaaggcgagacatttaaagacttcgataaatctgattatgcgaatggcacatacttcgaaaagtatgaaacgacagattacagtcctgtaactgaaaaagttcagcaactatttgaaggaattcatattccgacaaaagaagattggacaagtttaaaagagcaagtgcagaagaatggtttatacaactcatatcgtcttgccattgctccaacacaatcaatcagttacgttcaaaatgcaacttcaagcgtaatgccgatcgtaagtcaaatcgaatcaagaacatatgcgaatgcgacaacatattatccaatgccgtatttatcaaaagatacgttctggtactataaatcttcttacgatatgaatcagtttaaattaattgatttaatcgcagaaattcaagaacatattgaccaaggaattagtacaattctttacgttaatagtgatatttcaacacgtgaattagcacgttactacatctatgcacataaaaaaggcttaaagagtctgtattatacgagaacacgtaaattaagcgtggaagagtgtgtggcttgtaccgtttaatggcatattgccatactaaatgaataacccaatagtatgagcagggttatgaaccctgctcatacttggtttgttctactaaacggttagcttttcattgttagatggaaatttaaccgttcagtagaacaataatagatataggggtgattcaatgcgcgctgttaactggaataaaaaggaagatgatttcagtttaatgttttggaagcaaaacatcgctcagttttggacagaagaagaaatcgcggtttcgtctgacaaaaatacttgggtgcaattatcgaaagaagagcaaattgcttataagcgtgtattaggtggtttaacacttttagatacgaaacaaggtggcgaaggaatgccacttgtacttgttcatcttgaaaatttacaagcgaaaagtgtattagctttcatgggagctatggaagaagtacatgcgaaaagttatagtcacattttcacaacattagctacagaagaagaaattgatgatatttttgactgggtagacaatcatccgttacttgagaaaaaagctggtattattactagttactatcgtcgtttattaaagcctgaagtaacgaaaaaagagttatacatggcaatggtagcaagtgtgttcttagaaagttacttattctatagtggatttttctatccactttacttagctggtcaaggtaaactgacggcaagtggtgaaattattaaccttattatccgttaacttatggcggcttttggtagagataccaattgaaaaacccttttaattgctgggaccccctagtgtaaatttatctgtattattattgatgaatatatgcattcaggttattctctaactatcaatagatggaaaggagaatagctgatagggcaatcagcagcgaagcctttatctagcgataacatgtacggaagtatcagacatcgaaaactgtataaacagtggtgggtgcgatacgtagataaaggaacgttcaacgactatcccaatggcggtgaaattccgcaagaggagtagggccaagcggtgggtgagaatcccttaaatcgaaatggagggctacctgagaaggtagatgatatagtctcttcttacaggaaactgtaagctgtataaacggcataggagtagcgaacttatgtgaaggtaaaggatgagtcaattcacggcgtattcgtcggtattttagcacaacaaatcttcgcagaactttctgtagaagagcaacaagaagtgcaaaaagaaacacaagagttattaatggaactatatgaaattgaaatggcctatacagaagaaatttacacttctatcggtcttgtagaagatgtaaatcgtttcgttcgttacaatgcaaataaagggcttatgaacttaggacttgagccgaagtttgaagaagaagaaattaacccaatcgttttaaatggtttacgtacagatacgaaaaaccatgatttcttctctgtaaaaggaaatggttacgtaaaagcaacgaacgttgaaaagttagctgacgatgacttcgtgtttaacttttaatataggattataaggaaaagctgtcttattgattgataagacagcttttctttataattttgtttacataacactattatttttgtatagcgatttatatttgggaagttctattcggttaacggatagaacttttttgtaattaaatgggtatttacaaaccttttgtatcagtgtattatttaactagtacaccgatacaaaaggagggaagaaatgaaaatagagttttctccaaatacaccaatttacattcaggtaatggaatgcataaaaaaagagatcgtaacaggacatttattgcctggtgataaaattccctctgtccgtgaattagcgagtgaattacaagtgaatccaaatacgattcagcgtacatttcaagagctagaacgggatggagttgttgtcacacgtagaggaatgggacggtatgtaacgaatgaaggggagaaaattatggagctgcgaaaagagatggcgaaagaattacttcattcttttatagatggaatggacaatttaggtttttcagaagaagaaattcttacaattcttcgttcttcattacatgataagagggaggagagccaatgacagagctattgaaaatagaaaacttatggaagagatacggattaaaagcagtgatccgtgaattaaacatagagattacggaagggaaaatcgttgggcttgttggagataacgggagcgggaaaacgacgttattgaaaatgattgcaggcttgcaacacccttctgaaggtagtattacaatagacggtaaaaaggtaggattacagacgaaagaaatcgtttcatttatgtccgataagccagtctttgatgattggatgactgtaaaagatgctttatttttttaccgagatttttataaagacttcgatattcaaaaagcggtagatacgattgcagaatttaaaataccgttagaagaaaaaattacagcattgtcaaaaggtatgatagagaagctgcaaatcattttaacattttctcgaaaagcgaagctatacgtactggatgagccgttgggcgggatagatcctctttctagagaacatgtattggatttaattctacagttctatagggaagattgtacgatattaatttccactcacttaataaatgaaattgaaaatatttttgatgaagtgatctttttaaaagatggagaaatggttctatatgaaaatgtagaagaaattcgttttcagagaggaaaagcagttcatgaattgtttaaggaggtgtttagtaagtgaagtcagtactttcctatttatggaatgtaaataagaaaagatatattgttacttttttattctttgtgctaattgaagctgtgttattttcacaaatgattgtaagaaaaagtgatgcggctatcagtagacaagagggtatatttggaatcattatgattatatttttcttttatattgtttatatgtttatacaaacaatgaaatcatattcacgcttactaactaatccaatgttacgacttacagcaatatctgggaaacaatatgtaatttctatgcttattttctcatttatcgcaatggctatatggtatgggatatgtggaattcttttctacgtaagttatgtattagcttttcctacgacttctgtatatgtagaggcaaaagagattatgcaagtaggcataattaataatttaatatatacgataagcgatttatttgagtttttgtttagtgtgttacaaatcatattagtaattactctagttaagttacttaccaaaaagaaaaaggcgcaaaatatactgatcgttattatttttctagtaataaatatagcgattactttagcgacaaccttgctaggaaaattagctccagctttccaagtattgcgaagagtagaatatcatagtgaaagcaagagtctgtttattaatatgtttcaagaaaatggatttaacatttttaatataagtttcatggtaatggttagtgctctaataatatatgtaattgcttatattatcgataaaaaactagaagtctaaaggaggaatcagcattgggaaacgtagtagtaaagttagagaatgttcgaaaaaggattggtggaacggaaattattcgtggtttatcatttgaggttcgtgaaggagaagtatacggattccttgggccgaacggtagcggtaagacgacgacgatccgtatgatgacaggtcttatttcaatgacagagggcgatattacaatttgtggacatagtattcgctcggagcgtgaaaaggcactagagcaaattggagcgattgtagaaaatcctgaactatatgattatatgacaggaatgcaaaacttaaagcattttgcgaatatggccattacaccaattagtaaagagcgcattgctgagattgtaaagcttgttgaattagagcatgcgattcataaaaaggtgaaaacatattcacttggtatgaaacaacgtttaggaattgcacaggcattacttcatcagccgaaaatcttaattttagatgagccgacaaatggattagatccagctggtattcgccaaattcgtgattatttacaacgtttagcgaaagaagagaatattgctgtaatcgtatcaagtcacttattgagtgaaattgaattaatgtgtgatcgcgttgttattattaaacaaggtgagtttgtacaagagtacaacttacatgaaaaagtgaaacatgatgaggcagtcgttgtagcgtttgaagtagatgaagttcagaaagcaaatgaaatcattaaaggcaaagcaaaagggaatgtaattgtagcatctgtaacaaaagacaacattccgcaacttgtaaaaaaacttgttcatgctgatgtgcttgtatatggcgttactgttcaaaataaaactttagaggatgagttcttagcgattactgggggagtgaaagcgtaatgtttaaattaattcaaaatgaatttttaaagttgcatgcgaaaaaaggtatgtatattttaattggtgtcattgcggcactcgaaattttaggtactttagcaatgttgaagtggggaaaaggtgatgagtttaagggggcatatttagattatgcaaactcagagattggcttaattgttttatttacaacgatttttgggattacacttgctgcccgtactcttactgatgagttccaaaaaggtacaattaaacaattgttaatccgtccaagaaaaagacttgcagttttattttctaaatatattacagtgttattagcaatgttatttatcgtattagctggtatgctaattgcaatgattattggcggtattgtaatggatggtagtaaaacagaattaacgttaggaatcgtaatgaagtcaactttatatcaactactttcaccgttcttttttgcaacacttgcatttttcctagcaaatgtctttagaaaatctgtattaccattaattattacgatgttcctattcttcttacaaggtgcaattaatatggtattaataatgtttgcaaaaggtgtagcgaagtttgtagtattcaaccatttggatttaagagcttacgatagtaataaattaatcaatggtggaatggaaccaacatttacagaatttacgtttacaacttcattattacttgtagttgcatactttgttgtgttacttgtagcatcaagtgcattattccaaaaacgtgacgtattataataaaagaaatccccgcttgtaaaaacggggatttttattacataaaattcacttagattgcaacaagtatgcaatttttcggtggagaagaaagtggtacaatctcaattactgaattacaagcgcaaagtaatttatggattggtattggtcttacagttgttggattactttggttaattccttatgtttggaaacaatggcgtacagtaaaagaagttggcgtgccacgagtacgttttataaatgagcaaaaagtagtgagttcatcacaagaaaatgaagtgtatagtcaagtgatcgtaaccgatagattgatggccatagagttaccagatgaggctgtaaataagcttcggttagaagaaaatgattatgtaacagtatctgtagaagaagataaaatcgttataaagaaagcacataatagataattaaaaagtagctccttaggagctactttttaatttgtaataatttctacacgaaaattattaccgttctttacatatttaatatctgtaacagtgcggaccgtctttaaaatctccactttttcaccaattcgtgggatggtcggaacattgtcccaaataccaagcaagtcatctaattgtgccgttttttcataaaaccagattttcaatgtaaagcccctttctcgaactttatgtattttaatacataatatattatttttattcttattgtaaggggtttttttatattttatgaataaaaataaattaatcttctgggaagatatgttcaatatcaggagtaagagatacttctgataatacgatatgagaaacggtcgttgcatatgaagaaacatcattgataaattcttccagttcaacgagtgaaggaacagaaatttttacaatgtagcataagcttcctgttactcggtaacaaaaacttgcagatggataagattgaataaactgttgcatacgtgttgtatcaccattttttaaagtgatttctaaaatacaatctaaaacgagtcctgcttttttataatcaatatcgattgtgtatttttgaataacaccttcgctttcgagcttacgaacacgttctgaagtagatggagcagataagtttactcgtttcgccaattcacgcatcgaaaggcgactatcattatataattcatttaaaatttttcgatcaacacggtctaattgcatttgtaaatatacctccagtaaaataatgatttttgtaaagggaaaatataaattaagattcatatgaaatgtaaagtgaacgttatttattttacaataaaacagaaggaaataggaggggaaatgatggagagaatttcattatcaaatgtaggagatacaaagtttcaaaagttattagggcataattcggatatattacattcgtggagtacgttagaagatacactgtacaataaaggaactctttcagcagagttgaaggagcaagtgagaagaacattagcgtatgggaatgaatgtccgtactgtatggcaaaaggaagacctgatgatatgcaaaaggcagaggagattggtgtagccgttacttttgcgcatacatttgttcatgaccgaaaagcaatagatgatactatgtttcacgtattaaaacaatattggacagaaaaagaaattgtagagctttgcgcctatgtttgctttattactgcgtcacaacaacttggttttctatttcaattacagccaaattaagggggaaatgatgacaaatcaaatagcacttatcataatcgatgtacaaaaggcatttcaattaccagattggggcgagagaaataatatttttgctgaagaaaacatgagaattttgttagaagaatggagaaaaaggaaacgaccagtttttcatattcagcatgtaaataaagaaaatgctcagtcaatgttttatgagagagcggaaacggtaaactttaaagaagaagtgcaaccactacttggtgaagtggttattcagaaattcgttaacagcgcgttcattgggacaaatttagaagagcaattaagaaagaacaaatgtaatgcagtagtggttgtaggattaacgacaaatcattgcgtggaaactacaacacgaatggcagggaatttaggatttacaacatatttagtgagtgatgcaacggctacttttaaccgtaaaggtttagatggtaaggagtatagtgcagaagatattcacaatatgacacttgtaaatttacatgaagagtttgctacgattgtgacgacaaaagaagtattaaaattattttaagaaaataattgcaaattatgtagaaaaaaataagaatatttcgtataatctaagtacaatcattttgaaaataggggtggcatcatatggagcaaatttcagtaaagaaattagaagaggtacttgttgtagcaggggatgataaacagaagcaaaaggaattttatgaattgctcttatttactgagttttatgttgctggttcactagaagcagaggacggggcaacagagggaatacttcgtttgcgtcatttccaaggagaaggtagatggatcgttccgttctttacacaaatggaatttgtaaaagatgtgttgccagaaggaacgccccttattacgatacgtgggaaagagttatttggtagcattgagaaagatgctacagctgtattaaatgttggtactgatataagtaaaacatttattccagaagaaattgcagatatctcatctggacgaatttttaattattataagtaaaaggaaaagcgtaatcgcttttcctttttaatttgaatatggagtggctataccggaagaaatagagactgttttattattcgtgtttattgtcgctgtagctccaagtggaataccgatgtttggacttatatgtccaattggtaaaccgaataggaccggtatatgatatggtgcgaaatattcatataatattgcttgcaatgattgagatggctttgaaggagtgcagtcgtgacaacttgtgaaaataacgcccctacattcattaaactttccagataaaagtagctgatttaacatacggtcaatgcggtacggttcttcaccaatgtcttcaagtaataaaagtgtattgtccgtatttatctcgtagggcgagccaattatacttgttaacacagctaaatttcctccaactaacgtacctgtaactgtactgtgagagctagatacgatacattctgatgcagataaaatggttgaatacggatggaatagctgattgaaagaggataaagatagggaatcaataccttttcctagttcttcaatcatcggaccatgaaatgttataagctttgcataacgtgaaacagcagtatgtaaagctgtaatatcgctatatccccaaaagattttagggttttgccgaatgatttcatattgaatgtgagggaggagacgagcacttccgtaaccacctcgtgcacagaaaacggccttcacttcattatttgtaaatgcttcatgtatatcgtcaagccgaacttgatcacttccggctaaaaatccatatttctcgtaaacgctcttcccgattattacggataaccccatctcttgtaatacattcacaccttgtaatacattttcgattgtaggtggaccagatggtgcaatgatcattactgtatcaccttgttttaatgcatttggataaatcattaagctcagcctccttctctttcaatatattcgcttcatatgaagttcaacccttgcaaaagcaggggaaagcttatcaaataaagaagatataaaggaaataggaggggaaatgatgtttacaagtcgagtaacagacatattaaaaattgagtatcccgttgttcaagccggtatggcaggcgcgattacgacgccagaacttgttgcagcagtaagtaatagcggaggattagggacgcttggagcgggctatatgagcccagaacaaattcgtgaagcgatttatagaataagagaactaacagataagcctttcagtgttaatttacttgtaacgaaagagatacaaatagaagaagagaaggtaaatgaggcgaaagtattactaagtggagtaaatagagaattaggtatagaagtagaagggacgttaaaacttccaaaaagctataaggaacaattacaagtgttattagatgaaaaagtaccggtcgttagttttgcatttcaaacgttagaaaaagaagaaataaatgatttaaaaagaagtggaataaaagttatcggaacagctacccatgtgaaggaagcgaaagtacttgccgagttaggagtagatattattgtcgggcaaggaagcgaagccggagggcatagaggaacgtttattgggaaagaacgagatgctatgatcggtacttttgcgttaatacctcagttagtaggggctattccgcatatcccaattgtcgcagcaggtggtgtaatgaacggacaagggcttgttgcggcattggcactaggagcagaaggtgttcaaatgggatcggcctttttaacaagtgaagagagtattacgcacgatgtgtataaagaagcggttttacatagtacagatacgagcacaactgtaactcgtgcgttttctgggaaatatgcgcggggtattcggaatgaatttatagagagacatgaaggaaaagaagaagggctgccgatgtatccagtgcaaaacgtattaacttctaaaatacgccaagaggcagcgaagcaaaataaggaagaatatatgtcactttgggcaggacaggcagcatcattagctagaatcgaatcagctcagcatgtagtggagcgagttatgaaagaagcagagaatgcaatcgaacaattacaaaatatatacaaaaagaccacttgagtaattcaagcggtcttttcattagtttgctttataaaattgttggatggcttcgtcgatgtaaacccagcctttccaacctaagtgcatatgatcttttaagaagtatttatcgtattcatgatttgagaagtcggcaattggataaccagctttttcaatttgctcatgaactttcttatagtatgcttcgcggcgttctttcgggaagccagcgtagtcgtaccaaggacctttgacaggaacagaaatgaagagtggttttgcaccagattgttttaataaatcaagtacaatttgtaaatcttcatattctggcgattgatcataagcatcattttttaagtagccttcacgttgctttaatttcttcttgattttgctattgaagtaaccatcttcgataccatattcattagatccagattctgctgcacctgtttgatctgcatgtttacgagcttcatcccagttcatttgttttaatgaagggtcaagcttttctttatgcggtttaatattaaacatagctgtaaataaatctttacgatctaaaatgttacggtaaatataagcgaaaggtttagcagcaagtgcttttactttatacttcgtatcatcataagcgatgccttcaagcgagatttttaataaagtttctttttttacaatctcaaagtttaataaacgctttgcaatttgttttttcatttcaggttttaaatcattgttgaaaatgaagtggtaaccttgttgttttgaaaagttaggtgcaaagtgcgtttcatcaataccttgtggtacaaaccattgcggagaaagaacgaataccattttcttatctttcaattgatccattgtagatgcgaagtttaacacatgtacaaggtcttgtgttccgccgcgtccaagaaggaatggcgtaaatccttcaggctttactttaaaataattagatggatggaaagcatccatacgtgcgaattccgatgaaccgtacatcggaagatattttggatctgctaacatcttttgctgtaaaatcatactttgaattttttcttcttttaaagaagtagcagcttgttctactttttcatcacttaaaagtggaagtaggaagcgcgttggaataagtaagaatacagcaaaaagggccaatgctaaaagcatcggaccaaattttgctttgttcatcggatttcttccaactttttaataaccatgtttggtgtagcccactcgtcacggtcaaaatcagaaatagaaacttcaatatctaaacgctcttggaattcaactaataaagatactacagcaaaagaatcaagaataccttcttcaaataattgaacatctaagttttctttcacaatatcgttttcacatacttcttctaaaatatctaatacttgctctttgaattctgccatttttaaaatctcctttatatccgaaatatattatatgtgcaacttcttaatggaataagaagggtgcattaaaagtatctgttaaggtgtccagagaagattaggaaaccgaaacatacaatgtggaacgtaattacaatcgcaaggatgcgtgtgaatttattgtttggccaaaatttatgcttcttgttttttcgttcgaaaatatcgaataaaataaacagtgcggcatgatatagaccataaataatatactgcgcaacagcgcttccttggatatgccaaattcccataatgaagaagtttaaaaatgcaccgatatacgaaattgtgtaacggttcttaattaactttttcttcgttgcaaaaaatacgaaacgcatgtagatgaagtcacggaaccagaatgataaactcatgtgccagcggttccagaagtctttaatattacgactaaggaatggcttattaaagttttctggcgttttaattcccatcatataacttacaccaattacaaaagagctataaccagcaaaatcaaagaatagatataagctatagctatacatgtaaatcatatttgaaaagattgtatcgtgttgagcgaatgctggatccatacaatattgctttattaagtaagcaataataaatttatacaagaaaccttggaaaatacgatttagtcctgtatatagtaaattttgatattcttcagcgctaggtggcttttgaatatctttttggaatctacggtaacgatcgataggtcctgttgaaatcgcagggaaaaataaaacgaattcccagaagttaaagaaagaaagctctttaattaaaccatcacgaacttcaaataccatttgaactgctctgaatgttacgtaagatatacctagaaaaacaacaagttttaactcaggtagtaacgatgcaaatggtgcgatttttgccaaaataagaggcaaaatcgataaaataacagctatgcaaaatgtgaatgtactattatttttttttcttaaaattaaatagcctttaattagggcatattgccaaataataaatgcggctaacatcattgcttgctttggtttatctgagaagataatagcaagcatgattaatgttaaaacggcattatatttacgcaacattttaccttttaatccagctatgatagtaggtattaataaaatgcccactatagcgaaaaaataaaatgatccatatgcggtcatgctgtaacctcactcaataattttttgcgatctacctttccatttggtgtcattggaatagaagattgatacatgaatttacgtggaatcatgtagtttggtaatcgctcattgagttcttttttgattgcagatgttaatttgaattctttttcaaacgaatgctccccaggaacaacaaccgctaataaataatcgtatttctcaccttttttaattggaacgataactgctccttctacgtaagaacacgcacgaaggtgatgctcaatttcttctaattccattcgataaccatgcaacttaatttggaaatcaagacgaccattatagaatagaagaccattttcaacatagccagcatcgcctgttttataggcgcgctcaccgtcaatcatagtaaatgctttttctgttaattcagggcttcctaaatatccaacgcttacgcttggaccgacaattacgatttcacctttttcaccatcaggtgcaatcgtgccatcttctttcataataagaaggcgacagtctgatttacaatagccaactggaagtgatttgtattgattaagcacttcttctgtaacgtgaatacctgttacagcgacagtagcttctgttggaccgtaagtattcataattgttgcttttgggaaacgctcaattaattttctagccacttcatttggtaacacttcaccgcagaataagaatgttttcatgttcggtagcatactttcagagaaggatgcttccattaaacacatttcagcgaaagaaggtgtcgaagtccatacttgaatatccgattgctctaaagaagcaaacaagtcttttggacgcgcaatcatatctttatcgattgcccaaagtgtaccacctgttactaatgatgggtaaatatccattacagataaatcgaatgagaaaggtgcttgatttaagaatacttgccctgtttgtaagttgaaatcttctacagcccattttgtaaagctaacaaggcagttataagtaatctgaacccctttcggattacctgtgcttcctgatgtgtaaataatgtagaagttctcatcaccttttaccgcatgttcaggatttggagtgttccctttatgagtaaagaaaatatcttttaagttgtcttcacttacgatgcgaactggtaaatcagttacagttactgctgttgccgataaaagtaatttcgcaccagaattttcagcaatacgttgtacacgatcagctgggatagataaatctacaggaatgtaagcatgtccagcttttacacatcctaaaaagttaacaatcatttcaggttgcatatggccatacaccataattggtgaacgatcgtctggatactcagaagaaatccaatgtgctaacgcatcagaatcttcctttaattgtttgtacgtaattttcgcatctcgccaaacaaaagcggtttgatcaggcgtttctgcagcccacttttcaatttgttctaataacttcataacgttcccaccctagaattcattgtaaataaatgtacttgtgtttgtatcatggaatccatacaaccaaagtaatgcaaataaaattgcaagataataaaccgtctttgcaacccattgtgtgagtggtcgagaccatatctcttttaatctttccatgtctttccctctcttaatgaaataatagctctttgtaggtatcatgtcctacattattgtgaaaaaaacaaaatcccacattttaggtaaaaataagtcaaaaggctcttttttgatattagcactaaatactaaaaaagaaaatccctaacttagcaattatattacattcagcatgaatttgtaatgggtttgacatgtaaatagaaagtggattgtgtgaatacataaaagtggactataagaatacgtaaaaatacagtatttgtttttattaatcattcaagacggagtaaacttttaaatttctagttcttttgaaaaggaggaaattatcatgaatagagtgtggaagaatctaatttcggaagaaaatatcgtgaaatggagaaggcacttccataagtatccggaattatcatttcatgaaaaagaaacttcgcaatttatatatgatacattatgctcattttcttcttttgaagtaacgagaccgacgaagtatagtgtactagcaattaaaagaggtgtgaagcaagggaaagtaattgcgattcgagctgatatagatgctttgccaattcaagaggagacaagtaaatcttatacatctgtgaataaaggaatgatgcatgcatgtgggcacgatgctcacacagctattttattaagcacagcagaggtgctatcaaatataaaggaagattttgcaggtgagattcgtctattctttcagcacgcagaagaggtgtatcccggtgggggacaagaaatggttgaggcaggtgtaatggacggtgttgattatgtaataggtttacatgttatgtctggattagaaagcggaaagataggaattgtgtatgggccgatgatggcggcaccagacgtatttacagttgaaattcaaggcaaaggaggacatgcggcgcgaccagaagaaacgatagaccctattgctatcggagcacagattattacaaatttacaacatatcgtatcaagaaatacgagtgcttttatgcaaagggttatttcagttacacaatttcatgggggaacggctgacaatattattcctagtacagcaactttaatgggaaccgttcgttcatttaatcaagcattgagggtggaagcagaagggaaaatcgagaaaattgtgaaaggaattacagaagcacatggaggatcgtatacatatacgtatcgatatggatatgatccggttattaatgatgaatatattacgaaaatagtagaagaaagtgcactacatttgtttgggaatgagcgtgttgtgaagcttgaaccttctatgggtggggaagatttttcagcatatttaagaaaagcacccggttgtttcattaaattaggaacaggtaatgaaaatatatatacttgttatccacatcatcatccgaaatttgacgtggatgaatcagcattaatttgtggagtggagctatttttagagacgactataagattactaaaatcatagaaaaacaaaaaaaggcaactgcactctattgcagttgcttttatttctttccgtcagagagggctgagaaagaactatgctcattcatagtatatgaatagctaacggacaagcttgtacattttaatcatttttttaaaaatagttgttgacactgataatcaatgtcaattaatctaaaagtagttgaaattgataattattatcaataggatggatgcgacatgttaatgagaaaaaattttcaccttctgcggaggggattaaaagataaaaataaaaataaagatgttgatcagcatatggaatggcaaagaaatgtaattcggtctgaatatgtagatgagaagaagagcattcaaacagaaaaagagatacaaagtaaagggagaggttcagttgagtaagttagtaatgatttttgcaagtatgagtggaaatacagaggaaatggctgaccacattgccggcgtaattcgtgaaacagaaaatgaaattgaagttattgatattatggattcaccagaagcttctatattagaacagtatgatggaattattttaggtgcatatacttggggagatggtgatcttcctgatgatttcttagatttttatgatgcaatggattctattgatttaactgggaaaaaagcggcagtattcggatcgtgtgattcagcttatccgaaatacggagtggcagttgacattttaatagaaaagctacaagagcgcggggcagcagttgtgttagaaggactaaaagtagaattaacgccagaagatgaagatgtagaaaaatgtttacagtttggagctgaatttgtaaaacacctttcttaatggcagaagggagatgaagagcaagtgcatgagaaaatctcaatcaaaacgatgacagattatcatttgtatgattttatgcgttgtccgcataaattttattttcgtcatataaaaagaagagaaccttcttcatttgaatggcaacaaatagcacaaatgattgtcaatcaaattattaacgagtattacacgctacctgcgggtcaacaaacgaaaattgtacttttaatattaatagaaaagtattggaaaaaagtaaggattaatatgtttgcttcgaagacggagtactatattgtattagctaagctaacggatcacttattacagtttgttgaaaaggatgatagtcagacaccaccattgtttttatacgagaagtttcaaacatatatggaagagttaggtgtccacatgtcattgacatttgaagttggtgagtggagtgctgggtcgtttgtaattaaaaagtatgtcgtcgatgcggatgaggaaatgcttgctctttgtcagaagctaatgacagtatttagttataaagctttcggcgttcttccaggaaagattgaagttattaatttaatagaaggaactaagtatgagtacattccaaaacaggaagatattataactggaatggctgatttatctagaatgaaagaaatgttgcaacaacctgagcattatacagagcgtcattttcgttctgagtgtataagttgtgcatttcgtagtgaatgccaaggggaagaagtaaagaaagaagcggagcagaagaaaaatatcgtacattaaaggatgcaactttgcatccttttttgttgttgacatgaaaagcttttcatcatttaccgtatatttatagcagattttaataaagtgaatctttaatcagtgggggttttgtcaatcccccactgattatcagccctcattaatcgggctacccgcgaatagcaggataaagggaggaataatcaatgaaagatgaaacgaaagtttttcaatggttaaaaagaacaaaatgctccttttgaaattcaactgcaaattttacaggcatttcaattgtataaagtcattgttgaaatggataaaaagttaatgttgtatgaagagagagt

SEQ ID NO: 1368 - DNA, 17222 bp, Bacillus thuringiensis
ctttaagctaattctatctcgtttttgtgtaaaaaaaagagaaggactccgatccttctctccgtattacttatagcacttccgcatgtccattataaacaattccgcgtgctgcatcaactgttacttcttggccattttttaaagttgctgttacgcagtttacaccaacgataacaggaataccgattgatacgcctacaacagctgcatggcttgttaagccaccttcttctacaactaaagccgcagctttttcgattgcaggaatcatatctttatcagtgcttgttgtaacaaggatatcaccttcgtttacgttcgctacagcttcagcagctgtttttgctacaactactttaccttttgcagctttacgaccaattccttgtcctttagcaatttcttcaccaacaacgtggattttcattaagtttgttgtaccagtttcagcaactggtacacccgcagtaatcactacagtatctccaagtccaattagacccgcatccatgcctgtttgaattgctgtatctaacatttcgtcagttgaagctgcgcgcttctcagccataaatgcttgtacaccccaaacaagtgcaagacgacgtcctacttgctcgtcagatgttacagctacgattggagattttggacggtatttagagatcattttcgcagtatatccactttctgttggagctacgattgcagctacatcaagagcaagtgctgtatgcgcaacagattggctaattgcatctgtaattgttggagtgaactctttaatacgttttttgaacatatcttcatattgtaatgatttttcaacacgtaccgcaatgttagccatcattgttactgcttctaccggatattgtccagcagctgtttcacctgaaagcatgattgcatctgtaccatcgaagattgcgttagctacgtcacttgcttccgcacgagttggacgtgggttacgttgcatagaatctaacatttgtgttgcagtaataaccggtttacctaacacgttacattttttaattagacgtttttgtactaacggtacttcttctggtggaatttctacacccatatcaccacgagctaccattaaaccgtcagaaacttctaagattgaatcgatgttgtcgataccttcttggttttcgatttttggtacgatttggatgtattgagcgttatgctcttttaataattcacggatttctaatacgtcagacgctttacgtacgaatgaagctgcaatgaaatcaactttttgctcgataccgaagatgatatcttttacgtctttttcagtgataccaggaagcttaatgcttacgtttggtacgttaacaccttttttattttttacagttccgctgttaagaacttttgtacggatgtttccatcagctttttcgattacttctagttcgataagaccgtcatcgattagaatacgagaacctgggtctacatcgtcataaagaccagcataagatacagagaacttctctgcagtacctaatacttgctcagtagaaagaactacctctgcacctgttacaagctcagcttgtccgtctacgaagtcgtgagtacggatttctggaccttttgtatcaagtaagataccaactgttttaccagttttctttgaagcttcacgaatgtttttaatacgagctccgtgctcttcatggctaccatgagagaagtttaaacgagcaacgttcatacctgcttcgattaattgctctaatttttcaatactttcactagcaggacctatagtacatacaattttagttttacgcatattgcacctccgaaaattatgaaaccgttcccaaatatctgacattacgccgattagatggataattctttagataattgatacatatctttatcgattgtatgcttttgagctaacgcttcgataatgtcatgatcaacaagtttattatcttgaatacctacacaacgtccacctttaccagcaattaacaactcaactgctcttgcaccaagacgacttgctaatacacggtcttgtgcacttggtgatccaccacgttgtacgtgacctaatacagttacacgagtatcaaagtttgttgcttcttcaatgtgcttaccgatgtcaattgcacttccaacaccttcagctacaatgataatactgtgttttttaccacgttcgctaccacgttttagacgagcgattacatcatccatgtcatactcttcttctggaattaagattgtttctgcaccatcagctaaaccagcccataatgcgatatctccagcatgacgtcccattacttcgataacatatgtacgttcatgagatgtagctgtatcacggattttatcaattgcatcaataacagtgtttaaagctgtatcgaaaccaattgtgaagtctgttccagggatatcattgtcgattgtacctggtacaccaacacatgggaatccttgttcagttaattttttagcgccttggtaagaaccatctccaccaataacaacaagtccttcgataccatgtttctttaattgctcgataccttttaagtcgactactgggtgtttaaacttaggacatcttgctgtatataatttcgacccaccgcggtggataatatctccaacagaaccaagttctaatttttcaatgtgaccagaaattaatccagcgtatccatggtaaataccatatacttcaatatcatggaaaatcgctttacgaacaactgcacgaatggcagcattcataccaggtgaatctccaccacttgttaatacaccaatacgtttcatttgtactcacctcataaagattatttgccttataataaaataacacgaaaaaatataaaaacacaatggagaagatgtgtcttttcataataaaaacgtgcattcgcgaagaggaacgcacgcttttcttattttatcccaatggaagcgtttgaaaacgaaacttgcccaattttcatatatttttcataacgtttttcgattaattcatctttcgaaattccgtttaattgttcaaaagtttttctaattattaagtctatattttctgactgtttcaaaatattacggtgagctccaccttttgtctctggaataatttcatcaattacacctaattctttcaaatctgctgctgtaattttcattgcctctgcagcttcctttgcttttcctgcatctttccaaagaattgccgctgcaccctctggtgtaataacagaataagtggaattttctagcatatgaatgtaatctcctactccaaggcctagcgcaccaccactaccgccttcaccgataacgatacaaataactggtaccgttaaacctgccatctcaaataggttgcgggcaatagcttcactttgtccacgttcttcagctgctttaccaggataagctcccttcgtatcgatgaaacaaataataggacgattaaacttttccgcttgtttcatgagacgcagtgcttttcgatatccttctggatgaggcattccaaagttacggcgaatattttctttcgtatcttttccgcgctgatgcccaattacagttacaggcatccctttatatttcgcaatgccgccgacaatcgctgcatcatcgccaaatagacgatctccatgacattcgaaaaaatcagtaaataagtgctcaatataatcgagcgttgtcggtcgttctgcatgacgagcaatttgaacacggtcccatacttttagattgccgtatatatcttcctctaaattttctagcttttcttccaaaatacgaatctcctcactgaagtccatctggctgtttttcgtatagtctttcagttcacgaatcttatttcttagctcaacaactggtttttcaaattctagctctgccatacagccacttcccctccttgatgaacttctaaaatcttacgaagcgattctctcatatcatcacgatgcaccaccgcatctaattgaccatgatctagtaagaattctgccgtttggaaatcttccggtagtttctcacgcaccgtttgttcaattacacgtctaccagcaaatccgataagtgcacctggttctgcaagattataatcaccaagtgaagcgaaactcgctgaaaccccgcccgtcgttgggtgagtcataacagaaataaataatcctcctgcattactatgctttttcaaagctacgcttgtttttgccatttgcattaaacttaatataccttcttgcatacgggcaccacccgaagcagtaaagataataaatggaacttgtaagtcgtacgccttttcaaccgcacgggcgattttttctcctactacagagcccatgctccccattcgaaaacgagaatccattactgcaacaacaacaagcatgtcatcaattgttccttcaccagttacaaccgcttcgttcaattcagtcttcttacgatcgctctctagtttctcttcataacctggaaactcgagtggatttaatgaaaccatttctttgtcatactcacggaatgacccttcgtccaatatactatcaagacgttcccatgcattcataggatgatgatatccacaattcacacatacttttaaattttttagaagttctttcgtatacatgatttttttacattccggacattttgtcataacgccatctggcacatcttttcgtacttgttctgaaggtattgcagcgtactttttctttttcacgaataaatctcttagcacaatttgacccccttcgttgagagctaaggttagcgtaagaagaaaatggggctaacaccaaagtttgatgttagccttatcttctcaatctgtctaataacctcactctttacgtttaactttaaccgctacgcggtagaatgtttgtcataacgtgtcatggtcatttcgacaaattttatacattacgagtgaaactgtatattctctactaattcatcgtaaatttttagtgcatcattttcttgtttttcttccaaagtagcgtaaagctttctatacatatcgatagaatctcttgaaactttacaagaaagcgttgatacgtaatcatttacgatcatccaaatgcgatatagtaaataattatcgacttgttcaataagtgttttaaagaacgtttgatgaagcgttgggattgagttttcatttccttcaagtacttggtgtaatttacttagcactttagaaaacgtttctttcggtaaattacatacaattcgaatcatatctttctcgagtaatcgtttcgtttgtaataaatcacgaattgttttctcatcttgcaataagaacggagcaattaattgtacaagaccgttatcataaaagtttcgaataaacgtcccttcaccacgtctcgtttcaatcaatcctaccagttctaaagcacgcaatgcttctcttacagaggaacgtcctacgtttaagcgtgaacttaactcacgctcagacggcaaacgatcccccgccaccaatccatcctcttccataatggaacggattttttttacaatttcgagatatacttttgtatttgatgatgtcaatggaatttcctcgcttattctttaccaatcagcgctaattgttttgttttttcagcgatctcatttggatctacttgacggcgagctactcctgtctccattgctgcttttgcaacgtaagccgctacttgaggcgctacacgcgcgtcaaatggtgccggaatgatatagtctgcatttaactcatcttctgctacaagctcagcaatagcctgtacagctgccatcttcatttcttcgttaatttgtgtcgcatgtacgtcaagtgcaccgcggaaaataccagggaacgccagtacattatttacttggttcgggaagtcagaacgacctgttccaacaacagctgcgcccgctgcttttgccaattctggcataatttctggaactggattcgccattgcaaaaataatcgcatcgtcattcattgtacgaaccatctcttctgttaatgcaccttctgcagatacaccaatgaatacgtctgcaccttgtacaacatcagctaaagaaccttctatacgattcttatttgtatattttgcaacttcatccttcaccggattcatacctgtaggacgaccatcatagattgcccctttacggtcacacataataatgtcgcgtacaccatagcgatataaaagtttaataattgcaatacctgctgcacctgcgccatttgcgacaactttaatgtcagacattttctttccaactaatttcagtgcatttacaagacctgctactgttacaatagctgttccgtgttgatcatcatggaagataggaatatttgtttcttttttcaaacgctcttcaataatgaagcagtttggtgctgcgatatcttctaagttaacgccgccaaaagttggctccattaattttacagtttcaacaattttatctacatcgtttgtatttaaggcaattgggaatgcatctacaccagcaaagctcttgaataatacagctttaccttccattactggaagagatgcttcaggtccaatgttaccaagaccaagtacagctgttccatctgtcacaactgctaccatatttcccttcatcgtatattcatataccttacttttatcgtcataaatttctttacaaggttctgcaacccctggagaatatgcaagacttaaatcttttgcattttctacttttacttttgatacagtttctaattttccttgatgcactttatgcatgtgaagtgcttcttcacgaagtgttgacaaactatccactctcctcaaattattcttgctgatatcaatttctccaagtggtctgaccacgaacactactactataataatcgaagtgtagggaaattgtccattatattttcacaactacattttcttccccgacaatttcacgaagtgctcctaaacattcttcacttggatgaatcgataaactccgagataattgtaccattttatgttccttttcataataaattagtactttcgcaaaacctgaatagtcgaacaatattttcgtaacccgatttaaaagctttttctcatactgagatggcaatttcacgtaaacagatgcgtctttcttttcttcataaacatccatttcctctagcggatatagtccatttacaatccattgcagcttatgatttcttagctcaatcgtaccgtcaactaaaacaattgctccttcttgcaacttatccgagaaatgtatatacgtttccgggaagaggaccgcttccatttcatcattttgatcacagaatgtaataaatgccatcttttgaaactttttcgtacgaatcactctaacacttgttatatacacaatagctctttgtacttttttcttgtgtcgcatcgcctgagcgagagatggaatttctaattcttttgctaacttcacatattgcgctgtcggataacttgataaataaaagccaagtacttctttctctttatttagttgttcaataaaagatagctcttctccttgtacatattttgattttggaacagcatctcctaaatcacgtgcgagattcgcgtactctaacgcccctttaatacttttccataaattcgttctcgaaacaccaaaatcatcaaaacatcccgaccagacgaaagcttctaaattacgctccgttacgaactttgacggcatacggagacaaaattcaaataaatcttcgaacatttttttctctcgttcttctaataatgccgtcactgtagccattccaatatttcggatcgaaagtaaactgtaacgtatcgcattcccttctatttggaagttataaccacttctctgaagagacggcggcaaaacgtgaaaacctttccgcttcgtttctcgtatatactgtacaattttatcttcatttccaattgcgcttgataataatgccgtcataaattccagcgtatagttcgctttcaaataggcaagctgatatccgatcatactgtaagctacagcgtgacttcggttaaaaccgtaattcgcaaatcttacaattaaatcataaattttttcagcagacgtctcatcatatccatttcgcaaacatccctggacgaaatgcttacgttcctgatctaaaatatcacgattttttttactcactgcacggcgcagtaaatctgcttctccaagcgaaaaccctgctaacttcgatgcaatttgcataatttgttcttggtatacaatgacgccgtatgttctttctaaaattggctttaaatccggatgtaaatattcgatttttctttttccatgtttcgattcaataaaagtcggtatctgttccatcggtcctggtctgtataacgagttaacagctacgatatcttcaaactcattcggttttaacccgcgaagtacatttcgcataccgcctgactcaagctggaatacacctgttgtatctcctctccctaataattggaatgtcttttcatcttgaagaggtaagtttcttatatcgatttctttcccagttttgttcgcgataaattttataatattttcaagtaacgttaaattacgtaatcctaaaaagtccatcttaagcaacccaagttcttctagcgcatcggctggatattgcgtaacataaacatcgttatgtccttcttgaattgctacactgcctgttagcggttcttgactcataataacaccagccgcatgaatagacgtatgacgtggtaaaccttctacacgttttgcgatttcaaacacacgctcatgcaaaagattcccttgtataaactcacgaagtgattgtgattcttcatatgcatcttttaacgttataccaagctttgatgggataagttttgaaaatatatcaatatctcgcggcggaagccccattacgcgggcaatgtctctaattgccgcttttgctgcaagcgtaccaaacgttacaatttgcgcaacacggagctgaccgtatttatctttcacatagcgaatcatctcatcacgtcttacgtctggaaaatcaatatcaatatcaggaagcgtcacacgttcaggatttaaaaacctttcaaataatagatcgtattcaattggatcaatatctgtaatttctaatacgtatgaaacgagtgaaccagctgccgatccacgacctggtcctgttagaatatgattttcatgtgcatacttcataaaatcccatacgatgaggaaataatcactaaatcccatacgagaaataacatttaattcatgatccaaacgctttatatgcacttctttcggttcaccatatcgtttccgcaaaccttcttcacaaacacgacgcaagtatatatcactcgtttcattagacggaacaggaaacttcggaagttgatttacatggaacggtatttctacttggcaacgctctgcaatttttattgtattttggattgcttccggcgcatgggaaaatagtgcttccatttcatccgatgactttaaataatactgatctgttttcagcctcggcctatctggatcagtcattttcgttccactttcaacagatagtaaacattcgtgaacaagcgcgtcactttgattgatatagcgcacatcatttgttgcaacgactggaatattaaccctactaataaattcaggtagtttctcttgtaaaagcaactcatcttgaattgcatgatgctgcaaactcatataaaaatggccgaacatattttgatacgtgcgagctacttcttcagcctgactctcattgtcttctagtaataattgctcaatttcgccatctttacctggcgaaatagcaattaatcctttcgcataatgcgcaagccacttcttaggaataccttctttggactttgtcataatactgctagaaatctttaataaattttggtagcctatttcattctcagcaagtaatacaagcggataagacctttcttcttcttcactaaaaatagaagcggttaatccaataacaggctgtataccatgtttcttacatgctttataaaacggaataacaccatacataacattttcatccgtaatagctagcgatgaaaaaccaagttctttcgccctgactacaagctcatcaattttacaagcactttttaataaactaaaaacggtttgacattgtaaatgcacaaacttcactgttgtaccctctctttacctatttgactacttttattataggtgatgaggaaagcggaaatcaaaacatacttcttatactttgtccatatatatgaagaagaaaggggaatgacgatggatgtaagagaacatacttttttctctctgcttattattagttattttattgcctttggggttatacttggcggttcattaattggtggatttggtgcgtttcttatcggaaaaccagctctaacttacattaatcaattcgcccaaaatttaagaatttgggcactcgttgcagcaatcggcggaacattcgataccttttatagctttgaaagaagtttctttggcggagatatgaaagatatcgtaaaacaaattctccttatttttttcgcaactggtggtatgcaaacaggtctcattattattaaatggctaacgcaggaacatgtatgagagtaccaagtgccaatacagcaaaaagatggtacttagtattagctggtgctgctgttggaggcgtgttgagctggtttatttttttgtacatatacggtgtttttcaacaagaacaagctagtaaaatagcagaacaaagagaaattatagaaaaacaagaagcaaagctccacgtccttctcgaagatcaagaaaaattgaacactgaaaataaacggctcttaaccattcaagagattaaaataaaacttatcaatcgagaaaaatacgatttagacaatcttacactcgaaaatatgactacatctattcataatgatctccagcatcttttaacgaaaaacattcaaagtatcgcaaaaaataaagacctactaaaaaaggtaatcgaaaataaaacatacaaacattacgatcgcctataccgttttaaagtcgatacaatatcttttgatacagtgcttgaaattagcattactatagagaaagaaaaataaagaaggagggctttagcgccgctccttcttttcgttctaacatatagtcttttatttacaaatctcacgtaaatcagcaaaaagacgatccgcttcttcccaagaagatgccttggcaccagaagccatcggatgccctccgccgttatattgcattgccaatttgtttataactggtccttttgaacgaagacgaacacgaattacgtcatcttcctctaaaaatagaacccacgcctttaatccatcaatattgccaagcgctccaacaacaccagatgcttcagaaggaagtacatcaaactcttctaatacttctttcgttaatttaatgtaagctgctccttcttctaccatcgtaaagttttgtaaaatataaccgtttaaacgagcaattttttcttttgtcttatacatttcattgtataaatctgtgaatttcacacccatatcaacaagctcacttacgtaacgaagtgtttttgctgtcgtatttgggaataagaaacgacctgtatctccaacaattcctgctaaaataaggcgagctgcttcttttgttatttttaatcctttatcttttccatagttataaaactcataaatcatttcacttgtagaactcgctgtcgtgtctacccacgtaatatctccatatggatcttcatttggatgatgatcaattttaattaacatcttcccttttgtatagcgttgatcgtcaacccgttcttgattcgcagtatcacaaacaataacaagcgcattttcgtatacactatcttcaatatcatccattactcgtaagtatgctagtgacggttcattgtacccaaccgtataaatatttttctctggaaacgattcttgtagaattgtaccaagaccaccctgtgaacctaacgcatctgggtccggacgcacgtggcgatgaataataattgtatcaaactctttaattgctcctaaaatttgctcatgcatatgtataatctcctttttaatcaacttcttcactttatcctccattataacggaaagtatttcattcatgcgaacaattgctttataataaaagttagaaagtttagatatttctttttcttttctattatttttcacaaagcgatgggagtgttcactatgccagtattagtcttctgtattatcatctcatttatgttgtacctcttttacaaaacaaaatactttcgtacaaaccgcccaatggagaaaggttggctctcaggaaaatccgcaatggcactcggttcattcgttttatttttcgggataaaccaattctttttagaactttcaaccgctcgtattatcgttggtgttttattcgttctatttggtagtgcaagtgtatttaacgggtttcgccaatacaaacatttcttgccattagcagttaaagaagccgaagtctatgaagcaacataaaaaagcatcaatattgtgatgcttttttacgtcccttaactttcaaaatcatatatgcaacaaacgcagatggtatattaaatgggttaccttgtacatgaaaatgtagttgttcttctccaaaagacattttttcatatagctctcgctgagataatcctgtcttttcctttttttcatgtaaaccttgtaaatataaatattggatcggtatcattacaagaaagtaaaatagtgcgatactaccaaaaaagagtacggctgacgacataatgcataccacctttcagaattccattttcttacaatataatcataacacaatatacaactaaattgaattactattctgtcttttcttacgttacttttccactccactccatacatatttcactaaaactcccatctaaaatcatgcctttcaaatttaaaacaacaaaaaaagatggaacaaatcaaaacgatttgttccatctttttatttatcgattaactgcaccataagtaatgcctttccaacaacattaccttcatgatgcacctctacatcgaccttaccaaatttacgcccaatttctaatactttcggatgaacagatacaacattatcaatttgaaccggctttacgaaataaatcgttaagttttcaacaattaaatcgcttttcttttgcgcacgaatgacgcgatttgtcgcttctgtcacaattgttgcaaatacaccgtacgataacgttccgattgagttcgtcatttgcggcgtcaccgaaaattgatatagatgctcattcttcgcttctttcggcgtcataaattgattcgttacaatatcatcaatggtttctccaacttgtggctgccgttgaatcatttgcagtgcctgaagtacatcttgacggctaataataccttgtagtttatttccttcatcaacaacaggaagtaactcaataccttcccacaccatcatacgtgccgcagctgcgacagacattttaccgttcactgtaattgggtgttttgtcatcactttatcaattggtgtttctttcgctacaccgatcatatcttttgaagtcacgattcctagcactttgttactttcatcaacaatcggataccttccgtgcatcgtctcttcattataggcatgccattgctgcactgtatcatttggctttaaatataacgtttcttcaattggcgttaaaatatcttcaacgagtacaatttctttcttaataagctgatcgtaaatcgcacggttaattaacgttgcaactgtaaaggtatcgtaactacttgaaataatcggcagttttaattcatctgctaatttcttcacatgatcttccgtatcaaatccgcccgtaattaatacagcggctccagtttctaacgctaattgatgtgcgttcgtacggttaccgacaataagtaagttcccagcttctgtatagcgcatcatcgcttctaatttcattgccccgattacgaatttatttaacgttttatgtagtccttctctgcctccaagtacttgaccgtcgacaatgttaacgacttctgcatatgtcagtttttcgatattctctttcttcttttgttcaattcgaattgttccgacacgttcaattgtactaacataccctttattttctgcatctttaattgcacggtaagcggtcccttcacttacactcaaatctttcgcaatttgtcttacagaaattttatggcctactggcaggctattaatatgttctaaaatttggttatgcttggtagccaaatggtttcaccatactttcttttccctaaattcttcatgtgttgtactttcagtatactatattttcaaaactgttacactctctctttgcatacctgtactattttttttataacaaaatgactcttacattccaccagtcattctattacaacaatgtaatgctattgtcatctcattcgatagttcgcacacttgattacctatacaattaagacaagaaataaaacaaaggagcgaacacatgatgaaaaaacttttagaggttgtaggtgctgtatttttagctttcgtagatgggaaaaaagttacaatggaattgaatgaaacacctgagcagccacgtaccaaaagaaaagaatcaccaaaacaaatacaagtattaaaagctgtcctacacacgtaaaaacccttcacttttcttttcaaatgaagggtttcttttctatagtgtaatactttctccagcttctaatactttccctgtacaattttgtagcttttctacaaattgatatggatcttgttcaataactgggaacgtattgtaatgcatcggtacaacagttttcgcattaatccattttgccgctagtacagcatcttctggtcccattgtgaaattatcaccaattggtaaaaatgctagatcaactttatttaattccccaattaacttcatatcagagaatagtgcagtatctcctgcgtggtatacagttctctcttctgctgtaaataaaatacctgctggcatacctgtatatgtaatcgtcttattttcttcatcaatataactagagccgtggaatgcttgtgtaaacttcacttttccgaagtcaaattcatgtgaaccaccaatatgcatcgggtgtgtatttacaccttgccaacttaaaaatgttgctagttcaaatggcgctacaacaactgcattatttttcttcgcaagctctactgtatctccaacatgatcaccgtgtccatgcgataaaaggattgcatccacttttacatcttcagcttttaaatctgttttcggattacctgttaaaaacgggtcaattaaaataactttttcattcgcctcaattttcacaactgaatgtccatgataagatactttcattattacattcctcccctattcacattctcactttttattctacatgatttttcaattccctgtcttttctaacatctatttacttgtcataacactttcttccgagttaaagttatatttgtaattaaatatctcgggggtgccaatcgatgaatgctagattagaaaatttaatgcaatggctaaaagaaaaaaacgtagaagctgcgttcttaacttctacaccgaacgtcttctacatgacaaacttccactgtgaaccacacgaaagattacttggtatgtttgtattccaagaaaaagaacctattttaatttgccctaaaatggaagaaggtcaagcgcgtaacgctggctgggcacatgaaattatcggatttactgatactgacagaccatgggatatgattgcaaaagcaattaaagaccgcggcatcaatgcaaatgcagttgcaattgaaaaagaacatttaaacgtagagcgctacgaagaattaacgaaattattcccaaatgcagctttcaaatcagctgaggagaaagttcgcgaacttcgtttaattaaagatgaaaaagaactttctattttacgcgaagcagctaaaatggcggactatgctgttgaagttggtgtaaatgcaattaaagaaaaccgcagcgagctagaagtattagcaattattgaacacgaattaaaaacaaaaggcatacataaaatgtcatttgatacgatggtattagcaggtgcgaactctgctcttccacacggtattcctggcgcaaacaaaatgaaacgcggcgatttcgtactatttgatttaggcgtaatcattgatggttattgctctgatattacacgtacagtagcattcggtgaaatttctgaagagcaaactcgcatttacaacactgtacttgctggacaactacaagcagttgaagcatgtaaaccaggtgttacacttggcgcaatcgacaacgctgctcgttctgttatcgcagatgcaggttacggtgacttcttcccacaccgcctgggtcacggacttggaattagcgtacacgaatatccagatgtaaaagctggcaacgagtctccattaaaagaaggtatggtcttcacaatcgagccaggtatttacgtaccaaacgtaggtggcgttcgtattgaagatgatatttacatcacaaaagacggatcagaaattttaacgaaattcccgaaagaattacaatttgtaaaataataaaaaaggcagcgggattgctgcctttttctatttctctactatttcaaatttagcaccatcttctcctcatacttatcatcccatttaatcacatcttctataggttcatctttagagataggcgcgcaacttacacaagaagacttcatttcaatctttgctcctctatgaccttctgacgtttgtgtcattgtactaaaggctccattaatagcaatctctaagttttttaattctgtctttccatccccgcccttatatttttacgtaaacatccccccttcccccccatccttaatatgccctttataaaatgcagaacagctttt

SEQ ID NO: 1369 - DNA, 18672 bp, Bacillus thuringiensis
catacaattaactctggtgtaaaactagatccaccgccgattgtagcaattttaattccagtcatgctttattcccctttcgcttcaagctttttataaagatcgataaactctgctgctaattctttcactgtaatcgcattcattaaatgatcttgtgcgtgaattaaaagaacactaacctctgttttttctcctcttgcttctgattgtatgagctctgtttggaaatgatgcgcttcattaatcgcttctttcgcctttaccatcgcttcatctgcttctaccattttcccctgtttggcaaattgaagtgcctccatcgcaaagcttcgtgcgttaccactatttaaaatcaattggaatggaatttgttctgctgtagtcatcataattaccgccctctctataaggttcaaccgatttaaataccccttcagtttgaacatgtctattaaattattattttatgaatgatagtttggtgttcttgtagatgagtatcatctttttgaacatgatataaaggtaattattctgacgagctataggaactcgccagaataatattttttaaagtgatactgaattgtcgcttccttttgtttcagcttttgcagcctgtacataagtacggtcacacattaatacgaatggatagtaaattactaccgcaatagcaaagttcaccacttgtagtgctgcaccagcgatgcttccgcccgatacaagataaccactaaagattggtggcattgtccatggaactaacgcaactgtttttggtacccatcctaaagtgattgctgtataagaagtaataactaatacaactggtgtaagtacgaacgggataattaacgttgggtttaatacaattggcgtaccgaaaataactggttcgttaatattaaagaaaccaggaccgatagatacacggcctacaccgcgaagctgcgcacttttcgctacaagcattactgccactaagaatgctaacgttgcacccgatcccccgatatatacgtatacatcaaagaatggttttgtgaagatatgcggtacgtcatatgcagacataccatcattaaataatttcatatttttctctaatgctggtaaatagattgggtcaataatccccccaataatatttggaccatgtaatccgaagaaccataatacgtgaataagtagagcaataataattgcacttggtaatgtacccgctaaaccttgtaatggtaattgaattgtttcaaataccattttatgaatgcttgttcccgcaagtttcacagctaattgaatacctgctgttacaatcaaaataacgaatgctggaactaacgctgcgaatgatttcattactgccggtggaacaccatctggcattttaattgtaatatccctttgaacaaagaatctaaacacttctgttacaagaagagccactataatggaaacgaatagaccttgtgcccctgtccacgctaaatcaataccgccttcttttggcgttgtcggagaaataataattaatgcaccgaatgtaatgattgctgctgacaacgcatcgacgccgtaagatttcgctaaattgtaacttatcccaactgcgactatgagggcgagtatagcaaaggaaccagtccacataccgccaccgacatctttccaagcgtcaccaaatgtgcccttcataaagttttggaaagcatcaattggtaagttatttataagtactgcaaatgatccaactaaaataagaggcataactgcgataaatccgtcacggattgcaactaagtggcgctgcgatccaattctacctgcgactggaactaaatatttctccataaatgcaataaacttttgcatttcgcttcccccctaattattttttaagtgttaatgcgtgatctaaaactgcttctccattcatcatgccgtagtgcattggattgataacgtcgattccaacatttttctcgtcagcaagcgttttcattgaagagagcatgtaacgaacttgtggtcctagtaataacacatctgcttgatcgatattcgtttttactgcatccccagatacagcccaaatcttgccttctagaccgcgagcttttgcagccgcttccatttttgtaactagtaaacttgtagacatccctgctgaacaacataataaaatattcatttgaaaatcccccttgtgtagtataaaaaatttatgtttatttatttttctttacgctatttattaatgcaattagcgtgccaactttttaaaaccactaaaatcagtgctttttcgagcattttctttgtgtgttaacgctttcaattagtgtgtcgtccaaaaaatacacagtgtgttataaaacaacacgcttttaacacataactgtatgaaaatagattagtgtttagtcgtctagttgtgtttaatatgaaaaaacactaaaaaaactttttcaatgaaaaataattcattattttaacccactatttagtgaaataaaaaaaccttgcataagcaaggttcattcatccaccgacatcttcctatataactctacaaactcactcgctaattctttcaccgtaattgcattcattaaatggtcttgcgcgtgtaccattaaaagagtaacttcggtcttttcgccaccagcctctttctggataagctccgtttgtacgcggtgcgcctcctttaattcctctagtgcttcttgtaatttagcttcagcttctgtaaactccccacgcttcgcacaatcaattgcttccattgaacaacttctcgcgtttcccccatgcaagattaaatgaaaagctttcgtctctatcgtatccattgtagttctttactcccccttttcttccgccagtttttgtttatcccatatttttaagaacggtaaataaatgaagaatgctagcgcaaagttaacaagttgcaaaataacacctgaaattttcccgcccgatcctaaatatccactaaaaagaataggtgtcgtccaaggtacagcggccccactcggacgtgcaacccatccccattccattgcaaagtaagaaacaattgttagcacgactggaactaatataaatggaattagtaaaagtgggttcatcacaatcggcataccaaaagttaccatctcattaatattaaatataccaggtgcaattgacaatctccctaaactttttaattgttgacttcgtgcaaatagtaacattccgacaactagagcaagcgttgcaccagaaccgcccatataaatccataagtcaaaaaactgtgccgtaatcgtatttggtacatcttgcccagcttgaaaagcaactcggttttgatccattaacgacaaccaaacggggctcattacaccaccaacaatagtagcaccatgaattccacaagaccaaagaacatgaacgagaataactgctattatcgcgccccaaagactagcaccaagtacactaagcggttcctgtaaaatttgtcctacaatattatggatactgccaaaagaagtattttctataattaagcgtaaaatccaaataactgttacaacaataaatcctggaacaagtgctgcaaatgaacgcgtgacagctggtggaactgtctctggcatctttataattatctttttttgtacaataaaccgataaagttcagtagatataagtgcaataatcattgctacaaataacccttggcttcccattaatgcagctgggatagcgccttctacaagtacactttcttttgtacttggtataatatatgcaacttgaaatggagtcgcaagtaaaaacgtcacaagcgacaatgccccggatgctaaagcatctactttataatactctccaagtctgtaagcgattccaaaaacagctattaaagccattatattaaaagttgcactaactggataccctaaagctcgctgccaattctccccaaacaaacctgccataaaatcgttatatcccggtatcggcagtgcactaataatgaggaaaaacgatccaataattaagaaaggcatcgttaaaataattccatctcgaattgcttgtaaatgcctctgctctgcaaccttccctgctaccggcatcacatacttctctaaaaaccgtatcatctatcccactctcctcatggtttcattaacaaagctgcttgcaagatagcttctccattacaaagtccgtaatgaacagattgaatgacatcaacaggtatccctttatccttacatagttctttcattttcggtaataaataacgtacttgcggtccaagtaaaaggacatcagctttatcaatatgactattcacttcagaacctgatactgcccagattgttacttctatccctcttgcctctgctgctttctccatctttgtaacaatcaaactggaagacattcccgctgcacagcaaagtaaaatatttatcccgcttccctccccctttttctctacctaagttatggtgcatcccttgccaccactaggttacaaatatatatgtctagatttcctgctgtatgccgagcttaaaaacaaaaatttcttcgttttcacgctattccatttatccgtattctcctagtaaagaggacgctaactcgctataataattcagtatgatttttttaattgataggaggatatatttatgaaggcatatcgctttccacttattttgttatcttctatcctaattggtggtttcattggttatttcatgggtgccgatgcagttgctttaaagccgcttggtgacattttcttaaacttaatgtttacgattgttgtacctctagtgttctttagcatcgcatcgtctattgctaatatggatggattaaaacgtttcggtaaaattatgtctagtatggctgggactttcttatttacaagtattttagctgctatttttatgattattgtcgtgaaagtattcccgccagcacaaggtgttgtactagaactaacacaacctgacaaagccggcaaagctgttagtgttgcagatcaaatcgtcggtattttaacagtatctgacttctcgaagttactatctcgtgaaaatatgttagctcttattttcttctctatcttaatggggattgcaacttcagcagttggcgaaaaaggaaagccatttgctacattcctacaagctggtgcagagatttcaatgaaggttgtatctttcattatgtactacgctccaatcggacttgctgcttacttcgcagcattagttggcgaattcggaccacaacttcttggaacttacttccgagcagcaatggtatactatcctgcttctctcatttatttctttgtattcttcacattctatgcataccttgcaggtcgcaaacaaggtgtacaagtattttggaagaacatggtctctcctacagttacatcacttgcaacttgtagtagtgccgcaagtattccagcaaacttagaagcaacaaagaaaatgggtatttcttcagacgttcgtgaaacagttgtccttcttggttctactcttcataaagatggctctgttttaggcggcgtattaaaaattgctttcttattcggtattttcaacatggaattcgaaggaccgaaaacattagcaatcgcacttgttgtttctctattagtaggaacagtaatgggcgctattccaggcggcggtatgattggtgaaatgttaatcgtttctttatatggcttcccgccagaagcattgccaattatcgcagcaatcagtacaatcattgatcctcctgcaacgatgttaaacgtaacagcagataacgcttgtgccgtaatgacagctcgccttgtagaaggtaagaactggatcaaaaacaaatttgcttaataaatagaaagaggatgctcgttttgagcatcctctttctttgttgttaatccattccgccacaaatttgttaaaaccttcacaaatattccacacctcttatccattctccgtactataatcatgtatggaaaaggagatggacacaatgacacaaagcgcaccagaatttaaagttttgcaaagcattgcatttctcgctgtcgttttgcaaagttctttattatatacaatgaatcaaggaaatgtcttacttgagcaatccctcattatgggcatgctatttaatcttgcaaaattctcagcaccagcattcatatttatcgttggatttcacttaattcgtcactatacaaagcaattagtatataaagaatatatttccgaaaaagcgatacacttactcattccttatttcttttggtctattctttacttattaacaacaaataatcttattacgttacaaagtggaataaaaagtttattactcggaacagccgctccccatctttggtacgttattatgatgttccaaattcacttattgttccctttactatgcacacttttttattggtttcaaaaacgaacagaaaataaaaaagacatatataaatatatgacctttttcgcttgcctatattttctattaatgtggttctcttctcactatatttttaatggagaaaaattaacaagttcaacaattttacattatacagatcgatcatttctattctactcattctatttcgttatgggcggcattgccgctgtagcactaaaaacttggcgtctattcgtcatgaaacatatcccgcttataacaatattatttttcatcttatttttattcatcaattatgagttgtttagtttttacggagcaaactctattcatttaactgtttctacctatttaaaaccatctatgtttttatatatcgtatgcgaaattatcatactgtatgtgttatctattatgatagtacagcgtcgtggtttcttatataaaacgttacgtttcattggtaattacacgtatggtgcttatttagctcatttattcttcttgcaactatgcacaaaacttctttccttattcacactgcaagaaaatactatattatatgccctattactatttgtgttaacggccattatctctatttcaacaatggtcatttgtagcacaataccatttcatacttggattacagggccttctcctacaacaaagatgaaatggacgaaggttgtattacgaaaaaatcataaaaaactattcaagccatatatttgatataataatacgcatataaaaagaaagcgagagacacctatgattaatcaagttggacaaattatgctatatgtaaataaccaagacgaaacagtacaattttggacagaaaaagtagggttccaaatcattgcggaagaaaataacggaaacggattccgctggattgaaattgcaccggcgaaagaagcaggaacaagcatcgtccttcacgataaagcgttaatcgcgaagatgcaacctgaactaaacctaaatacgccttcacttatgttcttctcaaatgacttagaccgtctatataaagatctttctgagaaaaatgtcacagttggacaggttgtagatttacctactggtagagcattcaactttgctgataatgaaaataattactttgcagtaatggaacgcaaataaaaaataagctatccgaaaaaatcggatagcttatttcattttaagaaacttgttctgcattcgtttctctatgctgtatatgactcgtgatccaagcaattccaccggcaacaacgagataacataacaatattaaaatttgcatttgtaattgcgaccaatctcctaaagaaataacatcttgtaatcctctaagagaatgagacattgggagaaactgtccaattttgctaagaacagctatgtttaattctcctgggaaagtacctccgctcgtcgctaattgcaggacaagaagcgttaccgctaagaactttccaacaagaccaaatactgttactagcataagaataaatgtcataaacgtaaaggaaataacaatacttgataaaacaaagagtggcacacttgcgacttctaatttcataacacctagcacaactacatctacgagtagcgcttgaatgagtccaattaaatataccaatcctagtttattaataaaatgtaccgttccgcttaccttcatgttttgtctgcggccaagaggtaaaatattcgatgccataattccgccaacataaaatgcaagtgataagaaatatggtgcaatgcctgaaccgtagttaggaacgtcagaaactgttgacttcactaactgaactggctctgagaacatcgtattgcgtgcatcatcattacgaacatccgctatcttctctgcgccctctcctaatttcgtagaaagttctttcgcaccatcatcaagtttaacaagtccatttgttaatttactagcaccgttattcagctccgttccaccactcgcaagctgatttacaccttcttgcagggatgtaaatccatttccccacttcataaatccatcagccaaattcgatgcaccatctgctatctttttcgttccagcagtagcttcatttaacttaaatccgaatgtattcatgccttcttcaatcttatgttgaccatcagttagcttcttcgcaccttgtgtcaattgttgttggctattatttaaagtacttgttgctttagctagtccattagacgtagcaacaattttttgaaaagcgggatcttgctgcacttctggatgatttttcacgtactcttctaattgttgtttcacactattggccgccccatccgcttttacttgcccttcagcaagcttctcacttccgctcacccattcatttgtaccagcacttaattcactaactcctgattgtaacgttttttcaccttgtgctaataactccataccactatgaagtgatgtcgctccttgactcagctcatttgctccccccgttaaggcagattggctagacgcaagcttgtcacttccttctttcaatttcgatgtcccgtcacttaaacgatcaataccattcgcaagctgattcgctccattttttgcatcggtcgttccttcatgtaacttctcagcaccattacttgcatcactcaacccttgtgccaaatcttgaaactttgaaaaaacaccttctgtatatgatttcgtaatactgtttgagatttttgttttcatattttcaacagctgtcgttccaatttgagccgctacaaagtttttacctggatttactttgtactgcaactttgctggctctggtttctcatccataagtgtacttacctttttagagaaatcttccggaatcgtaacaaccatataatatttatcttcttttaacccttcatccgcacttttttctgatacgaaatgaaaagccaattccttattctcttttaaatttttaacaaaatcgtctcctgcatgaattgttttttcatccatcgcagcacccttatctaaattcacaaccgcaacaggtaatttatctaattttccgtacggatcccaatatccagctaaaaagaatcctgaataaattaacggaacgattaataaaaaaattaaagcgatacgtccatgtttatggtgccacatcgctttccaatctttaaatataagtttaattcccttcatgaaacatactcctcttctaatttaacacccttcgaatggtttaacagatttactatacacgtcactttacatactgtataatacatctttaattattaattcattccttttggtctatagaaaggagactcgaaatggaactgctccagttaaaatactttcagacagttgcacgactagaacacatgacaaaggcagctgaagaattgcatatcgcgcaaccttcactcagcaaaacaattgctagactcgaaaaggatttaggagtccctttatttgatcgccaaggccgacagattactttaaattctttcggaaaagtatttttaaaacgagtagaacgtatttttcatgaattaagtgaaggagaacgagaaattaaagatttagccgaattacaacaaagctctattacactggccgtttctattccaagaatattaccagaactacttggctcttttttactagaacatcctaacgttcgattccaacaatttcttgcatccactccttctatgaaacgacaactagataatatagaaattgacttttgtatctcctctgtgccaattgaaggtgaggagattgtttgggaaccacttattacagaagaaattttcttagtcgtcccttcaggccatcgtttatcaggccgaaaaaatatccacctgcatgaagtaaaaaacgaaccgtttattagtatgaacactggctatggatttcgacacttaacggatgaattttgcaaagaagctggtttcactccgcatattgcttttgaagtagatgaaccgaccgtgattagcgacctcattaagcaaggtctcggcatcgcttttgttccaagtttaactttattaaaaaactctactttagcatcaagcaagttgcgtattattgaacccaattgtcagcgaaccatcggattaagttggtcaaaaaaacgctacttatcaaaaacagctcagcaattccgtgaattcgtgattgattacttctccaacattaggacgtaaaattatatcaacaaataaaagttgccaccctcatatggtggcaacttttattgttcactcttttttaattccatttcagctaaaagtggtagtacattatcaaaaatatgcgtattattattttcacctgttacatatccaccataatatctactaaatacgttatcatttcggaatgtggccatatgatcatacaattctttcgcaaactttttatcacctgtttgtagtacgtacaaaatcgttaatccgtatgcggctggcgattcataattcacagtttgttttcccgtttctaaattgtaacgaccgtatagctttccatcctcctggaatttcttctttataaattccaaataagcagttgatgaaagaccacctaaacttcgatgatatgcaacgtatgattggtcaataagattcacttctttatcgtacgtaaatgtaccatcttctttatactctttcgggaatgcccagccatgccttggatagtccgctaaaaattgaacgacttcctgatattgctgagcagaaactttgtcgtacttcttcatataggagaatgcacgtggatttatgtatgatgttgttacaaaattattttgtttccctgcatctgcatcataataatcaacataataattatcttttttattataacgaagtacagcatcacttaattgatcggcaaggtttttataacgctcttccttatacatttcataagcacgatataattgttctataatacgaagatcatctataagtgcatttgtagctgactgcctctctcccttttcagagagtttccataaaacgatatgattcttatatacgaaattatcttgaataacctttacttgctcatcaaataacgcctgatcatctttatcaagtgtatattgtaaccataatcccgctgattctgataaagcttcacgtccctttgcttcacccgtacctgccttagtatctactaaacggtacgtggcaagcgttccattgtcattcaccatatgtcttaaaataaaattttctgtacggtttccttgtaaagctgaccaaaatacaattccacctaaagcgatcaagaagataattccaatccctatatataaacgtttccgcaatcttttcacctccctagtaaggctaaccttaattttatcagaacatacataaatttaaaaagacaatccactagattgtctcccccatttctatccctcgtaaacctctttagaaggtttatatagcgattgtacaagccgatcatattcacgacgtgtaatctctttattatatagcttcaataataaatctctatgctcttttgaaaatgccatctttttaatgacttcaggatacataaaacaccctctccatttcacataaacttcttcttttcgaaaaacagaacttatgttcgcataaaagattataaaagattcctgtaaaaaaaacaaacaaaacatgagaaactatttatttctttctattcaaaatattacaacattatattatcatattcactttttaaatacatatatatttttggtagtttttttgaataaatcttccaattcaatcagaaaataatggcaaaaaagaagaggagtttacatatggatacggtaacattagcaagagcattttttggttcttcattagcattccacattatttttgcaacacttggcgtcggactttcattgatgatttttataagcgaaatactctatcactggaagaaagactccgactatgccattatggcgaaaagatggacaaaggcgtttgctattcttctcggtgtagcaattccaactggaacaattgttggtgtgcaaatctcacttctttggcctggtttcgccaaaattgttgggcaagttatttctgttcccttccaaattgagattttcgccttctttttggaggctttattcatgtcgatttacgtatatgcagctgataaacttcctccatttatgagattaatctcgctatttttcgtcatgcttggtgccacggcatccgccgtgcttattacatcagcaaatacatggatgaatacaccagcaggcttttcaatgaatccagatggatctgtttttaacgttgatccgtggaaagctttctttaatccaagttttggcacaagtgcatttcatgtcgttattacggcttatgcaaccggtgcagctgtcattgcttctattgctggatttaaattattgaagaaaaatttaagtacacgtgaaattgcttatcataaaaaagggctgctattagggcttgtcgttacatttattacaggcgctacgatgtggctttcaggacatgaatcagcgattgccttacataaacactcacctgaaaaacttgcatctgctgaagctttatttgaaacgacatcacacgcaccgctatccattggcggagttgtggatcctaatacacttgaactaaactatgcacttgaaattccaaacatgcttagcttattagtgggactagaccctagcactgtcgtaaaaggactaaacgaattcccacaagaaacatggccaccattttatacacatacactattcaacttaatggtaggaactgctgcgtttacctttgctgttgcaacaattgcactcttatattggtatttcgtgtaccgaaaaaagggaacagaactaccgaagtggctactttgggggggctgccgcatgcggaccaattatgatgctcggtattgaattcggatggattttcagttgtagcggtcgtcaaccatggacaatttatggtatgcaacgtaccgtcgatgcatctacacgcgctgatttcgtcggtcctttatttgttttgttcatcattttgtatattggactcgctattttaacagtcattgttctacggacattctttagaagacatccattaaagaatgatttacaacaccaaggaggcgattctcatgtatgaggaaagtattgcaatcatcatcttatgggcccttattttcgtatacagtatactagggtccattgattttggcgctggtttttggggcatggtatacgcaaaacatccgacgctcgctgctaaacttgcgaatcggtacttatcaccaacttgggaagtaacaaatacgtttcttgttttcgtcgttgtcgcatttctcggcttctttccgaaagcggcctttactcttgcgacagtaatgttcgtaccagttatgttaattttagtgctcattgcagtacgtagtacatttatggtatttgcttactccttgccaaaataccaataccttcttcgggttatttcaggtattactggtctattaattccagcactattaattaccgttttacccgttacagagggagcctatattacaatgtctgaaggaaaggaagtactcctatatggaaaacttctttctagcccagttatctactgttatatgctcttcggactaacttctgaactatttctctcctctctctttcttgctgatttttcgagagaacaaagttcagaagatacgtatagaatttatagaagaaatgctatcatccttggtcctgcaacgctcgttacggcaattattgccctcgttgtaatggatccagaaacacattgggttatgcaaggattaataaagcaattcccgtggtttacagtttctattgttttattcgttatcggatactcgtccctttggtggacaaacaaaaagtacaatacactaggataccctcgcattgccgttttagctgtcgtcgctcaatatgcatttgcaagctatgcttacggggtcgcgcatttaccgtatattatttatcctgacgtaactgtatttacaagctttacaacgaaagaaacgttctatgcactgctcattctatacgcaattgggattgcaattttattaccaggatttattttcttctggaacttattcttgaaggatcgtacttttttgaaggaaaaataatatagcattggagtctgttccaaaaggcattttaggatagactccttttgtcgtgttttgtcgataagtcgatatattttaaaaatcgctgatatattttgagttgcgccgatatatttcaataatcgctgatatattttaacttgcgccgatatatctcaataatcgctgatatattttaacttgcgccaatacatctcaataatcgcccatataaatttcatttactatcttactgccccaataatttatagactcctctcataatagttatttcactattcgtgacacctgtcctttagcatgaaaaacacatattcggttcatctcgttatacgtctagttcttcttattttttgctgaatatactaccaatataaacttgagacaagctacatctgttcaagggaaaatagaaaggtaggcaaaatatgagcattgaaatatggattactattattgtatttttcttaacgatgatcgttatcttttggcgaccccgcggcttaaatgaggcttggccagcagcaatcggagctggtatcatcataattactggacttgtatcaaaaccagacatcatggatattataagtaaaattggcggtgcctccataacaatattagcaactattgttatggcagttatattagaaagcttcggcttcttccattggtccgcagcgaaactagcaaatttagcaaagggttctgggcgccgcttatactggtatattcaattattatgttttcttatgactcttttatttaataacgacggtagtattttaattacaactccaattttaattcttcttctaaaaaaccttcaattaaaaccacatcaacaaattccttatttattaagtggtgctttaatcgctacggcatctagtgcaccaattggtgtaagtaatatcgtaaatttaatcgcattaaacatcgtccatatgactctttatatgcatactgctatgatgtttgtacctgcaacattaggcttattatttatgtcatggctcatgtatacagttttgaagaaaaaacttccgaaaaaattacctgtttcttcatatgatattgaagaaattttcttcacgaaaaacttccatccactaaaaggaaataattctgttgatacgaaacaaaaacggacaagattcatgttaaaagtattaggtttcgtcttcctgatgcgctgtcttctattcgttgcatccttcttatccatcccaattgaaatcgttgcagtacttggttcactcgttcttctcatttggagatggtactacttacgaacaaatcctgtcgacattttgaaaaagacaccgtggcacattttaattttcgccttctctatgtacgtcattatttacggactccacaacgcaggattaacagctgtacttgtacaatggctcgagccaattgtgaatcagcatctactctatgctagctttgcgatgggcggacttgtatccatcctctctaacgtcttcaataaccatcctgcccttatgattggtacaatcacattaacagaaatgggactagatccagtcacattaaaaactatctatcttgcaaacatcattggtagtgacatcggttcactattactaccaattggtacgctagcttcactcatttggatgtatattctgaaacaaaacaaaattaaagtaaaatggaaagactatttaagtgtatcccttatcgttatcccgctcacaacagtcgtcacactatttctcttattctactgggtacatctcttctttgccttataaacaacagaagccccatttgctaccgtcttagcaaatggggcttcttctataataaagttaggtactacagtgtgatcaatcaagtaaagaggtgtaacatgttattgatataaatgactaccagcttctttaaattcttctgctttctctttcattcctttttcaattgcttctttcgtttctaaatcattttcttttgcatattcacgaatatcatgtgaaattctcatactacaaaacttcggtccacacattgaacagaagtgagctgtctttgccccttctgcaggcaacgtttcatcatgatattccatcgcacgttcaggatctaaagataaattaaattgatcgcgccaacggaattcgaagcgtgcttttgaaagtgcatcatcacgctgatgagccgttttatgtcctttcgcaagatcagccgcatgcgctgcaattttgtacgtaataacacccgtgcgtacatcatctttgtttggcaaacctaaatgttctttcggcgttacataacaaagcatcgctgttccaaaccagccaatcatagcagctccaattgcagatgtaatatggtcataacctggtgcaatatctgtcgttagcggcccaagtgtgtaaaacggcgcgccctgacaaatatcaagctctttctccatattctctttaattaagtgcatcggtacgtgtccaggtccttcaatcataacttgcacatcatgtttccaagcaattttggttaattcaccaagtgtttcaagctcagaaaactgtgcttcgtcatttgcatctgcaattgaacctgggcgtaatccatctccaagagagaacgaaacatcatactgcttcataatttcacaaatctcttcaaaatgagtgtataggaagttttctttatgatggaataaacaccactgtgccataatcgaaccaccgcgcgaaacgatacctgtcgtacgctttgcagtaattggaatgtaacgaagtaatacaccagcgtgaattgtaaagtaatctacgccttgctccgcctgctcaattaacgtatcacgatatacttcccacgttaaatcttctgcaattccgtttactttttccagcgcttgatagatcggtacagttccaactggtacaggcgcgttacgaataatccactcacgcgtcgtatgaatatttttacctgtagataaatccataatcgtatccgcaccccagcgcgttgcccatgtcatcttctctacttcttctgcaatcgaagaagatacagctgagtttccgatattcgcgtttaccttcacatgaaaattacgcccgatgatcatcggttcagcttctggatgattaatattcgctggtaaaatagcgcggccttctgcgatttccttacgaacaaactccggctctaccccttcacgaatcgcaacgtattccatctcagacgtaataatgccattacgtgcatagtgcatttgcgtaacatttgcaccttgctttgctctaagtggctggcgatccatttgcgggaaaacaggtgtatgtttcgaagctactctcacaccgtcatcctctggtttcacttcacgcccttcgtatgcttctacatcaccacgccccataatccaagagtggcgcggcgttggaattcctttttccaactcgaccttatacgcaggatctgtataaggaccgctcgtatcatacacacggattggtggatttggaacgccattcgtttcgctttgttcaatctcacgcatcggcactttcataccttctcgtggtccatccacatatactttcttactccctggtaaactcgacttcaattcaatttgctcagctgaaacagattgtttcataaattttgttgcccccctgttcgtgacaaggacaagatatggccagcgcatgccaaaataaaaagagccaggtccataaaaaaataaggacctggctcataaagacatcattatgtaaagccgttaacttccctacgctggtacgagccagatcaggtccaaagggttaagaagttcacgcgcttctctctcagcctacgcatacgttaggcacccctagtttatcactgatttaattttcaatactttcccatcatacacgataatctgaaaaatgaaaagtttatttcttttgctc

SEQ ID NO: 1370 - DNA, 15165 bp, Bacillus thuringiensis
  unsure (1)...(15165): unsure at all n locations
tttccacttaaacgtttaccaatatatacagttaaagttgctggtaataatgcaccgattggctcacctgttttaataattagaccagcttcagtaattgaaatggatccggcaccaattgctccggctaccatcgctgagaagattacaagaccgtttgcaccgagcataaaagcaattccggcaccaattgccggtgccattagtgattttgcaacaactccgattgtaataagtaatggtatatcaacaattcttcctatattttcgatcagtaaaccaattccgagggatacgaaaataccttgtgcgattccagcagatgctttaaatacacgagacattatatattccttcatttgtttcaccttcttctataagttagtaaccaattgttttcatataatcacgtaaaatatcgtttgattttgcgaatcgagattcttcatcctctgttaaattgagttctacaacttctcttataccgtctctagtaataatagctggtactcctgtacaaatatcatattcaccatactcaccatctaaaatggctgatacagcaatgacacggtgatcatcattaaagattgaactcgcaatatatgctagagaatttccaattccgtaataagtagttcctttacgtttataaatttcccaaccagcttttgcagtcttctcaacaatttcatctaaatctatttcaccaaatcgttctttttgttcttctaaaatttgcagaattggctttccaccaacagttacatgagaccaagcaaccatttgagaatcaccatgttctcctaatgaatacccatgaatactacgagggtctacatgtagcatttcagataaaattgttcttaagcgagaagaatctagtgatgtaccagtaccgattacgcgatttctaggtaatccagataatttccacacttcatatgtaataatatcaactgggttcgatgcaagtaagaaaataccatcaaatccactttccattacgccgccaacaacactttccataatcttcgcactcgctcctaaagtatctaagcgactttgccctggttttggtgctggccctgctgtaataataacaatgtccatatctttgcagtcttcatagcttcctgcatatacttttgttcttgtatttgtaaagttaatgcaatgtgataaatccattgcttccccaactgcacgttcatgatttatatcaattaataatagctcttcacaaatcccttgatttacaatggaatacgcacaacttgatccaactaatccagtaccgataattgcaatttttcttgtatgtcttttcatagcaatctctcctaattgatcatataatctatttcttttgctctttacactcctaattataaaggttctcacgatagaaatcatggatactttgtgaaatattgagcaaatcgtttgtcctttttgtgaattgttatattccattttcgtcatatttgttacagctggaaaaatatttattatgtatttattgacatataaaaaagaagacgagcgaataaattcgctcgtcttctttttcctgttattccgcacttaattgactttttaattgctgcacaatcatcggattcgcaggtgctgccggtttgtaataacttttttgctttgcgtactcatacatattacgttggcgcatttcatcttgattacgaatttgaattaacgtttggtgtaactgttcattatcagactgagcaatataatttgcataacttgttaaacttgcatttaatcctgctaaataatcatttaccatatctttttcattcatgttccgcttcctcctatcctaggaaagtcattaattgctgtttcgtatttcgtgcatcttgcgcatccttttgtaacatttgtttcaattgtggatctgtacacgtctgtgcatactgctccaacttgttaataattgttgcgtgtccaccaattaaatgacgtaagttttctacttcaagctctgttaaattttgcatggaatactcctacctttcttctttcattctcctttagtattctgttctttttaaatcgtattcatgaaaaagctttcttacatttcaaatcaatcacatctatttataaatacaaaaaaatgttataattacagaaaaatacaaatattcaaaagctaaccttataataacagtataatcctcaaacaaaccatggtaggaaggtgtgctcatgcaaaaatatgttaaagttatcttctttatcatttacgcaatcctctatgtaaaactgttgattgatatattaaatttaaagccgttattcacttctatagctttacatatgttatttctcatttgctttctatttatagcacttaacaattataaaaatcgtaacactacatttttcctattgtttattagtgcaactctattagtaagtattagcttcattaaaagtattcttatataaaggagcaataaacatgaaaacacatgacttccttacagaaatccagaagggctctgagcctagtccctatcaagaccccatcgtattcagtttcgtttgctttttcttagcgatatatacatttttcaaacctgcaaaataatatcatttcataagaaaaagcctaccattcttttcgaatcatatgcacaaaaaaaccttagaatcacttctaaggtttttgtttgctttgcttcttattcacgtaatcctttaataaacgtttccaacaatacatgtaaactcgtatctaaatctagcggcaaaccaaatcccccttgctgttcaatcgacgcaaatccatgacaaatacttctgaatccgcgtgtcgcatgaagtgcattctctccttctaagccatactgttgtaatacttgaagacaaagctttacaattccgtcacctgcttttcttacttcttcatctcgtaaaaaagttgcttcatatagtccaggatgttttcggacaaatgctacatacgcttctcctaatgcatgaattgcttcgtccgtatatttaccctcagtagcttcttctagtctgttatgcagctgtttgattccgtaaataccaagatttttccgtacatcttgtaacccttttacatgattatatagtgagggcgaacgtatccctaacctttgcgctaatgaagctaacgttacttcttgtattccatttgtatctgcaatttctgccgctgtttctacaattttttgtaatgtaagtccgattctcggtgacataaattacccctctttcttactttctatattccgcttagcttccttaatagcaagttttatgacagtgtctggattctttatcattttcccatgtcctgccgcaagtaaggaaggctcatattcgcttaacttctctgcactttgtaatgatatttctttgctccacgttgccatcgcaggaaacggaaaccaaaatttcatttgtcccgaaacagccatacctcctcttgtttggaatgcatccccaacaataagagctttattccgtacatcaagaaacgacatggatcctggtgtatgtcccggtgtcataattgcaagaagcgatccaactcggtcgccatcttctaataaaacatcaggtaccgtttttacttttttaggtacaccgccttttatcggtatattcggttcatccttttgtaacgtcgtatctccttctaacagctttgcgtcccgcttagaaatatagactggaacatgaggaagtacttcctttaatgcatctaatgcaccgatgtgatcatcatgcgcatgtgttaatacaattttagtaattggttttcctattttctcagccgcctgtaaaataccttttgcgctatatggcaaagccgcatcaattaaagttaaaccatcttcttcctctacaaagtaacaatttacaggaaacgctcttggcaaaaatgacaattgatataacgttttttcatgtatcatcctcatagtcccatctcccttttcacgaaaactaatgccattagttttattatactaatagcattagttttataccactaaaaaatttctttttttcaaaaaaaagaacagtagccgtataaacgactactgttctttaaagatattaaactgtataacgctcatcttctaaaattttcgcagcgatttcacgtttcttcggaattacgttaagtggtgtgtggcgagttaatttacgtaatgatgataacatcatgcgcagcatgtcgccattttcaactgcgataagtgtttctttcgcatctgcttcgatttcgttgaatgcttcttggcagaatacttcagtgtataacactttttgtttattcttttcaagaccagttgttttaattgctttttctgtacgaagaacagctgactccattgcgtataggttgcttacgatgtcagcgatattcacaagaatttcttgctctttatctaatgctttaccgtatttttgagccgctaatccagctaccattaagccgattttcttcgcattagttactaaatacttttgaagtgctaatggctcatcgcctacttcttctggcatcatcatcattaactcttcttgtaatttttgtgctttttgaagaagtggtaattcacctttcatcgctttacgtaagaacgtacctggtacaattaggcggttaatttcgttcgttccttcgaaaatacggttaatacgagaatcacggtacattctttcaatctcgtattctgccataaatccgtaaccaccgtgaatttgaacaccttcatctactgtatagtctaatacttcagaaccaaatactttgtttaaagagcactcgattgcatattcagcgatagaagctgctactgctttaccatcttttacttcttcttcagataatgtgctcatgcggctttcgaataaacctactgtacgatatacagagctttcagctgcatatgtttttgctgccatattcgcaagtttctcttgaattaatgggaagcgagcgattggttgtttgaactgttgacgttggtttgcatattgtgctgaaatttctactgcacgtttcgcagatccaactgtaccaacacctaatttataacgaccgatatttaaaatgttgaatgcgataatatgacctttaccgatttcgccaagtaagttttctttcggtactaacgcatcttctaaaattaacgtacgagttgaagaacatttaatacccattttcttttcttctgggcttgtagatacgccagcgtagtctttctctacgataaatgctgagaagtgctcgccatctatttttgcatatacaacgaatacgtcagcgaatgcagagtttgtaatccactgtttttcaccgtttaatacataatgtgtaccttctgcatttaaacgtgcagttgtttttgcgcctaatgcgtcagatcctgaacctggctctgttaatgcgtatgcagctaatttttcaccagttgcaagtaatggtaaatactttttcttttgctcttcgttaccgaataatacgattggtaaagatccgatacctacgtgagcaccgtgagtaattgcaaaaccaccagcgcgagagaatttctctgcgattaacgctgagcttactttatcaagaccaattccgccgtactcttctggtacgtcagcgcctaataaaccaagttctccagcttcttttaaaagacgaactgaacgatcaaactcatgttgctctaaatattcaagctctggaagaacttcatttacgataaagtcctctgtcgttttagcaatcattttatgctcagatgaaaaatcttctggcgtaaacacttgatcaatcgtaatctcatctactaaaaagctaccgcctttaaccgcatttcctactgttttttccatgaaaatttcctccttcatattttcatgagccgcttctctctttttgaaagaagctggctctcccttttgtttttataaacctttgttgcttccatttttttttataatccagttccagcggctagaatgttcggtggcttcgcttcttcctacgaggcaaagagcgcctctacgtctgaagctccatccccctcacattctgaacaagccgcttccactttttttcataatccagttccagtggctaaaacagtcggtcgtttcaccccttcctgtgaggcaaaaagcgcctcttcgtcaaggcttccaacgccctcctgttctaaacgagccacctgcactttttaaagtaattcaaatactcccgctgctcccattccgccgccgatacacattgttacgataccaaattgttcgttgcggcgtttcatttcgtgaataagagatagtgttagttttgctcctgtacagccaagtggatgtccaagtgcgattgcaccaccgtttacgtttactttttcttcatctaaaccaagttcacgaataacttgaatggattgagaagcaaatgcttcatttagttcgaataagccaatatcagataactctaagccagctagttttaacgcttttggaattgcagcgattgggccgattcccattacttctggtggtacgccagctactgcaaatgaacggaatttcgcaagtggcttcatgccatcgctcactgctttttcgcgatccattaataatacagatgctgcaccatcactcatttgtgaagagttaccagccgttacagaaccgcgaacgttaaatgctggacgtaattttcctaaaatgtctagtgtcgtctctgctcttacaccttcgtcttgtgcgaaagtgattgtttcttcttgaagtttattgtttgatccaaccgagcgtaacgtcacatctacaggtactgtttcatcagcaaagtttcctgcagctaatgctttcgcagcacgttgatgacttcttactgcaaatgcatcttgctcttcacgagaaattccatatttcacagcaacttgctctgctgtatgtcccatacccatataatattctggagccgcttctacaaggcgactattcggacgaacaacgtgtcccatcattggaactaaactcattgattctgctccgcctgataatacagcttcagagtgaccaagcataatacgctcagctccgtaagcgatactttgtaaacctgaagaacagtaacggttaatcgtaatagctggaacatcgtaagaaagtcctgctaatccgccgatattacgagccatatttaaaccttgctctgcttctggcatcgcacaaccgaaaattaaatcatcgattggtccttcataattcgcacgctttaacgtttcctttactactaacgcccctagatcgtcaggacgaactgtttttaatgaacccctctttgcttttccaattggtgttcttgctcccgcaacaatgacagcttctctcatgaacgatatctcccctcgttattagttacgtaatggctttccttttacaagcatgtgctgcattcttgcttgtgatttcatctcacttactaagctaataaatgcttcacgttctacatctaataaatattgctcatcaacctctgttccgtacggcacttttccgcccgcaatgacatatgcaagtttcttagcaatgtgaagatcgtactctgaaatgtaaccagataaatgcattgcttccgcaccaagtgcaagagttgcatatcctgtttccccaacaactggtatctttttacggatcggcgctttataaccagcttcatataaagcaagtgctttctgtttcgcatcgtatagtaagtgatcaccattcacactaataccatctttatcacctaagaagttatgagaaactgcttcttgtcctgaagttgaaactttcgccattgcgactgtttcgaacactttatttgcaactttttgcagatcaaactctacaccgtttgccattttgtttaagtgtttaatgtatagctctttattaccgcctccgccagggattaagccaacaccaacttctactaagcccatatacgtttcactagaagcttgaatgctcgctgctggtaagcaaacttctgtacctccgccaagcgtcataccatatggtgctgctacaactggcttagaagagtacttaattttcgtcattgcatcttggaagtttttcacaacccactcaatttcaaagtagttgtcgtcttgtgcttccattaagatcattgctaggttcgcaccaacgcagaagttcttcgattggttaccgataacaagacctttataattcttttctacttcatcaacagcgtagttaatcatttgcgtaatatccataccgattgcattgctcttcgaatggaactctaagcaaaggatgccgtcgcctaaatcaattaagctcgctccgctatttttctttaatacaccattttttgcttttaattgcttaagagaaattgcttttttattacgctcgattagcttatattcgccattatcgtaatagtagctatcgccgttatcatgtttatagaaagtagtgaaacctttctctaacatttctttcacccaagtaggaacaactacgccgttttcttccatcttttgaacagatttttcaacgccgattgcatcccacacttcaaatggcccttgctcccagccgaagccccacttcatcgcttggtcaattgcaacgatatcgtcagcaatttctttatgaagttttgcagagtataaaagagttggtgtaatgatgttccataataactctcctgcacggtctttcgcgtatacaagcgctttcaatttattcgctaatcctttttcttgtttacttaactctacggatgcagcttttaattttttacgcgcttcgtattccatcgtttcaggatttaattctaaaatttcttttccttgttttaagaagaagccttgccccgttttacttccaagccattttttctcaagcatgtcatgcatgaaagctggtactttaaatacatcacgctcttcttcttgcacattttcatatacgttatttgcaacgtgtacgaatgtatctaaaccgacaacatctaatgtgcggaacgttgcgctcttcggacgaccaataagtgggcctgttacagaatcaacttccccaatgctatagccgcgttttaccatctcttgaagagtaacaagtaaaccatacgtaccgatgcggtttccaataaagtttggtgtatcttttgcgataacaacgccttttccaagaacgtcttcgccaaatagtttcatgaagcttaatacttgtggatctgtttctttcgtcggtattacctctagaagttttaaatatcgtggtgggttaaaaaagtgtgtgcctaagaagtgtttctggaagtcgtctgaacgaccttctgccattttttcaactgaaatgcctgacgtattcgagcttacaattgagcccggtttacgaacagcgtctactttttcaaataatttctttttaatatctaagttttcaactactacttcaataatccaatctacatcagctagacgctcaagatcatcttctaagttacctgcttcaatcagtgctagatttcctttcactgtcagaggagctggtttttgctttaatagtttttgcacagccgtattactaaaacgatttctcacacttttatgttctaatgtaagtcccttcgcttcttcttcttttgtaagcgcaggtggtacaatatcaagcaataatgtcggaataccaatattagctaagtgtgccgcaattcccgaacccattacgcctgaacctagaacagcagcctttttaatttggaacatccaattctccccctattcttgaatgaatgctcattcaatttttcgacataagtcgcaatcaatgagtgagcctctactaataaatatatgatactgtttaaattttcgcaatatatttattgataaaattttctgaaataaatatttttctttcatttggccatgctatatatgtattttcttcactaaaatacactttccctttttataatctgacgaaactggaggaatatatatggcaaaacttaagaagaacccttcaaaggctggaattagtgcagctagtgtaactggaaatgcaggtccgcataaccacggcgtggaaaaaggacgtcaaggtaataaccaacaatataaaaagcataatatgggcgaaaaataacgctatatttttgggcagagaacgtggcataatgattaatggctgctttttctgcccaatttatttgtaacaaatgagggaattataatgaaacgaacaatagttatgattgtaatgattgctacactatttacagggatgattttcttctcttatgcacaaagacaacaagctgtaagagctgatcaacccaacattactgggcaatacggagttacaatcgatgcagacacaggtgaaattttgtatgggaaacgtgaagacgaacgctcttatccggctagtatagccaaaatgatgacaacccttcttttactagagaatgtaaaagaagatgaagaaattacagttacagaaaacgcaattaaaacagaaagtcaaagcaagaaaattaaacttcgtgctggagaaaaattaaagcgtgatgaggcattaaaacttatgcttatcattagtgcagatccaatagctgaatccatcgcagaacatattgcaggatcaaaaaatgaatttgtaaaaatgatgaatgctagagcgaaggaacttggtacaaagcatgcgactttcaaaaacgcaagtggtgctgatgcacttggaaataaagtatcgccatatgacattgctattattacgaaagaagcattaaagtatccagttgttttagaatatatgaattcaacgcgtacaactctacatacttcagaacgctctccaaacatcgcaaactacggacgagaagaactatatgacgatccatatgcgattggaagtaaaagcggtctatcagcacttggcaaatatacagtcgtaacagtggatgaaaaagacggtaaacgtgtcattaatgttgtattatcttctacccgcaagcaactgtatcctgatacgaagaaaatggcacattatgcatttcagcaattaaaataaccaaggagtattttctccttggttattttttaaccataccttttaatacgaacgcaacgtttgctggacgctctgctagacgacgcatgaaatatccataccagtcgtttccataaggtacgtaaacacgcattttgtagccttcttttactagctcaagttgacgctcattacgaataccatataacatttggaattcaaattgatcccttggaatgttgtgttcttcagcaagtttttttgtatattcaataatcgcttcgtcatgtgaagcaattgcagtataatttccatttaataagtgcattttaataatttttttataattgtcatctacatctttcttgtctgggaacgccacttcttcaggttctttataagcaccttttacaagacgtaaattcggattataagcatttaaatcttcaatatctttttctgtacgatataggtaagcttgaataacagtaccaatattatcgtattcagattttaattgtttaaagatatcaattgttttaccacagcgtgtatagtcttccatatcaatggtaacgaacacaccattttctttcgccgcttctaaaatacggcgcatattgttcattacgatttcatcagagatatctaatcccatagaagtcatctttaaagaaagctgcgaatcaagaccttctcttccaattgcacggatcgcttcaatcgattggttagccatttcatttgcttccgcttcattatcaacgaattcccctaaataatcgattgttacacaaagtccttgcttgttcaattgtttaatagctgctgtcgctaattcaattgtctcccctgcgacaaagcgacctgcaccaaagcgtaaaccgtactttttagccagttttgttagcgctttattttttgacaagaaaagaaacgaatttcgcattaattgttccatgtaattcacccctatgactgtaatttatctgttttttacccctcttcaaaattatatcattgtttaaaattattggatacaaataattatttagataatttataaaatactataaaaacatttaaaaccctatattttcgcttataaatataactgaaatatttttcgacatttagaaaaatggagtttaataggcataaaataggcatgtcgaaaatattcgacatgcctataaaaccctttatattccatgtaaattatataaggatattaatacagaaaacttacgattatatttccctcaagtttttttattgctcatttcgcttctcttcattcagccttttaatatctgtaattaactgcaccatctcttctttcgcatctggataagtttcattccaatgctttactaaagctggcatcgtcttagctatgtaagaatacagtgcccacttctgtacctgttcttttctctcttcattgctctctccaagtaacagctcagtgtatttctccagtaaaccatcaaactgctcgttaaacttttcactcattttatttaccccctatatgaaaaaagcagcgaaaatcgctgcttttctttataattttgatcgaacagagtttaattttttctccattgtgcttactttatcacgacgatcatcaatacgaatagttgttgcaacacgctgtgcacctttcgtatatggaacttcatgcatttgttgaattacttctagaatgacaggaagatctccttcaataattgtattcatcggtgttaattgatacttcacgcgatccgcatttttctctagcaccttttgtacttctgctacatattcactaacacttggattacctgttcctactggaataatcgatacatcaacaattgccatagtagtcttcctcctataatcgtttcttatatatccattgtctattttaccgaaatcctcatcattttactaatatgttactcttccactttaaactgctcgactaatctttctaaatctctcatatgttctgtcaaactttccatcgtgtgagctaccttttctaaatgattcacctgtgattccgttgcagcatgtacctcttcagaaacagctgcactttcttgactcgtaccagcaattgtatgcattaccgctgtaatttccccttgctcgtaacctatgttatgtacctcttctacaattttttcaactgaagtactaatcgtatttacaactgacataattgtgcggaactccatttccgcctctgtcgtcactttattttgtacatctgcaatgtctttcaatttacttacaacttctacaaccctttttacttctaattgtacatcaccaatcatcgttgtgatttctccggttgcctcttttgattgttccgctaatttccgaacctcttcagcaacaaccgcaaatcccttaccttgctcacctgcacgggcagcttcaatcgatgcatttaaagcaagtaaatttgtttgatccgaaatgccttttataagctcaacaacattttgaatcgatccaactctttgttctaacttatccgatgcttcttctgtatgaacaacaatcgaagatgattgtcccctcgtacggattaaattcctcattgtatttaatccttgcttagatgcctcttccgctttgccagctactccttttatttcaccaacggagctattcatttgttccactgactccgccatattctcgagctgagctgaaacttcatccacaccattcgcaagagtagaggctcctccactcacatcatccattgctcctgaaacttctctactagccgctactgtttcattcgttaagtaatgtaaactattcgttgattgttgcaccgttgatacgctgtttttaattttacttaccatttcattcatttgttcaaccatatcattaaagtgcttagtcaactctccaacttcatctttacttgtcactttcattcgcaacgttaaatcgccttcttctactttttgcacgtgattctttaatagttgcagtggtcttgctaatcttcttgagaacaagtaggaagctacgattccaactaataaactaatacatgccattataataactgtatttctcgtactatttaatagcccatcgattgtttctttcggataaaagattcctatcgtccatttcatcgtatcaaatgattgactgtaaacaactacatcttcaccttttattgtactgaccgcatattttgttacctctttatttaagctctttataagcggctctttagaaacatctttccctatcttttctggataaacaagagccatatttttatcatttataataaacatttctccgtcattattgtattgaatattgtgaagcaacttctgaatcgtcccaagcgatacatccatcgcaacaacgcctaatacagatccatcttgagctgtaattgctttagaaacacctacacttaactttcctgttgcaatttcataagaaggttgtccccagtggaccttttttacatcagcctctgaatctttataccatggtcttgtcgttggatcgtatccttctggcacttgcccaccttcagcaagattggcacttaatgtttttttatctttcgtaccaatatataaatctaaaataccaggatgattctttttatactctgcaaactctttcgttaaaaacgcttcctcttctggagtaaccccaccttgaagtatattacgaatcatctcactgttcgcgtaataccccatatcttcatccgttctttgaacaaatgtcgtaagttgctctgtcacaagatccatcgcattttgagaatactcgtctaaggaacgcacttccttttctttctgtaattgatacacagctgtacccaatattacgaacatcatagaaataagtactgaaaacactaccgcaatttttaaacgtaaacttcttaacatcttccccccagcatcccgttcgcaccccttaaaatctaaaaaacccttatattnagtatcatagatgggattttactattggggttaatatgaaaaa

SEQ ID NO: 1371 - DNA, 19595 bp, Bacillus thuringiensis
gataatgaagtaaatgttacaccatcaccatctccgtataccatctgtgatccgttccagaatgcattgttataattacttccgtaatgaactgttgattttaacggcgctcctgcatcattaattgaattacgattaaatgtattcttatagtaatcatacgtgatacccgcatagtaatgagcatctaccgctgctgcatcatacgctgcattgaaaacattatctgcatctgcccataatgttcctggtaatgttgaacggtttttcgcatcatatgttgtttcctcaccgttttgatatacatataagtccgcttttggttctacttcatatttcggtgttacccctaaatcttgctgcgcgatttcaattgcttttgcgccttcaatcttatttttatttttcaacttttcctttttgtctaaatcaggtgcaactgttccagacaatacttttaaagaaccgtccttacttacgtgagctacttgagtagaaccccatacaggcactccttcgtaaacttgttgcatacgtactactgttgaatcagttacagcatctttcttcacttgtttcactttgaaagaatcttgtgcactcttttcccctagcttgtaatcaccttttgctgcgtttaagtaatcaaacacaacagattctgctttcttgccagctgcttcagttcgatcaccagaaataaactcaggtgactgcaccgactcattgtacttgttagtagagagcacattcttagaatccgtaaacgcagagcctgtccctccaaacgttgtaactgccattcctgtcgctaacactaatgctaaactcttctttttcatataaccttccccctaataaaaaattttttgaaaaagagtagtttcatattagcattatgtttccactattaatatactaaaaattcaattaatttatttctcaagttttgtagaattttgaggaacaaatattgaaaaaacccctttccgattggaaaggggttttttcaatattttcttaaccataaatatctggattagagtaatttataaccttttcttctgaaaatttaaaaccgtaaatatctgggttagaatattttatactactttcttttaaagcgtttaatccataaatatctggattagagtaatttactgagccttcttttaaagactttaccccatatatgtctggatttgaataattaacgcctaaagaaagaatcgctactattccaagccctactgcaccataaatgcgctttttcaattcaattcctccttttcttctaaaactttaataacttctttataatatttattactttcctcatacttaaattcattctctaaatacatagctaattctaaataagcattttttaattccttcatactacctacactcttaaaaaacggaatagcctcattctctaaaaatctcttaaattcttgagattctccaaaatatttatacttaaatatacagaatgaataaatcattttattgtatttctcatcactccgtgagcaatcaattcctttttctatccattcctgcgcttcttcataacgtttaagatgaatgtattgcttagccagtccataaattgtttcaatataattcatattgacagtcttctgcaattcgaaactttgaagaaaatagtctttagatttatcatgctcatttttataatggtataattcccccatattatttaaagtcatagctttaatcatatctttttccgcaaaagaatctacttctcttaatatactctcataaatctttagagcttcttcatattgtgctttttcaacataacttaaagcaataatcgtttgacaatttattacataacggaatttatattcgttacggaacccctccatggcaatatgagcaaaatgcatggctaaatgtggtatatttagatgactatacgcaagacttaggttataatatatccccgtttcataatatccttgctctttagccatttcttctgtttcaattaaatattttaaactttccttatgcttatattgcaaactaagtaataatgccttactgtacgtatacaataacttttgaaagggtgagtatttcttgtacactttcttcaatctgtccaattcttcttcaagagcaggtagatctcgcttcatcattaaataacgtgtatacagcagtttataataatttataatttcaaaatccaacacatgcttcatttcaccttgcaactcttcatatatacgttctacttgttgcttgtccaaatgaactagtgcattcaaccattcatccagcttccccttcacatcttcttctacatctctcaaatccgtcacagcaatttctaatcttgcgcagagcaattgtagaatttcttctgatgcttcgatctttccattttcgatcttacttaagtatgagacagaacaaatgccctgacataattcttcttgtgtcattttttgctgaagccgtttgtaaaagacttgtttgcctattttttctaatgtttgttgcattgtcctcctccattctcattaccccattactctaataatacataaaatttggagaaatataaattgataaatataaattttctaaaaaatatgcataatttcatttttttctctcttgacttcacatcaatatctcttctttgctaccaatggtgaaaaattggtatactataaccaaattatggaggtgttctcgcgatgactcattataaagacgatagttatgccttacatacagacctatatcaaatcaacatggcttatacatattggaaagatggtattcataatcgccgttctgtttttgatttatattttcgaaagcttccatttgagaacggttacgctgtttttgctggccttgagaaaattgtagagtacattgaaaatttcagttttactgaaagcgatatcgcttatttagcagaattacaatttgaagaagaattccttcattatttacaaaatatgaaattcactgggacgattcgtagtatgcaagaaggtgaagttgtatttaataacgagcctttattacgtgttgatgcaccacttggtgaagcacaaattattgagactgccctcttaaatattgtgaattaccaaacattaattgcaacaaaagcagcacgtatgaaacatgctgcaagtaatgatgagcttttagagttcggcacaagacgtgcccatgagttcgatgctgccctttgggggacgcgtgctgcctttattggtggtttctcctctacaagcaacgttcgtgctgggaaacgctttgggatccctgtagctggcacacacgctcactctttcgttcaagcatatcgcgatgaatacgtcgcgtttaaaaaatacgctgaaactcataaaaagtgcgtctttctcgttgatacatatgacacattgaaatctggtgttccaaatgcaattcgtgttgcaaaagaatttggggatcgtattgatttctatggcatacgtcttgatagtggtgatatggcttatttatcgaaaaaggcacgaaaactattagatgaagcagggtttacaaatacaaaaattatcgcttctagcgatttagatgaatacacaattatgcaccttaaatctcaaggagcaaaaattgacgtatggggcgttgggacaaaattaattacgtcctttgagcaacctgcattgggggctgtttacaaactagttgcgattgaagatactgacggaaaattaaatgatacgattaaaatttcatctaaccctgaaaaaattaccactccaggactgaaacgaatttatcgtattatcaatcgggtaaatgatcatgcagaaggcgattatattgcattagattctgaagaacctggaaaagaagagcgcttaaaaatgttccatccagttcacacatatataagtaaattcgtaacaaactttgaagcccgtgaactgcataaagatattttcgttaacggtgaaagaacatatgaactaccaagtatattagatattcaaaaatataatgaacagagtctctctctattttgggaagaatatatgcgaactttaaatcctgaagaataccctgtcgatttaagccaagagtgctgggatcataaaatgaattacattcaaacagttcgagaacaagtcgaaaaaaacatacaaaagtaaacagagaagtttccccttctctgttttttcaatactatatggatatttgtaaaaaatatattaaaagaataagacgaatgtattttatttgtaaattttaatataacgctatttaaaagtaaaataatatttggtattattttattgagtcaatttcaacaaaatcaccaataaaaaagaggacgcgggtcgcgtcctcttttttataaatctttcactcttaatacacgcattgcatttaacactgcaagtagtgtcacaccaacatctgagaaaacagcttcccacattgttgcaataccaaaagcaccaagtaataaaacgatcccttttacacctagagcaaagatgatattttgccacactatacttcttgtacgttttgcaatttttacagctgtcgcaatttttgaaggctcatcagtcataataacgatgtctgccgcttcaattgctgcatctgatcctaaaccacccatcgcaataccaacgtctgcacgggctaatactggtgtatcgttaataccgtcaccaacgaaggcaattttttcttttccgtgcttcgctgcatcaattttttcaatctcttctactttttgttgcggtagtaattccgcatgaacttcatctaagcctaattctttaccgacagcttcaccaactggttttgcatcaccagttaacattactgtctttttaatacctagttcttttaacttttgaatcgcttgtttcgaatcctcttttacctcatcagagataacaatataacctgcatatcttccatctacagcaacgtgaactaatgtacctactgtttctggttgcttaaattcaatattttcttttctcattaattttgcattacctgcaaaaatttcttttccttgtacttttacgactgtaccgtgaccagaaatttcgttataatcatcgattattttttcatcaattgattttccatatgcctttcgaatagattgggcaattggatggttagaatatacttcagcaaatgccgcatactctaataactcttcacttgtagtaccttcgctcggttccatttttgtaactttgaaaacaccttttgttaatgttcctgttttgtcaaaaacaatatattttacatcatttaaagcttctaaatagttactaccttttactaacacaccacttttagatgcaccaccaatacctccaaagaatccaagaggaatggatacaactaacgcacatggacaagagattactaagaacactaaagctctataaatccactcagagaatgtagctccttctaaaataagtggtggaataaacgccatgatcgccgctgtaataactacaactggagtgtagtaacgtgcaaacttcgtaataaagttttccgttggtgcttttttactgcttgcattttgaactaaatctaaaattttcgatacagtggattcaccgaattcttttgtaacttcaattgtcaacacaccgttttggttcacaaagccacttaatacatcatttccaacttcaacttcacgtggtacagattcacctgttaatgctgaagtatctaccattgatgttccttcaattacttttccgtctaacggcaccttctcacctggcttaacgataatataatcgccaatttgtacatcttctggtgatacttgtttcgtttcatttccaacctttacattcgcataatcaggacgaatatccattaatgaagtaattgattttcgggagcggtttaccgcaatactttggaatagttctcctacttgataaaatagcattactgctacagcttcagaatattgttgaattgcaaaagctcctacagttgcaattgccattaagaagttttcatcaaatacttggccacgagttatgtttcttatcgctctccaaacgatatctccacctattaataaataagcaaggacaaataacggaattgttaccatttgtggtaagcccgctaatgcagcaattgctgtcaaaattccgccgaccactaatctccctaccatctttttcacatttgcttcaccatgatcgtgactatgtccgtggtcatgaccgttcttctcttcacgaacaactttcacatctggttctaacttttgaacgacatttgttatatttgctacagtcgcttctagttctcttttattcgcaacttctactcgtaatttcttcgatacgaaatcaacagttgcttctgagacagctggcatttccttcactttattttcaattttcattgcacagttcgcgcgatctaaaccttctaatataaatacttctttagcaattttatttttttgttcttcttgaactttaatatgcggttctaattttgtaacgagttgttttgcttccgtaacaacttcgttttctttattttgtgctgtttctaagatcattgtctttgttgcgaagtttacagagcaagaatttactccttctatattcccaacacctttttcaattttcattgcacagttcgcacaatctaaaccttctaacatcagtttctttttcaccaatgcttcagccatcgttctccctcctcgcgttcttttattcttcttcgtttacgtgttcaaacgcttgctcgaagatatgaattacgtgctggtcagctaacgaataataaacaacctttccttctttacgattcttcacaagtttcgcttgctttaacacacgaagctgatgcgaaatagatgattgtgtcattcctaataaataagctaaatcacaaacgcacatttcagcttcaaatagcgcatgtaatattctcgtacgtgtacggtcacctaatactttaaatagttctgctactttacttaaactttcatcagttggaattgtttgttttacttgctctacaacttcttcatgaattatcgtttgagaacatgtctcttgtggtgtttctactttatttccagccattatagctcacctctttaattgaacatatgaacaatcattcatatatcttatactcttattatatgagcgcccactcatatgtgtcaatgaaatctgaattttttttatgaacattccgttcacattttaataagtcgtatacatatttttcgcactctctatattctcatacaaaaaaggatgcacaattcgcacccccctttttacttacttttcatttttcaccgcatccacaattaaagaaacaaatcctaaatgattatcccgatttctatggtcaaaacgtttcgaacgataaataaatccatctttctcattccaatcattatagtgaaacttaccattctcatcacagtattctaagagccttacttgaaaacctgctgattcaaacatggacgtgattgttttatagctatgaacaattttatgacttgctgcaggatgatctaatggaccaggtccacctacttgtaccccttgctgatattcttcatctggaaaaaatgcatctggtactgcacaacgaatatatccattctccattaaaaactcataacaaatttttgcagcttcaattccttcttcatatgataaatgctcccatacatgttctgccaaaattactgataaagaattaggttgaaatttatcaagccaagcttctctccgtaataaatttaattcttcttcattcgtatgtaaccaaccagggttattattataaccctctgctccaacaacaacttttgcttcttccatttcgctcccacccttttttcatattccgacagaaaaattcgacaaaataatatacattccctttatttcaacaaaagaaaaagccttgcgcgctccctagacgcacaaggcttactgtgtttatatccctttaattagcttgttctaaattatcctgcgaacttccatcgtcttttaaatgactatgttttttcgaataaacaaagtatacaactactccgattgctaaccaagcaccgaagtacatccatgtttttaatggtaggtttaccattaagaatagacaacatgcaattgaaataatcggcaagatcggtacaagtggtaccataaatccacgttgtaattttggatgtgttttacgaagaataataactgacacaccaaccatcgcaaatgttaacaacgctccaatattcgctaaattcgacaattctttcaaatcgataaatccagcaattaaagcactaccaattcctgttaaccaaactgtaaatgttggtgcttctgtctttttattaattttcgcgaaagattctggcaataaaccgtcacggctcatagcgaagaatacacgtgtcgttgcataaatgtaagcaaaaattactgccataataccaattacagctccaattgcgattataccagctactttatcttgtcctacaacttctaacacatacgccatcgcttccggtacatctagctctttatatgaaaccatacccgtcataacgagacaaactacaacataaatgattgtacaaatgactaacgaagcgataataccaatcggtagatcacgttgcggattttttacttcttcagcagaagttgctaatgcatcaaatcctaagaaagcaaagaatactgctgctccccccgcgaaaactccacttaaaccatacggtgcaaatggtatccagttttctggtttcacgtagaatacaccaactgcaatgaataaaacaacgataccaattttaattaataccattatgttattcactcgtttactttctttcgtacctcttgataataaccaagttataactaatgtaacgataactgctggtaaattcactataccaccttgagacggaatcgttagcagtgcttttggaatttcaagccctaatccactcactaagttatggaagtaaccagtccatccgccagctactgcggcagtcgttacaacatatacggatagtaatgtccatcccattaaatgagctacaaactcaccaattgttgcatatgagtatgtgtacacactacctgaaacaggaagtgtagaagcaacctctgcgtaacataatgctgcaaatccacaaacgatggctgcaatcatgaatgaaaaaataactgctggaccagcatctcttgctgctactaatccagttaatactagaactcctgtaccaattatcgcaccaatccctagcattgttaggtcaaatgcccctagcgttttcgtcaaagttttacttttactttcccctaacaattgcgtaacggatttctttttaaataggttggccacgatgtatgcccccttttgccaagaagagctaagagatcttcactcttagcccttatcatgttgttttatatattgttcgattttgttttgtataatgcttctattagcaagatactgtttctgcttctaataattctttagcacctttgtactctacaccgtgagcttctgcaactgcttcgaatgttacatagccatctaatgtgttaataccttttagtaatgcagtgttacctaggcaagcttctttgtagcctttgttagcaatttgtactgcatatggtactgttacgtttgttaatgcaagagttgatgtacgtggaaccgcacctggcatgtttgcaactgcataatgaacaacgccgtgtttttcataagttgggttatcatgagttgtaatacgatcagttgtttcgaaaataccaccttggtcaatcgcgatatctacaacaacagaacctggttccattgatttaatcatttcttctgttacaagttttggagcttttgcacctgggattaatactgcaccgattacaagatcagactctttaacagcttctgcaatattgtaaggattagacattaaagtttttacttggtttccgaaaatgtcatctaattgacgaagacgttctgcacttaagtcgatgattgttacatccgcacctagtccaactgcaattttagcagcatttgtaccagcttgtccaccaccgatgattgttactttaccacgtttaacccctggaacacctgcaagtaagatacctttaccgcctttatttttctcaaggaattgtgcaccaatttgcgcagccatacgaccagctacttcactcataggtgcaagtaatggtaatgaacggttttctaattgtactgtttcatatgcgatagaaacaacttttttctcgattaaagcttttgttaattctggctctggagctaagtgtaagtatgtgaataagattaagccttcactgaagtgtttgtattcgctttcaattgggtccttaactttcataaccatttccatgttccaagcttcttcagctgtatcaacaatttttgctcccgcttccacatactgagcgtctgtgaaaccagaccctaaacctgcacccttttgaatgaatacttcgtgattgttacgaattaaatgtacaacacctgctggtgtcattgccacacggttttcgttgtttttaatttctgctggtaccccaatacgcataatgaaatgcccccttataattaacagaaaaaagagattcttttttctttttgtaataattaataacttatgtccttattctagcataacttaaaagttatgaaaacgctaacataccattttactaaagtttttatatttagaatagtgtaaatatataaaacattgattctattaggtgtttcgtgtcatttcattatctttcactctatttttattatactgcttcaaaataaacagcaatcatttattatttgacaataatgtaacaatgtaagaaacctaagcgataacgtatacatatacagttattactttactcaatactttagagatatattcttttcacaaaaaaacagctactagcatttagccagcagctgggtaacttataaataacttagaaaataaatcatctgtcgtttcagtaattttatcaaacagatcactttcttccgcttcttgctcttttaacatcttaattgtttcacgtgcatcttcagggtaatcggttatgataccatctacgttcaacttataatatgcctttaaattttccatatcatttactgtccatacgtaaattggtttgtttaacttccttgcttcttttactaatttcttatttaacatatattcttctgctacgtaaaagtcagccttcacattctttaagttagctctacttgcatacaatatataccctacttttatatctggatttgcacgcttaaactctttaataagtggatagtgtaacgtttgaattacacattgcttctcaaattcattatctttaatcgtttttaagactttgtttacaaaatctttttcgcccccatgaagcttcacttctatattaagtttgattttgccatttgctagcttaatgatttcatcaagtgtacttatttgtcctgaaagtccatcttgactaagggtaagttgccttaactccgccatcgttaaatctgacacatgcacattggcatttgcgagacgtttcagcttcaaatcatgtataaccgctagttcaccgtctttcgtttgtaatacatctatttcagcgtagtctgcttttgcatcaatcgcaccttgcacagcttctttcgtattttctacgccttttgatatatacccgcggtgcgccataataatcggttctttatacgaatttgaaataaacgttacaatgaaggcaacgaccattccggcagtaataattcctacaatgtatacgccaatgaatttccaacgatgtttttggaaaaaacatttatctgctttcgttttcgaataatctaatccttcttctaataaaacatcctcaaccggtaccttttgtaagtataatcgcgtaatcgccataatataaaatggcgtcacgataaagctgaataaatacaatgtgctcgttaaaaatacagaaatcgttgattcagctaataatgcaaatgttcctttcgggtttgtaaattcataaacaccccataggcacaataaatatattcccaaaaacacgacatatacaattccaattgaaataaaaaaccctactaaaaagaatagtactttaaaaaagctttcctttactaaagttgcacttttacgtgctgccacgcgaaatggtttttgctctaaaacaacaataggtagaacgaaaatccatcgaagattcaaatacgcgactacagcaaagaacgtgtaataaccaacttgtcccatcgttgtcttaaacagttctcctgtaataaagttaggaatttgaatttgcgggattaatgccgtttcatatcccatatttaaaagaggcaacaatacgacagcatataaaataaatcctggtaagcaatatgtaaaaagagtaggtaaatacgttaccgttttatataaaatcggacgtaatttcaccttctgtcttttatgagcgaaatacgaaataataataagcaccgcaaattctgtaaagataagaaacagtgctaacaatgataaaattacgattgctaagatcccataaggcgtctttaaaaacgctaataattcatcatttgtcgcatttgcataaccaccaaaatacaataacttattaaaaatgattccaaatagtggaacaaacacaatcgctgctaataatttataagcaagttgaaaagttaatacattccaaaaagcaaatttaactgtttgaaaggaatgtcctattactcctggtatagatagttttttacggtgttgcatatattcctccacattctaaaacgatatttgagatggattccatatttccagttctaatccatctttttaataataatatattccgcttaacatgaacactcttatacatataatgaaaaaagtgatggctacttcccatcactttttcatttattctattttttctctagcccttgtccaaatgctttcaagaagctaaaaccgaatgtaatagctctattgatatctggatcttttaatactttaaagaaatccatcacttttgtttttttaccactatttaattcatctgttgcaaattgcaatcctgtaactaaactggacgtaatttgcttcgttatttctgggtcaactgaagataacgcttctcctgcccccatcatattgttgagtgcatttttaactggttcacgatttaattgctccacagcgatttttgaaacatcttccttcgcagcaagtaaactaatcgctgcatctaatatgccagccttctgcaactgtgctaaaagctgcatcgtttcttctactgcttcacgattattagatagctcatttagaagttcatctgctaattgctgtttctgttcttcctctgttacaactttctttttaattatagtaatttctttcgccactatctccgccccctagtccacaagtgatacgtattgttttctttgccatttttgctggatttcaacaccattttgcggattacgctttttatctctcgggtttgaagatggtaacggacgattccctttttcacgtagtacacgcatctttaccatcgtttgtttgtacgctggtgtacacgtataaagatctgtcgccgttccagttaaaatattgattgcctcttcatttaccgttgcatgcatcggtaaatatagctctttccccgttacacgatctgtaacaagtgcctgtactttaattttcccaaatggtgatgctaattctacaaggccaccatctttcacattgcgctctagggcaagttcaggcgagatttcaacgaacacttcagatactttagataaaataccagccgatttattcgtcatattcccttcatggaaatgttctaacatacgaccattatttaaaagtaaatcatactcatctggtgctacaactggtggtacccattcatctaatgatagacgagctagtttatctgggaagttaaatccgtccacatataatagcggtgtatcgctaccatcatggctaccccaacataaactattccatccttctaaacgatcgtatgttgcctgagaatataaaggtgcaagcgatgcaatttcatccatgatttcacttggattttcataattccagtccccgccaagtgcacgagctactttttgtaaaatccaccagtctggctttgaatcaccaagcggcttcaatacttcatataatctttgaatacggcgctctgtattcgtaaatgttccctctttttctaagcttggtgctgccggtaaaataacatcagcaaaacgagctgttttcgataagaacatatcttgaacaacaaggaaatctaaattcgctaaaatatgttgtacatggttggcattcgaatctactaaagccatttcttcacccataacatacataccacgcagttttccttcatctgccgcaagtaacattgcaatattatttaaacctggtgctttcggaattgtagtaccgtatgctttttcaaatttcgcacggagcgcatcatctgaaaccgcttggtaacctggaagccagtttggtaatgttgccatatcacaagcgccttgtacgttattatgtccgcgtaatggatatgctcctgcaccaggacgacgatagttacccgtaacaagcaatagatttgaaattgctgctgaagttgtacttcctccagtattttgagttacacccattccccaaagtacacaagtaccatctgcttcatataccatacgagccatttctttcagattttctttcgaaatccccgtaatttcttctgtataatcaagcgtatacttttctaccattttgctatattcatcaaaattcttcacattttcagctatgaactttttatcgtgccaatcttgatcaataatatatttcgtaataccagcgagccatacgtaatcagttccttggcgcggatgaatgaataaatccgcacgctctgccatttcatgtttacgaaggtctgccacaattaatttttggtcatgtaatttatgagcacgttttacacgcgttgcaagtacaggatgtccttctgttggatttgctccaacgataatgacaaggcctgcttccgcaatatctttcactgttccagcgtccccgcccataccgacagttttaaataaaccgtctgttgctggagattgacaataacgggaacaattgtctacattattcgttccatatatttgacgggctagtttttgcataagataattttcttcattcgttactttcgaagaagaaataaatccaaatgcatcacttccatattctgatttaatatgctgcatattggatgcaacaacttccagagcctcttcccatgaagcttcaacaaacgtatctccttggcgaattaatggctttgtaatacgatcttcactgtttacaaaatcccatccaaatttgccttttacacatgtggaaataccgttaaccggcgcatctgaaacaggctgcactttcaaaatgtggcggtctttcgtccatacttcaaatgaacaacctacaccacaaaatgtacaaactgtttttgttttattcactttcgtcttacgcatcgcagcctctacttctgaaactgctaaaatactactatatcccggctctacatcctttacaaaatcaatcatcggatctaacacatccggtttcaatcctgtcatgaatccagcttcacccagcattgttttttccattaacgcattacatggacatactgttacacactgcccacaacttacacaagatgagtcatttatacttacaccattgtcccatataacacgtggacggtctaagctccaatcaatcgatatagtttcattcacttgtaagttttgacatacttctacacactgcccacaagcaatacattgatttggatcatatcgataaaatggatgtgacatatccacttcacacgcacttacttttggctcatacggatatttctgttcctcaattcccatcatatgtactgtattatggactttacagttaccattattgttatcacaaacggtacaatacaatagatgattttctaatattcgatccattgcctcagtctgtgcctcttttgcacgctgggactgtctttcgatatgcataccgttctctaatttcgttgaacaagcacgcaataactttccatttacttctacaatacacgtatcacaagtttgaattggatctacttctggtacatgacaaatttgaggatgttccaaattactctcgttaaataattgtagtatcgtcttttcacctgatgcagaaaattctttaccatcgacggttacacggactgtctgttctgccatagtttcccctctccttacaaccaactgtacaacacaattatgaatccgttttcaaaatcgcattactgtacatatttttgaaacgctctacccaaatactttcttatgaagtcgattctagatgttataaggtataactacgaaagcttgaaaatatcactattctacagttctattatatcgtacatatacaataataaccaaaataatctgtgatcttctttttaataggtgtttttattttttccattgttttatgataaatgtgggagagaaatacatataaaaggggaattaaatatggggcctacgcaagagacttatacaattgtacgttatcaatctggtacattttcaaaacaacttgatgagattgttacagaatctcctattactattaaattgaatggtgaagaatatgtaacagtcgtatgcacaccaaattatattgaagatatggtaattggttttttaatttctgaggggattatttcttcctataaagatgttgaagaactatgggttcaaaaagataacggaattgtccatgtaaaatcatcaaaagtgaatccgctctatcaaactttatataataaacgatacatcacttcttgctgcggaaaaggtagacaaggttttattttcgtaaacgacgcagcaaaagcaaaagacttacatgatatacatgtaaaaattactcctgaagaatgctttcatttaatgaataccttgcaacaatcttctactacatttcgccaaactggcggtgttcacaataccgcgctatgtgatcgaaacaatatcctcctatcaagaatggatattggaagacataatgcattagataaaatatatggtcattgtttgcgtaacgatatatccattaaaggaaaaatcatcgcatttagcggacgtatttcatccgaaattttactcaaagtttcaaaaatcggatgtgaaattgttctatctaaatccgctccaacaaaactggcattgcaacttgcccatgatttaggcattacagtcgtagggtttattagaaatgaatcttgtaatatttacacacatccaaaacgaattgatggctatcaatccaatgtttaaaaaataactcctcaatcgaggagttattttagttataaaaatgtaacatattaaacacttgaatagttaacaaagttaatatataatttcattacataattaaaacaaaacattgtagcatatatcttttcattcttttacaaattaaaagagaatactaacaaaacatatactcaatcttataaaagtaatggatttatttgaaatccaccagggaggttacaactatggaaattcgcttattaacaacagaggacgcagaaatatatttaaaagtttgtatggaaggtttaacgaagaatccggaagcttttagctcttcttatgaagatgttcttaaacatgaaaatcctgtggctgctatggctaaacgattaagcaatccggataagtatactctaggtgtcttcaaagataatgatttaattggtatcgctactttagaaacaaaaccatttattaaacaagaacataaagcaaaaatcggttccgtttttgtttctccaaaagcgcgtggccttggagcaggacgagctctaattaaagcaattattgaaaatgccgataaattacatgtagaacaacttatgctcgatgttgtagttggtaacgatgcagcaaaaaaattatatgagtcattaggtttccaaacttacggcgtacaagagcgttcattaaaacataacggtcaatattgggacgaggaacatatggttctgttcttaaatgattaatacttcaatataaagtgaaactttactcagtgggtgatttttccatcctccactgagtattagctgaatcaatcgggcttttacgggcagttatcgcccacctaactccctcgcattcgctgaattttaagatgggagttactgcccacaaatagcggggtagttttccaaaaacatctttcttaataagaaagatgtttttttgcattacaacaatgtaatcttcatgtcacctttatcgatcgtaccaatccttaccatttattatactaaaaatataaagtgaaactttactcagtggggaactacatcccacgctgatcgcatgtacttgatatatagaggagaatgtgacatgaaacaaaacaaacgagctatgcttttaatatttactacagcaattgtaacttctgggttagcaattttaccttggtttatcatataggaatactcccctaacaatgaaaaaagctgattgcttcttaagaagcaatcagcttttttattttataaaatccctaaaattttatttacacaacttataataataaccatagatacggcaacacacatgacaaccgtattacgatcttgcttttctttttttgaaatttcttcttttggattcatgtgtatgatctccttttaaaaaaagtgtgagataggaaatttttcttatccgatgcgaggtgaatacgaaaaccctctctatctcacatacacaatagaatggaattgtcattttataaataaaatgacatgacgttatgtcgcaacatagggtattttgtgtcgctacgttttttattataaaaaatagttgtgcaaaactagtgcattttttatgtcaattactccgagcgaaaaaatcatccctccattcaatcacataaaaagagttttttattattttcatgtaaactatacaagtagaatgaacagtttggggtgcacaagattatggtaaaaattttattagtagacgatgaagaacgtatgttacgattattagatctattcttaagccctcgcggctatttttgtatgaaagctacctctggccttgaagcactaaaattaatcgaacaaaaagaattcgatattattttattagatgttatgatgccgaatatggatggatgggatacttgctatcaaattcgtcaaatttctaacgttcctatcattatgttaacagctcgc

SEQ ID NO: 1372 - DNA, 15418 bp, Bacillus thuringiensis
ttttattgtaaatataactcgaggaggcatttagaaaaaattataccatggtgacacttagtcataaaaaaagttattgcaaagtatgtttagttgttttgttacaatatattcttgttggttagtaaaaccacatagcgtcttcttgacagacggtcatgtcctattgagtaactcatcaaggataatagaatactgtgttgtgtaacaagtagaaagcgcccgcttctcacttgacggcagcttatatttcatacagggaaagaatcattgattggtgaaatgaagcgagaagcattgtactctttaaagggaaaatggggactaggtgttggatcaacaattttatattttattttaagttatgtcgtttcgatggctgcaatgcttatactattaattccaggaattattatatttctcttatttgctggtctagcaggttcacttgaagggcaaacaatatcaaatggagcaagtgttacattcgggattttttattgcattatgataattttgagtagcgcatcgtatgggattacatcatacggttatacaaatgtatttttacagatcagtatacgagaagatgctaaagtagattacttatttgaaggatttcgtggctttaaaagaatgatgaaaacaatgtgggcaatgcttgcaattttattatatacaggtacatggattccgatattgttagtagccttatttgcattttttggtgaagaaggaaatgcgtcgtttgctattgctatctgtgtactactagaaatttcaattgttggtatgattgtgatgtatttttcttatgcactgacgtactatgtgatgattgaaaatccagaatatagtgtttcgcaggcgatgaaggaaagtaagaatcttatgaagggtcataagttagatttgtttcttttatggctgagcttcataggatgggctattttagcgcttcttacttttggaataggatttctttggcttagtccgtatatgagtacgacgacagcacacttttatcgctatatttcaaaaggtgaatttcaatagtaacatgctatactaatagaattattgtgtataggaggcgaggctacgcatgattagtgatttaaaaggagaagcactagattcattagaagggaaatggggattagctgttggagctacactactcatttcaattcttatcacggcttttagttttagtgttgattggggattttctttaattttcggttggcaaaaaacaaatggttcactttcaacgaatattcttacattttttgttactggaccgttaactttaggtggatattaccttggtttaaatatccttcgtgaaaagcaagctagtattggtaatatattcatttggttttcagagggaaagagatttctaaaatcatttttattatatttattagtaaatctttatcttttcttatggacgttattgttcattattccaggtattattaaatctttttcttatgcgatgacatactttattataaacgatcatcctgagtattcactgaaccaagctattacagaaagtcgtcgtatgatggatggacataagatggagtatttcattttatgtttaagttttattggctggtttatattaagttgtattacattaggaattggattcctgtggttaattccatatttctatacgacatctgcagctttttacgaagagatcgcagaagaatattatgagaaaaatatttagcattataaaatccccagtatgaattatttgttcatactgggggttttttgtagaaattctataaactgattactagtaagtggtttactgaaatagtaaccttgcatatatttacagttatgtttttgcagaaacttaagctgtttttcggtttcaattccttcggcaacgactgaaagatttaaagtatttgcgagggaaagtattgtagaaacgatggctcgttcttcaggacgatgatcagctaattgtgtaaattctctcggtacttttaatgtgtcgattggaaaaattgataaataagcaagagaagaatacccagtaccgaagtcatcaatggaagtttggataccgtattcttttaattgcttcagtcttaataacgtttctttctcgtcaatcattgcaatcctttctgttaactcaagggttacatattttggatcgacttgcacgtcgtttaatatttgtgaaatgctttcaattaattgatcttgccggaactcttttgcggatagattaacacttatttttaaattttggtagccaaaggtatgccatatttttaattggagacaagcttcttgtaatacccaatgtccaagtgggactacttgtggcgtctcttctacaattggaataaactcacatggtgaaatgtcacctaatagtgggtgtttccaacgtattaaagcttcagcaccgataattttatttgttgtcgtatcaatttgtggttggtaaacgagataaaattctttgtttactaaagcgatgggcaaatctttttcaattcgagcttttcgttccatttttttatatagttctttcgtgtaaagagagctaccgttttttcctttattctttgcttcgtacatggccatatcagcatgctgcaaaatggatagcgcatcttcacctgcttcaggatatattgcaattccgatgctcggtgagatttgtaaatgttgattttcgatttcaaatggctcattcatggccgctacaatcctatcagctattttttggacatctggcttttttttgtaattctcgataaggattgtgaactcatccccagctagccgcgcgagtttcatatttgatgttgctattctttcgagcctttttgctactgcgatgagcaacaggtctcctactcgatgaccgagggtatcattaataactttaaaacggtctaggtcgagaaacataacagcaaaaggctttttcgatatttttgctcgcgcaattgcctgttctaaatgttgatgaaatgcacgtcgatttgcaagctctgttaaagtgtcatggtatgctaggaaattaatttgttcttgttgttgcttgctttctgtaatatctttaatcattaaataaaccccagaaattttctcctttaaaaagatcggtacggcggtaacgtgcaagtagtaaatatctctgtttttatggtacgcccgtatttctaaagagatagaatacccctttttcacgcgatgaaaggcgttaatcatttcttctaaatcttcttcgtatatgagtgaatagtaaggctggtttaataattcattcgtttgataaccgagtaaagtagtaccagcgttatttactttgagaaaattaccgtacaaatctaatgtgaagattggatctggatgatgctcgtataaagatttaaacatttgttgattatgatagaatgatagagttcatttttctgttctactaaatcttctgtacgtagtttaatttgtttctcgagttctgagttgaattgcatttgagctagcaataagattttattttgttttcgaactaaactatgacgtatgagaacgaaagagaaagttattataagtccgattactataataggcgcaaaaacgtattcaactaatatgaaaacaataagcattactaccgaaatatacggtaatgataatcggattgattcaccaattttaggtgttagtagtacttgttcttgtttttcaggcttttttgtatggagaatacaggcgattgctactagtactaaggttacttgatagaaaggagtaactgtaaacatagaatactctggtatgaagtattttatatacgcataaatcgcatctgtagtagcatataaaattaaagcactgccaagaagtgcaccgacctttttaggtaataaggatagtggtttgaataaaaggttgattcctattaagagaaagagtaaatcagccattggataggtaagttgaacaaatatgtcgatataggatgttgtaaagatatgaatagttcgttcaataagtaagtagtaacttaaagtaaattgggctgtaacgataatacaaatatcacatagcataaaaagtttttctaataaatctcggttataaatgatttcgtatagaaaggcaaacgtaaagctaactaaaaaaagtaagtaaaaaaagtcagatggatcaacgaacgtatagaagtcctttacaattaaacgctgataggcaacgactatatcaccgataaaataagagagagctccaacagataatatgatccaaaataaacgagatagcccttctttcatgtttgaaaaataaagtaaataactacaagcgataatatcaattaatagggtactcattccgattaatagctgaaaagaaaatgagtattcatatagaaaaggcatcgctacatagtgaagcgttatagacagcaatacaatgcttataagaatacttacatgtgtttgttttttcatttatatcacctacggtttcttgaaaagcatatataagttttatatttattttgcacaattatagcaagttgtaaagatagattttaataattcttgtttctgcctcccaacatatcgacataggaatttgaattttgctataatgattagaatagttgcattatttagaaaaatttaaaaataataattactgcaactaggacatattgtttactatgtgaacttgttcttaatttaggggggagggtttcacaatggcaagtgtatatgaaaatagttatatgatcgttttgattttcttgctattaggtatattgctgccggtagtggctcttacattaggaaggatgctgcgcccaaataaaccaagtgcagcaaaggcgacgacgtatgagagtggaattgagccttttcatgatgcaaatattcggtttcatgctcgttattatattttcgctttattgtttgtgatctttgatgtagaaactttatttttatatccttgggctgttgcgtatgacaagctaggtttatttgcattaattgaaatgctcatctttgttgtaatgttgctagttggattagcgtatgcttggaaaaagaaggtgttacaatggttataaattttgaggaattacatccaaatgagcgagcagaattagaacgaaatatctttttttctacattggaacagttgaaaggatgggcgaggagcaattctttatggccgatgacattcggactggcgtgctgtgcaattgaaatgatgggagtaggttcatcacattatgatttagatcgatttgggtcattttttcggacttcaccaaggcaatcggacgtcatgattgtatcgggaacggtaacgaagaagatggctcctattgttcggcgcttatatgatcaaatgcccgaaccgaaatgggttattgcgatgggatcttgtgcgacagcaggtggtccgtatgtaaattcatatgctgttgtgaaaggtgtagaccaaattgtaccagttgatgtgtatattcctggttgtcccccaaatccagctgctttaatttatggaatcaataaattaaaagaaaaaattcgttacgaagcaaagaccgggaagcaggtgacgaataaatgagcaatccaaataaagatttagaggagctgaaaaaagaagcagctaggcgtgcaaaagaagaagcgagaaaacgccttgtagcgaaacacgaggcggaaataagtgagcttgaggaagaagatcaagaaaaagagaaagcgctaccaaaaaacgatgatattactatagaagaagcaaaacgacgtgcagcagcggctgcaaaagcaaaagtgacggcgttagcgaagcagaaaagagaaggaaccgaagaagtaacggaagaagaaaaagcaaaagccaaggcgaaggcagcagcggctgcaaaagcaaaagcggcagcgttagcgaagcagaaaagagaaggaaccgaagaagtgacggaagaagaaaaagcgaaagccaaggcgaaggcagcagcagctgcaaaagcaaaagcggcgacgttagcgaagcagaaaagagaaggaatagaagaagtaacggaagaagaaaaagcgaaagccaaggcgaaggcagcagcggctgcaaaagcaaaagtggcggcgttagcgaagcagaaaagagaaggaatagaagaagtaacggaagaagaaaaagcgaaagccaaggcaaaagcggcggcgttagcgaagcagaaaagagaagggacagaagaagtaacggaagaagaaaaagcgaaagccaaggcaaaagcggcggcgttagcgaagcagaaaagagaagggacagaagaagtaacggaagaagaaaaagcgaaagccaaggcaaaagcggcagcattggcgaagcagaaagcctcgcaaggtgatggggattcgggagatgaaaaggcaaaggcaattgcagcggcaaaagcgaaagcagcagcggctgcaagagcgaagacaaagggggctgaaggtaagaaagaggatgagccgaagcaggaagaactgtccgtaaatcagccgtatttaaatcagtatgttgaggctattagggagaagttaggagagggtgcattagtagattcctacattaataaactgtcaaaggatgtgccaactcttgtggtggatcccgaaaaatattatgaagtgatggagtcactgcgattccatgagggacttgcttttgattatatgtcagagctacatgcgacggattttgtgacacatatggaagtgtatgttcatttgttttcatatagtaagaaacaatcggtagcggtgaaggtaaagctagaccgagaaacgccgcaagtcgaatctgtgacagcgctttggaaaggggctgactggccggagcgagaagcatacgatttgctcggcattatatttaaagggcatccgaatttaacacgtattttaatgccagaggattgggtaggatatccgcttagaaaagactatgaaccgtatgatgtggaggtgtagctatgatccgcacggaagagatgcttttgaatgtaggacctcagcatccgagtacacatggtgtgttcaggctcgtaattaagattgacggggaaattattaaagaagctacacctgttattgggtatttacatcgcgggacggaaaagatcgctgagagcttacagtatacgcaaattatcccttatacagatcgaatggactatttatcagctatgacgaataattacgtcatttgccatgctgtagagacgatgatggggcttgaaattccagagcgtgccgaatacttgcgagtacttgcgatggagctaggaagaattgcgagccatctcgtttggtgggggacaaatcttcttgatataggagcggttagcccgtttttgtacgcttttcgtgaacgagagatgattataaatttattaaatgaattatgcggggcacggcttacttttaactatatgagagttggtggtgtgaagtgggatgcgccagatggttggattgaaaaggtggaagagtttgttccgtatatgagagagcaactggcaggttatcatgatcttgttagcggtaatgagattttcttaaatcgtgtgaaaggcgttggtatatatagcgcggaagaagcgatttcgtattctttaagcggagcaaatttgcggtgcactggagtaaactgggatcttcgcaaagatgagccgtattcgatttatgatcgttttgattttgatattcctgttggaagcgtgggagatgcttgggatcgctacgtttgccgaatgcaagaaatcgaggagtctttaaagattgttgagcaagcggttcagcagttcccgaaagatggagctgtgctggcaaaagtaccgaaaattattaaggcacctaagggagaagcatttgtacgtatcgaatcgccgcgcggagagattgggtgttatatcgctagtgacggaaagaaagagccgtaccgtttgaagtttcgtaggccatctttttataacttgcaaattttaccgaagttattgaaaggtgaaaacatcgctaatttaattacgattttaggtggagttgatattgtacttggggaggttgatggctaatgattgagacgctcttacaatcaccttcaagctggacgaatttcttcatttttttcggattagcggtacttctactatttgcagtccttggcttcgttacatatggaattttggcagaacggaaagtgatggggtttatgcaagggcggattggcccaaaccaggttggaggccgatttggtttactgcaaacggtagctgatgttttaaaactattattgaaagaagatagtattccgaaagcagcagataaaccgctgtttatattagcacctgtcattgcatttgcaccagcatttatggtgcttgcagttatcccgttcactgataaatttcaatttgcagatattggagtcgggttactttattatatcgctgtttccggtattacgacgataggtgttgtaactgggggatgggcatcgaataataaatattcccttttaggagggatgcgtgcggcggcgcaaatgatttcttatgagattccgctcgtaatgagtgtaattggtatcgttttgctagctggtagcctgaatttaaatgagattgtagcggcgcaggagaaggtttggtacattttcgtacagccaattggcttcgtcgttttcttaatcgcagcagttgcagagttaaatagaacgccattcgatttgccagaagcggagtcagaacttgtttctggatatcatacggaatactcagggtttcgctgggcgtttttcatgctttcagagtacgtatatttcttcgggatggcatcgttaattacagtgctctttttaggcggatggaatccagtcatgtttcttggatttatcccaggtgccgtatggtttgctttgaaatttagcagtgtagtctttctattaatttggttccgcgttacgttcccgcgtataagaggtgaccagttaatggagtttggttggaaagtattattgccgattgcacttgcaaatattttcttaacggcattgattaaggagttattcttctaatctatgaggggggtgccagtaagagatgaaaggactatttaaaggattaaaatatacattaagtaatttgagcaagaagaaggtaacgtatgattatccaaatcaaccgttgccgttgccagaccgttttcgaggaattcaaaaattttatccggaaaaatgtattgtttgtaatcagtgctctaacatttgtccgacagactgtattcagttaacaggaaagaaacatccggatcctacgaaaaaaggaaaaattatcgacacgtatgatattaattttgaaatttgtattctttgtgatttatgtacagaagtttgtccgacagaggcaattgtcatgacaaataactttgaactcgcggaatattcacgtgatgacttatttaaaaatttgcagtggcttgacgaaaacgacgaaaacgtcaggaaggagaataaggcatgaatggcgagtttgtagcattctttatactatccttgtctgcaattatcggcggtgttcttatgttgaacttaacgaaagttatgcacatgatgctagctctcgttctgacatttctcagcattgcaggtttgtattttcttttatcagccgaatttataggcgttgcacaaattttactttattctggtgcaatcacaattattatgattttcggcattatgttaacgaaacataacgcggaaaatgaatcgcgtcttactcttcgaaaatggattatcttctttgcagttgtagcatttggagcggttatgtatttcgctgttaataatgttgattttgcaaatgaaagcacacaaggaagtttacctctccatgaaaacaacacacttcaaatcggtacgcttctctattcaaaatatattattccatttgaactaacttcagttattttacttgtagcactcgttggcgcaattatacttgcgaaaaaggacgagaaagaggaggattccaatgagtagcgttccagcttctgcatatttaacacttgcgattattttgttttgcatcggtctatttggagctttaacaaagcggaatacagtaatcgtattagtttgtatcgaattaatgctgaatgctgccaatttaaacttagtggcgtttagtaaattaggcttatttccgaatttaacaggtcaaattttctcactgtttacgatggctgtagcggcagcggaagcggcggtaggactcgctattttaattgctttatatcgcaatcgtacgacagttcaggtggatgaaatggatacgcttaaaggatagcattgtgaccgaaaaagggggaaggaaacaatgatcgattatgcatggctcataccgcttttcccactcgtttcgtttttgttacttattatattcgggaagaaaattagagaaggaagcagcgtacttagtatttttttcgtctttctctcctttatacttgcggtacttgtgttaatagaaaggttttcagaagcaagcgtgaagcataagtgggtgtggcttagagctggagatgtggatatatcattcggctttgaagtgactgcattaggagctttaatgttatttatcgtgacgcttgtgagtctacttgtacatgtgtattcgaaaggttatatgaaaggtgatgaacgattaccaaccttttacgcatatttaggactctttacatttgcgatgttagggcttgttatatcaacgaatttattacagctttatatattttgggaattagttggccttggttcatttttacttatcggtttttatttctttaaagaagaagcgaaggctgctgcaaaaaaggcttttattatgacccgtattggggatgttggtttatttatcgggatgattttaattttttggtacgcaggtagttttgaatatgacgcaatatttagggcgatttatacaggggatctacctccttacatgattacaataacagcgatattaatttttatcggggcgatgggaaaatcaggtcagttcccgcttcatacgtggttgccagatgcaatggaagggccaacgcccgtttcggcacttattcacgcggcgacgatggtcgcagctggcgtatatttagtagcgacgatgtttcctctattttcagcaagtacagtggcgatgcagacagtggcaatcgttggagctttcactgcaatctttgcggcctctatcggtcttgtgcaaacagatataaagagggtgcttgcttattctacagttagccagctcgggtatatgatgctcgcgttaggttctgccggttatgtagctggtatattccatttaacgacacacgctttttttaaagcactattatttttggcggcaggaagtgtaattcatgctgtgcatacgcaaaacattaataaaatgggcggtttacagaagaagatgaaagtaactggtacgctatttttaataggtacccttgccattagcggtgttccgctgctttccggttttttcagcaaagatgaaattttagcggcgacgtggatgaatggcaattacgttttatttactttagcggtaattgcggcgtttttaacagcattttatatgttccgcctatactttcttgtctttactggagaaacgaagacgaaggaagaagtgcatgaatcgcctcgcgttatgacgtatccaatgattgttctcggcgttcttgcggtagtggcaggatatataaatacaccatggtttgggacatttctcggagattggttgacgaaagatgtagggtttaaggttgaagaagcgcatggaccagtttggattatgattgttgcgacactcgtttcatttgcgggaatcgctcttgcatatttcatatatggcaagaaatcaatttctagagattgggctgggggtacggaaacatctctttataatcttttgaaagaaaaatattatgtggatgaactatacaacatgacggtgatccctattacgaaaggaatcgctcatgtgcttcgcttatttgaagtgtatgtagtcgaaggaattgcagttttaattggaagtgtagttaaaggcacaagtaatcttggatcgaaacttcaaaacgggaatgtacaagtgtacggtactgtaacggcggtttcgctcgctgtactcgtcattattttgctctatacgggaggggatttacgatgaatgatttgttgttaacgttcttcattttttccccgcttttaggaattttattgcttgtattaacaccgaaaaaggaattgcgtacagtgcgggcgcttggcttatttgggacggcacttccatttggaattgctatcgtcctcgcttgtacatatgcttctggaaagaatttgtcactatttgatgagaaggtgaaatggattaagttcggcgattttacagcggtggataaaaggtggttttctatttattacgagcttggtattgatggtttgtcgcttgtcatgatggtactgacggctcttctagcaacgcttgcagcaattgcagccttttctattaaaagaaatttaaaagcattttatatgctgttactcatgctagaaataggaatgctcggcgtctttgctgctcaaaacttaatgttgttttttatcttctttgaaattacgttgccaccaatgttcttattaattggaaagtggggaaaattgtcgagtgaaaaggctgcgtatagttatttaatatataacggtattggctcagctattttgctcattgttttctcaattttgtttgcgaaaacaggtacaacaaatattgtggagctgaaagagatattaagaagcataaacgcagagggagcactcgtcatcccaagtagtttgcagcttagtgtatttattgccataatgattgcttttgcaattaaactacctgtttttccgttgcaccgctggatggtcaatgtacacatagaagcgcatccagctgtagttatgcttcatgcgggtgttttgctgaagattggagcgtacggtattattcgcttcgggaaagggctattcccggaatattttcacgatgttgcaacactaattgcgatattaggcgtaattaatttattatacggtgcctttttagcgctcatccaaacggactttaggaaagtactggcttactctagtatttcgcatatgggaattgtgttaatgggacttgcgtcacttaatgcacctggtacacaaggagcgttattccaagttgtatcacatggtttaattgcagccttgctcttcttcctactgggtgttatagaacaacgatttggaacttcggatattacggtgctaggcggacttgcgaaaagtgtaccgatacttagcggattctttttagcaggaggaatggcatcgcttggattaccagggatgtctgggtttgttagtgaatttcttgcctttctcggtttatttcaaggagagcccgtcattgctgcagtcggtgtgattggcatcattttaaccgctgtatacgtattaagggcgacacttcaagtgacatttggaaagaaagagtgggaagcaaaatctgatatacacggatgggagtatgtccctgttttactacttatcttttgtattattgcaattggagttatgccagagttactaggggatccgcttcaaaatacattgaaaacattgggggtgaagtaggatggatatgaatacgttacttagcttatcgtggcatctaatggtgccagaatttattattctcggcgccgccatccttctttccatatgtgatttgttttttaagctgaatcatagatatgtagctcttggtgcgattgctgctatcgtattagcaatcgtgtcattaattacgctatatagcgaactagctggagatattttaaacggatcgtttgtgttagatggattttcaaaagggtttaaaacattgctattaggtgcctcagctcttattttatgcaccgcaatgagcgatgataagaagaatccaattgaagataagggtgaatattattacttatttttaatggcacttcttggtgcgatgttcatggcttctagtgttgatttcattacccttttcgttggtttggagttactttcactttcttcttatattttagtaggaatacgaaaaaagagccgtgcatcaaatgaagcggcaatgaaatacgtcattagcggaggaattggaacggcgattacgctcttcggaatgagttatttatacggtattacaggttcaactaacattgtagatatgcaaaaggtactcactggggaactcgctagtggtattcagttattgttagctctcgcatttcttttattgctagtcggtctctcatttaaaattgccacagtgccgtttcatatgtgggcacctgatgtgtatgaaggagcagctacaccagttactgcttttcttggaacgatttctaaaattgctggtttcctactcattattcgtttgttccttatggtttttgcaagtgtattaatacaaggagatatgcaatctttatatgggcatatgagtatatatattgcggtgctagcaagtattacgatgattgttgggaatgtagtcgcgttaaaacaatacaatataaagcgtttatttgcttattcgggcattgctcatgcagggtatttactcgttccacttgtcgcattatcaccatttacgatggatagcatgtggttttatatgctggcatacatgcttatgaatataggtgcatttgctatcatccacggcttaatcttacaaaatgatgaggaaaatataacgattttcacaggtttatataaaaggtcgccatttgcagcgattatgatgacaatttttattttatcgttggctgggataccaggaacggctggcttcatcggaaagattaatatctttttaggcgcgcttcatgtagatccagcacattacgtactagcttcgattatgatgggtacgacagttgtttcattcgtatattatttccgtattttacaacaaatgtttttccgcacaggagagacagaagagaggatacggttaccgttaaatataaaggttgttatgagtctttgtgcaatttcgattgtaatactagggattatgccgatgattgggtacaatttcttttatgaatattttccattaatgaaagatttcttcttcttagggaacgtggtacaatagtgaaaataaaaggtgtggagtcagtactctgaggattatattttgtgttaacttgtaatgtagatatacgtttttggaaatcacggagtt

SEQ ID NO: 1373 - DNA, 20714 bp, Bacillus thuringiensis
  unsure (1)...(20714): unsure at all n locations
cttcccctcctattctatttttttcgttcatagatagaacagtaaaattgtagtcgtttttaaataggaaggcaactgattaatagttgatgaaattcagataatagttcgtcggtaaatgaatttatattggttgcttcttggattatatcagcgattatcagaatatatcggcgcaactacaaatatatcagcgattattaaaatatatcgacttaccgacaaaaaacgacaacagtaacaatatataaaagggtagactgcntgaaaggggcatgttttctacccttatttgtactatccaacttccttttctcgcttcacacgttctttagcactccatttaaacaccttatctagtagcgagtatattctcccagattctttcgttaacaaaggtcctaacgatgctaatattaaaacatacaaagctgagaacggtttaatcgctgccattaagccacccgcaattccaatattcgcgacgataatagaaaattctccgcgtgatacaagtgttaaaccgatattcgtagaagccttatgcgataacccagctttacgccccgcaaccattccagcagtaaaattaccgataagagtaatgaaaactgctcctaatgccaaccacactgctccgccaagtgaaaatgggtctatacttaaaccgaagctgaaaaagaatatagctccaaagaaatcacgaaacggaacgacaagctgttcaattcgatcactatgctctgtttcagaaaaaacgagtcctagtaataatgctccaattgcctctgcaacatgaatcgtttctgaaaatcctgctacaaagaacaaaatagcgaatattacaataataaaaatttcattggacgaaatatctaacattttatttaaaaaccgtgtagctttcctagcaactacaaagaatagtagcatataacctactgcgattaaaatagatgtaagagcacctacaaatgatgttgcccctccaagtactaatcctgaaacgactgataaatataccgctaaaaagatatcatcaaacataatgattcctaaaattagctccgtctctttattaccagatcttcttaaatcaacaattactttcgcaacaattgcactcgatgaaattgttatgatcccagcaataattaatgtttctaataaggggaaacccattatatatccgtaaagtaaacctaatataaaattaagcgatatatgaacagttcccccaaaagcaattgattttcctgatttaattaattttttaattgagaattctaaacctaagtaaaataggaggaatatgacgccaacacggccgaggaaggaaataacttctccactttcaataaatcttaaatcgataagccctaaatctggggcatgaggccccactagcataccgagtataataagaaacggaataatcgagaactttaactttgcagcgagaatagctgcaaaagcgactaatactaacgcagttccaacttcaaagattaaagtatccatcgattatgaatcccctcctactgaaagcaactcattaataattcttttcacttcatgtctttcacctgataatacgagcatatcgccagcttcaatgatagaatctgggcctggattaaagaacttcttcatattctttttcaaaatggcaataatcgttacgttatatgtgtttcgaacatgtaaactaccaattgttttttgtacaactggtgcattattttccaccttaaaccactcaattgataatccctcaaaagccatttcaatcgtatctaaagcttgtggcctatataccattccgcccaatatagctgcaatttgtctcgcttcagaatcacgaagagagacgcttgaaatactctcttcatgatcagcatcaaaatggtacatttctcttcggccatcatcatgaataacgataaccatcttttcattaccttttgtaatcacttcaaacttacatccaatacccggcagttcactctctctaatattcatattttccgcctcctaattttttagttacggcttttataaatcgacatcaatctccgttttaaagctctcatcctttgagatacctaaatactttagtgtctctgatggagtcgcgtgatgaaaatgtttttgcaatagcgcaatcgctatccctcttttgtacgcatgaaatccgaacgtttttcgcattgaattcgttccgattttaccaacaactccaactgcttctgcagcattatgaattacacgatacgcttgttggcgcgtaattgaatttggcgttttattagattgaaatacgtaattttctcttttaacgccaatagattgtacgtaatctaaaagcgcttcttttacttttgtatttaaataaatatcttgtttaaatttttcatctttcacaggaagagcataaaactctttaacagtcccgtcttcatttaatacatcttcaaatttcatgctaagtagttctgtaatttttaatcctgtgttaattccaataacaaataaaagataatctcgctgggagtgctcttttaaatattttttcatagcctcaatttggcttatatcttttaatgcctctacaacttccatacatgtattctcctcatcttatgaacggtaattttctcattatgttgtccattttaccttatcatgctatgagatttccatgtgttatccattattttcacaatatactcaggtggttctgaaaactttcaatgtggaaacttacgattgtataaatacgttgcggtaaaaaaatgtggggataaaagttcagcttctttctacagattggattcctcctttccttatacagctacttctacttttatattacgttacttacttacattatattatacatttcagtaacattaaagtattttttctgaaaataataaaaaccgagcgtttttgctcggtttttattattaatcttctttcggaagaacaattcctttatacaattgaactgtaatgaagtaataaatcgcataaataactacgaaaattacaattggtacccaaatacggaagtacggatcgattaaaataaatccgaaaatattcataccaactaatacgtgagcgatacccacaattgctgggaataagaatactaagaatagctctttataaatcgatttcgttagtaactcacggcgcacaccgattttacgcagcatttgataacgcgtaatatcttttgatgcaccagaaagaattttaaacataaggcagcttgccatcattgctaagaacgcaattccaaggaagaaccccataaatactgttccactcgcaatgccatagaacccactataagcttgatatttactatccatttgttcaacttttacatttttatatttatctagctgcaactcgtcaagttttttccattcttttttatatgttaaaaaatcatctgtttttccgataaatgctataccttctttaccatttatcccatcgtacattttttgatctacaattttaattgcatgatcattgtataaataatatggatggattgtactaaaagcatctgtccattccgctgaaagttctttagtattcgcatctttttgattcatctctctagaaactgcacctaccggtagttcctctgaaacttttttcgtatttactaaatccttcatagacttcatctttgccatatcttttacgaaaggacgatttttctctaaatcttcttttacatagtaaacgtatttatcatcaactttataacgatattcgcttttctctttaaatgtaataccatctaaaattttcttttcttcagctgttggattatgaactactgaatcatatattactaaaccatctaccatttttataacgttatttttgaacgccataccgcccgaaattgcaccagctccaagtgcaactaacattgccactgttgcaagtacttttgttaaactattaattcggaagtttaattgtgcaaatgtaaaagcattaagtcctttttcactacgctttttattactttttaactttttaataatgactggaagaagtgagccaaatagcatgtaagtaccagctgtcgttgtaattaatgcaataaggattcccatctcttttagtttttccatatagatcatagatgcataacctatacctaataaaataacagcaaggaatgccactacaactgtctttttaccttttactgcaacacgctctgtttgtgcatctgcatgtactagttgcaatacagaaatacgtgacaatttaatactgttcataattgctgataatacaaatagtgcaaagaagaagatgcaagtaacagtcatagatggtagataaaatgctttatacccttcaccagcaaattcaagctgtttcattaataactgtccaataccttctgcaagtcctactccaactgcaatcccaattgcaagagacgcagcacctaatacgattgtttcaataaacataagtaatgtaactttatgttttttcgcacctaacatcatatacataccgaactctttttgacgaagagataataagaaagagtttgcatataaaatgtagaagaacgttataattgctaataaaaatgatcctgcttggaatacgaatccaatagatttaatcactgaattagattctaaaaatgctttattcagtgctaacgtttggaacatgtaaaaaattgaaatcgacatgacaagaccgacaagtaagacgatataatctttcagcttacttttcagccccgacatggaaagtttaaataacatactggaacctcctttcttacgccttttgtgtacctaaatctgcaagtacatctaaaatttctttgtagaactcttcacgcgtaccaccgcgatgaatttctttatatagctcaccatcttgaatgaataaaatacgctgacagtaacttgcgctatatggatcatgcgtaaccatcataatcgatacgccttgatctttatttaagtttgtcatcgcatcaagtaaactcgttgcatttttagaatcaagcgctcctgttggctcgtcccctaaaataattgccggctcatgcactaaagcacgcgctgctgccgaacgttgcttttgcccaccagatacttcagatgggtacttttgaagtatttctgtaattcctaacatatccgctactttctcgacttttggtccaatgttacgtgatgcgacaccttgaagagaaagtggaagtgcaatgttttcataaatagataagttctctaataagttaaaatcttggaagataaatcctaatttttgcgaacggaaatctgaaagctcaccttgcttcatttttgtaatatccgttcccgcaatttcaacaacgccgcccgttgccttatctaacgttgaaattacatttaataatgtcgttttaccagaaccagatggtcccataattccaacaaactcaccctcttgaattgagaatgatacaccttttaacgcgtgtgattggttctcaccttttttaccgtacactttttgaacgtttttcacgtctacaactggtttcgtcatatatatcctcctacgcttgtttttccattacctattttgcgctttttagaagtgaactgctatttgttaacattacaattaccttacacttttgtaagatagaaaatggatgcgtgtaaggttggcttttcatactagttcacatttcgacatagtaaatcggtaaatgaaattatatcggcgattgttaaaatatatcagcggttcttacacttttatcagcgatttttcaaatatatcggcgattcttacacttttatcagcgattaccaaaatatatcgacttatcgacaaaagatgacaataaaaataggctgttccgcgaaaggaacagcccactgattaaagtttcactttatttctttaaaggtgttaccgtccagtacgtaataacacgccaaacccattctaatggacccattttaaagattttcatccaaattacactaaacacaatttgaattgcataaattgcgatacatacatatagcgtctgcatgtatgttaagttacctgcaaagttaaatacactaccagcaattaaaatcattgccgtttgtccgatataatttgttaaagccatacgaccgtagtatttcaatggtgctaataatgtttgaactggttttaactgaagtaataaaattaatgctcctacatagaaagctgaaataattggtccaacattaataccaatttttagaaactggcttgcagcatccattgttccatcttcattcatcaatatcatatttacaaatgggccagcaggcacgtgtccatattgataccatacagctgccacacttaaaacaaacataatgcctgtaaaaatagcgacttgctttatgttttttgaaagattttcaaatacacgatattgtcctgcagcaagtcctaataaaattaagccaagtggtaatagttctttaactcccattacactgaaggcaattgtcaaaataagtcctagtgctaggttcacttcttttttcgctttataaaacggcaaaacgattaacccacaaattgcgtataacgctagtgcttctccaggctgaaacatttgatgaattaaaccaaaaataaataatgcaactacgcggcggaaaaatagaacatatccatttttccctttcgcaatcgctcttgtaatgaagatatagaatcccactccaaataagaatgagaaaatcgagaagaaacgaccttctacaaataagtatagaaacctttgatagctagcatctactgtattaggatctggagttttaatattaagtagtgctaaaatatttactaaaataatccccagtaatgcgaagccacgaatgtaatctaactcatcaattcgtttgtttgtaatattgttccccataaagcagctccttgtccaaaatttaatcctcccttactctactggaaaaggacaattacaactatcggcaaaccttacagaaatcttacactattgtcatatagcaaaataaaaccaggtcatatttcgacctggtttactctgattgttttgatttttgaggttgtccttttttactattacgctgttttacttgaacaatgggatcaagttcattcgaaaactcagcgttatgtccattttgtgttttttgctctgggttattttgatctgaacgtttcgccattacattcactccttattagtgcggtgtaataatcatttgatgttgcaattggcgaattgccatacgtgctctatttaattgctcacgttgctcatcattcgcatgttgttgcatcgtttgtaaatcgttatacgcttgttctaattgtaactgtgcatctgaatactccatcgtattgtaatgctcttgtctcatgccttgttctaattgttcttttgcatattccaccgcttgttccgcttgtgtaatatacgattcaagtgattgacgctctgccataattgtccctccttgcttcaattcccctttagtgtgtcccttccatctctaccttatgagtatgttataatggattttgtttcattttgactcggcttaggagggaaaataatgaaggttcaaaacccttttccatatacaaacgacaataaacgttatcatacatggaattaccatttacgaaatgaatttggtgaaaaaatctttaaagtttcattagatgctggcttcgattgtccgaaccgtgatggtacagttgcttacggtggttgtacattttgcagcgctgccggatctggcgacttcgctggtgatcgccgcgatgatgttataacacaatatcatgaaatgaaagaaaaaatgcgctcaaagtggaaagatggaaaatgtatcgcttatttccaagcgtacacaaatacacacgcaccacttgaagtgttaaaagaaaaattcgaaccgcttctagcagaaaaagatgttgtcggtctttctatcgcaactcgtccagattgtttaccagacgatgtcgttgaatatttagcggacttaaataaacgtacgtatctttgggttgaacttggactacaaaccgttcatgaacgcactgcaaaccttattaatcgcgctcacgattatccgtcttacgtggaaggcgtaaataaattacgtaagcacggcattagagtttgctctcatattattaacggtcttccacttgaagattacgacatgatgatggaaacagctcgtgaagtagcgaaacttgatgtacaaggaattaaaatccacttacttcacttattaaaaggaacgccaatggtgaagcaatatgaaaaaggacaactcgaattcctttctcttgaggattacgtaagtcttgttgttgaccaacttgaaattattccagaagacgtaattgtgcaccgtatcacaggtgacggcccacctgatttaatgattggtccaatgtggagcttaaataaatgggaagtattaaattccatcgatgcagaatttgtacgccgcggaagctggcaaggaaaatatgcaaatgaggagaaacaacaatgaaattagaacgtgtattaccgtttgctcgcacactgctgcaaacggctgttaaagaaggcgactacgctgtagatgcaacacttggaaatggtcatgacacttgcttcctagctgaaattgttggggatagcggaaaagtatttggatttgatattcaaaaagaagcgattgaaagctcaacaactcgtctaaaagaaaaagaactttttgaacgtactgttttagttcacgatagtcacgatacacttctatccgtactaccagaagacgcaaaaggaaaagtaacaggcgctatcttcaacttaggttaccttcctggcggtgacaagcatatcgttacaaaaccgaactcaacaatttcggcaattgaacaattactagaagtaatggcacctgaaggtatcatcgtcctcgtcacttaccacggacacccagaaggacaagtagaacgcgacgctgttctcaaatttgcagaagagctagaccaaaaacaagctcacgtactgcgatatggcttcattaaccaacaaaacaacccgccatttattgtggcgattgagaaacgataaagtgaaactttaatcagtggggggaatccccactgattattagttgaaccaatcgggcatttatgggcagtttatttcccaactaacttctttgctccaggcgaattttaaggtgggagttttactgcccgttaatgcggggtaatatatcaacgatttttcaattatatctatcgtaactcgggatatataaacgattttttcgatatatctatcataacttacaatatatcaacgatttctcggatatatcgacgattcgacaaaacataacaaaaaaagacgtgcactcactgcacgtctttttgttattctcctatataatggatataaacattcttaaaggagacgagacaatgatcggaatactagcaggaatggggccaaaatcaactggaccattcgtcgatacagttgtagcagggtgccaaacaatatacggagcaaagcatgatatggactttcctcatatgatgatttattcgtgcccaacaccgttttacatggatcgccctattgatcacgaagcgatgaaaaaagcgattattgaaggagcacaaaaacttgaaagtactggcgcaagctttatcgctatgccgtgcaatacggcgcatctttattttgaagaattacagcgttctctttctatcccgattttaaatatagttgacgaaacgttacaagcaattcctgaaactgcaaaaagagtcgctcttcttgcaacggaagcgacagttcaagctggtatttatcaagacgggattgcaaaacggaatatagaatacattcattatgaaaaatggcaaacgatgattaatcaaattattatgtatattaaaagcggagaagttgaagaagctcgcaaattatggagcgcgctcattgtgcagttgaaggatgaagtagataccgcaattatcgcatgtactgatttgaatgttgtggctagtgaggattttgttgattcttctcaatgtcttgcgaaagcggttgttaggatgtacttatcaaatataaagagatcttcataaacatagaaaacactccttctaaaatgtgttttatgtttaataaaaatcccacaaacttttaactttcttcacaattctttcaaagtaatcacacttaatctcgctatattaaataagtagttattcatatagggaaggttaggggaactgaaagtatgaaagtaaatcgttcgcttcattacattttttggcgttggcatttttatgctgggctttttattacgccacttcttattacgttgtcactgagcggaattgggtatttatttcgagaggaagttgaagatttcatctataaagatttatattttgggaagagcgctcaaacagaatctatttcgatggctgattctatttcgttaacagagaaaaaatatccacattatagtgtggcgaaaattagtgagtttaatggggattataatacgagacttaccattgcaaatgagtatactggacaacaaaaatatgtgtatttagatagtaataatcaaattgttggggatcaaaatgcaagtgaaacgtttgccaatataatgagggaattacatagttctcttttagttggtggcactgtcgtcaactatactgtagaacttgcggcatgctggactatctttttaatcgtgactgggttgtacatgagtatacgccagttcaaaaacaaaccggcatccaataagcgagaaaaagcaaaacgacgtcattctattatcggtattatatttacaattccactcgttctgctagtcgcatctggattgccatggtcaggatttatgggtaaccaaatttataaaattgcgtcgtcgaatgaatcgctcggatatccgaaattgtatatggcgccgcctgaatcaaaggtaaaagaattgccgtgggcaacaagaaaagaagctccgcctgaatcgaattcaaatgaaccgaaagcaatttctgtcgatgaattacaaaaaggaattgaaataaagaagccatatgttatttcactaccagctgatccaaaaggtgtattcaccgtttcgaaatcgagcggttctggtattacaggtatgcatgttgcaccaaatgaagagataacagcttactttgatcaatatagcggggaattcatttcaaaaacggactatcgtgattatggattacttgcacaatggttcacttacggcatcccgcttcatgaaggacatttattcggatggccaaataaaatattatgcttactaacgacattatctctactacttcttatttattacggagtaaaaatgtggttagcaagaaagccgaaaggaaaattagcagcaccaccaaagcaaagagataagaaaagcataatcgttttctttatcatgatggttatactaggcgctgccatgcctttattcggactatctgtattagtgatttttgcgattgaacttcttatatatgtattttcaaaaatacgatcataataaaaagcatttgtacacgcgttgtacaaatgctttttatttctctctagatcacttatctatcttcaatggcattttcttttttattaataacttttttatctttccagccaataacacacttcccaccattaaaattaaatccccccaatgtattcaccacaatttgtacttaaaacaaattgtgtacagcgattaataataatataaatccacttaaagctgtgctaaattgtcctaatgtccaagatccaatttttacatttgcaactttttttcctaatttaactcctaaccaaacagtgaaaaaactgaatacagctgctgataatgaaatagcaaatggagataattttaataaacctgcacctagtccattcgttagagcattcatcgatatagcaataccaagaacaatagattcaaaaaaactaatattccctgatctatcaaggtcagctttttcaggagattttaaatatccagtaataacattcgaaacagattcatcttcatcaagtacttcttgattagccttctttttttgtggaattgtcattaaaataattcgtaaaccaattacaaacaaaaacaatgtaccaataacgtcagataatgtacctggaaaaacttttgaaatatattgcccaaacaaaatacccatttcactaaaaataaaagcaataattgcaattataaagttagctaaaaaacctattcgaatattacgaatcccataagatagccctactccaaaattatctatactagaagataacgaaagtaataaaatggtaattaaagctactatagtcataattgtcatactccttttcacaaaaaacagcaagttattttctgggttattgtatgataggtgaaaaaaagtgttcctacttaagatgaggctactgaaaaagcccaccacctactatatacaacagatcgtggaccctttttattttctgtatactgataaaatacgccattttcaaaataacaaaaaagacactcataagagtgtctttaactaaattagtggttttcttcatcactgcgctgttttctttcggtacatcttcccgttccaatagaagaatcgtgaagtgaggcctccgtactttacaatgcgccgtgccattttgtgcatattcttttgtgctgatactttttgatctgataaataaataccaagtaaccctctgcttatgagacgatgaaacttcgcatgaggcaaatcaccaatgctcttctctgcttcttctacaaagtgtttcatccgatctaatatcgcttgctcgttttcgtaataactacagaaattcaaatctccgcctatacggtcttcttcttgatcaatgaaataatcaagcaaaatatgaagtccttgtacgtaagggaagtatccttgtctaattttcgcaatatcttcatcatgtaattcatcatgaaatgcatatgcaacaagacagaaaattccaagtgtagaaccggcacatgctgaaaattcaaaccaactcatctcaggtaagttttctttatgtgcttcaaaccaatttttcagtcgcggctctctttcttctaatttcacgtgtttatgaatttgcaaatcacaataataacaagcaagttcatgaagaacaggagcaattttgtcatagtgcttcgttttctttaaaacatcttggcatgtttcaacaagttcatctaaataaccaccatcatcttgatcatcacgataacgataataattaccgccaccttctacttcaggtgataatgccattaacatcgattcatgcagtgcggcaaaatcatttggatcaagtgatgtactgcgatcacataaattatctaaatagtcgctgatcgtttgatacgctacgataaaacgaatacattcttctcggtgttcatttgctagcagagctaaaatgccaccgccctcacaatgaaacgttttatgctcaatacttgcgattgcctgactatgaagctcatcattcggaatatggtaggcacgctctttccacatcgctagctcatggtgtacaaccggaaacacatcacggtatactttcgccatgagcgttatgggattactcggtacgttcacttcttccttcatctcctctattaaatgtacaaataatgatttatttgtttgtttttactatattattgacatgcatttcagtaaatgactgaatataactcaaaatttcatcacgctcatactcatttaatagctcgtgataacaattcggccattctttaaaagccttatcacttattttaacattatcaaaccaagtgcggacacgtattttatctacaagtttatcctcacaagcttgcattagcaagagcggaacatctggaaaatcatctatttttttatgagcaatttcgatagacttaatcaattcactataccaacgtactgatactttgcgcaagaacaaagaatcattctccattgcatctctcacttcatggttacgtgttgacatttccaccgtaagattcgttgcaaattgcaattttggagccacaacatttaatattcttgaagcaaattgaagcggagcagagggtccagtcactacccctaaacaaggcgaactcaaaataataccctctacatcttctctcttcgtttcttgcatcatacgaatgacaataagaccacccatactatgaccgaatagaaaaataggtaacctatactttcttgcttctttcacccataatttaacttcctctatgtattcatcaaatgaatcaatatgtcctctatttcttgaagtcgttccatgtgacggaagatcccccatcacgacgtggtagccgatatgattccacatttccgcaacggcttcgtaacgtccgtgatattccattgcgccgtgcacaataacaatgacagcttttgcttcctccgcttcataattccacatacggctctcctccatttcactctttctcataatttgatacactaaaactagtctctaggaaaggaagactttacatgatatatccttacaaagaaaaaaaaccgaaaattgcgagtagtgcttttatcgctgactatgttacgattacaggcgatgtttccgttggcgaggaatcaagtatttggtttaatacagtcatccgtggtgatgtgtcaccgacaatcattggagaccgagtaaatgtacaagaccaatgtacacttcaccaaagcccgcagtatcctcttattttagaaaacgacgtaacaattgggcatcaagtcattttacatagttgccatattaagaaagatgctttaattggaatgggatctattatattagatggtgctgaaattggcgaaggagcttttatcggcgctggaagcctcgtttcacaaggaaagaaaattccgccgaacacgttagctttcggtcgtcccgcgaaagtcattcgtgaattaacagaagaagaccgtaaagatatggagcgtattcgcacgcaatacgttgaaaaaggtcaatattataaatcattacagaagtaaatttccgctgccataagattggcagctttttttatataaaatctaactttttctttacaaaacattattactccctcaacaaaatcttattaaaataaaagctaatatctccatatatatgtagatgagggaggagaattttcatgaaggtcagtggattatataaaatagaatgttacattttcagaggaattaaccgctactttgatcaaaaaacattaaatatctttttcagcaatattactcatatcggtggcgcgactttctccatcggactcacacttttctttttaattttcgcaaagggaactttgcatcaagctgcaattgcaactgctatttcgttagcaattagccatattcctgtgcaaatattaaaaaggtggtatccgcgaaaacgtccttatttaacaattcaggatgcaaaatatccagtccatccattaaaagaccactctttcccgtctggtcatacaacagccgttttctctgtcttcattccatttatttgctataatccaagcttacttgctttcctattaccgttagcgttatgcgtcggtatttcacgtatttatttaggccttcactatccgtcagatgtattcgtcggtatgtgccttggcacttgttctggcatcatctctttttatcaattcatcccacttttcacataaaggagtgatatgatgagagtcgccatttttaccgatacttttacgccacaagttaacggggttgcgaaaacgttagagcgattaacacaatattttcagaaagaacagatcgcctattctgttttcgcccctcagcatacagctgaagataattttgtagcgaatgtgaataagatgagaagtatcccgttaacaatattatatccagaatgtcgtttttcttttcctactccgcgcattaaacgggaactactttcctttaaacctgacattattcacattgccacacctttcaacatgggactttgtggattgtattatgcaaaaaagttaaacatcccagttgtcggttcttatcatactgatttcgatgcctatttacgttattacaaaatcgaattcctctccaatatgctgtggaactatttaaaatggtttcatagtcatatgcaaaaaaattttgtaccttcctttgaaacattacatcaattaaaaaacaaaggctttcagaccctctctatatggggacgtggtgtagattgcacactctttcatcctgcttacaatacagacctattccgaaaaaaatataatattacagcgaagtatgtcctttcctatgttggacgaattgctcctgaaaaagatattgatacgctgcaacaccttatcgttaaaacagcacatactcgaaacgatattcattggctcattgcaggagacggtcctctagcaacaagtttacgtgaagctgttccgaaaacaaatatcacttttactggctatttacaaagtgcagatttagctgaagcatatgcttgttctaacataatggtgtttccatcagctactgaaacattcggaaatgtcgtacttgaatcactcgcatgcggtacacctgtcattggtgcaaatagtggcggggttaaaaatattattacagatggaaaaacgggagttctttgtccgcctaaaaatgaagatgcatttctatcatccatttattttttattacaaaatgaagaaaaacttgagcagatgggaatatcagcttcatcttttgcgaaatcaaagagctgggatgagatctttcgcggtttgcttaaccattatgaagaagtcctgcagcataacgcatcagagttgcttgcttaaatagaaaaactcccttcaaaaaaacgaagggagtttattacatggtcataaattttagtttaataaatgatacataaggttaaacattgttttatttctatattaattatatcaaaaataaacataactaaacagacttgtaataaaaacccataaaaattaatatatggttatacagtattttaaactgtataatgattttaagaattccccttaaaatcaacttactcacatacctttatacagtaattgttccccaattctgtatatcaaaaaacctttcattcatttgaaaggtctttttgagcctgcacatattcttctttcgtatttacatttataaaccaatccgcattcgcttgtacatcttctccagaaacatacttcacattacattgtgataaaagctggcccatacttcttttttcttcctgaagtaaagcataaatcttttctttcacgcggttatgatacgccgcaagtagcggttgttttcttccattaataataggtacaaccgcatcatattcattgctcgtttgctctagtaaaatggcaaaccattgatgcgaaacgtttggtgcatcgcaaggcataatagcgtaccaatctgcttctatgtattccatacctgatacaatgcccgcaagcggtccatttcctttatagtgcggaatgtcttctataacaggaacttgtacgaattgctctactcgctcttttatatcagtatggctaattactacaatgtcttgcaaagtagttcccatcactttcacaatatgctcaacaaaagtagttcccttccaaattgctaacgccttcggctcaccaaatctactcgacataccgcccgctaatacaattccagcatacttactcattggcgatgcagctcaaatgtaatatggcctaattccggtaaaattaatttattcatcgcaagtcgaaccgctccgctagaccctggcatcgagaagactactttgcgcccaattgtaccaccaatcgctctacttaacattgcgctgcttccgatatcttctaaataactaatcatacggaacagctcaccaaatccaacaatttctttatctaataacgctgatactgcttcaattgtgacatcgcgtttcgtaataccagtaccgccatttgttaatacaacatctacatcttccttatgataaccagctaacaccgcttgctgaatactttctttatcatcttttacaatttcataagaagttactttatgtcccgcttcttttaacaattcatgtaatagttgtccgctcttatctgtttcttccgtacgtgtatcggaaattgtaacaatcttgcaacgcacttcttttggagcttgttttttatgttcagttacactcattttttatctttcctttcttaaagacttttcttcattttatcatacatacctttacacaattatgtatgaagccaatcatgcgccatgatacaatataagtatactaacccacaaaaaggaaagtgtactttcttatactcctagactacacatctttagctactctttatattttctacataatagaattcaattttaaaacttgtactaaaaaataaattggaggtctacattgtatggaactttataaaaaattaacaacaacatttatcctcttattcatcgcttcaatcactgtcggcttttccttaaaaggcgcaattccatacgctacattagtaagcattatattcgcgacactatttttactaagtagtgccttttgcgcaagtaaagcacgtcaaatgaaaggttgatcacatatgttcaaaaagaaatcaatcttttgtaaatcatgtaaaacagaaatacaaacgtatgaaaaagcgtggattcatatgccctttccggcgaatgacatgacgaatatgaaaaagtatattgaattagaaggacaaatttattgtagttcgtgtgttgagataatgaacaaaaaccagtaaatacaaaaggggtgtttacattgtttgaatccaaccgtatccagttacgaaagttttccgaagatgatattctaacatattataaatggcataatgatatagacgttatgagttcaactacactcactcttgataaatattcctttcaagacacagaaaaactttgccggcaatttattcattcttcgaactctaagacctatatcattgaagaaaaagctacgcatcttccaattggtattacttctttaattcatattgattcgtataatcgaaacgctgaatgcattattgatattggtaaaaaggattactgggggcaaggttatgggcaggaagctttaaccctattattggattatgcatttttagaattaaatttacatcgcctttctttacgagtattttcttttaacgatagagcagttaaattatataaatcacttggttttcaacatgaaggaacttgtaaagaagctatattccgcaacggcacttggcatgacattgaactcttcgctttattccaacgtaattataaataaaaaaagctttgcgctcaccgcgcaaagctttttttcatatattatagaccagcttgctcttttaaagctgcagctttgtctgtacgttcccatgatagatctacatcagtacgtccgaagtggccgtaagctgctgtttgtttgtaaattgggcgacgtaagtctaacattttaataataccagccgggcgaagatcgaagttgttacgaactagttctactagtacgtcttcagatactttaccagtgccgaatgtatcaactgaaattgatactggttgtgctacaccgattgcgtatgcaagttgtacttctgctttttcagcaagaccagctgctacgatgtttttcgcaacataacgagctgcatatgctgcagaacggtcaactttcgttgcatctttaccagaggaatgccccgccaccgtggcgagcgtatccaccgtaagtatcaacgatgattttacgtcctgttaaaccagcatcaccttgtggtccaccaattacgaagcggccagttggattaatgaagaatttcgtttctccatccattaattctgctggtactacagctttaattacgtgctcttttaagtcgcgatcgatttcttcccatgtaacatctggatgatgttgtgtagaaattacgatagtatcaacacgtactggtttaccattttcatcatactcaactgtaacttgcgtttttccatctggacgtaagtatgataatgtatcatctttacgtacttcagttaaacggcgagctaatttgtgagcaagcgagattggaagtggcattaattcttgtgtttcattacatgcaaaaccaaacattaaaccttggtctcctgcaccaattgcctcaatctcagcgtcagtcatttgaccttcgcgtgcttctagcgcttggtcaacacccatagcgatgtcagcagactgctcatcgatagatgttaaaacagcacaagtttctgcatcgaatccgtattttgcgcgtgtgtaaccaatgccttgaattgtttcacgaacgattttcggaatatctacgtaagtagaagtccccctttcccccgctaacaaccctaaaccagttgttacagttgtttcaatagctaca

SEQ ID NO: 1374 - DNA, 19456 bp, Bacillus thuringiensis
ttgaaagaacgtgatatgataatagtatttggttcagtagaaaaattggtacaattcgagaaagaattacaaagtacgaggtgataaggaatgcaaatatctagcgacaagattttaaataaaatggcgaatgaaattgcgaaggcaaaaagtagtgaaggacaaaagtcaaaagaacatttattagttgtgcgtgctttatgtgacttattattagatgaacaagttgaaacatctacatatagagaaccgaaaattcaatcgcaagtaattggatcacaaccagtaacaactatgcaaccaattgcacctgtttctggggagccagtatatataaaagaaagtgatgcaaacggtaattctttatttgatttttagaagataaatcgtttggcttatatgcaaaaattgcttatgataaaggtaaaaaaggggaattaagatgaaaattttctttttactaggttgtattgcagcggggctatctgttgcgttaggggcctttggagcacacggtttagaaaataaaatttctgcaaaaatgttagaagtttggaaaacaggcgttacatatcaaatgtttcatgcaggtggactattcgtagttgctttattgatggataaggttcaatcatcacttttaactactgctggttggctaatggtagctggaattattatgttctcaggtagtttgtatgcattaagtacgacaggcattaagttctttggtccaattacacctcttggtggtgtagcgtttattgtggcgtggattctagtagggactgcagttgtaaaaggattataaaaaacaaaagctggcatttgccagcttttttatggtcttggagcataagttgcttgttgacccggtaaatacgtaattctttctggaaattctacataatctaagtaaatcattagtaataagtaacgctttccggattcaggctcactaatgataatatgatcacgaccagctgcctcgataatacctgtataagattgagtaccaagagaactaccacgctcataagtcattacaactgtagcttgcttacctttgtttagacgaaggatattttcaatatatgattgttctagaggtaacatcccttgagaaattgcatattgcgcttgcgcagcttgttgctgcattgcttgttgttgctgttgctgttgcccagcggtcatttgttgcggttgtacataagttccagatggttgataaaaacctgttccataataggggttttgttgctgtgtcattcaaaaatccctcctcatttttattccttaatatacgctagggcagtctccagcagatggctggaagaagcagtgctttttaaagcgaccagagttttgttggttataccaagttggtggacatgccccttcaggtctaaagaaccataaggcaaagttggcaggccaaaaacgttgcccttgaatggtccgtctcgctagggcaatatcttgttcacgtgcccgttgataaaagtatcctttttgcgttgcttcaaaaccgccggggttttgataaaccatttgacgtaaattacgaatgcttttaaaatctaaacaatttccgcggacacgatttaccccaacgtttccgaccattaacattccttgttgcccttctccttcggcttcagcacgcatcagtctagccaacaactttacatcttcttcgttataagcaataacacccattatgtgtcacctctctttttggaataccttttggaaagaggtttatctctagatgaagtgtgtaacaattactagttcatacgtatgaggaaaagggctcagatatgacaaccaaacgaagttttacattgagagtggaaaataaaaaaagctagcgtgagccagcttttttattaaaaaactttagaccataagtttgagaagaaatcaccaatagagcgcattgttaacacaaaccaatttgctttttcaacttcctctgtcgtttttgcagtaactttcatacttttactaccgtctaagaaaccatatttatcagttgattctaaagtaattgagcctactttggcatctttcttaataggagcaactaaatgtccatcttcagcaagagatttatctaattcagtcccaattttataaggttctttgctaccttttttcgcaattactgttatttctttttcgggtgcaacagttacttggtcttctttcccttttactacagagattgtattgttcttattaacttttagtttttgtttttcaaagttattaaatccatattcgattaattcacgagattctgtgaaacgttcatccattgattttgttttaataataaccgagataagacgtacatcaccacgtttagcagtaatagtaaatccgtatccagctgtatcagaacttccggtttttaaaccatcggtaccttcataagcgaaagaagctcctggtaacatccaattccagttttccatacgaattggttttgggtgattgtctgggaagtttctaaatctttgttttgtatcctctagcatttctggatactttgtaatcattgcttttgaaagcatacccatatcacgagctgacatagagttttctgcatttggatcagtaccctcaggatgttttccttttaagtcagcgttatttaagccagtagcgtttacaaatttatatttctttaatcctagctttttagcatgttcatttgcaagatttaagaagtttttctcacttcctgcaagaagttctgctaaagcgatactagatccatttgctgagaatataacaatagaatgatataattcttttacagtatattgacgtcctttttcgaacggtacattagagaattcattattacgagagacttcataagcgtaatcagaaatatttactttcgtatcccatgtgatttttccttctttaattgcttctaaaacagcgtaaacaacaattaatttcgacatactagcaatagccagcaattcatctggattttgctcgtgaagtatttttccagtatctgcatcaaataaaagtgcagcggctgcctcaatatgtattttttcttccgcatgggatgttgttactcctaaggaagaaattgacaatacaagcaatagtaaaatagacaaaatttttttcatatagattatcaccttcgcatcgttatttagcatatagctcgtatcattttagcatatctttatatataaaaaggttacaattttacaataaatttgaaaaaatgtcggtttttcttcaaaagtgcagaaaaaaggagatttttgaggataaatatagagaagaataaaaaaaggaacgaatttcgttccttttcaccatttatatgtgtaaaaatttctctactttttcgtctggtaaaatgtttccaacgaagaatgttccaaattcaccataacgagcacttacttcatcgaagcgcatttcatatataagttttttaaattgaagaacatcgtcagcgaataatgttacgccccattcgaaatcgtcgaatccaacagatcctgaaatcacttggcgtactttacctgcgtattgacggccaattttactatgactgtacatcatttttttacgctcttccataggaagcatgtaccagttgtcatcaccttggcgacgcttatccattggatagaagcaaatatgatttgctttcggcaattcaggatataagcgagctaaaatttgcgggttttggtatggatcctcatcagctggaagatagttgcttaattcaacaacagatacgtaagaatatgcaggaaccatatattcagctaaagttgttttattcaattctgtctcaatttcatttaactcttccattgttggacgtaaaatcataagcataatatcagctttttggccaacaactgtatacattgcgtgactaccttttttcgcagtagctacttcgttccatttttcaacgacatttaaaaattcagacactgcttgtccgcgttcgtcgctagataatgttttccatgcagcccaatcaatagaacgtaaatcatgtaaacaataccagccatctaacgttgttgttgcttcactcattctattcacctcagttaatgatagttttacacgttaactatagcatatatagttttaaaatcatctatataaaaccttggcgcataaaattgtcacatttaagtgtttaagcaaggtgaatttaacggctgaattttatgaaaatataatcatttttattttatctattttttgggagctataagtttaaaatatagaagaaaagcagtattcttaaagatagagtttttttaacatatgtaggagggtttattcgtgagcaacttatttacaacagtaaaagaaaaagttcaaggaaaaggcatttctatcgtacttcctgaaggaactgatgaaagaattttaggcgctgcagagcgtttagcaaaagaagagttagtaaaaccaatcttagttggtaatagagaagaaattagcgcaaaagctgctagcatgaatttaacattagcaggcgttgatatttacgacccagctacatacgaagaaatggatgcgatggtagcatctttcgttgaacgccgtaaaggtaaagcaactgaagaagacgctcgcaaaatccttaaagacgaaaactacttcggtacaatgcttgtatacatgggcaaagcacacggtctagtaagtggtgcagctcactctacagctgatacagttcgtccagcacttcaaattattaaaacaaaaccaggtgttacaaaaacttctggcgtattcatcatggtacgtgaagaagagaaatatgtattcgctgattgcgcaattaacattgcaccaaacagccaagatttagctgaaatcggtatcgaaagtgcgaaaactgctgagttattcggcattgatccacgcgttgctatgttaagcttctctacaaaaggttctgcgaaatctccagaaacagaaaaagttgtagaagcaactcgcattgcaaaagaaatggctcctgagttaactttagatggagaattccaattcgatgctgcattcgtaccatctgtagctgagaaaaaagctccaggttctacaattaaaggtgatgctaacgtattcgtattcccaagcttagaagctggtaatatcggctacaaaatcgctcaacgtttaggtaacttcgaagcagtaggaccaatcttgcaaggcttaaacatgcctgtaaatgacctatctcgtggatgtaacgaagaagaagtgtacaagttagcattaattacagcagctcaagcactttaattctataatgaattgaaataaagaccgtcgctattatagcgacggtctttatttttctaaaccaagtgctttattattacgatcaataatacgttgtaaattcatctcatataaaggaatctcatctattgttaattgagatggtgttaactttggagcgaattgctgcaatgtttttaaaagacgcatcattaaatcttgtactgtaatggtttcaccaagtaattctgagagtgaggccatcgtacttggtacaatttcagggtacgtaaagcgtgtttcttccccttgaattgctaggttgtagaaatcacgaacgagtgcggcacgctcagagccacttccggtagcgcagagatagatttggacagcgacacctccgcgaatacgacgttgtgaaataccagcaaatttttgatcgcgaatacttaagtcataactaccaggacagtaagagccgacaatttcttttgcctcgatagtaacgtcgtaatcctttaacatctccttaatcaaatgccacattgtatcgtatccaaggtcaatatcgatacctttttctgtttcttggaataaaagtgatacgtttaaaacaccttcatcaagcacgaccgcaagcccgccagaattacggacaataacattgaagttgttttgttttaaaaaagaaataccttcttctaaatgcggaaggcgtgaatcttgaatgccaaggacaattgtattgtgatgaacccaagaacgcattgttgcggctgacttgccatttccaatgcttgtgcataatgtgtcatccattgcgaatgactgaagtgcatggaatgttggtcccaaactggattgatctacaatgcgccactctggctgagataaaatggaacgggaattgctcatataactaaccccttatctttaaaatgacaatctctattatagcaaaaaatgaaggatggagttttctcacatataaagggggagcttagaggtgaaataataaaaaggatgcattacatgcatcctttttattctgcaattttttctaaattaccgtttcggtccattcggaaagatgtttgagaacgttcttcgtcatccatgactgccaatttacgagctcggttcataatgttcataagtgtttcgtaatcttcttgtacagtatgagattgcttttctaatttttctagtttcttttctagttcctcattccgaaggatttgtgctttaatttcttgtttcaatctcgtattctcgttttcaagagctgtcacttttatatttgaagatccgactgtttgtaaaaaataaataacatcttgcattgtcatagagcttcttgcagcaggagcagtagattcttgatatggaatagcttctttatattgtacgattgattcttcttgtactaattcttcataatcagttatcgaatctgaagctggtggtgtataaagtaaacgttttttcgcttgttcaccgcttgcagcacgcattttatctttacgatgtttttttgctagttgaagagcttgttcatagctatagcgaacaacagcattccagcggaaaccacaagcagcagatgtacgatttaactgatcccctacttcctcaaatgcatttaattgcgtacttccttctctaacatgacgaagtaccgtttcagcaagtaataaatcatcctcatctgtccaagcatcttgtcttactttcatagattcaactccctttctttttatgaacttcctatttttataatgggcaaaaaaataaacttttatacaaagcttttaaaaatatggtagatttcgatgaaaggtaaaaattttcccatgaatggtgagcgcttctgtaggagagcatataaatatgtagcattatgtagagaataggctttgtagggaaacttgcaacgagcttcaaagagcggtaaaataccatttagtgtttatttttaaacgtacttgagaaaagtttaaaatagaggaagtgttatataatgggaaacgagtttcgcgtgtgcgatgactgtcaggcaacgaacgttaaaacgttagttccgaagttaaaaaaagtagattcatgtgcaacgattgaagttggatgtcagtcttactgtggtcctggtcgtaaaaaatcattcgcatttgtaaataaccgtccagttgcggctccaacagaagatgagttaatcgcaaaaattgaagcaaagttaaataagtaagaaaaagaagagtgaaaagattactcttcttttttatgcccataagaggaataatttattctgcgaaagtactcttgtatggacgaacgttttctaaaggatagacacaacttttgtattaaaattccaatttgtataaatttatatttcaaaataatggttgacagtcttttaaagcgataggtagaatagaagtgtctgattctgagaatcattatcaggaaaataacaattcacctaatttttttattactatttgagaataaatttcatttcaataaatatatgttgttagttaggatggttgagggatggaagcgagcgcaagcagtatagaacagcaagaagagaatgttaaagagattaagagcagaccgcttatcgcttctattattttagtagcgggtacagttttgttagctttaagcatggcagtttctatttcttttggggctgcagatattagtttaaagactgtatggcaagctgtatttcggtttgatggatctattacacatcataatgtaattcaagagcttcgcatgcctagagcaatagggggcgtagttgcaggtgcctttttagcggtatcaggagcaattatgcaaggtatgacgcgaaatccacttgcttcgccatcgttaatggggattacagatggggctgtatttggaattgcaattatgtatgcattttttcctaattcaccttatttaatgtttgttatcgcatcttttattggagctgcgtttggtgcaagcattgtatatggaattgggtcttcttcaccaggtggattaacacctgtgaaattagctttagcaggtgcagctattagtgctttattaggggcgatttcatctggaatcgcattgtatttcaatcttgcccaagaggtaagcatgtggaatgcaggcggagttgctggagtgaaatggcaaagtattaatatgttagtgccaattggccttgtttgtctttttatcgcaattatgatgtcgagatatattacaattttgagcttcggtgaagaaattgcaattggacttggtcaaaatacgacattaattaaatttatcggaacagtacttgttcttgttttaacgggttccgcagtttccatggcaggatcagttggatttgttggtcttgtaattccgcatatgactcgttttcttgtaggctcggactatagatgggttattccatgttctgcggtcttaggcgggctgttaattgaatgtgcagatatgttatctcgcgttattaacccgccatttgaaacgccaattggagcaattacagcgctaattggggttccattcttcctctacttagcacgtaatgaagggagaggaaagatgtgaggacgagtgtcttaacaaaaaagaacatttctatattaacgattttagtaggactaatcgtttctatatttcttattagtttaaatacaggaacttttaaaatcccgccaatggacgtattaaagtcattggttggactaggggctgaagatcagtctgttattttatttgaattccgcatgccgcgtatggtaattgctatactagtcggatctgctttagctatgtcaggtgcgattttgcaaggtttatcacgaaatccgcttgctgatccaggtattataggtattaatgctggagcgggattaacagttgttatattcgtctacttcttcttcgggaaagtagggactggtacatttttatctgtattcattcttccattcttcgcactagttggagcgatattagcagcggtaattatttatttactagcatggaaagacggcgtttcatcgactcgattaatacttgttggtattgccgttgcagctggatttggagctgttagtttaattttctctatgaagatgacatctaacgattttcgttttgctacgatttggctggcgggaagtctatggggtacagattggaaattcgtattaagtgtacttccatggatggttattttcttaccgcttgctataagtaaagcacacatattaaatgtaatgaacctaggcgattctacagcagttggccttggtgtaaacgtagaaaaagaaagacgtaaattattatttattgcagtttgtttagcaggtgcatctgttgctgttgccggtggaattggctttatcggtttaatggccccgcatttagcaaggcgccttgttggtggtaaacatcaaattatgttgcccaccgctgcgctaataggaacgtttttacttttattcgcagacgtaatttcaagaagtgtattaacaacttcagaaataccagtcggtcttgttatttctgtaattggtgcaccatatttcatttatttacttatgaggacaaaataaagggaggcttttcgtatggcaactttagcggtggatgcggtatctgttggctataatgaaggtttaattattgatggtttaacagttgaaattccggaagggaaaattacaacaattattggaccaaatggttgtgggaagtccacattattaaaaacggcgtctcgtattttgaaggcaaagcaaggtactgtttatcttgacggaaaagcaattgagaaacagccaacgaaagaaattgcaaagaaaatggcgattttaccacaaactgcagaagtgccaacgggtcttactgtatttgagcttgtgtcatatggaagattccctcatcaaaaagggtttggcacgttgaaagaagaggattatcgctacattaactgggcacttgaagtgacaggaatgaaagaatttgcgaatcgtccagcagaagcgctatcaggtggccaacgtcaacgtgtttggattgcaatggctcttgcacaaggaacagaattacttgtattggatgaaccaacaacgtacttagatatggctcatcaattagaagtattaaacttattgaaaaagttaaatgaagaagaaggtagaacgattgttatggttatccatgacttaaaccacgcttctcgtttctctgatcatatgattgcattaaaagcaggtaagttaatgaaacaaggaacgccagatgaagttatgacaagtgaaacacttcgtaacgtatttgagattgaagctcaaatcgttccatgtccagtaaactgtaagccaatttgtttaacatatgatttagcgatgattagtaatcaattgcgtaaaaaagcataagtagaaccccctcgtaaagaggggggcttctaatggacgttgagcttcttatatatgaatgggaagttgaacgcccgttagaatgggttattaacaacaattaataaatatatattaattaattgttatattcgtttcttatagttcattgtaacttataagataaatacagctagaaggagtgggaacatgaagaattttaaaatggcactattagcaatggtactagttgtgacttctgtactatttgcagcttgttctaataaagaagaagaaaagaaagcagatgcaaagactgaagagcgcactgtaaaacatgcaaaaggggaaattaaaattcctgcaaacccaaagaaaattgctgaccttagtggttcaacagaagaattattaattttcggtatgaaaccggttattactgctaatacatctcaagaaaaaattgatgcacatattgaaaagaaactaaaagacgttaaaccagttggttctgcttggggcgataaaattaacattgaagcagtagctgttgcaaaaccagatttaattcttgtaaataatcgtcaagaaaagatttatgatcaattatctaaaattgcaccaacagttatgttaaacactccattagatcaatggcgtccaaaattcgaagaagtaggtcaaatcttcggtaaagaaaaagaaacaaaagaatggttcaaaaagtatgatgaaaaagcaagcaaattacatgacaaaatcgtcgctaaaactggtgaagcaacatttatgaaaatggctgcatatccaaatgctttccgcgtatatggtgattacggttacggtagcgtaatctttaatgatttaaaactaccagcagttaaaggtacaccaactgataaaccgttagtacaagtacaaaaagaagctttaatcgattacaacccagattacttattcgtatttacaactggtgacggttctcagcgcttaaaagaattccaagaagaatcaatttggaaaaacatgaacgctgttaaaaataaccacgtatttacaattaaaaatgaagacttaaacaaaggttacttcccactagggaaagatatgatcttagacgaagttgctgaattcgttttaggtaaataatgtataaaggaaatcacttttacttcggtaaaggtgattttttctttttataaagggaattaatacagtctttcatttctttctgtttctcatttcgtttataatataaagtaagaatgtagtaaagaaagggggatgtcggaaagtggtatatttaaacgacaaactcagcgaaacaaaagtgtttaaagacccagtacataaatatgtgcacgtgcgtgatcgtgttatttgggatttaatcggaacgaaagaatttcaacgcttgcgccgtattaagcagcttggaacgacattttttacatttcacggtgcagagcatagtcgctttactcattcgttaggtgtatacgaaattattcgtcgtatgattgatgatgtgtttgatggcagaccaaattggaatgctgaagatagattgttatgtttatgtgcggcattacttcatgatgtcggtcacggcccattttctcactcgtttgaaaaagtattttcattagatcatgagaaatttacgcaaaagattatcgtaggcgatacggagattaatgatgtattaagtcgtgttgataaggagtttccgcaaaaggtagcagatgtaattgcaaaaacatctactaataaattagcgattagtatgatttcgagccaaattgatgcggatcgtatggattatttattaagagatgcttattttacaggcgtaaagtacggaaacttcgatatggaacgtatactgcgtgtaatgcgtccgtatgggaatcaagtagtcattaaaaatagtggtatgcatgctgttgagcattacattatgagtcgttatcaaatgtattggcaagtatatttccacccggtaacgcgaagtgcagaagttattttaacgaagattttacaccgtgcgaaatcactgcacgagaagtattatacatttaaaaatcatcctgttcatttctattctttatttgaagaagaagtaacagtagaggattatttaaagttagacgagaacgttatgtattactacttccaagtatggcaggaagaagaagattcaattttaagcgatttatgccgccgttttatgaatcgaaatctatttaaatatgtagagtttacagataaacacggtttagataattggatggaattaagtagtttatttaaaaagattggacttgatccggagtattatttagtagttgattcaacatcagacttaccgtatgacttttatcgtgcaggagaagaagaagagcgtctaccaatcctacttcttatgccaaacggagagcttagagagctttcacgtgagtcggacattgttgaggcgattacaggtaagaaaagaacggatcaaaagctattctatccacatgatttaatctatgaagatggaagaaaaggaaaatataaagagagaattattgagttgttagaaggaaagaaataagaagcagctaatggctgcttcttatgaaaaaacttgaaattatttgtcacttaagcgttttccgccaactgcataatggtttttagacatttcttcgatgaaaacaacgatgttttcttcaggagcaccagttgtttcgcttactgctgctgttactttctcagcaagagctttcttttgttcttctgtgcgtccttctagcattttcactgttacgtatggcatgtacaatcgctccttttatgtaagttacactcttattatagcggattatggggaagaacaatcgaaaaaacaaataatttctttttttgacatatggaagaggagatgaagcatggatcagttatttagatacccgttgcaccaaattcctttggtagcaatggccattattatcgcattatcagttcatgaatttgcacatgcatatgtagcatataaatttggagacgatacagcaaagagacaaggccgtttaacgttatcaccgatggcacacttagatcctataggtttgattgcagtattaattcttggattcggttgggcaagaccggttcctgttaacccatataactttaaaagaccgcgtcttgcaggtatattagtttcaattgcagggccgattagtaacttaattttaagcgcaattggtttaattatttggtatagcttagtaaaatttggtgtattatactcaattccatctgcagtagcagatacgttagctcaatttttccagatttttattatgctgaatatcgttttacttgtatttaacttattaccgatcccgccacttgatgggtatcgagttgtggaagatttagcgccagcaaatattcgcgcgaaaatgacacagtatgaaaaatacggggcaattgcgttattaattctcgttattacaccgcttagtaattacacaattcaacctattttccaggtagttattccgcatgtatttgtatttttagatagcattattgcgcctatttttggccttttataatttttaagtgaggaggattttacatatgacagagaaaaagaaaaaaatcggttttaatatcgtgaaaaatgattcaacagatggacatggtggatttggtgttggggcattaagcttagaaaacatttcacctgtatttgttgatgtactagagaaaactgcattcgttgatattggtgcgatgcacgcgcgtagtacagtagaaaaaggtattaagtttttaacaaataaagatgaagttccaaacggaaaaccattttggcttgtttgggtaacaattgaaagaactgcgacaggtgcgtattatgcaggtgtaacagcttgtgaaatgacagttgaccgtgagattcgccgcggatataaatcacttccagagcacgtaaataaaatggataaatcattgaagcgtcacattatggttgaccatatggatgaatcatctaaaaaggtacttggtacgttcttgaaagaacataatgaagcgatttggaacgaatctagtgaagaattacgccgtgcattattaagtgaataaaaatagctgacggatgcccgtcagctatttttttaccaaggaagatattttttccaccaacttgtttttttcttttcttcagtcgttttttcaaattcttctttatcatcgacgtgatccatacaatattcagtcggttcggtacctttagcgaaatacattttcacagaaataggacaattttttgtagcaattttaccgttctctggattgatattaaccgctacgacgtcacttggttgtttaaattctttttttggttgtccctctaaccctttctccatcgtatcagtccatattttcttcgcatatccttgttctgctacgtttgaaatagatttaggttgatcatatccgacccacacaccagttacgatttgcggagtaaatccgatcatccaactatccgtttcagtagaaccagatttgccggcatatgttcttgatagtttggataacatcgattgaccagttacagcagcatagctgcttagtttcttattaaacataccagtcatcatttcttccattacaaacgctttgctcttgtcgagaacttgtttactctctaaatgagcatcgtataatatatttccttcatgatccataatgcggcgaatgaaagtaggttttacttcttttccaccatttgcgaacatgctataagcgttaaccatttcaattggttttactggtgatgtaccaagagctagagaaggcacatcttttaatgcacttttaattccaaattgtttcgctgtttttgcaagcgcgtcatcgcctaaaaacaaattcgttttcacagcataaatgttatcagagactgcgagagcttgtgccattgttacgaaatcatctgcataataatctttatagttcttcggtttatactttgaaacgccgtcacctaaagtgaatacagtatattcgctttttaagcgcgtagcaggcgtgaatcctcgttctaatgccgcataatatagaaatggcttaaatgtagaaccaggctgacgaatggcttgtgtagccctgttaaattgactcgtagtataatcagttccaccaacaagagcagccacttcacctgtctttggattcatagagacgagagcagtttgtatgtttgttgtgtcaggtatgtgatcttttacagcttgttctgctacagcttgtagtttagggtctagcgttgtataaattcgcaagccaccccgttgtaaagcttgttcgtctaatccaacatcacgaaggagcgaagcttgtacagcatcttggaaatatggtgcgacctctgctacttttttcgtatctaatgaggcaaaagttagtggctctttcttcgctaaggctgcttgttgcttcgtaatatatccttgttctaccatttcatctaatatgagagcttgtcgtcctttcgcacgatcctctttcaaaaagggagaatagacacttggccctttcgggatacctgcgagcatactagcttctgctaatgttaactcttttgccgttttatcgaaatatagacgggatgcagcttcgatgccataagcgccatgtccgtaataaattgtatttaaatatccttctaaaatatgatttttattataattcacctcaaggcgaattgtgtacattgcttctaatagtttacgtttccacgttttatcatgatctaagtaaaggttacgagcatactgttgtgtaatcgtactagcaccttggacttttgccatcgcttttaaatcggcaacaatggcaccagcaatacgtttcatatcaaagccatgatgtttgtagaatcgttgatcttcaatagatagtgtcgcctcttttacataaggtgaaatttcattaagagatacattgtaacgtttttgcatttcattactttgtcctataacagtgtcatcatttgcgtaaaagacgcttgtttgcgggaccgcaacaggaggaggtcccataatttttgcaactataataataacaaaaaaagaaaaaacgaagaaaaggacgcaagaaaacattgcggtgaagaaaagacgtttatattttttaagttttggattcatagtttgatccatcttttttcagcccctcattaatacaagcgttattgtattagtattgagggttttcatttattttaaacaatgaaatttcgaaaataaaaaagccccttccattaagaaaggagctcaaaggcacgtgctggccaatcagtaatgatgacatctacaccataatcaatcatagtttgtaaatctttgtattcattaattgtatatggacggaaaacatacccttgctcttgtgctaactgcacaaattctttcgttaataactggaagtttggatgtaatccatttgcttctctatgttttgcttcggcaattggatcagaaagtggtgtatcatataaaattgctcttgggatttcaggagcaatttctgctaataatgaaacagagtcatggttaaatgatgaaaatacaatttgattagaaagatgatattcacgcacaagtgcaacagctttttcctcaatctttgggtaatgaataacatctgtctttaattcaatatttagttgtaagttcgttgtggaaagccaaatgaaaacctcacgcaacgttgggatttttgcttcatggaaagaagggtctttatagctaccagcgtccaatgattgtagttcctctaccgttttttccgaaacaagtccaacgccatttgttgtacgatcgacggtttcatcgtgaattacgacaagttcaccatcttttgataagtggacatcgagttcaattccgtgagcgccaatgcgttctgcttcttggaaggcaatcatcgtattttcgggatgtgttccttttactccgcggtgagcgaaaataagtggtttactcatgtgaaattctccttattatctcttttctttcattatgaaactgctttagggaaaatacaattgaatatgacaaacatttacaaaagtctaacagttgcacaaaagttaacgttaacgtaaaatgtaataatcaagtgaagggaggaataaacatgtataaaattgatgaagtaacaaagcaagttggtttgacaaaacgtacacttcgttattatgaggaaattggtttaattcatccccctgaacgtagtgaggggaacattcgcctgtatacagacggggatatcgccagaattaaaaaaattgtggaagcgaaagaagtgttaggaattacgcttcaagagatgcagcattttttatcgttaaaagaaagaatggagcaaagaagaaatagcgaaaaccctcgtgatcgtgaagtgattcaagaaattaaagatatgcttgaaaaacaagtggaaacgctagacgaaaaaatggagcaaatgcaacgtgtaaaggcagaactagaagatagtttacatcgtgcagtaacatttttagagaacacaaaaggagagtaatcaaaatggagagcaaacaaaaactagggagattgattacagtggtggctaccttccttgccttttcgggtataggggtagttgacccaattttgccaattattgctgagaaaatcggtgcaacgcattggcaagttgaaatgttatttaccgcttatattttaacgatggcaatcatgatgttaccagctggaatattcgcatcgagatttggtgataaacgaatgatgacgattggtcttgcgatcgtgactgtatttgcgtttatatgcggtatatcgcaaacgattgctcaattatctctttttcgcgcaggatggggattaggaaatgcgatgttctttacaacggcaatgacattattgattgcattaagtaaagaagttcatgaagcagtaggatggtatgaagcagctatcggtttagggatggcaggcggaccgttattaggcgggatatgttgtgcacattcttggcgttacccattttttgcgacgagtattttaatcttcttagcatttattttagtattcttttttgtaaaagaaccggagcgaaaagtgaagcgtaaggctgctggggtaggagaattacttaacctggtgaagtataaaccgtttatgcaaggtgcgatttcaggaatgttatactactacggatttttcgttgtgttagcatattcaccacttattatgcatttatcagctattcaattaggctttgtattttgcggatgggggcttgcgttagcttacggttctgcaattttagcacataagctagaagggaaatatgaaccaaaaacattattaaagggtagtttactcgtatttgcgattttcttaattgcactattctttgtgaaaattatgtggttacaaattactcttatcgttttatcaggattggcatctggcttaaacaatgcattatatacaagttatgtaatggatatttcaccttatgaaagatctgttacgtcaggtgtttataactttgttcgttggttaggtggtgcgattgctccaattttatcaggaattatcggtcatactgtttcaccacaaagtccgtttttagtaggtggaatt

SEQ ID NO: 1375 - DNA, 14216 bp, Bacillus thuringiensis
tccatcataaaaaagaactagaacatcatccagaactcgcttggaaatagacaatctgaaacagtctgtgtggattgccataataaagaacacggtagaacattcgaaaagaaaccgaataaatgggaaaacgatgaaaagtggtaaaactgattcagaaacaatcccccccttaaaatatttcaatctttttcggggaacgaggcaccggggagggggtcgatttttcaaatttagaaccaaattcgcgcgttatattaaattggaaaacgatgtaaatcagaagggagggatattgtggctagagtgaagcgtgaaacaatgagaaaaaggattgaaaaggatctaacaaatcaattaaaagaaaaaaagattgtaggtaatcattatactgacttaattcaagactatttatcgttgtgggatttaaagtgtgttcttgttgatgatattgaagaaacaggaataaaagtatctggcatgcatggtccgaaatccaatccttctattaatgatttacataaaacaaatgatcgaatgataaagattttagatgcacttggattagaagcatcggcagaagaaaagaaagttccttcaaaacctgtgcgctcagttaaagatttaacatgattcaaaataattatgtcactgaatatattgagatgtatcgcgcagggaaaattaagctgaataaagagcgcataatgctaattgagtacctggagaaatacattttaatacgcgatgatttgtatttcgataatgaaatgcatgaggactatataaaattcactgagaaatggtactttgaattgcaagcatttcaaaagttcctaacagcattcgtttttcttttctataaagaagatgattctgttttttacgagcaatttttaattatgatggctcgtggtggtggtaaaaacggtttaatttcatcattatgccatttctttattagtccgctgcacggaatagatcgatacaatgtttcaattgtggcgaacaacgagaaacaggccaaagtttcttttcgtgaagtctatgatgctattaaaggaaaagaaatactagaagatatgttttatcgaaccaaggtagagatactgagtaacgatacgcaaagcattattcaatatcatacatctaatgctggttctaaggatggacttcgtgacggttgtgttatttacgatgaaatacatcgatatgaaaactttgatgtagtaaatgtattctctagtggacttggaaaagtgccaaatgctagagaattttttattggtacagatggctttgtccgcgatggattcctggacaaaacaaaagagcgggcgatgaatattctaaaggggaaagatttagaagatccattattccctttcatttgcaagatagataatccagaagaaattgataatcctgatgtatgggaaaaagcgaatccgatgtttagcgagccgagaagttcttatgctaaacaattatttaaaaaggtattaactcaatataaacaattagaaaataatccttcaaaccgtgaagaattcataacaaaacgtatgaattatcctgaaacagatttaacaaagtctgtagcttcatgggaagaaatcatgcgtactggttttgaagaagatggggaaacgctcagagaggttccagatttaaaacataaagtagctgtaggcggactcgacttcgccagcattaaagactttgctgcggttggtctactctttaaacatggtgaagattatatatggaaaggtcattcatttgtacgtaaaggatttttggacaaggtgaaattaaaagcacctatatatgaatgggctgaaaatggcttactaactattgtggatgaaccagttattaatatctctcacattgtagattggtttgtaaaaatgcgtgagttatacggtgttaatacgattgtagccgatacattccgccttgatcttgtcaaaacggcacttgaagctgaaggatttatattgttgtatatccgtaatccaaaggcaatacattctcttttagcaccaagagttgaaacgttgtttgcaaacaatcgcattatttttggagataatccattgatgcgttggtacactaacaacgtctacgtccacatcaaaaaagacggcaacaaagagtatctgaaaaaagatgaatttaagcgtaaaacagatggatttcaagcttttattcatgcgctatggcaagcggataacattcttgtggatgaattcgactttatgctagatggtattaaattctaataaagggggtgataatcattggatggctagatgcagtatttaaaagaaatagtgaagtaggatttatgtttgatgtggaaatgtttattgagaaagccaatagagtacacatgaagcgactggcgattgatacctgtatatcctttttagggagaacaattagtcagtcagaatttagagtgaaaaatggtgaagaatttgaaaaggatgagctttactatcgattaaatgtcagaccgaataagaatatgacagcaagtaccttttgggagagtttcatttacaaacttatttatgataatgaagctttgattatacaagcggatgatggtgatttacttattgctgatgactttgaacataatgaatatgctgtgtttgaagatacttttacaaatgtcaccgtaaaagattatcagtttaagcgaagttttaagcaaagtgaagtcattcatttaagatacaggaatgataagttatcacctcttatcgatggtttgtttactgattatggtgatttattcggtagaatattaagttctcaaaaacgtaagaatcaaattcgcggaacagttgatatggatatgcttgctgcaaagagtgaaaaacatcaagccaaactgcaagaattcattgataacatgtataaagcaattggagaaaaagacgttgctcttattccacaacaaccaggttttaagtatgctgaaacatctggcggagggaattctggtcagagtgtggaggaaatcaataaagtaacgaatggcttcttaaatcaagtagcaatggcttttggtattccaactgctttgatatatggcgagatggctgatgtggagaagcaaacgaaaaattatatgcttttcacagtgaaacctttattaaaaaagatttctgatgaagcaaacgttaaattttttgaagaagaagagtatctttcaggtcaaaaaattgaagttaaagctgtttcttatcaaagtatatttgatcttgcgacaagcatcgataaactcatttcttcaagtgcatttacagggaatgagattcgattagaagtaggatatgaagtttctgatgatcctaacttaaatacacatcatattacgaaaaactatacgaaactaactgaatctgaaggaggtgagaatacaaatgacggtgaaaattgacgttaaaggaccaattatttcgaatgatgaagcttggatttatgattggtttgaaatggatgctacaagcccaggtaagattacaaaacaactggataacgcaaatagtgaggatttaattgtatcaatcaatagtcctggtggttatgtagatgagggttcggaaatttacacagcattaaaaaattatcctggtcatgtagaagttcaaattgttggtttggcagcaagtgcagcttctgtaattgcgatggctggtgataaagttcgaatttctccaacagcaaaaatcatgattcacaacgctgctaagtggcatggtggagatcatcgtgacatggaaaaggcagccgagatgttaaaaataacagatcgagctattgtaaatgcctatgtcattaaaagtggtaaatctgaggaagaactacttaacatgatggctgaagaaacttggatgggtccgcaacaagcattagaaaacaatttcgcggatgaaatcatgtttatggagaatccagttaaaatgacagcttcaacggctactgctgccatgcttccgcagaaagtaatcgatggctttagaaatggaaccatgaacaaaggccaaggaattacaaaagaagatttaaatgcagcattatcaggattaaaaaatgaaatcctgaatgatttacaaaacaatatagaagaacaaccaaaggagccgaatcctaaacctgtaaaaaacagtgggattaaagggctccttttaaaattataaaaaaacggaggaaacacacaatggtaattaaatttaataaatctgaagcatttactaaggcaaaagcaaagttgacggacactttaactaacgcagaaagtacagaacaagaacaaacgtcagcgtttgaaggtttctttgatgcactacaaacagatgtagcaaatacggtccgtgaacaagtaaataacgatatgcttgatcgttcaattttacagcaacgtggtcaaaatgttttaacttcagcagaaacaaaattcttcaatgcagttgttaaagaaggtggatttacagatggctcaatccttcctgtaacgactcaagagcgtgtgtttgaagatttagttacagaacatcccttattagctgaaattggtttgcaagatttaggagcagttacgaagtttatttactctgatgcaacgaaggcgtatgtatggggcgaattattcggggaaatccgtgggcaaattgatgctatcttcaaacaagaaaaaattggtcaacttaaattaactgcatttgcagcaattccaaatgatatgaaggaacttggcccggaatggattgaacgttatgttcgaactgttttagtagaaacatattcagtcggtctagaatttggctttattaatggtggcggatctgtagcacatcaaccagttggtttaatgaaagatgtaaatccagaaacaggcgctgttactgataaaaaatcttctggtaaactaacatttgctccgtctgataaaggggtaattgtagcaggcgaactttatgaagtagtaaaagctttatctgttgatgcaaaagggaaatccagaaaagtattaaataaaattgtaatggtagttaacccgattgatgcgattggcgtacaagcacgtaatacaatccagaccgcaacaggtcaatgggtaatggcattgccttataacattaaacctgtcgagtgtgaggaagttcctgttggtaaagcattattctttgtaaaaggacaatatattgctgcaatcgcaggtggatacaagctaaaagaatttgatcaaacattagctttcgaagatgctaccctttatacaattaaacaatttgctaatgggaaaccgaaagataataaagcggctcttgtttacgatttagaaatttcatttacaccacctgcagaaacaaaaactaaataaagggtgaagtaaatgagaaacgcaacaatttcagatgaaatattgcaagattttaaagaaaggatgcgtttaggtgatgaagaagaccataacctaagacgtatcctttttacatctaataaggctttactaagagtttgcggtgactatgaaattaccaatgatgaagagttcaaagaattagtctttgaacgttctcgttatgtttataacgatgccttagagtattttgataagaattttttaagccaaattaatagtttgagcattgataaagccttagaagaaattaagttagacggtgattaatatgcagccctttaaatataagcggccgttaaatgccgcaaaattaaacaaatgtatcatactagagcgaaaaatatcagaaacaaaagatgaagaaggaaatgttcatccgtctaaatggctagagttcgtaaaagtatgggcagaacctaaaacaccatttggtacaggctttagatcagaaatatttcaaggaaatgcagagtttgttattaaactaataaactttacaattcgatatcgagaaggtattaattcagcaatgcgtgtaaggtatgatgggaagttatacgagattaagtcagttattgatatcgacgaacaacataaggaaatgtgccttatttgtgaggagcgatcaaattggcagaattagaagttttcggaatagaagaatggattagggatttggaacagttaggacaagatgttccccagatcacaaagcaatcattacaagctggagcaaaggtattcaaaaagaacttagaaagaaattctcctgtgggtccggaggtgcaaaaaccaactccaaaacaatcatggcgagatggaaaacacgctaaggatgctattaatatagggaaagttgtgaaaaaaggtagttcctattcaattgaaattggatgggacaaagcagataattctccgcattattatatgaaatttcaaaactggggaacaagtaaaaatccaaacccaccacacaaagggtttgctgagaaaactttaatccaaagtgaaaaagaagccctaaaagaaatggaaagggaatttatgcggaggattacaggccgatgaaaaatttgaataaggaaatatttgatgttttacgtacagatgtagttattaaatctgagttaggtggagaatttatatatcaatttgttaaaggaaatgacaaaacagatatatggattacattttcagagttaaatagttctcctgggctatatgcagagaatgaggaaaaaaccactaacgttatgtatcaggttgatatatggtcaatggcaccaatcaaaacgcaattaaaaagtgcagttcaggcagctatgaaaaagctgtcttttcagcgtttaagcacttatccagattatgaaatggatacaaaaatttatcgatatggttttcgttttgtaacggaaattattaattaaggaggaaaatgaaatatggcaatgacaatagattttagagatttacattatgcggttttaactgaaacatcagatggtaaatttaattattctacaccaaaacgaatcggtaaaacagttagtggtaaagcgtcacctaaagcggaatcagtaactttttatgctgaaggtggaccagcagcaacagctagtgcatttggcggtacagaaattgaattagaagttgatacattacctttatccgtttatgccgaattgttaggtaaaaaggttgtaaaaggtcaagttgtagataatacaagtgatgttcctccttatgtagcattgctatatcgtttaccatacgacaacggaaaaaatctatatgtatgttattacaaaatgaagtttgagcttccaagtgatgaacataaaacagcagaagataaaccaacattccaaagcgcaaaaattaaaggtaaggcaattcaacgttcggacggtaattggagacatcgattagatgaagaggaagaaggacacgatgcagcagttgcggcaaagtggtttaaagaagtaccagctccaccaatagaaacagccccaccaagtgggaagtaattaagaaaagggatggcgaaatgccatccttatttttattaaggaggaaacagatgatgaaaatcacattacaaaatacagaaggtaaaaaagatttttatttaccacaatttatcccaggttcagctacttttgaagcttcaacattagctgatgaattacaagcggacttagtaccaaaagaaacaattgaaagagctgctaattttgttgccagtgtgtacggaaatcaatttacagcacaggaatttgtggatggcactcatgtatggtttttaagtcttacaattcattctgtttgtttaacaattatggggcgcctaaatgatgcgattaaggtaatggaaacggtagaagatgcgaaaaaaaagttaatggcacaactagaaatgaaaccgacggaggaaaaatcaaatatagcgacgctgtaattgatatttataacatattgatggatgcaggtatgacacaaaatcaaatcaatgaaatggatattgcgttttactttacctgtttagcgagaaaacaaaaagcaaatcgagtgacaacagcagataaagtaccaatgtggttgtaaaggtaggtgagaatttgaatggcactaggagataatacaattggtggtcgtgtccgtttggatacagatcaattcgaaaatgggattgcaggcattaatagaagtctgaaaagaatagacgctgaatttcgtaacacgtctgagcagttacgtggagttggttcagagatggatcaactggagaataaggcaaaccatttaaatcaaaaaatagaagctcagacgcaaaaaatgaagcattatgagcaagctttgagaacttcacaacaaaaacaacaagaaatgcgtcaaaaatgtgagcaattggctacatctatgcaacaattagaacaagagatacagcaaagtactcaggcatacgggaaaaatgctcaagaaacaaaagatttgcaagctcaatataatcaattacagcaagaatacaaacaaggcacacaagctttacaaagattaacagctcaagtttctagaaatgatacagcatttaataatgcttcagcagctttacatcgatatcgtaatgagctaggtgatacagaagaaagaatagagcgattgggtaatgtttctggaagattacgcgagcgtatgaacgaagttggaaacagtatgcaagaaactggtacgaaagtgagccaggggtttggtgcagcagcagttggcgtggcggctggagttggagctttagttgtaaatgcaagtcaatttgaagaagcgaacaagaaggtacaatctggtttaggattaacaagggaagaaagtttaaaggttagtgctgtagccaaagaagtatggcgcgaaggctatggggaagatttagctagtgtcagtgattctttagttaaagtaaagcgcaatattaaggatattaatgatgatgatactttaaaacaagtaactcgtgatagtgaaatcttagcagaaacaatggaatcagatgtaaacgaggtaactcgtggtgcagcccaattaatgggacgctttggtttatctggccaacaagcatttgatttattagcacaaggttctgtaaagggtttaaactactcaaatgagctatttgataatttaagtgagtatggtcctttgttccatgaaatggggtttagtgcagatggaatgttcacaattctcattaatggttcgaaaaatggcgcatataacttggattatgtgaatgacgttgtaaaagaatttggtatccgtgtaaaagatggtagtaagtccacaacagaagcaatgggtcaaatgagtaaagaaacgcaaaaagtttggaaagcgatgctagaaggaaaagcgacttccaaagatgtttttaatgctgttttaaatgaattacgaacaacggatgatcaaattaaagtgaatcagttaggcgttgcacttttcggcgtgaaatgggaagaccttgaagctactactatgttatcactaaataatatggaaacaggtcttggaaactacagtggcgcaatgaacaaaatggtcgatggttacgatacaagcgctaagcaatggaaatctgtaacaagagaactacaaattgctctagaaccacttggtaaggtgattttagatatcgctaaacaagcgattcctgaattgaaagaatctgtgaagggtgtcgctgattggttcaacggattagatgatagctctaaaaaagtatatgggacagcattattactagccccggcagttatgggggtagttagtgcacttgggttcctttcttttggtattggtgcaattatagcaaatccaattgtcgcaacaattggtggagttgtaattggacttggtgcattaggttttgctttcgtagatgctgggaaaaaggcacaaaaagcagaagaggacagtaggcgctttggtgatggtgtaagtgaaggtacgaaaaaagctcttgaagggtatgtgaatttaaaagagcaggcttttaaaacattagatgaaataccaacaatgacaggtgaaaaggctaaagaggctgtacaacgagcacatgacgaatttggtaagttagcagatgaagcgattcaagcaataaataaagataaagggaaattccaagcgcatttagaaagttggtttgccggagaatctgattcagcagtcctacgtgcaaaggacaaaattttgaatgatcaaatggaagtgtataaagcacaagaggaagccgttattaaagcgaatgaaaaaatacaaagtcttttaacgcaatataatgggcaaatctataagatgacagaatcagataaaaaggtgtttttaaccgctttacaatcaattgacgccgaggtagggaagtcagcagctaagagtgtaaatgagatacaaaagattggtaaggcgatggataatttcaataagaacacttctgttgatacaatccaaggtaaagtaaaggagttaggttcagagtatacgaaacttacaaatgacttagataaagcaagaaaaaaagaaatagaattcgcaaagagtcatattacagattctgaaaaccaaaaggcaacaattgctcaaatcaataaaaaatactctgaacagtccgtccttataacagaagggtatagacaacagcttcaacaagctcaagaagtgttaaaatccaaaggcgttgagatggatttaacaacgggtatcacgaaggctgaaaatgagaaaattaaaattcaaggtcgaggattcggagagtatgttaagaattccgaaataattgaaagtacaaatgagaatctattcaagagacttcaagatagatcttcaaaagaagctgatctgagaaagaaaagtgctgatgaagtaaaaacatatggagagtcattaatttcaaattctaatattgtttatgataaccttttccagtcaactcgtgaaaaatctattgaagttgcaaatgacattgcaaagacatttgaagatggaagtaaaacaattgatttaggagagcaaggttgggttgcagtagaagagttcgttgatggaattaaatctggtaagtacaaggtccaagatgtagcgattgcaatcataaacactatgcggtcagaaatgggtaataaaccattgacaccagaaggtattaaagtcatgacttcatttaccgatggttttaaacagatgaatatcggggaggtcgcatctaagttaaacttagatttaaagaaaaatctcgatatagatttaggaccactcggaaaaatgaaaactacacaatttgtaaatggattacacgagggcacagtaggtattgacgctgtgtttattttttttcaacaacagttatctaaattaacagcagcagatttagcaaaagacggcactcgtataatggctacgttaaaaactggtatggaaacagggtttattaatgtacaagacgttctcaatactttgggagttaatattgaagataagactaagtacaacttagggccgaatggagaagtgacaattgcgtctcttgttcaaggcttacacaatgggaagtttaatatagatcaggcactcgaagttataagacaaatggttgtacaaaaaacaaacattgatacaactcagcaaggggcagctattccgcaaagtaccgcagatggaattcgtcaaaatggaggacaacctgttcaagccgcagaggaagttaagcaaggtgtagaacaaacactgggatcaaccacagacggaaatggtggagcagcttctactacattaatgaatcgaattatggctcaatataagccaaatattataggtgaagcttttaatattaaactaggcgttgaacagcaattaggaagtacaactgataataatggcggtaataacgcgacttctatgatgtttaataatattaataataataaagggaatgtcaatggagcggccgtaggtgttaaacaaagtgtagaaaatactttaggatcaaccacagatggaaatggcggcgcatcttctactcttcttatgcaacgactaattaacgggaataaagggaatgtagtcggagcagctagtaatgttaaattaggtgtagagggtatgttaggaagtgcaaccgatggtggcggtggtgataaggctggtaataaattcgcaagtgatatgggagcaaaacgtggagccgctgttgcaagcggaacaagtgttgctcaaggtggtaaagatggattagggagtgtcagctctcttagtcctggagaagcttttgctagtggttttgctaacggtatatctaacggtcaatggaatgtacaaaatgtagcagctagtttggcacgaggtgcatttgatgcattgaaagctacacttaatgtaaactctccatcaaaattaacacgtgatcaaggtggtaagccgtttagtgaaggatttgcgctaggtattcaaaaatcagctcacatggctgaaaaagaaagtagagaaatgggtaccaaagcaaacgcagctcttgtaaatgaattgaaattaaatagtgaatcaaataagttgagattttctggtgttcgtatggcacaaggaattgcgataggtattaaaagtcaatattctgttgtgcgagatgcattgcaagatacagtaacaggagctatggatagtattcgttctataaaaccagaagaaatatttagtttccaaggtgatgacccactaacaaagtattttaatgcaatctttgtagatggagattggcaaaatgattggattacacatatccctgaaaatatgcgtgatatggtaagagaaattggacgtcaaatggaacgatttgagggactttctattcatgatgtaggcagcctttctagatggagagaagtattatctgataatcctaatgtcattcaatatagacctgacaatgataatcctgataagcaaccctatatgaaatcagaacctacttatattgaaattcctgtcatactagaaggaagagaaatagcgcgtgtgagccatccgtatgtaactgaatatcaaaatagagcacaagcaagaaactcaatcttttagatttgggtttcttttcttttgtataaaaggagagagacgatgagttcctttgaatttaatggagaacgaaaaagttatattcatattgaaagagggtggaatcctccaacatgggcgcctttaaggaggaattttctgaaaacccccggatatccgggggcaaggttattaagtacagataccgaaacccgtcctctttctgtacctgtggggattattgttccaaatgggacgaatttagaaacgttaaaagaagaaatagcggagtggcttattactgaaaatccagcagaactgatttttgatgtaatgcctgatagaacctatatggcagttatagatgaagattttgatattgataaatttgtggatatcggacaaggcactttgaaatttatttgtcccatgccgtataagttaggaaatgagcaaacggttgattttgaaaatgacggtcgagggttaattgcaaatgttaaaaacaaaggctctgtgcattcaaatccgattattgaaattgatattaaaaaaccaaacacttttttagatgtatggtttgaagataaatattcaaaggaaccagattatttccgtattggagtgccattaaaaatggaacaattgcctgtagaaagaaatcaacgtcttatatgggatgatatgtccactactgtagggtggagtaaggttagttctatggaagatggtaatccagttggtgaaatgaaaacagatagttaccaattctattgttcggactatggttcaagtaatggatggcatggcgcatctgttaaaaagagtatccctggtgggccagtacaagattttattatgcaagcccacgttacatgtaaaagtaaaaagatcaatgaaatgggacgagttgagatagcgatactcgatgaaaacagcaaagttctttcaaaaattgccatgaatgacctctattggcaagctgaacaaaattttggaacgatggtaattggatatgataataagcctggaaaaataggtttgatttatgagagtggtgattatccgaatacatggaatcagtattatggtaggttgtggatcgctagaaccggtaatgattgggaggcttatatttcaaaatttcttcctggaacagaaaaagatgattcag

SEQ ID NO: 1376 - DNA, 31495 bp, Bacillus thuringiensis
ttccccagttctcctcacatgaacattcggattgtttctttcatcgctggcgtaattttttgtatatgcagcatttcctatttctccccttttatatcattgtgatacaatataagtgtatcacatgtaacggtatttggaggatgaggtaaagtatgaaacgtttttttgcagcactgtttactatactaggtgcaataactgcccttgggattttctttacaaataaagtgatgtacttaaagaaaaaaacagaggaagaagtactcgaaagagaaacgaaaaaacattttcgtatagaggattttgatgctcttcataaagaagaaattcatatcccttcacaatttggatacgaccttcacggatattacattcctgctggtcattccaccaataagtttatggttttttgccacggtgtaactgtaaataaaataaactctgtaaaatatgcaaacttattcttaaaaagaggatataacgtcctcatttacgatcatcgtcgtcatggtaaaactggcggaaaaacaacaagctatggatactatgaaaaacatgatttaaaatccgtagttgactggctaaaaaaccgttttggcaccaatattacacttggtattcatggtgaatctatgggagctgcaacacttcttcaatacgcaggacttgtagaagatggtgctgatttctatattgcagattgtcctttctctgattttcacggacaattacagcaccgtttaaaggttgaattccatttaccaaaatggcctttattacctttagcaaacgcatttttgaaagttcgtgacggttatacaattcgtgaagtttcaccaatcgactgtataaaaaacattaacaatcccgttctctttattcatagtaaagatgacgactatattttagctgatatgacaaaagcgttatatgaagcgaaagaaaataataagcagctttatattgcagaacacggtgcacacgcttgctcttataacgaaaataaagaagagtacgaagcagccgtcgatcaatttttaaacacatatgtgaaagaaacaaaaaacaggcttgcataagcctgttttttattgcgctaaaacgtctgtaacttgttccatattttcagaaatccattgcattgcatcatctaacgttgggaattctgtcgtttgaaatgttacttcatcttgcagtaaccaaacatcctttgcctcttgccctacacctgcaatggaccaatgtaacaaactatatggatgattatcattcaaaaatgatgcccacgtgcgctcatttgcaatgtttcgtaatgtatgtaattgtttatccatctctcgtcaccttactctagtcagttatgaaaactattataacactctcttctttctcaaacaaagtgctcttttttctccgctatttgcgggcagtaaaactcccacctcaaaattcggctgaaacaaagaagttaggtaggagattaactgcccctaaaagcccgattggttcaactaataattagtgggggatgcctcccccactaattaaagtttcactttatattgccaagcacttcccttgattatatgatgaaattaagcgtttgggaaggagggataacgttggcaaaagtacaaattaaagtaaatgataatggctcttttcgcgttacaggggacgtggaattagtcgactcacaagggaatgcattcccagcaaaaccggcattttctttatgccgttgtggtttatcaaaaaatatgccttattgcgacgcttcgcataaaggtaaattcgagtctgttgttagagcaccagaggcagaataattttacatgtgacatgcacatttttttgtgcatgttttttctttttagcaactccgttatatcccttctctttacaacatttctaatacttttatttccattccagcctgcatatattttcacacaattcttcacattcgaatattttttactagccttttattttttttgtgctataatttgagcaaacagcatccttcggggtcgggtgaaattcccaaccggcggtgatgaagtgaaaacttctaagtccgtgacccgttttcaactcgaaaacggtggatctagtgaaactctagggccgacagtatagtctggatgggagaaggatatgtttctagttttttatatagtgaatacacttttatttcagtatgcatatttttaaagattcattttgattctttatatatgtttaattttctatacttattttttatactgaaataaaaagagacaactagcgtttaaaaattcgatattttgctaggttttttccttatgcagaaatatcaattatcgttaggtttctttcctatgctttcgtattcaaactatatttctagaaatcacgtctcccaaaccccaaggatattaaatccttggggttttttgattttttttggagaggtgaagaaaatgacagatcaagaatatatgaggattgccctgcagttagcagaaggaacatcaggacaaacaagtccaaatcctatggttggtgctgttgttgtaaaagatggaaacatcgttggtatgggcgctcatttacgagctggtgaagaacacgcagaagttcatgcccttcaaatggctggtcagaacgccaaagacgctaccgtttatgtaacactggaaccgtgtagccactttggaaaaacaccaccttgctgtgaattgctcatcgaaaaaggagttaagcgtgttgtaattgctactctcgattgtaatccgctcgtttctggtaacggaaaaagaagattagaggaagctagaattgaagtaactactggtgttcttgaagcagaagcagttttattaaatcgctacttttttcactacatgaaaacgaaacgcccttttgtaacaatcaaaacagcgctgagcttagatggaaaaacagcaactgtaactggtgaaagtaagtggattacaggtgaagaagcacgtgctgatgttcaccaatatcgccatacacatgatgcaattcttgttggagtgaatacagttatagctgataatcctcatttaacaacaagaattccaaatggtgggaaacatcctattcgcgttgttttagatacccatttacgaacgccaccatcttctcatgttataacagatggtttagcaccgacatggattattgtcggtaaggatgtaaagaaagagaagatatcttcttatgaatctaaaaatatagctatattccaaatggaaacgaagcatatagaaatcgaggaccttctttcctttcttggagagaaacaaattctttctctattcgttgaaggtggccaatcgattcatgcaagtttcttaaaaacaaacaattttaatgaaattgtaacctatataagcccgaaattaattggtgggaaagatgctcctactttatttggaggaaatggtttttcaaaattacaagatgcgctttccttgaaaattcaagagatgaaacaaattggtgatgatataaaaatcgttgcgaatgcccgaaacgaggtgacgaaatgtttacaggaattgtagaagaattaggaacgatagcaaacatgcaacaaagtggagaagcgatgaaattaacgattcatgcaaagaaaattttatcagatgttcacttaggtgatagtatcgcggttaacggtatttgcttaactgtaacaaactttacaactacttcatttacagttgatgcaatgcccgaaacgatgcagtcgacatcacttcgtatacttaaaccacactctaaagtaaatttagaacgagcaatggctgcaaacggacgattcggtggacatttcgtttcaggacatattgatggcatcggaacgattttaaataaaaaacaacattacaatgccgtctattacaaaatagcaatttctgatgaactgctgcgctattgtttgcagaaagggtccattgctgttgatggaacgagtttaacgatatttgctatagacgaatcttccataacgatttcactcatcccgcacacagtaagcgaatctgtcattggagaaaaaaatgccggagatatcgtaaacattgagtgtgacatgattggtaaatatatcgaacgctttattactaaacctacaaaacgagtaggttcaatgactgaaagctttttacaagaaaacggatttctataagggggaagcacaatgtttcatcgtattgaagaagctctagaagatttaaaacaaggtaaagtcgttatcgtatgtgatgatgaaaaccgagaaaatgaaggcgattttattgctttagcagagtacattacaccagaaacaattaattttatgattacacatggccgtggtctcgtttgtgtaccgattacagcagggtacgcggaacgtctacaattagaaccaatggtatctcataatacagattcacatcatactgcgtttacagtgagcattgaccatgtttctacaacaacagggattagcgctcacgaacgtgcaactacgatacaagaattgttaaaccccgcatcaaaaggcgctgatttcaatcgacctggacatatctttccattaattgcgaaagaaggcggtgtcctgcgtcgtgcaggtcatacagaagctgctgttgatttagcaaagctatgcggtgccgaaccagctggagttatttgcgaaattataaatgaggacggcacgatggcacgtgtacctgatttaatagaatgtgcaaaacaatttgatataaaattgattacaatagaagatttaattgcttatcgccgccatcatgaaacacttgtgacgagagaagtggaaattacattacctacagatttcggtactttccacgcaattggctattctaactcattagatacgaaagaacatatcgcacttgtaaaaggtgatatttcaacaggtgaaccggtacttgtacgtgttcattctgaatgcttaacaggagatgtattcggttcacatcgctgcgattgcggaccacaactccatgcagcacttgctcaaattgagcgtgaaggaaaaggtgttcttctttatatgagacaagaaggaagaggcattgggcttcttaataagcttcgcgcttataaattacaagaagaaggattcgatactgtagaagcaaatgaaaaactcggcttccctgctgatcttcgtgattacggtatcggtgctcaaatattaaaagatttaggtttacaaagcttacgattattaacgaataacccaagaaaaattgctggcttacaaggttacgatttagaagtagtcgagcgtgtaccgttgcaaatgccggcaaaagaagagaataaatcgtatttacaaacgaaagtaaataaattaggacacttactaaacttataattaaaggagagatttattatggtattcgaaggtcatttagttggtacaggattaaaagttggagttgttgttggacgttttaacgaatttattacaagtaagttacttggcggagctttagacggattaaagcgtcacggtgtagaagaaagtgatattgatgttgcttgggttcctggtgcatttgaaattcctttaatcgctaaaaagatggctagtagcggaaagtatgatgctgttattacattaggtactgtaatccgaggtgctacaactcactacgattacgtttgtaatgaggtagcaaaaggtgttgcgtctttatcactacaaatggacatcccagttattttcggcgtattaacgacagaaacaattgaacaagcgattgaacgcgcaggtacgaaagctggtaataaaggatatgaatcagctgttgctgcaattgaaatggctcacttatcaaaacaatgggcataaaaaaagaggctgcggcctctttttattttttcacctttttttgtacatcttttattaattcattcatcgtttttccttctgtttttatatgaagagcttgcgctgttctccatacattctctctttttttcgcttcttctataatagtaatttcttttctaacttcctttaaatcttttccttccgttttcaatccaaaatgttcagctttcgttcgaaagtgttgttcgattctttgttgcatctctttttgttcaggattttcggtagccttaactggatcagaacttattgcttttattaaaattaaacaagtcataatcgctaatatgtatttgtacatgtaaaatcctccaacccaatataaattacatatttactatgtacaactagggcttggaaaattcgtccacaaaaattctttttttcgttcaaaaaccaatagtatcaagcgttcacaactatttattacattttatttacaaaaaagcaaactcttttacaagtttgctttttcatctatcttataatgcacattcttcaatctcaaatcctaaatctgcaatcataccccagtccgcagtcggctcttgtccagctgtcgttaagtagtccccgacaaaaatagaatttgctgcaaataaaccgattggctgtacagaacgtaaattgatttcacgtcctcctgaaatacgaatttcttttgttgggtttacaaaacgcatcattgcaagtacttttaaacattctactggcgttaactctttttgcccttcaagaggtgtcccctttacagcaacaaggaaattacaagggatagaatctgcatctatacgttgtaattcaaatgcaatttcagcacgctcttcaattgtttctcccatgccaaaaatcgctccagagcatggtgaaataccagcttgttttgctttttgaactgtatcaacacgatcatcatacgtatgagttgaacaaatgctatcgtaattatttgcatgtgtatttaagttgtggttataacggtgcacgcctgcttccgctaaacgtcctgcttgatcttcatttaagaaacctaaacaacaacaaatcttcaagtctgtcgtttcacgaatttccttaactgctccaattacgtgatttacctctttatccgtcggacgacgaccagacgctacaatacaatatgtacctgctttacggcgtattgcttcatgtgccccttctacaatcttctcctgcgttaaccatgcatatttatcaatcggtgcttctgaaataatagactgtgagcaatatccacaatcttcaggacataatccagatttcgtattaataatcatattcaattttactttcttaccaaagtgatgatggcgaataatgtaagctgcattcataatttctaaaacttctgtatcatcagcttctaatatcgctattgcatcttctttcgtaatcattttctcttccactacgtcgtatgcaagttttttccaatccctttttgtttgtacttgtttcatttcatctcttcccctcttttgttatatgtataaataaagcatgatacgttgccattatcccttcatttcccgtgaagtctctttcgtatatgcgtagcatcgcacgaaagagtgagggactttgacaatatgatccttcattgctattagttgctcctacttttcgaatagaatgcagaaactccttaacttctgtaaaactctctatgtaacatgtttcagaaacatgcacatcccctgtttctatcttacatatatgaagcaactgatcttttgaataaaaacgttgaccaatcgatatttcattttttatatttctttcttctttcgcacgttggaacgaagcatgcaattcttgaaatgtttcatgtccaaacgttgaaaagagtaatatcccatctatagaaaaatgttgaaataaatttcttaacacttgttgtaaattatttaaccattgaaatgtagcatttgaaataatgacatcatatgattcttctaatcgtaattgctcaatatcttcacagtgaaacgttacattttttacattttgtctagtttgcgcaatcgcaatcatactttcagcaaaatcaactgctgtaatatgtgctttcggaaataactttgataattgttctgttacataccccgtcccgcatcccagttctaaaatacgtattgatgccgtttcactatatcgttcctttaagattgaaagtaatgaatgtgccatctttttttgtacatttgcatatcgatcgtaagatacggctgccccattaaaccgtttttgtagtaacgttttgttgatcatgtcgtatcccctctacaaattgaattatctcatttgcgcaatattcaaaattcgttacacataatgcatgccctgcttcacttactactttcagctcgctgctgctattctccgtcatactacgtgccgcagacaatgggcatattacatcctgttctccgtggataagtagtataggtactttaatttcttttagttcttctctcatatctgtttctattaaataatccaaacctagttgtaaagactgaatagaatcacctttaaaatggtctacaatgtcttcaaaatttttgttctcttttagctcatctttcgtaaacatattttcataaaaccgcttgagcgtatcttctttccttctcaccaaattccttttcagccgttctacatgcaaagcattccatccattactatagtcactcgtatttgtaaatttagcggtcccaccaattaatacgatgccttttgcctgaatctttttataagcttcaactgctgctaacgctcctagtgaccatccaactaaaattacgttgtcgttatgcgctacatctataattcgttccgcaaattcacttcgttctttcacattatgccaatctatgcattcaacaggatatcctttaaaatacggaagtactaaatcccaaatattctcttccattccccatccggggataaaaataatctttagctcgttcatacgaaaatctcctcttctttcgcaatgtgaataattcgatcaatagcccattttaaatcagctattgtatgttgcgatgtaactgcaaagcgaattcgagaactatgaaccggcacagttggcggacgaattgcaatggccgcaatccctgcctcttgcaaccttttactaaatcgtaaagcatgttcatttgaaccgactacaatcggtacaatatgagttgaactattcccaatatcaaaaccagcatcccttaatttagttctgaagtattctccgtttgctataaggttctctcttctttcgttatcttcttttacaatttcaattgctttttgcactgctcctaacgtacttggtggtaaagctgtagtaaaaataaagcttctcatcatattttgtaaatactctatataaatttcatcacctgtcaaatacgcaccataacaccctaaagccttgctaaacgtccccatatgtatatcaattttttgagcaagatttttttctatatgagataacccagctccgccgattccatatattccactcgcatgtgcttcatcgactataatgattgccccgtatttctctttcagctgtactaaatctcttaaatacacagtatcaccatccatactaaaaacggtatctgttacgattaatttccttttttcaggcgaagccattttcaacagcttctctaaatgatccaaatcattatgacgataccttttatgctctgccccgcttaataggattccatcaacaatacttgcatgatttaacttatcactaaaaacaatatcgtgccgagaggccaaagaagatatggcacctatatttgccgtatacccactatttacaattaaagctctttcagtacctttccagtcacatatgcttctctcaacctcttcatataatggatgatttcctacaacgagacgagaggcagtcgctccagttccatatctttttgtacaggcaatagcagcttcttttaacctttcatctccagctaaccctaaataattatttgacgctaaatttaacatcttttttttatctcgaataagccaagtctcttctgccttctctgttacatgcaaatcacgatactgcccttgctcatgtaattgttgtaatttagattgaaggtgcgcccgccacgtttgattcattttggataaactcctctaattttgaaatcataatatgttcttttgcagattctaatacttcttctttcgtaaactcaccttcaaagaatggtaataatcctaaaactggtaccccgctcagctcttcaatcatctctttattttcttgcactctttccatttcacattctttgcaacctgacaaaatgacacccgctacggttaagccatgcgcctttgcgtaagcaatcgttaacactgtatgatttactgttcctaatgtaggacgagctactacaataagaggcaactgtaattcttttgcaaaatcaattactaaagcatcttctgtatatgggacagcaagcccacctgccccttctacaaataagctattaaactcttttaatagttcattatagtaatcagtaatttcttttaactttactactcttccagctcttttcatggcaagtctcggagcaagtggttcttcaatagaataagggcaaatttcattttcttgtgtcggtacacctgataatgcttttaaccttgccgcatctccctcagggtttgatgcaacatgcccactttgcaacggtttatacacccctacgttatacccaagttctctaaatacacctgctaatgcacctgtaactacagtttttccaacttcagtatctgttgctgttataaaaaaaccgctcattattctccctccgtaacatccgagattgctttatataaaatacgtaacatatcgtcaatctcatcaattgtagaagcaagaggaggcataaatacaatcgtgttgccgagcgggcgcaaaatcatacccagctctcttgagcgtttacatacttgaacaccgactctttctgtccagtcgaacgcttctttcgtttccttattcttcacaagctcaataccaaccattaatccgcactgacgaatatcacctacatgtttatacgcaaagagcttttctaattgcgctgccacataatccgttttacgtgccacttcttctattaaatttgttttttcatatagttctagattcgcgattgctacggcacaccctaacggattgcctgtgtagctatgtccatggaaaaatgttttttgttcttcatattctcctaagaaggcattatatatttcatccgtcgttaccgtaactgcaattggtaaatatccacctgttaaacctttcccagcagttaaaatgtctggcgtcacattttcatgttcacatgcaaacattttcccagtacgcccaaatccagtcgctacctcatctgtaataaataatacattgtacttagtacataaatcgcgcagtccttttaaatatccttttggcattgtaatcatcccgccagcaccttgcattaatggctctacaatgatggcagctacttcttcatgcttttctttcaacaattcttccatttcttctaaatggctttttacaatttcctccttattatttccgtaaggagaacgatatgtatatggatacggcattttaatcgcatcaaataagagcgaactatacacttggtgaaacaagtctattgctcctaccgaaacagctccaattgtatcaccgtgatatgcttcttttaatgtaacgaatctttgtttctttggtttccctttatgctgccaatattggaaagccatcttaattgcaatttcaacagcggtagaacctgaatcagaatagaataccttcttcaatccatctggtacaacctcaataattttttctgctaataaaatagatggaacattagcaagtcctaacatagtagaatgagcaattttatttaattgctcacgaattgcttcatctaattccggtacttgatgtccgtgaacatttaaccatatagatgaaacaccatcccaatattcattaccatttacatcgtatagctttcttccctctccacgttcaataatgacaggatcttcttctaaataatctttcatttgtgtaaatgggtgccatacgtaagctttatttttctctgctaattcttcatatgtataagatgatttttcaatcgttttactatttattgtcacaattgtcacccctaatgttaacttgtttataaatatagttaacattaaatctgaatgactgtcaattattttaaaatcaaatagttcttaaaaaagaacaacttatcatatgataagttgttctactttccatgctgtatctttccaatttctaaaataatttcttcatcttttttcccctctgtatcaattccaagttgtttagcgtgctcaattaataaatcatgacgcttatcaaacctagcggtatttacttctttcgtaacctcttcttttgttttcccctcagtagaaactcctagtttctctgctgctttttccattgatttcttctcttcagcttctttcgctttcttcacttctgactgttgtatttgcttttgtttcaactgctctgattcagccgcaaaagctgtgtaaattccagcacttcctccaataactaataaagtggtaaaaagaattatttttttcttcactctttcctccccctttcaaattcattataacgtacatttttacagcgttaaaaacaattatcctttatttccctaaaaaaacatttaatatttttattgacatgtaagatgaaaatatgataaaaatttaactaacatcatatgaatcggcgttgataggatttagtagtatttcgatttctgatttcagagagctggtggtcggtgcgaaccagtacagagcgaattatgaattaccccctggagcttcttttacgaaacgtgaggagtagtgaaggacggttatagaccgttatgtctaaagagtggtgaaacgacactgtttcacaatttagggtggtaccgcgaatttttcgtccctgcatatattgcaggggcgttttttattttataagcgcatatcatatgaccctttattttgtgatacattcatttcacaagctagggtggtaccgcgatttcttcgtccctgcataattatatgcagggacgtttttttatccaatcatttccgcatcatatagaagaactaacaattaccggtaatttgtcacaaaattctaaattttagaaggaaatatacaatattggcgaattttatataaaaaagagctatttcacattacttaggaggggaaaacaatggtttcaaaaattgagtctgttcttttaacaatttttatctttttctgcattggctttagtgttatcaaattagaagtttcaccacacatcccgattttatttggcatcgttcttttattagcgtttggatttatgaaaaaaattgattggtctactataaaaaaaggaatgataagtagtatttcagctggtattccatctatatttattttcttacttgtaggcgtattaattagcatttggatcgcagctggaactattccaactttaatggtatacggcttccaacttgtatctccaaaaattttcgttccaactgtttttgttgtttgtgcaattgttggaacgagtatcggtagtgcatttacaactgctgcaactgtaggacttgcctttatgggaatgggtactgcccttggatacgatccagctcttattgctggggcaattatttctggggcattcttcggagataaaatgtctcctttatctgatacaacaaacttagcgcctgctgtaacgggtgtagatttatttgaacatattcgtaacatgctttggacaacagtgccagctttcattattgcttttatcgcatttttcattttaggaagcggatctggtggaaacgttgatttctcagcatttattaacacattagaaaaaaatgcaacgatttctatcgttacactgattcctattttattactgttcctattcgcatttaaaaaggtacccgcagttccaacattacttgcaggaattgtggtagggattattattctctttatttttaaacctagcacttctttagctgatttaataaaaattatgcaagacggttacgtttctaaaactggtatcaaagatattgatagcttattatctcgcggtggcctgcaaagtatgatgatgtcaattgctcttattttcctagctctttgtatgggaggattattacaaggaatgggtattatagcgcagctgatgaatattatctctagcttcgtaaaaactagtacacgcttaattatttctactgcttcaactgcaattggtgtaaacttcttactcggtgagcagtacttatccatcgttttaacaggacaagcatttgctaataaatacgatgaagtcggtttagaacgtcgtaatttatcacgagtattagaagatgctggtacagtaattaatccactcgtaccatggggtgtaagtggcgtattcttaacaaacgttcttagcgttccaacattcgattacctgccatacgcaatcttctgtttagcatgtccagtcgtaaccattatcgtcggctttactggattcggtctttcatggaaaaaagaaaaagcagtaccagtttcataatataataaaaaggattaccaaatcggtaatcctttttatatttctcgactatctattcgctttctttcttctaaataacataagtaatcccgctccaacaaacgcaagacccgctccaattgtagaagcaatacttgcacctgttttcggtaaatcacgttcatctttttcagcttctttattttcacttacagttgttgttgtttcttttgtattttgatcatctgttgtagtttgtccagatccagtattgtttccatcttgttttggttcattaccattattaccttcttctgttggtggtgttgggttttctccattacctgttggcggtgttgttggattttctcccccacctgttggcggtgtcgttggatttccttcaccagtttctttatcatcatttttcttcgttatatcaattgcatatttagcaaattcattttcagatggtccaacatatgatatgttcccatctttctttatatacttttgtgcatttggtgaagaatcaaatgttgtatttaatttatctgcaacaatcggtttaaacgtccaattttgatcagctgctggatcaatattttttattttttgcatatacttcacaatgatttgacgtgtttcatcttgtgattggtatacaacctcccctttacttacacctgggaacgtttgactacttccacgatagttatttgtagcgacgatgaacttttgatcatcagctactggcttaccttcatatgtcatatttacaatacgattcgtatttgcatttacaacttttccatctttatcgtatttcgctggttgtgttacatcaatttcgtattttaagccatctaaaatatcaaagttatatgtaggatagcctatatttactaacggctgttcttctgttttctttggatcaatttgattaaactgacctgcagacatttcaagccattctttcacttgtgccccatttacttttacagcatataacgtatttggatacacgtataaatctgcaacgtttttaattgctaacgttccagctggaatatccgtataatatgtagcaccgtttcggccacctgctttaaatggtgcgcctgcagataaaaccggaatatctttaatctcttcgtactctggttttttaagttcttgttctacataccatttttgcgcatttgtcacaatttgtacggaaggatcatcttgtactaatgaaaaataactattaattggtgctttcgttttacctacaggtgtatttacatagtcgattgtcgcttgatgctcatctttaatttcattaactaatttttgatcagattctactaatggggtacctttactattagcaatcgggcgaagttgtggcttagattggtctttttgtacttcccattttccgtttacctttttcaattgcatatcaataatacctaagttacttccaaagacaccaggcattacaactggaacaccattaaatacatccttcacttcagtatgtgaatgtcccattaatactgcatctacgccaggaacttctgtcgctaaataaaacgatgaattttccattccttcgttgtatccactcttatcaacacctgaatgcgctagtgcaactataatatccgcaccttgcgccttcatttccggaactaattttttcgctgtttgcacaatatcttttgcctttacttttccttctaaattcgctttatcccaattcataatttgtggtggaacaaatcccattacaccaatcttcactatttgtttttggcctgcttcatccactacttctttctctaaaatatgatatggtttatcaaagtaatgctcgtcattctcatcattaccatcatggtcatctatatagacattcgagttaataaccgggaaatccgttttttcaatcactttatttaaataatctaaaccgtagttaaattcatgattcccaagagagatgacgtcatacttcattaaattcattacacgatataatggatgtgtataactaggatccacacgattcttctgatcttttattttatttgctacataatctccaagcggtgtcccttgtaatgcatccccatcatcaaataggacagagttcttcacttcttcacgtgctttattaacgagtgttgccgtttgtacgagacctactttattatctgttttcgtttgataataatcgtaattcattaagttaacgtgaatatctgatgtttctagaattcgtaagttaactgtactctccccagtgttctcatctgcatgagctgttgctggcattacttgcggtgctataacaccaatcgcaagagttgctccagccagcattttttttgactttttcacaaaaaatcccccttatacaattaccagaaataatgaaatgaatccctatctgtctctaaccacataccttttttcttctattagagacacaattttcatttcatcctgcgctaacgagtagtccccttaaacgcccgattgatgaagactaacaattaataggaaataaagctcccactcattaaagtttcaccttatctgacattatcatatataaagttctttcctatcgtcaatattttttgacaaacttcaacaaattttctgtaaagttattataaacttttcataaacatataatatgcccttacattgctaatactgctgaatatgatacaattaccaattacaaggaggatgaatttatgaaaaaagtcatcttaacaattgtttgtctcctccttctgatcatttcttattcttattttgaaaagaacgacgagacaaaacaaaatgaatctgaagaaaaaacagaaaaaacatctgccccaaattggattgataagcaaacaaacgaatctttttatcatcttgtattaggtgattcactcgctaaaggatatggatcgacacaaggtggatttgctgaattagcttctaagcaaatagaagcacaaattcataaaccaattacagtagaaaaccttggggtaaacggtcttacaacagatcgtctcgctaaaaaagttcaatcagaagatgtaaaggaaaaaattagagcagcaaatataattacaattaatattggaggaaataatttatttcgtttaaatcgtgatgttggtgttatagatggtataaaaatgttaaataaagaaaaagcccattttgaagcggatataaaaagtattgtaaagacagttcgagatcaaaatccggacgctttactcattctctcagaactctataacccgttacaactcgatgactccatcgcaagttatgcagatatgtttttagatggctggaatgaatctgtttattccatttccaaagcaaatcaaccatctatcgttttaccaattcgcaaattaatatcaaatgataaaaaagagttattatttgaccaagtacacccaaatgataacggctatgcaattattgccaatacatttacaaagcaagtgttatcctacaaatattaaagcgaccatgaaacaattctatttttataacatgtcttttttgttacaatgatagtggaagggggcctttatatggaatcacgcgagtgggaacgtattgttgatcatcttctttcgctagtgcctcttttttatcgcaaatttatgcttcctggagaattttcttctcaaagacatatgccgccatcacatacacaagtattactgcttttgcatgaaaacggcacattagcagtttccgaaatcggcaagcggctagcgatttcacggcctaacatgacacctctattaaacaaacttattcaagaagaactaatagagcgtcattatagcgaaaaagatcgacgggtcattttaatttctctaacagctgaagggaaattattagtaaatcagtatcagcaattcattttagacaaactaaaagaaaatttccaaacattatctgaggaagagcgcgaaaagctcattcattctcttcaaaccattcaaaatttaattttgaaaacaaacgtataaagctgcttctaaatagaagcagctttatgattcgtaataattaccatagtatacattggaatatggccatgttgttaaatatggttttttttcctgtgtaggctgttgtgttggtaattgtggtatttgtgataattgctgtaattgttgttgccgatataattcgtattgtctactcgtatcataaaccggataataatttacatatggatatacttgaggtacgtaataataatacattatcctctcctcctttttcttaaacatattcaaaggagaaaatgaatgtgacattgtttataattgtacaagtggttctctcactcgtttcttccttttcttcaaacgtaacttacggttcttttcgtataaataatgcacaacgaaatatgaaatgagaccaaacacaactcctaaaatcgtcattccaattaatacatacacttcactttgtaataagctctttaatatcgtaaaaatgtgacttgaaaacaagtccgatatcgtaaatggttcatgatgaattttctgtacatgaaatggataaatcatttttcctagcgcatacgcaagcggaaataaaaatactgggagaaacgatattttcccaataatattgccaataactgccgcaggaaaagatccctttgctaacctgacgattggataaaatattacatatacgagcgatgccgtataaatgactaacatttctaagccgaatcctatagcaaaccctaacgatactttctttgcgccttctggcgatcgaagcaacttataatattgaaactttaatattctccacatccgctggaaaaacgaatatgttttcttagtttgttttcaccctcatcatctctttaactatatttttatatgtagtatgtccttacacactctgaaaaacaaatttagttttctcttttattataaatgatatcgaaatggttaaccaaatatacatccgacattttaatataaaaaaacctcccttttaggaaggctcttctacatttttaaataaactcactaataacgctttttgagcatgcaatcgattaccagcttgctcaaagacgatagactgcggtccatctataatttctcctgttacttcttcttcacgatgggcaggtaaacagtgtaagaaacgatatgtttgcttcgcatgcttaacaagttcgttattgatttggtaaggttgaaataaagtatacttctcttcttcgccctcttgccccatgctcatccaaacgtcagtataaatgaaatctgcttcattcaccgctaattcaggatcatgcaaaacttcaatttcagctcctgtttccttggcaattgctaacgctttttttacaatctcttcattcggttcataccctacaggcgttgccacagtcatatgcattccgacttttgcactcgctagcaacaatgaatgacatacattatttccgtcacctacgtaagccaattttattcctttaaatgtatttgtttcttcgtatatcgtcataaggtctgccaatgcttgacaaggatggtgatcatccgttaaaccgttaataacaggaatactcgattcttttgcaagctcttctacatccgcgtgtgagaatgtacgtatcatgatcccgtcaatatactgcgataatactttcgcagtatctgaaacgctttctcctcttcccatttgcatctctttcccacttaaaaacataccatgtcccccgagctgtaccattcctgcttcaaaagatacacgagtacgagttgaatgcttatcaaaaataagccctaatattttgccttgtaataaaggctcttgcttattcttttttaaatatatagcgaactcaattaaagaaataatttcttctttcgttaattcttctagtgttaaaagatctttcgtatttaatttcggtacttgtacagttgacatgaaacttcccccttatatgattgatacgttttttgtacaaactactttttttattatatatactgcctgttctaactcttcattcgtgacaatgagtggcggtaatagtcttatcacattaggacctgcttgtaatacgagaagtccttcgttttctagttgttctataaaacttgcaacttcatgcttacactcaatcccaatcataagccccttaccacgtatattttgaatacattcgacatgctgtaattcctcttgcaacttctctaatacgtactcgcctttttcttgtacttcttttaaaaacgatggtttttcacttacttgcaatacttctttcgctgcagccatcgcgatgtaattcccgccaaaagttgaaccgtgtgatcctgcagtaaacgacgctccgagctctttccggccaatcatcgctccgacaggaatcccattcccaagcgcctttgcaacggtaacgatatcaggctctattcccacttgttcataagcgaatagtgttccagttcttcctatccccgtttgtacttcgtctataataaataaggaaccgaacttattacataatgtttcaatctctttcaaaaaagatagatcagcaagtattactcctccctctccttgaacaacttctaccattaccgccgcaacttcttcattcattacttcctctaatgctttaatatcgttaaaagggatatgtaaaaaagatggaagtaatggaccaaatccttcttttaccttatcttggcccgttgcactcatcgttccaaatgttctaccgtgaaaagactgctggcatgttacgacgagagattttccagtatgcttacgtgctaactttaaagccgcttcatttgcctctgccccactattacagaaaaacacataatctaattctctattttctgttaataatgacgcaacttcttcttgcaagctgtttgtaaacaggttagatatatgccatatatcatcaagttgctcttgtacacctttgagaacagtagggtgacaatgtcctaaattacatacgccaattcctgatgtgaaatctaaatattccttaccgttattatcaataactttcgttccagttccctttacaaactcaatagttcttctgccatacgtttgaaaaagatgactcgtcatgcaatactcacacctttcgttaccgtcgttccaatacactctcccgtaacctcagtaaaatcttttgtaccattcacaatacttatcttttgcactcccatttttaatgatgctagtgccgcctgtactttcggaatcatcccacctgtaataacacctgtttctataaaagtagcaatttcagattcatccgtttcctttaccaaattcccttcatgtaatattccatctacatccgtaataaaaataagctcttttgcccctaacgcagccgcaatcccagctgcagcattgtccgcatttatgttataaacttcattaccatttaccccgattggagcaataacaggaatatactccatattcattaatccttttaataaggctgtttctacataacttacttcccccacatatcctatctcttcactgacaggttgaacttgaagtaaattgccgtcacatcctgaacaacctaccgcaagtaaattatgcttttgtaaattcattacgagttttttattcgtacttccgcatagcaccatttgaacaacatccataacttcttttggtgttacgcgtaatccatctcttttttctacgttgatgttacaatcttttaatttggcatcaatttctggcccaccaccatgaacaatcactactttatacttctgttgcaatttctttatacattcaaaaaacacagcttttaattgattcaacatactaccgccgcatttcactacaatatattcgctcatcttctctctccttatgtacgataacaagcgtttattttcacatattcatagcttaagtcacagccccaagctgatcctgtctcttctcctaagtgtaagtacacattaatgactatttcatcttcttgtaatctctctttcatttcttcttcagaaaatgtttgaggctcactattttttaataccaatatagattgaagagtaatgtcaattgtattcggactaatagctacttcactttgtccaatactgctaataattcgtccccagtttgggtcttcaccatgtattgctgttttcacaagactcgaaccgactatttgctttgcaattttttttgcctcttcattcgtttgagctcctagcacatttacttctattaacttcgtagcgccttcaccatcttgcgcaattttttttgctaaatcttcacataccttctgtaaagcacatacgaaagtttcccaatctgtatgttccatatttatcggccttgtttctgataatccacttgccataacgatgaccatatcattcgtagaagtatctccatctaccgtaatttgattaaatgtatgattcgtaatttgggataatgccgtttgcaatacgtcatgctctatatgagcatctgtcgtaataaaactaagcatcgttgccatattcggatgaatcatccctgaaccttttgcaacacccgcaatcgtcactttcttcccatcaataatcatttcatagcaagtttctttcgttatgagatccgtcgttaaaattgcttcagaaaaagaatatgcttcactttcttccttcgtcggtataagagttgcaactccctttcggattatatccatcggtagcggaacaccaattacacctgttgaagctactgcaacgtaattttctttcaatccaaaatgttccgcccctaatgtgcgcatctcgtatgcgtcttgtaatcctttcattccagtacaagcatttgcatttccactattaacgataattgcttgtaacttcccttctgccgttatactatccttcgttacttgcaaaggggctgcttgtatttgattcgttgtatacacagcggcacatgatgctggtacgtcacaaacgattgcccctaaatcctttttcagaccatttgcagtaccaattgccgaaaagcctttcggcgttacaattgaaccattttctaattttgtaatagacgctactttaatcatcatgtcccccttatagataaagcggcatatgttgtaaacctgttgtctcttctagtcccgctattatgtttgcattttgaatcgcttgcccagccgcgcctttcatcatattgtctataacagaaacgaccgtaactatttctgttctttcatcgtaagctatgccaatatcacaataatttgagcctctcacttcttttggacttggaaatttcccttgcgtacaaattcggatgaaaggcgattgttcatacgtttcttcatacaatttttgaagttgctttatttccatcttttgttttacttttgcataaagtgtaatcatgattcctcgtgatatcggtattaaatgtgtgctaaatgtaattggctgtaactcactattccattctgtaagcatttgctcaatctctggaacgtgctgatgctggtttactttatagatgtgtaagttatcgtatagctcaggaaaatgagtcattgttgttggtgttttacctgctcctgatacccctgatttcgcgtcaataataatcgaatcttcttcaatcctgctactacgtactaacggtgctatcgctagcaatgtggctgtagcaaaacatcctgggtttgcaattaaatttgccttttgaatcttagtccttttccattcacttaacccatacactgcttttctaagaatttcttctttcgctgctggccttttataccacagttcatatgacgaaggatctatcatacgaaagtctccagataggtcaattacttttaaaccttctgctaataacttgggagttaactccgccgatactcctgctggtgttgctagaaatacgatttctgcttctttccctattgtctccacatcaatttcttgtaacgtatgaacgaggacatttcgaagatgcggatatacatttgttatacactcaccaacttgtgaaaaagaatgaagagatgctatagaaaaatatggatgttgttctaataaacgaattaactcaatgcccccatatccagtggctccaataattgcgactttcataagttcctcctcaaatcgattctttaaattaagtatgattataatattgtatatttatagagtcaattaaatatttataaatttttaaaagtaaaaaaacttaattttactagaaaaacattacacacaaccgaatttttatacaaaaatagtgcatggtagtttttttatttcacttcaagtacaataaaacaatacatacgtacatacaggcgggaaaaaatatgaacgaaaaattaattgagaaaatgattataaaaagttttcagcaatatcaatgcagtccaatatcaaaagaagatcaggaaatgctaattaaacatattcaaacgataattcattcaaatactgaaattgatgtatacgaggcagttgaggatatcgtttacgattatgtgactggaaaataaaaaaataggagatttccatatggaaacctcctattttttacttaatgatttacctgctacacgttcaaataaacctgggaataaagcataaagtttcggtccaattcccatccacttcggtaagtttacttcacgttttttcgtgtgcatcgactttacgatttgttctgctacgtatgttggttttaacatgtaacgtcccatattctttacataggtaccagattgatccgctatttcaaaaaagtttgtatctatcggacctggattaattgctgtaacataaatatctgtattcgctaattccatgcgtaaactattcgtaaatcctaatacagcatgtttcgttgctgcatacgcacttgatttcggagttgcaatttttccggcaagggaagcaatattaataatatgtccttcgttcttgtttaccatataaggtagtaccgctttcgtacatgctactaatccaaatacatttacttggaacatatcttttacttcatccattgacgcatcttcaaacgttttaaaaataccaaatcccgcattgtttactaatatatcaatacgtcctacttcttgtaatacctttgaaaaaacagactgtacttccatctcttcacttacatctaatacataataatagcaaggcgtattataagtttctttaattttgtctactaacgcttgtagtttctcttctgttcgagccattaatacgggagtcgctccctgtgctgcaacttgcattgcaacttgctcaccaatcccactagaagcacctgtaatgacgattactttattttgtaaacgtcctgtcattgctgtcacctactttgcataataaatcaattgttgcgatgattcatcaatcatcacttgttgattatatgctaaatagtccaattgtccaaccgtttctgaaatagtaagtggtaattgttctttatataataccggaaatagttttacacatacttcaaatgctgtcattggtttttcctttaataactcaagcactttaaaagcacgtgtttcttgcttttgtaatctcgtttcaataagttgtttcacatttagaacatcttccccatgccctgataaaatgcgtgaaatattcatttcgcttaaacgctgtaatgtttgattatattgtagtaatgggcgtgcccgttctgtttgcccttcatatggtggttctagtattggattcgaagaaatatgactgatgagagcatctccaccaattaatattccatcagattctctatataaagaaatatgagtagaagcatgacctggtgtttcaagtactataaatccaggcaaagaatcaatacgatctccttctctcacagtatgcgttaacgatctattacaagaatatttaagtgtcctcgtcgtcaataacgactcgtctttcaaaaatgctgctggcacaccaaactgtaaggccgtctctctaaaaaattcatgataccgctttaaaaattctggattttgtgtgatccaaggctcattccaaggatgtccaataatattcgtcttctcagaaaatatatttaaaagtccacaatgatctgcatgatgatgcgtaatgactactgtttcaatatcttctatcgtatgtcctaatgcacctaattgactttctaacgcattccttgcctcttctgtattcgtccctgtatcaattaatgttaatgtctccccctcaactaaaaacacattcacagtttccactgcaaatggtacaggaatctccattcggtgaatcgccgtcatgcttagcccccctgtctctttccggttcaaaaatgaatacttcttcagtttacaacttctatatatatttgtcattattttcagataaaaagaggtgtttcctataaaaaaacgaatgtatgtacatttataagaatttctaaccaaaattaaaggaggaacatcatgtctattcaaaacatttcctttctcggtgcaggctctattgccgaagctattattggtggcttgttacatgcaaatgtcgttaaaggtgaacaaattactgtaagtaatcgttctaacgagacaagattacaagagctacataaaaaatacggtgtcaaaggtactcataataaaaaagaattacttactgatgcaaatattctttttctagcaatgaaaccaaaggatgttgcagaggcgcttaccccttttaaagaatacataaataataacgtgcttattatttcattactagcaggtgtttctactcactcaattagaaaactacttcaaaaagacgttccaattattcgtgcaatgccaaatacatccgcagccattttaaaatcagctaccgctatctccccttcaaaacatgcaacagcggaacatattcacactgcaacatctttatttgaaacgattggtctcgtctctgttgtagaggaagaagatatgcatgctgtcactgcattatccggaagtggacctgcttatatttattacgtagtggaagctatggaagaagctgcaacaaaaattggtttaaaagaagatattgcaaaatcacttattcttcaaacgatgattggtgctgctgaaatgttaaaagcaagtgacaaacacccttctattttgcgaaaggaaattacttctcctggtggaactactgaggcaggtattgaagtattacaagaacataaatttcaacaagcacttgtttcttgtattacacaggcaacgaaacgatcacataatcttggaaaaacattagaacaactaacaaaagaaaaatagaaaaaggagctcaagtttatttgagctcctttttctataatttacacttagttattgttcttcccaaaaatctcttcttgcaggcgacgaccagttggcgttgctgcaagtccaccttctgctgtttcacgaagtgctactggcatcgtttgtccgattctaaacattgcctcaattacttcatcacatggaattgtactcgttacaccagctaatgctaaatctgctgagatcatcgcatttgcagctcctgctgcattacgttttacacaaggtacttctacaagtcctgcaacaggatcacacactaaaccaagcatgttctttaatgaaattgccattgctgtagctgcttgatcttgtgttccaccagccatctcaactgcagctgcagccgccattccacttgctgaaccaacttcagcttggcatcctcctgccgcaccagaaatacaagcgttattcgcaacaaccataccgaaagctcctgctgtaaataagaattcaatcatttcttcacgtgtaggctgcaatttttctcttagtgcaaatagtacacctggcactgttccagcagaccctgctgttggtgttgcacaaataattcccatcgctgcgtttacttcatttgttgccacagctttgcttactgcatccaaaatcgtatctccagataagccttttccactcttcatatacgcttgaacttttacagcatctccaccagttaaaccagttggtgatttcacgccgcgaataccacgttctactgcttgctccatcactactaagttcttttccataccagcaattacttcttcacgtgaaatacttcttgtttccatttcacattgaatcataatttctgcgatttttacattttgttctttagcttgcgccactagttccgctgcgttccgaaacatggtgtgtcccccctgcaattattccataatagttacttgacaaatattttgttgcgcttttatttcttcaattacttcatctgctaataattcatctgtttcgatgaccataagcgctcttcttcctttttctttacgagatacactcatcgtactaatgttaatctcatgtttcgcaaggattgaagctaccgctgcaatagcaccaaagcgatcgttatttacaataagtagtgctgggctcgtgcctgataattgaagatcgaatccgtttaattctacaacttcaattttaccgccaccaattgagcaagcaacaacttcaatttcatcttcacctttatacaaacgaattctcgctgtatttggatgaggtgcattggcatcttcttcaatgaattccacttcaatttcgcgctcttttgctatttctagcgcctctggaatacgtaagtcatctgtttcaaatcctaatattccaccgattagtgctacatccgtaccatgccctcgatacgtctttgcaaatgatccatataacgaaatgcttactctttctggttcatgacgaaacagctggcgagcaacttgccccattcttgccgcgcctgctgtatgtgaacttgatggtccaatcataactggaccgataatatcaaatactgagcgatacttcatcataactccccctaaacctctatgaaaaaaatttattctactattctattaagctgctacatctgtcgcttttccagttgtaccacgaatttgttctgctatacgaattggatagtttttgaataaaagtaatccaatataacctgaaataacaccagttatcataatacataagaatcttagcattattttcatttaaaaatgatacaagataatccacaataaagtctggtagcaatccaaagtttaacacagaagccattgcaagcatagcataaacaagtgatataaccattgctaatgcaactaaatttgcacccgctattccacctagactacctgctgatgttctgaactcttttaaagagtggtatacctaccaattaaatctccaccaccttattaataaaaagcttcaactaaggaacttgcaatagatacactcgctaatcatatcgtttagctaaaaagtgaaaaagacttatgacaaataatagtaatatctttcctattataattctcgtgttactctctcatgatttagtcaacttcacttgttacgataatgactaaaatacatgtgacttatcataaattataatctgccctcattatagcttgttttttataaaacgcttacttttgttgaattttaaaagttctgaataaaagtccatttctgctatttgtatcacttgtatgtcatctgacttatataacagtttttctaaataatcattatttcgtatttttatcctatatattcaaaccatcctaattttctgtatcatccaagtataagtataaaataataacagttttatttttaaatttttttagacaaaaaaaatggtaacccgccgttaccattttttataaaattatcatttttctactgggaatgatttcaaatccgtcgctatttctgtattagaaaacaactctctagcctctttcaataattccttatatgtatctccttgatagcgagaactaatgtgagttaatattagtcgcttcgcatttgcctgaagtgcaatgctcgcagcttgcttagatgtagaatgaaaataatcatacgcttgttgctcatcttctgctgcgaaagtcgcttcatggacaagtacatctgcatcttgcgcaagctccctactcgcttcgcaatatcgcgtatcacctaagatagtaataattcttcctttttgaggtgggccgataaactcatttccatttaatatcgtgccatcctctaattcaactgcttcaccatcttttaaacgtttaaagattggacctggtttcacacccatctcaagcaacttatcaactaaaagagcaccttgtatatctctctctacaatacgatatccaaaacattctataccgtgtgacaatcttttcgtttctacataaaattcattatcttcaaatacggtaccttcttctgttatctccacaacttcaagtggatatttcacatgtgtcgtacttaccgataatgccacttcaataaattgtttaattcctttcggtccatacaccgttaaaggcgtagttcctccttgaaatgaacggctacctaataaaccaggcaatccaaaaatatgatcgccatgtaaatgcgtaataaatattttttcaatgcggcgcggacgtacagatgtatgtaatatttgatgttgcgtggcctcgccacaatcaaataaccaagtttgtcctcgttcttctaacaattgtaaagcaattgctgaaacgttccttccttttaaaggaacacctgcaccagatcatgaat

SEQ ID NO: 1377 - DNA, 23784 bp, Bacillus thuringiensis
ctcttacatttaatccatcgccatataacggtaatttttttccttccagtgcattcgtaaccattaacggaattaatttttcaggatattgatacggcccgtagttattggaacaacgcgttactataactggtaattgatatgttttatagtaagatagagctatcatgtccgcactcgccttacttgaagaatatggactatttggagctaacggtgttttctctgtaaacttccctgtttttcctaaagagccatacacttcatccgttgacacttgcacaagttttatatgcgaatattttttaactagttctaataaagtgaccgttccaattacatttgtatcataaaaaggaatcggattttcaatactacggtccacatgtgattcagctgcaaaatttacaatcacttgtacatcccgctcttttataacgtgttctaatagctctccattttgaattttctccctttacaaaagagtaattcgggtgatccagaagagattttacgttatttaaattcccgctatatgttaaggcatcgtaattaataattttatatgtttcataactttgtagcatgtaatgaacgaaattacttccaataaatccagccccacctgttactaatatattcataaacaacgctcctacttaaaaactatcttcatattcctctaataatggtaatatctgatccttatcggacaatataggatcggttactggccaaggaattgctaaatctttatcttcccaaagtaatcctgagtcatgctctgcgctataatattcatctactttatacataacgatagtatgcggaacaagcgtgcaaaatccatgcgcaaacccttttggcactagtaattgccgatggttatctgcacttaaaatatatcctttccattgtttaaatgttggtgatttttttcgtaaatcaacgataacatcataaattgccccttgcataacttgaatgagtttcgtttgtgctttcggttttttttgaaagtgtagtccccgaatcgttcctgccttagccgaataagatacgttatcctgtacaaatgaatacgttatccctaatgtttctagcacctgcttattataactctctgaaaaaaagccacgctcgtctccaaacaacctcggttctaacaattttgcatcggtaaaatttgtttctacaactttcatattctcacctattctccgttaaactgtttcccaaaattaatatcacgcgctaacgtattcgccttttgaagcgaagcatgagttcccgcatcagtccaccagccgctcatttcattataagtaagtacccctcgttttaaataccaattatttatatctgtaatttcaagttctccccgtgcagaaggttttaattctttaatataagaaaagactttcgaatcatacaaataaattcccgtaaccgcataagaacttttcggctctttcggcttttcttcaatttcaactatttttcggttttgaatatgtgctacgccaaatctttcgggatcttctacagattgcaatagcactttcgcaccttctttttgatttgcaaactcttcaacatacggaagaatatcatctgaaaaaatattatcccctaatataactaccatacgatcattcccgacgaaatcttcacaaagccctaacgcctgtgcgatcccgcccgctttatcttgcacacgatacgtaaaggacactccaaattcatgaccactccctaaaaagctaacaacatcccccatatgctctttacccgtaataatcataatatctgtaatatcgcattgttttagcttatataccgcatgataaatcatcggataccgaccaacaggaagtaaatgtttattcgttactttcgttattggatataatctcgatccagtaccacctgctaaaataattcctttcacttttcatctctcctttatgatggagataatatatctttgtaatgttctacaaacactttccggtacttctcatatgtatccgcatcaaactcatccccgttgtaatgaatacaccataaatttgcttgatttgggataccaattaaataaccagccctttgaaactctaaagactgtgacacatcataaaagtgaaacccttgaaacaaatcttctcgccacggaatatcatactgcgttgccatgaataaaccatcaattgcctgaactgacaaaaatggttgattaccataaaaaacctgatctaaatttaataattgataattccgtcttctatactcaatcactttccctactaaattttttccttcccaccatatcccgttattcggtaaaaactgagccccagcgactcctattaaaccaagcttttcattttctttaaaaagagatataagtgtagaaaacacgtctcgattaataagatatgtatcttgatgtatatacactttgtatttcgctggatatgaaagggctcggttgtatgcacttgccatactttgcgcatctcgtatcggaaaaatttgcacgacataaccagagggaacaaaaatgtttcttatttggctctcacattgtttgaaaagctcctcattatttacacaaacaacgactaatattgtatgatctttcatttttgtccccccttttattcttccttatttacatctgacatatagtgttccacaaatattttccgatacttttcatagttcgtcatattcacatcaaaatgataatggatacaccaagcatcgcgctgtacaggtacaccgactgtatatcctgcttttttaaattcaaatgattgagatacatcataaaaatcaaatccgtcaaataagtcttctcgccacggaacatcatattgtgtcgccattaataaaccatcaatacattctacaggaataaatgtttttgattcatgatacggttgttctaaacttgccatataaaacaaatcattcatataaccaatgacttttcctacaattccacgcccttcgttccatacgccagtcggaggaacatattgcgctccaaccatcccaatcatcccaaggttttcatgttcctcaaataattgaagtaatccgtataaaaaagccctatttataataaaaacatcttgatgtaaatacactttatacttcgctggatgcgaaatggcttgattgtatccactcgtcatacttttcgcatttcgaatcggcataaattggacaatataccctggcggtactaacaattgcaatatatgtcgcacgcagtttgcatacaatttccgatcatttatgcatgtaacaaataatattgttttgtctgcagcactcataattgtgatttttcagcttcaataatatactgaaatacaactgtctcagccatgaagccacttccaagacgatattttttacaaattccatataactcctcaataagcggctcatacattttatgatcaacatatacacgatctactttactaattgaatatcctgcttttaaaaacattcttagcatttcattgaatgtaaagaaacgaatatgtgttttatctaataaaccatattctgtatacgtccaatttccagcaagtaagggagctaatactgaaatatgagcaacgtttggtatacttgctaaaatcacaccattttgctttatatatggcttaaccttttcaatcacagcccacggatcaaataaatgctctaatacatccccaaataggacgcaatcaaattgcccctcctcataaggaagatctattttttctatatcccctaaaataacatgatctagtctttccttcgctttttctgccgcctctggaaatgcctctattcctgatacacgtgtaccgttttctttaatagctgctcccaatgcaccgctcgagcaaccaatatcaagaacttctttccattccttttttatatgctttaataaattcggattcgctgcattataataatgctcggatttttcttcatataaagaacttttttcgcgattcatttcacacactccttatgcaaattgaattagaaatataaatctcatatgaattctataaagtgcagattttgttcatcccccaatgattattagcccgcaaatagcagtataaaatcttttatttatattggttacgttactgatactctaatatataaccaatctattagagttagaatagcgataaatcatttctaaaaaacgaaacctattacactttatatggtttatcaaaaactccccgaaaatatttacggttatattcaattgcagcattattcggaacataagaagctgctaattcattgtaataatacgctttatcctgctcccctaacctgctataacaaatacacatttgtaaatagggtagccatgtgtagctagctggactatggaaaggactttccgttgccattggtacttccgtggcaagtttaaaccaaaatatcgcttcattatatttttcttgttccatatatatatatcctattcttgtacaattctctcctctagggacgtcataccgaaacgacttcacacaagattcgattgccttctcccacattcctagctttgcatagcaatctcctaacttaccacatgcataaattttctcttcataccatccttcgtcttgattaagaaatgtttcatatagaagaactgcatcatcatatttttggttatccgtagattcatttgcgtaataaaataaatctctcggacttaattcttcacctgccgctacagtattttgaaaaattttcaaattacgatttgttacttttttttcttttttatgtgtaatagcaacattactactaaaaacctcaccagaaatagctaaatactcatgaacctttccaaaccattgaaattgtttttcacgctttacaagtcgatttctttttgtacaatataaaggtttcccgttagaatccattgcaagatgataaggcatcgaaacagcatcaattttaggatctaattctctttttaaaagtttcaatgcttcttgagcatcttctaataagacatcatctgcatctagccacaatatatactcttgcgtcgcttttgaaaaagaaaaatttcttgctgctgcaaaatcatcaatccactggaaatcatatatgttagaagtgtatttctctacgatttctttcgttcgatcgacggaacctgtatcaactactataatttcatccacaattttttcaactgtttctaaacaacgggctattgtctcctcctcatctcgaacaatcatacataaactaattgtaattccttgcttgttcaacataatcaccctcttccaaatcaatcatatgttatacatatactaaactttccatttttttaaattgttcaagtagtttaagatttcttttcaataattcaaatgtccgtgtcattttctttcggttttgcatctactatataatgaacgctttatggaggtgaatttatgtcaaataataattattcaaatggattaaatcccgatgaatctttatcagctagtgcatttgaccctaatcttgtaggacctacattaccaccgataccaccgtttacccttccgactgggccgaccgggccgactggaccgactggacctacggggccgactgtacctaccgggccaactggaccgactgggccaactggacctacgggacctacaggacctacaggaccgactggtggcactgggactactggacctacggggcctactggtggcactgggactactggacctacggggcctactggtggcactgggactactggacctacggggccgactggtgacactggggctactggacctacagggccgactggtgacactggggctactggacctacggggccgactggggctactggggctactggaccgactggaccgactggaccatctggactagggcttccagcaggattgtatgcatttaactccgctgggatttctttggatattggacttaatgctccagtaccatttaatactgttggatctcagtttggtacagcaatttctcaattagatcctgatactttcgtaattagtcaaactggattctataaaattaccgttatcgtatacactgcagcagtaagtctattaggaggacttacaatccaagtaaatggggtatctgttccaggtactggggccactttaatctcagttggagcacctatcgttgttcaagcaattacgcaaattacgacaactccatcattaattgaagtaatcgttacagggcttgggctatcattagctgttggtacaaatgcatctattattattgaaaaaatcgcttaaatttttacttagcagtaaaactgatatcagttttactgctttttcaatttcaaattcaatcatgaaacattcgctatctacataatcatattgttgtatgacattttgcaggaggcacaaatatggaaagtaaatctgctgttcagctttatctcgaattgctaaagaagaccattttatttgaaatatggttagaatatgaggcatacttacccgcatctctacatatttcaaaagaactagaattcgagccagttacagtccccctccctttattcattaagcaatatgctgaaaaccataacttaaaaattgtaaaaccaaatgtttcaaaaagtgaacgccatgatggaatggattggccaagagcagcacatagcatgatcggtcgagaacgtatgaaccaattacaagaggcaatggaaaccgttgttcgtgaaaatatagagggagattttattgaaacaggtgtatggcgcggaggatcgtgcatttttatgaatggttttttacaagcaaacaacattacgaatcgtaatgtgtgggtcgctgattcatttgaaggtttgccagcaccgaatctagaacaatatccaaaagattacggtgattatttgcacacattcgattatttacgcgtctctttagaacaagtacaagagaatttcaaaaaatatgatttactaaatgatcaagtgaaatttttaaaaggctggtttaaagatactttaccaacagcaccaattgaaaaaatagcaattgcacggcttgatggtgatatgtacgaatccacaatggatggtctcgtgaacttatatgataaagtttctaaaggtggctatataattatcgatgactacgggctaccgccatgcgctgaggctgtgacagactttagaaaccaacgaaatttaaaagcccctattactaaaattgatgtatttggcgtttattggagaaaagaataaaaaagatttaatctataggagatttcattttcactcatccttctctcacttctaatccaattaagtattctttttcggaatctccttacatataacaattgttttcctgtgttctctcaatacaaattgaaaattttattaatagatttactgcatcttctcatacaagaaaggggtatactcatgagtgaacttaacaaagaaatgactttactcccccctcctgaactcgtccaatatgtaggtggcgacttcaaaaaagttggaaaagagttcctaaagcattttattcaaattggcgctttaaaaccaaatgaaaaagtattagatgtaggctgcggcgtcggtcgaatggctgtaccattattgaattacttaaatgatgatggagcgtattatggatttgatttgtttaaagatggaattacttggtgccaaaataacatttcaactatgcgtaataattttcactttgaacatgttgacatatacaatcaattctataatccagaaggaaaagaagatgcctctcaatatcgtttcccctatgaagacgggacattcgattttatctttttaacttctgtatttacgcatcttctcccaaaagaattagaacattacgtatctgaaattgtacgtgtattaaaaaaagacgggagatgtttcattacattctttcttataaatcctgaatcgtcctattatttaaatgcaggacaaagtacattaggtttttatcatcgaatcgaaaattgctacgttgtaaataaagatattccgaatttcgcagttgcttatcctgagacagatatttgcaatctattgaataagtacggcctagaaataatcaataagccgcattacggtttatggtgcggcagacatgaatatacaagttaccaagatattgttcttacaaaaaaaagcttctgaaaggaagttatgtatgatgaatgaaaaaaatccacctctcgtttccatccttattcccacttataatcggcctcattatttcaaaattgctctagaaagtgcattggcacaaacttattctaatattgaaatcatcatcggagatgatagtacaaatgatgaaacagcaactttaatacgcgaacaatacttaccaaattataaaaatataacatacattcgaaatattcctactctaggacaatttcacaatgaccttatgctcatagaaaaatcaaatggtgagtatataaattttttaatggacgatgacgtgttttataagcataaaatacaaaaaatgatgacctattttgagcaagatcccaataaaaatcttgctcttgttacttcttatcgagtacgcattgatgatcatggaaatctaataggtgattcccatccaacacaaaggttatatagtgaagacaccccattaaacgggatatttttaggtaattggatgttaaaaggtggacacaacattatcggtgagcctacaactaccttgttccgaaaggaattgctcactgaaccttttggcactcttaaagagcgacaatattcttgtagtgttgatatggcctcatggatttctttactttctaaaggaaatgcaatatacatttctgagcctttaagtcaatttcgctaccatgctggacaacaaatacacaataagctccttcaaggttgtgaagatttcacacacctcgttataacagcaaaagaatatggctttttacaaaatactacagactatagagcagctctacttagtgcttaccaatggtgtaaaagttccttaaaatactatcttcatcaactagatatttttcctgacgcacatgtacgtctttcccattgtttggatataattattaaagagttaaacaattaaactactctgcaaaattaaaagtgtatggactatatgtgaatcattcgtatagttcatacattctttctcatactataaagtgaaactttaatcagctctcaccaatcgggcttttacgggcagttgatcccccacctaacttcttcgctttcgctgaattttgaggtaggggtcttactgcccattaatgcgggataaaatccattactataaagagcagtagaaaggaatacctacattgaaagatccaaattctcaatatcaaatagactacgtattactatttattttatttgccattgggattgttagttgttgtgctattgcaagtgcgcaagcctctttaccgccatttttacaaaacgtcaattttgtactaaagcaaatccaatggtatttcattggatttatagccattggtgttattatgattatcgacttcgatcgttatcaaaaaattgcttggtatttgtacagctttgcaatggtactacttattggactagaacttcaagtaccaggtgccgttacaattaaaggcgctaccgcttggtacaggctcccaggcatcggaaattttcagccttctgaaattatgaaattatttttaattatcgtcattggacgaattatagcaaaccataatgagaaatatttttcccaaacaatacatgacgattttttactacttggaaaaatatttgcaacaagtttgccaccactactactcatcgcaaaggaaccagatttaggaaatacaatggtcatttcagcgatgcttgcagcaatgatactagtttctggcatacgatggcgttttattttcggattagtttcagctactttcgttgctggaactacattaatatatattttttttactcacacagatttctttaaagcacacattttaaaagaatatcaattaaatcgcttctacggatggttagcaccttacaaatatgatgcacaaggctatcaattaagacaagcattcttagcgactggatccggagaaatgcaaggaaaagggtgggaaaatggacaagtatattttccagaaccacatacagattttattttcactaatgtcgctgaacaatttggatttctaggcgcaagtgtcattatttctctttttttcttactcatttttcgaatgattcatattgctttagaaagtaatgatcctttcggtagttacatttgcgctggtacaatcggaatgtttactttccaagtattccaaaatatcgggatgacaatcggattacttcccattacagggataacattacctcttatgagctacggaggaagttcactgcttacatacatgattgcgattggattcattttaaatgttcgctcaagaacgaaaatctttatgtttaaatgaacaacacaaaaacgctatatttttatctctatccttttttagatatactaatgaaaaatacgatggaggtttaaatatgaaatatgacattataggagatattcatggatgcttccaagagtttcaaaatttaacagagaagctaggatataactggagtagcggtctaccggttcaccctgaccaacgtaaacttgcattcgttggcgatattacagaccgtggtcctcattcattacgtatgattgaaattgtatgggaacttgtcatacataaaaaagaagcttattacgctcctggaaatcactgtaataaactatatcgatttttccttgggcgtaatgtaacagtcgctcacggacttgaaacaactgttgctgaatatgaggcacttcctcctaataagcaaaacattataaaagaaaagtttatcactctttatgaacaatcaccgctctaccacatactagatgaaaaaagagtaatcgtatgtcacgctgggattcggcaagattacataggaagacgagataaaaaagtacaaacctttgtattatatggcgatattacaggagaaaagcatgccgatggctcacctgtccgtcgcgattgggcgcaagaatacaaggggcaagcttggattgtatatggacatacaccagtaacagaacctcgattcgtcaatcagacagtcaatattgatactggtgctgtatttggtggcaaattaaccggattacgttatcctgaaatggagactatctctgtcccttcttctttaccttttgtcgctgagaaattccgtccaatttcataactaccttacttagcattatttaggcagatctcatataaaactaggtaaagtaattaaaaaaagatgcaataaagtgcatctttttttaattacactacatataatgtcgcaggaggtgacagaatgaagaaaaaatcttctaaacaaaaaagaaaatttccccctttatatctgcccatgtacggaattaacaactggtgtagtattcgggctgcagcgatagaagaactggaagaacaagagtcatcaaaaaaaagcaaagtaaaaccaacatatgtctctttagaaaatgctgtgatgagccgcataatcgatcgcagaaaaataaagatgcaacaaaaaaataaacagctctcaaatcaagatgaacaggtaatacattctaatcaagcagaagaaaagacggaagaaaatatttctgtagcaataaataaaaaagtggaaccagaaattccagctgctattataaacaaagtaaaaaaaataaaagaggcattggcttcatcgaatgatatacaaactgaaaaacccctcataattgagacacctacacctgaaaatacaaaagttaaaaggggcggccgatatgcatatgcagaggggcttcactctcatgcggagggcatggcagcacatgcggaaggcttattaacacacgcaaaaggttctttctctcatgcagaaggatcaaactcaaaagcaactggacatagttcgcatagtgagggaagtgaaacgacagcaggcggggcttattctcatgcggagggtaaacagacaattgctttaggcgaagcagcacacgcagaaggaaacgcaactatcgctaacggatcctcttctcatgcggaaggtcatcatacatcaacagctcattttgcaggtagccatattatggggcgcttcggcattgcagaagaagcttattcttggtttattgcaaatggtgtaagcgacaccgaccataatatcggggctaaatggcttgctcataatggagaaatgtacattgagggcgcgtcttacaatgcaagcggaacggattttgcacaaatgtttgaaaccgaaggttataaacctattgatgtcggttatttcgttacatttagtaacgaagaaaaaattcggatagctacttcacgcgattcgttcattttaggaatatctagtgcaacccctgcccttataggaaatagcggggctttaagttggcaaaaacgttataaaacagataactttggaaaacgccaatatgtatggacggaagccgaagaaatacaacctcttttaaatacagaatgggatccaacttgcaaatatgtagcaagaaaagatcgcgccgagtggcttcctgtcggattaattggacaaatgttagtacgtgatgacggcacttgcgaagcacatggatattgtcgtccaaatgacaatggcattgctacaaaagccgaaagtggatttttcgttataaagcgtacgggtgaaaaccaaattttaatattattccgctaagaaaaaagggaacaaaattctttataatataagaattttgtcccctttttaagtatgccgcaacacttcttgcatatcgcttggaagctttatagtgaaagacatctctttctctaaaataggatgataaaacgtcaaagatttactatgaagtgcttgccgtttcatttcatcccttctccctccatataagctatcaccaagtaacggatgtcctatatgagccatatgcacacgaatttgatgcgttcttcctgtctcaagctcaagcgctacatgtgtcttatgatatgtactatcaattaccttaaaatgagtaactgccctttgtccatcctcacaaaccgttcgctcaataatgctatcagattttcgaccaattggtgcatcaatcattccttctcgttctacaatctttccgtgaacaattgcttcatacgttcgtttcacagctttttgttgatgctgcttcgataaaagatgatgcacgaaacgattttttgcaataagcataagccccgaagtatcacgatctaaacgtgttacgatgtgcactgtacttgcaaggtgctgcttatcataatgagataaaagcgcattggcaacactccttgtcggatgttctctagacggaatcgttgacatgttcgcctctttattaatgataagaaccgcgtcatcttcatatacaatgcttaaagggatatcttctgccatcatcccttcacttctttcctcaactggaaaaaagacacgtaattcttcaccagcacgcaactgatgacgaacactcgcatgttgaccatttacttcaattgccccgccgtgaaactttatatccgttaaagcggctttagaaatacatttcgttttcaaaaattccctaactaaagttccctcttcagccggacctatatcccatttcaatgtaaatctgttcaaatatataaccctttctatttatccgcaacaaacgagtcacgaactcgtttccagaacgggaatggacggaaacgaacaaatcgtactttctcgtttgcgacccgatactggattgatttcacatcttgatgaaccatcgttaaatgatccactgtaatttgtaagttcattcctgcagctggctttaacacacatgtatgatgcttcggcaatacgagcggcgatcctacagtacgaaatacacgattgttaatggacgccatttctgcaatttgtatcgcttcaatagatgggtgaataatcgctccgccaagcgctttattatacgcggtacttcctgaaggagtagagatacataggccgtctccgcggaatgtttcaaaatattctccgcgtatttctacttctgttactaatgtaccttctgcactttttacagtcgcctcattcatcgctaaatactgtgactctttacttccattcacatagcgaataataacttctaaaagcggatattccaccacttggaatggtgttttcgcaattgcaattactaatttctctacttctgtcggtaaccaatctgcatagaaacctagatgtcctgtatgtacaccaacaaatgctgtttcatccaatcgattataataacgatgaaacgcatataaaagcgttccatctcccccaacagaaattacaatatcgggttccttttcatccattataaatccaaaatctagcaagtactctttcatcgtgcttgccagtgtatctgatgattgatctccctttgacataattgtaaatttcatcgcccaacaccctttagtttatgattcagaatctttcgtttcttgctttcttgaaaaagccttttgcgcttcttgaatttcaagacgaatagaagacatttcttcatctaataaaaacgccgcttcagctgcacgttgcaaccttattttaatatcttcaggaaaacgtccactatatttataatttaaagaatgctcaattgttgcccaaaagttcattgctagcgtgcgtatttggatttctaccaatactttttgttcaccctgaatcgtttgaacaggataactaatgacaacatgataagaacgataaccactatctttcttttgcgtaacataatcacgttcttccacgatttcaaagtcatttcgttttcgaagatattctacaacaggcttaatctcatcaacaaattgacacatcattctaagcccagcaatatcctgcatatcttctctcaatcggtctagcggtacatttctcttctccgctttatcaataatacttgcaaccgactttacccttcctgttacaaactcaattggagaatgctctgttaacattgcaaattgagtacgcattccttttagtttcactttcagctctgccaccgcttggtggtaaggtgctaaaaattcttcccaatttcgattcatttcaaccaccaccaaaatcaatccatttgcttatagaaatactttttctacagcagttactagttcttctccgtaatttgcattaccttcaatattttcaactaaatattctacttcttcttttaatccttctaattccatttcaatgtcattcacgcgaacgaacataaccacatcgctattcatcgcttcatgcattgcttcccagcatgtgtgcggaatacttacataaatgaaagatgattcattttctaagatatataaaaatgataaattgtctgagtctacaagtacgtgattacgcgcacttaactcctttacctctatttcactattttccgcacaaaaaataagagcattctctctcttttctacgctcttaacttggattttattttgcatgctctaactcctccatctcaacttcctgtcttacttaacagtattattgtatcataacatggacgcaaacaaataaaacattgaaccaaatttatgaaaaagcgataatgtgtaaagaattatttttcaaaaggagattatacaatgacacaagaaattgaaattgaattcaaaaatatcggtacaaaagaagaattcgatacattatgtaaatcgttttctattgaagcatttacaaaacaagtgaatcactactttgaaacacctgacttctcgttaaaagaagctggctctgcacttcgtattcgtcataaaggaaaaacttatactttaacgttgaaacaacctgcagaaattggtttattagaaacgcatcaagtcgtaacagaagacgaagcaaaaatgatgatggaaacaaacacaatcattcaaggagcagtagtagatcaattacacaaattacaaattcctgtttctgctttaacatatatgggtagtttaacaacagaaagagcagaaacattatttaaaggcggaacgcttgtctttgatcatagtttctattacaatcacgatgattatgaaattgaatttgaagtgcaagatgaagaaacaggaaaagctgcatttattgatttattaacgcaacataacatacccgttcgccatacaaataacaaagtaaaacgctttttccttgccaaacaaaacaaagcacgctaaatgaaaatttcactaatgaatatgtttcactagtggatacatctcactaaaaaaggttacacccgtagaataagcaaagaatctttgagaaggctgtttatttgccctctcgaacattccattgctacaatagatatacatttcatggaaaaaggagtttataaaggatgagcaagcaaccgatgacaccatttgaagcaattggcggtgaacaatgcattgcaatattagtagatacattttattcctatgtcagtaaacaccctgacttatctcccatcttcccggaagatttaacagaaaccgctaggaagcagaagcaatttttaacccaatatttaggtggtcctaatttgtacactgaagaacatggtcatcctatgttaagagcacgccatctcccgtttgagattaccccaaaacgagcagaggcttggctatcatgtatggagcaagcaatggatgatactggagtgcatggtcatataagagagtttgtttttgaacgtttagcattaaccgctcagcatatggttaatactccaaacgaaacaggtgaagtgtaatggataagcaggaagcaaagcatataaatatgccatctccttccgcatgcgagcataagtctgtagaagcatatttatttattgatccactttgtaaagattgctgggaaattgagccttttattattaaactatggcttgaatacgggaaatacttctctattcgtcatatcgtaacagggaaagtggatggaacgaacgcttcctcacacaaatggaataaacctgctaatattcgatttgtgtgggaaaagacaaccagtttacaaggtttttcatgtgatggaaaggtacatatgcaagaagcatcgtcaacaccatatttagtttcgatggcaattaaggcagcggagttgcaaggccgaaaagcaggttcgaagtttttgcgaaaactccaagaatacattttccttgaaaatgtatcaaaccctgattgcgaactattacttgcatgtgcgagagatagcaatattgatgtagaagaatttaaaaaagatctacattctgctagtgcaaaaaaagctttccaatgtgacttgaaattcacgaatgaaatgcatattacagaaataccttccctcgtcttttttcatgcgaactcagatgaagaaggtattaaaatcgctggaaattattcctacgatgtatacgtacaattattgaaagaacttgtaaaatgtgaaattgagccagaaccattaccacctttagaagtgctactagaagcaacacaatttatatcttcaaaagaagtagcatttatttatgactgtccgcagcaagaaattgagcgcgaactaaaaaaattacaactgaaacgaaaagtacaaatgattgaagtaaaatgcgaacgttattggaaatggatagcaaaagaaaaagacctggtgtaaacaccaggtctttttctttacggcttataaaaatattaaaggggatgggagaaattttcacgttcaaacaaaggggtatatgtttgtatgtgaattcgttcacgcttattatattacaagattcgacgtcagatgacaaccccttttgtcgaatttcacacttttgtcacattctaaacgttttcatttttgaataagctataaaaaaggtcatttagggggtttatttatgaaaaaatcttatattgctcttctctttctagctgtcatcgtttcttttttcttgtacatcctctctctactacaagcttttcctaaaattattgccttacctcttttattcggaatcatcgttatcacactctcttatttcaattataaaaaacgattcaaagggttttaagttcaaaaatcagccgtaaagctatcctttcagttagaaaaaataaagaaattcatctttttttcaacaaatatcgacattaaatctattcaacaaaaaagacgaggatacaatccctcgtcttttttcattacttttcttcaaataataatgcttctaattcatttaatttctcttcaaatacttgtagtgcctcttttactggttcaggagatgccatatctactcctgcttttttcagcacttcaattggataatcagagcttcctgcttttaagaactcgttaatataacgttctactgctggttgtccttcttctaaaatctgtttagatagagctgtcgctgcactaaatcctgttgcgtattgatatacgtaatagttgtagtagaagtgtggaatacgagaccattctaaaccaatctcttcatcgattactaaagcgtcaccgaaatatttcttatttaaatcgtagtaaatttccgttagcatgtctggcgtaacagcatgtccttcttgtactttcttatgaataatatgttcaaactctgcaaacatcgtttgacggaatacagtaccacggaacccttctaaataatgatttaataaatatagacgctctttcttatcttctgtcgtttttaataaataatcatttagaagcgcttcattacaagtagatgccacttctgctacgaagatggaataatcaccatatacgtgcggttgtgtttttcttgtatagtaactatgcaccgaatgaccaaactcatgagcaagtgtaaataaattatttacattatcatgccagttcattaaaatatacggatttgttccatatgcaccagatgaatatgccccgcttcgttttcctttattctcatacacatctacccagcgattttcatatgcctctttcaaaatatcaacatattcatcaccaagtacgtttaaagattttaataaaaggtcttgcgcttcttcgtatttcacattcattttcacttctggtacaagtggtgtatataaatcatacatatgaagctcatcaagtcctagtgcacgcttacgaatatcgatgtaacggtgtaataaatgtaagttgtcatttactgtttcaacgagttgatcgtatactgcttccggaatattattattgctcaatgcagcttggcgagcagaatcatatttacgaacacgcgcattgaaattattacgttttactgctccacttaacgtacttgcgaatgtgtttttaaattttccgtacgtttcatatacagctttaaatgcatctttgcgaacacgaggatcatcactttctaaaaactgaatgtaacggccatgtgtaatttctatttcttctccgtcttcccctttaatagatgggaattttaaatccgcgttattcaacataccgaatgtattgcttgatgaactcattacttcagatgcttccgctaataaagcttcctcagcttctgataatacgtgcgggcgttgacgtgtaatttcttctaatgcatgttcatatacacttaaatctctattttccttcaagaatgtttgcagtgtatcttctgaaatcgataaaatttcaggaacaatatacgctgtgctactagatacttgtgaatataaatttgttgcgcgatcatttaatgcttgatatacagagtttgttgtatcttgatcgtaacgcatatgagcatatgtatataacttacctaatcgcattgaaatttcatcttcatattgcaatgcctcaagtaaattgtccgcagagtcaccaagtttccctttaaattcagttaacttcggcaatagctctttaatagcttgaaattctttttcccattctgcatccgtttggaaaatatcttctaatcgccacgtacttgcttcttcaatctcgttgcgatctggtaatgctttcgctttgttttgttcagacattctttaagccctcctttaaatatctctacttaagtacaattcgtttttttcttatgtaattccttcacaatcattctttattatatccccttttcctcctctcatgttaaaatttgcctcaaataaagatagcgcatgtattaagcaaatctcatcatgttttataatctcctcctctgtttttaacatcatgacatcccttattttccggtacgtataagttcccactttacgcaaaacacctatatagcataaaaatgtcatatattcagtaactgccactttccatatatgctttgaaaagtacggaagtatccgccttttcgtatacctttttacataactacacacgtattgaagagaaatacactctcccactgcaagcttccctatacacttcatatatagaaaagcttgccatataaatgggtttgtttgtaaagcaaatgcagaagggagtggaacaccaatttcagaaggaaagcttgctggggtacatttaaattgatataagaggcgtaataatgacttataattataattccaaatcggcagggcatttttgcggaagtagttctttctcttcttccactcttcacccaatctttctttcccgaaaggaacgggagaaaaaagcatttcaaaagtagtcgtatcagttggtaaatatatagtatgtgagaaaaagacatttgtagaaaagggagtgacaaatgcacatttcataaatgatttttgtttcggacagaagaaaataagaagtggctgaggataagattgtaaggagaaagccataagtgaggaaaatttcatccaatatgcagattgctttttcaattgatttccaccaacgatccaaatgacctgtataccagcttgccaatacgaatatgttcttttgtacagctgctctatagcgaggtttgcacattggtattcaattgcaatttttctgcccgccctctctacaaaaacatctggtcgttgcttaatttctggaaggtagtactctatatccacctgaaagttttgacgcttgaaccatctatataacaattctttaccgtgcatatgatacgttgattccgcttcataaaaggcaagacatgaatccacttttttatgagcaaaatgccaacttttttgtttccctaatttcatttgcacttcctttccacaagctacacaaaagaatcgttcttgttgacgcatacggcgcaaaagcttttcattacaattatagagtaaatgaattttctctccgttttctcttttagcgataaatatcgtaatcacaccctttcagctccttatattctacaatttgttacaaattccttttaaaaaagagatatcccaatttcggacatctctttttataataaaggtgataataagcggtatgttgattcaacaattcgtctatgaagacgtcttttatgaaaatgatcaacatgaatttcacttgattcttctaaatcatctttaaagtcttgaacaagttttcgaatgctatctgtatcatataaaaaggcatttacttcaaaattcaaatgaaaacttctcatatccatattagctgtcccaattgaagctaaatcagaatcgacgatgacaactttactatgaagaaaacctttttcatattcatatatctttacacctgcatctaaaagctctgggaagtaagatctcgatgcgtaaaagacagtacgcttatccggtttactcggcattaataaacgaacatcaataccagcaagtgcagcaacctttaatgcggataaaatatcatcatccggaataaaatacggcgttgcaatccaaatggatttccgagcagaagcaatcatggcaaaatataaatgcttaatcgtttcccatttattatcaggcccacctgcaacaagctgcacgcctccccaatgctccccctcaactgctttcgcttgtaaatattcaggggctagcacagcctcaccagtcatataaaaccaatcttgaaggaaaataagctgcaaactttgtacagcttcaccacgcaaatataaatgtgtgtctcgccaaaagccgaagtacttatccttccctaaatattcatcaccaatatttaatccacctacaaagccttcttttccatcaataataacgatttttcgatgatttcgataattaattttatcgtttaaaatcggaaagcgtacagggaagaacggaatcatttcgactcctgcatcgtttaattcttcaatatacgattttgataatttaaaacttccaaccgcatcatacaaaaaacgaacgactacgccctcttttgatttttgtattaaaatatctttaatttccgttccaagcttatcatcacgcacaatgtaatattccatatgaatgtgatgtttcgctcgttttaatccatctaaaatggcctgaaacgtttcatctccatttgttaatgttctcgtttcagtttgaaatgaaatatttaaagcgcctaagcgatccgctaaacgaaataacagctcttgatgcttatgattgcgtaaaatccgttcttcgtaatcttcatgccccttatattgtaaaaacgcttgttcatcgagcaacgccttcttttggaacattctcttcctccgaaagttctgtccgaataataaataagcgaagaatccaaataccggaaaaatacctaacacaatgagccatgtaagtgtttttgacggatgacggttctctaagaaaataacgcaaccaattaaaaacgcagatactgtaaataaaatactaataatacctaaaaccgaaacatcttttatcccaatcacatctgaataaaatgctacatcaataaacatacgtaacgaaacaaataatgcgaacaatagcagtataaagaaaatcagctttaacgtatttttcatctcttacctcctaactaagaaagctttcctattcttcatataaaaagccgatttcatactacagaaatcggcctacgttttagcaggaaaattattgcgaatcgtttcaagcgcatgctctttcacaatttgttttccatactcacttacacgatgaattgttaaagttgattcttctccatattctaaaataatacttaaaatacgatcgatttcttcttcatcatgtagcacttcatcgaattccacatatacataatagcggttctcaaatgaatacagctcatcttttatatcttcaaagataagacgatgacttaatgaaatgacatcttcaaaatcattaaacttaattaaaaagccaaacgtaccatcttcattaaagtttgttcctgtttgttcttctacctcttcgactaattcttgctggaataatgattcgatgccttcatctagaggaatatctataattttgtctacccctatcggtagttccagcttttgcccgtcctttgaaagctctgctttcgtgacaagcacttcaataaattaacgactg

SEQ ID NO: 1378 - DNA, 15151 bp, Bacillus thuringiensis
gctatcttcaagaaatgatttagatttggttttaactacatgacgtcaatagaagggaagtcattaactactaagccccttttccattcagatcaagggtttcaatatacatctaaatcctacgcaaaacagttagagaaattaggatttgtcggtagtcattctagacgtggaaactgttttgataatgcgtgtatcgaatcattcttctcacatttaaaaacagagaagttgtatttagtgtgcccaaaaacatatgaaatggcctaccgagcaattcaagaatatattcaattttataatacagaaagattccaagaaaaacttcacggcctttccccgatagaatatcgggaaaaggccgtggcataatactctttttatttctgtctacttgacagggagatgaccattctacgtgatatggtgtctctttttatctaattcaattacttcccaccaaacatcttctccaaagacttcgcattggcaaacaatacttctttcaagttatcgtcagcaacgattttatagtcgccatctttgtctttctttaagttcaatgtaacttcgcgagttgccattgctgcatctttatctgctaagtttttgacgatagttgatgtcattgttttttcgattgctttttcagattgttctttgtcttcactaaaggcactagcgaacgccattggcataacttctcccactgcttttgttacagcaacggatagatcagcagatgtaattttcactttcacttctgctttgtcatcctttttcgatacttcttctagcttttcaaatttaaaggtttttgtaattgcacttagcattgcttttgcctcagcatcatctgttttttcatttagtttattaaattccttgtcactctcaacaaatgtacgagccttttctacatcacctttttgtatcgctgttaaaaattcttctgtagtatctttcggatttgcacaccctgctaaaacaactgctgttaatcctactaccatcattaatagcaataatctctttatcttttgcacgctcattctcctcttatcttttctagtaagtcagcattatataatagtatgaaactgacattacaaacattttttagtatatcatttatatgattcgttttctattaattcccaaaagataaagggccttgcagcattcctacaaggcccggcttctatcaatctgtatccgtagcacaaatgaaccacattttctgttccctactatctaacaccatccaagtaacatcccacgcaacatcgtaaaaccaatctgtccaagggcgatagctttcgaacactttaatatcttcgtatcgatcttggaacatatattgacatacattgactgctaattgttttgcgataactggtcgttccttaaacccttcatatgctccgccccacaaaatttgcgcagcaatgctaccatcaagcatgactgcgagctgctctttaaaacaaaacttatatttgtctgatgtatgtatttttaactcttctaagttattgattatgtctaaagagttgaagattcttctaaagaagtgctcatgtccatctttcgaatgtggtatttctttaaaaaaattttcgttatgcactttaaaacagcttattattgctccaccaattaagttttgttccttaaacgtgtttataagttgctcaacaggtgagtcattcgtgtctattttttcaaacgttccctctttccatctcataacgcccactactctctattaaaaatttgtttctttattataaatagcaaaataaaaaccagcaactttgaggttgctggcttatctcttattcatattcgaaacaacaacaactgctccaaacacataatgccctgctaccatccacatactccgatcaaaaatcataagcgataaccagagtgatatattcatagtagcaaataataaatataaaatgtaatctctcttttgtattgctcctctattcatcaaaatgtaagcggcaccgataggaggaaaaagacaaatatttttcttaacgactacggatgcggagttagtgtctgcatatgaacctccttttcatcataatacttgcttcaacatcggcctcactaccctatattcatcactataagcttcctttatgattaaaggcgggtaatcacttttttcttcctcaatcattatgaatacttctgttttctcttgtgatgtattagattctctatatttagagggggttttacttgggttaaatttctttggtacttcgcccagattttgccccactttttttactttgacagggtcattcgtaacatagtattcttgttcgtcccatactaatataggtggcacttgttctcttttggtacatattatataagtagtactagctaccagtagtatacaagttaataaatagaagatagttcttttattcaaatactacactccttatctatcatttcattggattatataacacaaattatttacggtaaatggatttggtggtaatttttaggtttaataataaaaaaaaccttaccgaagtaaggttccgtttttacattctatagtgactgattaattaatacgatcattacaataattgctataagcataacaactaaacagccgattaatttataaaatcctcgcttcgttaacgtcccaccttgaacgtctttacgaataaataagaatacggctaaaaataatacaagcccaatgccaaaagcatacatcatttgcatatgttaatcttcctttctctcctccatcttaatatctttttgctaaaacaacaaatgagataaagacggtactcattgtaagtgccataagtatattcaataattcagtagctgatagtgtaagtatttttaagtttaagccgatagagaaaagaagataatatgccgttaatgcaaaaaaggttacaaacattcctttataacgaatcagtttcattcgctcgtctttttctttaaattgcggatgcaagtagcttagacagaaacacataatcatcatccccagcaatggatacgttatggctggcggtgcagaatgcgtcattatacctgttaatatcataaatccactcataaatagaaaaataatccccataattacaaagtacttttgtgaataattcatccctattccccctcttcttttccttcataaataaatacatgttctattgttgtctgaaatgttttcgctatttcaaatgctagcggaagtgatggatcgtatttccctttttcaattgagataatggtttgtctggaaactccaagtttctcagccaacttttcttgagatagtccaaatttttttcggtattcgaccattttattttccaaggaaatttctccctccttccatataccgagtatatatgtaaagtaaactttacgtcaagttccctttacatatattttgattattattcacgctatttatatagaagaaacttttttaaatttcagcacgtctattttgaagcgaaacacggaacactgtaaataactgttactatatctcctcacttctttttttaaaatttaatatctccatatttgttttatccttttaaaatatttcatttatttctttatttcacgaaatgcgttatttgttttacggtgtttttcgtcatatttatagaaactaactgtttatggagcattttttatgtttagcaactttttttgtagaaatccttcactttcctttcaatatttaacactatctaaataaagtttacgataaattcataattttttattttttatactatattccgttatattgttgtataatatctatgaaagcgcttattatttcaatatacataattcaaactgtttttatcgaaacattctaactattatacctatatttaaatgcaacaattatagctattagtataggcataccaaatatatccaccccatttttctgtaaaattactttataacatgaaagattaacttgggtgataagttattgtgaatgtttttttacaaaacagataagtaatagtgtttggtattatgtaaattattgtaataacataagagtaaagaaaaacatttacattgattattgattcattacttattgaaaaagagcaaaatgcacctttgtatggaaaaggattatatgcattgggaggtttaaacaaatgacgaggaagaatacaacgacaaacccttgggccaagttccacggtccgaaccttggttatgttattgagcagtatgatctttacgtaactggagcaggttctgttgatccggaattacaagagctttttgaaatttttggagctccttcgtttcaagatgatgtcgtaacaggggacaacacagcaacacatttttctcctcaaaacacaggtaacattgaaaaaattcttaaagtcgttcaacttgttgagcagattcgttctttcgggcacacgttggctcacatcaacccgatggaagatgctgcaaatggacaatctcttcttgagaaagcaatgaacgaactgagcgatgctgacttgaaagcgattccagcgaaaacggtatggcaagatgcaccagaaggtattcacactgcacttgatgtaattcatagattaaaagacgtttatacaaaatctttagcttatgaattttctcatatacaagatagtgaagaacgcgcgtggttgcatcaaatggtggaatcaaattcattgcgtcaaccactatcaaataaaaaacgaactgctcttttaaaacgtttaacagctgttgaaggtttcgagcaattcttgcataaaacattcgttgggcaaaaacgtttctctatcgagggcgttgatatgcttgtacctgttttagatgaaattgttctagaaggtgctaagaacggcgtagaggatgtcatgattggtatggctcaccgcggtcgcctaagcgtacttgctcacgtattagaaaaaccatatagccacatgtttgctgagttcaaacatgcaaaaatagaaggcgcagtggctaattctggctggactggcgacgtgaaataccatttaggtagagaacaagtcgttagtaacgaagaagttagtactcgcgttacattagcaaataacccgagtcatcttgagttcgtgaatcctgtagtagaaggtttcgcacgtgcggctcaagagaatcgtaaaaaatctggtcttccagatcaagatacttcaaaatcattcgtaattttagttcatggtgatgctgcattccctggtcaaggtattgtatctgagacactcaacttaagcagattgaacgcgtatcaaacaggcggaacgattcatgttatcgcaaacaatgcagttggttttacgactgatagctatgattctcgttctacgaaatattcaagtgaccttgcaaaaggtttcgatattccgattgttcacgtgaatgctgatgatccggaagcttgtcttgcagctgctaaccttgcgattcaatatcgcatgttgttcaaaaaagacttcttaatcgatttaattggttaccgccgctacggtcataacgaaatggatgacccggcagttacgcaaccacaagtgtacaaaaaaattaaaaaccatccaactgtaagagcaatttatgcagatcaattacaagctgctggtgttctaaatgcagatgaggttgaaacaattacacagtttatacaagagcaattaaaatccgactatgcactcgtaccaccagctgatacgagtgatgcaacaattcacgttaaagtaccagatgttgttgcaaaaggtattcagtcaattgatactggcgttgagattgactcacttcgtgcaattaatgaaggtctactatcttggccagaaggctttaacgtatatccgaaagtgaagaaaattcttgagcgccgtaaagatgctcttgaagagaacggcaaaattgaatgggcacttgctgaatcattagcattcgcttctattttacaagaaggtacgccaattcgtttaactggtcaagattcacagcgtggtacattcgcacaccgtcatatcgtattacacgatactgatacaaatgaaacatattcaccattacatcgcttaccaaacattaatgcttcattctctgttcataacagtccgttatcagaggctgctgttgttggttacgaatatggttataacgtattcgctccagaaactcttgttatgtgggaagcgcaatatggtgacttctcaaatactgcgcaagcattatttgatcaatatgtttcagctggaagagcaaaatggggtcaaaaatctggcttagttcttctattaccacacggttatgaaggtcaaggaccagagcactctagtgcacgtccagagcgtttcttacagttagctgctgagaataactggacagttgcaaacttaacgagcgcggctcaatacttccatatcctgcgtcgtcaagcatctatcttaggaacagaagctgttcgaccattagtattgatgacgccgaagagtttattacgtcacccacttacgctttcaactgctagtcagttaagcgaaggacgtttccaacctgctttagaacaagaaaaccttggcatgaaaccaaataaagtaaaacgtcttgttttaagcacaggtaaaatggcgattgacttagcagcagaaatcgagtctggtaaacatgagtacaacttagacgaagttcatgtcgttcgtattgagcaattgtacccattccctgctgagaaagttcaatctattattaaacgctttaaaaacttagaagaaatcatttgggttcaagaagaacctcgtaatatgggcgcatggcattacatggctccaattctgttcgaacttgctggagataaagtgaaaacaggctacattggacgtcctgatcgctctagtccatctggcggcgatccattcgctcgcaaagctgagcaagaactaactgttgcacatgctttagatgtgaagtataacttccgtcaagataaacaagaaattgaagtttacagcaactaaaaagtaacaatgaagctttctagcttgttccttgggcagatattctgcccaaggccaggctaacaaatggagattaccgaagacaaaagaagaaaaaacacaccgttaggcaaataaggggaggacatttaaaatgatcgaaattaaagtacctgagcttgcagaatctattactgaaggaactatttcacaatggcttatcaacgtaggcgacaaagttgagaaaggtggcagcgttgttgagcttgaaactgataaagtcaatgtagaaatcattgcagaagattcaggtattgtatcgaagttactaggcgaacctggggatacagttgaagttggtgcaactatcgcaattttagatgctaatggagcaccagttgcagtaagtacacctgcaccagtggctgagcaaccaaaacaagaaacgactgaagcaccgaaagctgcggcaccaaatgctgagcaaactgcaacactacaagggttaccaaatacaaaccgtcctatcgcatcaccagctgctagaaaaatggctcgtgaattaggaatcgacttaaacgacgtacgtagcacagacccacttggacgcgtgagaccacatgatgtacaagctcatgctgcagcaccaaaagaagcaccagctgctccaaagagtccagctcctgctccagttgcaaaaacggaattcgaaaaaccagttgagcgcgtgaaaatgtcccgccgccgtcaaacaattgcaaaacgtcttgtagaagttcaacaaacatctgcaatgttaacaacctttaacgaagttgatatgagtgcgatcatggaattacgtaaagaacgcaaagatgctttcgagaaaaaacatgatgtacgtcttggcttcatgtcattcttcacaaaagcagttgttgcagcattaaaacaattcccattattaaatgctgaaattcaaggtgacgagcttatcattaaaaaattctatgatatcggtattgcagtagcagctccagatggattagttgttccagttgtacgcgatgccaaccaattaaatttcgctgaaattgaaagtgaaattcgtgaattaggtaaaaaagcacgtgacaacaaactttcattaaaagaactacaaggtggtacatttacaattacaaacggtggtgtgttcggttctctaatgtcaacaccgatcctaaatagcccacaagttggtattttaggaatgcataaaatccaagtacgcccagttgcaattgataacgagcgtatggaaaaccgcccaatgatgtacattgctttatcttacgatcaccgtattgttgatggtaaagaagcagttagcttccttgttgctgttaaagatatgcttgaagatccaaagtcattattattagaaggttgatagattaaaaatctattaaaggctgtagaatgaatcattctacagcctttttttattgtgttcatacgggacaaatttcatgacataaggtaataatgtatgcctaaacgtaaggaggattaaaatgaataaccttccaattcatgcaaaacttaaagtaaataaggatactttcttcctccccgattcaaacgggggtgtctattttcgaaataacgccagttcatttcgtatggacggtgatggaatttatgattggattgaaaaattaatgccaatgtttaacgggaattattctttagccgaaataaccgatggcctccctctcccctatcaaaaccgtgtatttgaaattggagagattttatatgaaaatggtttcgttcgcgatgcaaatcaagatgcacctcatgaattaaacagtacattactcgacagatatgcttcacaaattgaatttttagaagctgattctcattcaggtgctttaaagtttgaaacataccgcggagcaaatgtccttgtacttggttctggggatatgctcacttccttagtttcttctttattagaatctggtttacctacatttcattacctcgttacagatcgggatgaaacaaactatgacagaatacatgagctaatagaacgtgcatatgaagttgataacagtgtactccttcaagaaatcgatactacaattgaccgtcccttgcgtgaagtattcgaaccttttgattggattttatatgtttctcaaaacggagacattgacggtttaaaaacagttcacactatttgtagagaaacgaaaaagaatttcataccagctatttgtttatcaacactcggtatagctggacctgtcgtaacagaaaatcgtgatgaatgctgggaatccgcatggcatcggctacatgaaacgactttacaaaatgaaaattcatcggattccttctcaccaattacatctgccatgttagcaaatgtaatcgtttttgaattgtttaaacatgtcgcggatgattcatatcgtgaaaaagaatcacaattctttttattaaactatgaaacacttgaaggaacgtggcatccttttataaaacaccctcttgcaactgatgaaagttttacaattgatacgatagaaaatatttctgaaaaacttgagcatcggtatggccaacatacttcaactgatgtattccgctttttcgattcattaacttctaaagaagccggtatattccatgtatgggatgaacaagattcatatcaattaccattatcacaatgctatattcaagtagctactccactatcagatggcccagctccccttctgcctcttatgactcgtagtggattgactcataatgaagcacgccgagaagctggtttaacaggaattgaaacatatgtagcagaaatcattcaccgccttattcctgaacataacaatatcggtatcggtgctggagaaacgatgacagaaggattttaccgggcactacaacaacatttaaacaataaactgtatgagcggcagtcacatattctagaggaacttacaactgttgatttaattgatattcaagataaacattgtaaattttattacgatgctctctctacaatccatgaaacacctaaaatcgcaatgagtgaagagattctcagttttccagtcgtttgggttggtataaatgatagatggtacggtgcatctaatattaatatgacgttagcgttacgaaacgcactacaactatcactctttcacgttcaaaatgaagaaattccttacagagctaatatcttgcctgaatcctctattattttatatgacacggattcttttagagtggaaatacaagcggaagaagaaattccaagtgtgcaatctttacagcttgccttacagcatttagaagaacataatttttatcccttcgtgttcgatttagcaatcgaaccatttttaaaagaaaacctagacggtgtgtatggggtattaattgcaaaggaggacggtttatgattcaaaatatattgcttataggagatggccttcttgcagactatgtacatgatcaattatgcaaacaatattccatcattcgtcagcagacccttacagaagaacttcctgaaaatattcatctcgctctcgtattacatgacggatctccttctactattcatcatgatgccgaacttatttttcgctcaaatcatattccatggcttcgtggttttacttcatttggcgaaggtattatcggtccttacattcatcctcttacgcctggatgttcccattgttctgatggacgccgttttatcgctggctttgatcaaaaagaaatgtgggaactacagcggaaatatgcctttaaagcagataatgtaacgagacgtgacgtacgtgccacccaaaatggaatgttgcaaatgtgccatcttatttgcgcagaaacaggaaaaatattaactcataaccattcttctttagaaaatgaacttattttactaaacttacaaacattacaatgtacgcggcattcttttcttccagatcctctctgtcctgtatgtagtaatttacctgatgatactgcggatgcggcggaagtttctttacaaccgagtttaaaagtaagcaccgaaacgtatcgctgccgttccattcatgagctaaacacatttttaacgagagactatttagattatcgggtcggtatgttgaacggaaaaatgcagcattctgtattaccattcgctgacgtcattataaacatgccattaatgttcggaaatgaaggtgttgcgggacgaactcattcatttgcagtgagtgaagcaactgctattttagaaggtttagaacgatattgcggtatgtcgcctcgagggaaaaagacaaatgtgcatggtagttttcatgatttagaggaacatgcactaaatcccctcacactcggtgtccatacaaatgaacattacaatcgtgataactttccattcaagccgtttgatcctgattatgagcaaaactgggtatggggatattctttatcacaaaacagaccgcttttagttcctgaatcaattgcttattatagcctcggtcatcgagatgctttcgtgtatgaaacatcaaatggatgtgcaattggcggtagtttagaagaagcgatttttcacggcattttagaaattgtagagcgtgatgccttcttactcacttggtatgccgaattacctcttccccgcctggatcttaattcagcaaatgatacagaattacaattaatgattcagcggttacgtacgattaccggatatgaattacacgcttttaacgcgacgatggaacacggcattcctagcttatgggtaattgcaaaaaatacgcgtgaaaatggaatgaacgttgtttgtgcaggaggcgctcatttagatcctattcgagccttaaaaagcgccattcaagaaatagcaggcatgttacttataacagacgatgagctcgagcacaaaagagaatactacgaaaaatgcttacaagatccttatttcgttaataaaatggaagaccatagtatgctgtatggattgaaagaaacagaagaacgtcttcacttccttttacgggaagatgcaccggtgcaaacgttccaagaaatgaatgtatcacaatcatttgatatggatttaacatccgatctccaccaacttttaaatcgtttgcatcaatctaatcttgaaataatcgttgtagatcaaaccgttcccctcatagaaaagaatggattacattgtgtaaaagttattattccaggcatgctaccgatgacgtttggtcaccatcttactcgagttacaggactggaccgggtatataccgtaccgatgacacttggatatacagacgaacctttaacgaatgaaagattaaatccacatccacatccgtttccatagtaaaggagggatttcatgcagctagatacttttttacatcatctccatttctctatcgatgaaattatgccgaatcatgaggtggactggaaagacgcaccgcttccttataaattatatcgaaatttacctaccatcccgctctccttagaaatcccattatctttaccgaactcttctactacacctactttagatgagattggtcactacctttggtattcatttggtgtaacacaattatgtcagctaaatagcgagagaaatgtattacgaagatctattccttcgggtggtgctttatatccgaatgaattgtatatctatttaaagattgacgattacccagacggcatttaccattatgacgccgcacatcaccgacttattttacttcgcgaaggaaatttcgattcttatttggcagacacactcggtaatcgctgtaatatagatgattgtttcggtgctgcattcgtatccactatgttttggaaaaatttctttaaatacaataatttttcatatcgtcttcaaggattagatagcggggtcctcattggacaattgctagaatgtgcaaagcaattcggttatacaaacggcgtatactttcaatttctagaccgtgcactgaaccatttactcggattgtcagaaggtgaagaaagtgtgtatgccgttattcctttaagtacagagccagaaactaattggtttcacaatgattaccgtgaaaataaaacagttacttctcatgagttgttgcaacaaattccgccgctcgcacatgaacatttcattcgctcaaaacatgtaggtgaatatccgatgataacaaaaataaatgaagcttctatgatcgaatcaacagcacacttccaaacactacatcatgaagagcactatcaacataatccgtacgctgtacagctaccaaaagtagaacggttatcgtatgatttcctacaactttgtaaaaaacgatattctcctgatgcggattttattttaacgaaatgggatgaagctgagctcgctactttactacaagaagcgagcctttccttcccctattacaacgaccttgacggtaagtatacaaatgaaaatacacgcgtctccttatacggatgtttttatagcgtgaaaaatattgaaaacggagcttacgcttataacagtaaaacacattccatacaaccaattcgatatggagaccttcgctacccacttcagtctagtatgacgatggataacgtaaacctttttcaagtaccactttgcttacatgtagtcggacagaaagattactatacacgtgcattaggctatagaggataccgcattcaccaaatggaagctggtatcctcgttcataaactcgtttttgctgcaactgctatggggatgggcgggcatccgttactaagttttgatacaaattcatgtgatcaattgtacggtattgatgctgggaatgaaacatctcttattcaagttccagtcggggcatatcgggcgcggaattggttaaaaggggctttgcattgttagaagtacgccgtctatcggcgtgctttttttaaaggatttaatttataaaaagcgaaatgagtatatattcttacataaaaggagaatttaacttgagtattttacaacgattaatccagcaagcaaaaaagcctcgcgggacaattggttcttccatgctttgtattatgaacagtgcacatacgagactaaccaattgggcattacaaaaagtacatataaagaaagatgcaatcatattggatatcggttgtggcggcggtaaaacgatacacactctttcaaaacgaactccacttgggaaaatatatgggattgattactccgatcaagctgtaaaaaattctatacagacgaatataaaggatgttcaaaaacaaaaagtccttgttcaacaagcaagcgtttcttctattccctatcatacaaacttcttcgatctcataaccgcttttcaaacacactacttttggcctgatgtggaacaagatataaaagaactatttcgcgtcctacaaccaaacggatcctttttattggtcgctgaaacttttaaaattcaatatcatatggagaaatggaaaacgaatgaagaattaataaacctattttataagacaggatttacaaatgtgaaatgttatgaagaaagaggatgcctttgtgtaataggaaacaaataaaaaagcagaccctttgtaatctgtaccctttgtaaaggacattttgaaaaaagttaggcaacatcaagaagatggtttctgtatccaacaggagtcatcttttttaaattccattgatatctataatgattataatacgtcatatatttcttaatctcttgtttcaattcattaaaggacacgcaaggttttatatgagcttcatctttcagatgaccaaaaaatgattcttgtggggcgttatcccaacagtttcctcttcttgacatggattgtcctaggtttagctttttaactagcttttgataggtagggcttgtgtagtgggatccttgatctgaatgaatataagcaccttcagtcaatcgaatccgcggattcctttttagtttatggagagttgtagttacgagctctaatgtcatttgttctgaaacatggta

SEQ ID NO: 1379 - DNA, 16461 bp, Bacillus thuringiensis
gaaaattataggtgaagaagccgctacttctaacggtcatatgattatcgttggctggaatgagcgcgcaaaacatgttgtaaagcaaatgcacgtattacaaccaaaccttgatatcgttttaattgatgaaacactttctttacttccaaaaccatttcatcatttagaatttataaaaggttgtccgcatcacgatcaaactttattaaaggctaatattgcaacggcacacaccatattaataacagcggataaagaaaaaaatgaaagcttagcggatacacagtccattttaaatattttaactgcaaaagggctcaacccaaacattcactgcatcgctgaacttcttacttctgaacaaatacaaaatgcaacgagagctggcgcgtcagaaattatagaaggaaataaattaacgagctatgtatttaccgcttctcttttattcccttccatttcaggtgtactattttcactttacgacgaaatctctgataataaattacaactgatgaagcttccatcgtcctgcaccggacaaacttttgccaattgtagctatactcttttaaagcaaaacattctcttactaggtataaagcgcgacgaacaatatatgattaatccagttcattcctttgttctcattgaaagcgacatactcattgttattcaccattagtaaaatgacgctctaattcttgcatgagcactttcccaatattgatatattttcttttcacatctccatctggatctttcggctcagcaaattgatccattccacttgttccagctgttaaagtattcacattatcatctagttcgtcttgatatacgtgcgaaagaatatacggcgttccaagacgaactattacgcctggtacatctagttctccatcaatggctgtaaatggcactcgtaaaaattgatacccatcttcttcatcgattttgtaatcgaagcatcctttatcataatcccaattaccaccaatgctatatccaagtggtttcataatctcttctaatttatataacgcatatgtacgtccttctaaatttgattgaatcggaatcaagcccatccctcctagacttttcctttagcatacccactttagtttgaatatactgatggacttttcgataaaataataaaaagcgaccggaatccggtcgctttttattattttaaacgctcttctaattctgcttttaattcttcaaatcctggtttaccaagtaaagcaaacatgtttttcttatatgcttctactccaggttggtcaaatggattcacgcctaataagtagccgctcatcgcacatgctttttcgaagaagtatacaaggtaaccgaatgtgtactcatttaattcaggaatattgacgattaagtttggtactcccccgtcgctatgtgcaagtaatgtaccttcgtatgcttttgtgtttacgaagtctacagtttcaccagcaaggtagtttaatccgtctaaatcgttttcttctgattcgattgttagttcatgtgtagatttgcctactttaaggactgtttcaaataagtcacgacgaccttcttgaacgtattgacctaatgagtgtaaatcagttgagaagtttgctgaagatgggaaaatacctttttgatcttttccttcactttcaccaaataactgtttccaccactcagcgaagtattgaagtgctggttcatagttaacaagcatttcaattgtttttcctttattgtataaagcgttacgaactactgcatattggtaagctggattttcttctagttctgatgttccgaagtcatcacgaccagcagctgcacctttcatcatctcttcaatatttaagccacttactgcgattggtaataaaccaactggcgttaatacagagaaacgacctccaacatcatctggaataacaaatgtttcgtaaccttcgttatcagctaatgtttttaatgcaccacgcgctttatctgtagttgcataaatacgtttgcgagcttcttcttttccatacttttcttctaataacttacggaagatacggaatgctagtgctggctctgttgttgtacctgatttggaaataacgttaatagagaagtctttaccttctaatacgtccattaaatctttcatgtaagtggagctaatgttttgtccaacaaatagcacttgtggagttttacgttgttctttagaaagcgtgttgtagaaagaatggtttaacatttcgattgctgcacgtgctcctaagtaagaaccaccgatacctacaacaagtaaaatgtcagagtcatttttaattttttctgcgcatttttgaatgcgagcaaattcttctttgtcatattgaagcggaaggtctacccacccaaggaaatcgttcccagctccagttttttcgtggattgcgtgatgtgttactttcactgcatcacgtaaataagtgatttcatgttcaccgatgaaggataacgctttagaatagtcgaacgttacatgtgtactcatctttttccctccaattatggatatgtatttctgtattcactttagcgaaactgaagttgtaaatcaagcgattcaaacattgtaaacgtaaccaatatatattttttagaaaaagttcattttttgcataaaaattcgcatttttcggtatagatgtatatacatcttctttcaaacattttttatgtataaaaacaacataactaccccattctataaaagagttaattaactcatcgcttgctcatgcttcacaattaaggggggctttttcatgagtactttacaacgtatcgcattagtctttactgtaattggcgctgtgaactggggactaatcgggtttttccagtttgacttagtagcagccattttcggtggacaaaattcagctcttgcacgtattatttacggcatcgttggtatatctgggcttatcaaccttggtttactgtttaaaccatctgaaaatcttggtacgcacccagaaacaaacgaaattcgataatcagtatgtcctttcacctccgacatacgaatatgattgcatgcaatcatatttgcaaatatatatcataagataaagtaaaagaggaacgctcatatgcgttcctcttttactttgttaactcggactcttcaatccattctgccaacttttctcgcagcgtattaaatccgttttcagatgggttcggtataagaatccttccttgttttcttttcgccgcttttaacgataaactcatttttctgtgctcttcatcaattgaaagtacctttacttctactgtatcgccgacctttaaaaagtcatgaatatcctttacatatccatttgtaatttcagatatatgcacaagcccttgtgtttctgcatctaacgctacaaacgcaccgtaatcttgaattccagtcactttccctgttacaaccactcctgttgtatattgttctgacatatgaaacactcccatacgtttaccattctctctacaattatagagagcaaagcagatatatttattttaaatatccgattggttagtacgcattctagataacgttatctagaatgcgtataccttatattagtaaattataccactatgacagaactcattcaaaattcatgaaaaatttcccttaaagaagtataattatccaatattgggatagactactaacacatggctttctagtattcccccccttttatggacaaaacgtattacgttttgtcctttttttattctctacaaaccgttccattctcttcattgcttccataagttgttcaagcgatgttgcataagaacaacgaataaaaccttcaccactttcgccaaatacggtaccagggacaacagccactttttcttccagcaataactgttctgcaaattccgctgaagataatcctgttgaagatatagaagggaaaacataaaatgctccgcctggcacatgacacgttaagcccatttcattgaaagatttcgtcatgaagttacgacgcttcttataactatctctcattcgaatcacttcatcgttccctgcgcgtaacgcctcaagtgctgcaaactgagacatcgtcggtgcacacatcattgaatactgatggattttgagcattaattctgaaaattgaacaggagctgcaatcataccgagacgccatcctgtcatcgcaaacccttttgaaaatcccgaaattaaaatcgtatgctcacgcatatttttaatactcgcgaaacttgtatatacttcgtcgtatacaagctctgcataaatttcatcagataatacaattagattgtacttctcaacaatcactgctatttcttcaagctcggatttatttagcattgcacctgtcgggttatttggtgaacaaagcaaaatcgcctttgttttcgctgtaataactgcttcaatctgttctggtagtactttaaactcgttttctaaagtagtcgccacaggaaccggaactcctccagctaatgtcacaagtggtgcataagaaacgaagcttggttcaataatgagcacttcatcatcaggatttataatggcgcgcatcgctacatctaacgcctggctcgctccaactgtaacaatgatttcatcacttgggtcataagatactgcaaattgtttttttagatactttgctatttcttgacggagctctaataatcctgcatttgctgtatatgacgtatacccttgttccaaagaacgaatacatgcttgccttacattccaaggggtaacaaaatctggctctcctaccccgagggagataacacctttcatatttgctgctaaatcaaaaaattttcgaataccagatggttttaaagattctgctgatctagatagttcaaattgcttcatggtgtcaccacaattcgcttatcatcatcgtctttttcataaataacaccctcatgtttatacttcttcaaaatgaaatgagtagttgtagaaacgacagattcaattgttgctaatttctcagaaacaaacatcgctacttcccccatcgttttcccttctaatgtaatagaaagatcatatgtccctgacattaaataaacggatttcacttctgaataacgataaatttgctcagcaaccgcatcaaatccaacgccatgctttggcgtaactttcacatcgatcattgccgttaaacctgtatgttctttcactttcgtccaatcgatatgtgttacataatccacaataatcttttcattttctaatctcgcaaccatcttctttacttcttctacttctatatttaacagcttcgctaatgtatctacagataatcgactactcttttcaagacaagctaataattctaattctttttctgtcaccatataaatcatccttccttttcgtttgtgtctaaattatacaaataccctttcaagtttgaaaagaagatttttctattgaattatgtcaaaataaagtgaaactttaatcagcggaaaaatgcgggataaagcgaaaggggatggaaccgtgaaaccaaaagtttatattgctgaaccagttccaacatttgtagaaaactatttatcagaacactgtgattatgaaaaatgggatcaaaatgagaaagtacctcgtgatattctattagagaaaatacaagataaagatgggttattaaatttcggatctgctattaatgaagaattactgacagtagctcctaacttaaaagtagtgagcaacatttctgtcggttacgataattttgatttacaagcgatgaaaaaccgaaatgttatcggaacaaatacaccatacgtattagatgatacagtagctgatctcgttttcgcccttatgctatcagctgggcgccgcgtttgcgaactcgattcttacgtgaaaaatggtgaatggaacgctgaaatcggaaaagaacacttcggactagatgtacaccatagcacaattggtattatcggtatgggccgaattggagaagccgttgcaaaacgagcaaaattcggatttgatatgaatgttctttactataaccgccgtcgtaaagaagaagctgaacaaaaattcgatgctacatattgtgatttacagacgctactgaatcagtctgactttattgttcttcttactccattaacagatgaaacatatcaccttatcggagaaaaggaattttcattaatgaaagacacagcaatcttcattaatgcttctcgcggcaaaacagtagatgaaaaagcgttaatccatgctttaacagaaaagaaaatctttgcagcaggtatcgatacatttacacaagagccgattcaaaaagataatccactcttatcattacaaaatgttgtgactttaccacatatcggatctgcaacattaaaaactcgtcagcaaatggccatgaccgccgctgaaaatttagttgcagggttacaaggaaaaacaccgcctaatattgttcgcgggtaatactgaataaacgaaaggcaagatgacatcgtcatcttgcctttttttgttaacatattttcttcttccttggagatgatatgaacaaaaatcaatggagtgacaaaaaatgaatcataaatatacttgtccttatttcactttttccactcgcggcactactgttcattacgaattgtatgaacatgataataaaacagaacgtcctactttcatactcgttcacggctttttatcttcctcattcagttaccgccgtctaattcctttactatcgaaggaaggaacagtcattgctcttgatttgccaccgttcggaaaaagtgataagtctcatctgtttaagtattcttatcacaatttagcaacgattattattgatttaattgaacatttatctctctcaaacattgtattagttgggcattctatgggtgggcaaatttctctctatgtaaaccgtatacgtcctgaactcatttcaaagacgattttactatgtagctcgagctatttagcgcgcgcaaccttacctttactatactcttcttatttaccgttctttcatttatacgtaaagaactggattataaggcgcggcattgttcataacttaatgaatgtcgttcatgatcactcattaattgacgatgaaatgaaaaaaggttactccgctcctttttatgacgaccgtatatttcccgctttaactcgcatgatacgagaccgtgaaggtgacttatcttcaactgaattacaaaaaatcgaaacacctatcctactcatttggggtgaaaaagaccgcgtcgtccctgtacatgtaggtcatcgtctacacaaagatttaccgaattcaaaatttatttcttacgaaaatacaggacatttactacctgaagaaaagcctgaacatgtttatgaagaaattatcgctttttccgcgcaataaaatgaaactttaatcagcctccacctaacttctttgcttccgctaaattttgaggtgaaggtcttactacccagcagatagcgggataatataaaaaaggctgtcggaaatcccgacagcctataatgaacagcttccgccttcttttattacaagtaattccacagctaatttctcacatttttcaagcgcaggtacttcctcaaaagacataaagtatatatgttgaatcttctttgcgatatattttggatcgtcaaacacacttatgacgctcacaacatcgctcgcttctgtttcataaaactccggtcccatttgaaacggatcccaattcttcacaacctctatcatcttttcatatgtacccattcgcttcccgccttttcactttttaatacttttctttatcctatcacatcagctattctataagaagagagagaactttcataacttattggttttacagaagaagggagcaaacttatgcaactatttcataaagcaatcaatcgacgtggaacgcatagtataaaatgggatacatataaaaacgaagaacttatccatgcttggattgctgatatggattttgaagtaccaaaaccaattcaaactgccttaaaacaacgaatcgaacatccgatttttggctatacacttcctcccgaaaatattggagatattatttgtaactggacaaaacaacaatacaactgggatattcaaaaagaatggattgtctttagcgccggaatcgttccagctcttagtacgagcatacaggctttcatcaaagaaaacgaatctgttctcgtacaaccacctatttatcctccatttttcgaaatggtcacaacaaacaacaggcagttatgcgtgagtccattacagaaacaaaatgatacatatgtgatagacttcaagcatttagaaaagcagtttcagcaaggcatcaaactcttgcttctttgtagccctcataacccaatcggacgcgtttggacgaaagaggaacttgtgcagctcggatcgttatgtactaaatatgacgtaatcgttgtggcagatgaaattcattccgatatcatttatgcagaccatacacatacaccgttcgcttccttatctgaagaattagcagagcgcactatcacttgcatggctccaagtaaaacatttaatatcgctggattacaagcgtcgatcattatcattccaaacgaaaagctccgtcatgcctttacagccatccagtatagacaaggcttccacgggttaaatatcttcgcttatacagcgatgcaaagcgcctatacagaatgtaatgattggctaaacgaaattcgattatatatagaagataatgctcaatttgcttgtgaatatattaaaactcacatacctgctctttccgtaacgaagccagaaggtagctttttattatggattgattgttctcgtctaaagctttctcaaaacgagcgtaccgcactacttgaggaaaaaggaaaaatcatcgttgaacctggtgagaaatacgggttaggtggcgaagaacatattcgaattaacatcggctgtccacgatctgttttagaagaaattttaaacagactgcgtcatacgttttcataataagaaaggagtctgtcccgaatcattcttggggcagactcctttgtcatattttgtcggtaaatcgatatatttcaagttacagtcgatatattccaataatcgccgatataatttgagttacagtcgatatattccaataatcgctgatatattttcaattacatttcacaaagaaagctaccattcacggtagcttttactttttcttcatatccgatgctttttttacaattacgccacaagcaattcgatcccctgatttacctgtcggttgtgtcataccatcatcagggttttctgtaataataatagacgctccatcttttctatgaatcgtcgttttcccttcttcaagtgtaatgtgaggtgcatcgatttctgctttaatctttccagaaccatctgcaactacgttcggtaaatcaccgttttctgcacccttcggattaaggagtccatgctttttattatcaggattaaaatgattcccagatgattcaaatcgtggtgctttacactcaccaatttcgtgcacatgtatgccgtgcgggcctggcgtgaaaccttcccctttaatcttaattttcactccgcttgtttgctgagttactttcgcagtccccacttcatcacctgaagcattatgtaatttcacgtcaatttctttcggctttccttggtcacaacctgccatcagaaatagtaaacaacaactgaaaaaaagccgttttttcattttattccctccaaaatatattctgcccttagattgtccgagcatagaaggaaacatacaaaaatgagttactgtttcttttcagctaatagtttttcttcaactttctgtaatcggtctgcttctctttttgatatacgaataaacatgcgccacgtggcaatagcaccgataataaatagaacgcaaacaatccccggaataatatattctgttttatcttccggaaaatataaaggcatcatatagaacactccttattataggatttataaaacatcagaattttctgttatattattttaaattatagtgcaacctccccatattctcaaggggcgttctgaaaacgaaggatttctttgactccttccctcactttccttactataaacttgaggtgaaaaatatgagagaaacatttgaaattggtgaaatcgttactggtatttataaaacaggaaaatacattggtgaggttacaaatagccgccctggcagttacgtcgtaaaagcattagctgttttaaaacatccggtgcaaggtgacttacataacgtaaaacaagctgacgtaccatttttccacgaaagacgtgctttagcttttcgtgagcaaacgaacattccagaacaaatggtgaagaaatatgaaggagaaattccggattatacagattcactaaaattagcattagaaactcaaatgaattcattttctgaagatgattcaccttttgcagagcgtagtctagaaacattagaacagttaaagaaagactacaaactctaaaaaacaaaacgaccaaattacataatgtgcaatttggtcgttactgtgtgctcactttctttaacacttttgaaaaatcaacaagttctcctaatgttggaggtgctggttttactaaatactctttatctttttctactagtttaaaaatgttgtacgtcgtcattgcatcatcaagcgcacaatgatgcttccctgtccctacttttccatacgcctcaattgctttccataatcctgtttgatttctttctccaaaaaacttcttatactcaagagataaatcacgacactgtccgaagaatggaaaagctatccctgccatttcacaattatgcttcagcactttcatatccatatttccccacgttacaattgtcggtttacatttcgtttcgtattctgaaagcttcttaacgagttcaggaaatgaaatccctttatccacgacttcttgttttattcctaaaaacttcttacatcgatccgttaaagagggaaatgttttcggcctaacatgtgatgaatacgtatcttctaccttacagccagcaactgaaacgagtcctacctcaataatctctggaaaaaatcctttcggtttctttctatgctggggcatcgtaaactcaaagtctaaaaataaaaatcgttgttcatccatacgatcccttccttatcatttttgtcattcctttctatttgacactcctacacgaacaagctcgaatgctaattccattttaaatattcagattggatgtatcttatatatatgtcaaatgcccacaaatattttaaaaaataagaaaaaatgacctatgcagaaaatatgacaaaatctctcctttcatttacatccgccattttcctactttataatgacgttatgtgtgtttcttctagagcatttttgacacactaagaaaaagtgaatgaaaggagatgagatttttgcacgaaacaacgcaagaactcgctaactggcagtattattttgctatcgcagtctttttaattacatatgccattattatttctgaaaaaattaatcgcgctgtcatcgcacttcttggtgcagcactcatggtaattgtgggggtcgtcgatttacataacgcctttacgaaacatattgaatggggaacgattacgctactcatcggtatgatgattttggtgaacattacgagtaaatcaggtgtcttccaatacgttgccattaaagcagcaaaaggggcacaaggaaatccaattaaaattttaatttcactttccttacttaccgcgcttggctccgcatttttagataacgttacaactgtacttcttgttgttccagttactttatctattacgcgcatactgcaagtaaatcctgttccttatttactttctgaaattattttttcaaacattggaggaacagcaacattaattggtgatccacctaacattatgattggttctgcaaataagcatttagacttcaatgctttcctattgaatctagcacctattgtaattattattattgcagttacagcgataatactttacttcatgtatcgcaaacaattaattgccgatcctgtacaagttaaaaaattaatgagcttagatgaaaaacaatacattaaagacccagtattaatgaaaaaatctttaacggtacttggacttacaattgtaggtttcatgactcattctattttccatatcgatgccgctattatcgccttaactggtgctactgtacttatgttaattggtgtgaaagagcatgaaattgaagaagtatttgcaagcgtagagtgggtaacaatcttcttcttcgcagggttattcgtacttgttggaggacttatcgatatcggtcttatcaaaatgttagctcaaaaagtaattggtataacaggcggagatatttcttacgcatccatccttattttatgggtatctggtatcgcctctgcaacaattgataacatcccattcgtcgcaacaatgattccacttattaacgatatggcagttgggctaggcttatcaccatctgacgcacaaatcgatgtattatggtgggcattagcactaggtgcttgtctgggcggaaacggaacattaatcggagcttctgctaacgtaatcgttgcaggtatcgcgagccgcgaaggacataaatttagttacatggacttcctaaaagtcggtttcccaattatgatcgtttcattaatcatttctcacatttatatttatttacgctaccttatgtagtagaaaaagcgctctgataatcagggcgcttttttacttatagctacttatcaacaaaaatgaaaaatctactctttatatctcaccggttcatttcgaataataaataagtgaatcggtaagaacaccgaaaatgtgattacatgaataatcgtaaataatatagagttcgttccgtatctgtctaaaatagcgtagataagataaatggacaatacaatcgatacagctgttgctagtaaacttataattggtacgaaattaaaaatgaaacatgcaacatatatgccgaatactttccaccctgcttcttctttcaaaaaatctggtaatttatctttcgctaagtccccccacgtcttactattcaaaaacggaataaacgcaagcaccccgtccgttgcaccatcatttttcgccatcgaataaagtgcaaaagccgttaacaaatatgaaataattgcccaaatcaatataacaagaataaacgcaaaactaagagcaaagaaacctgctagtacgccttgatcctccatcttatcctctcctctctactttcaacatatttcattacattgcaagttatgttttaaaatttatccaaactctttgtataataagagaagaaagagaataagagaggagaaacacgtatgcatccatttgtaaaagcattacaagagcattttacagctcatcaaaatcttgaaaaagcagaacctatggctcgttatatgaaaaatcacttcccatttctaggtattcaaacaccggaaagacaccaattattaaaagacatcattcaaatacatactctcccagataaaagagacttccaaattatcgtacgtgaactttgggacttaccagaacgtgaattccaagcggctgcacttgatattatgcaaaaatataaaaagcatataaacgaaacacatatccccttcttagaagaattgattgtaacaaaatcttggtgggacactgtcgatagcatcgtacctacatttttaggtaatatctttttacaacatccagaattgatttctgcctatatcccaaaatggattgcatcagataacatttggttacaacgtgccactattttattccaactcaaatataaacaaaagatggatgaagaacttcttttctggattattggacaactacattcttcaaaagaatttttcattcaaaaagcaattggctgggtccttcgtgaatatgcaaaaacaaatccggatgtagtttgggaatacgtgcaaaacaatgagctcgctccattaagtaagcgcgaagcaattaagcatattaaacaaaattaccgaataaataacgaaaaaataggcgagactctatcatagatagacgcgttcctctattgagatttaaaaaagaacgtgttagaatatgttcattattattaatataagtagcgatgacggacttataagtacttgcataaaaagcgattcagggatagtgaaagcctgaagccgcaaggaaacggcagtcctgagcaatacatgataaagtggatgcaccttttgtgtatcaactagggtggaaccgcgggcaaacgctcgtccctaggcaaataagccttgggatgagcgtttttttatgttctttttaacatatactgcccgtttccaaagtatcagagtatgtcatcgccaatacgttaactttcaaaaggaggattttcttatgtattcaatggaacaagttgtaaacttagcgaaacatcgcggttttgttttccctggttctgaaatttacggtggtcttgcaaacacttgggattacggtccacttggaatcgaattaaaaaataatgttaaaaaagcttggtggaaaaaattcattcaagaatctccacacaacgttggtttagacgcagctattttaatgaaccctaaaacttggatcgcttctggtcacgttggtaacttcaacgatccaatgatcgactgtaaaaaatgtaaagctcgtcaccgtgctgacaaattaattgaggatgctttagatgcaaaaggcatcgaaatggttgttgacggtcttactttcgaccaaatggctgacttaatgaaagaacatgaagtaaaatgtcctgattgcggtagtgaagaatttactgaaatccgtcagttcaacttaatgttcaaaacattccaaggtgttacagagtctagcacaaacgaaatcttccttcgtcctgaaacagcacaaggtattttcgtaaacttcaaaaacgttcaacgctctatgcgtaaaaagcttccatttggtatcggccaaatcggtaagagtttccgtaacgaaatcacacctggtaacttcacattccgtacacgtgaatttgaacaaatggaacttgaattcttctgtaagcctggtgaagatttagagtggttcgcattctggcgtgaaacttgtaaaaactggttactttcacttggtatgtctgaagagagcatgcgtcttcgtgaccacggtgaagaagagttatctcactacagtaatgcaacaactgacattgaattcaaattcccattcggttggggcgaactttggggcgttgcatctcgtacagacttcgacttaaaacgtcacatggaacactcaaacgaagactttaactatatcgatccacaaacgaatgagcgttacgtaccatactgcatcgagccatctttaggcgcagaccgcgtaacattagcattcttatgtgatgcatatgaagaagagcaattagaaaacgattctcgtacagttcttcgtttccaccctgctttagcaccatacaaagcagctatcttaccattatctaaaaagctatctgaaggtgctactgaagtattcgcagaattagctaaagacttcatggtagactttgatgaaactggttctatcggtaaacgttaccgtcgtcaagacgaaatcggtacaccattctgtatcacatacgacttcgactcagttgaagacaaagctgttacagtacgtgaccgtgacacaatggaacaagttcgtatgccaattagcgaactaaaaggtttcttagagaagaaaatccagttctaattataagaaaaagaggctgctcatataaaatgtaccctatagaatagacacttgaaaaaagtctattctatagggtatttcttgtataataaaaggaaaattgggatcggagaatgttgaaaatgacaaaaaaactatttacagaaagagaaattcaaattctatcaaataacctatacgtaaaatctgtaagtcagaaaggtatcacttatacagaggaatttaagcatatttttattgaggaaaatgaaaaaggaaagctacctcgaaatatttttgaagaatgtggttttgatatagatatgattggaatgaaacgagttatgtcatcgggaagtagatggcgtgctgcttatagaaaaaatggtgtattaagattaagggatacacgtatcgaaaacgctggaaga

SEQ ID NO: 1380 - DNA, 19506 bp, Bacillus thuringiensis
gtttgtgtttttattataatgagttttggttcaatgcaaaaagaaggaaaagaggattattgacaatagtcttcttcgcctttctttcattaacacaaatggttgtaactgtttttggagatgcaggtatgattttcaatatcatctcactatcgttacaacttgtaagtttgggtgtaattgtaccacatgaaatgctttctaaaacataccaaacaatcagtgaattatttcctgcaatatatgcaggaaatggctattatacaataatatttggaggagttagtttagaaagaaatattatttcattattagttattgtattggttatacaattagtagcaggtatgattttagctataaaaggaatggcaaagggaagaggaagctctgtagttaaagttgtataaaagtaaaaaggtatccttcgtgggataccttttacttttgttactttgcaacttctgtccacttgtagttaaattcaccaccgaagtcagttgttacaagtcctttaatgaaagagcgttgtaagtaagaacgaccttgttggtataaaggagcgacagcgccgtcttgtaatagaattttttcagcttgcttcattgcttcaaagcgtgctttttcatcgccagctaaatctgttttcactttatgaattagctcatcgtactctttgttagagtatttatcgaagttataagcactatctgttgtaaatagatctaagaatgtaattggatcagcgaagtcagggccccagccgtcaataccaatttcatagtcaccacttaatagtagttttagctgttgtttacgtggttgtggttttaagttcactgttaatccgtctaagttcttttctaattcaccttttaaatattcaccagtctttttagctaaagcattgtcacttgttaatagttcgattgttactttgtcagtaccaagttcttgttttgcttttttccagttttctttcgctgttttcacatcatccttgactagatttccattttctttacggaagtcgttgccttctgggctctttgcgaatttcgcaggaaccattccttcagctggaaccgcgccgttatttaagattgtttctacgtaagcttttttattcattgcgccgttaatagcaaggcgtgcatgttgattttttaatgtttcatttttctgatttagtcgtaagaattgaatgccgacttcagcgcgttctttgaagtttggatcgctcttatatttatcaacaaactctgcagttaaagcaacacgatcaatttgtcctgaatcatataagttcacttctgtagacttatctttaacgacattgaagttgatttcttctagttttacagttttagcatcccaatagttaaggtttttcttcaattggaagctttgttcatgtttccagttctctaatgtgaaagcaccgttgtaaattaaatgagttgtttctaaaccatatttatcgccttgagactttaagtactcttcattaattggtaagaatgttgagaatgtcgttaagcttaagaagtagggaacaggacggtctagttgtacttctaacgttttgtcatcaacagctttgacccctagttgatcaattggcaattgtttttggtttatttgtttcgcattctttatatcgaagaataagaatgcgtattcagctgctgtatcaggatttacggcacgttgccaagcgaaggcaaagtcctttgctgtaacaggagtaccgtttgaccattttgaatcacgcagatggaatgtatattttgttttatcgggactaatgtcaaccgactcagcgacaccaggaaccggtttattatcttctcccattgcatataacccttcaaaaacattgcgcattacgttcatggattccccatccgttgcttttgcaacatccattgttggaatttctgaagcgaatgataagttaattgcctgtttatcaggtgctttatcgtttgctttcgctccgcttgcattatccttatttcccccgcaagcagttagtaatagacttgcccctaaaacagatgcaacaacaggtataacttttttcttcattgttcgttcctccctaaatgtgttgttcgtaacgtcataatgtccatgtcttgaagtagttatagaaggagataaaacctattataaatatttgtttataggtaatcaggtgttctatatgtatatacatgttgatctataatctatcgttatatgtttcaacgtagtagacattatattttgatggtgaaatatttcgtttctttgattatttagaatattaacactggaaagaactatatgtcaataataaaaatagattgttaatttcttagaataatatattgaaaaagcggattctcatgtgtgagagaacctatttttaatatattttgctaaaaaaacaattggtgtgggctaataataagtggggatgaagaaacccccacttattaaagtttcactttatttttcaatttttgcccacttgaagtttaattgccctgcaaagtctacttgcacaattcctttcacataagaacgttctaaataagattcgcctttttggtaaagaggagcgataacagagtctttaaataatattttctcggatgctagtaatgcttcccagcgagctttttcatcaccagctaaagttgttttcacttttgctattgtttcatcgaattccttattagagtaatgatctaagttataagggttattcgttgtaaatagctcaaggaatgtaattggatccgcaaagtcagggctccagccatcaattccgatttcgtagtcaccttttaataaaagcgaaacttgttgcttacgcggttgcggttttatatttactgttaatccatctagattcttttctagttgtccttttaagaattcaccagttttcttatcaaggtcagcatcactcgttaataattctaatgttatcttttcagaaccaagctcttgtttagcttttttccataactcttgtgcagattttgtatcaacttttgttaaatcgccatttgcagtacggaagtcttttccttcaggtccttttgcaaagttttttggaacgagaccaaatgttggtgtagatccatcatttaataacgtatttacaaaggattttctatcaattgtttgatcaattgcttggcgtgcagaaacgttttgaagcactttgttttgttgattcatacgtaaaaattgtacgcctacgtttggacgttctttaaagttagcatcctttttatatttatcgacgaagtcagatgttagttttatacgatctaattgttttgactcgaataaatttacttctgttgatttttcttttacgacgttaaaattgatttcttctagtttgacagtatctttatcccaataggtagggtttttcttgaatttaaagctttgttcgtgcttccaatcgcttagtgtaaaagctccgttgtacaagattgtattatcttctaaagtgtacttatcaccttgtgctttaaagaattcctcgttaattggtagaaatgttgggaacgctgttaagctaataaaatacggaacaggacgctccaattctacctcaaacgtatggtcatcaactgcttttacaccaagttggtcggctggaagttctttgttgttaatttttgttgcgtttttaatatcaaagaatagaaatgcatattcagaggctgttgctggatctacggctctttgccaagcgaacacaaaatctttagctgtaacaggagtgccgtttgaccattttgaatctcgcaattggaatgtgtatttcgttttatcgccacttacttcatgagattttgcaacaccaggaacaggtttgttaccttcaccaagattatacaaaccttcaaatacgtttctcattacttgaccagaatcagtatctgtagcacgagccgtatccattgttcgtatttcagtaggtgaagataagtttaaaacctgtttactaggtgcctcgtcttttgcatttgctccgcttgcttcgtttttataactaccgcaaccagttaataaaatacttactcctacaactgatgcaataccgggtacaaacttctttttcatttgattttcctcctaaataattaagtttggatgatgatgagggaaatgaaaaataaaaaatccctcttttcatattgagaaagagggatttttacgtacaagttatgcacccgtatataaacgaagtccctcattctatctttcaagcataaagcttgcaggaagtggcacagtattcaaaatgaacctgttgccgaggtttcaaagggccagtccctccacctctcttgatacaatgagtaaacgaataaattttattaatttttgtgtttctttgataattcaaaatcttacaccttgaataatgaagtgtcaactaaatgaaatatagtttaaattttcagttttattaaacgaaaaaaccactgcatagggcagtggtttttctactagaagttaaagttatctggatctggaccaacgcgacgatcttcatttaaagcttgaattgctttcatatcatcagcacttaattcaaagtcgaagatgtttgcattttcaataatgcgatgttctttaattgatttgggaattgttacaacttcgttttgtaaatcccagcgtaaaataatttgcgcagttgatttattatattttgtcgcaatttcttgtaacgttggattatctagtagttgtccttgcattaatggtgaccaagcttcaagctgaatattatgttctttacagaatgcatgtaactcttcttgtgctaaatgtgggtggtattccacttggttgaccattggcttaatttcagcaatttcaaatacgtcttgtaagtggtgaatgtggaaattactcacaccgatagcgcgaacacggccatctttataaagtttttctaatgctttccatgattcggtatatttcccttttacaggccaatgtactaaatataaatctaaatattctagacctaatttctctaatgtagtttcaaatgcttgaagtgttgtttcatatccttgatcgctattccatacttttgaggtaataaataattcttcgcgtgaaacaccggattcacgaatcgcttgtccaacaccttcttcattttgatagattgctgcagtatcgatgctgcggtagccatttttaattgctgcttttacagaatcaattacttctgaaccatcttctactttaaaaacacctaaaccaaaccaaggcatttttacaccgttatgtaatgttgtatagtcttttaaacttgttaaaatcatattatttccccctagcttttttgtttgttgcttctactgctttttgaattgcctctgaaaaattatattcgtataaagttttgagaccctcagctgtggaaccacctggcgttgttacttgttcgcggaggttagctggattttgcgtttgttcgagcatagaagcagagccagaaatcatttgaatgacaagatgttttgcggtttcttcatcgactccataactttttgttgtttcaattaagctttcagcaaagtaataaaggaaggctggtgcacttccagtaactgcagtaagctgatgaacttcttcctcagtacaaagttgcgaagtaccaataccttttaaaagcagttgcagggtttcttgatgcatctcatttactgattgtcccattgtatataaggagatagattttccaatttcagcagctgtattaggcataatccaagcaacaggcgtgccctttgggagtctagcttctaaataagatggtccaatgccagctgcgactgttacgactagttgatttgatattaacggagatagctcagctaataactcttcatgagcagaaggtggcattgctaaaacaaccgtatcaacagatgtaacatgctgtttccaatctgttgcagtagacacattatatcgatgttgtaactgttttagcttttctacgttgcttcgattagagacgataatttcttcgatgtactctttgcttgttttaagtaatccggaaaatatagcttctgccatacgaccggcaccaataaataaaattcgatgtttagttagcatattctttattcctttctagtagagatatgttataaaaacgatatcatctttaagagaatgttgtaaaaagaaaagacttaccgtagatggaatggataatgagaaggcggaaattcatgctaatattaactgttattaatctctttatatgtgtagctggtttgctagagtggaagagcaattataaggggcaagaacatacaaataattatatctagaaaataattagaattgaaaaacccctgaagcatatatgcttcaggggtttactaatagaatataagattatgcttttgtcataccaagtaatacagcgccgccgataattaaaacactacctagtgcaataaagatcaattgacgttttgttttcttttcacctaagaagacaatcgcaccaaatgttgagataacgattccagtttgagataatgggaagcttgttgctactccaacacgtggtaatgaaagaagtaagaataagtttccagttccccatagtaaaccagacaaagcattacggattgcatatttgttaaatggtttatgtttagacgtcagtacaaccgcaccaacaaacataccaactgcttgtggtaaaatagcagaccaaccatcaatattataccaacgaataataattacatatacaagatagccgaaagtagaaacaattaaagtaagaagtccttttttcaattgtccaggtggctgagcattttctttatcatctaatgatgtgaatacaacaccaactacaattaataggattgcaatcgttcccagaatgatcgttgtagtagtagtccactcacggaaagcgataaccccaaagatagaagttgcaacaagttgcataccagtagaaatcgttacagtagttgaaacacctagtttttcaactgtttttaattggtttacttgtcctaaagcccagaataaacctgaaataaaaccaacaattaagattgtcattgttaaagctggttgagtaaatacatacataattgttgcgaagaatagagcaccgattgtcatacctaccgtttggctatatgcaccaccgcccatttttacgcttactaataagatgtttccccatgcaattgcaggaagaagcgctaataaaatgtccattacaagactcccttcggtttgctataccaatatagttacatatcgttctaacgatcggtaatgccccactaatagagtagaagattaccgatcgctaaaacaggatgaagaattcacaatataaatgcgttttcatttcttcattttttgaaacacctccatataataacaggaaattgcctattttagaaagtgaattcaaataaaatgtatatttaaataagaggtaaaattcagttatttcccattggtatattttatttcctaagaaataaagaagcagcttcgacaaaagctgctttaagagttagtgattcttttattaataagttgaatacatagtagaaatacgagtgacataccgatagtaataactacaagtgtccaggcgagttgcatattacttgcatcaatagccatgtaaattgcagttgggattgtctgtgttttaccaggaatgttcccggcaaacatgagtgtagcaccaaactcaccgagcgcgcggacaaagctcaaaatcatcccgcttagtaaggcaggaaatgcgagtggaagtgtaacgtgcagaaaaacttgatattcacttgcgccaaggtcacgagcactttcttcaatttgtacatttgcgatagaaaatcccgttttcgctgattggtacataagcggaaatgcaacaactgtagaagcgataatcgcagcagtagatgtgaacataatagactgctgaaataatgattcaacccactttccgatcgggctgttgtttccaaagatgataatgagaaagaagccgataacagttggtggaagtaccattggtaataaaaatatggtttctaatagtactttatatcgccatgaggagcgagctagtgctcgcccgacaattgtccctaaaattgtaacgagaatagtggcgcacgcagctactcttaaagatagaaagacaggcgataaaatagcatcaatgctcatagtaattacgacagaactgtaaatccatatttcttaaagatagattgtgcatcttttgactgcaaatactcataaaatgaagtcgcctctttcttatgtttagattcctttataacacctaaaggatagtggattggctcatgagaagtagctgctgctgtctcaccaatctttactttatccgaaatgagagcatctgttttgtatacgatgccagcatcgacattccctgtttctacatatgttaacacttggcgaacatcttttgtaaatacgactttattttgaacatcattccaaaggttttcgtgtgttagagaagcctttgcatatttgccagcaggtacagattcaggtgtaccaagtgcaatttttttgattttctcatcttttaaatcttgaaattttgtaagtgaactatctttagggatgactagaactagttcatttccaagaagatttttcccttctttttcactaatgaatcctttttttacaagggtttggaatttatcttctgctgcagagaagaataaatcagcaggtgcaccttgttcaatttgttgttgaagtgctccagaagcaccgaagttaaaagaaagtttgatatttggctctttttctttatattgtttttcgatttcttttaatgcatcttgtaagcttgcagcagctgagatagtcagttcaactgttttatcctctttagcagctgactttgtatgcttttccccacttgtacaagcagcactaaatataagaaggaaagaaagtataagtgccccgatggaacgtaatgtaaatttattcataaaaaaatcccctttcgttttgatacatctaattataactaattatatctaaatataactagttataattgaatgtaatttgaacatatatctatttttaaaaaataggagaaatattcttttctttgttacaatgaaaggagaaagtgaggaatcgtctatggatcatcattcctacacaacggaagaagtagcaaagcgattaaaagtatcaaaattaactgtatacgacttaattaaaaaaggagaacttccttcttatagagttggtagacagatgcgcattgatgcaacagatttagatcaatatataaaacaaatgaaaacaggaaaggtacaagttactcctgtaaaaaacgatggtagtagtatcttgaacacgtgtattattagtggtcaagaactaacgttagatatgttagctaaacgtatagaaaatcgtttgccaagttctaatgttttaagggcgtatcaaggtagcttaacgagtttagtgaaaatgtatcaaggagaaggaagtatcgttagtttgcatttgtttgatggtgaaactggtacatataatgttccttacgtaaaacgcattttagtaggacagccatgcattatgattaatttattgtccagaaatgtaggattttatgtccgaaaaggaaatccgaagagaataaaggcatgggctgacatatccgggtccactataaagtttgtgaatcgagaaaagggttctggtattagagtgttagtcgatgaacaattacgaatccaaaaattaaataaagctgatattagtggatatgaatgggaagaatcgaatcatcttggtgttgccacgcaagttgcaaatggaaaagctgatgtaggagtaggttcagaaaagttttcgcaaattgtaaatgtggactttattccaatcatgaaagaacagtatgatttagtaattttgaagaataaagaaaatgaagagttgattgaagttgtgaaagacattctgcaatcggaagaatttcataatgaattaaatgcgattggcggatatgatattacgaaaacaggtcaaattgtatatgaaacaaactaaaaagctgcttgtctataagacgagcagctttttctatatataaagggggttggggaaacaaagtgttaaacaagaccttgagcaagtgtataaatgaaagccgtaagaagagtggctccacttgcaagtacgataaagtctgatttgttgaaagtaatgttgttcattataaactctccttatttgtttaatgtagttgcaacagcttttgcatcgacaagtgcggatagcaccatgcccattgtatttaaaaatttatttgatttcatattgttcatcatgcgtatccgctccttttcgaattgttgttgccctgcttatgtcttaattataggaaatatggctacttgcaactattgaattagcttacgaaagacttacacttttgtaagaaaaaaagacattcatgtaagaatgtctttcacagcatattgatatgatgatggtcttcaattgtttttaaaaaactacgcattgaattcgtcatatagctatctttacggcgtatgaaaaccgttgaaatactgccgtatttttcagggattgcatgacaatgtaccttacctgctttagaaagatgatggacagcagactgtggtacgagtgtaattccgaggccgagtgcaacgctgtttaatattgtctctaatatattgaattccataattctttttggtagcaaaccttcatctttaagccaacgttctagtttggagcggtatccacatccttggttaaaaacgagtagaggagttgttgtaaattcttctatatgaaaggctttattttgtgttataagcattaatttctctgtactaacatcgtattgttcgattagtggatgtttaataggacctgatataaaggcgccatccaattgatgatcaagtacttctctaattaattcttctgttagacccgcttgtaatgataaatcgacatttggatagcttttatagtaagaagataaaatggtaggcagtgtacttactgtttcgactgtaccgattttcaatataccggagggtgtttcgctatctaaaaatacttgttttagttcgtcgacatcttgcaaaattttactaacataaacgagcatttttcttccttcagctgttaaagtcattcctcgtttatggcggtaaaagagtggggtttttaattcgttttctagttgtttaatacgtgtagttacatttgattgtacataatttaattcctttgctgcgctacttacactaccctgatcggcaacgcttttaaagatttgtaagtctcgtaattccattttgtaatcccccttgatgttaactatcattataaatgatagttaacatcattttgaatcattttacgtgatatattttttcttttacaattctctttgtgcaaatagaaagaaacgggggattgcggtgagaagaggtcaaatgataataggggctgtagcgtgtttaattgcgagtatgtcatggggagcgatgtttccagttgctgatcatgcgctagaatacatagatccattttatttttcgcttattcgctatggagcagtggcgataatgctgattgtattgttgttagtgaaagaaggaaaacaggcatttcgtttagagggaagaggaaagttactcgtcttttttggaacgatggcatttacagtatataatgtcctcatatttttagggcaaatgttgatgggtaagtcgggtgtaatggtagcttccattatggaagcacttatgccgatgatttctatttgtattttatggggatataagcatataaaaccgaagaagtatatgataacgagtatggttattgcttttgtaggagctgtgtttgttattacaaaaggtgacatgagtttctttgtaacattgaaagataatatgttcccattagcatttatatttattggtgttataggctgggttatttatacgatgggtggtcaaacgtgtagtgattggtcaacattacgttattctacgttgacgtgtgtattcggtacgactgttacaggaattataacggtaattattacgtggcttggatatgtttcagttcctagtatgggaacgatttctattgtaaaatatgatttgttatttatgatgacattgccaggtattgtagcgctacttgcttggaactacggtgtgaaaattttatcatccattaatgggattttatttattaattttgtaccaattacgactttagctattatgatgatgcaagggtatcaaatcacaatgtttgatattatagggactgtacttgttattgcagcacttattcgcaataacgtttgccagagaaaagaagaaaatataaataatagagttttacaagaagaacaattacgtcaagctgtttaataggcaaatggaggatttcacatgttagaaagtttattgtttttcttcgccgtcggagttgcctgtgagcttgcagcaattaatcgaaatggtcgtaaaaagataaaacaacaagctgagctgatacagcttttaaaagagttgaaagaaagaaaaaattaaaaagacgaccgggcatagacggtcgtctttttctatataaaggggaaaggggacacaaagttatacaagcgtagcagcgtaaataaaagcagtaagaagaagagagccgctagctaatcctaaaaagtctaatttgttaaaagtgatgttattcataatacattctccttacttgtttaatgtagaagcaacagcttttgcatcgaaaagagccgataataccatgcccattgtatgtaagaaattgttcgttttcattttgttcatcatattaatcgactccttttcgaataattgttgccctgtttctgacttaattgtatgaaatatagtaagaagtaactatcgaattagcttacaagaaaattacacttttgtaagaattgaaatttaacaattcatacttatttttattaccaactcctaaaacttagtgttataattgttgtaagaatatgattatacttcggatgtttagaaaggaacgaaataaatgtataaaccaattacatttttgttgaaatatatatttaaaacagctgggaaagtagaagtgcaaggaagagaaaagctaccagaaggtggtccgtatgttgttgcgtgtacacatacaagttttatggatgtattaatgttagctacagggatgtacccaactcaaattcattacatggcaaaaaaagaattatttgaagggaaattcaaaaattggttctttaaaaatgtaaatgcattccctgtagatcgcgcgaatccgggaccgagtacacttaaaattccatcacgtttattaaaagaaggaaaggtagtagggatttttccgagtggaacgagatcagcggaagatgtttcattaaaagcgggtgctgtgacaattgcgatgcgttctaatgtacctttagtgccggcagcttatgttggtccatcaagtgtaaaagaattaataaaggggaaaaaggcaaaattgatttttggagatccgattcaaattgaggctggagaacaaatagatcgaaaaaccgctatgaaaatgatgacagatcaattaaatgagaagtttgaggagttaaaagaagctttgcaatcaaatcaaaaataagaaaagacgaccgggcatagacggtcgtcttttctattactatttataataaaggggacacaaagttatacaagcgtagcggcgtaaataaaagcagtaagaagaagcgagccactagctagtcctaaaaaatctaatttgttaaaagtgatgttattcataatatattctccttacttgtttaatgtagaagcaacagcttttgcgtcgataagagcggaaaataccatgcccattgtatgtaagaaattgttcgttttcattttgttcatcatattaatccgctccttttcgaatagttgttaccttgtttctgacttaattgtatgaaatgttgcggaaagtcactatcgaattagcttacagaaaaattacacttttgtaagagaaacaaatgaaggtgtaatgataagaagatttgacatatgttcatgagattcattaacttaaagatagaggtgagtgcatggctaatattaaagatatcgcaaagatggcgggagtttcagttacgactgtttcgagagtgttgaatgatcacccatatgtaagtgaagaaaaaaggaaagcggttatagagatagttgagaaattgaattactcgcaaaacgcaaatgctgttcatttatcaaaaggaaagacgaatattgttggtgtgattttaccgtatattaatcatccgtgttttgatgcgatggtgagcggaatgatggagattgcgttaactcataattacagagtgttactttgccaaacgaattataataaaaaagaagaaatgaaaagtttacatatgttaaaaacaaaacaattggatggtcttattatttgttcacgtgcaaatgattgggaaacgatagaaccgtatgcttcttacggcacaataattgcttgtgaagataatgatatttcaaacatctcaagtgtatatacgaatcattcagcggcctttcaattaggaatggattatttgattgagaaaggttataaaaaaattggctattgtacgggaagaaaattagggccgagtagtcaaaagcgttttgatgtttataaacagcaattgcaatctatagatgaagaggttaacgaagaatggatttttacagaatgttttacactagaagatggtgtaaaagtggctcataagttaaaagagatgcaggatcttcctggagcattaatagtagcaggtgatgaagttgcgattggggttatgacagaggttgaaaaattagggattcaagttcctgaggatttagcgattattggctttgataatcaacctatctcgcaagtgttacaattgacaactattgatcaaaatttaaaggagatagggaaaactgcttttgaaatgttgcatagaaaagtgaatgacgagagttctaaacaagaaaagctggaaattccatacgaacttgtggaacgctctacagtttaatcttaatccgttatgtgtataatcgcataacggattatttttttgaaatatctttgacaggaaacgcgtttcatactttataaaggagttaaaccggtctgtaatatccatggattcttttcaagtgttaaagcagtgaatagaatttggaggaatatgcatgaatgaacttttatcgagtatgaaaaagtatgtagatgatgatgaaaagattttagtttttgtggtagggatctttgagaaggataatttcatgttatgttatcaacatggaatttttgttgccactactagacgcctcctgttttacgggaaatttccttactatccttcaacatttaaagagtactcatatgtgcatatagatagcatagattttcatccgtactttgagtttacttgtaatcatgaaaccattcgcgctaagtatattcagaaagggaatgtggagcaatttgtccgtgcagttagagcaaatatgaataattaatcaaccctctgtttaaacataatatttcaatttttaagagggaaaatgcggaataaaaaccacttctaaacctctaggagatagtgatacaatgtcaaatggggggagggtatgaactatggttaatcaacgtataaaggaaataacactaattacaattggttcattattattcgcaattggtattaattactttgcaattccaaaccgtttatcggaaggtggaattattggtttaacggttgttacgtactacttatttgattggtcaccagggattgtgaattttgctataaatgcaattttactagctattggttataaattttttgataagaaaacaatgatttatacaattttagggattgtagaaacatctttgtttttatacgttacagaacatattgagtatcatgtaaatagtgatacattattagcagctttatttgctggtttatttgtgggtattggattaggctgtatgttcaaagccggaggtacatcgggagggtcagcaatcttagctcggttagcaaatcaatatttaggttggagcgtaggtaaaggcgtactaattattgatattgttgtaattgctggttctgtatttataatagggcaagaaaaggcaatgtatacacttgtagctgtgttcatcggagcgaaggtgattgatttcattgtagaaggaatggatacaaaaacggctgttacgattatttcgaatcaaccagatttaattcgtgaagctattacgaaaaatatgacacgcggtgttactgtattagaagggcgcggcggatatactggtaaaaataaagaagttttatatgttgttattaataaacaagagcttgttaagttaaaacaagttattagccgggtagatgaagatgctttcgttgttatacatgatgtacgtgatgtacttggcggtggctttaaagcaagctaaaaggtgaacgagtaaattcgttcaccttttttaattcttacaaaaatgtaagtgtaatgtaatgagattcaatagtagattttattccccctttttaaaatggatgtatatatatcctgcagaggaggaatgtttattatgaagaaaaaaatgatcactactataatagcgatgatagtgatagtagtaatgttactgcctacgaaacttggaccggttatcgataaatataatccattttataagacgaaagaatactatacggttgtgaatacaattggtcagcatattggtgatgagtggtatgaatatgaatttattgcattcgatgaacgtggtagagagcagaaaataaagaaaacggttaagcatatgttaaagagagatgaagcattaaaggtttttgcaaaaggacgttacggtgaatcgattgaagagattgaggttgcaaatattcctataaatgcgaagagtaaacttttaacgatgagatagtaaaatatacccccagctattttttgtcgaaaataaaaataccaggtaagggtattttaggagttaataaaaaagccttagtccatatgaagtgcaccccaattgttagacacagtctaacaattggaggtgcattttttatggctaaattttcttcaaaagaaaaaatccaagcggtgaaacgatatttagatggtacagaaagtggaaaaacaattgctaaatctataggagttaaccctagcgtacttcgtgagtggattagacgatatgagtcttcaggtgaaaaggcctttgaaaagtgctatacattctacccagcccagtataaactagatgtactttattatatgaatgaacacgggacatctatcagagaaacagcggcacttttcaatataccgtcttatgaaacacttcggaaatggaaaatagcttatgaaacaggaggattggatgccctacaatcaaagaaaaaggggcgtccaaccatgaaagataaaaaaataaagccagtagatgaaggatcaatcgaagccttacaagcggaaaatgagcgtttacgtatggaaaatgcatatttaaaaaagttgaatgccttagttcaaaacaaagaaaaatcaccaaacaagacaaagcgcaagtaatctacgagttaaggcatgaatttcctatcaaggagttacttcaactcgcaaacattccacgtagtacgtactattactggatgaaacgttttaatcgtcctgatccaaatgcggaggtaaaagaactgattcaagctatttataatgaacacgatgggtgttatggttatcgtcgtattcgtgatgaacttatgaatcgtggacacaaagtaaatcataaaaaagtgtatcgccttatgaaagaattagggttaaaatgtctggttcgtatgaaaaaataccgctcttacaaagggacagttgggaaaattgcgccaaatattttaaatcgcaacttccaagctgaaaaaccaaatgaaaagtgggttacagatattacggagtttaagttatttggggagaagttatacctatcaccaatgttggatttatttaatggtgaaattatcacgtatacaattggttcaagaccgacctattcccttgtttcaacgatgttggaccaagccctttattgtgtaaccaatccggataaactcctcattcactctgatcaaggttggcactatcaaatgaaacaataccgtcattctcttaagaattgtggcataactcaaagtatgtctcgcaaaggaaactgttatgacaatgccgttattgaaaatttcttcggtatcatgaaatcggaatttctgtatcgaaaagaatttgaaagtataacacatttcaaacaagaattagcaaagtatatagaatactataatcataaaagaattaaggcaaaattaaagggtatgagcccagtacaataccgggctcataccctagaggctgcctaatgaaacgacctgtctaactttcgggggtcacttcataaatgccacgactttttatattaattcgtactaatgcctctcgctgcccaaatgcgatcgatatcagcagcatgttgtccgccatataaaagagcatccgcttgcttaatcgctttcgctccatcactgaatttagagtttggtgttaatgaccagtgtgattgtaaaatgatttttgttgctacatcacggccaaaagcttgtgccatttcgtattggccttgagcccaaatttcaccatcatcatgcacttcattcgttatatctttcggatatactttattcgtatctaatcggcgtaagcatgttggatctgaactagaataagctgtcgcatcccattctccaacacatgctttaccatatccagtagtcgatactgcatcttcatatgtagcacctaagaagtcgccaaatccttctcccatcgctccaccttctgctgaactaccaaagccaggaacttggttatcttgaatcgaatgcccatactcatgtgcgataataccagcatcttctgcatcatcaacaccgccagtaccgaaagttaaagcttttgttgatggagaatagaatgagttatcatcagttgtaccattaacattcacttttatcgaacggttattaatatttttaaaacctagactttgaatgtaacgttgcaatgtgtcgatatgatagtacgacataacatcttcaaagctatcatttgcgcgtgtatagttaaattgtaaattcgtagattttgttttcgcttttgaagaaatcgttacatattctccaat

SEQ ID NO: 1381 - DNA, 24815 bp, Bacillus thuringiensis
cgaagattgaatatccaggaaagctaactatttatttattataatgataactctcaagatgaaacacctgaaatcggcgatgatttcgacaaagcttatgctcatattcgccacattcgtgttcctcccggtgaaccgaagggtaaatcacgtgtattaaactacgggcttagtatttcagatggtgaatacttctgtgtttacgatgcagataaccagcctgaaccacacgcactgcgaatgcttgtagagcacgctgaaacaactgaagatgctgttggagctgttggacacgttcgtacagtaaacgaaaaaagaaactggttgacgcgaatgatttcgctagaatttcaaatcttccagctccttatgcaatctggacgctggttactattccaaacaggctcactgacaggaacaaatatgcttcttcgtcgctccgcactagaagagcttggtggctatgacccttatgcaattgcagaagatgctgaattaacattacgaattacacaaaaaggttatctcttaccaatcgtcccagaatcagttacttgggaacaagaaccagagcatttaaaaattcttattaaacagcgtacacgttggctccaagggaatttatatattttagaaaaaatgttctcatcactaagtttctttaaaggaaagctgcttgttcattccttacaacaagttctagtgtatgttgtattttggctattcctaatcatttcgaacgtttggtttgtaattgggctgctcgggatattccaaattcaatatagcattccgctactatttatgtggtatgtcgcatatattacatatgtttctcaattatttagtgcccagagtgtcgaacgaacctttacaccgactaatatttttattagcgttattatgtactttacgtacgcacagctctttacgtacttatttattcgtagcttaatcttatacttacgtgcaaagagcaagaaacaagtcattggctgggataaaacagttcgattcaaaaaagataaataataaaaataagcacagagcgccgtatgctctgtgcttatttattgccgtataaattatatatcagacaataccccttagctgaaagtaatttcacgtccatcccccaacgaacgatcgaccttcatttatatacgaaaaagtgattgctatttttgtagaaccaattgcttctcttgctgttctttgcgcgtttcagtcttaggttccgtgctttcttggacactacgatgtgccacacgtttcaaacaaatatgcttccactttctttcgtaacgtttcattattctagatgtcccccttgaatgcgctttaaaactatttgaaatcgcttacaggaaataatatagcacatatatataaacgtgacaacacatttccgacaattttttgtcaaaaatatgaatagaattcgtaagggatcgaatattgtcgaaacctatcgttttttcttcgtataaaaggcatactacttatgtggtaaagtattttatttcccctacccgcattttaaattccttctatataaagtgaaactttcattagccatcaccaatggggcttttacaagcagctcgatttatttgcttttgctgaattttgaggtggggttcttactgctcagcaaatagagggataaaaaaagagctgatatgaaatcagctcttttccttctattattaatgacgcttcatacgtccttctttttgtaactctttaaataatgctgccatcataaagaaaataacaaagacgaacgggaacgctgcaataatagctgccgtttgtaatgcttctaatccgccaatatataatagcgtagaagctatcgcggctagaacgataccccaaatcattttaatacgatttggtgggtttaaactaccatgtgtcgttaacatccctaaaacgaatgttgcagagtctgcagatgtaataaagaatgttgcaataagtaaaatacctaaaactgataaagctgatccaaagctgcccatctgatcgaacatagcgaataatcctacttctgttcccatctctttcactttttcgaagatatgtgcatcaccaaacagctccatatgaatacctgttccgccgaaaacagagaaccaaagtgcaccaattacggtcggcacaagtaacacaccgattacaaattcacgaattgtacgacctcgtgaaacacgagcaataaacgtacctacgaatggtgaccatgcaatccaccatgcccaatagaaaattgtccacgattgaatccattggttcccaccttcgtctaatggacttaaacggaagctcatgcttggtaattcctgaatataagaaccgattgttgaagtgaagtaattcataataaagtttgttggacccgcaaataatacaataatcataagtgcaaacgcaaaaataatgttcgtattacttaaatatttaattcccttatccagacctgtttgcgcagataacataaataatactgttacgattgcaataataactaactgtgtcgttaatgaatttgggatagatgttaaatagctaacaccacctgcaatttgttttgcaccgagacctaatgacgttgcaacaccgaacacagttgcaaaaacagctaacacatcaaatgaatgagcaatacgcccgtgttccccgcccttaaataacggacctactgtcgcactaatcgtacttgcttttccttttctaaaggtaaagtaagcaatacataacgctacaaacgcatatagtccccaaggatgtaatccccaatggaaaaatgaaaaacgcagtgcaagacgcgcactttcctcagttgcaccttctccaaacggaggtgcgtataaatggtttaatggttcagcaacgccccagaaaactaagccgatacccataccagcactaaatagcatagcaaaccatgtcatataactataatcaggttcgtcatcatctttacctaaacgaatagaaccgtatttcgaaacaattaaaaagatagacacacctaaaataatagaaacggaaataatataaaaccagccgaacttactaactaatgcagtttgaattgcggttgttacatttcctaaactaccttttccaataatagattcgggaataatcccccaaattgtaaatgcaatacataatgttaatgaaacgatgaatgtttttgtcagtttcctcatcaaatcccccttcgtaggtttcgcttttgtaaataacataaattccgatatgtaaaatcggatagaaaactataattttgcggtgattttcttactttcaccttcaccaattcgaattcttatggacagccttacctttcgtataaccttttcactctgcaagagctacaagctagaaatactgctgtcaaattgtgtgagaaaaacgcggataggaatgtattttcctaaaaaaggatgtgttacatatgtaaaaaagggcaaatttcttccttgcaaccctttcgttttgtaacaattatgcggttttttttctagtatatagcacgtgtttatagcttcacaaacaaaatgtttatgtttatataactatattacccataaaacggtaaaatactcaaggaatgtaatcgtttagtaaacattatgtaacattactgtaatatttttatttacgtcgaaaaaaacatgttgtattaaatattttgaatataactagaaacctatgattcatatagaatgaaaaacgctttcttatattttttgttatattacaggatattaacgacttattacgaatggtttgtaattgtgtgttttccccaaatccgaaaaaatctgttgctataatgaggacacgaaaacaaacgcaatggaggctatcatgaaaaaattaattggtatagcaacagcagcagtttttggtcttgggattttcacatcatctgctaatgcagaaactgttgtaacaacagatgtactaaacgtacgcgaaaaccctactacggaatcaaaagttgtcggtaaattactaaacggtaataaaatagatgtacaaaatacagagaacggatggtcaaaagttactttagacggtaaagacgcattcgtaagtgcagagttcacaaaaagcatctactacgtaacagctaacgtattaaacgtacgtgctgaagcgaacacaaactcagaggttcttggaaagttgaagaaagacgatgtaatcgaaacaacgaaccaagtacaaaatgagtggttacaatttgaatataacgggaaaacagcttatgttcatgttcctttcttaacaggtacagcacctgtaattgagaaacaagaaacaacggctcctgctaaagctgaagcaccagctaaggctcaaacacctgtagcacaagcaaaaccagctgctaagcctgctgtgaaagctgctgaaactagcgaaccatctggtggtcgtgagttaacagttgtagctacagcatatacagctcacccgagcgaaaacggtggcacatatggcggccgtgtattaactgcaatgggtcatgatttaactgcgaatccaaacatgaaaatgatcgctgttgacccgaaagtaatcccattaggatctaaagtatgggtagaaggttacggagaagctatcgctggagatactggtggtgcaattaaaggtaaccgtatcgatatcttacttggatcagatagcgctgctcaaaaatggggacgcaaaactgttaaagtgaaaattttaaaataaccaataactgctaaattacaagccggttctctttattgagagctggcttgtatttatttataatacatataaggaggctatgcccatgaatgtacaagcaaaagtagactggattggtacgccaaaaccgtacatatataaagatgaagtgacatataacgctacttctattgatttttcactcgctggcgatgataaacgctataagttaattgtgctcaagtctgaaaacaatacacattacaaaattgtgcaatatggaataaaaccaggctctcaaaagccatttcctatcgacattccatttgaacaaaacatgttaccaattatagagcaaatattacatgatccatatgtacaagaaatattaaaggaaacacactcataattgtaaaaaaatatatcaacgatttttcaattatatctatcataacttacgatatatcaacggttggacacgaaatatcgatttagctacaaaaaagaagctgttcaaatattgaacagcttctctcatattaacgagttggaccagatacatcttctgatttcaacgtattatttgcaccaagagaatgatacaacatctttccatttccattcacagttacaatatgttcgctattaaaacttttgaacttcacagatccatcaccgtaacgaatatgatactcttcatatgtcgttactttatatttcgtatcactttgacgctctacattacgaacttccatcgttaataagtcttctgtaattccttttttgtgtaaatactgtatataatcacggtcttccttatacgatttcccactcttatcataattcttttcaattaaactaaaatcatttaatgaaattgcacgtacgttatcataaatatgatttcttacaaattcgcccactgctgaacttgatgtttctttcgggaattttaagtaatacgtgctttggtctccaattttaacactttcagatttcatcacaccaaaatcagtagttttctctaaatgtacttctactgtttcatctgtggatacagggccaagcttataacttccataatttaattttccacgttttttcccattcacaaatacagttgcatcactttcatcagaagaaatgcttacatacttaccttcaagcgataaatccactttcaccttctcgctctgttcatccgctaaatctacttctttctctgtttctaattcagtcagttctgtcttcgccgttgcctttacaacatatgtacctgggaagtatggccccaactctttcgaagttttatcactagaaagctctgtttcttttttgttattcacatgtatttctgcattttttgcagttgtactaatgctcatataataagatttcatgctgaacttatactttggatataagaaccactcttttccctcttctactatttccccgtccttaaatgaagatttatctttagttaacttttgatctactgtctctttctgtaaataagacagtaattgtttgttgtaagaaggattctcttttaaataacgcatgtacgctttaatatcctctgtcttaatctttaagcttgaatcattcgcttttacaaactcatcaattgcattaatatctttcttttggaatgcttcaatcattacatttacttgcttttcttttgaaaacttatatgctccaaatttatatgccccaaataataatgcagcaataacagcaaaaccaatgatcaaaaataaatttttcttacttttcactgattttgtctcgctttgtaattctgtatatgaagcagcagtgttatcaacgattacttctactttactcccacactcaggacaaaagttcaaatggtctgcaacattctttttacatgttccacaaaacttcaacgtgctctcctcctattttttagctaatttcattccagcaaatgccgctacatatgtcacaatcaagctaaacaaagttaaatatataaatgaattttgcatagataataccgttccacttgttccaaataaacctgttaccgttcctgaaacattaatttggaacttagaaatcatattcattacaatcatcataattgtgtaagaaccactacataccgctaatgtaatatatatattggcggtcggtaatttagctaactttcttcccgctctaaacataaagaacaatggaataataagcagtaataaaccataatggaatacattattcactttatcaaattctgcaaggctttcctcatttgctccttttgaaatcaatatctccctaagctctacgccatttacagagacgcctgatataaatgaaaacgatagcgtgctctcatatgtatttgatttcttaccaattctagtaaattctttactaagtgctggacttgatacttctaacggcgcaaaatgagccatactccataattgaggtgttaactctaatgctaataatgtactttcagattttaaaattgttatttcttttaatggttcaataccgtcttccttacttactaacgccataatacaaaccgctatcgctgttactaatagtccttttatcatagctgaaacaccgtaatacacagacgctccatatggcattaactcttgaaatgctactgccatattgtttttgcttgtatgagcaataaatcctaataaggtaaataatgtcccacatacaacaccactcaataaactcttaatcgctgaatagccaaccgtaatcttacctgcttctgagaatggaattgcaaaagattgtgatgctataaaacttataatgaataaaaagacgccataaataataccaactgttgctgccataaagatttgatctttaatcgttttcgcaacatgctgtttccctaaccaaattcctgtaccagcgaaaataataaatggaatgattaataataatgtaaatggagtatgccaagataaagaaaatatcaatccactatcatcgttagctgtaaaaccaagtaaatggtaacttaacatcgtagaagttgcactcgaataaaaacttggcaacatttctaattctttcgcaaatttgctaaacatctcacttaacatagaagcaaataataaactaccaatccaaccagcaattaacatgagaatacttgcaacagccccaccaataaaacctttttgtaacacggctttatctgctttaaattcaactttaggagcaccatccattgtaggcaattttacagattgttcttttttcttcacaacagataaagaatacccgcacttttgacaatataaatttttttgagcattttcactgccacaacctttgcagtattttgcagtatctttttctaatgttactgcatctatagctcctgcaatctccatactaccttcatttgggcaataatttacttcttcaccatgttgttttccacatgtgcgacaatacatttaattcactccccactttgcttaattccacaaactggacagtaagtagagtttttatcgatatgctcattacatgaaatacaatttaccgtttcaccttcattttctaccgctaacatcgggttagattttccacacgaaccacaaaacttatcatttattgataaaggtccaccacattcacatgtagctttttcaccttgttgtttttgcaattcaacaatgcgctttcttgcttgataaatagctacatcaaattcttgaactggagcaatcatttcttttaagctcgcttcatttactccacttcctcttaattgaacatacacttgctgcccaacctctaatagaacctctgcttttttctgcatttgcacttgcattccctttttcaattgagcaatttcttgtgcaacttgcaacttcattttcccttgttctattccttcttgtaacttattcattccactacctaacttcgtctgtaaatctgacaaattacttctcctcctatacgtatatattcatatatgaaattaacattttatatattaccatgattttcaagttatgtaatccaaatttcattttttctgttttgagcattttttgtttataatggtaaaggaaagaaatatgtgtacggaggaatattatgctgcaacactcaattacgaaagatgaaattatgatgattgcgaatgagttcgttcaaggactagatccacagcaaacagctgatcaggaacatgtcgctacagctcggcacctatatcgtagtggtgttgtctacaacgttgactttgatggttatacactgtcaggaactgtagatgcggaaggcaacgtatatagcgttcatattccgattcgtaatgtcgctgaaagttattgtgattgcttcgcaccaacacaatgtgagcatatgctcgctgtattactatctgcagcgtctagtttcgggcaagtaggagatgtattaactttatttaaaaataatacgaaaccttcccttcctcctattagaactgcaagacaagtattgcaatcatcagcttttgaagaaacggattataaaagttgggaatcatattttgaaaaagaatatgaatcatttaaaaaagaacaagctcgccttacttataaacaaatgtattttcttatgagtatctttacagatttctatacgaagcttgagcggaaagctccgcgcgtcatcgccatacatgaattattcaggttacatgcagcaatttactgctttcaaaaattattagaagaaattcaggcattcgaagcaaacaaaacgtattcttatcaccaacctgttaatgtcattcgcctatttgtagataaagtggaatccatcgttcgggacttacaatcagaagcgattccttcagagtctgaaataattttgcaagaaacaactcgtctcgttcatgaagtattcttctctaccgacgcttatacgcaagagcgatttttcatttatcgtcacatatggagtgaacttttaaacaataaagagaacatacaagaggaagaaaaacgaatcgatacgaaaatcaatccactatccaaagcattagcgtcttctcatcttctctttttaaatgatgaagatttactagcgatggacttactaaagaaacaacctgcttctgttgtgagtctatacttctattggttagaagaactattaagtgccatgcaatgggatcgtgcaaaaaactggctttcctttacgtataaacaagtaaagaaaacgatccaagatcacgaaaatacgattttcataaaagatatcgttcggctatttgtaatcatgtatgaaacatacgcaacacatacaaatgaacaagctggttttgaaatgattttacaagaactattaccgtatagtttcacaaactacgaacagtacgtactcgcgaaaaaacagtatcgcacatgggcagagcttcatctcttatatggatttgaggcaatcgaactgttgaaagagccactgaaagatattgaaaaagaagcgccagaagtggcacttcctctttaccatcttgctgctgtagaggcgattgaagaacgaaatcgtaaatcatataaacgtgcagttcgttacttaaagaaattacgtacattatataaacgattaaaacgcaccgatgaatgggatgctttcattattcacatcgccaatctccattcacgtctgcgtgcactacaagaggaattacggaaaggaaaattaatcgatgatcaatcaaactgaagtaacaattaggctccagcatgttagtcaaggttggttcctttggggagaagatgacagcggtactccattatccgtaacaagttggaaacgaaatgcattcacatggcactccacttctttctacggtacgtttctaaaagaagcaaccttcgaaggaaaacaaggtgtgctgctaacaaatgcacaagcctttgaatacattgcaaacaaaccgatgaattcctttgcacatattcaaataaacggcatgattacagcacttacgaaagatgcaaatgaactatgggatgcctttacgagtggtagtttcgtaccagatatgaatcattggcctaaacaaccatcttggaaagttcaaaatacaccaattgaagatgacacattagcatcgcttttctcagcagcagtaaatgaaagcatattacaagacaaccgctcaaatgacggctgggaagatgctaaaagactatatgaacattatgactttacgaaaagacaactggaaacagcactacatgaagaagattggcttcggaaaattggttatattgaagatgatcttccgtttacaatcggactaagactacaagaaccacaagaagaatttgaaatgtggaagcttgaaacaattgtgacaccaaagcgcggggcgcatcgcatatatgtatatgaaaacatcgattccttaccgaaaagatggcacgattacgaagaacggattacagaaacacaagaaggttttagtaaactcataccgtggttaaaagaaggagatacgttccgaaatgaactctttgaaacagaagcgtggaacttcttaacagaagcaagcgacgagttacttgcagccggtattacaattttactaccatcatggtggcaaaatttaaaagcaacaaaaccgaaattacgtgtccagctgaagcaaaatacagcacaaacacaatcgttcttcggtatgaatacgctcgttaattttgattggcgcatttcgacgaacggcattgatttatcagaaagcgaatttttcgaactcgttgaacaaaataaacgtctatttaatataaatggtcaatggatgcgactagatccagcctttatcgaagaagtaaggaaactcatgaaccgtgccgataaatacggactagagatgaaagatgtcctgcagcaacatttatcaaatacggctgaaacagaaattgtagaagatgatagtccgtttactgatattgaaatcgaactagatggatattatgaggaactattccaaaagctgcttcatattggagatattccaaaagtagatgtccctacttcactaaacgcaacacttcgcccgtatcaacaacacggcattgaatggttattatatttacgaaaacttggatttggagcattgctagctgacgatatgggactcgggaaaagtattcaaacaatctcttacttactatatataaaagaaaacaatctcaaaacaggccctgcattaatcgtagcgccgacatctgttcttggaaattggcaaaaagaatttgagcgtttcgcaccgaatttacgtgttcaattacattacggaagtaatagagataagggcaattcttttgaagatttccttcaatcagcagatgttgtattaacatcttatgcattagctcaactcgatgaggaagaactaacttcattatgctgggatgctgttattttggatgaagcacaaaatattaagaacccacatacgaaacagtcgaaagcagtacgaaacttgcaagcaaatcacaaaatcgctttaactggtacaccgatggaaaatcgccttgctgaactttggtccattttcgactttattaatcatggatatctcggaagcttagggcaattccaacgccgcttcgtcacaccaattgaaaaggatcgtgatgaaggaaaaatccagcaagttcaacggtttatctcaccatttttactgcgccgaacgaagaaagatcaaacagtcgcattaaatttaccagataaacaagaacaaaaagcttactgtcctcttactggtgaacaagcttccttatatgaacaacttgttcaagatacactgcaaaatgtcgaaggattaagtggcattgaaagacgcggctttatattacttatgctgaacaagctaaaacaaatttgtaatcatccagctctttatttaaaagaagaagagccacaaaatgtcgttgaacgctctatgaaaacaaaaacgttaatggagctcatagaaaatataaaagatcaaaatgaaagttgcctcatcttcactcaatatatcggcatggggaacatgctaaaacgcgtgctagaagaaaaattcggccagcgtgtcctcttcttaaacggtagtgtaccgaaaaaagatcgcgacaagatgattgaggagttccaaaacggaacgtatgacattttcatcttatccttaaaagctggcggaacaggattaaacttaactgctgccaaccatgtcattcactacgatcgttggtggaatccagctgtggaaaatcaagcaacagaccgcgcatatcgcattggtcaaaaacgatttgttcatgttcacaaactcattacaacaggaacattagaagaaaaaattgatgaaatgctagaaagaaaacaatctctaaacaatgcagtcatcacaagcgatagttggatgactgaactatcaacagacgaactaaaagaattactcggtgtataaagtgaaactttaattaggccaatcacgtagagttttactacccgcaaaaaaagcgctaatctcgaaatgagattagcgcttttttctattccaaaaccaattacttattataatccccgttaacccgccgcacgtatcaagcaatgaatcttgccacattggtgtacggtctcccgtaaaccattggtgaatttcatcaaatgttgcataacccgcaacgaaaagaagggcatatataaaacatcttttcctcgaataacctgatcgatgaaaagcgtaataaatcaatgaacctagcataaagaacaccataaaatgagcacctttacgaaggaaaaactcaataaatccgcctacacctttattcgcaatactaacaggggttcctccaccataatcgatagatacccatgaaaaatgctctttcacaaattcaacatttacatattgttcaatatctgaacgcatatcctgctttttatatggttgtgccgaagaatagaaaatcagccccatccatagtaatacaggaatccaaaataaccatttacgattcattatccagaattctcctctcttcatcttttaagggtaccaaaaaaaagaaaaaatttcacgccaaaacatgacattcacgccctatttataaagtgaaagggggtgatacacatggcaattgaaacaatcgtaatggatttaactttacgtcttgtcttaaacaacggattagataagaacggcaaaacagttttcaagagcaaacaatttaaacgtgttaaaacaaatgcgagcttagatcaagtacacaacgtagctcatgctctagcttccttacaagcatcaccacttcactctgtacaacttgtaagcacatcagatctttctaaactataaagtaaaactcggatcagtggggattttattcatccccgctgattattagcccgcaatttaaccaacagacccaaatcccgtaaatagcgggataaatacaaaggagggaataacacatgcaagtactagagttgattttcgcgaaagaagatggaaaaacagtcgttttttctatcgatacgcccatcacaccaatcgatgcacaagtcgtaaatcaagtaatggatacaatccttgcctcatctgtattttcatccattgatgaaaatacaagaaaaaagggagctcgccttgtagaaaaaaatgtatctgaagttccaattactctataaaatgaaaaagacgaatctgcatcattttgcagattcgtcttttttcttcggcatttcaatcgggataaaaacctttgaaaaaccgacgcatacatacttataatgttcttcccctatatcaaactcagtcgtatatgttgagaagaatatataatcatttcgcttcgtataatgatcaattaataacccaacttgtggttcaacatactttttcgctaactttttaccggccgatgccaaatcgccaaggagaccctcttcattctctttttgaacttcatctagcttcttactcacatcattacgcttcataaactgtttcgctgcccattctgtatattcgcccttactcggattactgtttgctaaatatactaggagaacgacaactaaagccataataatatactttttcttcatactatatcaccgcctactcttttctattttcatatatatgtacaagcgatgcaacttagaaagactatcacctattgattgtaaacgaatagccaaaatttacaatatgaaatagaatattaacaattaatttacttaatttatatataattatattcagaatgtaaattataagggaggatatagaattatggataatgaaaacaacatttttatttctagttctacaatgatgcttgaaccatgtaaacacccttattaccgtacaaaaattattgacagtagcggaaaccatctttactcctgtcaaactgctctccaacttatacagaaatcttgtctaacaaatattcattctacttatcaagggagacgtaatgctgtaaaaacaaaatttaaatttaaacaaaacgttccaattccgatcaatcatagagaatatatttgtgctttcccaacagaatctcctgcttctccaaattgtatttggcttttcttcaaacatgttcatacaatagagtttttcaaaaaagctaaacgagctaaaattcatttttcaaacggagctaccgtaacgatacaaattagttcccataagctaagtcagcaattatggaaagcgggatatgtattatcccaaatgaacatgcaagattcatcaccttaataacaaatagaatggaaggtagtatttcctcaccttccattctatttgctatttttatccttttacactatcgcgcattttctcgattgcttgccgatacatccaccttacttgataatatgtcatttccgtctctaaagcgatttctcccatcgtcttccctacaaaaaaacgttcaaaaataatatacttctccttctcgtctaacacactcataaaatccttcactcttatttcaacatcttcaaaatgaaagatatcctcatactcacctacacatacacatctttcttgcaaagtagattctttcttcaatctttctaatatataaccacgcaccgttacaagtgcatatgcagggaaatatcccttctttgcatcaaatctttcatacgcatgccaaagaccaattaaaccacattgataatactcttcataatcttgacggatacctaatttctttatttgatttacaatcatcccttcatacaaaacaactgtctctataaaagtcgctggcttcacacagtacccgtttctaaaaggtatacctttctagtattccgcggtaccttcacaatataaaaataaacaaaagatttcaccgtgagtaatttcaaatactaccgacggaatttgaaattacaccagctagtatttgaaattttgttggtggtatttgaaataggggtaaaaataaaaaaggctccttctatacattagaaggaaccttttgtttatgagttctcaagttatactattctgtagttatatttttgaaaaatctatcgatcgcatatagaccagtagctaaaatataacttgtaacatgaacaaaaaatttgctataagtttcttaaatatatgtatcttctccttataacaaaaatgcagcaattacttttataattgctgcatttctttctagttacatgaaatatcaatattattgcaccaatcctcttagtgcaccaaagccgatcgttaaaatgaagaagataaccataagaatcgttgccttctttttacttaaaccggccgtaatttgaagacctaaccatgtgataacaaatccccaaattgtaaatacttcaatgctatttgcaataccttttacagcgcctccacttgaagcaaaaattgggcctaaaccagtgtaaagttcttttcctgaaccacctagaataagtgctaaaactatatttattaataaaccaagtactgaaataatgcttgaatatacattaattgttaataatttcttgtaagaagtatcattgctcattaacatcattaacactttatatacagcagcactaatgaagaaacctattatcataccgataacaccaaatacaaaaccagcaccgaaagtcattacaggtgtaacattaacccctaattcttgattgagcttaattgattcaggtgttaaagaatatacataagcaccaattccaccagtaatccccgatagtaaagaaagtatccaaaacgcaccccaaactgcattactattcttcattctctcaaactgctcacctggagaagtaatcattcctaataatgatggcttcttcgcacctacatcttgcgtattaatatttgcttccattataacgcctccttctatttatataacccgttctaacgggcggttcacttcctcatatagaggctacgaaccgcccactagaacggtaatgtgtagttctactacactattaattactcataacgcaatgcttcaattggatctaatttcgcagctttatttgctggaattaatccgaaaataataccgagtgtcatcgagaacagtacgcctccaacgacaacttcccacgaaacgagtggtggccattttgcgaatgtagaaacgatatatgctccgccatacccaagaccaattccgattaaaccacctagaagtgttaacataacagcttcaattaaaaactgtaataaaattttactacgcgttgctccaagtgctttacgtacaccaatttcacgtgtacgctccgttacagatacaagcatgatgttcataacaccaattccaccaacgactaatgaaataccagcgataccaccgatgatcattgtcataataccagtcatcttcgaaataccttcttgaatttcttttaaattcataacttcatatttaccagttgcatcggtcggtttacgactatttaaaacatctgcagcttttttacctgctttttctagattatctacattttttgcttgaacagaaatattttgaatttcatcttttccatacagtgtcggccataatgaaattggaactagtgcttctgatggtcccattcccataaactcattatctgatttgtagacaccgataatttgcatcggttgacctttcatttcaataattttaccgactggattggtatccttaaacaccttttcttccatttgtttactaatcatgacaacgttattaccctgatccacatctgattcttgtaaagaacgtccctttaacaactttactttatttactgcaaagtactcactatctaatccagtaatacttaccatttcttttttatcttcaatatcaagtggttccatgctggaatttgttgttaccacatgtgcgatctctggaatttttttaatttcaaaaatgtcttcttcagttatcttcggtgcttctaccattcccataccgaaaggatcgtttatatctgcactataatgaatcggaaccgtttgattacctgccccaacaaactgcgatttcaatgcagcttccccgccttgcccaattgcaacgacagtaataatcgaacctaccccaataataataccgagcatcgtaagagctgaacgcagtttatgagctaaaatagaagacagggcaatttttatactatctagtaaactcataccgcacaccttctatcttctgtaactttcccgtctcgcagtacaatgcggcgggaagaatacgctgctacttcctcttcatgcgtaaccataacaatcgtcgtaccttctgcattaagcttcgtgaaaatattcataacttgctcaccagacttcgtatcaagtgcaccagtcggttcatcggccataatgaacgttgggttattcgcaatcgctcttgcaatcgctacacgctgcttctgtccacctgataactcatttggtaaatgatgcacgcgatctgccaatccaactttacctagcgcttccaaagcacgcttgcgacgctccgctttcttcacgccaccatatacgagcggaagctcaacattttccactgcggaaagacgaggtagtaaattaaaatgctggaatacaaagccaatatattcattacgaattaaagcaagctttgactcgtctgctgttaagatattcacgtcattcagcatatattcgccttctgttggacgatctaaacaaccgataatattcataagcgtcgacttaccagaaccagacggccccataattgaaacgaactcaccgctctgaatcgttaaactaataccatgtaaaatcggcaccgccaattttccttgataatacgttttagcaatatgatttaacgtaatcatttctctttcacttccattccgtcatacacatcgtcggaaggatttttaaccaccttttgccccactgttacgccttctacaacctctgtccagtctccatcagtagaaccttttttcacattttgtttacgaagcttacctttttcctcaacataaacaaatgcatcatcgcctttttctacaatgctcttacttgggacagcaatcattttcttattctctaagtttacctgcaatgaaacgtggtagcctggagataaaccgtcttggctatcaagacttgctttatatgtatattgagacatattttgagttgcttcacccatgccgccagcttgcgccatctctgcacttgttgggaactcacttacctctgtaatcttacctgtccacttcttcttattatttgctttcgcagttacagtgaatgtttgatctttttgaatttgtgacttctgaagctcagttaacgtaccttgaacttggaatggatctttagaagctacttgtaaaaacgcttttccttgaccgcctagcgcttgagatgaactttgtgccgcatctttatctaacttttgaacaacaccagcaaaattgctataaatcgtaagttctttctgcttcttacttaactcttctttctgcaactttcctttttctttctcaaggtcaattgttttttgtcctatctctaactcgtttacttgctcgtccattggatctgttacttctttcccagctccgctatctttcgccttcttaatttctttcttcaatgaatcaatcttctttttcccttgatcgtaacgcatatccgccatcttctgatcaagctcagcttgcttcatttgaagattaatctcttcattgtcataagagaataacttcgtacctttttctacctcttgcccttcttttacctcaatatctttcacttttcctttggccggatctgcatagaaactttcaatattaccaggcttcacctgaccagaaattaacttcgtattattcagcttacgttctgtcactttctcaaaacttacagcatcagacgttgttgatgcacccttcttcttaccttgcataacaaaaatattaattgccgctacaataacaattagtgcaataaccccaataataatccatttcttcttcttgtttggagtacgaaccgtatttggtaacatattctctctcctttttataacttaatagtttaatataaaaattgtataaaactttctgaaaatagattacatattattacattgtttttacaaagttttacacatccatttatattgtaacaaaaattccaatgattagaaatatgacattatatcttttaagatagatttaaggaaagtttatattatatagaaaaagccatccaaaataataattggatagcttttcaaacaaaatattacgctactttaggatcttttctctcatgtccacgttgaacaataaataagaagattgttgataaaaccgctcctgttaatagtaagatgaaacaaccatcccagccagaactatcaacaataacaccaattgctgcgttagctacaagacttccgcctacgtaaccgaatagaccacacataccaactgtcgtacctactgcaaatttcggtactaattccatcgcacttaaaccgattaagaactgtggtacataaattaaacaaccgataatagaaactgcaatacttacaacaagtacgctagttgcttgccaatatataaacgtaccaataacaactccaaccatactaataatacataatggcatacgttttcctttaaataatttatcacttaaaaaaccaacgattaatgaacttggaattgccataccttcaaagattgcatatgccgcatgcgcttctgcttttgaaaatcctttaactgtcgttaaataaagtggaacccagttaataacaccgaaacgaattaaataaacaaaagcattcgcaatacataagaaccatacaaatttatttttcactacatacttcattaaaatttcttttggtgacatcttgttagcattatctgctttttcaagattttcatagtcattacgatactcatcaattggaggaagaccttcagattctggtgtatccttcgcattgatccaaacaagtactgcaattaccattgcgataatcgcagggaaaataaacacgccgccttgccaatgattttcaccgaaaatacctacaccaattccgacaagtggtggtacaagcattccaccaacgttatgtgaaatattccaaaggcctgttttcgtaccacgttctttcttcgagaaccatttcgtcataacaatactacaaggtggtgctcccataccttgtacaataccgttaacaacaagtaatgtaacaatcatcccaaaggatgatgcaaagccgaaacaaatatttacaagccctgataagaataaaccgactgcaataaagcgctgggcgaaagctttatctgataaattacccataaagaacttactaaatccataaacaattgccattactgagcctagtagaccaatttcagctgtactaaaaccatattcttgtactaaatacgtacttgataacgtaaagttactacgaactaaataataagcagcatatccaactgaaattccgattaacacacgaatacgtagtaatcgatatacacggtcgatcatatccgctggcaatctttcaattgcaggtgctggcttgagccatttaaacatatattttcgtctccttttctcacttcagagagagacgctgtctattccatatctcgattattccgctatttgatatattttggttcgtccttctaaccggctgtccttctatttctttctcattcttcgcaaacatcgttggtacgccaaacgacactttttctaaaatatgccccgcttcttctgataaacaataatcaataaataaatccgcaataataccactcggtgcacgttttagtttcgaaatcgcattaacggataaccctgtttgctcaggttcgttacttaaaatcggaaagccttgtttttgaagcattctctgatctcccataaagttgatgcctatcatatattcaccgctcgcaacaagttctgctgggatgtaaccattcactgttacttctccaacttgttctgccagattcttcacatatcccttcgcttcctcttcacctaacgtatcaatcagtgattggaaaaacgtatatgctgtacctgaaacatttggatcgggcatgacaatctttcctttatatactggattcaataaatctttccatcttaacggatacgagagaccgagcggcgctatttcctcgttccaccgctctttattaatcgcaattgccagcttctccacttcataaccgtaccaataaccatctttatctttaacagtttttgaaatacgatttgcatgttggcttatcacaggaatagaaagatttttttgcttcatcatttgatgcgcatctactgtaccgccaataataatatccgccttcggatttccagcttcttcttccactctacgaagaagttcttctgttgaaagacgaataaattcatacgtacatccgcgcggcttacaaaatgatgaaagtaacgcttcaccaacttcctcacgagccgctacatacgcaacaatatgacgatcatccaaaatagggagaccatttttactatatttaatagaggttgtatctcgagagcaactagacatcgctcctccaattactagcaaaaagaagaaaaaggctatctttctcatgacgcattctcctttacgaataactctgctagagagcctttcatatacatgacatttccgttattatcaccgagatattgcacaacaaagtacgatggatacacagaaatcgtaagaatatcttcacgatcattttttacgcgcttacctgttttataagctgtaatataagcaatcggttcattctgcgattgtaataacttctgaatttctccgtaatctgtaatttgctttgcgtaccaaatagaatcaagtatgtgcgtaagattgatagtacgtaccacatcgccttgacgtactacgacatcctttgctgaagcaaagaaatcactaatacgctctggcgtgtaatacaggcttaataaatacgtttgaagtgctgaaatcatcggatccatgccattctttccgtatacattttccccatactggaacaagtcacctactgcaaaagtacgcttatgtccattcaagtacgttacttctccagtaaatacttgttcttggctcttaacgtcccctggctctattcgaattcggtcaaagaatgaaacaatcgtatgcaaacgaacttcatccgttacaacgatttctccccacttttcatgtcttactttcacttcaattggaagagattcattcaccctttgtaaaacggcttgtttatcatttacaatgttgattcgattatagatttgcttctccataacataaaacaaaacaagagaaacaatcatacaaatgacaaacataagaatttgaaatgatagccttttcatttctgcctacctccaagataaaaaaacgttgtttcgaaaataccgcataattgtttcataaatgtatcatttaaccgctttcaagttttttatgtcttccatccttctcggaagcaaaaatgtaatgaatattgtagtacctatttcttcactactctcaatccgcatgcttccgccctgcttattcataatctcctgacaaatatacaaaccataaccattcccgtaactagaaggaagtgcctttcctttcggagactcattccactctgcaagcaccacttcatctataccgatcccatcatcatgaacaaaaaccttcgcctcatgctcatttacaattacattcatacgaatgtgcgaagcatcactatacttaattgcattatcaagcacatttaagaaaatttgcttcgtcttatcaaaatccgcaacaacatgtacatccgttaactcatttaccacttcaatttcaaactgatttagacgaggtttcacaattgaaactgcttcttctgccaattcctttatattcacaactgtaggagacacttcaaacgtactcgtcccatatttcgaagacttaagcagttcctctacaagtgataataaacgctcactttccaccgccacataacgaagactttcctgtacatcttctttcgattgtaacttcggaattaaatccacataaccgataattgccgttagcggtgtttttagctcatgcgtaatgcggtctagaaaatctttctgcttttctttctcctcctgcaactgcttaatatgcagctcaattccatcggccatcgcattaaaagatgctgaaagctgagcgatttccacatactcatttaactcaatcttactcttataatcaccattcgcgagccgctgtgccatttgtctcaactgatcaattggtttatgaagagacttcgccaaacgaatcgcaaagaaaatacccgtagctactaaacaaagagatgtcattaagaaagtccagctcacatttgttaaaccttccttctcacccgttaactcatttataaaacga

SEQ ID NO: 1382 - DNA, 23292 bp, Bacillus thuringiensis
  unsure (1)...(23292): unsure at all n locations
catataaaagtaaacctagaggtatacccttttttgtagcgaatataagggttacaattaccattaagagggtatcccccgtcgcatctagtatgcgcggccaaaatatactccaatcaactcgcatgagcttctacctccttcagctgcacttgcagtcttagatgttgtaatgctttttgaatttccctctgctcaccttgcaactctacaagaagatttccaaatagcacattttgaagttcaataatatttccgtacagtacatttacatcgacgttatagttttttgcgatatatgatagtaccggctgtcctgtctcctcaccagtaaatgttagacgataaatttgaccaccattttgaattttcgctagaacactttccggtaaatgatcattaatgacagaacgtacaaagttttgagtcgtctttgtttttggttgcgtgaaaacatcaaacagttttccttcttcaataactttccccttctccattacagctacacggtgacaaatttctttcacaacatgcatttcatgtgtaataagaagaattgttaaattgtattctcgatttactttctttaataagtttagaatttctgtcgtcgtttctggatctaaggctgatgttgcctcatcacatataagaatatctggcgatgtcgcaagtgctctagcaatgcccacacgctgcttttgcccacctgatagctgctctggataatagtttgctttatcttctaaccctacaaacttcagcagttcatttactctttcttttatctcattctttggtactttcgctaactttaatggataagcaatatttccaaatactgttcttgaattaaataaattaaaactttgaaaaatcattccgattctttgtcttagtttacgcaattctttcgtcgataatgatgtaatatctttatcatctattgaaatcgttcctgccgtcggtctctctaacatatttactaagcgtaataacgtactctttccagcgccactaaaaccgataatgccaaaaatttcgcctttctcaactgataatgttacatcctccaccgcatgaacagattggccagctgattcatacactttacttacattggtaaaagaaatcatttttttccctcctatatgctgtaaaaacttgaagcagagctttcgaggtaaaataaaaagtgccctccttcttatcaaccataaagataagaaggagagcacttatatgtactcgttcacatcttctcatcttccaagcctttatatggcttgctggagttagcacggtattaaaaaaacccgttgctgaggtatcgtagggccagtccctccacctctctggataagaatgtatcgatttaattgtcgtttaattaattctcattatagaactcagaataataagagtcaatacattttttagaaaaatattaattattcctttattaaaattttcagatgaatattcatctgaaaattagtaactttcaaggttatttaaaattcttcttcctcatatttttaaacaggagaatcctctctacgaattgaataaatttatttgaatatgaaactcggaggaagataaatatatgaaaacagctcttttactcgtcgatattcaaaacgattattttccaaatggaaagatggaattgcgtaatccagtagaagcaagcgaatatgctaatcagttattacaacaatttagaacaaacagcgaacctatttttcatatccaacacgtagctataaaagatgacgctacttttttcctacctaatacagaaggtgtacatattcatgaaagcgtacgtccacttagagaagaaacagttatagtcaaacattatccaaatagcttccgagaaactaatcttctagagcaattaaaacgtttaaatattgaacatgtcgttgtatgcgggatgatgactcatatgtgtatcgatgcaacagtaagggctacattcgattttggctttcaatgtaccgttatacatgacgcttgtgctacaaaagacctttcttttaagaacgctactataccagctgtttatattcacaatacaattttagctagtttaaatggcgtatatgcaaatgtaataagcacgcaagaatttttagctacataaaaaaacactcctttcattgagcaaaactgaaaggagtgttccttgtcgttccatagattttctttcaaattgtattatacaggaaattctcaaaatgaatactaaaaaatatgactaataagtcaacttttctcatcattttatttctgttcacatgtttatcacgctattaataggttttagctcattctcttcgaacgacggtaatatatggggtttcaattttaaaagaagctnttcacattctgntnaccccccttacatattttcttataaagtttcagaagtagtttttgcttgcatgtgaagtgctaagtaatcaggtccaccagctttagagtctgtaccagacatgttaaagccaccgaatggttggtaacctacgattgcaccagtacatccacggttgaagtataagttaccaacgtggaagtcttcgcgtgctttttcaatatggtcacggttgttagtaataacagcacctgttaaaccgtattccgtattgtttgcaattgcaagtgcatgatcgaagtctttcgctttacagaatgctactaccggtccgaagatttcttctttcattaagcgagcatcttctgcaacgtcagcaacgattgttggttggatgaaccagcctttagaatcgtctccttcgccacctgctaagattctaccttcttctttaccaattgcaacatagctcattactttatcaaatgcagcttggtcattaacaggacccatgtttgtacctaatactgctgggttagcaactgttaattcttttgttaattcaacagcacgatttaatacgtgatcgtatacatcttcatggattactgcacgagaacatgcagaacatttttgtcctgagaatccgaatgctgatgcaacgatagacttagctgctaattcaagatctgcttctttatcaacaacgattgtgtctttaccgcccatttcagcgataacgcgttttaaccaaatttgtcctgggtttactttcgctgcacgctcatagatgcggatacctacatcacgagatcccgtgaagcttacgaaacgtgtacgaggatgatctactaagtagtcaccaacttcagaaccgttacctggaacgaagtttactacaccagctggtaagccagcttcttctaatacttccataaatttcgccgctactacaggagttgtactagctggttttagtaatactgtgttaccagaaactaaagcagctgttgtcatacctgccataattgcgaatgggaagttccaaggagaaatgataacacctactcctaatggaatgtaagagaaacgattatattcaattggacggctttctactggaataccgtcttttaattttaacatttgacgaccataatattccataaagtcgattgcttctgctgtatcagcatctgcctcattccatggcttacctgcttcttttacaagaatagcagagaattcatgttttctgcgacgaacgattgctgcagcacggaataaaatgtctgcacgcatttctggctttgattttctccaagtttggaatgtttcatccgctacttgcattgctttttcagctaactcacggcttgcttttgaaacacgaccaacaagttcttctttatttgcagggtttacagaaacaattttgtcttctgtagtgattttttctcccccaataattaatggatagtcttgtccaagataagattctactttctttaaaccttcttcaaacgctaatttgttagcctccactgaaaaatctgtaaatggctcatgtttgtatgctactaccattttttttagcctccccttagaaaaacgtttacattttacaacattattctacacgataatttagatttattcaaatattcctagacttatattttaaaaattaataaatttttaaaatataataaaaaaaagagattcatacatgcgtatgaatctacaaaatatgagtatattccaaaacatttttcccgatcaataatatagtaactaataaaaataaagtccttacatatccaacacctttttgaaccgcaaacttcgatccaaaataagcacctaagatcattgataatcccatgataataccgtattcaaaatgaattatgtctaagaataaaaaagtaattaaagatacaatattactaacaaagttcaaaagttttccagatgctgccgcttgaataaaatccaagccaattaataaaaatgcaaaaattaaaaacgaccctgtccctggtccaaaaaacccatcataaaatcctatcattaaaatagcaaagaaaaatattaatgtttttctttgcgtcatcttcttataggtagacacacttccccaattcttttttgcaataatataaatagcaataaataccaacattacaagtactaatgggcgtaaaatatccgatggaataaattttactactaaagcacctgcaacagctccaacaatagttaacgggattaactttcctacaattttaaaatcaacttttcctgatcgaatgaaatacatcgcactcgtaaacgtccccattgttgccgctaatttattcgttgcaattgccgaagctggcgataggccaacaaacataagtgcaggaagcgaaattaaccctcctcctccaacaacggaatcaataaaagctgctaaaaaaccgaatgcaattaataaaataatgacttgaaaacttaattcttccatgagctttacccctcacccctattttttacaacattttaaattataacaaaattacataagaaaaaaagctgttccatagaggaacagccttcatatttaatctaaaattttcacaagtggttcatcttgttttgcttcacgtataataatagcttctgggcgttctacagatttaatcgttacttgtactttcatataattcgggaagtattccataacaagccctgccacatattgtgtaaaaccaactatttccgcttttccattaaactggacaggaatatcaagcttcatttctcttaattcatcatctctatacataccagtaccaataacagctgtatagtcgccttggaaataatcgcttagttttgccttaaagttggatactcttgcaagatcttcacgtttattatctgttttcgcttgctctgatgggaacaaataatatttttcattaatttgtttccaatcttcaaccgtttcactacctttttcgacatttgcataagaaacaaaattacctggcacgagcgaagactttggagcttggcgataaatcgcaaatgttatcggaatattttttgtttcaggttctttttgatgtatgactttcaaaatttcttgcgccatttttttcccttcagctaacatcttttcatctgggattgcagcttcacgtgggtaaccatgctcttcgttaaaatattgaacagaattcatcgctaatccaactaccataccaacacgttcctcgccgttatcgccttttttcacataataatcatgctctaaaatatttgaaatatatattggattttttttatttttcacttctagtgattcggatcctgttcctaacgcaggatttaatcctatatttggaaatttaactgcatctttttttaatttttcctctagttccttttgttcagcatctgtacgttttcttttaacaagcatctgtatagtttgagtatctagagcttttccgccttttaaaaaattatctttcgtactaaatgattcttttgcaattcgcattaatcctgtttcaaattcatctatatcaaggcgactatttaacccttgcaccactaaaccacgtgcctttccaccatcaaatggaatagtcgtcttataatattcatccgaaatagcgtattttggaacaactgattgttcttttgctttccccgatttcccagccactttttcatctttgtcggcacctgcactacacccacttacaagtaggccaaggcttaataccgctaatgctatttttttcatggtaagtttgcacctcttacttatttagctcttgtaagaacctctcttcattccaaacctcaacattatgtttctccgcttgtgctaatttcgaaccagctgcttcacctgcaacaactaaatccgtactcttactaacacttcctgttacttttccacctaatgcctcaatcttcttcttcgcttcacttcgtcccataacttctagcttacctgttaaaacaaccgtttttcctgcgaagtaagattcaacattttgtaaatctgcaatttttatacctttgtatgtcatattcacgccatactctttaaactgctgtaataactctaatacatcttcattatcaaaatatgtcacaacagattgagccattttttcgccaatttcattaattgcttttagttcttcttccgttgcttttacaagctcatccatcgtttcaaagtgctctgcaaatgtacgtgctgctttcgctccaacgtggcgaattccaagaccaaataataatcgctctaacgagttttctttagaattttcaattgcttgtattaagtttgttgctgatttttcaccaaaacgttctaactgtaataattgctctttcgtcaatgcatataaatcagcaaatgtacgaatgtaatcagcatcaaagagttgtgtaatgacacgttctccaagtccatcaatattcattgcatttcttgaaacgaaatggattaacccttctcgaatttgagcaggacaagttggatttatacaacgaagtgctacttcttcttctaaacgaacaagttcactctcacatgctggacaatgagttggcatgcggtattcttcttcctcaccagtacgcttatcaaaaataacgttcacaacttcaggaataatatctccagccttcttcacaacaacgtagtcaccaattcgaatgtctttttcacgaattaaatcttcgttatgtaaagaagcacgacgaacaatcgtaccagcaactctcactggctctagttctgcagtcggtgttacaacccctgttcggccaacacttaattcaatgcctgttaatctcgttacaacttcttcagccggaaatttataagcaatcgcccaccttggactcttcgctgtagttcctagactttcttgaagagcaacatcatctacttttataacgattccatcaatctcataatcaagatgcggacgtttttcttgccattcttctacataagctataacttcttcaattgtttcacatgtacggcgatttggatttgtcttaaatccaagttcacctaagaaatccagcgattcactatgtgatgaaattgttttttcttctacattcgcaagaccatacacaaacatagataagttacgcttcgctgcaattttcggatcaagttgacgtattgaacctgctgctgcattacgcggattcgcaaatacatcttctccattttgctctttttcttcatttagtttaacgaatgaacgcttcggcatataagcttcgcctcttgcttctaacgttacttcttcatttaaacgaagtgggatagctttaatcgtttttaaattttgagtaatatcttcacctgttacaccatcaccacgtgtcgccccttgaatgaagcgtcctttttcataatgaagcgaaacggcaagcccgtcaatttttaattcacatatatatcttacattcgcaccatcaattccttgacgtactcttctgtcgaaatcacgtaaatctccttcgttaaatgcatttcctaaacttaacattggtgacttatgtgttactttttcaaatatatcaagaacagtccccccaacgcgaacggagggagaatcttcactcataaactctgggttctctgcttctaattttataagctcctgcatattacggtcatattccgcatcagaaacagaaggattgtctaatacgtgatattgatagttaaatgtatttaacaagtcacgtaattcttctatacgtttttttactatctcttttgacatatcctcattcctttcctattgtttcgtcacaggcgcaaattttgctaacaaacgtttaacaccaattgggcttgggaacgcaatatctaattcttttgcatcaccttcaccttttacacttacaactgtaccgactccccatttttggtgggaagctttatctcctactgcccagccaatttgttcgccgcctgtcgtcttagctgcagggcgcgcgaaagctgaacgagagcgtgttgctgttgtgattgtcgttttgccgctacttgccgttctgccttttgtaccaaacgatgtttcacgcttcggcgctgtttcatttaatgattccactagttctgtcgggatttctgtaataaatcgagacgcagcgttcatacttgttctaccaaataatgtacgcatttgcgcgttagataaatatagctcttcttctgcacgagtaatacctacataagcaagacgacgttcttcttgcatttcatcctcttccataagagaacgagtatgagggaatatcccttcctctaagccaacaataaagacaaccgggaactctaatcctttcgccgagtgcatcgtcattaaaataacttcttcaccagcagttgggtcttcatctacacgatcaatatcagcaacaagtgctaaatctgttaagaatgcaacaaggctcttatcttcgctttgagattcaaatgtttgcgtaacagataagaactcgtctaagttttctaaacgaccttccgcttctaaagaacgttcatttttcaacatatcgcgatagcctgttttttcaataacttcttctactaattctgtaacagataaatactcttgcatatttacccagttatttaataaattcgcgaattcttttactgcctttgtaatttttgcacttactccaacatgctcaatctcatcaaatacagcagttaatgaaattccattttgcacaccgtaattaataattttatcgatagaagtcgcaccaatgccacgctttggcacatttataatacgtgcaaaactaatttcatcatctggattaccgattaaacgtaagtacgccaaaatatctttaatctctttacgatcgtagaacttcgtacccccgacaattttatacggaatgttagatttaaggaaaatctcctcgaccatacgagactgagcattcgtacgatatagcactgcaaaatcagtatattttcgtttccccatttgaatatcgtcacgaattttttttgcaacaaaatacgcttcgtccttttcagttgcagcacgataatacgagattttacttccaacttgattgtctgtccataatttcttcggcttacgattcgtatttttttcaataacagcattcgctgcatttaaaatattttgtgacgaacgatagttttgttctaacagaattacttgtgcattctcatagtctttttcgaatgacaaaatgttagaaatatctgcaccacgccagcgataaatagactggtcagagtcacccacaacacaaagatttttaaaacgcgctgccaaatgtttaacaagaagatattgcgctttgttcgtatcttgatactcatcaacatgaatatattggaacttacgctgataaaactctaatacttctggaacacgttcaaatagctgaatcgtcgtcataattaaatcatcaaagtctaatgaattatttttcaaaagacgtttttgatactctgtgtatacatcgctcgttaatttttcatatggatcagccattgtaattttttttgcatatttatccgcagataacagttcatttttcgcattactaatacccgctaaaatagagcgcggctcaaatttcttcggatcaacattgcgctctttcataatttttttgactacagttagctgatcacctgaatctaagattgtaaagttacgattaataccaatacgatcgatatcgcgtcgtaaaatacgtacacacatagagtggaacgtcgaaatccaaatatcttctgcttctggtcccacaagtgtatcaatacgctcacgcatttcacgagctgctttatttgtgaaggtaatagctagtacattccatggtgctacacctttttcaccaagtaaatacgcaatacgatgtgttaacacacgtgtcttaccactacctgcacctgccattaatagaagtggtccattcgttgtttgtactgctttttgttgctgtggatttaaaccgtttaataacttatctgtcatactcatatacgcctgcacctactctccttttactgctttaactatttttaacgccgattttatatcatcataaataatatttccaacaactactgtatcagcatattgtgccatttctttcgcctgttctgcattagaaataccaccgccataatataacttagcttgtttcaattctgcttttacatttttaacaagttcaacatctccatacgtaccgctatattctaaataaaatatcggtaaacgtaatagcttgtctgctaaacgagcatatgcaataacgtcatcttctgttaaatcacatttcgcttctgtaagctgggctactttcgcttctggatttaaaacacaatacccttccataaaaatttcgtcccagtccataatatccccaaattctttcaatgcctcatgatgaacacctgttacccattctacttttcggctatttaaaacacttgggatgtaataaaaatcaaatcctggtgtaattgcttctacatcagaaacctctaatacacaaggaactgcatatctacgaatgctaactagcatgtgtaatacgttatcaattgtaactccatcacttccgcctacaataaccgcatcagttccagactcacaaatcatttctaaatgttcatcgcttaactccttatttggatcaagcttaaatacatgtttccatccggaaatatcgtacatgaaaacacccttccttttctctagttatatatatttctgttcaaaataacagtttattttcatcattattgttttaacttcatcttaaatatttgtttaaaacggagaattaagtttggaattacctcttccatattttttaaactagaggatttaattttgaagttccttttatgcattctttcattataacaaaaaaagttacttacacacacgcacaatccaacatctttttccacgtcaaatgttggattacatatcccaaaaatcaaacgggatactaataagagaaatagtattatctatttcaactttcataaaaaggagtgtttttctaatgaagcaaaatatcgggacaataaacgctctaattcgaattacacttgggctcgtcctcttcggatgtagtgcaactaaacttgtacgcaagccgtggtgcacttggtctaacatttttctatggattggtgcaatgaaagttgcagaaggaattgttcgtttctgccctgttgttgaaatgtggaaattcggaaaatacatgaatatgggggcatttaaaatgcctagcatgaattttggtgaaaaaggacatgctaaagaagaagtgaatcaaacttccactcatgacaagccagagtcaaaaggaagttatgacgcttctgacaaagagattgagtcagcgattgaagatataatcctggcaaaaccgctttgaatcatttgtcacgatgcaagatgctctcaaagggacttagctgctgcagtgggcggttaagtcttctttattttactataaaacagaacgtatattctctttttgaaccttaaaatgtatataaaagatatcaaccaataaaattcagaaaattagatgcatacctcttgcttaaaatgatataaaagtgatatcatttttatatcaggaggcgatcatatgaaagaaaaacaagtattttatgtaaatggttttctcggtattattggaattttgattttagctgctatcggtgtatttttccttgcacaagaaattttcataggagcggcactaactattatattagccgcagttctcgctacaggtatcggtattgttcaaccgaatcaagcgaaggttattacgttcttcggtaattatttaggaacaattcgtcaaaacggtttatttttaacgattcctttcgcattccgtcaaactgtatctttacgtgttgaaaactttaacagtaaaaaattaaaagtaaatgacgttgatggaaatccaattgaaattgcagctgttatcgtatataaagttgttgattctgcaaaagcaatgtttggtgttgaacattatgatcgatttgtagaaattcaaagcgaaacggcaatccgccatgttgcaacaaaatatccttatgacaatttccaagatgaaacctgcgttacgttacgcggaaatactgaagaaatctctgaagaattaaaacgtgagttagaggcgcgtcttgaaattgctggtgtagaagtattagaaactcgtttaacgcacttagcttacgcaacagaaattgcccatgcaatgctacaacgccagcaagcaaaagcagtattagctgctagaaaagaaattgttgaaggtgctgtgaagatggcgaaagattccatccatatgttagatgaagaaggcgtactagaactcgatgacgagcgtaaagcaaatatggtaaacaacttattagttgccatcgtttcagataaaggtgcgcagccagttattaatacaggaagcctatactaagggctataagtaattatggctaaaaagaaaagctttccattacgtattgatcctgaattacacgcagtcatcgaaaaatgggcaaatgatgaatttcgtagcgtcaatgcacacatcgagtatttacttcgagaaatggcaaagcaaaaagggaaattaaaaaaagatgaagatgcataaaaaatcccgctgattcctcagcgggatttttacatattaacttttcgtcatctcatgcccaattgcacgatatcctatatcacttcgataaaatagaccatcactctcaattttaccgatttctttatatactttatcttttgcttcttgtaaactatttgccttacaagcaacaaataatacacggccaccgttcgttacaaagtccccatgtttcattgctgtacctgcatggaaaacaatcacatcttgcagtgcatctagtccgctaataatatcaccttttttatatgcttctggatatcctttagaagcaagtacaacaccgattaccgcttcttctgaccattgtaacgttagttcactttcatctaatacagcgttacatacatcaactaaatcgttttctaatcgaggtaatacaacttctgtttcaggatcaccgaagcgtgcattaaattcaattaccttcggaccatcatttgttaaaataagacctgcgtataaaatacctgtaaacgaacggttttcttcaatcatcgccttagcagttggatgcaatacggtttgaatcgcttcttgaactgctgtttctggaatttgtggtactggagaatatgcacccattccgcccgtatttggacctttatcaccatcaaaagctcttttatgatcttgggcgattatcattggatgtacagttgttccattcacgaatgccattaatgaaaattcttgtccatctaaaaactcttcaataacgaccttcttacttgccgcgccgaatttcacatcttgcagcatttctttcacagcttgtaatgcctcttcaagcgtcatcgctaccgttacacctttaccagcagctaggccgtcagctttaataacgattggtgcaccaactttttgaatgtactgtactgcttcttcataatctgtaaaagtttcgtacgccgcagttggaatatcatactttttcataagctcttttgtaaaagctttactaccttcaataacagcagccgctttattcggaccaaatacgcgaagtccctcttctttaaaacgatcaacaattccattcataagcggaatttctggtccaacgaaagttaactcaacattattctcttttgcaaataaaactaatgcatcaaaatcattttcatcaatatcaactggtgttgcaacatctctcataccttcattacctggtgctacatataccttttctactttttcagattgtgcaaacttccaagctaaagcatgctcacgcccaccgcggccaattactaaaacattcatatttcatcccccaataattaaataagtacaaactagaagctatgctcctagtttgctttttcatatcaataaaaggttatctcgaccagactttttaaacatccatatcaataaaggtttaaaaaggaggattaagagaaccgagcaggtctaggcgcatttgccaggaggacacggagtgtagctttcctacatgagtaccgcactggcgatgcaacgacgacatgcgaaggttatctcgaccggactttttaaacatccatatcaataaaggtttaaaaaggaggattaagagaaccgagcaggtctaggcgcatttgccaggaggacacggagtgtagcttttctacatgagtaccgcactggcgatgcaacgacgacatgcgaaggttatcttaaccggactttttaaacatcctctattagtgtttgaaatgacgtacgccagtgaacaccatagcaatcccataagtatctgccactttaatagaatcttcatcacggattgatccgcccggttgaatgattgctgtaattcctgcttttgctgcttcttctaatgtatctggcattgggaagaaagcatcagatgcaagcgcgctaccttgtgctttttcaccagcttgtgtaattgcgatttttgcagaacctacacggttcatctgtcccgcaccgacaccaattgtcatgtcatctttcgctaaaacaattgcgtttgatttcacatgttttacaactttccaagctagttttaaatctttccattcttgctctgagggttcacgtttcgttggaattgaaattgtactttcatctaatgataacgtatcttcctcttgaacgagaagtccaccttgtacagaagttagttttttgcttgcacttgtcgctttttcaatatttatagttaataaacgtaagttcttcttactttgcaacacttctaaagcttcttgcgagaacgaaggtgcgataacaatttctaagaaaatttcatgtaacttttctgctgtagctttatcaatttcacgatttgctgcaataataccgccgaagattgatactggatctgcttcataagcacgagtatatgcttcgtgaatattagttcctactccaacaccacatggattcatatgctttactgctactactgctggttctgtaaattcttttacgatgctaagcgctgcgtctgcatcattaatattgttatacgataattccttaccgtgtaattgttctgcgtatgcaacagaagacgttgctgcgaatggcgctttatagaaagttgctttttgatgtgggttctcgccatagcgtaagtcttgctttttctcaaatgtcacagttaatgtttctggactttcttcacccatttgctctgttaagtagttagaaattaacgcatcatacgctgctgtatgacggaatactttcgctgctagtttacgttttgtttcctctgctacttcaccgttctctttcagttctgctaacacaatatcataatctactggatctacaattaccgatacgaatttatgatttttcgcagcagagcgaatcattgttgggccaccgatatcaatattttcaattgcatcagcaaatgttacatcaggcttagcgattgtttctttaaatgggtataagttaacaacaacaaagtcaattggctctatacctaactcattcatttgtgttacatgtgtttcattatcacgaactgctaatagaccaccatgaatatttggatgtaatgttttcacacggccatccataatttcagggaaaccagttacttcagaaatgccgattacttgtaagccattttcttctagtaactttttcgtaccacctgttgaaataacttcaatcccttgttctagtaaccctttaacaaattctactactcctgttttatctgaaacacttactaatgcacgctttttcatttatccttcacccctggttgtatgttagttaacagttgattctttcacagactgaacaatttgattcactgtatttacgtataatttatgttcaacttgttgaattttcttttgtaagctttctctcgtatccccttcagaaacaaccactgcttcttgtgcaataattggccctgtatccatacctgcatctacataatgaattgttactccagttactttcacacctgcttctaacgcttgaccgacagcatctttacccggaaagctcggtagtaatgatggatgaatattaataatcttcccgccgtatgcttctagtaacgtcggcccgattaaacgcatatatccagctaaaataacataatcaatttcatattcttctagcttctttaatatctctttttcaaacgcttcttttgactcatatgctttcgctgaaaaagcaaaacacggaatatgatgataatttgcccgtccaacagctcgtgcttctggtttatcacatactaataaactaatttctgcatccaatcttttttcttctaccgcattaacgagagattgaaagttagatccacttccagaagcaaaaactgctaatctactcatagtgctgtgcccccattaaaagtaacgccagctccttgtatagtacgtccaataatacgagccatttctccttgctcttcaagaagacgaacaacatcttttgcatcttcttccttcactgctactaccataccaatacccatgttaaaaatattgaacatttctttctcttccagttttccaacttcttgaagcaaactaaagatcggctgaatttcccaagatcctagttcaatctcagcaccgattccttctggcaacatgcgtggaatattttcaataaatccaccacctgtaatatgcgccataccgtatacttcatgtttcttcaatagttctaaaataggtttgacataaattttcgttggttttaataattcttcaccaagaggtagttctaagcggccataaatacgctctaaagatagttccccatcttctaataacacttttcgtactaaagagtaaccattgctatgaataccgctagatgctaagccaattagcacgtgaccagcttcaatcttttcacctgttacaattttctttttatcaacaatcccaactgtaaaaccagctaaatcatattcttccgtagaatacattcctggcatttcagctgtttctccaccgattaatgcacaaccagcttggcgacagccctctgatatacctttgacgatgttttcaattttactaggttcagctttaccacaagcaatataatcaaggaagaaaagcggctctgctccttggacaacaatatcatttacacacattgctactgcatcaataccaattgtgtcatgtttatctgccataaaagcgagcatcaatttcgttcccacgccatctgttccagatactaatacaggttcttctaatgcaaattttgatagatcaaacatacctccaaaaccgcctaaaccgcctagtacttcttttctcatagttgtttgtacgtgttttttcatgcgagataccgcttcatatccagcttcaatatctactcctgcttgcttatatgcattcgccatcgttatttacacctcgtcttttaatttctccccatccagggcgggctattttaagaaaggatctagctcctacatcaaaagaagtagaagcttttctcacttttcttatttcatactttctaaaagctcttgctcataatcataaagagctgttggatagtccccattaaagtaagccatgcataggccgccatatttcccttcatatggacgcccaattgcatctactaatccatcttcgcttaaaaatgttaaagaatctgctccgatcatttcacggatttcttctactgtatgatttgctgcaattaattcttttctcgtttgaatatcaatgccatagaaacatggatatttcagaggtggtgaagcaattcttacgtgaacttctgtcgctccagcctcacgaagcatacgaacaattcgtttacttgtcgttcctcttacgatagagtcatcaatcataacaactcgtttcccttcaactacacctcttactgcggaaagcttcatcttaaccccttgctcgcgcagttcttgagaaggttgaataaacgtacgtccaacgtaacgatttttaattaatcctaactcatatggaatacctgtcgcctccgcatagccaatcgcagctgaaatactagagtctggtacaccagtaacaacatctgcttcaataggagcttctgccgctaaacgtttccccatattcttacgtgctgcatggacgttaacaccagcaatattagaatctggtcgtgcaaagtaaatatattccatactacaaattgcatgttctacatcgtttgtgaaacgatctacgtgaattccttcatcattaatgataagtaattcacccggttctacatcgcgaatgtatgttgcacctactacatcaaaagcacatgtttcagatgctacaacgtaagcatcccccatctttccaattgaaagcggacggaacccattcggatctaatgcaacgatcatttcatttccagttagtaaaagatacgcaaacgcacctttcactttatttaaagcctcttttacactttcaattaaagaatctttcgtgctacgtttaataagatgtaaaagtacttctgtatctgaactagtttgaaaaatactgccctctgcttctaattcacgacgaagcatttttgcgttaattaaatttccgttatgagctaacgccatactatgatcggaaaaacggaacaacaatggttgaacgttagcaacttcacttccaccagctgttgcatatcgtacatgtccgattgctgattttccatttaatccttctagctcacctcttgaaaacacttctgatattaaacctaaccccttgtgaccgacgattttttccccattatttacgacaatgcctgcgccttcttgcccacgatgctgtaaactgtgcaatccgtagtatgaaacttgtgctgcattttcatgcccccaaattccgaaaacgccacattcttcgtttaacccctttatttcagcaagcatgggattgcccctttccaagcctttctcatttcatctacatttgctgtaagtaatacttcattttcttcattatgaattgttacttcatttgtacttgttacttctccaacttggattgcttctactgctttctcaaacgcctctttattttcacgttttacagttatcacgaagcgagactgtgattcagcgaataatgctgctgttgcttctccatctaatttcacagtagcacctaagcctttagcaccaattgcactttctgaaatcgcaactgctaaaccaccttcagcaacatcatgtgcagattgaacaagaccagcttgaattgcttctaatacttgtttttggcgttttaattctacatctaaatcgatacttggtgattgaccgaaaattttgccgtgaatcattttctgtaattcacttccgccaaactcagctttcgtctcaccaattacatacactaaatcaccagcttgcttaaactcttgtgttgttacatgttttaagtcatgcacaagtccgaccatcccaacagttggtgttggatatacagcttcaccactacgctcgttatacatcgatacgtttccgccgataactggtgtttgtaatgtgcgacaagcttcactcataccgtctactgatttctcaatctgccagaagatttctggtttttctgggttaccgaagtttaagcaatctgtaattgcaagtggctctccgccagaacatacgatattacgcgctgcctctgctactgcaattttaccgcccatctctgggtctagataaatgtagcgagagttacaatctgtcgtcattgctaatcctttttctgtaccgcgtacacgtacaactgcagcatctgaacctggcgtaacaactgtgcttgtgcgaacttggtaatcgtattgatcgtatacccactctttacttgcaattgttggttgctgtaataaagcgaataacgtttctttataattttctacttttggcgtttccattttcattgcttggaattcagcaaagtatgctgcttcttttgatggcttatgataaattggtgcttcttctgctaaagcatctgctggaacttcagctaccttttcacctttatggaataaacgaagcattttatcttctgttactttccccatcgtaaccgctgcaagaccatacttctcaaataaatctactatttcttgttctctaccttttttcacgacaattaacatacgctcttgtgattcagatagcatcatttcatatggtgtcattcctgtttcacgctgtggtacatcatctaagtacatttcaatacccattcctgctttacttgccatttctgcagatgatgatgttaaaccagccgcacccatatcttgaattccaacaagtgcatcggattgaattaattctaaacacgcttcaataagaagcttttccataaatggatcccctacttgaaccgctggacgtttcgcttctgagctttcagatagttcttccgacgcgaatgttgcaccgtgaataccgtcacgaccagttgatgctcctacgtacattactgtgttaccagcaccgtgcgcttgcccttttttaatgtcttcgtggttaatcaaacctacgcacattgcatttacaagtggatttccttcataacatggatcaaattgtacttcgccgccaacagtcggaataccgatacagttaccgtatcctgcaattcctgctactacttcttcgaataaatatttcacacgtggtgactgtaattcaccgaaacgaagtgagtttaatagagctaccggacgtgctcccatagagaatacgtcacgaataataccaccaacacctgttgcagctccttgatatggttcaatagctgaaggatggttatgactttccattttaaatacaactgcttgattatcaccgatatctacaattccagcaccttctccaggtccttgcagaacgcgctcacctgtcgttggaaacttacgaagaactggtttcgaatttttataactacaatgttcagaccacattacagagaataaccctgtttctgtataatttggcagacgacctaaaatcttttcaaccatggcaaactcttcgtctgttagccccatttccgcatatatacgctcttctttaatttgtgttggatttggttcaagcattaacgacatatgtttccctccactgttttaagatagattgaaagacttttaacccttcagcaccaccaagtaattcatctacagcacgctctgggtgtggcatcataccaagtacatttcctttttcatttacaataccagcaatatctgaaacgctaccgttagggttttctacgtaacggaatgcgatttgattgttctcttttaattgtttaagcgtcgcttcatcacaatagtaattcccctcaccatgcgcgattggaatattaattacttcatcttttccatattgtgatgtaaacatcgtttcattattttcaacacgcaactgaacagtgcgacacataaattttaagttttcgtttctcattaacgctcctggtagtaatcctgattcaacaagaatctggaatccattacatacacctaaaatcggctttccttgctcagcagctttttgcactgctttcattgcattagcaaagcgagagatagcaccgcagcgtaagtagtcaccataagaaaatccacctggtagtagaattgcatcatattcatctaaattctctgtatcgtgccaaacgtaatctacttcttcgccaagctcatctttaattgcatggaacatatcgacatcacagttcgaacccggaaatactattacggcaaatttcactgtgcgacaacctcctcaacttcataacggaagtcttccattacaacgttcgctaatagtttttcacacatttcctttaccttgctatctaaatcagatacagatttatcaattgttagttccatgtactttccgattcgaacatcttgtacttctgtgaatgaaagactatgaagtgctccttttactgctgttccttgtggatctaatacgctttctcttaatgttacatataccttaactttatacatgtgaaattccccctaaacgttttaaaatctcttcataagcatctgttaaatttccaagatcgcgacggaatacgtctttatcaaacttttcattgctcgtttcatcccataaacggcaagtatctggtgaaatttcatccgctaaaatgatttctccttcttccgttacaccaaactctaatttgaaatctactaatcttacacgacagcttgcgaaatgatcaatcaacacttgattgatttgtagagccatatctcgtaatacgcttacttgctctggtgatgcaacgtttaatacacgaatatgatcttccgttacaagcggatctcctaaatcatcatctttgaagtaaaattctacgattggttctgcaagtacagttccctcttccattcctaatcgttttgaaagacttcctgcaattacatttcttgtgacaacttctaaaggaataatactcacttttttaacaagttgttctgtttcagataacttctcatcaaaatgtgttttaattaccacttcttgtaacagtatgaacaataaagttgtaaattcattgttcaaacgaccaatccctgtaatcgtc

SEQ ID NO: 1383 - DNA, 19992 bp, Bacillus thuringiensis
atttttcgcatcaagcttcgctaatacttcagaaatataattacgtactgtacccggcgaaagataaagtgccttcgcaatttcgtttgccgtctttccttctttcgcaagcaacaatacttccttttcgcgatctgacaacggattttgctcctgccataagccaaacattaaatcttgggagacctctcgtttccccttcattacattacgaattgctgccgctaaatcttcacttgggctatcctttaataaatagccgtgcacaccagctttcattgctctttcaaaatatcccggccgtgcaaatgttgttaaaatcattactttgcatgatgatttttctttctttaacgcttcagcaacatctaatccactttgaatcggcatttcaatatccatgatacttatatccggttttaacgattcaattaattttagcgcctcttccccgtttgccgcttgtccaattacttcgatatcatcttctagatcaagcagagcccctaacgcaccacgaagcatccgctgatcttctgcaataataattcggatcatgccctcacctcatcttttcctgttctaataacaactggaacttttactgttaacaacgtccctggattgattgtacctagttcaacaaatccatcaataagagcaattcgttctttcatgccgcgaataccatttccatcatgattttgatctgttaaaccgattccgttatcttctactttcaaaatcagttcaccttgtgattctaatacagaaactgcgcaccgcgtcgccttactatgttttacaacatttgtaacagcctcacgtaaacacatcccgacaatattttgttcaattggtgataacgagctcgatcttgcttcttgcctcacttctaattcaatattagctgcttgtaagatcgcttttatttgctctagctcttcttctaccgtaatcatacgcatatcagaaattaattctctcagctgttttaaggctgtacgagaagtttgtgtaatttccttcgcttccgcacttgcacgctctggatttttcacaattaacttctctacaagctggctttttaaagtaataagagataacgtatgccctaatgtgtcatgaagatctcttgcaatccgctgccgttcttcacgttttactaagtctttaatttgctcgttcgcctcatctaattgatttcttaacatctttttctgattaaaattacgcataccaaatggcgtaagaagcattaaaataaacatcggaacgatatttactaaacttgtagttgttatttgattcatatttacaaataaaaatgctccaagcattataactaacgagcataacagcactcgaaatactttcttatttggcgcaaatcccatcgcacttgctgtgaaaaagccaaaaaatatcataaaaggattataaaataaagcaaataaaaagatgagtatcatttgaatgcatgcccataaaataaacgtcttctgaacaaaatatagctgacggtatgtgataataaaaagtatcaacataccgcttcctagcacaagcttccaccctgatgcttgtgctaaatggtaaattggaaataataaatacacaagccacatgtacggaaaaaatcccatatgttttggaaaaatctcaatcctcttcttctctatcatttataccgcttcctgtctttttcttatatatattgatactacaacaaatataaggaaataacctcctaataccgcgatattttcccatccaattgattttccagctacaatatcccacgcaccacttccaaaatggtatgttggtgtccattcaccaatcgttcttaagatttttgggaatacttcaatcggcatccataacccgccaactatagctaaactcatatttaaaatatttgctaagccagcagctgcgtccgccttcttaatggaacctattactgttcctaacgctaaaaatggtgttacccctaataataaccataaccccgcaccaatccattgccctaccgttaactcaacatgattaattagtatccctgcaataaaaataactaatattgaaaaagcatttactactgtttgagcgataatttttgctgttaaatatgctccctctggaagcggtgtaatttttaaaagatgtgtccatccttgccctttttcctgagaaagtctcacaccgaaactaaagagtgcagtccctacaatactgaaagttgccatcgaaattaaataatgtgctttccacgcatctccgttttgtggtacttgaacaacatttgtaaaaatgtagtaaaacataacgggcattaataatgagaaaaagataaataatttattgcggaatgtacgtaaaatttctattttgcactgcatccataacgctctcatgcgatttcctccttctgatttgcgacaaactgttcaaatgcctcatcaaggcttccacgttcaactgaaacatctgttacaggtaaactcctttgataaatggcttttaaagttgcatccgtatcctccgttgttaaaatgaagcgtccttcgtttgactttacttctgttacatttggtaattcctttagtaattttgtaggaatgctttcctttgagtaaaatgtaattgtttttctcgaaatcgttgctttcatttcgtctggtgtaacatctgcgataatctttccgttcgcaaataataagatacgatttgctaaagcatctgcttcttctaaataatgcgtcgttaaaataatcgttttcccttcacttgctaactttcgaatcgtttcccaaaacgttcttcgagacgtaatatccattccgactgtcggctcatctaaaaataacaaatccggatttcccgcaagtgcaagcgcaaagtttaaccttcttttttgcccacctgataatttctcacatctttgctttcgctctgattctaaatttgataactgcagtaacgtctctttctctataggattcgtataataactacggaataactcaattgcctcttccaccgtaatactatcaatgacacttacttcttgcagcatcgcaccgaggctattacgaacatctctatgctttggactctttccaaatatagagaccttaccttccgttggttcctttaacccaagcatcatcgacatcgtcgttgttttcccagcaccattcggaccaagcaacgctactatttcccctttatttacatgaaatgaaacattatttactgcgtttttatgtttaaatgttttagaaacatcatttacttcaataatcttttccatctctccacccccgctgtttcttatatttacattgtattccttggaaaacttaggaaacagtatgatgcgtcatgacatcgatatgacaattgtcatgtattctttatgagaggaatcaacccgcataccgcaagcgagtagcaggacgaaaataaacatgatacaatcggataagatatatattcgaggaaggacagtggttttcatgattattcgtaatgaacaagatttagaaggcttacgaaaaatcggccgcatcgttgcgcttgcacgtgaagaaatgaaaaaacaagcgaagccaggtatgacaacgaaagagcttgatttgatcggtaaaaaagtattagatgagcatggtgctatttctgcacctgaaaaagaatatgattttccaggtgtaacttgcattagtgtaaatgaagaagttgctcatggtattccaggagatcgtgtattaaaagaaggcgacttagtaaacgtcgatgtatctgctgcacttgatggctattatgcagatacaggcatttcatttgttcttggagaagacgaggcaaaagaaaaactttgccaagcagcggttgatgcattttgggcagcaatgaaaaaggttagagctggctcaaaacaaaatcaaattggtcgtgctgtttcaaacttcgcacataaaagtggatacaatgttattcaaaacttaactggtcacggcattggtcttagcttacatgaagcaccaaatcacattttaagttactatgacccaatggataatgcacttctaaaagacggtcttgttatcgctgtagaacctttcatctctatgaaagctgatcatattattgaacgtggtgacgacggttggacattcgttacacctgataaaagtcttgttgcacaatgtgaacataccgttgtcgtaacacgcggtgaaccaataatcttaacagaaatctaataccaaaaacggctgttttgtagatttattccacataaaacagccgttttttatttttgggaaaatatgtgaactagtgttgaactctttatcatttaagtatataatctttagcggaggttacttaagcttatctttactaaaaagatattgtaactaaggagtaaaacaccttctttcttattgtttaaacaggctcaaaaatgaccgtagtaacgtgttagtcgaatattctgtaatccttatatttctctaacaatgtaagaaactatcacctttcaacttcggtccactaatcgcacgactctctttagacaaaataaatgactattttcaaagtacatattgtcttcattctgaccaaaaccaaccctatctagatttttatttccacataactttaaggcaaaaataagccttcacaaagggatacactacattggttagtatgtatcgtaaaacttacctttataaccattcttttttactagatatacatgaaaactatctcacatataaaggtctgatatcattatttatatcagtatttttttcgacattttttgtcgaattgtgtatatttccatagaactgtgtaaatatacattttgttttacgttaaataatattgctttgaacataattctgtttgtctgagaacgcgtatagaaacggagggataacaaaaataaatagcttataacaaatacttttaatattccatttgttcatgtggaataagtccccaatggacaaatgaatgttcagaggaggaaaaatgaaaaaactttttaatgtatgtttaattgtattcgtactattttcgcaacttgctagttttccatacaatcaagtaagagcggaaaccttaacaggagattccttatttgacactgttgaaatgaaagatgcgacgaatcatattattgacgaatcaaaaaatcctaacaatttaataaagataggatcaaccattcaagtagaatacgcttggtcaataaaggatcaacaagttgcacacgcaaatgatacagcagtagttcaaataccacttgcattaaaagtatctaaagatttgcaaggggatttagtaacagatcaaaaaaatattggtcaatattttataacagctaaagataataaattaaaattaatatttaatgatcaagtagaaaatttgaaagacgctaaaggaaaaattaaagttgataccgtgtttaacccaactttaaaacctggggaaaaatcagttcaaatcgcttttcctttaggaacaatggttcagcctatatcagttcctgttcaagtagaaaactataaagaagatggcaccaaacaggatactaataaacaagcgcaagatccagtagctaaacctgttactgacaatccggagcaagatccagcaactaaaactgttactgataatccggaacaaaacccagcaactaaaactgttaccgataatccggaacaaaacccagcagctaaaactgccactgataatccggaacaaaacccagcagctaaaattgctactgacaatccagaacaaaagctatcaagcgaccctgctgagaatacaaattcaggtccaaagcaaataacaacaaacattttaaccggtgtaaagttgacggataaagacggaaaaccatttatagaggataaccgtccaagtacagattcccctgccaatattgagtttacatgggaacttttaaaatcaatgaatgtgaaaaatggagattactatatttttgatcttcctaaacattttaagatttacaatacaattaacagtcctttatatgatagtgaaaaccatcaaattggtaattttactgttacaaaagatggaaaagtcacgatgacattcaacgattatgttgaagagcatccagatgttgctggtaacctacaattaaagacagaatttaataaagctgaaattaaaggtacaacaacacaagaaattcctttcccgattaaagataaggatgtttctattacagttgactttaagcctaatgtacaaacagctacgaataaaaagggtttacctgatagaccaattaatacaaatgaaattaattggaaagtagagatgaacaaaacgaaagacacccttaaaaacgctgtttttaaagataacattccacaaggtacaagcttaaataaagattctattaaagtttattatttagaagttgatgttaatgggaatgtaacgcgtggtgcagaagccgagccaacagattacaatattatttcatcagatggctcaaaattggagattgctttcaaagattctatcaataaagcatatcaaatcgaatatgccacaaaaattactgatgaaaatattaaaagtttccgaaataacgttacgataacgagtgataatcaaaagcaacaaaacgcaagctctactgtaacggtttctcgtggtacacacttaaataaaacaagtaaatatgatccaaagacgcaaacaattgagtggacaattacttacaatggtgatcaaagagagatcaaaaaagcagatgcgattttaaaagatatttttgacgatacacacgaactagatgcaaattctattgttgtaaaaaacgcttcatataatgaaaaaggaacgcttgtaacaggagacgctgttaataattacactgtaagtaacaagaagaatggattcgatttacagtttaatgatgatattaatagtgcttatgtgattacctataaaaccaagccaactaataaagttatagaagatggaaaagtaaaaaataaagttacagctgataatgattcaagtaaagaaaatgaagctagcttcaagcagcaaaatattattaaatctaataataaagctgaaacaaattataaagacaaaacaacaacttggacaattatagtaaataataacaactatccattaaacaacgcgattattacggacacctttgatcatggtggattacaattaaaagataagaaactagaaattaaagacggaaattatacccttcaagctgggactgactatgttttagatgtaacagataaaggcttcaaaattactcttataggtacgtatcagtctaatatgacaaagacattagtcgtaaaatatacgacagactttgattatacaaagctagaaagtggtaaaacttcatttaaaaatacaggtaacctttcttggatagatacggattctaatccacaatcaaataaagttgaagctaatttcgattctgatactttcacaaaggcaaatggttataaatacggttcttataacgcccaaacgaaggaaattacttggataataggctttaactataataatgttgagattaaagatccttatgttatagacgtcatacaagataaacaaaagttagtgcctggatccattgaagtgcgcgatatgattttaaatggaaatcctgataatgcacaacctggtaatgctgtaccaactgagaaatatgaacttgaagaacctacagagaacaataaaaacaccctaaaggttcatttcaaacaatcaattaattcaccttactatattatctttaaaacaagccttgatggtgaacttatccaaggcacctacaaaaacgaggcagatttaaaagatggctctaaaatcgtaaacacccttacaggtgacactcaagtaaataaaggtggcagcttcgttactaaaaaagctgtgcaagacgacaactatattaattggagtatcgcaattaacgaaagccaatcaaccattgcagatgccgttgtaacagatgacccaaccgaaaatcaggtaattgtggaagattcattccacttatatcctacaactgttgatccatatggaaatttaacaaaagatacagtaaacgaattaaaagaaggaacagactataaactcaaaataacaacagacaataataccggaaaacaacatttcgaaattgccttcttgaaaaaaattgatcgagcttatattttagaatatcgctcacttattaatgcagacgataaagaaaaagtaagtaataaagcgaaaatcacaggcaataagttgacagttaaaaacacagaaactactgaaacgattgaagtgagaatgtcttctggttcaggcggaggatctgctactaaaggccgtggaaaccttgaaattataaaggtagataacgacaataaaaacgcactattagctggggcagaatttactttatacgatcgtacaggtaaaactgttatccgtaaaattacaacagacaaagacggtatcactaaatttaataatttaaaacgcgataagtatttattaaaagaaacaaaggctcctgaaggctatgtaattagctgggatttaaaacaagggaaaattgttgaacttggtacacaagagactacaacatataaacttgcaaataagaagtttgtcggtaaagtagttttaacaaagtctgatgacctgaataaaaacgtcacactgcaaggtgccgttttcacactacttgataaagaccaaaaaataatttcagaacacgaaaaattaacaacaaatgataaaggacaaattactgtagataatttaaaaccaggaacatactacttaaaagaaataaaggctcctgagcattatcaattagatgatcgacttattgaatttacaatcgaggaagatcaaacaacagtaattaataaaacggcccaaaacagcttaattagaggctcagctatcctaacaaaagttgataaagagggtaatactttagaaggtgctgtatttagtgtacgggaccaaaataacaaaagaattcctggttataccaaattaacgacaaatggtaacggacaaatcgaagcgaaaaatttacttcctggagagtaccaatttgttgaagagaaagcacctgaaaattatgaaatagataaaaaaccgcttaaatttacaattgataaaagccaacagaaagcacttactgttaccgcgacaaatcacctcattaaaggtggtgtcactttaacgaaagtcgatgatgtcgatggcactgcccttgaaggtgctgtatttaaaattgtcgatgcgaatgacgagaaacaagtaattcgtgaaaatataaaaacaggttcagatggaaaagttaccgttaaagatctagagcctggtgtttataaatttatcgaaacagaagctcctaaggattatacgttaagtacaaaccctatcgagtttacaattgataaaagccaacaagctcttgctactgttacggcaaataacagcttaaaaacgggcgaagttgaattattaaaagttgatgagtttggtgagaaaaaaccacttgaaggtgcagtattcaagcttgtcgatacaaataataatgacgtttccccttacactaacttaactactgataaaaacggtaaagttaaagttagtaacctacgtcctggtacgtataaatttattgaaatagctgctcctgaacattacgttttacgagcagaacctattaaatttacaatcgatagaagtcagaaagaaactctacttgtgaaagctgaaaatgctttaaaaccaggagatgttgaattaacaaaagttgatgatatcgatggtacagctcttgaaggtgctgtatttaaaattgttgatgctaatgatgaaaagaaagtcattcgcgaaaatgtaaaaactggtgcggatggtaaagctatcgctactggcttacgccctggcgattataaatttatcgaagtaacagcaccgaagtattacgacaaaaatacaaaaccaattaaatttacgattacagaaagtcaaacaactcaggctactgttaccgctaaaaacagcttaacaaaaggcggtattgaattaacaaaagtgaatgctgcagatgaaaaggaaacacttgaaggtgcagtatttaaaatcgttaatagagatactaatgaagatgttcgtacggaccttgttacgaatagtaaaggaatgctagttgtagatgacttacgtcctggtaactatgaacttatcgaaacaaaggctccaacttattacgatgtaaatgtagaaccaattgaatttacaatcgaaaaaggacaacaaaaactccttccacttacatttaaaaatagtttaacgaaaggaaaagttaaacttattaaagaagatgatgtggaaagtagtaaagctcttgccggcgctgtattcacattgcaagacgcaactggcaaagaaattatgaaagatttaacaacagatgatcacggagtattagttattcctgatttagcaccaggggattatcaatttatcgaaacaaaagcccctgaacattataaattagacaaaacacctattaagttcacaattaaaaaaggtagtaaggaagatcttcctatccctgttactgtaaaaaatagtttacttacaggtggcgtcactttaacaaaagttgatgatgttgatggcactactcttgaaggtgcagaatttataatcgttgacgctcatgatactaaaaaggtaattcgaaaaggtttaacgactgataaaaacggtaaaattactgcttctgatttacgtcctggagactatcaatttattgaagtaaaagctccaaaagactataccttaagcaaagaccctattccgttcactatcgaaaaaagtcaaaaagagaatattactgttaccgctactaacggtttaaagaaaggtgcagtaacattaacaaaaattgatgacatcgatcgtacgatgctcgaaggtgcaatctttaagattgtggatatgaatggtaaggaagttcatacgaatcttgttacagataaaaacggaaaaatttctgtttctgatttacgccctggagactatcagttcattgaaacaaaagctcctgagcactatgtattagatgaaacaacgattccatttacaattgaaagaagtcaaacgaaagagatcaatgttacaggcaaaaatgctttgaaaaaaggtagcgttgaactaacaaagattgacgatattgatataaatacaaaactttctaacgccgtatttaatttattagatgcagacggtgagctagttgaagaaggcttaaaaacaaatgctgaaggtaaaattgttgttgaaaatctacgtcctggtacgtatcaattcgttgaaacaattgctcctgaacattacgatttagataaaaaacctatcgtatttacaattaaaaagagccaaactgaaactcttcatatcactgctacaaatgctctaacaaagggtgcagttaaactttctaaagtagacgatattgatggcactgttcttaaagatgcagtatttaaaattgttaatatgaacggtgatgtagttcataaagaccttgttacaaatgaacaaggaataatcgaaattaacgacctacgtcctggtgattaccaattcatcgaaacgaaagctcctaagcattacgttttagatgaaacaccaatcaaattcactattgaaaaaggacagaagaaagttatttctttaactgctacaaatagcttaaaacaaggtagtatcgaattacttaaagttgatgatttaaacactcaaacaaaacttgccgatgcggtatttaatttactagatcaagatggcaaagtacttaaaacagatttaaaaacaaacagtgaaggtaaaatcgttatcgaaaatttacgtcctggtacgtatcaattcgttgaaataacggctcctgaacactatgatttagacaaaaaaccaattatatttacaattgaaaaaagccaaaaagatattgctaccgttactatgaaaaatagtttaacaaaaggcggcgtggaactttctaaagtggatgacgtcgatggcactactcttgaaggcgcagtatttaaaattgtggatatgaatggcactgtaattcgcaaagatcttgttacgaatcaacaaggtaaaattagcgtttctgacctacgtcctggtgattatcaattcatcgagacaacggctccgaaacactatgatttaaacaaagagccaattccattcacaatcacaaagagccaagctgatcctatctccgttacagctacaaatagcttaacgaaaggcactgtggaactttctaaagtagatgatgtagatggtactgctcttaaaggtgcgatatttaaaattactgatatgaatggtaacgacattggcactgagcttacaacagatgtacatggaaaaatttctgtttctgatttacgtcctggggactatcagtttattgaaacgaaagctcctgaacactataaattagatagtacacctattaagtttacaattaagaaaagccaaaaagaaaagctccaagttactgctacaaatagcttaactgagggtgctgtagaattaataaaagtggatgatataaatccagatacaaaactttctgatgcagtgtttaacatcatcgatgcgaaaggtaaaattgttcgcactgatttaactactgataaagatgggaagatttcagtttctgatttacgtccgggagattatcagttcattgaaacgaaagctccaactggctatgatttaaacgttaaaccaattcctttcacaattacgaaaggacaatctcaggttacctctgttacagccttaaatagtttaacaacaggttcaattgagttaactaaagttgatattgatcaccatggaacacttgaaggtgccattttcaatattttagaccaagatggaaaagtcatccgagaaggtttaaaaacagatcaacacggaaaagtaatcgtaaatgatttgaaacctggtaattatcaattagtagaaacaaaggctcctaaaggctatcaattagatgcatcaccaataaactttacaattgataaagcccaagctaagccactacaaattacagtttcaaataaaaaaattgaatcttcttcaggtggagatgacaagccaattactcctccaaataaagaagataacaaaggcaatgaaacatctgagaaacacgaaaacggaacttccgaagaaacatcgaataaaacagataacaaacagcaagatgatcgaaatacggataagcaccttccaaatacaggtcataaagaagaccctacacaaacagtaggtattgttcttctactagctggattattaagtattttagctacaaaacgcaaaaaaaattattaataattttttcacatccaatcaatctctcaattgattggatgtttttttatacaaaaaggacgatacataaagtatcgtccttttaacggggtgaggctgcccaaaagtacggaaaacctttgaacagcctcttattttcatatggatgccttacatatatcactgataataattatgaaatgcggaaacataattaccatcaactgattcaaacatgagaaatgaaaccctacagtggttccattcctctacataatctaaagtttgggtacactagattcatgcaatgtaggagctttcagagtagaaagcgaaccttcgtttaaaatgatagcatacatatctccctcaaaaatatgcaaatatgcatatatcgtttttttatttatcaatgtcagaatattgaaaaataaaaggtgtgaaggtaaaataaagtcattatccgtcttcttttgtcagtcagagagaatagaagaataggagaggaaaaaatgagaaaattattgaaacaaaaaatagtaagctctttgcttgctgtatcacttgctgttagcttagctccaattgggcaagcaaaagcggattccacgtcagaggttacacaaactccatctattacaaaacagattgatccaaaccgcgcgattgaacatgttcgtttcttatctgaaacaattggtcctcgccccggtggaacaaaatccgaagaatgggcttctcgttacattggtatgcagcttaaatcaatgggctatgacgtagaatatcaaccatttcaggtgcccgatcaatacgttggattcattgaatcacccctatcaacaaaacgtaattggcaagctggtgccgctcctaatgcactaatttctacagaagctgttacagctccccttatctttgttcaaggtgggacaaaattagaagatattccaaatgaagtaaacggtaaaattgttttatttgaaagaggaacgacagttaccgactataataaacaagttgaaaatgctgttagcaaaggtgcaaaaggtgttcttttatacagtttaattggcggacgcggaaattatggacaaaccttcaatccccacctaatgaaaaagcaatctatccctgtctttggtcttgcttatgcgcaaggaaatgcatttaaagaagaaatcgctaaaaaggggacaacaattctttccctaaaagcgagacatgaatctaaattaacatctctaaatgttatcgccaaaaagaaaccaaaaaagagtacaggtaatgaaaaagcagtcgttgtaagctcgcactatgatagtgttgtcggagcacctggcgcaaatgataatgcttctggaactggattagtattagaactagctcgtgcttttcaaaatgtagaaactgataaagaaattcgctttattacctttggttctgaagaaactggattacttggttcggattattacgtgaatagtctatcccaaaaagaacgcgaccgtattttaggtgtctttaacgccgacatggttgcaacaaattatgataaagcaaagaatttatatgctatgacatctgatggctctacaaactttgtaacagacgctgccttgcaagcaggtaaacaactaaataataacctcatcctacaaggtaaattcggttctagtgatcatgttccatttgctgaagctggtattcctgctgctctattcatttggatgggtgtcgatagttggaatccattaatctatcatattgagaaggtataccatacacctcaagataacgtattagaaaacatttcacctgaacgaatgagaatggcattagacgttatcggaacaggagtttataactcgcttcaaaaacctgttcctcaaactgaacagaaagctgcttaatcatttaaaagaccactgattttatgaactgaacccaaaaaattagacaaatatattaagcagctactaaggattgaactctgtattgcacaggggacaatccttttagttttgttttaattcttttgtgattgtagtaatgaatataagtttctagttcttgcttaaattgttccatactttcaaactctttaagataaagtaattcagactttaataagccaaagaaattttccatgactgcattatctaagcaatttcccttacgggacatactttggataacgttatgttttttaagcgactgatgatattgtcgcatttgataatgccaaccttgatccgagtgtaaaataggagtttccttatcattcaaacattgaaacgccttatttaacattttagaaacaagggaataggcaggtctatgttctatattgtaagctataatttctccgttatataagtctaaaatgggtgatagatatagttttttaccatgtaagtggaactccgtcacatctgttacccatttctcgtttggttttgatgcgtgaaaattacgttttaaaatattaggagcgaatttcccgacagtccctttatatgaacgatatttttttaatcgaacaagacattttaatcccaggatattcattaaacgtcgaacggttttatgatttaatgcatggcctcgattacgtaattccaatgtaatacgacgataaccatacctcccaaaattctcactaaaaatctctttaattaattctttaactttcttatatttatctggacgtttcgcttgtttcatccagtaataatacgtactacgagcgatattagcgactttcacaaggtcaacgaccttatatttatgccttaattcataaatcaattgcgctttgtcttggtctgtgatgttttcttcttttgaactaaggcattcaacttttttaaatagtcattttccatacgcagacgttcattctctgcttgtagcgcttctatagaaccttcaagaaatacttcgttttgttttaaatgttggagcttagctttttctttggccatggttagacgcccctttttctttgattttagggcatctaatccttctgtttcataagctactttccattttcggagtgtttcgcaagaaggaatattaaaaaaagcagctgtttctctcagagatgtcccattttcattcatataatgaattacatctagtttatactcgagagggtaagttgtatagcgtttttcaaacgccttttcccctgaaaattcaaaccgtttaatccattgataaagttctctaggatgaacccctatagaattagcaatggtttttccgccttccgtaccttctagatatcgttttactgcttgtattttatcttttgaagaaaatttagccataaaaaatgcacctccaattgttagttatgtgtctaacaattggggtgcacttcagtaatggtggtcttttttaaattggtaagattgtactaggttgagcaaaaaaatggaaccgaaaaagttatttctaatgaggatagccttcttatgatgaagtttcattcagtggatctgcaagcaaacataaaagaaggaaaaaattacgattttactttacgtggatatagagtacctatactttcatggtttccaaatttagatggtgccgaaccacaaaattagcactattctttaataaaaaatcctactcattttttaatgagtaggattttttattaaagagctatttcgtattaatttgtgccatcatttaatatgctatttttaaatgatttccaaatttgatgactaattatctaaatttctaaactctatacagcactatcaattaaacaattattaaatatatcttctatctaaaacatcgtattatcattagctgcttcacttggaatctcttgaattacatcccagtgttcgacaatctttccatccttgatacgaaatatatccactatagcaactcccttatcttgagaattagtacgagagtgtacatgaagagcaactgtatccccttcagctactacacgtttaatctctgcagaggaattaggatttttaacaaaatcctccttaaagaaatccatgaaggcttttcgtccatcagcaacaaaaggattatgttgcttataatcttcgctaacatatttagggataatatcgatattatgtttgttaaaaacttcattatagaaatcaactaccatctttttattcttttcattttcttttacttcttttgatacagaagcgacattttcgctctttattgagttccctttgttattaccggtggaagcttgatataccaaagtcgaaactactcctaaaataaatacagaaataattgttatgattaaatttttctctaatttcatatatacctacctcttctacttaaataagttttcttctataaaaagcttgaagaaggagaaaccttccccaaaatgtaatgtcagggataatgttaggaatttcatttatcctaacctccccctatacaaggcatattagaaacgattaactctaacttaatacctcattaacagttgcactgtccacaatttgaataaacttcttaaccttatcgttctcatcaaacttataaaggtgacaaaaatctgctacaaatgacttccctgtagttttatatgttccactatattttccataaacgataacagtattgttattaaaagcataaatttcatctttagcgctatagtcatcccattctgtgccaagacgttcatgtacgtttttcactacttcatctggacctatataagtacctgcatatggaaacccagcagcttctgtccaagatacattttcacttaaatacgttttgaacgcatccaatttcccttcgccagttaacacatacgtttcatgtaatagtttttgatatttattcatatcattaaccccaaggcatttcttttgttacaacttttgcacttaattctaatacacctttatttgcatagcctggatatgctgcttcaagttttgccacaaaatcttttgaagttccactttcctcagaagcttgaaccgccgttcttagataatccattgtcgcagtaagtgcttgattatttagggatttttcgattgatccatggctaggcacaattatgtcagcatgtaatgcttgtaatactttcaagttctcaatccatgcctccatagccgcttttgagctagtatccgctaagaatacatgtatttcgttaaatacatcgataccaccaattaatacttttagttctttattaaataggctagttctgtaatgatctaagcctactagttcaaatgttaacccctgaaaatcaatcgctttttctttaaatacttgaggtaataccacgttacttggtgcattttctccaagggcgtctttccaaacttttaatttccctaagacagaatgaacgatatgttcaacagtagactctgttgcatacgctatagcttctgggtaaacggctttaatgctctctaatccaaagtagtagtctggatccccatgaataataaagattttatctaaagataagttgttttttttcagatactcaacaatttctttcgaatcagattgagtaaattttgagtttattaaaaatgcatggtccggtttcttaacctaatgttggctgtgaccataaagcttttttcgtccgaactaaacaccgttaatttcacatctttttgatttgtatcgattgttttaacatagtatgttattctccttttgttaaagttattaactaattatcatatttttatcttgttccgataaaatctcccactcccatttatctgaaagtgtaatagtactagcgaatattccggagatcaatgtcaggtggcctaagataacatgtttgctactatatcctaaattttcttaatataaatttttaaaacgcgcttcaattttatccggcgtcattacgccaccaccaataggaataatttgattatccttttgtaaaagtaatgaaggatagctattaacaccaagctgtcgaactttattgaaatcattttggacatctattattgtttcttgagcgtttaaacgttctaacacttgttcagggtccaaaccatgctcgattgcaatcttgcgatatgtttcaggatcactcagactttggccctcataataaaacgctttttgcatagccgaagtgaattctaataaacggtctggcgctaatgagcgtaaagctgaaaagccaattgcagcatctttcgaattcattttaaaagtcccttcctccaccaatttttgatatgaaggaccaaattcagcacctgtaagttgattaattcttttatttccttcttctatatatgagaagtttttcattggtaaattatctaaaaataaccctccacataaaaccgttaatggtaattcagtgtggtttttgtaaaatcctttaatactttctgaaaaaccatagcgccaggcacaatatgcattccatacggaaataaaattatcttg

SEQ ID NO: 1384 - DNA, 26525 bp, Bacillus thuringiensis
catcccattatctatgcaaccatttttcgcaattttagcaggtcttcttcttggaagtagacttggtgccttatccatgactgtatatatgctcgttggcgtagccggcgcaccaatcttcgctaacttcaaagctggatttggagcacttttagatcctactggtggttttattatcgcatttattatcgttgcttacgtatccggaaaactagtagaacaaaaagaaagaccaacattcattacatttgcaatttcctctttcacaggaattattttaacttatataatcggtactacttacatgtacggggcagtcaatctctttatgggcggtaatatgagctataaagctgcttggatgattatgatgtggtttgcagtaaaagatattgcatttacaattatcggtgctattatcgcacctcgcatatattatgctgtgcgtcgttctgcttatcagcattctcattcgacgatttcataataaaaaaatgagttatttcagtatactgaaataactcattttttattatgactcttgattcgcttgttcttctaaaattttcttcatcattgcaaccatgtcatcacgtaattctgggtgttgcagggccatttcaattgtcgtttgaacgaatcctagcttttcacctacgtcgtagcgctttccttcgaaatcgtaggcaaatacacgttggatttcatttaagctttggattgcatctgttaactgaatttcaccaccagcaccgacatgttgctgttctaagaacataaagatttcaggcgttaaaatgtagcgccccataatcgctaagtttgaaggagctgtaccttgtgctggtttttcaacgaaattgcgaacttggtaacgacgaccttcttgttctaatggatcgataattccatagcgatgtgtttccgactccggaacagtttgtacaccaataacagaagaaagtgttttttcatactcatccattaattgacgtaaacacggtttctcagcttggacaatatcatcacctagtaacactgcaaatggctcatcaccaatgaatttacgtgcacaccaaacagcatgtcctagtcccttcggctctttttgacggatgtaatgaatatctaccatttttgaagaagcttgtactttttcaagcaactcatattttttcttctctaataagttttgttctagttcaaatgcgttatcaaaatgatcttcgatagagcgctttgttttaccagtaacaataataatatcttcgattcccgatttcactgcttcttctacaatgtattgaatcgttggtttatctactatcggtaacatttctttcggcattgctttcgttgctggtaaaaaacgtgttcctaatccagctgctgggattatcgcttttcttacttttttcatcacaaaataccctctctcctgtcggaatcaatagcaagcatttcctacataaaacaaaagggagatttcgctcccttttgttccttactacttaaaattactttgtattataaacgattcataatgtcttctttaatagtaagtaacttttgttcactattttgtaaagaactatcttttacaccaaagtaaaacttaatcttcggctcagttccagatgggcgtaggcagaaccatgaaccatcctctaattgatattttaacacatttgatttcggtaagtgaatctcttctttatgtccatcttgtaaagatgtaacgatgcttgctttatagtcttccactgctacgactgttaagcccgctacttctttcggcggattctcacggaacgttgccatcatctcttggattttttccgctccatcttttccttttaacgttaacgatacaaggtcttcacggaagaagccgtatttctcaaatacttctaatagaccgtcatataacgttttcccttgtgatttgtagtatgcagctacttcacatgcaaatagaacagattgtactgcatctttatcacggcagaatgggcggattaaataaccatagctttcctcataaccgaattggaattcatattgtccgctttcttcatactgtctaattttctcaccgataaatttaaatccagttaacgtatcaactgtatctaaaccgtatgcttttgcaattgtacgaccaatttcagacgttacgattgtttttaatacgacaccgttctctggaagcgttccgttttctttcttttgagatagtaagtaatcaagcattaatgcacctgtttggtttccggttaatacttggaactcaccattatgattacgcactgctacaccaagacggtctgcgtcaggatcagttgcgattaatacatctgcgcctaccttttcaccgtcacgaattgcatactcaaacgctgcgtgctcctctgggttcggtgattttactgtagagaagtttggatctggtaactcttgttcttttacaactgttacatctgtaaatccaacttcttttaaaccacggcgtacagaaatatttgatgttccgtgtaatggtgtaaagacgatttttaagtctttaccaaccttttgtaccatttctttattaatgatgacattgttcaattctgcagcatatgcatcatctacttcttgtccaataatatgtaataaaccgtcagcttttaattgctctacatcagcgacttcaactgttaattcatcttctactgcatttacgtagctaattaactcatctgcttcttttggaggtaactgtccaccatcttcaccgtatactttgtatccgttatattcaggtggattatggcttgccgtaagaacgattccacttactgtatgtaaatgacgaactgcgaaagaaagtactggcgttggacgtaagctttcaaacacatatgttgtgataccgcgtgcaccaagtgtagcagcaacttccattgcaaactcaggtgatttatgacgagaatcataggctacaacaacaccgcgttttttcgcttcctcacctaacttttcgataaagcttgctaatccttttgttgctttacgaactgtatatacatttaaacggttcgtaccagcaccaagttcaccacgcataccacctgtgccaaactctagatttttataaaagctatcctcgattttcttctcatcttgcttcatattttctagctgttcttttaattctgcatctaattgtgcgtaagaaagccagcgactaaattcttgtttccaattcattcttctctctcctctcgctcgtcatacctttattatatgaaaaaaacatgctgtatctcaatattttataaaatctaacaggattttactaggaatatttgtatacactattgttaaatactccactaaagggaatgaggattatgcacgaatggggcttgtcagaagagctcaaaatacaaacaaagcaaatgattgaaattgctgaaaaagaactatcgattatgaggaacgcaatcgataaagaagacgaatgtattttatgcaaaatggaagatattcatcatatgttagcaaatgtacaaacattggcagctacatactatattcaggcatatttatcaccttatacggaaagttcatcttttattacgacagctatccaacatttaagcgccagaaaacatggtgctcttatcgtcgtggaacgaaacgagacgcttgaagctctcattcaaactggaacgacattaaacgctcatttaactgcgccattactcgaatcaatattttatccaggtaaccctcttcatgacggtgccgttctcgtaaaaaataatcatattgtctcagctgctaatattcttcctttaacgaaaagtacagaagttgatcctgagctaggaacacgtcacagagctgcaattggcttatctgaaaagagtgatgcacttatattagttgtctctgaagaaacgggccgtacttcttttgctttaaatggggttttgtatacgatttctttataaagtgaaactttaatcagccctcaccaatcgagcgtttaccggcaatccgacctaactgctttcctttcgctgaattttgagttatgggtcttactacccggcaaatagtgggataaacaaacctataaaaaagaagactgttccaaaatatcggaacagtcttcacttatactcttattcttctccaaaacgctccacaagtgttgcaagtgtacgtaccattgcgccagttgctccagctggacctaagtcgtgcgcaccttttgtttctgatgttccagcgatatctaagtgtacccatggtgtatcttcagcgaattcgcctaagaatgtacctgccataaccgcatgtccttcacggcctggtgagttatttaaatcagcaaacttactgtttctcacacgttctttatcacgatcaaaaatcggtagttgccaaattggctcatctgtttccatagaagcctctagcacttgctcaaataactcttcattatttgtcattgcgcctgtcgtatagtttccaagtgcaacaattacaccgcctgttaatgttgcaacatcaacaaggtagtttgcaccaagttttttcgcatacgtaataccgtcagctaaagctagacgaccttctgcatccgtatttaatacttcaattgtttttccgctcatagatgtgattacatcgtctggcttaaatgccgtaccacttacaacgttatcagttgaaggaataacagcgatcacattttgttctgggcgaagttcaccgataatttccatcgcacctaatacagcagctgcaccgcccatatcacctttcataccaaccatgccttcacgtggttttaaagaataaccaccagtatcgtatgtaataccttttccaacgaacccaatgacatctgtccactcttcttttcctttataaataagagcaatcatttttggtggctctacactaccttggtttactgcaagtaacgcacccataccaaggtcttccatctcttctttctcaagaactttatagtccatatcatatttctccgctaattcaacagcatactcagcaagctttgtcgctgttaatacgtttggcggcatatttacaagtgtacgagctgaatttgttgcacgtccatgtacgtagccaactgttaatgctgcttcaatttcttgtgcatcttccgctgtaatagccgtgaacttctctaactctacacgatcctttttatctgatttatacgtttgtaactcatatgtaccaaggccttgtacctctgccgcaatatgagcgacatcaatcgcgtctaatttctctgttacgaaagaatcaagtaagattgctgcatctcgtacttttgctgcttgcagtgttttaaacgccttaccaagagccgcacgtaacgtttctgtcgtgtaagattctttctttcctaaaccaacaaagtaataacgtttcacatttattttccctaagctatgtactttcgaaatggcctttttcttcgtagataattctttctcttctagtaaaacttgtaattgcccttcaaacgctttgtccagttcttgtacaaaactactcattttctcttcttcaaataaagcaacaattaccgcttcatgacctgctaattctttttgtacttgaaacatgttcagaccccctaaatttctctaccaccattataactttattttcgataaaatgcgataattctaactacagttatatggcgtgtaaaatcgcagatccaaaatctcctctatcatgaaataagccaagaaaaaaagtctagcgtaattacgactagactatctttgttttaaatattgaccacgaaacacttgcatcgtttcgtcttgatttaacatcgttaactcttcttctgtaaatttaccatttcctacttttactacgtacacatttacttttttcttaccccattggctataaacatctttcaccgtatcataatatagatcaagacggtttccttttattgcaccgcccttatcagctactacaccatacccgtaacctggcacgaagagaatcgttccaatcgggaatacgcgtaagtccgcagcaattgtggaatataaatcccttttcactttgacacctgaatatgtaataccatactctggatgccctggcctcttaccagttgactcaatccccgatgtataacctgttgcagtcatttcaattgaacgatatttagaccagtcgtttgcctgctctaaagcatttatcacttctttactcggagcaacatttctcttaacttctgctgcatgtacttcttttgcactcattccttcatatatctttacaatctctaataaagaaactcctgtgaaagcattccatgttacgcataatgcaattgcaagtaaacaagtcatcataatgcgaatacaatatcgttttaacatttttatattccacactccttcatcgttaatcattccctatacgatgaaggaatatgcaaaaaaataatctccaacttaattggagattaaaacatttgatatccgcttttccgaagtttcttgattacgactcctgctaaagcagcccctactaatccagtagatagaataaatacgtctgcatgtcctaagtgcgatacacttgtcccaaatgaagaaaatgtttctttcggttttgaaaaataatcccacatactcgctttattaataataagcatacaaacaatcggatacacaataaccattacccaagtagctcgcaaaatcatgttgagtaaaaatccaattccaaagaacaaaataaagaataacatcattgaaataagtagtaccggtatactcactcttttcccctctccttcgcacgtgccgtaaatacgtgataagctgtataaccaaatggttcacctggatttaatgttttgtccacttcaagatgtagttctgatcttccttctaacaaatatttaataagcacagacgtattcggatcgtctacaatcttatccggatgtaagaacgccacttcagacaattctttctcctgtacaataatattttctccttcaggttccaaaaggaaaataatcatattatcactaatctcattacgaataacacccgatcgaacaccaataatccccttcacatgagcgacaatgcctgtctcttctaacacttcgcgtttcacagcttcatcaaccgtctcaccttcatttacaaaaccagccggtaaagaccatttcccttttaatccactgtatttcttcttaacaaatagccacctaccatcttttgtagctactaaaccactaacagctagccataccttccctcgtttctccatgatgtaataacctcctccatcagaacggacagaatattctttcttttttatatattatactatatttttaatatgaaaaaagcagaaacagctcttagccgtttctgctttttctactatatattaaaagaactttaatttaccttttttaagaactaataaaggtccacctaataagaataggtaacggttatcgattactttcttcatgaaggaagctttccaacctgttaactttttacccataacaacgcccattgcatcgtcatgacctaaagaacatacagatcctttattatcgaatgcgaatttcttcatctcgcccttgccacgaactaatacagttaagttgtgtgcaatattgtaaccttgttgaattgcaatttgtgctgttggtgggtaaggacggttaatttcttcattaataattaacgctgcgtcaccaaccatgaatacatcttcgtatcctggagcgtgcatgtactcatcaacttttacacgtccgcgcattgcttcaaagccagactcttccacaataccattaccacgaacacctgcagcccaaactactgtttcagacttaattaattcagtgtcatcgccattcgcaacgataataccttcttcagttgcttctttaattgctgtaccgatgcggaattctacaccttttttctcaagctgttttacagcgtattctactaacgctggatcaaaacctggaagtgctgttggagcagcttctacacagatgatacgtgctttttcacgtggtacattatactctttgcaaagttcaggaacacggtttgcaagctcacctacgtactcgataccagtaaatccagcaccaccaacaacgattgttactaactcatcgcgttgttcagttgcatatttagagaaactagcttccatatgctcacgaatttcacgagttgcattaatgttagcgattgagaatgcatgctcttttaatcctgtaattccgaatgtttctgattcgaaaccaagaccaattactaagtaatcatactctaactcgccatcttttaagataatgcgtttttcagcagctttaatttctactactgtgtcttgtacaaagttcactttatttgtatcaataacgtcttgaatatctagacagattttttcatcttgtaatgtaccagctgcgctctcatgtaaccaagtcgcttggtagtgatagctgttgttgtttactagcgtaatttcagcttcatttacagataatgctttttgcagacgaacagtcgtaatcatcccgccataacctgcacctaaaactacgatttttggagtcttcaccaaatcacaacccttttctttatataatagtaataaaaaataataccaagtactaaaaactctatttgtcaagaatgtggaatttatcacattctatatcataacaaaacgcagtcaaaaaatcgtacgaattttgtcatagaaatttaacataatacttccctatattagtcggttttattccagaattcaagcgtctggagaattatcaatattttaaaataacatagcgttttcaagggttttttagcctttttttcatgtattttcctttctgtatattttatacaataaaaaagaacctatgcgaaaacttacacacaattcagtcgttttcagaagtattatgaactcaaatatgctatcatttatttgaaagtgtcatcatttgcaggattttcgtgtacatatgaacaatatatgaaatcaatatcaaaattccatctatagggggaatgaaagtggcagaaaatcaaaaagtttacgacataacaattattggtggtggtccaacgggactgttcacagcattttatggcggtatgagacaagcaagtgtaaaaatcattgaaagcttacctcaacttggcggacaattatccgcactctaccctgaaaaatacatttatgatgtggctggatttccaaaagtgcgcgcacaagaattagttgataacttaaaagagcaaatgaagaaatttgacccaactgtttgtttagaagaagctgtcgatacgcttgagaaacaagctgacggtatatttaaacttgttacgaataagcaaactcactattctaaatcagttattattactgctggcaatggtgctttccaaccacgccgcttagaattagaaggtacagcgaaatacgaaaagaaaaacttacattatttcgttgatgatatgaataaatttgctggtaagcgcgtcgtagtatttggcggtggcgactcagcagtagactggacaatgatgttagaaccgattgctgaaaaagttacaatcgttcatcgtcgtgataaattccgtgcgcatgaacatagcgtagaaagcttaatgaattctcgtgcagaagtaagtacaccatacgttccagtagaactcattggtgatgacaagattgaacaagtcgttcttcaacatgtaaaaacggaggaaaaaattatcatcgatgttgatgacgtaatcgtaaactacggcttcgtttcttctcttggcccaattaaaaactggggcttagatatacaaaaaaacagcatccttgtaaattcaaaaatggaaacaaatattcctggcatttacgctgctggtgacatttgtacatatgaaggaaaagtaaaacttatcgcttgtggatttggcgaagcaccgacagcagtaaacaatgcaaaagcttacttcgatccaaatgcaaaacttcaaccgatgcatagctcaagtatgttttaatatgcaaaaataaagctccttccatacgtggaaggagctttccttttatataacataaaagcacactgagtccaataaactatcgaactcagtgtgcttttcgtctaaaaaattattgttttcttcttctacctaatacgaataatactccgccaactaagaatgaaattcccgcaccaactgacatcatccatgaatgtgctccccctgttttcggtaattctttttctacttttacttgcggttctttaattaacttttccagtcttacttccggtttctccggtttcacttctggtttcttcagatctttcggttcctccggtttcacttctggttccttcggctctttcggatcttctggcttcacttctggttcttttggttctttcggttcctccggtttcacttctggttccttcggctctttcggatcctccggtttcacttctggttccttcggttctttcggcccttctggcttcacttctggttctttcggttctttcggttctttcggttctttcggttctttcggctcttccggcttcacttctggttccttcggttctttcggctcttccggcttcacttctggttccttcggctcttctggtatcttaagatcttcttttgttttcggtaaaattgtaactgtaggctcaagtggtggatttattttatcgtccactaccgctctatttgttatccctttacttggtgctgcttttaccttcactttaaaaataatactacgttctttcgtatctgtaatttctagatactttgctattacttttccaaactccatttttaactctattggatttggttcagccccttcaaatctaatgctatcttgcacgtactctaaaccggctggaatttcatcttctacctttacctctgctagtttgccgttttctaccgtatttttgaaactaattcggtattctacttcttctcctagcttcggttctttattatttactgtcttcgtcgcttttaacttaccatctttatattctggctttattgtcgctgtcggttccataactggatgatctggatcatctacatgaatgatcgctttatttgttatttcctctccaacttttaccgattcttttacctttactttaaagatgatacttctttctttcgtatccgtaatttctggatacttcactgttacttttccattctcgactttaagttctgttggcacaggcttatcacctacggcctccagactttctttcacatactctaaaccagacggaatttcatcttcaatctttacatcaactaacttcccgccatctactgtgccgttaaaagtaattcgatattcgatttcttcccctagctttggttcatggttacttacttctttccttgcctctagtttcccatctttatattgaggtgtaattggtataagtgactcaactggtggatttgtcggattattatcatccacaaccgccttgtttataatttcttttcctacttgtaccgtttcttgtactttcactttaaagatgatacttctttttttcgtatccgtaatttctggatactttgctgttacttttccattctcaactttaagttctactggatttggttccggcccatcagactttatactatcctgtacgtattctaaaccagctggaatttcgtcctctacttttacctcagttagtttgccgttttctactgtattttcaaaactaattcgatattctacttcttctcctaacttcggttcatggttactcactgtcttttcagcttgtaatacaccctctttatgttgaggttgtatcgcgacattcggtttctctggtggatttatagtatcttccacaaccgccgtattcacaatcgcttcgccaattttagctttttctttcacttttgctttaaagacgatacttctttctttcgtatccgtaatttctggatattctgcgagtactatgccgtttttcacttttacatgcaacggttttggattatccccctcagctcttccgctaccttctacaaactctaaactgtttggtaattcatccttaattttcaccttcgctaattttccgtgctcaactacgttacggaacgtaattcgatactctacttcttctcctaattttggagctgggttatttactgttttctcagcttttatttttccattcttatactccggtgtaataatcgcttctggtttttgcggaggattcttcggattatcatcatccacaattgccgtattcacgattttcttcccgacttttactgcttctgttacttttaccttaaagataatgctacgctcagctgtatcagtaatattttcatacttcgctgtaatttttccagcttcttcttttaactctaccggatttgattcattaccttctgcttttaaactatccttcacatactctaatccatttggtagttgatcctcaattttcacttctgctagttttccgttttctaccgtatttttaaaactaattcggtactctacttcttctcctagctttggatcttttttacttacctttttattagctttaaatttaccagctttatgctgcggtgtaatatctacttctggtcgctctggtggattttttgtatcatcaacaattgctttatttacaattgccttgtccacttcaacggaatctttcaccttcactttaaagataatgcttctttctttcatgtcagtgatattttcatacttcgcactaaccttaccagcttcttctttcaactctactggggccggcttatcaccttctgcttttagactatctttcacatactctaaaccaaacggaatttcatcctcaattttaacctctgccagttttccatctttcaccgtattattaaatgaaattcgatattcgatttcttcacctagcttcggtttatgattattcacctttttatgagcagcaattttaccatctttatattgtggtgtaatttttgctgtcggatcaattactggatggttcggatcatcaacatggataatcgctttatttgtaatgtccttccctattgtaaccgaatcttttaccttcactttaaagacaatacttctttcttgcgtatccataatctctgaatactttgccattaccttaccattttctactttcaactccactggttttggctcttcaccttcagctttttcgcttccttctacaaactctaatccagctggaattttatcttctatttttacctctgctagttttccatctttcaccgtattattaaaaataattcgatattcgatttcctcacctaacttcggttcatggttacttacttcttttcttgcctcaattttcccatctttatattgtggtgtaatcggtacataaggctcttctggcagattctttgtatcatctacaattgcctcatttacgatttcttctcccacttttacgctttcttttaccttcgctttaaagacaatgcttctttcctctgtatctgtaatttctggatactttgccattaccttattatttttcacatgtagctctactggtttcggtttagaaccttctgccgtgatactgccctccacatactctaaaccatttggtaatgcatcctttatatttacctctgctagttttccgttttctaccgtgtttttaaaactaattcggtattctacttcttctcctagtttcggtttatgattattcgccactttctgcgcagcaattttaccatctttatattgcggagtaatttccacatgaggctcttcgggctcattttttgtatctactacgattgctttattaacaatctccttgcctacttctgcctcttcttttactctcactttaaagataatacttctttcttttgtatccgtaatttctagatactttgccattaccttgccgttttcaaatttcaattctaccggacttggtttagaaccttctgcttgtaaactgttctccacgtactctaatccagctggaatttcatcttctactgtaacctctactagttttccgttttctaccgtgtttttaaaactaattcggtattctacttcttctcctaatttcggttttttattgtttacaaatttctctgctttaagcttaccgtctttatattctggcgtaattgttacttctgaagttgttggatcttttgtatcatcaacaactactttattgacaaggccttcaccaactttaaattcttcttttactttcgctttaaagacgatacttctttcttctgtatccgtaatctctggatatttggcgattacttttccatctttcactttcagttctactggatccggcttagtaccttccgctcgtaaactatctttcacatactctaatccatttggtaaattgtcttctatttttacctctgctagctttccgttttctaccgtgtttttaaaactaattcggtattctacttcttctcctaacttcggcgtttcattatttaccgtcttcttcgcttccacttttccgtctttatgctgcggagtaatttctgccgtcggtgtttctggttcatttttcgtatcatcaacaattgctttgttaacgatttttttaccgactttcacttcttcctttactttcactttaaaagtgatacttctttcttctgtgtccgtaatctctggatacttcgccattaccttaccattttccattttcaattctactggatccggcttagtatcttctgctttcacactgttttctacatactctaaaccttctggtaaagtatcttctatttttacctctgctagttttccgtcttctaccgtgtttttaaaactaattcggtattctacttcttctcctaacttcggcgtttcattatttaccgtcttcttcgctttcacttttccgtctttatgttgcggaataatttctgctgtcggtgtttctggcggatgtttcgtatcgctcacaatcgcttcattaacaattgaatcgctcactttaccttttactttcactttaaaggtaatacttctctcttttgtatctgtaatctcaggatactttgccattaccttaccgttttcaaattttaattccactggatctggcttagaaccttctacttttaaactatctttcacatactctaatccatttggtaaatcatcttctattttcacctctgttagctttccatgttctaccgtatttttaaagctaattcggtattccacttcttctcttaacttcggcgtttcattatttactatcttttttgcttcaagttttccatctttatactgaggagtaatttccgctgtcggattaactggcttattttgcgaatcatcaatagttgctttattaatgatttttttaccgacttttacttcttcttttactttcactttaaaaacgatacttctttcttctgtatccgtaatttctggatattttgccattactttaccgttttcaaatttcagctctactgaatctattccggcaccttttgctttcaaactattttctacatactctaaaccttctggtaaagtatcctctactgtcacgtctgttagctttccgttctttaccgtatttttcatactaattcggtattctacttcttctcctaacttcggtgtttcattatttacgattttcttcgctttaatttttccatctttgtgtaatggtgtaattttcgcttctggttctttcggatctttcatatcatcaacaattgccttattgatgatttccttccccacttccgcttcttccttcacctttaccttaaagacaatacttctttctttcatatccgtaatattgtcgtattcagcaataacttttccatcttttacacttaactttaatggagctggtttatcaccttcagccttttcactgccttttacatactctaaaccgttaggaattgtatcctctattattaccttttctagttttccgttttctaccgtgttcttaaagctaattcggtattctacttcttctcctagttttggtgatggattatctactgtcttcttcgaatcaattattccatccttatgttgcggagtaattctttcctccggttcaatcggtggatttttcgtatcatcaacaattgctttattgacaatctctttatctacttttacttcttccttcacctttactttaaagacgatacttctttctttcatatccataatatcgatatacttagctttgactatcccattttcaacagctaattctactggttcaggtgcttctccttcggccttgatgctattttctacatattcaagaccttttggaattgtatcttccactcgcaccttttctagttttccgttctcaaccgtattatgaaaactaatgcggtactcgatttcttcgcctaactttggcttcttattattaactacctttgtagcagcaatttcaccttttttactttgcggtgtaataacaacctttgattcaacaggctcatttttcggatcttttgcaattgctttatttacgattgcctcccctacttttgccgaatcttttactttcactttaaaaacaatacttcttttttctgtatccgtaatttctggatacttggccattactttgccatcttccacttttagttctactggctctggttttataccttcagctttcaaactatctttcacgtattcaacacctttaggtagtgtatcttctactagcaccttttctagttttccgttttctaccgtattataaaatgtaattcggtattccacttcttctcctagttttggtgtttgattcgttacgcttttttctacatccactttaccgtatttataatccggcgtaatcttttcctctggatgctcagtttgtccatttggctcactcacaaccgctttattaacaatcgtttctcccgcttttgcctcttcttttactttcactttaaaggcaatgcttcgctcttttgtatccgtaatctctggatattttgcgattatcttaccattttctacttttaactctactggatttggtgcagcaccttcagctctcacactgccttgaacaaattctaagttagctggaatttcatcttctattgtaactgcatctagttttccgttttccaccgtatttttgaagctaatttgatattcaacttcttctcctagcctcggcttcttatttgttgcttttttctttgcagcaattttaccggccttatgctgtggtgtaatcttctcttctagattctttggtggatttgttttatctctaacggttgctttattaacaatttcttcaccaatttttgcagtttcttttacttttgttttaaagacgatacttctttcttccatatccataatttctggatactttgcaattacttttccattttcaaacttcagctctactggctctggttttgcaccttcggctttcaaactatctttcacgtattcaagactacttggtaattcatcttcaatggtcaatacatctagacgtccatcttttgtcttatttttaaatgtaatacgatactctacctcttcacctaacttcggtgttttattagaagctatttttctcgcctctatttcccctggaacttcttttggggtagtaaccgtaacatttgcatcgtcctcagtttcatactttatctcggcactatcttgtccctttacaacaacgacattttttactgttgtatctgattgtacagaatctttcacttttactttgaatgtaataacggtactttcacccggctttaaaacaccgccgtctttagcattagcaccttcaccaacacggaaatcaatttgattatttacaaactccgcttcatcatcgcttgcatcatctgttttatttcctttattacttccagaaacatattgaatagaccctggaacatactctaaacggtcatctaatttatcaaaaccttttacattcgataccggcgcttgattatttttcgtatcatttttcacttcaatttgatacgtaaactcttcaccagctttaatttccttaacttctttaccggtactatctaatgcctttttatcaacttgtaagtttggagcattatgttctgtaacgaatgtggcgttatttaatacgtaaatatcaccgccaccaccatatgctctaaaacgtatttttccttctttcaaatcattctttacttgagtgggtccttcaaggtgatacgtatgaatatctgtactgaaagaatttgtccaatctggattatatcctgggtattttttcgtaacaaattcgttagtgccatctacttgtacttctgtcatagatgagtcattaacatcattatctttacttttaatatttttaaacttttgataccctaacccaaaatcatactctccataatcataggcatatccatcattatcagctggatcaccttgcgatgaaaaataactaaattccgccttgaaagcgccttcttttggtgtgtttattttattaacactaatatctgtccaggctgtacttttttgagagactagcccttcccaaatcttcatgtcttttactgtttctttatagttttcataaactaatataagattccagttaccccagtaatagccgccacctgttacatctttaatttgtggcacatttgcaactgtcaacgtttgagaaataccttgctgtgcaattatatttgttacatctgcatacgctacatatcctgcgccactacctgagtaattagaaatataaggtagataatcagcttttcttatgctatcagcagttacctctgcatattctttatttcccattctcattttgactggttgccttacttgatcctcggtaacctttctatcagcgatatttcctggtaaccccattgctgctgtccagaataagtaagcctttttcactttacttccagcaggaatgttaggaaatgcacctgttgacgaattaaaagtactatcatcgttatcaacatcaaccgtcattttattcgttttataacccatactttgtctgccataatgatcagatgtcaaaccaagcgtcacattaccagtctgtactaaattaccaggagcaattgtagaatacaacgggtctccaaatccttgtttatctcctgtttggatttgaaccttcgaagcattttctgatgcagcttgtacttctgcatcactctgctttactgctaaaggtgattgctttttctctttttctagttgcttctcagcctcaggttgttttatcttctctatttctgttttttgtgcagatgtatttttatcttctacagatacttttaattttccatccacttctttagtttttgaatcagttgttgatccgatagctttcttactactgtcagcctcatcatcggtattagcttctaacttctcttcagaaggaagcccttcaaacatctacagacatgtttcctatttgtagttgatccttttgcacactaattttttgcttatactctttattaaaatgttgcgcacgacgagcttttattaatacagtcattttttcatgtgattttaaatcttgaattttaagattagaagaaagaacctttcctccattatctttttcctctacatagaaatccgctaccttattttcaagtaacttctctccgtttactttcacagattgcgaaagaaactcaattccattgtcattattttgtttaattactaattctcggattggtgtatctcccgtattttcaatcttatattgaaatacgtgctccctctccgctacttctcccttatacatttcagcattcacttgatctgccttaattttcacatcatttccttgtaactcatcccagctttttttatttatctctgtagcaaaagcactgggcgaaggcaatatgatggatagaagaagtgtgatcattgttacgacattaaaacacttcaatacttgcttcatattttctacctttctcctttctatatacttgctatccgcctacttcatttcagtaaccctttcatttagtagccgaatacatagcaatatatatccactcgcaacaatccgacctacgaaaatgtatcgttgaaatcccaatgtcaacaatataaatctcatagaatattactattttaatttatcaaaaatagcatatataccggacacttatacaaacctttaccatacttttaatatagtaaaaacatcgtgctgtataggtttatataacagttaaaggatacttaaaaattttaacatactcctcaccctatttatacatacaatagaaaatttaccattttttagttattttcagtttgttttttatgattaaaattttctaaaaataacaaccgttacatgtaaaaatatgttatattaaacaagaacaaacgttctttttttaaaaaaaggaggaattttttatgctacacgaacctattatcgtaaaaaaagaagctttccacgcaatcggcgtttcggttacgacgactaatgaaaaagaggcatctactgaaggaaacattccacaactttggaaccgatactttcaagaacaaatgatgcatcacatcccaaatcaacaaacgaaagaaacattcgctttctactcaaactacgaatcagatgaaaccggtacatatcaatttacaatcggtatgcctgtttcttcattagaagacgttcctgaaaatatgacaactttaacaatacctgccgctacatatgcggtatttacaacaagaaagggaccagttgctgaagtcgtttgtgaagcttgggaatatatttggaaatggtcgaaagaaaataaacgtgccttcacaacagactttgagctttacgatgaaagagcgttagatccaaacaacgttcaattggatatttatattgcgttagcctaaaaaaagatgcccattcggcatctttttttgtcgttaaatagctactgggcaaattcattattattgtctacaatgagaaagtgcagtatagaaatattagaaactgtataaaacgattgttaataggttttttagtttaaattcgtcacatagaaaggaagcaatatggaggaactacaacaaaataaaactgctttagaaggaagcggaaaaccgttattaaaaaatacgaatttcctttttctttgggcagctactcttttttcaagctttgctttagccttttttactttttcacaaacgtggtacatagcaaaaacattaaaccttgaagcttcactcggtgttgttttcgtagcccttagtgttccaaggcttatttttatgattgtcggcggcgctgtagctgataaattcccgaaaaaaaacattatgttttactccaatatcattcgagcgattcttgtcgcaaccattctcacatggttcattgtcggtgatgtaacactatatacatttgctttattcgctttattctttggacttgctgatgctttcttctggtcagcggatggatctatcttaccggaattggtagaaaaaagccggttaacacaagcaaattcacttacacaaatgacgaaccaagcatcggtcatcttaggccctgtacttggtggtattctcattaaatttacgaactatgagacaatcttttccattacgattttattactgattgtcgctgccatactcgttcaaaaaatacaatttacgatgccagaacaaaaagatacagataaaggtatgttcacttccattaaagaaggaatcttatatgtaaaggaatcgccattcctttcaactttccttatttgtagcgcttttttaaacttatttttaatcggcccgatgcaagttggtttccctctttttgttaaaaacgttctgcatggtgattcgctccagtttagttacttagaagcatctgtaggcggcggaatggcaatcggtgctatcattgtaggtttaaaaaatattaatcgtagacgcggtctattttgtattatcatgatgctattgtctggtgtattcttcttagccatcaactttagcaccgtactttggcaagcactattagccggcatgttttatggtattacaatcgcaatggcgattgtaccgcttatggcaatgattcaatcgacagtaaaagaagaaatgatgggacgcgtaatgagtttacttatgctatcatcaatgggctttatcccgctctcttatgcattcacatcacttgcacttgcaatgggaattccaatcgtaaccgttatgaaaagtggtgcaatagctgttatcgtcttcgtactatttgtagcgattcgtgttccagttgtaaggaagttcgattagccacttagagtcatgtattatacgcatggctcttttttgaatggatcaaatagtgatattcccttacttctccttaatgctgctccccattctaatccaacctctaaaaataaatctcgcactgtactgtataaaagtgccccaatgtctttacaaatttccccatatttatatgctcttacaacacttttcacgcgccaaattaaatttccatacacttcttcgtcagctaatatttgctctagtaaaacaccttgttctagtaacccactctttttatacgcaagctcgaccttactccaaaatatattaattttcttcggattactcgtcatcggcaccagtgcgtatataaaaggcttcggtatatcatgacggcaatacgtctcatcaagctcatacgttccttttcttttctcttttatttgtgaaatgtttttagaaagaattgtttccccagcaattttttgctcatttttactacagccagttgcattatcctcagttttacaagcggacattttcatacggtcatccatgcggtcaatcgcagatgtaagaaatacatataagttcgcactatacccgccgcgtttatgcctttcttttgttgcaacacgctttataattcctagttcctctaactttgcaattgaacggcgtactgtacgaatactctttccaacattcgtcgcaatcgtccccattaatggacaagcaacccctactgttttttgtttctcattcaccgcatattttcctaaaaaatgaataatgatagaatcagttttattcaattgaaatcggtagcacttcaaaacttgtttttgatatgtattaaactcttctttacttcgaaattcactatatggtttcattaaattatataagcttcccatttatatcacctcatttataagtaagaggcaggaagcgaaattggcgtgatagttaatattttttaatggagatgaaaatatgatcgtaattagcgcttgtttaggtgggattgcttgccgttatgacgggaatgacaatctcgtttcaaaaatagaggagcttctgcaaaaagaagatacagtcctcatttgccctgaagtattaggaggactaccaacacctcgtccttccgctgaaattattggcgggaatggcgacgacgttttagacggaaaagcgaaagtgataacaaaaaatggtgaagatgtcacagcagctttcgtaaatggtgcttataaagcattagaacaaattaaagatttacacccagaatatattattttaaaagaacgcagcccatcttgtggtagttctacgatttacactggagaatttaacggtaataagcaaactggtttcggagtgacaactgctttatttaaaagacacggatttaaagtcatttcagaagaagaatttgaaaacaaaaaaaggaattgaccctgttcgtcaattcctttttatctgtcttatttcacacttagtttttctttcactttcgctggaagctcgtcttttttcacttcttcccaagctgttacaccttttttatctgagtggtatacgcgtaggaatgcttctttacgaagatttttttgagctatgaattctaattctttctctttaccgtctttatcaaagccagtcagcttatattcataatctttaaatttctgcccattactagctttactatcaaattcttttccatctactgtaatttgaacataatactcatctttacccatacggtttaaatcacaaccaactaacaaacttgcaaatacaactaaaatactaaatagtgcaatgtatcttttcatttccttcacctcatatgttttttcttatattcttatcttaaagcccggagcttaaagaagaaattcaaaaacatgacatgaacattacacttttgtaagataataattatttcttcactttagaaattgtcattccattaagcttctgtataacgtttttgtttctcacgctcatcagctacactaccgccaataacgtctttcacgccaatttcgccacttatcacgtaatttccttataccgtttattacgccttctattatgccctcaattataatctctattacaagatatctcactaaactaataataggtttaattacgtatctccctataaattcaagaatatcctccatcatattttcctccttcttttaaaaggaagctgctactcctccgcgtccagttacaatttctgccctactgcggtatatatcaacaaagataatacgacaacaacatccacgataacgctattgaatttggaagaaacttcggtaaatactaatactgtagttaacatggctaagagaattattttttcacctatattcggagatgctcccaaaaactttataaaatcaaagacaactttactacaattcttcccgtaactaatttattatcgtggtaaactgtcttccactatatccgtaacagttccattcggttcaaagattacacgtaatgatccttctccaccataaccagtatagtcatatactgaataagatttatatttctcaatcacatgtggctgtccaattgcagcttttacctgattcgcgggcataccttttttgattttcaaataatgattgtaacttactgctgccgaattgttatttacatctttataccacggtacacgatcgtttttttcttcatattcctttacaggctcttcactacgtttcgtaaatacctgattctctttatctttatctttatcctttatagcagtacgttcaatatttacaacgtaaccatatgtatttaattcaaccataatttcatatgtaccatccgtatctttttcagtataaaatacgcgtttttcatggttattataatgttttatgttctcaccaccatagtcaatcgtattaagaatatccgtatacgtcataccttcctcaatcttttgagattcatcatgagaaatataacgcttttgtgatgatggtgcatcctcatttttaatactttcacgtttgctcgtagtcataggtgttttcttctgatcttttagtacttcaccttccgccttcgctggttgctttgctcctgcttttgttaatacgtctgtatcgctagaacaagctcccaaaatcgatactgtagtcaacgccatccctactataagtactctcttaaatgacttcactctaatctcccccggtggtttttaatatctagtaatcaatgtattttaattaatacggaagtattcagttctatacaattggctataaccttctccctcatgccccttttttgtataaagtgaaactttaatcagccctcgccaatcatcctcgttacaaatattaacattaaatataactaataaatagtatatttttgctaattatttacattttttctacataatcttatcttaaaatgaacaatatgaatctcgaattcacagcgttaatcatatataccatatataataacatttaaattaaaatctaaagtaaatttacatgcattttctgttttaacgcaaaaagaaaaggcctttctaacgatttgaagtgcaccccaattgttagacacagtctaacaattggaggtgcattttttatggctaaattttcttcaaaagaaaaaatccaagcggtgaaacgatatttagatggtacagaaagtggaaaaacaattgctaaatctataggagttaaccctagcgtacttcgtgagtggattagacgatatgagtcttcaggtgaaaaggcctttgaaaagtgctatacattctacccagcccagtataaactagatgtactttattatatgaatgaacacgggacatctatcagagaaacagcggcacttttcaatataccgtcttgaaaaacacttcggaaatggaaaatagcttatgaaac

SEQ ID NO: 1385 - DNA, 24258 bp, Bacillus thuringiensis
ttttctcaaaatcctctgcaaattgaagtatttcttctatgttcatatactctgttgttaattccgtctgcaatccgcgcttcgttttatacaaccaatgaattttatatttcatactacattccccttatgtaagacttcttatatgtagccagctaataaaagcctcactttattttattatattttatcaagagtcaaagaattatattcaatattatcacatgcaaaaagagctatccctataggaatagctctttcatctattacataaatctttcaaattgtactcgcttattaatccagtacattacaggcataccaatcgccatgacaacaaattcaccgattgcacatgttaaccaagacaacataaatggtaaacccaatgcaagatgaagttcaattgcaatcataaacattgtaatcgtaaagataactgtattaaaaatcatacgagcccaaacacctttaataaatcgcatagaaataatcgttgcaactaacgcaagaatagattggcctactccaaatactaaatcataagcgatcataggtgagaaaaagagattcgttaaaaatacacctaatacaattccgtaaattgctttcttgttaaatacaacgagatgattaaacatctctgaaatacgaaactgtacatttgtaaagccaaatggctgaataagcatagaaacagcaatatataatgccgctaaaataccattaccgactaatgttctaatattcatgacaaaatctccttagtttttttacgtgggatggtttcgaaccacgttattcttttttttagcaacaagattatattttacgtggtagcccctctttcgtcaatagatttcctatcataaactacctttttccttttagacaacgtataatgaaacatatgaaagatttaggaggtttcacttcatgacagcaacaattcaaaatgaaaaagtgatcgtttccatttctgacaaaggtgcagaattacagagcgttcgcttaaaagaagacaacatagaatatttatggcaaggtgattctacttattggggacgccgtgcaccaattttgttcccaattgtcggtcgattagtagataatacatactacgtagacggtaaaccatattcattaacacaacacggtttcgctcgtgatcttactttctctgtgaaagaacaaagcgaaacaaagatcacttatatcgttactagtaatgaagaaacattaaaaaaatacccatacgaattcgaattactcgtttcttatgagctagatggacaaagtgttcatgtaacatatgaagtaaacaatcctacttctaaagaaatgttcttctcaatcggagcacatcctggattcaacttccctttattggacggtgaatcatttacagattatcacttatcgtttaatggttcggaacgcttagaaacaagcgtattagaagggccttatctttcaaacaaaaagcaattaatcgctgaaaatacgactgaattgccacttacatacgatttattcaaaaatgatgcacttatttttgaacatatgaatacgaatgaaatttcgattcgttctcataaacataataaatttgtaaaagtagaatttgatggatttccatttgtcggcgtatggacaccaggggataacgcacctttcttatgtattgaaccttggtatggaatcgctgatgaagtaaatccagcaaaagatttcaaggacaaaaagggaattcaatctttacaagcgaatgaaacatttacatgtcgttacagcatcacaatcggataactaccctatcccctacttcaaaaaaatatttaagtaggggataatcttataatttggaggtttctcattttgattgaagtatatattgatggtgcatcaaaaggaaatcctggtccttctggtgcaggagtgtttattaaaggcgttcagccgcctgtacaattatcagtaccacttggaacaatgtccaatcatgaagcagaataccgcgctttacttctagcattaaaatattgcatcgagcataattatagcactgtctcttttcgtacagattcccagcttgtcgaacgggctgttgaaaaagaatacgcaaaaaataaaatatttgcacctcttttagatgaagcactgcagtacataaaaaacttcgatctcttttttattaagtggattccaagtagtcaaaataaagtagctgatgaattagctagaaaagctatcttacaaaattaacgggggtatgagtgtgaaaagagagtggattgctcctcttgctttattatttgtctcttttatttggggagctacgtttgttgtcgttcaaaacgctatgtctttcgttggtccatttacgtttaatggtattcgctttttattcgctggaattattttattattcgttcaaattattttctcacagaaaacttcaaaacaagaattaaaacatagtagtttagccggattaatagttgggttcttcttatttgtcggttatttattgcaaacatttggcttactctatacaacatcttcaaaagcaggtttcttaactgggctaagcattgttatggtcccaatcttttcctttatctttttaaaacaaaaagctaccattttcatcgtacttggtattgttgtagctacaacaggtttatacttattaacagctgctgattctttccaattaaatataggagatatacttgttctcggttgtgcagtcgctttcgctgcccatattcttattaacggcttcttttctaagaaaatatcacctttattattaagcacatctcaagtattagctgttggtatattttcttctatttgcgcttttttgtttgaagattgggaaaagttattttcagtatcactatggacgaatcaatcctttttattcgcactctttctaactgccctgtttgcaacatctattgcttttttcattcaaacatcggcacaaaaacacacttctccaacgagggtagcaattattttcgcaatggagcccgtttttgctgcattaacaggcgttctcgttgcaaatgaacaactttctatttctgctattatcggatgtctatgtatttttctaggcatgatttttgttgaattaccttccaaaacaaaaaaagaagcgcaggctgcgtgaagttacgcttgtaacttccgcataaaagccttagcgctttttttatctgtaatttcttcctctttcaatcgttctaataacgcaacgaaataactaccatcaaactgcaattgatgtttaattgtcgcttctattgctgcgttcacaatcccatcagacgcaccagtatatccttgtccaaacataataaacccttgtgcttcctctgataatttaaatcctttcgtatgtaagaatgaaagataatcttctactgtttgcatgttattcccacctactcaaaaattctccatctcctatcatacatgtttttacacgctatgagaatgaaatttctttgacaactttgtaaatcaatcttctacttctcttacaatggagggttttctaataatctgaaggaatatgtacagtggaacttatttcatattaaaggggagacacgatgaaacaagcactattaattatcgacgctcagcaagaattaattgatggaaatgagcaagaaaatgaagtttttcgtaaaaccgagctattatctacactaaatatagccctccagaaagcaatagattcaaatgctcttattgttttcgtaagagatatcgatgttgcttctggtagtggcgaaggatttgaagtacataatcaaattcaagtaccccagtctgcaatctttattaataaagcagcaaccaattcattctacggtacttctttacttgaacttttaaaagaagaaaacattaatcatattgttataggcggatgtaaaacagaacattgcattgacactgccgttaggacagcaactgtacaaggatttgacgttacattaattaaaaacggtcattcaacaactgattctaacgtattgtctgcagaacaaattattggtcatcacaataaaactttacacggtcattataacgttgatcatttttctatggtgcgagatatcgaggaagacctctttcagccaactcatgaccaatatcgtgattaaattggctcaaaaaagaatccttcatttaaaagggttcttttttatccaaaaatttgcgctgcaatactatatagttcactatttctgtttattaaccgattactatttttcatcataattggcggtatattcacctttttaaaaccagcaatctctaattctttcatgaaatcgttctttccttctagtacatcaattcttaatttaccattatgccctcttgctaaatcatgtactattctcattgccatctcatcatttttagcaacaaccggccctattatcttattttctggtgtttgtatgcttaaaccgtaacctaatacattttgttccttgtcccttacaacgatacactgttcactttgcataattcttttctttaaaaactcttttctatttgttccaaacgcatattcatctatttttattattttttctaaatcaccctcttcataattcatcacataatcttcatttcttacacaataatctttcgcattgtatgagttacatatgtatttagaaacataacttactgccctaaatcctaacttttcatataaaggtttcccttcatccgtagcaatcagcataattggagtatgagctgatacgcttttaacgcacgcttccgttattatctttccaatccctctccccttataatctggatgtacaatcaccattccgatagacgctaatttctccccatataatattattgccgcgctagcaataagttcctttctctcattccatacgccgtatacaatacctgagttaaaaattgtttcaacttcttctctgttataatcccagccaatataagaagacaatgctacaatatcgcctatttgttcttccctaagacgctccaacctaatttctaattcaatcatactccatccccttatctagacatttaaatcattattacgaaatcaacttgtacatgtttcgctttatttgtcacacacatatgttattttgaccaagactatattgtaaatgaggtgacaacatgcccattacgaatcgattttctaccaccactaacggcgcactcgctattacaggtaatactttaggcttaagtaaaattagcaatcaaaaccgtgctggtacaatcggtgcaattggtgcaattggtgcattcgtaactacgaatactgctttacaagtacctacttttcctgcaggtacaacgttaaactatacacaaaatagttctaccactattttaaatatccctgctggtagtactattctttacgcagaactcgtttggggtggaaactatttatctcgtgatcaaaacattacgagtattttagggaatcctgtttctttcacaacacctgtgtcaacatactcaattaccccttcggctattacagcttcaaatcaaactttcgtttctggatctgtcacatttggattctatacacgatctgcagatgtaacatccctcgttcaagctgctggatctggctcttatacaaccggctctgtccctggacttgttgatcctttagatgcttctaatggggctatcaattcttctggatggacgctcattgtcgcttatcaaaatggttccttacctgcaagaaacttaaccatttatgtagctggtaaccgtgtttctgcagaaactggtagtgccgatgtatctgtttctggatttttaacaccttcaggaggaccagtaagcgggagattatttttaagttctaccgaaggagatgcagatttaaccggggatcaagctttatttggaccaaatttcagttcattaaatgctttatctggaccaaacaatgctataaataatttcttcggttctcaagttaataatgctgcaggaaacttagatacaacagggacattcggaacgcgaaatcaaagtgcttctacaagtacaaacatctccgcaggaagacagggctgggacattacttccattgatatttctccttatttaacaaactcacaagtatccgccgcaatccgtttaactactaacggggacgcatatatgttaaatacagtaggcttacaaattaatataaactcaccaaatatacaagcgacgaaaagcgtgaataaaagtgttgctgcaattggagatattctcacttatacagttactatccctaacaccgggcttcttcctgccaataacgctatttttatagatagtctccctagcggtacttcttttatacccggcactgtaacagtagataacgtaccgcaaacaaatgcaaatcctgcggctggtatatctcttggaacaattaataatggtgcttctcgtacagtaactttccaagctactgtcgtttctcttccaagtcaaaatcctatctctaacactgctaatattacatttcaatatacaccaatcgccggaggaacaacttttaatggtcttgcaacaagcaactctgctggaacacaaattaacctcgcagatattaatggaacaaaatcagttaacaaactttttaccgatattggtgaaacattaacttacagtattgccttagctaatataggaaatatcgctgcaacgaatgtgatatatacggatccgattcctagcgggactactttcattccagggagtgtaactgtgaacggagttactcaagctggagcaaatcccgctaatggtatatcaattgggtcaattgccgcaaattccactactactatttcattccaagtactcgttccttctatccctcaaacaaacccaatattaaatagtggaacaacaacatatcaatacattcctgtacctaatcaaccagcagtaagtgggactgataagacaaatattgtctccactcaagtgaataatgctactgtaacaatgacgaaagcagtagataaaaattttgcagatattggtgatacactaacgtacaccgtttcctttacagctacaggtaatacaaatgcgaacaatgttatttttacagatgtcatccctactggaacaactttcgttctaaacagtttaacaatagatggcacgacacaagtgggcgcaaatcccgctaacggcgtgaatattggatccatcccaagcggcacaacaaaaaatgttgcatttcaagtagtagtaaatacaatacccgcgtcaaatgtcgtatctaacggatcaagtgcttcttatcaatataccgtcaaccctagccaatcacccgttacaaaaaacatttcttctaatctcgtttccactcaaattaacaatgcgaatgtaacattaacaaaatcaactaacaaacaatttgccacaattggcgaaacgataagttatacaattcttattacaaacagtggaaatgcggccgctaatagcgttcaactaacagacccacttccaaatggaacgatattaactcctggtactgtaacactaaacggagttttgcaaaatgtagattctctcgtcgctttacctatcggcacaattcctggcggggctacttttaccctttctttccaagtaacagtcatcaatattacgacccaaaatcctatcattaataatgccttcgcttcttatctatatactgtaaatccaaatttgccaccgacttcaaagacagcaaattctaattctgttacatcaacaattagactagcaaatctccatgctaataaatctgtagataaaacgtttgcggaagttggcgatgtattaacttacaccttcgctcttactaacgatgggaatgttgcagcgaacaatgtattactatccgattcaattgcgaatggaaccgcctttgtaccaaatagcgttatagttaacggtgttactcaaccaggcgttacaccaactagcatcaatattggtagcatcaatgctaatactacaattacagcttcattccaagtagtaataactagcattccaaatccaaaccctatttcaaatagcgcttccatctcctataactttattgttgatccaaacgcttcacctgtaagtaagaacactacttcaaccactacatttactcaagtaaacgatgcaaatgtcatttcagccaaaacagtggatcgagcgttcgctaccgtaggggatatattaacttatactgctactttgacgaatgcaggaagtgtttctgctgatagtcctactttcgtagatacgaatccagacggtactacctttattccaaacacttttcttattaatggtgtactccaaaataacgcagatccaaatataggtgttccactaccttccattgctgctaacggctcacttaccgtctcttatcaagtaaccgtcacctctttaccaatacaaaacccaacgataaattcatctagtacacagtatagttttattctaaatccgggcgatccaccaactgtagaaacatctgtaagtaacactgtaagtacacaaattaatttagcaaatgtagtgattgtcaaagaagtagatttaactatcgccgatgtcgggcaaccaatcacatatacaatttctttagctaatcttggaaatactatagcaaataatgttatttttaccgatataatccctaatggcaccacaatcgtaccaaatagtatttttataggtggtgctttacaactaggtgcagaccctagtaccggtcttcaagtcggctccattccttcaggtggttttacaacgattgtttttcaaataagtgcaaatgggctaccttcaccaaacccaattcaaaacagcgcttcacttcaatatagctttatcgctgatccaaatttacctgctcttgttagaaacgctgctagcaatatagtaactacacaaattaatactgctaatatcgttgctacaaaactaacgagtacaaacttcgctgatgttggtgatgtcatactatatgcgactattttaacaaataacgggaatatccctgctgctaatgtaacgtttacagatatcattccagcgggtaccctcttcattcctaatactgtaacgattaataatgtccctgtagctaacgcaaatcctgctaccggcatttcaattggtacaataggagcgaattcatcacgcaccgttgcattccaagtttttgtaccaactatccctgctgtaaatccaattacaaatcaatcaggcacaacattccaatatacgtatgatccatccaaacctgctgtgatgcagatggttgcttctaacactgtacagacaactattaataacgcctcaattgccgctactaaatctgcagataaacagtttgctaacgtaaatgatattattacgtacacgactactttaacgaataacgggaacacacttgcatcaaatgtaatatttacagatgtaattccaaacgggacatcatttattgctaatagtgttactgtaaacgggaatacactgcctaatgtaaatccagcaagtggaattgccattgatccaataaatccgaatgcaaatacgctcatctcgttccaagtacaagtaaattctatcccgaatccaaatccactcccgaaccaaagcaatacaacgtaccagtacgtcgtagatcctaacttacctccagcatccgccaatacgttaagtaacgtaataacaactcaaattaataacgctactattgtcgctactaagtctgtgaatacaccgacagctgcaattggcgatatcgttacctatacgattgcagtaacaaatacaggtaatactcctgctagtgcgactgttttaacggatgggcttggtgcaggagcttcatttatccaaaactccgtaacgatcaataatgtcccacaaccaggattagatccatcacttggtattcacttggcagatatttcgccaggggatactgtatttattacttttcaagcacaaattttagcgataccacctagtggcacattaacaaataatgctcttgtaaattatgaatataccgtgaatcccaaccaatcacctgccgtcaatagtacaattacgaatacaacggttactccaattattgatgctactctttctataaataaaactgtcaattcaacattcgctactattggagatacacttactttcacttctaccattactaattccggtaatactaccgcaaacaatgttatttttacagatgtaattccaaatggtacaacgtttattccaaatagttttacggtaaatggaacaactattactaatgcaaatccacaaaacggtatcaatattggtaacttgaattcaaatgcatctgctacactcagttttcaagtaaacattacaacacttccaaacccgaatccaatcccgaacaaatcatcgcttcaatatagctttattgtagatataaatgaaccgccagtttcacgaacagttcaatctaataaaactttttcacaagtaaatactgcttccgttatcgcaacaaaaactgcaagcagtgcttttgctgctgttggagatacaattacgtatacaactatcctcaccaatagcggaaatacttcagcaaacacacctgtttttatcgatatattaccacctgaactttcattcgttcctgatagcgtacaaattaatacaatcccacaacttggatttagaccagatagcggaatctctttagactcaattccagttggaggaacgacaacaattagctttcaagctatcgttggctcaataccagctacaaacccaactttgaaccaatctagcacaacatactcgatcattattgatcctacccagccgccggtgatagaaacagctacaagtaatccaactttagttcaaattaacgaagcgattattcaagcaacgaaaagtgtagatcgactattttctgacgtagcacctggaaattcatttttaacgtatactgttttattggataatataggaaacgcaactgctacgaatatcatttttacagatcccattccaaataacacagtatttatagaagatagcgttcgagtaggcggagttttattgcctggagtaaatccagcgaatgggataccgattggggatattattgctggagattttataaacgttaccttccgtgtgcaagtagttagcattccaaatccaattttcacaattggaccaggcggaccaaactcaccggttgtaaacagcgcttccattaattatcaatttatgacaggtccaaacttaccactcgtttcaagaagtacgacgtccaatccggtttcgacacaaataaattctggggaaattgtggcaatcaaatctgtaaataaaactttcgcaacaattggcgatacaatttcttatacaattacattaaataaccctggaaatgtcacttcacaaaatataatttttacggatactttccctgatggaacgacattcatatctggcactcttacaaacgattctggtacacagcaaatcggaaatccagctaacggaattcagattggaaatataaacccaaatggaacggccgtgattactcttaacgtacttgttacaaacattccaagtataaatccaatttctaattatagctctgtacaatttgcacatgtggtcgatcctagccaacctgccgtatcgcaaacgaatgtatctaatacggtttcgacaactattaatagtgcaattttaacaacaaaaaagagtgctgataaatctatagtttcagttggagatacgattacgtatacaactactattagaaataccggaaatacagccgcaacgaatattactttcacaagcgctattccagctaacactacctttataccaaattcagtcacaataaatagcgttcagcagtctggtgcgcaaccagcacttggagtaaatataccaaatatcgctcctggtgaaacggtaactgttactttccaagtaaatgttatttccgtttccccttccagttcaattatgggtaatgacacaattttatattcttatactgttgatccaaacagcgctcctgctactacctctacttcaacgaatattgctacaaatcctgtattagatgctatgataacgatggtaaaatcggtcgatcaaacccttgtaacactaggcgataccataacctatacgacaattttaacgaataacggtaatacaaatgcaactaatattactttcacggatcttataccaaatggtacaacatttattactgatagcgttacaataaatggactcacacaaattggattgaatcctaatacaggcataacgattggatcaattgcccctaacagctcaatatctatagcatttcaagtgaccgctacttctacccctgttcaaaatcctattgccaattccgctactgcttcttacacatttatcgctgatcccaatgcacctattgtttcaagaaacgttacttcaaacacagtgtttactacgattaatacagctaacattctttcattaaaacaagtcgataaatcctttagtcgtattggagacacactcacttatactgtcgttttaacaaacaatggaaactcatccgcacaaaatgttatatttacagataccgtaccaagcatcactacatttattgcaaacacattttctattaatggagttcctcaaagcggggcggatccatcgaacggtgtgaatattgggacaataacagccgggactacagtaacagtttcgttccaagttactgtaacatcattaccaaccgcaaacccaattgtaaatttctcatcaacatcgtatcaattagtctcaccacctgaagcagaaacttcaattagcaatcctgtttcaacccaaattaaagaagccatattatctatgaccaaaaatgaaagtgtatcctttgcagatatcgggcaaactgctttttatactacttctattaccaatgtaggcaataccgatgcaactaatattgtattcacagatgcattaccaagtggactcacatttgttcctaacacattaactgtcgatggcgttttacaacctaacgcggatccaaatacaggtgtattacttgcaacacttccaccaaatgaaatatatagcatcgtctttcaaattacagtaaacaatattccccctagtaacccagcaccaaataaagcatcaacggcgtatgaatttactgttgatcctgttaatcctcccgtttcaagtgcagctacttccaacactacactccttcaaataaacaacgcaactattattagcaccaaaacagcaaatcttacttttgcggatgttggtaatacaataacatttacacttaaccttcctaataccgggaatgtgaccgcaactgatgtaactattatcgatattcttgatagcaatttaagtttcgttccaaatagtttcacagctaatgggcaaaccattccaaacgccgatttatcaactggtgtaaatattggttccattaatggtggtaatacggcaatcgttacattccaagcaactgttattacacttccaacacttaatcccatttctaactctgcttctaccacatatcattatgtcgttgatcctagccagccacctattacaacttccaatcaatctaatacaacgacaacacaaattaatagcgctatccttactgcacaaaaaaattcaaatgtatctacggtagatatcgggcaggatattacctacaccgttacaattacaaataacggaaatgtgagtgcaacgaatgttatttttaccgaccttattccagacggaacttcctttgaaccgaatagctttacactgaacggaactagcatcccaaatgcagatatcattacaggcgttccaatcggtgatatcgcgccaaacgaatctgtcatcgtagcatttcacattatcgccaatgaaattccgcctataaatccaattactaatcaagctagcgttagctttcaacatatcgttaatccagctaatcctccagtttcaaaaaatattatttctaacaacgttacaacaaaaattgaaagtgctattttaaatactattaaaataggagataaaacttttgcaacgattggtgatacgattacgtatacaacgactattacgaacacaggcaatattcctgctaacaacgctatattctcagaccctttaccatcgtggacacaatttgttgcaggatcagttattgttgatggcactccattaccatccgcttcgattattaacggtgttggcataaatacaatcagtccaaatcaaactgttacaatcatattccaagtacaaatcgtaagtaatccaacaacgttcacacctgaactccaaaacttaggatttgttaacttccaatataacgtaggcaatgcattactggctcagcctggcaatgtggaaacgaatgtcttcgttacttctattaatacagccatactttcagctgtaaaaactgctaatacagcctttgcaaatattggagatacgatcacttatacagtttcgattcaaaataacggcaatacaaacgctacgaatgtaaatttctcagacccagttccaactggaacgacctttgttgaaaatagttttgctgtaaatggaagtaccattccaggcgcaaatccaaataacggagtgaatatcggaacagttagcgcaggtagttccttaaccgttactttccaagtcatagttacatctactccaccttcaaatccgattacaaacgtagcatctattcaatacgcattcatcgttgatccggcctctcctcctgttacaggcacgataaattctaatagcgcttcaacacaaattaataacgcgactgttacaactgttttacaagcaaatcgttcaattgtatctatcggggatgtaattacgtatacagcaacattaacgaatactggaaacttccctgcaaactctatattactcattaacggagttcctgaaggagcattatttgttccaaatagtgttacgctcaacgggatttcacttccagatgcaagtccaactctcggtattccagttggtattatcgcaccaggtgattccgctactattacgttccaatttcttgcaagttctattccaccgcaaggagcgattataaatcaagcacttacaagttacacgtatattgtcgatccaagtcaacctcctgttacagcaacatcctcgtctaatacggttaatacagctgttgttgatgcatcgttatccgtaattaaaagtacagattctctcgtacaatctactgacggtacaatcacttacacagtagtcgttcaaaataacggaaatactactgcaaatacagttactttaacagatttggtcccagaaggaactgcatttattccgaatagcgttaccattagtggtgtttctgttccaggtgccgatcctaacgtaggaataccattaaactccatcacaccgtcagaaatcgtcactgtaacattccaggttatcgttcaatctataccaagcgtgaacccaattttctaatacagcccgtattgactatacttttatcgccgatccaactgctcctatcatctctcgaacaattacgtctaatcccgctttcacacaaatttcggatgcaactatcctttctttaaaagcagtcaatgcacctcaaacaacaacaggtgatattttgacttacacaataacactagaaaataccggaaatattccagctacgaatctcatattttcagatacgattccccaagatactacattcgtagaaaatagttttacacttaatggaacagctatacttggtgccaatccaaatgtaggtgttactttacctaccttagcagcaaacgctactcaccttatttcgttccaaattcttattaaagattcattctcgcgagaatcgattacaaatcaatccaatacaacatatacaatccaaccagacccagggcaaccgcctattactgaaacatctactagtaatatcgtcattacaaatttcgtgcaagcacaattgacaattacaaaaacatccaatccaacaactgtagatattggcggaactatactttatatttctgaagtgaaaaatatcggtaatgttgacgcaataaatattgttttcacagattctatcccagctgggactacattcgttcccgatagtgtcacaattaacggtgtccttcagccaggtgtaaatcctgaaaacggaataccgattggaacaattccagctaacagttccaaaacgatactatttcaagtgcaaacaaataatccacctactgaaaccgaaattgtaaatcaatcttcagcaacttaccaatatgtaagtatccctacagccccaccagtgaatcgctctgcaaattctaacattgttacaacatcacttcaaaacgcaaatattatttctgttaaaagcgcggatataactttcgcatcaatcgggcaaattattacctacacaaatacactacaaaatataggaaccgttccagctaacaataccgtgttcattgataacattccagaaggtactatatttattgaagatagcttagcaataaataatgtaattcagcctggcgctaatcctgaaaacggagtaactctcggcacgatacaaccaaatgaaacagtcactatttcattccaagtacaacttacaaatataccagttggcaatgtagtcattaatatttcagacacctcgtacgaataccaaattgaccctagttctcaaattattcagcgtagatcgttatcaaatgcagtaaatactgaagtgcggacggcaaatgttagtgcaattaaatccgctaacagatccattacacgtatcggtcaaatcatcacatatacagtcgcagttacaaacgctggtacaatacctattacaaatactctcctacttgacgcaattgcttctggcaccacattcgttccaaatagcattcttgtagatggcgtaccaagacttaacgaaaatccaattacaggtatcaatcttgatataattcttccaaataatacgattattgttacgttccaagtaagcgtagtctctataccgccacaaaataacattaataatatcgccgtcattcactatgagtatcgaccagacccaagcacaccaccaatttcagaaacgacctcttccaatgctacaaacatacaatttattgatgctattcttattactacaaagtccactaatactgtattagctaacattgatgaaaccattgaatatacagtattcattcaaaataatggatcggctacaactaactccatcttttttacagatactatagcggatggaacagtatttattccaggaagtgtagtagttaataatactgtacttcctgcagcagatccgaatatcggcttttccattcctaatgtcgcagcaggtcaaatggctacaataacattccaagtttccgttacgaatttacctgctgtaaatccaacacctaatactgcaaacgtcgtctacgactttattttcaatcctgactttgcaccaattcaaaaatctactacttccaatactacttttgttcaaattaatgatgctgacatcgtttcacttaaaactgttgatttaacctctgtaacgattggtgacattttaacttatacaacaactttaacgaatacagggaatacggatgccactgctgttgtatttacagacaatattcctaatggaacaacctttattgacggtagcgttttagtaaataacattcctcagcttaatgccaacccaagtgcaggtatacttgtaggaacgattgctcctaatatttctatcccagtcacattttctgttaccgtcgtagctcttcctgctagcggccatgttcaaaatcaatcaacttctcgttatacaataaacgtggaagaacaaatatccactagcaatattaccttcactgaagttatttctgctaatgtaattgcgacaaaaacaacacctatccaatatgctgacctacaaactattatcccttacactatttccattacaaacaatgggaatatacaagtagaaaacattattgttacagatatcatcccagcaaatacgagctttatagagaatagtgttatcgtgaatggcaacgctcggccaaatgacaatccacttaacggtatacaaattgataacattccgcctaatacgacagcaaccattctattccaagtacgggttacttcgattccacaaacaaatccaatctctaacacgagtacaattgaatatgaatacacggtaccaaatcgaccacctattaccgaaactattatttcatcagctgctttaacagaaattaatcatgcgaatttgaatagtaataaagctgttgaccttgcatttgcaacggttggtgatacgttaacgtatacgattacactaaatcaaaccggtaatgttgcagtaaatgatgtaatcattcaagatattattcctcaaggtactacgtttatagaaaatagcgtcattgtaaacggagaaactcttccaggagtgaatccagtaagcggcataccaattggtactataactattggtggagatgctatcgtttcattccaagtaactgtgacttctattccaacaccaaatgaactaaacaacaacgcaattactacttttaactatatagtcaacccaaataacgtacctgttacaaatacgactacaacaaatactgtcaaaactactgtccaaaatgataatgtcattgcttttaagtctgctgatgtaacaaacgccttacctggtcaaactttaacatatacaattacgattacgaatagcggtaatgtgacgattgaagaccttcttgccatagacgccgtaccaatagatacgacttttgttgctggtagtgttacgattaacggaatcaatcagcctaatgagaatcctgaaaatggtattacgttaggaaatcttgctcctaatgaatttgttattattacgttccaagtgacaatatcttcttctactcttcaatctacaattaataatgatgcttctgtttcctataccgttatcattgatccaacaaaaccacctattacaattacaaaacaaacaaataccgttacaacgacagttattgatccgatggttcgcattgaaaaaacagctgacaaatctattgtcgttataggagatatcattacattcacattagcggtattcaatcattccccaattcctacaatcagtacttctgttatagacacaattccagctggtacaacatttatagaaaacagcgtaaccattaacggcactcccgttccaaatgttcgtccagacactggtattaatattggttctttatctgcaggtacagtagcaactataacatttcaagttctcgcaacttctattctttcaaacagtacaattataaattctgcaacagttaccgctgcttttcagttgacaccacaggatccaattattactttcattgttaattcaaatatcgttcgtataccagttcaatttataactgcaacagtcacgaaaaatgcttccgtcagctcagcttatttaaatcaatattttgattacacggtacgcattacaaatacttctgaaatttcactctcaaatatttcgttacaagatactattccagcaggtttacaatttataaatggcactgtctttattaacggtgaacgctctccactagcgaatccgaatatcggtttcctagtcgctactaatttggaaccaaacgaaacaattatcgtgttattcacagtacaagtgataagcccccctgttaataatccctttaaaaatacggccaatatttcgttacaacttcaagtctcgcctaccgaccaaccaattacagtaaccgttacaagtaacgaaaacatcgtcacctttgttccagaaaatccagatgaagcacttccaaatttaaattgcttctttgacggtgaacgcttcattcgcattactcctcgaaatgtacgaaattacctttggacttggatttggtggaagtaattgaaacaaaaaagagattgtagtttggttgaaaccaaattacaatctctttttcattacctatatcccactacgttgtaactcgtccaaggatatacgattaaacaccatctcaagttattttagtcgtaataagttggccagcttcattaatagtaactttccatttcactccactagcagtcttcatgattatacctttacttgcctctatttcaatatctccaaacattcttccgccagtcgtcgctaaccaagcactcccattttccatagaagatcttgcaaagatacgattaattcgaaaacgtttatgatcttgagaataaccacttaatgtaattctaactttatataactgactggccttcatattcgatataattgtatcgccaacatttaatggaacatccaacgcgataacccaacttccagttgcacttaatgcatattcaattttaattttctttgggctctctccccatccaaaatacattccaaaacaatttaacatttgtattggttttttcgtaaaatccatttcaattacaactggattactatctggaacgtcaatatagtttacactttgttcatctattaaattaaagcaatttgtgagatttcccccgtacggcacttttccacttacttgcttaacgttatatttctgctgagcatttactaaaatatcatcttgatttcctattaaatgaggtctatttaacgtcaaaggtaactgaattcgtagggattcttcataagtagacttacaaacattgtattgtcctttatctacaatagttgtcgaaagcagatttgaaaaaaggtagttacgatgagaattggaagaaaattcaataacaatttgttcactactcatccggtacgtatcccagatcatacaatcaaatgtattatacgcacctgaacaacgaattactttttccgtttgttgtctacattgcacttgaatatcatgaaacgtatttcctgaactttcatttggcaaatcactatttccatctacttcaatcccatacacacatccatcaataaatatagattgaaatacattggcgttaatccagcaaggtgtattgatatcatttatatattctgtcttcaaatgtattgcagtttgaaagtttttaatttgaataaatttaacttgaaagaaactaataaaatcccatgccttttgacaataaaaatgtatagcttttcctttatacgatggagttgtatttattatatttatatttgatataacagattgattaggtacttcgatttgttgtgaaccagaaacataaataacagcagattgaaacaatggatttataacttgaagagtaccaccaactatcgaagcgttactttgtagctcaaatgcattaaaatccccatcaatttgcagtgttacggtaggatccaactctaatcttacgtttgatttaataacaatcggctttacaattttgtacgtatttatccctgtaattctaaccgtcgaaattcgattcgctacacaataatcaatagcttgctgaattgctaatgagctatcatttcccgagtttggaactgcgccaaaacaatcaatatgaacgctactttctggcgcacaatcttcttgggatgaaatatattctgacaaaataaattcactcctcatattacctttttcatataatatgtgagttgtctcttaaaagtttctataataaaaaaaaacaaacgacctactcggtcatttgtttaattcatatatatttttcgtttcctctatcattttagttaacgagaaatatctcattgctttctctcgtgctttcaatctaatagcagttaccttttcttcattcccttgtagttcctcaagcgcacttgcgaattctgattcgcaatattcagatatcaaaacacctgactctccatctattaccgcttcatgtattccaccaacatctattgaaacaattggtgtccctgtagccatcgcttcaattactaccattggaaacacttcacgaaaagataataaaagtaaggcgtccatattccctataaactcatgcggctctgaaatattccctagcatcttcaccctttgctgcaatccatatttttctatttctttcataatcgattctttctctggtccatcaccagcaatataaaacataaaatcatttctctttttcaacacatttgcaattttgacaaatagttgatggtttttctctttggataatctagctaatatccctattttatatgtagattctttctttttctgctggaataaaaacttttcaatatcaacaccgttataaattgtatttattttttcttctgctacatgaattgaaattaaattgttcttttcaaactcacttactgtaataatattgttcacatatttattcatgaaataccgaaaaagcgttggcattttcttttctaatatcgttacattgtgtttcgtataaacaattttcatcttttttttaataaacttttgaagtagaaaagcatataataccattcgcaaactatttgcatgaataagttctatctttcgtttacaaatttcgtttcgtaaataataaatatttctcaaatgattccatcgactaagtaagataaaattttcttttctagtaagggattcatatagttctccatcacctgcagctgtataaatcttaaaatcctcataatgcaaattattttctaatttacagaaataattttcggctccgccagttatcaatttatcagtcatcaacagtatattcataattgcgtcttcccaactacattgattttattttttttataagcatgataagcatacttactaaaatagtaaaagctttgcactgcattaagacttttttggtcccttaataatttccaataccgaaaagctgctctaactttatttctcgaaacagaatttgctacaattcgatacttcgctaatacttgctgtatcccttttgcttcatgcccttcatgtaataagttcagccataacgctgtatcttccggctgtacactaggcatttcgacatacggaattttttcacgatcaatcatcaccgttaaacacccgataattgtatttcctactaaataatgatagtcaacagattttggtacactcacttcgcgatttaattcattaccattttcatcaattaaactatacgacgcatatgaaaaagcaatattcatttcttccataaataacaattgtgtcttcaatttatgcggcaaccatatatcatcactatctaaaaaggcaatgtaccttcctctcgcctctcgaatcgctaaattccgagctttagcagcaccaacattttcttttaatgataataacctaatacgtgagtctccttctattatctctttaatttttacggcagattggtcggttgaacagtcatcaacgataatcatttcccagttttcatacgattgattctgtacagataaaattgtctcacctataaatcgtctactattataagaaggtgttattacagaaacatgaggcgccttattatgtgctgatagacattttaccatctatctttccccttccttcatatattgaaatatacttctcgacaactgctaaaaataaaaagaacgcttcgttaataatgagtgacaatgacatcatctgaaataaaaatgcaatcatagtcaatagaaggtatggtttttcacgaaacaaagtatgctgcgctaacttaaacattaatatgaataaaaacgcactatatagaagaaaaccaattgtacccgactcagacaaaatttctaaaaatgtattgtgtacatataatttttcattaaattgatactcataataattcgagaagttaaacgcaccaattccgatatatggattggatgaataatatccccaagcagcttaaaatcatctagatctaccacttccattatcatgggaggaatca

SEQ ID NO: 1386 - DNA, 23323 bp, Bacillus thuringiensis
tggtaaaacctcttcgcaaatctaacttgaatatgccttccctagtggctatgaacagatatctatggatgatttaacgcagataattgagcaaccaggtcgtaatcgacgggggaagataccagccagcaagctaatggaattagcctctcattcgtgtggtgttaccttctgtaaaaaggctttttccttccaactaaaaatgttgatgaagcaaattcgttttatcgaagatcaaatcaaagaatgtgaagaagaaatgtcacaacttttaattgatttagaaactcctatcatgacaatacctggtgttgggcccattttaggagccactatactaagtgaaattggggatattcaccgctttgacaaaccatctaaacttgtcgcttacgcaggcattgatgcctctgtgtcccaatgtggacaatttgaagcctcaggtacgtctatatccaaacgtggttcttctcatttgcgtagagccttattccaagcggctattacagcgcataaacatgaccctgtattaaaagctttttatgaaaagaaacgaaagcaaggaaagcactactatgtttgtataggggcggtagctagaaagctgtgttacattatctatgccattcttaaaagcaataagccttatgaagtaccacctcacacaacagaaacatgaccttttcattttttttgaaaatccttaggtttatttggcacgcccttttttagaaaaacaccccctatttatataaaaaactccccttgacttctcatagttggtctttcaactttctatacttattataacacgcattgctatgcgtatcaataggtgagggtaaatttctctgtttttttatatgtttttttatgaatatatcagtatatcgagcacccaaattgggtgctttttattatgtgaaaattacataggtggtgcttagtaaatgacacgacattatttaataggtacattagttaattggcgtgaaagtgtagaaagatttcactacaatgaatcattccaatttttaaaagaagaattccaattaagtgatgaagatacaataaaagcattttggttatctttctataaatggtacgaatacagacacccgaagttacgagagttattaggagaatggtaaggagtgagcaaagcgaatggctaaggaatatgcaaaacgcttttataaatcaacagcatggaagaaatgtaggggggcatatattgctgcaacattagatggaatgtgtgagcattgcaaagaagtacctggatatatcgttgaccatatagtggagattacaccagtaaatataaacaatccagacatcacattgaaccatgagaacttacaatacttatgcttacaatgtcataacactaagacatttagtaagtacagtccgatgagggaagatgtaatgtttaatgagaacggtgaattaattaggagggattagagatgcagtgtaatggtaaggtgttaaataaagaacaagtagacaagttacagttcatgattaataactattctaataagggaatggatatttgtacatgtgatgtagagcgggtactaaacaaacaatatatgaaactaacaaagctagagaaagctattgctcttagcatagtctttaatgctattgataccaaggaactagatggacatgtaagtaaagaaaaattatcggatgtacttaaaataattgaagcgttaaaagaagagatagatgcagataaagagttagaagaagaaaaagaagcgcatctaaatataattaataaactaattgatagtttattagcagaaaagaatcaggaacaaaaagaaccaagccccccctttcaaaaataaagcaaagccccttagggggaccgagaggggagcttcacgtaacacacaggtcattgctatagggggtgtggtcatgggaggagtgaaattttatgagcgataatttagatatagaaaaagaaaaacgaattaagagagagatgacacgattaaacagtttattaaagaatttagagccgaagaaaaagagagctgtttcttcactcataaaaaacgctgcttttatggctgtcactttagaagatctgcaagaagaaattaatcagaatggtgttacggaacaataccaaaacggagcaaatcaatttggagttaaaaaatcttcagctgttgaagtatacaatacaatgataaaaaaccatgtacaggtaatgaaacaactaactgacttgcttccgaaagaacagcctaaagaagaggatgatgggtttgaagactttgtgaataaaaaatgagtaaacgaataagaaaacagtatccattaacttataatccaattattgagtattacaatctcattgaagcaggggaagtaactgtatctagtaaagttaggcggatatataagaaactcgttaatgatatatacgatacctcttctgtatttgagtacgatgcgaataaagccaatcatgtaatagaattcattgagaatttttgcaaacactcaaaaggtaaatggggcggtaagccaattgaattggagatttggcaaaaagcatttttagcagcttcttttggatttgttcataaaattgatgggacgagaaagtatagagaagtactcttaattgtggctcgtaaaaatggaaagtcaacaatcgcttctggaatagggttgtatttgcaagttgccgatggtgaaccaggtgcagaaatatatgcagttgctactaaattagaccaagcgaaattagtttggctagatgctaaaaggatggttaagaaatcccccgtattattaaaacgaattaaaccgcttgttcgtgaattaaatgcagattttaatgatagtacgtttaaacctttgggaagtgattcagaaacacttgatggtcttaatgttcatggagcgatgatggatgaaatacatgcttggaaggataagaatctatatgacgttatagtggatggtacttcttcaagggaacaaccaatgatatttatgattacaacagctggaaccattcgtgaatcagtttacgatatgaaatatgaagaagccgaaatgcttttaaatggtttggacgatccagacggctataaagacgatcgctttttaccaatcatatatgagttggataaaagagaggaatggactgataatactaaatggaaaaaagctaatcctggtttaggtacgataaaaaagatagaccaacttgaaacaaaggtaaacaaagcgaaagcaaattctttgctagttaagaacttactaacaaaagattttaatatccgcgaaacaagtacagaagcctggttaacatttgaacaattaaataacaaggctacctttgatgtagcaaaattaaagccttcttatgggattggcggttgtgatttatcttcaacaactgatttaaccgcagcgaaggttatttttatgcttccaaacgatccgcatgtctatgtattacaaatgtattggcttcctgaagatttgcttgagcaaagaagtaaagaagataagattccatataatttatgggcagaacaaggaatattgagaacaacaccaggtaattcagttcattataaatttgtaacacaatggttcttagaagtcagggatgaattaggtatttatattccgtggatcggttatgatagatggtccgcaaaatattgggtggaggaaatggaaggctactttggtaaagaagcaatgattccagttgcccaagggaaacaaactctttctagccctatgaaattattaggagcagatttagagtctaatttagtaaattacaacaataatagcattgataaatggtgcttatcgaatacagccattgatgtggataaaaacctgaacatacagccgaacaaaacaaataatcagcgtagaagaattgacggaaccgcagcgcttttaaatgcatatgttgtgcttcaagaaaaacgtaatgattacttaaatatgatttgagggaggtgaggaattggggttattcaacaaaatattcggtagaaaacaaccgcctactacgacccgttttgaaatgataaacgataatggagggggctttttctcgtggaatgggaatatctatcaaagtgatattatcagagcctgtatacgtcctaaagccaaggctgttggtaaattaatagcaaagcatatacgagataatgcaaatgaatttaaagtaaatccagagccgtatattagattcattttagaagaaccgaatccattaatgacaggtcaaatattccaagaaaaaatgactgtacagctagagctgaaccataacgcctttgcatatatcaaacgggacgaattaggagttccaattgaaatttatcctttgccatgtgtaacagtagaagttgtagagggagctcaaggtgatatttttcttactttttattttaaaaatgggaagagaatgaccgttccatatgtcgatgttatccaccttagaaaagattttaacgaagatgatttctttggtgaacatccaggtaaagctttatcttccttaatggatattgttacaactaccgatcaaggaattgtgaaagcaattaaaaatagtgcagtggtgaaatggatattaaaattcaaatcggttttaaaacaagaggacattgatgcacaagttcaaaatttcaagaaaaattatttgagtattgataatgaaaacggtggagcagcttcatctgatccgcgctatgatttagaacaagttaaaccagaagcatttgttccagattcaaaacaaatgcaagaaacaacacagagaatttataacttctttaatacaaacgaaaaaatcattcaaagtaaatacaatgaggatgaatggaatgcttactatgaatctgaaattgaaccgttagcaatgcaactttctggggaatttaccaggaagtttttttcacgtagggaacgtggctttgggaacaaaattattttcgaagcagcaagccttcaatatgcttctatgcagactaaaatgaatttagttcaaatggttgatagaggagcaatgacaccgaatgaatggcgttctattctctctgtaggtccaattgaaggtggcgacaagccgattcgaagactagatacagcgttagttaaagacggaaatacaactgttaaagaccaactatgagaagtcaaggggagttttttatataaatagggggtgtttttctaaaaaagggcgtgccaaataaacctaaggattttcaaaaaaaatgaaaaggtcatgtttctgttgtgtgaggtggtacttcataaggcttattgcttttaagaatggcatagataatgtaacacagctttctagctaccgcccctatacaaacatagtagtgctttccttgctttcgtttcttttcataaaaagcttttaatacagggtcatgtttatgcgctgtaatagccgcttggaataaggctctacgcaaatgagaagaaccacgtttggatatagacgtacctgaggcttcaaattgtccagattgggacacagaggcatcaatgcctgcgtaagcgacaagtttagatggtttgtcaaagcggtgaatatccccaatttcacttagtatagtggctcctaaaatgggcccaacaccaggtattgtcatgataggagtatctaaatcaattaaaagttgtgacatttcttcttcacattctttgatttgatcttcgataaaacgaatttgttccatcaacatttttagttggaaggaaaaagcgtctttacagaaggtaacaccaaacgaattagaggctaattccattagcttgttggctgttttcttccccagtcgattacgactggtttgctcaattatttgtgttaaatcatcaatagatatctgttcatagtcactaggagaggcatattcaagtaagatttgcgaagaagttttaccaaaaacatccgaaaagatgctttggtactctgggaaagtctgatctaatacgacaagagcttttcgttttaaatcactcatattacttacaagcgcattacgaaagcggctcatttgttttagagcgaacattttctcgtccacaagtggggtttcaacaaaacggccgaatcgaatgatatcggcaatcatagtggcatcaatggcgtctgtttttcgctttctaatttctgttccttttcgccaagcattggtttgaattggatttaatacaacgactgagaagccatgatcaagtagaaaagaataaacggctaaccaataatgtcctgttgcctccattccaatcagtatttctgtaggagactcaatatattggtacatccaatttaacagtgcttgtccgccttctttatgattctgaaagggaaatggcttagtaataggttttccagtttggtcgataatggacgcataatgtttatgtttagcgatatcaatacctaaatagaacatagcttacacccctattttaatcagtgttagatagtgttgtcctcctctgaactaataagcgctactacctcgtaagagatacgaagaatgaccaatggtcatcaacatccaactcattcgtaaactacttattagacagaggtaccattctttcaaccgaatacaaagattcaaggaggtggtcggcaacactctatctacaaatataagtatctcatataactagatactcacgggtttataggtaaatccctttcctaaaaaacctaactttatcatacgaggaggtaataacgatttctagtagggaagtaattaagaggttaaaaaaagaaggatggtttatagtgaacattgaaggcagccaccatcagttcaaacatccttctaagattggtaaagtgactgtgaaacatccttgcaaggatattccaaaaggtacacttcgctcaatctataagcaagcgggttggttataaaccaccccttgctttccctaattatacaagaaatcgttataaaaacaaattatgaaaaaagactattacgtttatcccgctatccttgaaaagtcttcagatggttacggtatttactttccagaccttcctggttgcgtttctcatgcagatacacaagaagacgctttaaaggaaggtagagaagcattaggacttcacttatatggtatggaaaaggataatgaatcaattcccgaaccgacaccaattgataaattagaattagatacagacgaaaattcttttttaattgatgtttggatgccaccacttagaaataaagacaaaacaacttataaaagaaaaaatgtaactcttccttcttggttagaagaatacgcaactcataaaggcgttaatttttccgagatccttgtagaaggtttggaaatgcatttgggcattaaagataaaaagaatacaccataaaggacgccatgagcgtcctcttttttatataagctatttgtttactcatattcatttttttattcttctttgaaccgacactatagataggcacgtatcagctcaaagaagagcaaaagctctccttatggaccgtttaattattttgtattcctgcataatcacaattagattctaaagttctctttgtaattatttacttgccctataaacgccagttcattcaaacagacatccataaagctttattcggtaaccaacccattcaaattttacagttactattaaaaatagaaaagagcaaccatgcaccagtcgctcttacgtaaaattctatgctattactataattcattttttcaatagataccatatgtaaaacttactgtaagaaaagtgtaagttcctcagcaagctttatccttctagaaatttcagcatgcttctgatatacataactactactatagcctaattccctagctatagattctaatgtttttcgttgcacatacttaccaaatagaattttattttctagtccttcaaacttaccaattaatattttgaggtcgtactgatcgttcatcttattcgctagttcatattctatagccgctatgtgttcctctattttcgcaccatctgaatcagcagttaacttatactttgataaatcaccaacactccaacgcattaattctcttttacttctatgcaatttattttctaaataaatgatttcatcttccaactttttataatctttaaaccattcaaacaagggttggctcacctgcttcctctttcaccatgtaaactcatttcttcatgttacgtttatttaactgttttcttaaatgcccgtaactcacattaaactttttagcaatttcaatatatttcatcccatgttctttaagtttcatggtttcttcacaaattgtattccattcgtcttctgttctttgtatggatgttttaacaaaaactttaccacccaaaacaacccctatttcattcaatctcttccctacttcacactttgtccaacaatacacaaaatcacgagaacatttattgtcacactgacggcaatgattatctgttaatcctagtatttccaccctcgcttcttttggactcatatagtaaccattcctaacttatctacatgatataaataatcaacaggtgctctattagtttgtggtactatatacgctcttttctcaaattcctctcttggaatagactttcttcctccgtcatacagcatggcttcatagtattctgctactacagaaacaggaacaaaataaataacctgatccgttctgaattctattaaaaagaaacaaagtgctccctgttcttgtgtatcctttaaatagtcaatctggtgcctacttatattatctaacgggaagcttgtggttttttcagtagatttcgcttcaaaataaacagctcttcctttgtacacaccgtcataatctactgtagatttactttcccatgcacttttagttatattgcctttcttatctgtctttatcacttttattggtgtagggcgcttattaaatactcctacattcgccgctttatacatacggcatgtattgtttaataaaagctcaaataacattcctctatttgcgtaacccatgatacaccgtctctttccactaaaataattattttttacaaattataatcttgtactacctggcttaagaactctcttaccgcgttcttctttcttgcttcgggtttaattacaagctcagttaccttaaatcccagcaattcagcaccttctatatttcccctaagcaagttatgtaaattatgactataatactcatccgttacctcaatcaccaattcaagcttatgaccagcaggaaatgtaagcatttttgttgcttctctatataattcatcttcttccattctcttgttgtgtctttgtaatttttcttcaaaatcttcagatttacttatctttatcattctgtctcacctttatctaaaataagaattttgtaaaaaaattaataaattctccagcattgtgcactctatacctaaaaggactaattatgaaaattctaaaattcatcatctttacatttgcctggattatatatgctgcatttttgtatgccatattctttttatgattattttttatatacataagcttaagaattataaactctttaattttcatcttcccaaaataactattttgtccagttttctaatagctctacattctcatagatattaccttttacatgatttagatttaattcactccacagcaattcagcatgatccactccgttacaaatccaccaagcgccttccatctgcttaactgctcctgtgaatccatctgtttcttccatacgatcatgaaattcttgatagacaatgtccccttcgtaaatttcactgccttttacatcctcaattcccgtgtatcgaagtaactcaacatctttcaaaggagagatatacaccgcataacaaatgccatcaacgatatgtgccaattgcactctttctttagcaaagtctataaatccgacttcatacattttctccataaccttgtcccacgcccgaaacttaatatcttccatctctcattctcctttacgaataattttttttacattacacatactatctacgagtcagctacattctttcaaaacggagctttacccctccggactgtttaggcatttggcaggtgatttggtcaattacctgccattccgattaaaataacgcttttgttaaaaactttttgtccatgtaatcattagcaatgacttttctgttgacgggccacattgattctttatttctggatctaaccatctatccccgagatgatgttcagctacttcctgtgctatctcaataaattcccaatcagatatacccttcaaatattcaagagctttttctttatccatatcaacactccccgtttcttaacaaaattcaaatttgataacattccaggactccctcatttaagaaagtcctggaaatatagtttatttaacttgaaccaatggattagcttctccacttacttgtggtaacttgccatcccatttttcaatttttttaatttctacaatttctggagttaaagacttcttaataatctcatttgcttcagcttttcctctcgcttcctcaatggctttctctgcattgattgtagcttgctttttctcaatctctgctttttcaaggttttgttgagcatctactactccttgaatcgcttttgctgtatttgcatctggtttaggagcttctaacgtaacagaatctactaagaagccagtagtatctaccatttttctaaactccttttctattgccccattaatttccccttgatgttggaatacttcaagaactgaatagttagagaaaacgtttaatgtagctttcttaagtcgagtttgtaaccacccgttctcaatcacatctggggcctgtcctttgaacttgttataaatcttaggaagtttctctgcatcattcatgtaatcataagatagactcactgttaacggctttccatctttggtttgtacgctaaatttatctactttaaccgtttctgttgaaataggataagctgttacacgtttaaatggtgaaactaagtgccatccttgtcctaaggtctccttttcaattcctgtacttctgttataaacaacacctgcatgtccctggtcaatcacctttacactcattgcagttaaaattccacctgttaaaagactgaatcctactactgctgcacctacgattttctttgtattcattttatttttcctccttgaacatgtttttaatttttaatactacgtttccaatacactcaaaaactcctaatttaccagctataatccataaaaatgacaacaccatgatacacactataattcctacaaataacgagaacattgcatcactcctttctttttagcttcacagcaatccagcgtggtatttttgtatattttaagagtgcaaacatggtagtttccgtatccccattcgcaaatgaccaacaaactcttcccatcattctgtcccacttaaacgttggatcaattttttctttgtatggccataacgttttgttctctttaatagttatatttcccatacctttcctagcttttttaaaccatttgtaatctttattgttacccttacatgcatataaaccatattgagtgcctcttgcatatcgcattttaaatgtatccccttatcctttatttgagattgagcaaactatttatgcaattgctttatccagccatatcctcatcaaagaaaaggatttctaaattagctgttgcaacttcatacatttgatttgaattcatgagttctacagttgctctatcttctattacatgtaacacacgatatgcatacacatcatcagttacaatatcaccagaacgatactcgttcggcttacgtcctttttgagcaaatacacgtcttacactttctgcgttgatttcctcaactgtggcatatctacatttattcgcatgattgtagccccaatcaccatgtattgttccttcgcatccccacgatccccataattccactttattgttaaatgtatctttaatcactcgtttcacttgtgtaataactttgttatccttcaattcgcatacaacccattgaccagcagctacattcttttcatcaatttggaaattcattccctatctctccttaattaaagatttatgaattcaaactaatttgctatataagttagctttctacgcttcattatttcttctcttgatggtataaccaactttgaccaaggtgaagcttcttttgccttctttccacattctgatcgtgttaacactggagttgttatggcttcttctacagtccacttcaaacgtttaactctgtcacgtgccgtattataactaataccatttaattcagctttgttccgcttgtccatcagttaacactttatttttacattttgaattgacttgttccgccaattttaatgcttgatacttatctataggtggcttactgattgcatcaatcaatctccaacctttttttattcttgctgtataagttgaatgagagataccatttttcaaagctatttctttaatgtttttccatctatttgcgttatatcttgatggttttgtcattgcaatttctttgtcccatcccaaatttctaatcctacgtgtcagtaattcattactaattccattctttgcagccgcctcatattcttctggagttatataataatcatatggattccgcatgagtatcttctcctattcaattgttagttaagttcttgaatttcttttaacgatctattcgaaacttcaatactacgaatcttaaaactataattcttacgatatttttcacgaatttttaacgccgcttcttctttcgtttcagcttcacaaaattctaatttaaatcctgattctgtaacaatatccaccatgtatgtatctataagtggctcataaataaaatcatgatctattgtgatttgttcagtcatttagctcaccttctatcggtgaaagtgtaataatcatttgttgctctaaaacgttccctatcacagcattcatccataaattaggattcatttttctcattaaaaattcgatgactacaattaactcttcggtagataaggaaacaaattctcctaaaggttcttgattgaacctgccaccacatttttcaattgttagacctacttcgttgtcaatcacgtacctttttgcagttactaaatcaaattgacggactttctcacggccgaatcctattattaattcctttagtacgtcatgaatgacacgaaaatctaacacttttactttctgttcaagctgctctctacactgcttgcataaagtcctttccaaaccagaaatatatattttactcatatcagactcaggaaaaggattttcgcatttataacactcttctccaattacatcttcaaatggatttaacatgtaaatcgctcctatgatttatatttgtttagcatttcttgcaatctctcacgctcttcatcaatagattgcgagttttgcttttcaatttcttttttagttggctcaacatcttcacgtaaccaatctggaacaatttcttttctatttgaacgacctggtcccgaaccattcaatcgcttattcttactcatttcaaagcgtctatctaatgcagcaacatcatctaatgtttttactttttgcttttcccagcttttcaaaatagccttaatataattccattttggtttattttcatcaatggctttgtgagcagcatgtttaattaattcgctaccaaacgaatcacaaaactctcctaattccgtaatggcaatttcacttaatggaattccttcaccttttaaaaagttataactgactttaaattcttcatcgactaatacatgtgatttcgattctttattatcatcatgataataattagtattttgtatattattagtacttagtaaagaattagtatttagtagtcggcatttttccatagggtggttcgtccactcggtggtttcaccatcatgtggttcatccataggatggcttttccactcagtggtttcaccactaggtggtttatccaccctatggtttttggtatctatggttggtaactcataaacaatggtttcccaatgtgaaattttccctgtttctgaattttggattggatatctcttcaaataccctgcctttttcaactcttttagggtacttgttgttgttttctcgctatccttggcatgttgacttaattcagtagcatgaaatgtccaatcatccggtaaagaaagcatgtaggctaataatcccttcgccctccaacttaagttctcatcacgcaaaggcgtattgtgtatcaccgaataattcgtatcctttttcactcgaaaaatacccatatttcctacctctcctattttcaaaacatttattaattgttataatacgtattattattttttctttaggacccgttgcagcgggttcttctcttatgcattcttgcgaattctttcaactacttcttttctgccaccaaccttttcaagatgatctgctacacgaaaaacctctgttttttctgcttcacgatcacttttctgtttcttaaaatacatagctgataactgttttgaaatctctaaatctcttataccttgcttctgataagcgttatgtaattcaagatacaaagttttattcctttccttatttgcctggttcatttgtttatataacagatgcagattttgtatacactctctacgctcctcttctaattccaaagccttttctagatgttccggaaaaactcggctttctattcccatcttttaaagcctccctttctaagcgatcactttcatcaaactttcgttcaatgaaagtaccacctttataaactccatacgcaagtatcacaatccctaatccaaagatacagacattcgttgtactttctaccgttgtaatatccattaggctaaaacaaacaccttttcagactcaatttcttgcgctaaagcttcttttaaatactctttaatgttattcatcgcttctaacttccaagccccaccatcggcttcaaacaaaccacaacgtgccccttcacgcattctgaatacaaacttactttcgggttgttctacttcaacaaatgttcgatatgggcttaattgcactggattaggtacttttgcattccctctactcgcaactcctgttttcaccgttacagcttgtgatacaccatcatctccaatttccttcacatcattttctacaacggtaccaactacctgtaaaacgatgtctcgatgattgttttgtacaaaacctgattgcaatgcaatattaaattcttctctgtcataaaaacttccaaaattaaaacgtggaatggacgcttgtgcttcgatataggtacttctagccttatctccattaaccgcagtaaagcatcttaccgttgttgggtttacaatatgaatcattacaggttcagttgtgtcaaattctgatttcacgtaacctactaaaccagataaactacgaacagtaatctctgctggtgtcggttcttgcacaagatgtaatctttgtgttgaataagtttgttccccgattttatgtgtttcaatcgttccaatctctagtaccttttcaattgcttctcttgtcatagtcattttttatttccccttttcttaattagatttacttttcatataatcgattactaccgtttgcttttcagcaacctgattttgttccttctcttctacttcttctacaggttgtccaacatctgttttcacatcaccctgtagatccatataaaactgtccctggatcccggaagctaactcttgaccaactaaatttccgttttgatccatatctaatagaatcttagattctaccgcttctgttggcgctagtttcgaagtggcttgaacttgacaattccatacatcacgctttttatcaccagcaaacgaaagtgttaaaacaatctttcttgcttttttaggatcagtatttaaatccgccatattttccattacacgctcaaactcttgatgaaatctttcagcaagtgctccatcagcaaatgtatttaaatcaatcatgacttccattatttctctcacctaatccttccttcttaaaattcaacatctacttgaatatcaatgttcataggtatttcttgcgttacacgaattgattttggacttacacctttttgaatcaactttttaacttcttcttttgcagcttcttttgtgtgaaactcactgatacctggaaaacctgcgaaattactagtaatcactaaaatcttttgttgcatgtttgctcctcctactgaacttccgccatatttatttgtgcatttgtagctgtaatttcttcttctaaaatgattggaagtgaatattcttcattaatgatttgaatcgctctatctaaatgatgacgtttaatagctttataactactaatcccaaactctctatgtaattgactataaatatcgctatacactttttttctaaggctaacatcccgataagcattagattctttaccacctaatagaagaacacctaactttcttacaacctttgatacttcatcacattcgatagcatataaaggggcgttttctcttaaatccttcacatcggatttaatctcctgaatttcctgggtatgtccttctaaagcttgaaacgttaactttaaaactcccattggatctgtaggtattttttgttgattttgtatatgttgcttcattcgtttaaactcttcaataaacttgattttcatttgaacagcttcttttgtgttataactcattacaactaatgtaaaagcttcttctgtcagatcgattttaggataacgacgccctctattttcataagttcgctccttaaaattcaggagtgaaaattcataacctgcatactccatttgagttctgatatcagccataacattgtcatgacgtttattgaatacttccgcaatcttcaagctatctgtaacaacttttccgttgttttcaaatactagtgcttgttcgtttgctactgttaattgatccatattactttcctcctctacaaactcggaataactttagttttatccgtattacgatgtaccaaatgcaattcattacttacttttttaaaaatcaaccaattatcaggattcaaattgtatgatttaatatgaaccttttctttttttgttggctttttaccatttttcaattaactcacttcccttttgctcatgtcctttaatttgcagaaccaatatttatcgtcaaatttcgcgaatatgttaaaaaaattatttactttcattttttatatttcgttgttccacttttctttgaatgattaactctcgtgcagctggtattagcggtgttaaaaattccttccactgttcccttgtaaggattactttcaccacatacccattttcatcacgaataatttgtcccccactcatcctcaatcacctcaatgcatctatatgtttgtgggacactaggactatccatttaaatcaaaatttcatgaaacaatattcttcaaattattcgctctctcttgaacgcgttttttcataagtacgaatttttcgtacttaggtccaaaaaatatatcctcataaggaacatcaaataagtacatgtactttttgattaattcatctggaatgtttgttgaatcttgttcatataaccatagggtttttggggatacttctaatatatccgcaagttctgcttgattgaaccctgcactttctctaagttcattcaatgttcttttcaagtaatccattttgttacccccttccttcaatatttattgtattactaaatttatgtaatttcaatacaaaagtacgaaaaaatcatacaaaacgaacactttacgaataattcgtaatgtgttatattaaaaatgtagttacaataggaggtgacggtatgactgatttacaaaaacaaactatagtaaaaaacataaagaaatttttaaaagaaaatgatatgactcaatcggatctagctagtcaaataggaatcgcaagaagtaccttaagcgattatatgaattacagagccaaaccaagttcaggggttttagaaaaaatggctactgtgtttggagtgacaaaatctgatattgatacaacttataagaattcaaaagttgaaattgtagatggagaactccaattagttcaagaaaaacctactgacaatgaatcaaaaaaggaaatccctattattggtaaaatcgcagctggcgttccattggaagctgtacaagatatagttgatagaattgcacctccatacaaaactcacaatatcgatgaattattcggacttgttgttaacggtgaatccatgaataaaattgtccctaacggccattacgccgtactaaaaaaacaacctgatgtccaaaatggagaaatagcagctgtaattgttaatggacattacgcaactttaaaaaaggtgtataaatttacagatttaatgattttagaaccttgttcacatgatgaaagttttaaggaccaacaatactcacaagataactgcgaggatataaagattataggaaagtttttatacagcgtaagtccaatcattcaataattaggcggtgaaaaggtgtatgtagtcggcaagtgtcgactgaatgaaatattgaaagaaaagaaattaactcaagtagatttagcactgaaacttggcatggctaaacaacaaatacattcttacgcaaacaatgacagggttatgtcttatcagaccgctaaaaacgttgcttctcaactcaatattaatatggaagatttatacgaattcattcagtcggaaaaacagtgagtttttctcactgcacctgaaagtcaactacttgattgacctcaattcataatgcaccttattgaaacttatattttcacatagtattcgtctaataaattaaaaatatacataaaatattgattaagaaaggggtttagttaatgaaatgtgtcatttatagacgtgtatcaactgacatgcaagttgaagaggggatttcattagatatgcaaaaacttcgtcttgaacaatacgccaaatcgcaagattggatagtggtaaatgattactgcgatgaaggatatagcgccaaaaatacagaacgacctgcttttcaacaaatgataagagatatgaagaaaaaacaatttgatattattcttgtttacagattagatcgctttactcgttccgtttcagacttacattcaattctaaaaataatggatgaatataatgttaaattcaaaagtagtacagaaatatttgatacaacaaccgctactggaagaatgtttattaccttagttgcaacacttgcacaatgggaacgagaaacaacagccgaacgtgtacgagactccatgcataaaaaggctgaattagggctgagaaatggagctaaagcacctatgggatataacctaaagaaaggcaacctatatatcaatcatactgaagcagaaattgtaaaatacatattcgaaatgtataaaacaaaaggtgtagtaagtattgtgaaatctttaaacagtcgtggtgttaaaactaaacaagggaaaatatttaattatgatgcagtacgttatatcataaataatccaatttatattgggaaaattcgatggggagaggatattctaacagatattgcccaagaggattttgaaacttttatcaataaagacacttggtataccgtccaacaaatacaagatagtagaaaggtaggaaaagttagattgcaaaattttttcgtattctctaatgttctaaaatgtgcaagatgcggaaaacactttttaggaaatagacaggtaaggtctcataacagaattgctgtgggttatcggtgcagctcaagacatcatcaaggaatatgtgatatgcctcaagttccagaaaatatacttgaaaaagaatttctaaaccttttagaagatgcagtcgttgagctggacgcttctgatgaaaaaccagtagagttgagtaatttacaagaacaatataatagaattcaggataaaaaagcacgtctaaaatttctattcatagaaggtgatatccctaaaaaggaatataaaaaagatatgctaacactaaatcaagaagaaaacataattcaaaagcaactcgctaatataactgacactgtatcttcaattgaaataaaagaacttttaaatcaattgaaagatgaatggaacaatttaaacaacgaatctaagaaagcagcagtaaatgcaattatatcttctattacagttgatataataaaacctgctcgtgcgggtaagaatccaattccacctgtaatcaaagttatggatttcaaattaaaataaacacaacctaactgcatttatttaatgtagttaggttgtgtttaattgaccaaaccatggtgtttgaaatgcactgccgccagactgaatcaatccgctcaactgctctttatcaaacagttcgtgtaaaatcgaacctttatccgttaatagattttgaagccatactgttactgcgtttgtatagtgtggattgtgcgttttcggatacggactcttctttctatataagatgtcatgcggaagtacatcttctaacgctttacgtaatagacctttttcgcggtttttatacattttcatttcccaaggaatattccacgcatattcgacaagacgatgatctgcaaatggaacacgtacttctaaacttgcccccatactcatgcggtcttttctgtctaataatgtggtcataaaccataccatatttaaataaaataattggcgtctttttgcttctagcggactttccccctctaaaataggaacttcttgaatcgactcttcataacgcctttgtacatattgttgtaaatttaatttatttctccattctttttttagaagttgttcacgtgcctctgtagaacgcatccatggaaatgcactcgattgtaaatcatcttctctataaaaccacggatatccaccaaatatttcatctgcacattctccagataagccaacgacaaaatcttgtttaatttctcggcaaaaccataataatgacgaatcgatatctgccataccaggcaaatcacgaacaagtactgcttcagttaaatactctgctaatttttcattcgaaatgacgcagcgatgatgggttgtttgaaatgtctcagtcattaaattaataaacggagcatctgaatttggctggaatgcatttgctttaaagtatttgtcattatcttcgtaatcaatagaatacgtgtgtaattgcccttttcccgatctctcatattctttcgctgcaatagctgtaatagcgctcgaatctacaccacctgataaaaaagtacatagtggtacatcagaaacaagctgtcttgtaatagcatcttgtaataaaaagcgcgttttctctactgtttcttcaaaagagtcttcatgttttttactttccacattccaatatctccatatacataaaccgttctttgaaaatgtcatcgcatgacctggacgtaattcttttataccagcataaataccgtggccaggcgttcttgacggtccgagtccgaatatttctgataacccttctaatgttacttccgccttcacatctggatgcgacaatatcgcttttaactccgaaccaaataataagcgtccgctatcatatttataaaaaagtggctttacacctaatcgatctctcgcaataaatacttgttctttctgttcgtcccatactgcaaacgcatatataccgtttaaatgatcgacacattcttctttccattcaatataagaagctaataatacttctgtatcagaatgacctttgaacgtataccctcttcttaataattcctttcgaatgtcttctgtgttataaagttcaccgttatagcaaatggcataattcgtttcatcttttaaacaagtcatcggttgtttccccccctcaggatcaacaacaattaaccgtttatgcccaaatgcgacatttcctttaatccaaattttattatcatccggcccccgcttcgctaacgtctcagccatcttcgtaacgacatctctttctccttctaatgagcgtttataatccacccatcctgtaatcccgcacatataaatcatccttccatcttatttcttttcttgaacgtgcagtaatccccaccctaagagtgcggatcaaaaaataaaaaacttgacgataacctactatccacatatggaatagcattctcactcagtaaaacgtgttttattgtatgcccacctatgtctagatgtgtctagttataaagaacgcacgaactgtctataacaggaataactacttttcataaaggagaaatcgtatatgatacaacgtaaacatattttatataaccagccccgtgctcatacagtcggtaatgtagaatatataaacaatgaatgggtattctttgatgatgaaaatgatgaagcgtttctattagaagatattgccgaagatgggtttgaaattttgtataataacaattggttaccagcccgtttctatgaacaagatgtattacaaatcgccaacgagcaacaccatttgcaaaatggtgaaatggtacgtattcgaaaaaagttacttcttagctataatgaatggctcgaggaattacctgactctgtcttcacattattaaccgaatcattgcaatcacttcactactctttatatgattgcatgtattgtcataattatttatctttcttaccgaaagaggagtcacgcgaaggagtaaatattcttttgtttgataacgacgaaatgatctgtacactgcagcaccatttcgtccgtcacactacgtcaaataaaaatatgttccgttttacgaaagtaaatggagaagagttgcatatcgatgcgacataaaataaaaaaccaccttatctcccaagtctttgagattataaggtggttttatatttaattgaatacgtaccagccaagtggcaa

SEQ ID NO: 1387 - DNA, 21346 bp, Bacillus thuringiensis
tgccaacaacttttatgacattcttagttgtgtttagcaagatacacgggagaggtttacagattcgtaataatgaagcaagtagggcttataacttattatggtataaaatatatgtaaactgcatactctagaattgacatctaaagaacttacaacatgaaaaagacatcttcgactggggaaggtgtctttcttacctttagtcaagtgctattgaaagatttgattcgatgaagtaatttattttttagagtgatgggtatctttcctctaaaaaataaatttgtgtacaccaaatagacctaacgagatatcatttttttcgcgaggtcaattgtgctatagtatatttagttgattacgaaccggttgatgctatttcgtaatcatatagtttttcgtgtgtaataagatgaaatgccactttcaaaaacttattcatacacgcaacggatgcaactttatgaggctttctcaaaggttgcttctttaatttgtcatagtattctaccagatgattctttgttttcttacgtaatgtaatcatcgatgtaaccataaagaataagattttccttagtttattgtttccccttttattgattttgtccttataatgagtattccctgactgataacgcctaatatcaatccccacataggcatttaattgcttattatttttaaaacgtcttatatcacctaactcaccgatgattcgaacggctgttatttcccctattcctggaaatgaccgaagcacatgatattctgtacgttcattagaaagttccaccatctgctttacaagctgtgccttcttctctttcaagtctgcaatgcggctggcataatctttgacttgctcgcagcgtacatcgtttcttgagattgctgggtaagagatttttgcagctttaaggagggcggttcctttctcttctactcgtttcaaagacaaccgtttttgtgtatttgcctttaacctactgcaaattctcgttttagaatgggctaacacttcatccgggtgtggatatagttgtacgatattcaaaaacagggacgaccgctttgtaaatagctgttccaactctggaaaactcaattgtaggattgcgtgtaaccgagaatataaatgagtaatctcaatgtctaactcatcatagtaacgtgtgagtccacgcatctgttggtagtatcccttttcttgatacgtttgttcacgtcctactcgaaagtgcgattttgccagttcatgcgcgtcgcttttatctgttttttggcggcgcattgaagccgtttgtaagtttgcttcaagaggattaatacgacaatatgcataattattatcttgaaagaatcgttccaacggtttggaatatacacctgttgcttcaaaaacaatttcaggttcttctccacctcgacctatcaggggctgtagcgtttcatgaagctgttcaaaccaggatacggttatggttaatttccttctctacctcacattgacggtatcgattgtaaataaccatcatacttttacccatactgacatcaaaagctacaacgtgttgcatgacatgaatctctccttttttgccaatcatagaagcctccacagtgccttatcgattccactttcttatacacgatctcctggatccaacatactaaactgattcaaataagggtgtgaagtcgatctgtttatttatacggactccaatatggtccaagacacctttcgaccttacttcacttctactaaaaaaaatagtagcacaaaccgtggccttggtttgtactactaatgttagtatgttttgcatattacacggtgtacctacatataatgaaatcgacagtgattttttctccttttatgataaatctattgaaaaaagcattcttggggacgaatgctttttttctattccctatttcacatacacataggctccaatcataaaccctatattaaaagtaaattttaattacatataaaattaacacgttcctcttttataataaaactattcttttgtatagtaatgtgttttacttttcaaactttacatattcacctgaaacccattgatcaccaccaacattataccaaccgtccctatatccccaagactgatatctttcgctttggtgtacgttttttacgacgccataattagttcctgggccagtacgaacgcgtaatacatctgctgtaatagtaactacccctaaaccatcatttgaaggttgcgaagttgtggatgattgtccatccgcttcgaaatgtaaccactctgagttttcgtaaacccactgatcgccacctaaattaagccatccgccagaacgtccccacactttataattttcaggtgcatttagtttcctaattgaatcatattgagtccctggtcctttacgtaagttcacgttttgaccagtaatataaacaatacctgtaccacttgtaattggtggttgtggaatctgtggcgtttctggaatttgaatttccccaccagaaactaattgttgtttaaaccactgtacacgcccttcattaatcattctatgaggacaatatttaccgtttctttcttggtgtgttttaactttagaaattggaatgttgaacatatccattaactgacgaattacttgagcggcattcaattcagctttacgatatctttccccacctgacatagaataacaaatctctataccgatactattacgattacctggtccattcccatcacctgcatgccaagcatttctattaaacggaattaattgaatagcttctttgtcatctacagcgatatggaacgaagtacctgtactattgttagcgacattattacgttcgtttaatgccgtagcatcattatacgtgttgtggaatgtaatttccgttggattcattggatatggacataaaactgaataacgactttctggtactaacatttttttgatttccattactgaacatctccttttttctcttcctgtttttgtttaccgcccaaaatttcaactgcatttgttaatgctgaaggtaaggggattcccatacgaccagcgttttctaaaagtgaaagcaactcattgcccatgaagaagaaaatagtcgcttcacgaattgcactgttacttcccagtgctgaatctagttgagcggacgctccgaccaaaagaaaaagcaccacctttttggcgatgcctttgaaaccaactttactttttaattctccgttataccctgctgcaatcatgccagttaaataatcaataactgccatcgttactaagattttcaatgttgcatcccatcctcccaaaaaatacccacaaaagcctccaaatgtagctataaatgctttcattaatatatcaatacgatccatctttccatctccttatttataataaaaaagagagacgcttgtccctctctcaataagtacttttattttaagatattaaatcatcccttttaatattaaacccaagactgacatagtaattgcactaataataattcgtaaaatccaagttgtattaatgctaatcttttctaattgcttattaattgtagcaatgtctttctcattaattgttgtgcgagtttctaaattacgaatatctcgcataatttctttttgttctgcttttaaactgtcgatttttacatatacatcttccactgcattcacatccttttaaaatcttaataaaacaatctctacatgatatgagacaaccttatttatggtgaatgcatcgcagaaatttcaaaacaaaagccgtattttgtgcaaaataaaaacagcttatggctgccctatttgcgttgtattttcaattgttaatgtctcttgtggcggatattcacctgtaagtttaaaataatcatttgcacaaatgttccttttagcaactcctaagttcaattcatataatttggctccacaaccacataactcacatttcgttaaaaccctaaaaccaatagttccgtcagacatttccctccacacctcaactttactcgtatcattggaaacccctgcattatctaacatgtcagcaggtacttgtataaagactcctgtttccgttcgtttcacgtctactattcttcccatataaggaagcgtttcaccttcttgaaaaggcatcatatagttaatatccatgtttaatccttcctttctatccaagtgcgttaaatttccagccacttggagtactcacataaaaacccgctccagcattaccgtctgtaaaacgaatatgtccccattgttggaatccaccgccacctaagttaatcccctgcattgctcgtatattcctatggattttcacttctttttcagtacttatatcaaacgtttgtccgtctggtgatggagatatattattattcacaccacctacagcaagcgcgttaaacggctgaataccatctgctctttctgctgcagcacgatcccaattatacatagatgcatatttgccactgtataacgttacaccacttacacaaattgctgtcccttgtctcatgtcagcatttccagaacaaactttaataattaatgcgtgctgttgcggaatatagtttgttggcactttgaaagtgaaagagtatcttctgatttctccataaaatgtagacggttcaggaaaatccattttttgttcattccatatatcgtaacttacattgtctcggaatttaacgcagcatacttgtaaacgaggtttccctgttttacgtgcaccatttatcatagctgttctaaagtgagcagaaactgtatattcgttaccaggatgtatcccattattcacgactgtttcgggatagttatacatatctacccttgcagcatttaccatttgctcgtaatcgaatatatgtgtattcttttctattacgacatttccccatgacttccaagtaagaccatatccaccttcaaacccataataatcggtatgtccaatgtttttctttgtaacactagaaaagtcgggatctgatattaggtttcgtcttgataccgcagttgtttttgttccccattcgtcttggaataggaaatctagcattttaacagttacaccatctttatcaatagttatcttatcaccgtcaattctaataagattcgtatcaatgccttttgccgttaaccatttcaccattgtatcggcattaatagctacctttgaaacatcaatctctaatttttccgatgaaaagttaatagctgcgatgatattcccttttttaacttctgcaaggattccttcatcaagaaccttaagtttagaacccgttgcttttacataagcggcgtaagtctcatttataaacgtttcttgtttttcagaaatgattgaaacgccctctttattagtactaatacttctttctaattctgtaacttttttattgtaatcttcagtagctattctattggctatatcttctagcattttgtcagcatccgtttgatcttttggatgtagccaaaattctgtagctatagtgccacgttgtaacataggtgcagcacaccataaacgtccatttcttgtaacgtaataacgccatctcacaaacgccgcattagctggcgctttatctgtgcatacagcacgaacccatgtatgatttacaacagtgatattcgttctagctgtcttaatgcgagtttttttgtcagcagtccaccattcaatttcaataaatgcaccgccaccatcaataggtgttttcccgtcagtattgaaataacctgatgcaacaaagtcttcgttaacctgacactcaataaattgacttgtaagtccccaccaacgatcttgggactgtccagtaacagtaattgcaaatgtattcatacctttgtattttaaattcgtatcaacagcaccagtagccccattaccgctattccaaaaccaatatttcggtcctaacgtaaaattagcatcacgcaactcgttgacagtacctaaaccacctacataagcttcaacatctttctttttcattgctagcttcaattcttcagattgttgcaggatcgttgtagtagcttgagtcagtgtttccccttgctgagtttgtatttcctgtattttttttacatcacttgttatcccttcggcgttccgcgtaatctccgttactttctggctgaatacattttcttttaccccatcttccggagacggagcgtatgcttttggcatagatccttttaacacggatacatttttgaagtagcactcactaccatcagcagaacgatcaccataaatatataaactaaacccttttttcatatctgatttatcatgtaatttcattgttgtatgaactcgaacccactttttaacaggttcgatggtcaattctggcgtacctccactatgaaagcccattgtattgttaccctcaataaagtggtgtaatcctaccgctattttgttatttgctgtttccgtccatacatctaaagcgatcgtgtacgtatcacctggctggaaatcatttcgaaaactagctggcatttcttgaggcattccaagccaccttttagcttgaccgaattgaccatttttgttaataacagcaactacaggatacccaaactttttgtcatcaacgtgcatatgataaccctttgtaggatctgttgttccagcgttataacctgttgcccaattaccagcgcgcaaattaccgtttaggttcttatcccattgcagatcgttatcggcccaatagtgtgtgaaatctccgttacgtgcatagttacgatcaccagcatcattaatgatagattccgttttttcaatacgttcttttacaccctcaaaactttgctccaactcataagtcgattttgtaaaacctgtaggaacggaacctttttctagtttaggtttcttgaaacgaaatttcttaccctttgaattttcgtttctttcaaatcgtaatcgcaatccccatccagttgcccgcgcatcaatcttaaatgtaaatgatctcctagaccaattagcgacaggaaatctattgtacaagttttctgcccaaactccattaataaattggaatacaattaaatcaataagagcatcattttgcatatcgatactaaatgtcatatctttctctttttcgtagtcacccatcttagtattatctagatggaattgatagaaagagtcggtatgatctgtacattctacgatcatgtaatcctcagtgaacgattgagcagctttgttgactagtgcgcctccagacattccaattgtttgtggcttttgatttcgcccagtattgattagccagttttcaacgcccactgtacgagattcaacctgctccaattttttagagattctcccagcctcttctttgatctcggttgttatcttggtgaaaacattaccatctgcaatatcttcaggagcaggtcgccacgaataatctttactgcctatagtcaattgtggtgaactctgctgataccaacaaccagcaggagggtttgcatcaggttctatacgtaaatgactctcgttatctgttcccggtaacgacatcatacttgctgtcactgtgaacgaaacgcttaccctttgccattgattagtagatttatttggacggattccggtagcacctggtgcaaaatagaaagtgtgttgtaattcttggccatccggtaaaccttttactcgagtataaattgaataggttactttatctcctactttgacaactccccgattcaccaaatctttgaagttataagctaaagcagtccatgatgattgggtttcaacaactgcattaccttgaaaaacatctttcgaaattttaactttatcggctgatttaaaccaccaacgattgtctgcttgcgcaaagttcaaagcaccatcaaaagatttagaaccgattaataagtttcttacatcgtcattaatgtttgctacactttctttaacttgtgaaataactttcgtatttccgtccacatcactttctaaggtgttgattttatttgtagtctcactactatttttcgttaatgtttcaatagacagtttaaatttctcagaatcctgttcaacctgggttacttttttatcaatttcaccttgatctctttgtacgtcagaaatagttctcgtaactttttgaagactttctgttactgtattaaattggccagtggtttcttgttgcgcttcttccactttcttatttaattcttcttttgcgagtttaatatccttattaacctgctccagtgtatcttttttaattgattccacatcaggaataaggagttcccaacctttaccgttccacacttttaaaacaccaggtttaccgttactaatatctcgccatatcgtcttaccaattttaagattcgttgttggtggattcacagcctcgatgatttctactgtattattcttcaagttttcttgaactttctctgctaactctttcgctgctttcgactctttctgtgcttcatttacttttttatcagtatcttgtacaagttcttctaatctatctaacaattctttatttgctttatttcctaaagtagcgcgaatcctattgtacatttttcttaactcttcgttcgcatcagtaatttcacgataatcgccaaacacgtattgatcttgtgaaggatcagtatgtgattcatcaccaacgattgcccttgcttcaaggtataacttaggtgtgaatcctgtatctttgattcggattgtatcgccctcattaattagttcatgtgctagtccgaaaatacgtccaatcgattgcgcttctacttcgtatgaaacagaagatacacgttttgctagctctgttttcataagagtcagtaaacgttctggtgtgatatttccttctgtttctggagtatagaaaccaaatttatgctttccatgttcattccaccgttggaacgcatcattatcaacaatgtaaggaagtccgttattgatactctcaattgtgataagtttatcaccttcatctcgtacaaaaccgacaagtgctgtgcaaatatctcttgagtgctcaatacgtctaacaccaactaaatcttttcctagcactacttcttttccagtttcttggccacgtttccttatcatatctacataccggccagtgatttgagaacctactacttcgacacgatattggatttctaactcaaataaagtagcgattttctttaaaaaagcgagcggatctataaattcatcaatagtcattgtatggaatgaagaataatcggtttttccacgtttccactttgaatccgcaagagcaatatctataaacgtattaactgtttcgctctctatgcgttgtggtttaatgaacccatccttggctatttgaacccaagcgccagaagcatgtacagtaatcgttctatcattagattctttttctacttcattattgataacatacggaacaatacgaccatcacgcacttcctttaatactaagttctgttgttgtaatgcaactgcatgtgaagttccatcaaaagttttaaattctaacgtatcaatgttgtttttgatttcccaatggcgtttatcatcccaatagtcttttgattgaatgactgatataatctgatctgttttgaaatcaacaacatgaagtatcccacttggtgttctcatctaaatcgctccctatatttcacctttgctgttcctatatcggaaggtatgatttccagtgtattaatacctttattgataacaggaaaattactaaaaatatcttttatgttaatagcgtttttcccctcaatactgacatgactgctttctgtatcaatcacgactttgtcaccaacatcgaatatataaggcggtgtattttgattatttaaattcactttccaaaatttcaaatcagaaactgacatcgcttctactggcggaacatcttgccactgcatgatactaatctgtatttgagctgctttttccatatgtttattgtctttatcggtccatcttgcaaagcgttctgaatcatctttttctgttccaggaagaaattttgaaatataagcctcccaatcattaccggttctagcgatccacaacctaccataatactgattccatgtattcggataatcaccactctcataaatcaaacctatttttccaggcttattatcatatccaattaccatcgttccaaaattttgttcagcttgccaatagagatcattcatggcaatttttgaaagaactttgctgttttcatcgagtatcgctatctcaactcgtcccatttcattgatctttttacttttacatgtaacgtgggcttgcataataaaatcttgtactggcccaccaggaatactctttttaacagatgcgccatgccatccattactcgaaccatagtccgaacaatagaattggtaactatctgttttcatttcaccaactggattaccatcttccatagaactaaccttactccaccctacagtagtggacatatcatcccatataagacgctgatttctttctacaggcaattgttccatttttaatggcactccaatacggaaataatctggttcttttgaatatttatcttcaaaccatacatctaaaaaagtgtttggttttttaatatcaatttcaataatcggatttgaatgcacagagcctttgtttttaacattggcaattaaccctcgaccatcattttcaaaatcaaccgtttgctcatttcctaacttatacggcattggacaaataaatttcaaagtgccttgtccgatatctacaaatttatcaatatcaaaatcttcatctataactgccatatatgttctatcaggcattacatcaaaaatcagttctgctggattttcagtaataagccactccgctatttcttcttttaacgtttctaaattcgtcccatttggaacgataatccccacaggtacagaaagaggacgggtttcggtatctgtacttaataaccttgcgcccggatatccgggggttttcagaaaattcctccttaaaggcgcccatgttggaggattccagcctctttcaatatagatataactttttcgttctccattaaattcaaaggaactcatcgtctctctccttttatacaaaataaaagaaacccaaatctaaaagattgagtttcttgcttgtgctctattttgatattcggttacatacggatggctcacacgcgctatttcccttccttctagtatgacaggaatttctatataagtaggttctgactttatatagggttgcttatcaggattatcattgtcaggtctatattgaatgacattaggattatcagataacacttctctccatctagaaaggctgcctacatcatgaatggaaagtccctcgaatcgttccatttgacgtccaatttctcttaccatatcacgcatattttcagggatatgtgtaatccaatcattttgccaatctccatctacaaagattgcattaaaatactttgttagtgggtcatcaccttggaaactaaatatttcttctggttttatagaacgaatactatccatagctcctgttactgtatcttgtaatgcatctcgcacaacagaatattgacttttaatacctatcgcaattccttgtgccatacgaacaccagaaaatctcaacttatttgattcactatttaatttcagttcatttacaagagctgcgtttgccttggtacccatttctctactttctttttcagccatgtgagctgatttctgaatacctagcgcaaatccttcactaaacggcttaccaccttgatcacgtgttaattttgatggagagtttacattaagtgtagctttcaatgcatcaaatgcacctcgtgccaaactagctgctacattttgtacattccattcaccattagatatacctttagcaaacccactagcaaaagcttctccaggactaagagagctgacactccctaatccatctttaccaccttgagcaacacttgttccgcttgcaacagcggctccacgttttgctcccatatcacttgcgaatttattaccagccttatcaccaccgccaccatcggttgcacttcctaacatgccctctacacctaatttaacattactagctgctccgactacattccctttattcccgttaattagtcgttgcataagaagagtagaagatgcgccaccatttccatctgtggttgatcctaaagtattttctacactttgtttaacacctacggccgctccattgacattgcctttattattattaatattattaaacatcatagaagtcgcgttattaccgccattattatcagttgtacttcctaattgctgttcaacgcctagtttaatattaaaagcttcacctataatacttggcttatattgagccataattcgattcattaatgtagtagaagctgctccaccatttccgtctgtggttgatcccagtgtttgttctacaccctgcttaacttcctctgcggcttgaacaggttgacccccattttgacgaattccatctgcggtactttgcggaatagctgccccttgctgagttgtatcaatgtttgttttttgtacaaccatttgtcttataacttcgagtgcctgatctatattaaacttcccattgtgtaagccttgaacaagagacgcaattgtcacttctccattcggccctaagttgtacttagtcttatcttcaatattaactcccaatgtattgagaacgtcttgcacattaataaaccctgtttccataccagtttttaacgtagccattatacgagtgccgtcttttgctaaatctgctgctgttaatttagataactgttgttgaaaaaaaataaacacagcgtcaatacctactgtgccctcgtgtaatccatttacaaattgtgtagttttcatttttccgagtggtcctaaatctatatcgagattcttctttaaatctaagtttaacttagatgcgacctccccgatattcatctgtttaaaaccatcggtaaatgaagtcatgactttaataccttctggtgtcaatggtttattacccatttctgaccgcatagtgtttatgattgcaatcgctacatcttggactttgtacttaccagatttaattccatcaacaaattcttctactgcaacccaaccttgctctcctaaatcaatcgttttacttccatcttcaaatgtttttgcgatgtcatttgcaacttcaatagatttttcacgagttgactggaaaagattatcataaacaatattagaatttgcaattaatgactctccatatgtttttacttcatcagcacttttctttctcagatcagcttcttttgaagctctatcttgaagtcgcttgaatagattctcatttgtgctttcaattatttcggaattcttaacgtactctccgaatcctcgaccctgaattttaattttttcagtttcagccttcgtaatacctgttgttaaatccatctcaacacctttggattctaacactttttgcgcttgttgaagttgttgctcatacccttttgttatcaatacagattgctcagagtattttttgttaatttgagctatcgcaatttcttgccctttagtatcagctattttgcttttcgcaaactctatttctttttgtcttgctttatctaattcatttgttaatttcgtatactctgaacctagctcttttactttaccttgaattgtctcaacagaagtatttttgttgaaattatccattgctttacctattttttgaatctcatccacactttttgaagctgcttttccaacctctgcatcaatagcttttaaagctgtaagaaataccgacttatcggccgcagtcatcttatatatttgtccattatattgtgtaagtaagctctgaattttctcatttgccttaataactgcttcttcttgtgccttaaatacttccatttgatcgttaacaattttatcttttgcccttaatactgcggaatcagtttctccagcaaaccaactatctaaatgagcttgtaacttgcctctatctttattaatcgcttggattgcctcgtctgctaacttaccaaattcgtcatgtgctcgttgtacagcctctttagccttatcacctgtcattgttggtatttcatctaatgttttaaaagcctgttcttttaaattcacatacccttcaagagcttttttcgtaccttcacttacaccatcaccaaagcgcctactgtcctcctctgctttttgtgcctttttcccagcatctacgaaagcaaaacctaatgcaccaagtccaattacaactccaccaattgttgcgacaattggatttgctataattgcaccaataccaaaagaaaggaacccaagtgcactaactactcccataactgccggggctagtaataatgctgtcccatatacttttttagagctatcatctaatccgttgaaccaatcagcgacacccttcacagattctttcaattcaggaatcgcttgtttagcgatatctaaaatcaccttaccaagtggttctagagcaatttgtagttctcttgttacagatttccattgcttagcgcttgtatcgtaaccatcaaccattttattcattgcgccactgtagtttccaagacctgtttccatattatttagtgataacatagtagtagcttcaaggtcttcccatttcacgccgaaaagtgcaacgcctaactgattcactttaatttgatcatccgttgttcgtaactcatttaaaacagcattaaaaacatctttggaagtcgcttttccttctagcatcgctttccaaactttttgcgtttctttacccatttgacccattgcttctgttgtggacttactaccatcttttacacggataccaaattcttttacaacgtcattcacataatccaagttatatgcgccgtttttcgaaccgttaatgagaattgtgaacatttcatctgcactaaatcccatttcatggaacaaaggaccatactcacttaaattatcaaatagctcatttgagtagtttaaaccctttacagaaccttgtgctaataaatcaaatgcttgttggccagataaaccaaagcgtcccattaattgggctgcaccacgagttacctcgtttacatctgattccattgtttctgctaagatttcactatcacgagttacttgttttaaagtatcatcatcattaatatccttaatattgcgctttactttaactaaagaatcactgacactagctaaatcttccccatagccttcgcgccatacttctttggctacagcactaacctttaaactttcttcccttgttaatcctaaaccagattgtaccttcttgttcgcttcttcaaattgacttgcatttacgactaaagctccaactccagccgccacgccaactgctgctgcgccaaacccttggctcactttcgtacctgtttcttgcattgtgtttccaacttcgttcatacgctcgcgtaatcttccagaaacgttacccaatcgctctattctttcttccgtatcacctagctcattacgataacgatgtaaggctgctgaagcattattaaatgctgtatcatttctagaaacttgagcggttaatctttgtaaagcttgtgtgccttgtttgtattcttgctgtaattgattatattgagcttgcaaatcttttgtttcttgagcatttttcccgtatgcctgagtactttgttgtatctcttgttctaattgttgcatagatgtagccaattgctcacatttttgacgcatttcttgttgtttttgttgtgaagttctcaaagcttgctcataatgcttcattttttgcgtctgagcttctattttttgatttaaatggtttaccttattctccagttgatccatctctgaaccaactccacgtaactgctcagacgtgttacgaaattcagcatctattcttttcagacttctattaatgcctgcaatcccattttcgaattgatctgtatccaaacggacacgaccaccaattgtattatctcctagtgccattcaaattctcacctacctttacaaccacattggtactttatctgctgttgtcactcgatttgctttttgttttctcgctaaacaggtaaagtaaaacgcaatatccatttcattgatttgattttgtgtcatacctgcgtccatcaatatgttataaatatcaattacagcgtcgctatatttgatttttcctccgtcggtttcatttctagttgtgccattaacttttttttcgcatcttctaccgtttccattaccttaatcgcatcatttaagcgtcccataattgttaaacaaacagaatgaattgtaagacttaaaaaccatacatgagtgccatccacaaattcctgtgctgtaaattgatttccgtacacactggcaacaaaattagcggctctttcaattgtttcttttggtactaagtccgcttgtaattcatcagctaatgttgaagcttcaaaagtagctgaacctgggataaattgtggtaaataaaaatcttttttaccttctgtattttgtaatgtgattttcataatctgtttcctccttaataaaaataaggatggcatttcgccatcccttttcttaattacttcccacttggtggggctgtttctattggtggagctggtacttctttaaaccactttgctgcaactgctgcgtcgtgtccttcttcctcttcatctaatcgatgtctccaattaccgtccgaacgttgaattgccttacctttaatttttgcgctttggaatgttggtttatcttctgctgttttatgttcatcacttggaagctcaaacttcattttgtaataacatacatataggttttttccgttgtcgtatggtaaacgatatagcaatgctacataaggaggaacatcacttgtattatctacaacttgaccttttacaacctttttacctaacaattcggcataaacggataaaggtaatgtatcaacttctaattcaatttctgttccaccaaatgcactagctgttgctgctggtccaccttcagcataaaaagttactgattccgctttaggtgacgctttaccactaactgttttaccgattcgttttggtgtagaataattaaatttaccatctgatgtttcagttaaaactgcataatgtaaatctctaaaatctattgtcattgccatatttcattttcctccttaattaataatttccgttacaaaacgaaaaccatatcgataaatttttgtatccatttcataatctggataagtgcttaaacgctgaaaagacagctttttcatagctgcctgaactgcactttttaattgcgttttgattggtgccattgaccatatatcaacctgatacataacgttagtggttttttcctcattctccgcatatagcccaggagaactatttaactctgaaaatgtaagccatatatctgttttgtcatttcctttgacaaattgatatataaattctccacctaactcagatttaataactacatctgtacgtaaaacatcaaatatttccttattaaaatttctcatcggcctgtcactctacgcataaattctctttccataactctcaagacctctttttcactttggattaaagtcttttctgcaaaacctttatgtggaggatttggatttttactagtcccccagttttgaaacttcatataaaagtgaggagagcgatccgctttatcccatccaacttcaatgaaataagaaccacctttttttacaacctttccttcttcaatagcgttcttcgcgtgtttaccatcccaccacggttgttttagtgttggtttattaggttcggggccaactggagaattaaattccaacttctcttcaaatacccttgcaccagcttttaatgattcttttgtaatttttgggacatcctgtcctaaattttctaattcacgaatccattcttctataccgaagacctctaattctgccaattagatcgctcctcacagattaaacacatatctttgtgtttttcatcaatatcaatcactgatttaatttgaaaaagcttccctttatatttcacacgcatatcagaatgaacaccttttctgtacggaattgtaaaatttattaacttaataacaaattctgcatttcccttaaaaacttcagaattaaaccctgaacctacgggagtttcagccttcgcccacgctttagaaaagacttcccagcctgctggtagcgcgtttccctcatcgtctttcctttcagttttatgttcaatcataattcttttatctctttttcctggattcatgctgtttcctcacttaattgaagttgcaataccatactcttaatggtatatcgtactttttcatctacttgaccagaaaaatcacgattttcataccaatttgtgattaaaactaatgcgattttttgcgcttgttttcggttatcctcagtagcattgtaatgcttacctacagatccttttacatatatctcggcattatcaattaaaagctctaagatatcatcctcttctatatcctcttcttctaatctcagccatttttttgccaaatttaaatctattaacatgaaacccctcctaaaaaagaggggatatcccctcttatgcttgtgtttgttctgctaatgtaagctctcccactactaacgcttttttatcaactggtttaacatctaagcgctctctaactttcataccaactaaatctttcccccataaatctaatgcttgctcagagaattcaataaataatgcttctctatcaaaaacagttatcgcttcttttaaatcaccaaaatacattggtactttctttgttttactatctgtttttagcgtcttattacttaatacaacaattggatacttgccaaataacagtttcttcgtcgccattgttggatctggttgtaaaatgtacttaccatctgaatctttcagtttatctaaataattaaaagcatcttgattcatgatggcaattgccgttgtttcaaacgcagtatccaatttaacattgaaaatgtcctttaaatcatctaccttactaaccggaacctttgttgtaccgaaattatcatttattgcttttaatatcagagcattacgagttgcttttgatttttttcctgtccatttcctaacatatccttgaatattttctgctgtatctgcgagtaattctttagagaattttaaaattccaccttttttctttacagcaaattgaatatcttcaaattttggtgattccatttctggaaagtctgccgcttcatcaatattatcgaaaggaatgtagtccgcttctacttcaataacacgagaaccagtaagagtagatacagattctacatttacataattctcaagtgcatctggagcactacgacgtaattccttgatagctgttcgaatatcctttggtactgttaaaccaccatcggatggaacaccttctgtcattgtagttgcatttaatacttccttttcgtcatctgtaagtttatgtttccctacagccgctttcattgcattaacaaatgcatcagcaggttttactgtattattttgtggttgtggaatagggtctgttggaatattgtttttttcatcttcataaagagcagatgcaatatcaaattccttctgcaaatccttaatttcatttgtaagttgctctgcttcctcaagctttttttgagccaataactctcttgctgctgcttttttgttctgaatcttattcaataactctcttaattcttttggcatctttcttcctccttaaaattgagcaataaaaaaagagttagattaaatctatctctctcatcaaattattaattttttcttcttcacttttttgcatcggttctcttcttggctctttaaatgcctttggggtattcctgtattccttaaacagattacttgtacatgcaaccgcagtattttcttctgccacttcaacgttaaaatattcacttgctttaagaccgtttagccacgtctcattttgcaccatttctcttattacttcgatgtctacgccctcttttagattatccttataaacattgatgatcccttcctctattgcatctaagtcatcggccatctttctaaaatcattggcatttccatatataccattccacggtttatgaatcattaagtatgcattagaaggaatgatcaacttatccccggcaaatgcaattacagaagcgattgaacctccaagcccatcaatatgaaccgttttatgcccctcgtgacgtttaatcatattataaatagccattcctgcaaaaacagagcctccaccgctatttatatagatgtttaagtctttcccttttacactatcaaggatatttcttacattctcaggatattggtcctcatcatcccaagcaccccaccaagaagaaacgatatcaccataaaaataaagagaagcagtatcttcagcttgatttttaatctgtagccaatccacttccatcacctcctcgtatgataaagttaggttttttaggaaagggatttacctataaacccgtgagtatctagttatatgagatacttatatttgtagatagagtgttgccgaccacctccttgaatctttgtattcggttgaaagaatggtacctctgtctaataagtagtttacgaatgagttggatgttgatgaccattggtcattcttcgtatctcttacgaggtagtagcgcttattagttcagaggaggacaacactatctaacactgattaaaataggggtgtaagctatgttctatttaggtattgatatcgctaaacataaacattatgcgtccattatcgaccaaactggaaaacctattactaagccatttccctttcagaatcataaagaaggcggacaagcactgttaaaatggatgtaccaatatattgagtctcctacagaaaaactgattggaatggaggcaacaggacattat

SEQ ID NO: 1388 - DNA, 31690 bp, Bacillus thuringiensis
ctatactaagtgaaattggggatattcaccgctttgacaaaccatctaaacttgtcgcttatgcaggcattgatgcctctgtgtcccaatctggacaatttgaatcatcaggtatgtctatatctaagcgtggctcttctcatttacgtagagccttattccaagccgctattacagcccataaacatgaccctgtcttgaaagctttttatgagaagaaacgaaaacaaggaaagcactactatgtttgtataggagctgtagctagaaagttgtgttacattatctatgccatcctaaaaaacaataaaccgtatgaaatccctcaatattcaaaagaagtttgatacttttatttttttaacatctcttagggttatttggtgcaccctttttttaatttcctatttataaaattcctcttgacttctcatagttggtcttttttagcaataaaaaaagaccagctattgctgctcctgctctatttgcgttttattttcaattgttaataacttttgtggcggatattcacctgtaagtttaaaataatcatttgcacaaatgttccttttagcaactcctaagttcaattcatataatttggctccacaaccacataactcacatttcgttaaaaccctaaaaccaatagtcccgtcagacatgtccctccacacctcaactttactcgtatcattggaaacccctgcattatctaacatgtcagcaggtacttgtataaagactcctgtttccgttctttttacgtctactattcttcccatataaggaagcgtttcaccttcttgaaaaggcatcatatagttaatatccatgtttaatccttcctttctatccaagtgcgttaaatttccaaccacttggagtactcacataaaaacccgctccagcatttccgtctgtaaaacgaatatgcccccattgttggaatccaccgccacctaagttaatcccttgcattgctcgtatattcctaaagattttcacttctttttcagtacttatatcaaacgtttgtccgtctggtgctggagttatattattattcacaccacctacagcaagtgcattaaacggttgaataccatctgctctttctgctgcagcacgatcccaattatacatagatgcatatttgccactgtatagcgttacaccacttacacaaatcgctgtcccttgtctcatgtcagcatttccagaacaaactttaacaatcaatgcgtgttgttgcggaatatagtttgtggggactttgaaagtgaaagagtatcttctgatttctccataaaatgtagacggttcaggaaaatccattttttgttcattccatatatcgtaacttacattgtctcggaatttaacgcagcatacttgtaaacgcggtttccctgttttacgtaccccatttatcattgctgttctaaaatgagcagataatgtgtattcatttccaggatgtatcccattattcacgattgcttctggatagttatacatatctacccttgcagcattcaccatttgctcgtaatcgaatatatgcgtattcttttctattacgacatttccccatgacttccaagtaagaccgtatccaccttcaaacccataataatcgttatgtccgatgtttttctttgtaacactagaaaagtcgggatctgctatcaggtttcgtcttgataccgcggttgtttttgttccccattcgtcttggaataggaaatctagcattttaacagttacaccgtctttatcaatggttatcttatcaccgtcaattctaataagattcgtatcaatgccttttgcagttaaccatttcaccattgtctcggcattaatggctacctttgaaacatcaatttctaatttttccgatgaaaagttaatagctgcgatgatattcccttttttaacttctgcaaggattccttcatcaagaaccttcagtttagaacctgtttcttttacataagcggcgtaagtctcattaataaatttttcttgtttcttcgatgttatttcgacgccttcttcagtagcactaatacttctttctaattcggttacttttttatcgtaatctttagttgctactctattagcaatatcatctatcattttatcaatatccgtttgatctttcggatgtaaccaaaattctgtagctatagtgccacgttgtaacataggtgcagcacaccataaacgcccatttcttgtcacataataacgccatctcacaaacgctgcatttgctggtgctttgtctgaacacacagctcgaacccatgtatgatttacaacctggatattcgttctagctgttttaatgcgagtttttttgtcagcagtccaccattcaatttcaataaatgcaccaccgctatcaataggtgtttttccatcagtattgaaataacctgatgcaacaaattcttcgttaacctgacactcaataaattgacttgtaagtccccaccaacgatcttgagtctggccagtaacggtaattgcaaaggtattcatgcctttgtattttagattcgtatcaacagaaccagtagccccattaccactattccaaaaccaatatttctgtcctaacttaaaatcagcatcacgcaactcgttgacagtacctaaaccgcctacataatcctcaacatctttctttttcatagttaatttcaatgcttcagaatgttgacctattgttgtagtagcctcactgagcgttttcccttgctgagtttgtatttcttgcactttaccgacgctttgtgaaatactatccgcggttttctctactgctgttacacgtttatcaaatccactctgattattttctacatttgttatggtttctttaattcccttcacattttgctcaatctcagttgtttttttcgtgaacgtttctttagaagtaacttcatcattagcaggttgccatgtagttcttatgttcccctcttccaatttcgcatgatgtgagtttaaattaccatcaatattgcgtccagaataataaaacctaatttgagttacatctttatcttttgttttgaacgtaacagttagaggtgcgtccttataatctacattaatctttaattgtgagtctgcacgtacagatttccattcttgctctccgtctgtataagttattgccgtttccacaccaaaccaaggatttgcattgagtttcgtcattttcccagtaaataagaaggaaatagtaaacgttttgtttctgtaattaatcttattggaaagagtcatttgcttactgtctgaccatgttccggtcatattctgtttgtttaaccctgtttctgaatcgcttgctagattaattgaacctacagaaatgttactcatgtcggtttgtaattgttcaatggtctgcttatttgaagtcgccgtattctttatttcatttgttgtttttgttaaaacgtttgttgtttgcttcacatcggcaatagtttgttttgtaccttcaactgtatcttccactgtatttaatttttcagtaatttcatcgtctttttttgttaataactcaatagatctagtaaaactctcgttagtctgtttcatttcagaaacagttttattaatttcaccttgagagttttgtacatttttaatagtttgcgaaacttcttggagaccatttttaacttccttgaattgtccattggtttcactttgcgcttcttccactttcttatttaattcttcttttgtgagtttaatatccttattaacctgctccagtgtatcttttttaattgattccacatcaggaataagaagctcccaatctttcccgttccacacttttaaaatacctggtttaccgttgctaatatctctccataacgtcttacctactataagattatcaattggtggatttttagcttcaataatatttaccgtattattttttaggttttcttgaactttttctgccaactctttagctacttgagattcttttcgtatggtttcaattgttttttcattctctttcaccagtttgtttagctgatccagcatctcttgtttattacctaacgaactaagaatttgattataaatctttcggaattcttcgttaggatctacaatttctcgataatctccaaatacatatttatcttgtgtaggatcagtaaaagattcgtctccagctattgctcttgcttctaaataaagttttggtgtaaaacctgtatctttaattcggattgtgtcaccctcattaatcaattcatgcgctaatccaaatacacgtcctatggatgccgcttttacctcataagaaacagacgcatttacacgcttcgtcatttctaattccattaaagttttcaaacgttcaggagacatattttcattgtcagtttccggactataaaaaccgaatttatgtttacctttttcattccatcgttgaaaagcatcagtattagtgatataaggaagaccattattaattttttctatcgtaataatgttatcgccttcacctttcacaaaaccaattaaagctgtacagatattttgcgagttctcaattcgcttaattccaattaaatctttccctaattcaattgttttccctgtatcctgcccgcgttttttcaccatatcaacataccgttcgatatgattccctacaacctcagttcgatattgaatttctagttcaaatagagaagcaatctttttcaaaaaacttaatggatcaataaattcatcaacggtcatagaacggaaacctttataagaaatatttccttttttccatttcgttcccttaagagctatatctacatactctgctactgtttttgcttcaaacttttgcggatcaatataatttgctttaccaagtaaaatccattcaccagacgcgtaagttgtaagggatctattattagaatctttttctgtttcagtaattgtgtatggaacaattcgcccaccccttacttcttttaagaccaaattttgttgcgtaagcgctgcggcttcttttgtaccatcaaaaaccgtaaaatctagcttatcaacattatttttaatctcccaatgcctattgtcattccaataatcctttgattgaatcgctccgataatttgatctgtttgtgaatcaacaacatgtaatattccacttggtgttctcatctaaatcgctccctatatttaacctttgctgttcctatatcggaaggtatgatttcaagtttattcgtacctttattaataacaggaaaattactaaaaatatcttttatgttaatagcgtttttcccttcaatactgacatgactgctttctgtatcaatcacaactttgtcaccaacatcgactatataaggcggtgtattttgattatttaagttcactttccaaaatttcaaatcggaaactgtcatcgcttctactggcggaacatcttgccactgcatgatacttatctgtatttgagctgctttttccatatgtttattgtctttatcggtccatcttgcaaagcgctctgcatcatctttttctgttccaggaagaaattttgaaatataagcctcccaatcattaccggttctagcgatccacaacctaccataatactgattccatgtattcggataatcaccactctcataaattaaacctgtttttccaggcttattatcatatccaattaccatcgttccaaaattttgttcagcttgccaatagaggtcattcatggcaatttttgaaagaactttgctgttttcatcgagtatcgctatctcaactcgtcccatttcatttatttttttactcttacatgtaacgtgggcttgcataataaaatcttgtactggcccaccagggatactctttttaacagccgcgccatgccatccattacccgagccatagtccgaacaatagaattggtaactatctgttttcatttcaccaactggattaccatcttccatagaactaaccttactccaccctacagttgtggacatttcatcccatataagacgttgatttctttctacaggcaattgctccatttttagtggcattccaatacgaaaataatctggttccttttcgtatttatcttcaaaccatacatctaaaaaagtatgtggctttttaatatcaatttcaataatcggattggaatgcacagagcctttgttttggacattggcaattaaccctcgaccttcattttcaaaatcaaccgttttctcatttcctaacttataaggcattgggcaaacaaagttcaaaatacctttacctaacgtaacaaaatcctctggatcaaaatcttcatcaataaccgctaagtatgtcctatcaggtgttacatcaaagactaattcaacaggtttttctgtaattaaccactctgctatttcttcttttactgtttctaagtctgatccatcaggaacgataattccgactggaacaggtaaaactcgcattttagtttctgtcgttaataatcttgcacctggataacctggaacgcttaaaaagttccgttttaacggagcccacgctggttttttccaccctttttcgatttgaatacaatccttgcgtatattgttaaatgtaaaagagctcacgttgccacctcatttcttttcaaattaaaagagactcaaacttaaaagtctgaatccctctgtgtttctcgttcttgatattcggttgtatagcgatatgtaccacgcgctacatctcgtccctctaaaacaacaggaacctccacaacgaaatctccaccaagcattggaatgactccaccaccagatgatcccgaagaataatgaatcacttgattcgcaacactagctgccatcgcttgtctactatttgacatatttccatacacaccactcataacactctttaaacctgataattgattcatggaattagccatcatccgactcatgtcacccattagttgattcatagttccagtgatacccagtgatctttcttttgaagataacggtgtaaccgtgatggaattccctcttttggtaaacagttcagggcctttttctccagtaataaatgagccatctcctacaggttttccacctttcgcaagcattggtacatgtggaatagtcggcgcgctaactcctggtatattgtttagtaattctgctggtgtattaaagccatctataaatttatttatgatacgaataattccattgatagctgtacgaataccacttttaataccatcccatacgcctaataccgctgatttcatgccttcaaacgctccactaacagcatctgttacccaacgaacaggagtcataatggcttcttttaatccattccagacagaagatgcggttgacttgataccttcccaaatgtttgaaagtgtagatttaataccattccaaatactactgcttgtgctactaatcatgttccaaaccgttgagatggcttctttgatgctattgaatacagaacttgctgtagaaacaattgcgttccataagctagatagatagcttttaatcgtattccatactgcacttgttgtggagctaatcgtattccatgtattcacaatccaatcttttattgaggtgaatatcggtgttacaaaagctactaacccgttccagcacgattgtaagaaattcttaacagcattccatacagacattgttgctgaactgattgcatcccaaacggttgtaactgtatttttaatccactcaaatacagttgtcgcaattgaaacgattccattccaacaagtcgttaagaaacttgtaagtgcatcccacaccgctgtagctttttctttaatagattcccataccgaagctaaaaactctcgtatagactcaaaaattggagtggcgaaatataaaatagccgtccaaattgcttgtaagtattgtgtaataaaactccatacagtttgaatcactgtggaaatgccgttccaaatcatagagaagaaatcagcaattccttgtaaaataggagttagaaaggcaactagtccattccaagtattaatgaaaaactcactaatcgctgtccacacttcagaagtagtttgactgatgccattccaaacttctgataatgtttcaactactccatcccaaattccagtcaaatattccacaatagaattccatatttctgtagtcgtttcaacaatagaattccatatttcagataaagactcaactatcccattccatacctctattaagtattctttaattgaattccaaacttccgatgttgattcactaatgctattccacgtttcgctggcccattgtacaatcccatcccatatgcttactaaaaattctccaattgcattccaagcatcaatggtccattgtttgatatcatcccaatttttataaattgcaacacctagagcgacaacaagtgctactattatcggaataatagcaaccaaccctgtcatcgcccatcctatacttgttataacagcaactattggtgctaaagccatgaatgctcctgcaattacaccaatagcaacagcaatcgctgttaacgttgctgctaattcaggattattagaaatccattcagcgaatttagaaacaagatctgctataacttcaagaacaggctgaagagcaacctgtaaatcttgcattgcttgttgaaatttaaccgctggagatgcatctattttagaagtagcaccctgtaagtcttctactccttttttcaaatcgacttgtttaccttccgctttcaaaatggtgtcgatgattttcttcccttggtcttcccaaagagtaccgaacatcttcgtgccaagtgcatttctgtctgttgcattttcaacaccagctaaagccttcgttgcttcaagcatagccttttgtccattttcaccaccgccagcaattgcctgaccccatttttcaaactgatccgccgagatttttgttttatctaaaacctcttgcatagatttatctacacctgcaccaaattcggccattttaatacgaccttcttttacacccgatatgttcaacaggattcgcaacatcctgccagttctcttatgaacttctgtacatcactatacagaccagactatatcatcatcttttatataagatgctccccatttcgaatgtcatcagcttacaccctacgcttttcagctagtcgttgcacgttcctttgttaaaggcttcgctcagtattgtctcttttgagagttccactgaattaaaggagttttctatgaatgtcgccactcatagggacaatcatttatccaataggttatcgatattccaacttttagtatctactcctgctgacatgattccttggacttctttagccgaaaatccagcttgaatcatttgatctccatattcagcaataatatctaattgttctggtggaaatcctgtttttaataatgtattcactagccccaatgcttcctcgttcgtaatacctaacgttgcaccaatctcattggtttcttgtataagttcattaaaatcaattccagcgtaggatgctgcaatagtcgctgcccctttaaccacagcggcatttgtttcatcagaagcatctttatttaatgcccattgtctgcgaacaccttctaatgcttcttcagcgtcaataccataagtactaacgcccctaatcgcttcttccactgattttttcgaagactctggaacatcaaaagtgatatcaatcttagttttcaattttgacatatccattgctttttcaactgctgttgcgattccgccaccagctgccattccaccaatgacgttttcgagtcctactttgagtccttcaaacttcttctctgttctttcggcttcttgttgcaaatcccttaactcatttcgaacttgttgaattgaatttccagcatccacagatcgaagagcacgttgtaatttttcaatatcggcttctgttcctaatgcttctcgtccaataatcccaatcgcttgttctaactgtcgacttgtagccgatccacttttaattgcatttacaagacgattacctaatgcccctgcaaaatcatccacgcttttgcctgtagcgctaaacaacgtttctaattgtcttgttgaacttgccacattttcttgttcagctttcatattaccaagcttatttttcaaaccatcaagtgacccttgtgtaaattcaatttcacgtctaaacgcacgatattgttcttccgatatctttccgttttggaattgcgcttgaacctgctgctccgcttcttttaatttatcgagcttttgtgtagtgttttcaatttgttgtgtaagcaactgttgtttttgggctaatgcttccacattaccaggattaaattttaaaaggcgctctacctctttcagttcggttgctaagctatcactctgtttatttacatcttttaaagcgttttgtaacggctgcgtattcccaccaatttcaatcgtaatccctttgatttttcctccagccattctttcacccctttcttagaatgaatcaaagtctttttggtttgcttttctgactttttctttgtctggattctccatttcagcgaattctgcaatataatcaaaacaatctccaattgtcatgacttccaaatcccaatgcgttaatttcgctttataacaaagagcaaggaacgtatcagtggttaattcttcatcactgaacgtcccttgctctccattacttttctttattttttttttgcgcccatcgtactttgaatcatatccataatttctggaataatctctgagatagggaattcatcaaaaccgtctaaccatgtaattggatcatcaatttctggatttgctgttttcgcatataaccaaactaaatcatatacaacttcaaaatctagcttacttaaatctgcatttgctaaatcaatagtggctagtgaaccctcttgaggatttgaaggagacaaaatccctaacttaaacatatcagcaaataaatcacgtctgaattgcgctttatatcgtttaacagtagctgctgtactttttaatcggacttgttttccgtctattgtaattgtcttttccatttactattacgctccttttggtgctgctggtgtttttacatatacttttttgtaccagtcgttataaattgcttgtgttgttttagcagtcgttttcgttttaaccattggtcttccaccaggtactaaaacaattgggctagaaacaaacttcagttcatttgtatttggttcagccgaacttgtttttgttttagatgcaagtgttggacgacttgctgaacagttatacataacatgtcgtgttgcattgacatcaccatcaaactcaaataataaagcgaatggttttccttttgcatcagccaattcatttaatacaccatccgtttcgtctaattcttcaccgagtgcatcaatagcaaatttttctgggatagtagcaatacttaatgttccatcgtaaccctgattattacttgccgcgtaataaagcatgtcatctgcatagaattcaattaaatcaccgcgtggctcaaatgttagttcaactccaccaggtaatggaattggtgtcccaaatgtaactaagaaatctttactatcaaatggcacgtaatgtacatttttcaaaccgaatgttaccttgttttcattcatttacaacaacctcgtttcatatgttttttgaaataatttctcagattcaataaaaatcccatacgagtcataaggtatttcatgatcgtctaggaccttttccaacttggcttctgcaaccaagtccttttttgtggtataaagttcgatatttacatcatttatcttgtgatagaccttattatcagccattaaatttgctgaaccatccacaagaaaacagatataaggcggctccggaactggattaccaggtgttgctgtgaaatgcgaataagccacaggataacctgtagcttcaagaatttttctaaattctcctaatgttactgtcatgattcaattgccctttcaatacgttttggcaattcatcaattacatactcttcaactggacgaatatgtactttctctggtactcgtccaccagcagctttcgcatgaccattttctaaaagatgcgtcaattgcccttttgtattatggataacaacagctttatcaacttttttctttcgccagccttttcgataaccacctgtttttttaggactattttgtcttaacttatctacagcgatatcagctacatcttcttgtgcatttgttaattcttcttccacaacatttgcatatctttgtaattctctagcaagctctcccgcaaaatcgttcatattaaacatgctcctttgcgataatagtcaatgtttgatacatttcatcatcattcattggcggttcgataatatcaaagatacggcctttcatattgattcgcatttcttctgtaatatcagaagtataaggaatcacaaaacgataaacccgtgtagcttgtgaagctgaagcttcaatgtactcggaacctttcatcgtttttatcattgaccaggctttctttaattcttgccaagatgtttcgattacttgatttaattcatcttttattactacaggttgctcaatactaattcgattcctgaaatcacctgtattcagcggttttttatactgaaaaggacgcatattaatcaccgtccaacttaattgcttctaaagcttttccaatgcttaaactattaatctggcttaaaaaattcttatcaaaatactctaaggcatcgttataaacataacgagagcgttcaaagactaattccttgaacacctcatcaatattaagatcataattaccacaaaccctagttaaatctttattggatgcaaataggatgcgtcttaggtttgcatcttcatcatcacctaatcgcatcctatctttgaattgctgtaatatttcatttgaaattaccttatccattcacatcattccttatttagttgctggtggagttggtggtgtaaaagaaattttcaaatcataaacaagagctgctttattatcttttggtttaccattagcaaactgtttgattgtataaagcgtagcatcttcaatcgctaatgtttggtcaaactttttaagtttgtatccacctgctattgctgcgatatattgtcctttcacaaagaataatgcttttccaactggaacttcttcagattcaacagtttgaatgttataaggtaatgccattacccattggccattagccgtttgaattgtgttacgtgcttgtacaccaattgcatctacaggattgacaaccatcacaattttatttaacactttacgggattttcctttcccatcaacagataaagcttttactacttcataaagctcaccagcaattacttcaccattttcagaaggagcaaatgttagtgtaccggatgattttttatcagtaaccgcacctgtagttgcatttacatctttcattaaacctacaggttgatgcgctactgatccaccaccatttacaaagccaaactctaaaccaacagaataactttctactaataatgttcgaacataacgctctacccatactggccctaattcgagcatgtcatttggaatagcactaaatgcagttaatttaagttgtccaatttgttcttctctaaaggctgcatttatttgccctctaatatcaccgaataattctccccatgcatacgcttttgttgcgtcagaataaataaacttcgttactgctcctaaatcttgcattccaattgcttcaagtaatggatgttcagttactaaatcttcaaatacacgttcttgtgtagtataaggaagaattgaatcatccttaaatcccccatcttgtacaactgcattaaagaatttacgttcttcagacgttaaaacgttttgtccacgtgacgtcaaaatttgagcgtcttgcgcttcgatacgtgcttgtgctgaaatcttttctgataaatccgttacaagagtatcaaacatatcatcaaatgcagcagataaatcctccatttttgtatcttccgctttcaccagattcatatatgcttgttttttcgcttcaaagttttccattgtacctttaattttcataaccataattgtttcctcctaatttttgagaattaaaaaaaccttttccgtttttgattaccctccacttgtaaatgtggtggttctggattaggtttatttgataaattcatattttgttgtaagttattcgttaccctattaataatctgttccaactgttcatcagtaataccactatcactttctcgattatcaaattctactttgtcagcaaaaccttcttgtactgcttgttcagcagtaaaccacgtttcagcttctaataaatctgtaatctcttcacgacttttacctgttttttgctgataaattgaaactatcgactcatcatatgcttcgagtgcattcaatgttttttgaatatcctgcttgtttccataagctattgttgacgcttcatgaatcatcattcgtgagcctgtgcgcataacaatctcgtcagcagccattgcaataatcgatgcagcagaagctgctagtgatgtaacttccacaatgacttttttatctaagtcctttaagtaattataaatctcaacaccttgatcggcatcgccaccaccactgtttagtttaattttaactgtagatgctctaacttctttcaaagcgcttcttacactttcagcactaatagcatcgtaccaccaactgctactaccgatataacctgataacaccatttcgtgctcatcattttctggattaactgcattagaaaactgataaggaatatgttgtattttatttttcattcttatcacctccttcaattgaatttgcagattgataattcttcgtaattacaaattcgtctagttctggattattagagcgttcagcaccaaacaacttcctcacctcatttctagtgaatgcaccacttgctactaatttatcaacagcctcagcatgatctataatatctttctctttcacaccagttacttcaattttttctcctaataggaagttctttttttcaattaatttcgcatttaattcatcttcaatctttttaattagaggactaatacagaattttatataggctttaattgatgtttcgtagtctcccatatcaccacgaactaatgccgtaggaatacctaaaatattagccacatgatctattaaatctttttttaatttagatagttcctctacagaccttccattatttgaaccatcggcaatttccgtataattaaaaccctttatctttggaacaattgcaaaagcatttttacgaaacgccccaaacaatttatccataaagctttgtaatttagtaaggttttccccttccaaattctgtgcagattccatctcagcggttgcacgtatttgattagaaaacatatttgtctcaatcatacgactaaacagttgagtgtaatctttaaatattccactcatgaattttgtcaattcttcattgttataagtaatgtagataacctcgtccatttgaaatgacctttgaaacgtgtaatcctttacggttacatttttaaatacatcagggtatactgcatattcaacacggtcaaaatgatcagcaatgagtaaatcattttgatctgtaagaattgccaacacttcattatcaagtatcaatttgtacacaaaatcttgccaaaagtcagcggcactttgatctgtattcggtctaatattcaataagtaatgccagtcattatattgacgtgtatcctttttcatcatccgaaattcagacagcgaaacggttcgagcaataaaattaatacaagtttctaaagctactttttttaaatacgctctttgattcgtttcaataccaaagaaatcaaaatcatttagcatcgtattaatctctttatttttaccaagtacatccgacaaccaactcatatttcctcctcacccctttcttaaaagtttaatgcattcagcaagtctagcgctgcgccaacatctgtttctcttacctcatccgctcgatacatagcatgtacaaacgcctggaatccatctgtttttctacgaactggttctttcttctcatacattttatttccatcttttttaataacaacgagtacattattggtataccaacgcattaacggattatcaccaaatacaatttgacgatgtgcgaatgcaacttcaattctaggagcaagcaaaccatgaatagctctcggatttctaattacttcaacttcaaatccagcgtcctcaaaaagtgttcttaataaatctgcacgataattatccattatgatttttttgatatcataatagtttcgcatttcaacaaaccaagcaacgatggtatttggatcaattgtttcgccttccacaactgtcagaagatcttgctcttcccattctcgaattggtgcaaacttcttcttaccagctatttcagcatcctgttttttcgaataactataatatttatcaacgaattcctttctagcatacgaatgagatttccataaataatcacccttacttctaaaaagtaatccacatgatgcgaaatcacgaatacttgcataatcaagcgcaccaatacattcatgacctcgtaaatctggcaattcacgattagttgctgcaatctcttcccattttgcaactgacctttctaaatctgtaacaggtaaattcattcgttttgtcatgaactcttctctattacttgggtcatcttctaaatcttcatattcttcttttatagtttcaagtaacccctcagcatattcgctcaatggtttagataacataggattagcaagttcccaattatcaatatcatccacttcagtttcatcattcaatttacagataaaaggaaagacagcattcggacgtgcttcaccgttcaataccttcattgccttttctttttgcttatctaagaaaccgtcacgaacatatccatctgtaccaatataaaattcacgtgggtttttctttttccctaaaccactgatatgaacgcggacatctttattactttcgtattgatgtatttcatcaaatacaaccgcaccatcacgcaaaccatcttttgtatcaccgtttgaagtcctaaacttcagtacactttcagtagcctttgaaaccgtttgagttaacgtcgttttaaaggctcttttcaagacctcattcttcttcacacatttatgaacttcatcagggcttgttttcgcctgttcttcactattcgcaacaactgaaatgttatactctggaatgccatgtaattcactaattaaaaaatgaataataacagaaatcagaccatttttaccgccaccacgccctaacatccataggaatttacgataaaatacacgtccatttttcttataaaacaaaaagacgaatgctattaagaatttttgaaatggttgcatcggaaaataccacttctcaccgaagttaatacaatcctcaatcatttcatcatcaaaatacaaatcgtctctatttaaaacgtatttttctagatatccaattaacagttctctttctttattgaacttcactttcccacttcgataaagttcaatatattcttctacatatttttgcttaatcatgtaagatcacttttgttatatcctgtatcagggttagtatttttaacaacaaactttatatctctccctaacgcaattaaagaactgttaattttattcctctcacttataagagggtgggccttaacgaaaacttgagttccatttttgattgttacggattccccttctttagttatcgttttattaatttttcgaaatgctttaactagatcaatatagcgttccaccttttcaacttcaactaaatctgtcgtatcaacactattcattaactgttcctttaaccttacaatactaacagccatctacccacccccccttacgcgcgtattttcgaaaaaaacctgtcagttaaccccctcctccggtgccccttagacgaaatattgatgaaatattttaagggggggtgttattaccgaatcatttttaccacttttcatcgttttcccatttgttgattttctttttgaatgttctaccgtgttctttattgtggcaatccacacagattgtttctaaattatctatttctaatgcaagtgctggatgatgttcaagctcttttatatgatggacaacgagttgaatcttcttacgttttgcactctcgctgtattcattcgtgtctgtttgtactcggccattacgtttacattcctggcactcatagttgtcacgcttctttacttgttctcgtatactcttccactcaccactgtcatagaacttacgcttctgctgtttggttttgtattccttcattacacattacaccaccatctgcacaccacttacagcgtaatccatcctttgattttgctattcgttcactatactgttccgtatatccacatgctttacatctaaactgtacaatcttttgtacccttttacttcttaatagatcgtctattagtttgttcattaaacttatatcggcttctctctttgctgctggtgttagattgttatgaaatccttctattacttcaattaagattggcaacttctctacatctacatactcttcaatatcatctaccccaaccgaatgtataagcgtactaatcgcaattgctttctcaagtttagttaattgcatctatcctcaccccttacacttaaatcctttctccgtctgtctctttctagtaattcttttattgatgtttgttccaggtattccacggaataaaacataggtttcccaccatacagcttgtaatacttaacatctattccagcttttttatgcgctttttcaagaggtttaaggtatttgatatatgctttcttatcaatgagcataagaccaagcgcagcaatcttaccatttaaaacgctgtccaattatcctcaccccttatcttctaataaactagcaatcattttatttagtacacttaatgttgcttctccacactctttctctgttgcactgtttactatcggtccgaattcttcttctaatagttgtaagtcgacatgtttagcaagcacatcctcacctacagctataagaattgaactaacaatacctatcttctcaagtttagttaattgcatataccctcactccttatttatcaaatgcaacacgtttgcgcttatctttccttaacaacaaatataatttatatctgaatgtttgaattactatcattaatacgtttgacaatttctgaagccatcgtcttaccatttaaaacgatgggacattctactgtaatatctttcagtgcgctctttcccttaaacctactcataaccttttccaacttctccaatgcagccgtacattcattagcagcttccgttacttctttaattccttttaatgcttcagttgtttcaacatttaattcaattgttaatccttgaatattcttttttgcatcatgtgatttttgtgtatatttgttcattacccacacatctacaaaagcaccattacattttggacaaactgttacttcttgatattcttctttagatggatgataaactttatccatatgaccacatactaaacatttagccttattaaaatactttttcccttcattcaccttactcactccttatctctatctatatactcacgcttttcagaatcccaaacctcacaatagtcgaaacgttctttttcttcttcataccatttgattgcttcgtgcttagaattagttgttgtatgaatatcagcaaatccaccgcaaggataatactgatcgaatcccaaacaccaatatctatcatttaaattgatttcgtccatccttcattctccttcaatcaatttcttttacttcttctatcgcatatactatagcatccaaaatattttccccatctacctttttatttagagatttttgtaaattatcaaccgtagcttttaagccctctacagtttgagataatccttctaccgtttcctttaactcctgattatcggtaaataattgattaatcttctttttcaatatgatgttttgtaataacgcatccttcattacttacacgcaccacctatataatttttacataataaaaagcacccaaatcgggtgctcgatatactgatattcattaagaaaatatataaaaaaacagagaaattcacttccacctcttgatacgcatcgcgatgcgtgttataataaatatagaaagttgaaaggaggtaataacgatttctagtagggaagtaattaagaggttaaaaaaagaaggatggcttatagcgaacattgaaggcagccaccatcagttcaaacatccttctaaggttggcaaagtaaccgtgaaacatccgtgcaaggatattcccaaaggtacacttcgctcaatctataagcaagcgtgttggttataaaccgccccttgctttccctaattatacaagaaatcgttataaaaacaaattatgaaaaaagactattatgtttatcccgctatccttgaaaagtcgtcagatggttacggtatttactttccagaccttcctggttgcgtttctcatgcagatacacaagaagatgctttaaaggaaggtagagaagcattaggacttcatttatatggtatggaaaaggataatgaatcaattcccgagccgacaccaattgataaattagaattagataaagacgaaaattcttttttaattgatgtttggatgccaccacttagaaataaagacaaaacaacttataaaagaaaaaatgtaactcttccttcttggttagaagaatacgcaactcataaaggcgttaatttttccgagatccttgtagaaggtttggaaatgcatttgggcattaaagataaaaagaatacaccataaaggacgccatgagcgtcctctttttttatataagatatttgttactcatattcatatttttattcttctttgaaccgacactatagataggcacgtatcagctcaaagaagagcaaaagctctccttatgaaccgtttagttatttttgtattcctgcataatcacaattagatttgaaagttctctttgtaattacgtactcgccctataaacgccagttcattcaaacagacatccataaagctttattcggtaaccaacccattaaaattttacagttactattaaaaatagaaaagagcaaccatgcaccagtcgctcttacgtaaaattctatgctattactataattcattttttcaatagataccatatgtaaaacttactgtaagaaaagtgtaagttcctcagcaagctttatccttctagaaatttcagcatgcttctgatatacataactactactatagcctaattccctagctatagattctaatgtttttcgctgcacatacttaccaaatagaattttattttctagtccttcaaacttactaattaatattttgaggtcgtactgatcgttcatcttattcgctagttcatattctatagccgctatgtgttcctctattttcgcaccatctgaatcagcagttaacttatactttgataaatcaccaacactccaacgcattaattctcttttacttctatgcaatttattttctaaataaataatttcatcttccaactttttataatctttaaaccattcaaacaagggttggctcacctgcttcctctttcaccatgtaaactcatttcttcatgttacgtttatttaactgttttcttaaatgcccgtaactcacattaaactttttagcaatttcaatatatttcattccatgttctttaagtttcatggtatcttcacaaattttattccattcgtcttctgttctttgtatggatgttttaacaaaaactttaccacccaaaacaacccctatttcattcaatctcttccctacttcacactttgtccaacaatacacaaaatcacgagaacatttattgtcacactgacggcaatgattatctgttaatcctagtatttccatcctcgcttcttttggactcatatagtaaccattcctaacttatctacatgatataaataatcaacaggtgctctattagtttgtggtactatatacgctcttttctcaaattcctctcttggaatagactttcttcctccatcataaagcatagcttcatagtattctgctactaccgaaacaggaacaaaataaataacctgatccgttctgaactctattaaaaagaaacaaattgctccctgttcttgtgtatcctttaaatagtcaatttgatgtctacttatattatctaacgggaagcttgtggttttttcagtagatttcgcttcaaaataaacagctcttcctttgtacacaccgtcataatctactgtagatttactttcccatgcacttttagttatattgcctttcttatctgtctttatcacttttattggtgtagggcgcttattaaatactcctacattcgccgctttatacatacggcatgtattgtttaataaaagctcaaatgccattcctctatttgcgtaacccataatacaccgtctctttccactaaaataattattttttacaaattataatcttgtactacctggcttaagaactctcttaccgcgttcttctttcttgcttcgggtttaattacaagctcagttaccttaaatcccagcaattcagcaccttctatatttcctctaagcaagttatgtaaattatgactataatactcatccgttacctcaatcaccaattcaagcttatgaccagcaggaaatgtaagcatttttgttgcttctctatataattcatcttcttccattcgtttattgtgccgacgtagtttttcttcaaaatcttcagatttacttatctttatcattctgtctcacctttttctaaaataagaattttgtataaatctcattaccaaccaaaatcagttggtacatacacttgttgctgtgttctaataatttgacgtaagtctgtttgcggtggcatatgatccgtttctgtcacccgaattaaatatctccattcatgtttagttgcttcgactccacgatgaatatcaaaccaatcaaactcaactggtgtacatgcaggtactgtaaatgcctctaattcgcccgatgcgactttttctcttacttgttggttcaccataccgtatagccttgtgtttggttcagcaggtacatctagctctacaggttgtccaataaattcagttaagcacccttcacctgtaacaagtagatgaaaacggctagtgctcattttttcttgcgcgaatatatgtggatttgcttttgcttccggtcgtaattccgaacctcttggaacaccgtcactatgccaattaggaatcgccggacacataccaggcattaacatatgaacttttgtatctacaacaatatacttgcggtcatgtcgtaaattcatcgctccaatagcagcctttgtaagctctcctccatatttcagtgcatcatctaatgaagcattccataatgctggtgtattctttaatacatcaatacttggttgctcaatctctctatactcaagaacacgaattggatttctattaaactgaaatttagatgttttcatttttttctccctttctattcaaataacgctttggtttagttttctcttatgtcataaccaactatttcagcatcatcaaaattcaagtctgtttcttctacttttctcacttttaacccaggtatttctttttgcaacaaatgtacaacatcatcagcacagtccgaacgactttctacacgggcaattatgatgttcatttgattttccgatacatgatctggcaatataaaatcataaaatattttccttttaattctttcttctactgtgatttctacttttcccatttcctatctctccctttttaataaaattcaaatttgataacaacccaggactccctcatttaagaaagtcctggaaatataattatttaacttgaaccaatggattagcttctccactcacttgtggtaacttaccatcccatttttctatctttttaatttctacaatttctggcgttaaagacttcttaataatctcattcgcttcagcttttcctcttgcttcctcaatggctttctctgcattaattgtagcttgctttttctcaatctctgctttttcaaggttttgttgagcgtctactactccttgaatcgctttcgctgtatttgcgtctggtttaggtgcttctaacgtaacggaatctactaagaacccagtagtatctaccatttttctaaattccttttctatcgctccattaatctccccttgatgttggaatacctcaagaactgaatagttagagaaaacgttcaatgtagctttcttaagtcgagtctgcaaccacccgttctcaatcacatctggagcttgtcctttgaacttgttataaatcttaggaagtttctctgcatcattcatgtaatcataagatagactcactgttaatggcttaccatctttggtttgtacgctgaatttatccactttaaccgtttctgttgaaataggataagctgttacacgtttaaatggtgaaactaaatgccatccttgtcctaaggtttccttttcaattcctgtacttctgttataaacaacccctgcatgtccccctgatcgattaccttcacactcattgctgttagaattccacctgttaaaagactgaaacctactactgctgcacctacgattttctttgtattcattttattcttcctccttaaacatgtttttaatttttaatactacgtttccaatacactcaaaaactcctaatttccctgatacaatccataaaaatgacaacaccataataaacactataattcctacaaataacgagaacattgcatcactcctttctctttatcttcacagcaatccagcgtggtatttttgtatattttaagagtgcaaacatggtagtttccgtatccccattcacaaatgaccaacaaactcttcccatctttctgtcccaattaaacgttggatcaagtttttcgttgtatggccataacgctttgttctctttaatagttatatttcccatacctttcctagcttttttaaaccatttgtaatctttattgttacccttgcatgcatataaaccatattgagtgcctcttgcatatcgcattttaaattaatccccttatcctttatttgagatcaagcaaactatttattcacttgctttatccagccatatcttcagcgaaaaatagaatttctaaattatctgttgcaacctcatatatttgatgcgagttcatgatttgtacagttgctctatcacctgttacgtgtaaaacacgagatgcatacacctcatccgttacaacatcaccagaacgatattcgttcggcttacgtcctttttgagcaaatacacgtcttacgctttctgcatcgatttcttctactgttgcatatctacatttattcgaatgattgtagccccaatcactatgtatcgctccttcgcatccccacgatccccataactctactttgtcgttaaaagtatccttaatcactcgtttcacttgtgtaataactttgttatccttcaattcgcatacaacccattgaccagtagctacattcttttcatcaatttgtaacttcattccccatctctccttaattaaagatttatgaattcaaactaatttgctatataagttaacttcctgcgctgcatcatttcttctcttgatggaataaccaactttgaccaaggtgaagcttcttttgccttctttccacattctgatcgtgttaacactggagttgttatggcttcttctacagtccacttcaaacgtttaactctgtcacgtgccgtactataactaataccatttaattcagcttgttccgcttgtccatcagttaacactttatttttacattttgaattggcttgttccgccaattttaatgcttgatatttatctataggtggcttgctgattgcatcaatcaatctccaacctttttttattcttgctgtataagttgaatgagagataccatttttcaaagctatttctttaatgtttttccatctatttgcgttatatcttgatggttttgtcattgcaatttctttgtcccatcccaaatttctaatcctacgtgtcagtaattcattactaattccattctttgcagccgcctcatattcttctggagttatataataatcatatggattccgcatgagtatcttctcctattcaattgttagttaagttcttgaatttcttttaacgatctattcgaaacttcaatactacgaatcttaaaactataattcttacgatatttttcacgaatttttaacgccgcttcttctttcgtttcagcttcacaaaattctaatttaaatcctgattctgtaacaatatccaccatgtatgtatctatgagtggctcgtaaataaaatcatgatctattgtgatttgttcagtcatttgattcaccttctatcggtgaaagcgtaataatcatttgttgatctaacacattccctattacagcattcatccatagattaggattcatttttctcattaaaaattcgatgactgtgattaactcttcagtagataaggaaacaaattctcctaaaggttcttgattaaacttaccaccacgtttttcaatcgttagagctactccgttgtcaatcacgtatctttttgcagtaactaaatcgaattgacggactttctcgcggccgaatccttttattagttcctttagaacatcatgaatgacacgaaaatctaacacttttactttctgttcaagctgctctctacactgcttgcataaagtcctctccaaaccagaaatatatattttactcatatcagactcaggaaaaggattttcgcattcataacattcttctccaattacatcttcaaatggatttagcatgtaaatcgctcctatgatttatatttgtttagcacttcttgcaatctctcacgctcttcatcaatagattgcgagttttgcttttcgatttcttttttagttggctcaacatcttcacgtaaccattctggaacaatttcttttctatttgaacgaccaggtcccgaaccattcaatcgcttgttcttactcatttcaaagcgtctatctaatgcagcaacatcatctaatgtttttactttttgcttttcccagcttttcaaaatggccttaatgtaattccattttggcttattttcatcaatagctttgtgagcagcatgtttaattagttcgctaccaaacgaatcacaaaactctcctaattccgtaatggcaatttcacttaacggaattccttcaccttttaaaaagttataactgactttaaattcttcatcgactaatacatgtgattttgattctttattatcatcatgataataattagtattttgtatattattagtacttagtaaagaattagtatttagtagtcggcatttttccatagggtggttcgtccactcggtggtttcaccatcatgtggttcatccatagggtggcttttccactcagtggtttcaccactaggtggtttatccaccctatggtttttggtatctatggttggtaattcataaacaatggtttcccaatgtgaaatttttcctgtttctgaattttggattggatatctcttcaaataccctgcctttttcaattcttttaaggtgcttgttgttgttttctcgctatccttggcatgttgacttaattcagtagcatgaaatgtccaatcgtccggtaaagaaagcatgtaggctaataatcccttcgccctccaacttaagttctcatcgcgcaaaggcgtattgtgtatcaccgaataattcgtatcctttttcactcgaaaaatacccatatttcctacctctcctattttcaaaacattgattaattgttataatacgtattattattttttctttaggacccgttgcagcgggttcttctcttatgctttcttgcgaattctttcaactacttcttttctgccaccaactttttcaagacgatctgctacacgaaaaacctctgctctttctgcttcacgatcacttttctgtttcttaaaatacatagctgataactgttttgatatctctaaatctcttataccttgcttctgataagcgttatgtaattcaagatacaaagttttattcctttccttatttgcctggttcatttgtttatataacagatgcagattttgtatacactctctacgctcctcttctaattccaaagccttttctagatgttccggaaggactcggctttctattcccatcatttaaagcctccctttctaagcgatcactttcatcaaactttcgttcaatgaaagtaccacctttataaactccatacgcaagtatcacaatccctaatccaaagatacagacattcgttgtactttctaccgttgtaatatccattaggctaaaacaaacacctttttagactcaatttcttgcgctaaagcttcttttaaatactctttaatgttattcatcgcttctaacttccaagccccaccatcggcttcaaacaaaccacaacgtgcaccttcacgcattctgaacacaaacttactttctggttgttccacttcaacaaatgttctatatgggcttaattgcactggattaggtacttttgcattccctctactcgcaactcctgttttcaccgttacagcttgcgatacaccatcatctccaatttccttaacatcattttcgacaaccgtacctactacctgtaaaacaatgtctcgatgattgttttgtacaaaacctgattgcaatgcaatattaaattcttctctgtcataaaagcttccaaaattaaaacgtggaatggatgcttgtgcttcgatataagtacttctagccttatctccattaaccgcagtaaagcatcttaccgttgttgggtttacaatatgaatcattacaggttcagttgtgtcaaattctgatttcacgtaacctactaaaccagataagctacgaacaataatctctgctggtgtcggttcttgcacaagatgtaatcgttgtgttgaataagtttgttccccgattttatgtgtttcaatcgttccaatctctaataccttttcaattgcttctcttgtcatagtcatttttatttccccttttcttaattagatttacttttcatataatcgattactactgtttgcttctcagcagcctgattttgttctttttcttctacttcttctacttcttctacaggttgtccaacatctgttttcacatcaccctgtagatccatataaaactgtccctggatcccggaagctaactcttgaccaactaaatttccgttttggtccatatctaatagaatcttagactctaccgcttctgttggtgctagtttcgaagtggcttgaacctgacaattccatacatcacgctttttatcaccagcaaacgaaagtgttaaaacaatctttcttgcttttttaggatcagtatttaaatctgccatattttccattacacgctcaaactcttgatgaaatctttcagcaagtgctccatcagcaaatgtatttaaatcaatcatgacttccattacttttctcacctaaacctttcttattaaaattcaacatccacttgaatatcgatgttcataggtagttcttgagctacaataattgaattaggactcgttccttttttaatcaacttttgaactccttcttttgcggcatcctttgttttgtatccaaaaacatttggtgtactggataaactcgtaacaattactaaaatttgttgttgcatgattgctcctcctactgaacttccgccatatttatttgtgcatttgtagctgtaatttcttcttctaaaataattggaagtgaatattcttcattaatgatttgaatcgctctatctaaatgatgacgtttaatagctttataactactaattccaaactctctatgtaattgactataaatatcgctatacactttttttctaaggctaacatccctataagcattagattccttaccacctaatagaagaacacctaactttcttacaacctttgatacttcatcacattcgatagcatataaaggggcgttttctcgtaaatccttcacatcggatttaatctcctgaatttcctgggtatgtccttctaaagcttgaaacgttaactttaaaactcccattggatctgtaggtattttttgttgattttgtatatgttgcttcattcgtttaaactcttcaataaacttgattttcatttgaacagcttcttttgtgttataactcattgcaactagcgtgaaagcttcttctgttaagttatacttaaggtattttcgcccacgctcattttcataatttgactcgtgaaaatttacgagtgaaaattcaggtcctgcatattcaatttgttttctaatatctttcaacacattgtcatgtgtctttacaaacatttcagcaatcattagactatctgttactacttttccgttgttttcaaatactaatgcttgttcgtttgctactgttaaatgattcatgttactttcctcctctacaaattcggaataactttagttttattcgtattacgatgcgccaaatgcaattcattacttacttttttaaaaatcaaccaattatcaggattcaaattgtatgatttaatatgaatcttttctttttttgttggctttttaccatttttcaattaactcacctcccttcgatctgaaaccttacggttcatttcgtataacttagttttacttctgcgcattttttaacaatttcatgccctttcataattcgtgttgctaatagtactccgttcatgcttttcactctccttaagatttattgacttaatggatatatgtaagttaacttgcttttatctactcacaatctgattaaaatgcttttcaagaaactcttgcattctatcagctataaacaaccactttttccctctagactctgggtaataagcaaaacctggattattcatatccaatattttttcctcacaaggtttgtaaagaatattttgtgaaaacca

SEQ ID NO: 1389 - DNA, 25860 bp, Bacillus thuringiensis
ccggcggacacggcgggactacagggggggaagtcactgaatcacaatccgcattagctgcaagtgtacacgttatttatatgagcactttcgtattagcagtatgtacattaattatcggttggcttttattaaagccagctacacaaacaagtgagcaacaataaaaaggatgaccattttggtcatcctttttttattcttcattctccacaatatgtttcagcatggataatttattatcccaaaaacgttcataatatgagagccactgttgtaattcttctaatggttctggatgcaaacgatatatcttctctcttccgctttttcttccacttactaaattcgcttccgaaagaatatgaaggtgctttacaaccgcagtacgactcatcggaaaatgatccgttattttggaaatcggtaactctttgtcacttaataaccgtattacttctcggcgggttggatcagcaattgcttgaaatacatcatatttcgctgctgacgaggacacttagccttcgacaacctttttcagtttttcatttacaattgctacccaaccaccgctcattctatcgcgaataatagagctcttcgcatttgctttcggaagaatttcatcaggatgtttccagccgccgtgaattaacgtaaattctgttttgttatctcctaagtctttcaaaataaatgaaacaacccagccatctgtatcccatgagaaagacaaatggtttggctcatcaatttctaacactttacatggtgatggcccaaatggtgattgcacatgaaattcatgtcctacctctaatacaaaatcatttggcataaaccatgacgcaatcccttctgcagttgatactacactccataccttttgaatagacgcgttaaaaacgattgtttgtttaatatcatttaatgtattttgttgttccattttcattctcctttactcggcgttacaacataacaccttttggttatacttcgataatataacaccttttagtttcatgtcaacgccaattcttttactgttgagaaattctcaacattttttcaacaggacaaacaccctcttagcattccctcataatatactcacaaaggcaatacaaaataaaaacttctctcaacatgaaactccatcattcatattgaaagaagcgccttacttatatcatgcgtacttcgtctctcctccttccctcaagggacaatacgcgagatatgacaaatcagaaggaatatgcccaccatttgagtaggtagttatttctcttctcctcaacatttcctcaggagcgaaatgactaccgactcacttttttcaaacaaaaataaaaaggggatgaaagctatgttctattgcattaactgttctgatattcatcatgaaaaacatccgaatgataaagtattcaaaaacggtttttatattgatccatttttaggtgatcgttatcaccttggtatgtgtaaagatgcccaaaatcatgaaacaggggagcctcttttaacgacaaagaaattaggcacaccccaatctattatgaacgtattaccgacacatgttgtcccaacataaaacataaaaaagagctgggtgagccagctcttttttatgctttataaacgatcattgctgaaaaacaataaatttggttttcatcgtcgttaatggaaacaccaacttgatacttaatatctacaaagttgctatcatcaatctttttcaaaaacacattcacagcgtcttctaagtctttttcgtgactttcatcaaacactttcacacgaatcatgttaacaccatcctagatcgcagccctccgccgcttgattattgccacggtgcgtatctatgatgcgataaaactttccattctcatatatatatccgtcttctaacacatattttttatcttcagtatagacataaaacttacctatcataaatttactcgtatataattccaaataatttggtctaaatttagctacaactttatttgtaatatcaatttttattgtgcgccccaccttctctccctcctttgcaaagaacggatttaggtatattgtattagcgcttttacattttatgcttaaaaataagtggatatgccctctttctcacctgtactatttttctaaaaaaatcactataaagtgaaactttaatcagcccgaccacccacctaacttctttgctttcgctgaattttgaggtgggggtcttattgcccgttaatgcgggataaataagttcaaaaaaaaacataaaaaagcactttatcttattgactcgaatataaatattatgttatcatataaaatttgacatttttacatacgtatgctatcattaaaagtggttaccacatatggaggtggatgatttgtttcaaattggtgataaaatcgtttatccaatgcacggtgcaggaatcatcgaagcaattgaagagaaagaaatattaggtacttcacgtcaatattgtgtgatacgcatcattagtaaagatatgcaagtaatgcttccgatggatcaattaaaaaaatcaggtattcgttatatcgttgatcgaggtacgttatatgatatacatcttgaatttcaaaacggggagtcagacccatcactctcatggaaacaaagatatacaatgaatatggaaaaaatgaaaaatggccctttacaagatagcgcagaagtggttcgggatttacttcgccgtaataaagagagaacattaaatgcgagcgaaaaacaaatgctagataatgcacgaaaaatgatgatcagcgaagtcgcgctcgtacaaaatgttactgaacatcaagcaacagaatttcttcaagatacaattaatcactaaatttaaaatagctggccgctatttttttttgtaaaaaaaggacgaagagttttatctcttcgtccttttatattacccacgcccagcttgaaacgatggatataacgtcattccaccatctgcaaatagcgtaattcccgttacgtaactcgcctctgatgaagcaagccaagttgctactgctgcgatttcttcaggttttccaatatagcccataggtatcatactttctacgtcagcacgttttttaggatcagcaaacttttctgcattgattggcgtattaattgcacctggtcctatattatttactcgaataccttttggcgcatattctagcgctaacgtttctgtcatcagtttaatgccacccttacttgctgcatagtgcacaaatagtggccacggaattttctcatgaacactagacatattaatgacagaccctttaatatcatgttctacaaaatatttaatcgcttcacgacttcctaaaaaagcacctgttaaatttgtattaattaccctattccaatcttcaagcggcatttcatgcgacggtaccgcgttttctatccctgcattattaatcataacgtcaagcgtaccaaactctttcacagcagattgaatgagattcacaacatctgattcgacggttacatcaccttttacagcaatcgcttcgccgcctacctttttaatttcttctaacacatcattcgcttctgattctcgtgagcgataattaataaccactttcgctttttccttagcaaacctcactcccatcgctcttccgagaccagttgctgatcctgtaataacgacaactttccctgctaaatcactatacatttccatacctcctttaacttttggctatacctaacataattccggctgcgataataaaaacgataccgacaacgatacccgttaattgacgtttcgttttcttttcacctaatataaggatcccaccaagcgtggaaataataattcccatttgcgatagcgagaaacttgttgcaactccaacacgcggctgtgaaatgaataaaaacatatttccagctgcccaaattaatcctggaataatattgcgaattgcatatttattaaatggatgatgtttaaaggtaagcaaaatcccacctaacaccataccaactgcttgtggcaacaaagccgaccagccatctacgttaaataacctaattactactacgtaaactaaataaccgactgttgaaattaataaaattacgatacctcttttaaagtttgctgcttgctctgcattcttttcttcttcactttgaagcgatgttaaaataacaccgataataatacaaacgagcgctaaaatcccaaggacgaccgatattgtcgtggaccattcatgaaatacgataacgccaaataaagtcgtcgcgactaattgaagtcctgttgaaattggcatcgtcctcgaaacacccattaaatcaatacttttcaattgatttgcctgaccaagcgcccaaaataaacctgacacaactccaactccgataacggtaggtgttaatactggcttcataaaaatataaacaacaattgagaaaataagtgctccaaacgttgttccgagcgtttgactatacgggcccccgcccagttttacgttaaatagcacaatacttccccaaaatatagctggtaaaatcgctaaaaatatatccatcactcattacctttctttactaaatgccatagattatcactctaagtcgttagagtgagcttttattttttctttttcccgttcacaaactttttctgcaataacgtcagaaacattcttttctcgctccactttctttatctttacgtgatctaaatggtcttccaaagtaagcgtaactttatcgttcggcggattatgcgctccttgaaatgtaagaaattgtagcttcacttcgtatctaggaacaaattcatctttcttgccgagacgctttatatctataactgaagcacattcatattgatcttctgtcacttgtctaataactgaatagtacctatttgataatgcactctctaaaagctgttctcttgattctttcgcgaaagaatcgcttggagaagagaaaaaggccacacatagcattgtgataactacacatatttttttcatagttccctccttgttctatagattagtgttctcaaaactgccataaaaaaacgactttccctatgtaggaaagtcgttttaatgaatccaatattaaccaccgctcactggtggaattagtgcaacaacatcaccagattggaccctgtcatcttcatttgcgtattcttcattaatcgcaaccataattggctctgaaactggtacattatattcgttcgcaacaacatcttttaactgtgcaaccgtaatattttctttctctatttgtaattcacttgtccctgcttcttcttgcaagtgcgcaaataacaatactctaatcatacttatagctccttcccaggctctcccgccggatatggtgttttttctaattgatcaccaatccatgagtcaccatcttcccaaaactcctttttccaaatcggaacaatttgttttatgcgttccataatatattcgttcgcttcataagccgctttacggtgtggtgttgaaacagcaacaacaaccgctatatcagaaatttgcaacgtaccgatgcgatgtgtaatcgcaacatatgtacctggccatttctctttcacttccaagccaattttctctagcatcttttctgccatcgtcttataagcaacatactctaagtataatgtacgacgccctttcgtaaactctctaaccgttccaataaatgttgtaacagcaccgcattcacgtcgaattactttcttcgttacttcttcaattgagatttctgtatcaattacttcataatatgtatttatcatttcgcactcctaaccgtttgtaaaaaccagtctatgtacaactcttcttctgttatatgaaatactttatattcttctcgtatatttgccggaacatcataccacgtaataaccgccacaatattttctactttatgtaaaagctcaatgtcttccgcagaacgaagtaacactactttcgagtaattctcttttttatagccttctattaaaattgtatccacttcaaaaaactcatataagcgaataatttcttgcaaggaccatttctttcttagtgaagaaagtgaaagcaatccagcaccttctacactacttacgacagcaccagctttacggtgtctttcgctatctttttgcgctacttctggaaagcctccgtgcccgtgatgtttaattgtagcaactttcatttttcgttcagctaatgcatgcaccactttctcaacaagtgttgttttcccgctattttgatatcctactatttgtaagattgaagtggctttgcccatggccaatcacatccctcagagtgctctaacaataatacggatactttcattccggtctcaaatcctctcgttcctccaggtaacacgataaaagcattcgcatctgcaagtgaagataccgcactcgatttatctaaaccaactggcatcgcttgtaacgccccgtccacaattgttacgttcgctcttacgaaacgagtaaatggatttggctttggaaaatctttttgtaaaatagcatccgctctatatacgtgaggttccttcgcatacaaatacgtttttataattggatgcacaaataattcaaagcctacataacaagcagacggatttcctgataaaccaaagagtaactttccatcaacttcagctactgtcgttacacttccgggcctcatggctatcttattaaagagtacatttgcctgtaacctttcataaatagctggtaagtagtcataatctcctactgatacaccgcctgttgtaattaaaatgtcgacctcatccaccgctgattgaacagctgtaaaacatgcatctaactcatccgcgagttgaccataataacgaactttcccgccagctttcataatttgagctgcgatcatatacgagttactatttctaattttccccggttctaacggctcatgtacttctaataattcacttcctgtcgttacaataccgacaacaggctgttttacaactttcacagtgctatatccaaacgttgctaataaggcggcaacacctggattaattgcaacgcctttctgaacgagaacttgattttgttttatatcttctcctttaaacgacacattgtcaccgttattaaaagggcgttttaacttcatatatgttttcccgttcttctcaaacccttctgtcagctctagcattacgactgcattgcaatcttttggaatagctgctcctgtcataatacgaaccacctgaaaagatcctacttcttctgtaaaaacagaacctgccccgatttctcctattacttcaaattcaactggattctcttgagttgcttctttcgtatcttctgctcgaatggcgaaaccatcgtaaggggaacgatcaaaatgaggaacgtcatgatctgagacaacatcttccccgagaattctcccgtaactttccgtaatagaaatttcttctacttcaccatgctttgcatatttcattacccgttctactgcctcagcaacttgaattggaattcgtttttctaccatcgtttctcacctcatatttgcaattttttttatctcgattaaactttatatattcaatagaaattacttcaaggaggaattccatgtcttcatttacacactttaatgaccaaggacgcgcgaagatggttgatataagtgacaaaaaagcaaccgttcgaacagcaattgcgtgctctagcattgtcgttacgaaagaaatttacgataaaatctctcacaatgaaattgggaaaggtgacgtattagcagttgcgcaaatcgcaggcattatggctgcgaaacgaacttctgatattatcccaatgtgccatcctttactattaaaaggtgttgacgtttctttcgattggaaacaatcagaagaacaatatcgtttactcattgaagtaaaagttaaaacagaaggtagcaccggtgttgaaatggaagctttaacagctgcttcggctaccgctcttactgtgtatgatatgtgtaaagctgtcgataaaggtatgattatcggcgaaacgtacttacttgaaaaaacaggcggaaaaagtggagattatacgagaaattcataatcctttctccgttgaacctaaaggattccctttaggttcaacctatatatcttgcatataaacttttcgctacatttatatcattcgtcccatgaatgaaagctctgccatctgtaaataaaacaaaacgatattcttctaccggaaacgacaataaataaggtgtcgcctttatctctacgcttctttgtaagcgctttttaatttcttccaaattaaaattcttccgcacacctggacgaatttgcactgtatttcgcccacataacacttctgttttcgtttgtgcttcaaatgttaaactcggatatgtacgtaaccttccgcaagataaacaagtatcttttttctgcctattcactttaaatgccatctgttgattattccaaagatcaaatgataacatcgtttcacgaagcgctccgtagtcttctactaatattttcagcgcttccgtagtttgatgcgcaactactaattgtactgccggttgtataataccagctgtgtcacatgttgctccgctcgccggatgctccattaaacagcgaaaacacggtgttttccctggtaaaattgtatacgttactccatagcttccaacgcacccaccatatatccacggaatattatacttttgtgaaatatcattaatgagaagacgcgtttcaaaattatctgtcgcatctaatattaaatctacatcattcactaattcttccatttcttgcaccgttacatctgtcacaaccggagttatttccacctcagaattaatcgctcttaaatgctctgctgccgctaccgccttcggtttatactgctttgcatcttcttctgtatatagttgttgtctttgtaaattactccattctacataatcacgatcagcaatcgttacttttccaacacccgctctaacaatcgcttctgcatttgccgcaccgagagcaccagcaccaataataagcacatgcttctctcttatttttctctgcccttcttctccaacaccagaaaataatatttgtcttgaatatcgctcctgcatgcgatagccccctttcttatcctcctatataagacatttcgatttttggacgattttttgcactttcttctgttcgttcatccgaatacctatcttttctattcatccatacatcttgtataacacttaataactcctcatccgaaagatttcctctaagaagttctcttacatccaaaccctctgtcgcaaataagcacgtataaaactttccatctgccgaaattctcgccctcgtacaagagacacaaaatgactcagaaacagatgtaataaaaccaacttcaacatttgttccaacgtaccgatatcgcttcgcaacttcaccaaagtaatgcgcttcagctggctcaagcggatacaccttatgaatcatctcaatcaattctcgttttgtaacgacttgatcaaaattccacccatttgtactaccaacatccataaactcaataaaccgaagcgtgattccttgctctttaaaatacgcagccatcggtagtacttgatgatcgttcatcccttttttcacaaccatatttacctttacttccaagcccgcctctttagctgctataattcccttaattaccggtttcgtattaatatttcgaccattaatattcttaaatatgtcatcatctatcgcatctaaactaacattcactctatgtaatccagcttcttttaatgccttcgcttgtttcgttaaatgaatagcatttgtcgttaaccctatatctattagcccatcaattttcacaagacgtgcaataagttttgttaaatctttacgaagcagtggctcaccgccagtaagtctaattttccgtacaccgatgctaacaaataattttgccaaacgctcaatttcatcaaaagttagtaaaaactcgtctttcaaaaaagcatattctggcccaaatatttccgctggcatacaatatgtacatctaaaattgcaacgatcaatgacagatatacgtaaatcttgaagtgggcgtccaaaaaaatctttaaccatctcctgcatcgccaccctccctttctgccaaatttctttcttttcattctattataatatattttcgaactgcgatgtttttgctcaagtgaataaagtgaaactttaaataattagaggggattcactccccctggttaacgaggtttacttacaaatacaaagataaaaaaaccttgaaacataaaagcttcaaggttctctgcttattaacttaatctaataatagtcagggtagcccctggcgttgctgtagataatgtagctattgcaactactccaaataactgtaagctaacagcagctccagcaggcaagttagcaattattgttgcactaaatgaaccagtagccactgtcggggcgtttatcgttcccgcaagcggactgccatttacagttatacgagaacttacaagtaatcctgccgttaaattaattgtataagctatataataatttcctgcattcgcaactgtaaatacagtatttccaccactaacggttattcctggaccaatattttgattgttcggtaatggtacattcgtaccacctaataaaacggaaatagcggttcctgatgtattattcgcaaatgcatacgttgcagttgtactaactccagtcaccccggtcgctcctgtggctccagctccggttggacctgtatctccagttggaccttgtgaaccggttgctcctgtagcccccgttggaccttggattccttgcgggccttgaattccttggggacctgtcgctccggttgctcctgtagctcccgttggaccttgaattccttgcgggccttggattccttggggaccttgaattccttggggacctgtcgctccggttgctcctgtagctcccgttggaccttgaattccttgcgggccttggattccttggggaccttgaattccttggagacctgtcgctccggttgctcctgtagctcccgttggaccttgaattccttgcgggccttggattccttgtgggccttgaattccttggagacctgtcgctccggttgctcctgtagctcccgttggaccttgaattccttgcgggccttgaattccttgggggccttgtgggccggtcgggcctatatcaccttgcgggccttggattccctgtgggccttgtgccccggttgcccctgtcactccttggattccttgaggaccttgtggaccttgaattccttgggggccggttggacctatctctccttgtgggccttgaattccttgtggaccttgtgctcctgttgcccccgttactccttggattccttggggaccttgaataccctgtgggccggttggacctatctctccttgaacaccttggattccttgcgggccctgtaaacccgtcactcctgttgctcccgttgctcctgtcgctccagttgagcctgtcgccccggtatctcctgttactcctgtcgcacctgttactcctgtcgggccaggtggtccacctgatggacctgtcactcctgccggacctgatggccccgtcgggccggtcggtcctgctggtcctcctgacgggccagtcacccctgttggaccagttactcctgttgggccggtagttccttctcccgtcgctccggttgcccccgtatctcctgttgctcccgtcggaccttgtatcccttgaattccttgtggtccttgcactccttgtgcacctgttgctccttgaaccccttgtattccttgcactccttgtgcgcccatcggaccggttggaccaatcgccccttgtataccttgcactccttgggggccctctggacccgttgctcctatttccccttgtatcccttgaattccagttgctccttgtgctccagttgctcccgttatcccttgcacaccttgtattccctgtattccttgtggaccttgtgggcctgttgctcctaccggtccttgaatgccttgtatcccctgaggaccctctggacccgttgctccaactggccctggaacaccttgtattccttgcgggccctgaagtccctctgggccttctggacctgttggtcctatctctccttgtatcccttggattccagttggaccttgtgacccagtcggacctatgtcaccttgcggaccttggattccctgtgggccttgtgctcctgttccccctgtcgctccttggattccttgagaaccttgtgggccttgaattccttgggggccagttggacctatgtcgccttgtgggccttgaatcccttgcggaccttgatctccagtggcccccgttactccttgaattccttggggaccttgaacaccttggggacccgtcggacctatctctccctgcactccttggattccttgcggaccttgtaaacccgtcactccggttgctcccgtttctcctgtcgctcctgtcactccagttgagcctgtcgccccagtatctcctgttactcctgttgccccggttgctcctgtcgggccgggtggtccaccagatggacctgtcactcccgccggacctgatggccccgttggaccggtcggtcctgctggtccaccagatgggccagtcacgcctgttggaccggttactcccgttgggcctgtagtgccttcccctgtcgccccggttgctcccgtatctcctgttgcccccgtcggaccttgaattccttgtattccttgtattccttgcactccttgtgtacctgttgggccttgaattccttgtattccttgcactccttgtgaacccatcggacctgttggaccaatccccccttgagcaccttgcactccttgtggaccctctggacccgttgctcctatttccccttgtatcccttgaattccagttgctccttgtactcctgttgctcccgttatcccttgcacaccttgtattccctgaatcccttgtggaccttgtgggcctgttgctcctaccggtccttgaataccttgtatcccctgaggaccctctggacccgtcgctccaactggcccttgaacaccttgtattccttgcgggccctgaagtccctctgggccttctggacctgttggtcctatatcacccatcggaccttgtatcccttcaactccctgtggccctgttgctcctgatggccctggtactccttgtattccttgtggaccttgatctcctgttacccctgttgccccttgtggtcctatagccccttgtataccttgcggaccttgatctcctgttgctcccgttaccccttgaataccttgaactccttgtattccttgttcaccagttactcccgtcggaccaggaataccttgaataccctgcggaccttctggacctgttggcccaattggcccttgaatcccttgaatcccttggattccttgcaagccctgtgctcccgtgcttccagtaggacctgtacttcccgttgctcctgttacccctgtacttcctgtagctccagtattcccagttgctccagtcgcacctgtacttccactcggtccaccgcccggacctgtcgcaccagtcggccctgtcggaccaggaggtcctccagatggtccagttatcccagttggacctgttattccagtcgggcctgttatcccctgaccagttgctcccgttaaccccgtacttccagttagtccttgtgccccttgaattccttgagctccttgaattccttgaggaccagttacccctggcactccttgcacaccttggattcctcgaggtccctcaggtccagtagctccaatcggaccttgtaatccctgtacgccctgtatcccctgcgctccagttgctcctgtcgaaccaatcggaccttgaattccttgcaccccttgtaaacctgtcgctcctgttgctccttgtggcccccttaacccttgtggtccctgctgtccttctggtccagttgcacctattgaaccaactggtccttgtatcccttgcacaccttgaggtcctgtcgggcccatctcccccatcggaccttgtaaccctctcggtccttgaggaccagttggaccccgtggacctgttgggccagtaatccctatacctgtaaatccagttggaacaggagggaaagtaggtccaataagttcgggtggaattctaaaattagagcttaacgaattttgcttcccattattatcacgtttcttcacactttcaccacctacaaaccttctttttcataataaataaacctcttcttaatctattttcaaaaataatttccaagactatttttattttaaataataaaaactcccttaattccttaagggagtccagcaactgaatccatattatctatatttggcaccgcctgcatagtactcgacacatttgcaccttgcccagtattcgttcctgttacagtaccagcaggagtacctctcgtatacgttgttgtgacagaatctcctggctgtaaacaaagctttgtctccgtccctattacagtaacaacatcaatccaagtacaccccattgaaccactatacgatttcgaagcagtaaatgaagtgtctcttaaattatcgcccgtaaatatatttcctgtattattaacgataacaaactcttttatatgtgccggcatacttacacactacctttcctttacgaacctaacgtacgtgtacttgttgctaatggtggaagaaatactgatgttctaattaccgcttctggctgccttttcccatttaaaaaaatagccgcactcgcccctccggcacccgcatacgcttttgatacagcaaaaggtgagagatcataacaatcgccaacattaacagctcctgtattatttataatttttactttacgcatgttaattcccatcttctccatcctccttttatatactgtatgcaaaagaaaaaaaacttgaaacatactcgtttcaagtttttaactatttactatttcgtttcaccttcatattgaagcataccgccgaccatgttcactgttttaaatccttgctcatttaaataatgacatacattttcactgcgcattcctgaacgacaaataaagatatattcattctctttattaaagaaatctactttatgtgggatatcacccattttaatatgtacagcttctggaattttccctgccgctacttcttcatcttctcttacgtccactaaaaataacgtttctccattttctaaacgctcttgcacttcttctgtagtaattgttttaacttctgtcatatgtagttcctccttatatacaataaaacctttagtttctttttcacaaacattctctaccaattttagcatgcaaaagaaagaacgcaaagaatcgaaaaactatttctcaattttcccgcaaaacttattctttacaaacataactcttgcattgtatcctcaatatacttgttttatgaaaggagccaatgaaaatgacactttcccttttcattatgggcatcattttcttaatcgctgcaattattactctcagtatgaaaaataataaaaaaataaaatcctcacaagaaatgtcattcttatttctattgcttagcatagcgttctttggtatagcaatagctacatatattttccgtctacaaatcatgtgaaaaaaggtgcctactacaaacattgcaccttttccccatcatttttcttctacacaaaactagatactttccgattcaaaaattcataaacttttttttcaaataaataaatatcaagtgctcctgccatatgcccatttatactttctatctcatatacttccgcatatttcccttgtttttgcaaaatatctaccattttataattataacgagacggctgaagcaaatcttgtttacacggaatcataagcacattcgcttctatgttagaaagagattcttctagtgaagaaaacccatgtgcaatatcatgcaataaaactgccttcgcagtatacatccatgaatttgcatctactagctctaaacttgtatatgtcgctttatttatctctttttcaaatgatgttagtgtagaaaacttttcataaggttctacctctatactattacgaggaaatgtcatttcataaaaatgctcatcaaacgcgttcataaacatcattctatttgctaaatgaagcccctttatcggttgctgttctccatattttccatctttccaacttggatccagttgaattgcttcaatcgcattttgcgctacgtttactgacgtaataattggattttgtgggttcgtaataacgccaatcatccgctctaccatatgtggatagtgaaccgcccattgttgtgcaatcattccccccgccgacggtccgattacagcgtgtaaccttgaaattcccataccttttattaactcatattgcatacaagctacatcaagaaatgtaaaaaccggaaactccatagcatattcttctccagtttctggattaattgatttcggtcctgttgtaatcacatatggattcctcacctgcacattacaaagattatccgtacatataacaaaatacttatttgtatcaattgctttcccaggtccaatgagcccatcccaccaaccagactcctcatcatgcactgtatattttcccgccgcatgacttgttgcactaaaataatgacaaaccaaaatcacatttgacctttctctatttaacgtaccatatgtctcgtatcccatttgaacaggaatttccctaccattttcaaacgtaaactcttttaaaacaaacttctctttttttacaatttgcacagactctccctctccccgttatagtatgaactgcttactaaagatttttttccatgcaactaatctccttcttcttttcataaataaatgaataatatacaaaattagccacaaaatagcactatattacaagattaaagagggcatacatatgatttggaattggttacgtaagaaaaaaaaattaaataaaccagaagcaaacgaaagagataaccaggagcagcattctaacaatgaagaggatgataacaaagaacagactagaagtataaaacataataaaggtaaaaataacgagcaaaaagattcttctcaggataaacaacaaagcgctaaacaagatgaatcttctcaggataagcaacaaagttctaagcaagatgaatcttcacaggataaacaacaaagcgctaaacagaatgattcatttcaagataggcaacaaagtgctaaacaagatgattcatctcaagataaacaacaaagtgctaaacaagatgattcatctcaagataaacaacaaaaatctaaacgagatgaatcttcacaggataaacaacaaagcgctaaacagaatgattcatctcaagataggcaacaaagtgctaaacaagatgattcatttcaggataagcaacaaagcgctaaacaagatgattcgtttcaggataagcaacaaagctctaaacaagatgattcgtttcaggataagcaacaaagctctaaacaggatgattcgtctcaagataggcaacaaagtgctaaacaagatgattcatctcaagataaacaacaaagtgctaaacaaggtgattcgtctcaagataaacaacaaaacgctaagcaagatgaaccttctcaaagtaagcaacaaagctctggaggtaatagtatttatgactttacaaaaccagaaaaagaccgtattcattctctacaagatttaatagagaaacttaaaaagtctagtgattttattaattaccatacatctgacgatgaaacgatgccttattggatttcttactatcgcccttcacttgatggggagaaattacaaaaatatttaatgcctactcttttagagagaccttgtacttcgctagaagaactaaaagaacatattccgatgagtggcattacaattacgaacgacttgcaaaaaattgaagacatggttttaaagggacatgcgatcattcaattgaatcagcaagatcaaaaatgtatgcttgcaaacattgcaattgataattatcgtgcaccaacccctcctttaaacgaatcaactgttattggtccgcaagaaggtttcgtagaggctattgatacaaacattaatttagttcgaaaacgtctgcctgttttagatttacaaacaaaagaaatgattatcggcgagttttccaaaacgaaagttgtcatgatgtatttagacaacctcgctgaaaaagataatgtagattttctcgaggaatcattacgcgctcttgaatatgatcaaattaatgatagtgcttatatacaagaattgatgggtgaaaaatcaattttccctctatatatcaatacagaacgtactgatagagttacaaaagcgcttattgatgggaaaattgctatttttgttgatggttctccgagtgttttactaacaccggtatcctatttcgattttttcatttcaccagaagactataacgtctcctggatgtacgctacattttcaagggttttaagattaattgccgttctattttcaatttgcgctacaccgttatacgttgcagttttaaattatcattatgaacttattccgagtgatttacttgaaactttaattttatcaagagcacaagtaccgttcccgcctttaattgaagctctctttttagaacttgcaattgatttattaagagaagccggcgcaaggttaccgatgaaagttggtcaaacgctcggtatcgtagggggtatcgtaatcgggcaagcatctgtacaagcaggtttaacgagtaatattttattaattatcgttgccttatcagcactcgcttcctttattacacctatttataaaatgggtaatgcggttcgattactacgtttcccgtttctcatatttgcagaaataggaggacttttcggtatttcacttggatttatctttttattcacccatctgtttagacttacttctttacgcaagccgtacgctttgttctatccaacaagacaacaatctgttaaagattcttggatccgttttcctttaacaatgattgatacaagagatgtacaagcaagaccacaacatgtaaaaaaagctgcgaaaggaatttcaacaaaacatagatcggattttgatgattaagaaatgaggtgcattgatgagtaaagttcaagaaaaatatcaaatatctcctgtctttgttttcttcttaattcacggtgcacagtttggtgctggcgttctcggcttcgctcgaatcatcgcaaaggccgctggatacgacggatggatgggcgttctaatcacgggactctgtatccatctccttatatggatgatgtattttttattaaaagaaacaaatggaaatttaattgatttacaaaggcaaacgttcggaaagtggatagggaatatctttaatatcatctttgcagcttattttttaaacgtcagcatttcggttattcgaacatatgttgaaattattcaagtatggatgtttcctaccgcttccacctttatgttaacactctttttatgcttagttagctattacattatctcttctggatttcgtgtcattactggcatttgtgtcatctctgttggtggtacattaggatatttatttctaagcttattcgttttgaaatattcacattgggataatttactacctatattcacacattctttttcagacattttaaaatccgctcaactgtcaatctacagtatgaccggttttgagatttacctcatggtatatccatttgtgaaaaagcctatgcaatctcataaatacgctcagcttggagcactattttcaaatcttctatatttatttagcacccttttagcctttgcattttttagtgaaaaacaattattaaaaacgatatgggcacaactttctatgacccaagtcattcaattaccatttatagaaagactcgaatatattgcaatttcaggctacgcactcgttattatttcaagttttatcctccctttatgggcgtcaatgagagcaactcatgaaatattccgtgtaaaacaaagaggggttttaatcgcttttatccttatcaccctcattgtttcacaacttttaacaaacagacacgatattaataactttattagtaatgtatcaaaggttagtttttggctcatttatgtatacatcccaatcctatttattattgtgtgggtgaaaagaaaatggaaaaaatcaaaagcacaagcaaattaatacttatttcttgtataacattcttcagtctaattggatgtttacaaaaaaatattatcgacgatgtacaacttattcaaggatccgtatttgacgttgcaaaaggcaacaaagtaaaagtgacattcgtttgccccattcagaaaaaaggaaataaagttcaagtttttgaaggaactgcaaatgcggtaaaacaagtaaaagcagatacatcattagaatcttctcaaccttttgctagtggacaaatgcgtgtcgctctatatacgataagacttgccaaaacaggaatgtctacttcattcgatacattacttcgagatgtgaatatagggaacgctttatatgccgctttattagaggggaatggtactgaacttttaaaaggcaaatattccacttcatacaacgttgcaatttatataaaaaagttgttagaacataatatggagaccggtcctttaccaacggataatctgcatgtaggagcatttcgttattatcaagaagggcaagactactatattcccattctaaagaagcatggtgataaaataaaaatcactggaattggtctttttaaaaaggataaatatatcggtaaaattgcggaaaaagatatgttcatatttaaaggactattagagaaacataaattagattcacatgaatttaaaacagattctgcgtacgtaatgattaataatattcgttctgttccaacttacgatataaaaattaaaaacggaaagccttcttttttcattcacgttcgtcttgacgcacgtattcaagaactatcaaagcaaattaacttagaaaataacaagaacacaaaaaacattgaaaaagatgtccaaaaacaattagataaacaagctgctaagttaattaagcaatttaaatctttaggcgtcgatcctctcgggctaggtgcaaagtataagcaacattatcgcccattcaaattagaagaatggagacaaatgtataaagatgttccagttcatataaaatacaccgtgaatattacaaattctggtgtaattgaatgagaaatgattgaactcctctctccagcatgatacaacggagagaggagtttttattttagatagagagagaagatatttatgggggagcttatgtctaaaaaattagtaaagcctattttaaatggtattttatttctcggcgtctttttatttgctcatacatacttaaaaaatgtttccttcacacgttacttgcttgtcgttataccaatgttactcgtcggtatttttggcatcgatcttatttcatcgcttttaataaaaaaagaagaataacgagcgaacatcttatttcaataagatgttcttttcatttcataatcaccttatgttacaataaacttcggcataacgtaagaaaggatgaaacaacatgacaaacgaaaaaggtttagataaaggatacgaacttgttgcgaaaatgcatgaagtattcggacatcctgtgacaaatactccaacaaaattaacagaagagcgtgcaaaaatccgtgcaagttttatgcaggaagaactagaagaatttctagaggcaacgactgttgaagatcaatacgatgcactaattgaccttatttactttgcattcggaacgtttgccgaaatgggtgtacgtccagataaaggattcgaaattgtaaacaacgccaacatggcaaaactattccctgatgggaaacctcgattccgtgaaggcgacggtaagattctaaagccagaaggctggcaagcaccggaaccacaacttcgtgctgaaattgaacgtcagcgtcaagaagctgaaaaaaactgctaggatttcctagcagttttttattatggctttttttctgccaatcattaatgacccacgtgccctgcgtgtcctgctgctccactaatactagctgctcctgctgctgcccctgctcctcctgctccaattccacctgtccaaggagaagattgttgttgttgttgatattgctgatattgttggtgctgttggtgctgttgaccttggtatccatgatgttgaccttggtgtccatgatgttgaccttggtgtccatgatgttgaccttggtgtccatgatgttggccttgttgcccatgatgaccgtgttggccttgatgaccttggtgatggtggtgaccttggtgtccatgatgttggccttggtggtgatgtccatggtgaccatgttggccttggtgagtttgataaagaacagcttgcggatgaatgtggtggtgaccgtggtgatgtacttgttgcccctgatgaccatgttgaccttgatgatggtgatgaccatgatggccgtgttgaccttgatggtggtgatgaccttgatggccgtgttgaccttgatggtggtgatgtccatgatggccgtgttgaccttgatggtggtgatgtccatgatggccgtgttgaccttgatggtggtgatgtccatgatggccatgttgaccttgatggtggtgatgatgaccatggtagccgtgaactacttgcggatatccacctactcctcctgctacaacacctactcccggtacaggaaatcctgtctgtactcctccaacgaaagatggaaatgcagttggtacgcctactggtactcctcccgctgctccgccaacaaatgttgggattccagtttgcactccggctaccgatgatggaaatcctcctgttaatgttggaattccagtttgtacacccgctactgatgtagaaaaccctccaggtgttccgcccatccagctcggaattccaccgtatccttgttgtcctcctcccattaacatcatttgttcataactatccgatccactcccgaagaaaccatgtggtgcattattgtccatccctttcattcctttcacctcttctactcaatttagcctaccttttttatcatatttcctatagaagaataggtgtttgtctgcactagaattccgcttctttttcttcattcatgataaaattaattaactgaatattttttctaggaggtatttatattgaagaatgtaacaaaggcttctatcaatgatttagattcaatcgtccatatagatattgacgtaattggaaacgatagtagacgaaattatattaagcacactatccgtgaaggcagatgcatcattgtaacagaagaaaattctatctctggctttctaacatacgatacaaatttctttggttgtactttcctctcattaatcattgtttcaccaactaaaagaaggcaaggctatgcaagctcgttaatctcatatatgttaagtcattctcctactcaaaaaatattttcttcaacgaacgaatcgaatgaaagtatgcagaaagtatttaactcgaatggttttatacgtagcggaatagttgaaaacttagatgaaggtgaccctgagattattttctatacaaaaaagctcagaacataaacgctctgagctttttcaaatgatttagtttgcaacaacgttaacaagttttccaggaacaacaattactttacgaactgttttcccttcaatttggtcttgaattgcttcaagtgcaagttgttccatttcttcttttgatgcgtctttactcattgttagttttgcgcgaactttacccataacttgaacaacgatttcaacttcatcttctacaagtttagactcatcaaatgttggccagcttgcatatgtgattgtttcattgtatccaagtttgctccatagctcttccccgatatgaggtgcaactggtgcaatcatttttacgaaaccttctacatattctcttggaagtgtttcagctttgtatgcatcattgatgaataccatcatttgagaaatcgctgtgttgaagcgaagctctgcatagtcttctgttactttcttcactgtttgatggtaagctttttcaagctctttatttggtgcgtcagtaattttctcacttaattcaccgttatcttgaacgaatagacgccatacgcggtctaggaaacgacgagctccgtcaagaccattttcagaccaagcgattgaagcatctaatggtcccatgaacatttcgtatagacgaagtgtatctgcaccgtggcttgctacgatatcatcagggtttacaacgttaccttttgatttactcattttctcgttgttttcacctagaatcataccttggttgaataattgttggaacggttctttcgttggaactacaccgatatcgtataatactttatgccagaaacgagcatatagtaagtgaagtacagcgtgctctgcaccaccgatataaatatcaactggaagccattgttttactttttcaggatctacaagtgcttcgctattgtttggatcgatgtaacgtaggtaataccaacagctaccagcccattgcggcattgtatttgtttcacgacgaccttttttaccagtctcaggatcaacaacatttacccactcgtcaatgttagcaagtggtgattcacctgtacctgaaggacggatgttttctgttttcggaagaactaatggtaattcctcttctttcacagctgtcattgtaccatcttcccagtgaattactggaattggctcaccccagtaacgttgacggctgaataaccagtcacgtagacggtacgttactttttgatttcctgcgctcgttacttcaagccattcaatcatttttgcgattgcttcttctttatttaaaccatcaaggaatgctgagtttacgtgtgcaccatcacctgtgtacacttctttcgtaatatctccgccttttacaacttccttcattggaagattaaatactgatgcgaattcatagtcacgctcatcgtgagctggaactgccattacagcacctgttccgtaagttgcaagaacatagtcagcaatccagattggtaatttctcaccgtttactgggttaattgcgtaagcaccagtgaatacaccagttttttctttcgcaagttctgtacgctctagatcactcttcatttttacagcgttaatgtaagcttctaccgcttctttttgttctgctgttgtaatttctgcaacaagtgcatgttctggagctagtacacagtatgttgcaccaaataatgtatcagggcgtgttgtgaaaactgtgaatttctcgtctgtaccatcgatgttgaagt

SEQ ID NO: 1390 - DNA, 31206 bp, Bacillus thuringiensis
ttcgcttcaattaaatgatcaaataccatataacgctactcggcgatagtcacgaataatacgtccacgtccgtatgcatctggaagacccgtaataacacctgatttacgtgcatttctcatttctggtgtgtatgcatcaaatacaccttggttatgagtttttctccaatctctaaaaatacgactaagttctttatccatttcgtatccataagattcacaagcttgttctgccatacgaataccaccatatggttgtaaagaacgtttaaatggtttatcagtttggaaaccgactactttttcaatatctttatttaagtatccaggggcatgtgatgtaatagaagaaacaatttttgtatccatatcaagaacgccaccgttttcacgttctttcgttgttaaatccattacttgatcccaaagttgtttcgttgcttcagttgcttctgctaagaaagattcgtctccttcgaaaacgtttacattatttaaaatgaaatcgcgaacatcaatctctgctttccatttttcacctttaaagttttcccatgcgtttttaacattttctaatacttgagtcatcctaatctcctccatttttgattagtacaggactaagattttttatataacagcttacacacttagaatactacttttttacgaaagtgaacgaaatagttgtgacatgtttgtgaaatattgagcaaactactatatatatagtgttaacttcatttaaaagtctttaaaattaaccctttccttaattgtatttttttggtatccttatatacgagtcctattttgtaatataagaacaatacccattgtagagctgtaatactcttatctcctaatctgttatagtttttataacagaacaaaaaagtgtacacatgttgtacacttttttgttacttctataaaacatctctttttctattgccatcatagaatccgccacgattgtctgttaatgaaattatttgctctagtccctctatatgatcacctataattcgaagtacagctggagggtgacctatttttgcgaaatgttcactgggacgaatacggttcatcttatcaacctcaacacgatatacacatgcaatttcaaatccagacagaagagccttcacttgtgctacacaaggtgacaataaagatttatacccaattgctttcaaacacttttggctaaatgcattaggtaccgcaataagtgagcctacccctaaatcctttctatcacaagctaaatttagtgcatacttaaatgcagttacaagatgaagtggtactcttaaatctaaatagtgatttaaatcatttaatgcgacgtcctttccatctgctatagcttttgcaaaaggatatagctcactcgctggaataataaaatcgccgtctataaataacacaatttctcctttggcaaaataagttccaagtgagcgccctacatcatttccgagtgcttctttatatacaattgtcgttgcccctttgtcttttgcaatttttttcgttttatctgacgaaccatttacgacaacgataatttcgaagggttcaattttgcgaagctcttctataacgtttccaattgttttctcttcatcttgtacgggaataacaacagatagttgctttcctttatacaaattagatgtgacgccccatccttgataaaactcttcaaaacttaaagtatgatagacactatcccttttcctatttccatcataatatcctccgcgctcatcactgcttaatatccgtgccgctactgcttctatatgatcacctatcattcttttttcagattgggaaagatttgttccatatgcagcatgctggaatggacgaaatttatttggcgtaataacgtcaatggcgcaatgacgactaattctccatttactttgaagtaggcgtaaatgagccacaataggattaacaaaacattcatatccgatgctttgaacgacttctttcgtcagcgcatgaggtacatctaataaagaattaatttttaattcttcacgctctaacattgcatttaatatttggcgccatactgtaatagaagtaggtttttgcctttttaaaaataatgcatccaaattatttaaaactacatctgcctgatcgtataaaatcggattaaggaataattttaattttgaagtttgaatagcaaaatcaccatctataaatagtaatacatcacctatcgcatgttttgcgccgactgcacgtccaacatcgttccctagtagctctgtatgtttgattactttacaccctaaacgatctgcaacatcttctgttccatcattacaaccgtttgctactacaataatttctactggatttaatggtcttaccgattgaataacgtctgaaatcgtatcgacctcattacatgcaggaataataacagataatgacttagccattgttttgttcacgaaaccacttaattgtttccttcaatccgttttcccacgttactttcgcctgaaattgaacaagcttttttaattttgttacatctggtcttctatttggaatttcttcaaaaccatgaggatatacttcttcaaaaggcacttgtacaatcttcgaagaagaattcgttaattttttaattacttctgctacttcttttatactctgttcattctcagaacctatattaataatctcaccatttaccttctcatccattgcccgaattgttgcttctaccgcatcactcacatacgtaaaacaacgtgtctgctttccatctccatatacgagaatgtcttctccttgcaaagccgcactaataaatcgcgggattacccctgcatacggaccatctttcgctcttggaccataaatattaaaatatcgaacaatcgttaccggtaaaccttctaatgcgtatcctaaacataatgtctcttccaacgttttacaaactgcataactccaacgaattttagaagttgccccgtataatcgatctccctcttcagagaaaggcggcttggccttaccatatacttctgaagtagaagcaaaaactactttcttctttccttttaacgctgcttgtaaaatatttctcgtcccatcaaaattcgtttctatgagctctatacttttttccattgttgttttcacacctaaaattgctgctaaatgaaacacgacatcatgctgatctactaattcataaatagaatttttatctaaaacacttattggaataacacggatttttttcattaactctttatggtacttatttttacctttataaaagttatccacaacagtgacctcataacctcttctcatcaactcttcagctaaatgcgacccgataaatccggccccacctgtaattaaacatttcttactcatttactcaccttctttacaatcccgcgtgtatctattactcggtccattcctttaaaaagcttccaatcaatattagaatgatccgttaaaattaaaatacaatccgcttttttaactttttcttcatctaaagaaacagattgatacaccttatctccaatttccgcgaaagaaatataaggatcatgatattctatctcgtatccttgatttcttaataattgaataatcggtaacgctggtgattctctcaaatcatttacatcttttttatacgcaatccctacaattaacaccgttgcaggtgattgcaccacactttttactttccggaccattttctctggcatttcttcattaattatatgtgctgcctcaattaattgactaattgccccattcttttttattctccattgaaaatataaagggtctactggaatacagtgtccccctatccctggccctggccaatatggagtaaacccaaatggttttgtagatgccgcttcaatggcctcataaaaatcaatgcctaaactttcacatagtgtgtttagttcatttactaaagaaatgttaactaagcgctgaatattttcaaatagcttgcacatctctgctactttcggagagctaacaggtacaacttcgtcaaaaatggtactatataaatcctgtaccttttgtctacacttttctgtttgtccactaataacttttggaatagcttgaactgaatattgactatttgctggatcaattctctcaggggaatatccgatatagaaatcttcccctaccttgttactattttgagaaataataggtatgatgacttcttcaagtgtgcctggatatgtggagctttcaaaaatgaaggtttgtcctttttgaaggttttgttgtatataatgcgaagctgaaatgagggcacttaaatctggttctctttgttcattaattggagtcgggacagtgacaataacataatcactactttgaaaatcagcaatgccttgatccggtgtgtttactgttaatttttttttcgtcaataaactttgtaactctttagaagaaacatctggaatataactttctccttttataattgagtctatttttctaatatctttatctaatccaagtactgtatgccctctttctgcaaaatgtaccgctaaaggaaggccaacataccctaacccaataatagctactttactactattcatttgtattctcttcttcccttctcaattgttgaatgatatctctatctctatctccatcagtaaagccaccacgttcatccgtacgttgtaataaatacgtaaccgcctcaagttgatcaccgaaaatacgatcaaacgctgaaatacgcccatttacaaattcgtgttgctctggacgtactcgatttgtttttataacatctactaactctactgttgtaatagagaatccttctaaaatagctttcacttgtgctaatggcggaatgataagggcgtcatatcctattttctctattaccttcttatgcatggcatgtggtacagcagttagtgagttattccataaatctggtcttttcgctaccaaattcaaaaagtattttcccatactaattggatctgctggatgaaacatatctaataagcattgtaaatcatttaacaccacgtcatttccatcttcaacagcatgtaaaaatggagtgagtttttttgctggaataacaaaatcaccatcaacgaataaacaaatatctgccgtagcatgcatagcccctattgctcgtgctacattatgtccaagcgccttcgtaaattcaactacaataacattctctagctttgcctgtttaacagtctcaacatctgctccattcgcgacaactataatttcatctacacctgcttctttcacttcttgtataacagaccttatagttattttttcttctgataccgggataatggcactatatttcgcttttttcttttgtaataaaactggtttatactttcctacaaacgctctatctctattgtcctctgaaaaaccaccgcgattaccgtatgtttcgattacgtattgtaaagcacgcaaatgatcacccataatacgactagtcgctttcggataaggagagccaggtgatgcgcccgtatggacaggacgaactttatttgtgtaaatgacatcaactgaagccatatcagaaatatctactcctctagacatcgccatcgcttgaaataatgctggatctgctaaattccaccaccccagtttttcaatcactttacgacttatcgcatgtggtattgcaattaaagatcctacaacaaactccttcttgttcaaataacgatttaacatatattttccaaccgtcgtataatgcggtctcatcttcaaataaacggaccatgttaaattatttaaaacaatctcatgtccttgctgtattcctttaataaaattgtataattcttcacttttcatgacgatatcaccatctaaaaataaaacaatttcaccttttgcttctctagcaccaattgcccgtcccacatcattaccaagggaatatctataataaattacacggcaattatgctgtagcgctatttctttcgtaccatctgtcgatccattatctactatgataatttcatatggttcgagctttcttacttctactaaaacttttgataaagtacttgcttcattatgcactggaataacaactgacactctcatacttgtatcactcttacccttccaagcgaacatatgaaataataggaatacgtacaactacatcttccggtggtccataagaaggagaagtacgaacacttactgctccatctgtcacagataacagaatacctgcaacaatttcggccgctgtcacaacttgcactaactcaccaacatggttacgtaattcttcagtaaataacatatataagtctcctttcttacgcttctttaattgatataatacttgtaaatggtaataaaacttctgttcctattccttcttgcaatgttaagaagtcatcaccaactgctacaataacgcctgttaactgtcccactgtcacagtaatttctacgtttttacctaaatactgctctgcaatttctttaaaaggtgatgtattacattcttttaaaatgttacaaataatcgattgaaattgacttgatttaataaattcttctgtagcttgcttggaatttctttgaataaacctcgcgaagttttgcgaaaataaaagtctttccacagcaggcaataacttattatctaaaaaataatctaattgtctattaaacaatcttgataactttttccaataattactgaacagacacatatacttctcctcctattatttttaaattataaaaatacatccatacatcttaatgtatacaaaatagatatttttgtgataggtaagacatacattttctaaaagaaatatttgtttcagggcataaaaaaaactatccaaaaggatagtttcttacacttcaatatttcttaacatcgtatatatatcgttattcactttaccaaatgatttaatattgttttgaatgttagataataaaacaacgtacacactaccgtttttactaaatccatttaaacaattccaacctggcattacaccatgattcgaatagcttcctgggtctacgtaccagccaaatccgtaatcctttttcacggctgtaaacatttgatcgtaacttgcttttgaaattaactttccagagtataacgcttcgttaaataaatataaatcatgtgcactcgtatatatatcaccacaaccatatagttgtgacatgctcggaatattaggtgttgtcatattattatttactattttataacccgttgatgggaatcttgtttgttctaacgctgtgccaaaaccagaatgtttcatacccgcagtagcaaaaatatgttgtttaatatattcttcgagcgactgtccacttaccttctcggcaatgtatgcaagtacggagtagttcgaatcggaatacttccatttctctcctggaccaccaatacgcttttgatttcctatccgctttatcagttcttcatgagaaatatcttcttttccctgctcatattcgggaatccctgatgtatgtgttaatagatgttttagctgaatactattaccttgtgggaaatttggaatatactttgcaacagtatcttctacttgtaatttattctgatctttcaactgcataatagcagttgctacaaacgcctttgaaatagaaccaatataaaaagtcgtctctgaattattcggtacttgctgctctttatttgccataccgtatcctttattcaaaagaacttttccattcttcacaataacagctgtcccgctaaagcctgcgttttttaaatactggtccaattgagcgttttcattaatttcttgagttggtccttcagcaggctgttccgcaacttgcgcttgcttcacttgttcttcctgctctttttgtttttgcttctgtacttcttgtttctttttttcttctttcttttttagctcttcttgtttcttcatttctgctgccgcttttaaagtttcttctttcttattatgcgcaacaatttttgtatacatgaaatatacaagtgataatagtaagacgagaatgattgttcttttgatgtatacaatcggccgacgtactttcccattcgcattatttttttcctgatccataattgcttttttccccttactcaccaataatttaattcctctattaaagatttattttagtagattatggataatccattctatatcatccctactttatcacgcactgcacatattaccaacctatatgtacaaaaaagaaaaagaaaatttacaaaagtaagattcccgttaaattattaacaaaaaaaagaggatatcctctaaaaaattgatgttatcaatctttttggacatcctcttatctcattatttatacgtgttttttcatatcatcggcaacagattcaacatttgtacctacgataacttgtacacttgtattacttaatttcataacaccttttgcaccagcacgttttaatgctgcttcatttacttgaccagcatcttttacttgtaagcgtagacgtgttgcacagttatcaataactgttaagttttcttttccgcctaaagctgctacgtaagtttcaccaattgaacctgcaactggtgcatcaccatcttcaactaactcatcgtcatcttcacgaccaggagtttttaaatcgaacttcttaattaagaagtagaatactatgaaataaattgctgcgtaaattaaaccaatacctgctagtaagactggttttgttgcaataccgaagtttaaagcgtaatcgattgcaccggcactaaatgagaaaccatcatgaatgccaagcgatgttgtaatgaataaagaaagacctgttaatacagcatgaataccatataatactggtgataagaacatgaatgagaattcaataggctctgtaataccagttaagaatgaagttaatgctagaccagctaacataccagtaactgctttacgcttttctggtttagcagctgcaatcattgcgaaacatgctgctggtaaaccgaacatcataactgggaagaaaccagtcataaacatacctgctgttttgtcacctgcaaggaaacgagcaatatcaccattaacaacattacctgctgcatttgtaaagtccccaaatacaaaccagaagtatgtgttcattacgtggtgtaaaccaattgggattaataaacggtttaataaaccaaatagtcctgaaccaattgcacctaaattaacaattccatgagctaatgcatcaataccattttgaattgttggccaaatttgtgcaaatagaattcctaatatcagcatcacaactgatgtaacaattggaacgaaacgttttccagcaaagaaacctaaccattctggaagtttaatcttatggaatttattataaagaagtcctgctataacaccaacaataataccacctaagactttcatatctactttagtcgataattcagcagccttagatacttgtgtcattgtatccgcaagcttagatggatctacatttgcgctattacctattaaatcttggactttacctaatttaccttgtaattcagcagttgaataccctttgctaagtgcatcaatactatttttcataacaagataaccaattgcacctgcaagacctgctgcaccactaccatccactgaaagaccgattgcaataccaattgcaaaaataagtgctaagttatcaaaaactgctgcgccggcctgtgccataacaggaatatcaaatacatctggttgccctaaacgaagcaataatcctgctgctggtagtactgcaatcggaagcattaaagctttaccaatacgttgtaaaaactgcaacattttaattccccctaatcaaatttatgaaatcgttatcattataagtacgctttagaaaacgctttctattacataaccataataacatatagttgtatagatgtgtagtttttatttctgaactttttatggataaatctcctatttccaaactgttatataaaaggaaaattctcctttttaaaatacagaatactcgaaacgaaagacctattatagcacattgaactttcgttttatcattccactttttcatgttattatttatttccgagcatatcgggaaaagtaaacttagttaattcaaaataggagcgttggtactatgcagtgcattgaaacaaacaacttacaacagttgttagaacaagtaaaaccatatacgaaaaaaggaaaacttgctacttatatccccgaactaggaaatgcaaatccagacgatttagggattgccattttccataaagaaacagaatatatccatgcaggtaactcacaaacactatttactcttcaaagtatttccaaagtaattacacttgcccttgcccttttagaccgtggtgaagaatatgtattttctaaagttggaatggaaccaacgggtgacccatttaattctattattaagttagaaacgacaagtccgtccaaaccccttaatccaatgataaatgcaggagctttagctattacaagcatgttagcaggaaaagataacgaggaaaaaatggaacgtattcttcattttgtacgtgaaataacagataatcctactattaattattcctctaaagttgccgattcagaactagagacagcttacctaaaccgttcactttgttattatatgaaacaaaacggaattatcgattgtgatattgaagaacttatggatttatatactcgtcaatgcgcagttgaagtaaactgcatcgatttagcacgtatcggcttaatttttgcaatggatggatatgatccatataagaaaaaacaaatcatccctaaacatattacaaaaatttgcaaaacatttatggtcacatgtggtatgtataacgaatctggtgaatttgcaattcgtgttggtattcctgcaaaaagtggtgtagccggtggtatttttggctgcgtaaaaggagacatgggaatcggtattttcggaccagctttagatgcaaacggaaatagtattgccggttttaaaattcttgaacttctttctgctcaagaaggttggagcattttttaatcgcgagttatcctgctatactagcaggattttttatttcgccaaaacctcacttttgtcagttatcaatcctcttacaaaaacagtgctgaaagtttctctatatcatgcatatttgttcccccctcctgaataatatagtacaacctagcgctatatgtggaggtgtgaaagatgaaactaatatttcaaatgggaaaacaacctgttcttgaaaaaacaatccttctttttatattgagtattgtagaaagcttgaagttaaaagttgtttcactcgacgaagctcaccgatacatattcaatttagaagtacttgaattattaatggatcggaacatcgatgatcaagtacttgaacttattcatttcgggatgggacttgaagacatttatcatgtgcttcctgaagaacttgagcatacgattgaagaattaaagtggctttgcattcaagtattaagtgagtacagtatgcatgaagaatccgaacaattaattgaagatatacggtaaaaaagcacctatgtaggtgcttttaatgtttttttaaactatttttatacgcctcaatatttactggtagctcttcctcttccaaagtatgttcatttacatctttatgaatgaacgcacctttaggtggttgatgatcatgcccttttttcttatgatcaaatgctttcccgcgtcccatacaaatccccctttcttaaaagaaatccgtattagtatggagaaaagtacgtcgatatatgcaatctcttgctgtatttccaaggaaatactcgaaccttgttttctactctccttacaacaactgatcgatcccaataagaattaataacactcctgcgataactgtcgcccatttccctaagtattctgctaaaaatcgttttcctacatacgcaaaaccactaatacaaataaaactaaacaccccagaaatagtcgctgtaagccaaagatttaaatttgttacccctgcatcaaatccacctgcaatattattaatagacaacgcaactcctaaaacaattgcttctgagaaactaattgttttagaaccatcaaaatctgctttttccggatcacgtaaaattcccataagtacattatcatctttagaacctgcagtatttttttggcccaagaaaggctgacataaaataaacacaccgattatccctaaaaagattgctccaatcagatttgctgtaaactctgaaataaataacgcaatccagtttccaaaaaatccagctagtaaagtaaataaaaatccaaagaatgcaatgataaaattgttaaaccacgaaatacgaattttacgaatgccatatgcaattccaacacctgcattatctaaattagaagcgatcccgattaaaaaaattgaaaataagcctaccgtactcataaatagtcacccctttttctcacttttcaatgcatattatgaaaatgttgagcaactgtgcctgtctgtttcatatacttgtaataaatgctcaatattttttcaacactaaaaaaggagtgcctacactatggctaatgaaaacccgaatgatcggcttggcaaattaataaaaaaacttttaaaagaacgcgccttatctatgcgccaactaggaatacttacaaatattgatcctgcaacagtctcaagaattattaatggcaaacaaccgccaaaacaaaaacatctacaaaaatttgcagaatgtcttcaagttccaccccaattgttatttgatgaaatgtaccctgattctcctcacataaataaagaaaaaacagatatgtacacatctcttgataccattcagcaaacgctgcaatcctctaacttattcgatttcgattacactacaactcgcgtaaaacaagaactcgaaaattacgaacgctatgcccagacaacagaaggtgaaaaacgtattcataacagtttcgcaagcaaattagagcaaattgatagtgcaggtccttttattgaacaattaacagatatgtatcaacaattttgcaatgaaaccatttcaaaagaagaacgtgcagttcttgggagcgcattactttatttcattttatcgacagatattattcccgactatctctttccaattggctatttagatgatgcgatcgccgttgaattagcaaaagagaaattacttgaaataaaacgaaagacatagcaaaataaagaactatttcagttgtttatattcaactctgaaatagttcaataaaaaatcgtacaagtatacatactcgtacgattttactatacaaatctattttttcgtgtggcaccattcatatataaatgctgttatcacttttgtaaattcaattaactgttcaacttcaactttctcatttacagaatgtgcttcttctaatgtacctggtccatatataatcgctggaatgtgaaactcactaaaccaaccgccatcagttaccgttgcagacatatctaaaattgcattttttgataaaatagactcgtgtactgagctaagtttttttacagctgcatgttccctatctacttctaatgaagggaaaatttcaccacgatctacaatcattgattctccgccccacttaaattgtggcggattttcacttaaccatggatcggcagctgctacctttccaatatactcttcaatttcttttattatttgttcatgtgtttcgttcggatagaagtgcactgttatccataactggcactcatccgcaataaacgccgcatgccttcccccctcaataacagctggattaattgttgttgttccagatggatagccttcatatgttttcatgactgcccagtggcgctctaattcttgtaaactttgcacaattttcatcattttttcaatcgcactcgctccgaataaacgtccccctgcatggatcatttgcctacgtgttgcatcatgaaacgtttgcgggcttttcacagtaatccatccagtaattacgccgccctgtccttgcatatgtaaatcactcgtatccactacgactgcaaaatcagcatcataacctcgcctgcagcattgaagcgtgccagcttctccaacttcttccccaattacggattgaaagattacatctccaggtaattcaatgccagcttcttgtaaaagctgaatagcaaatagtgccccagccaatccccctttcatatctgccgcaccacgtccaactaaccaaccatcttttataaatggctcaaacggattcatttcccacgcctcatctgctgtcacttcagctacatccatatgtccattaataataagacttttatgtgtgtcactttctatcccttttttcaccccaacaacgttcggatcattcggatatacatcccatttatcaacactaaaatttcgttttcttaaaaactctgcaacaaattcttgcgcctcatttgtgtttctcgccggcggtgctagtgtttcaaaacgaattaaggtttttgtaagctctagtaactcatcttttcgtaaatcaatctgttctaatagctgtgaaacttcttgattcatcgctaattcccctttgcatacatagtatgtttccagctttattttcacaaaaaaagagactgtttacaattttacagtctccaaattactcaatattataaactttctacttttgttgtattgatcttttcaatatgctctactttacgtaccttatttcttgtcgcacggtaaaacagtaaacaaacaatcataaatggaattccacaatataacgccattctttgctctgggataaaagccatagcaactataactgttatatttaatgctaatgccagaagtggtacgaatggatatagcggtgttttaaatttcaagtccttcacatctccgccctgcttaacatatgcccttctagctaataagttagataaagcaatagatgcccaaactaatatcgccccaaatccggcaatagaaagtagccataaataaactgtatcttccgcataaatacctgatagtaatgaaagacagcctacaatcgtgcttacaatcaatgcataaataggaacaccatttttagataacttaccaaaaatcggactaatcattccttgattagacatagaccatagcatacgagaagttgcatataatcctgaattcgcaacggatagtactgctgtaataataacgaagtttataatatcagctgcataaggaataccaattttatcaaatacaactacgaatggactttctatcactcctgcttgctgccatgggaataatcctgcaagaatgaaaatagataatacaaagaacacgagtatacgccaaactgtattattaattgcctttgggattgttttttctggattttcactctcacctgctgcaataccgactagttctgttccttggaaagaaaaattaacagcaatcatcgtaattaaaatagcggataatccatttggaaacaatccaccataatcagtaaaactagagaacattggtgctggttcatttcctttcatatctagaaaaccaaacattgctgccccgcccaaaataataaatgcaatgattgtaattactttaatacttgcaaaccaaaattcaacttctgcaaaacttcttgaagataatgcattgatagcaaagagaagcaccgcaaacgctacacaccaaatccatgacggtacatcaggaaaccatcgtttcattaaaatactaactgcaatcagttcaatacctatcgtagcagaccagtttaaccacgacatccatccgactacataacccgctgcaggggaaatgtgcttcgttgcatacgtttgataagatcctgcgtcgggcatcgcaacagctaactctccaagacagagcatcgttaaatacataacaaaccctccaacaagatacgctacaattgctcccccaggcccagcttcatgaattgtatatccagatcctaaaaaaagaccggtaccaataactcctccaagtgcaatcataaatatgtgcctgcttttcaattcacgttttaaaccttggttttgatccatcatataaatccccccttttccctttggaaacccatttcatgtaagcgtttttaaaatcattcataataaaaatgattattgaaaagagtgaaatacatagcacttattaatcactacctgttattaaaagatcatccctcactgttattaataactttttatcagcaatggcttgtccttctactacttctaatgattcgatatacccactgattcctaccttaatttctactttctgtttatctattgtttcaattaacgctaatttctcccactcgtatacgtatgaactttccgcaacaaatagcttctctacttttccataacaaggactatacacaccttctataactgtcttcactttataaattcctccctcttattaattgacaccaaaacgttgtatatcctgtaaaaattcatattctcccctctagagatttcgaatattatttatgcaaaatacgtaccaagtctctgattcatatattaaatgagagtttcacacaaaaaagtgtgcacaaccgcaaaatttttctatcatttgaaaagttttaagagaaaaatagcaaaaaaattttgcgattttataagaattttaataaaattataaaaagtcagtcttcatagggtgaaatgaggagaagataatctatgcgtacagaagaaattaatttaaaacagatcgttgaaatgaatatgctatatgaaactttactcaatgagctcgatatcgggattcatattattaatgaggaaagtaaaacgattatctacaaccgcaaaatgatggaaattgaatcaatggaacgctcagatgtattatataaaagtcctttagaagtatttgcatttgaagaaaataaaaatagtactcttatagaggcattaaaattaggaaaaacaaacaaaaatataaaacaaacgtattttaacaataaaggacaagaaattacaacgattaacgatactttccctataatagaaaatggaaaaattaaaggcgctattgaaatatcaaaagaaattagtcacttaaagcagacgataaaaatgggtccttctcgaaaacaaagcaccaaatttacctttgatcacataattggtgattctaaagccattcaatcaatcattacagaaggaaaaagagtaattcgtacatcttcctccatacttctagtaggagaaacaggcactggtaaagaactatttgcacaaagcatccataatgaaagtcagcgttcaacaaaaccctttatttcacaaaactgtgccgctatacctgataccttaatggaaagcctactatttggcacaaatcgaggtgcctttacaggagcaatagataaatcaggcttattcgaagaagcgaacggaggaactttgttattagatgagattaattcattaagtccagcacttcaagcgaagttactgcgagctatacaagaaaaaacaataagaagaatcggaggcacacaagaaaaagaaattgacgttcgtattatagcaactattaatgaagatcctcttgaagctattacacacaatcgattacgagaagacttatattatcgattaagcgtcgttactttatgtcttccgcctttacgtgaacgaaaagaagatattccggctcttgttcagcactttatcgaaaaatacaatattcaattcggacttagtgtaacagatgtagatgtgcatgtaagagagtttttatatgcatatgattggcctggaaacgtaagagaattggaacatatcattgaaggttcaatgaatttagttgaagatgaaaacatcattacagcgtttcatcttcccactcgctttcgcgaacgaataaaaaaagaattcaatatgcaacctttcttaactaataacgatactgatacgcctaaaacgttaaagcacacaatagaagaaatggaaaaaaactacatcaatcaaattctaaaagagtatcacgggaatatctcacaagctgcaaaatttttaggattaagtagacaaaacttacaatatcgaattaaaaaactgcatttacacatatgaaatgaaacttggatgagtggattgctagccctaatcaattcgacttttattgcttgttaatgcagcataaatctgctttaacatacaaataaacacttggtaaaatatgctacaataaacatataacatactagaaaggagcgatatatatgagtaatgataacaaattaaagttattacaatacttagccttcttccctaccattgtatgtatgatgttactaattgatataaacgcctatccttatgcaaagctattagcaacaattagtggctcctttgcagctattatgcttgctgctttttggaatttgaagctacgtataaaaaacgagaaatcttcgtaatacaaaaaaaatcgagctacttagcccgatttttttatttgccattaaaactcaacattctctaaatacaacccacttgcctcagcaagacaattaatttgattgcgctgcttttcctctaaaatgtttggaattgcttcagcgtctaattgtcctaatccaacttcaattaatgccccgacaatttttcttaccatattatgaaggaagccgttaccacttactctaatttgtacaaaccctgcctcttccatcacatcaagtgtatatacttctcgaaccatagattttttctttgatttcgcatttgaaaaagcagtaaagtcatgtgaaccaactaaatgtttcgcagctgctttcatgcttttcacatttaattttttattcacatgcatgctgtatttacgcataaatagatttgtatgctcttcattccaaattttatacagatatgtttttgctttagaattgtaacgagcatggaaacgatcatgtacttcttccacattcgtaatgctaatatcattaggtaaatattgatttaaatattttttcactttatgttccactaacttctcatcactttgaaagttagcaacttgattcaaagcatgtacaccagcgtctgttctactacaaccaataatttcaatttcttttccgaccatttcagatatgacactttcgatttttccttgaattgtattatcgttattaccgagacgttgccatcctttaaaacgtgcgccatcgtactgaattgttaatttataattatgcataatattctccttcatagaaaatattccctcataccatgagggaatattaataaactttactttctaacaagcttcactacattttctacgtgagctgtatgcgggaacatatcaactggttgcacatactccacttcatagctcttcattaatgcttgtacatcacgcgctaatgaagaaggattacaagacacatacacaacttgtttcggcttcacctttaaaattgtttccagtaatttatcatcgcaacctgtacgtggtggatcgacaacaattacatctggacgccatccttcttttacccatttcggtaaccattgttcagctttacctgcttcatatttcgtatttgtaaatccgtgacgcttcgcattttttcttgcatctgcaatcgcttctggaattacatccataccacgtacttccgctgcatcatttgcaagccaaagaccgattgtaccaacgccacaatacgcatctacaattttctcatcgcctgttaacgcagcggctttttttgcttcattatataaaacaacggtttgctctggattcaactggaagaacgcacgtgctgataattcaaatgataaatcaccaagtgtttcttgaattacttcttttccagctaatttaaatgttttgtcgccaaaaataacagatgttttacgccagtttacattttgcataattgatttaaccgctggcatctgtttttgtacttctgcaataaattgttctttatttggtaattcttcttttgttgtaataagtgtaacttgtacttcacctgtttgaactgcagtacgtgttacaattgtgcgtactaaacctttttgttttttctcattgtaaatagaaacatttaatttttctaaaatacgtcttacaacttttgtcgcttcattcgttgctttatgttgaatcatacagtgagcgatatcaattaactgatgtgagttttgtttatatagccctgtaataaccttttcgtctttacgccccacttgtaattgactcttattacgataatgccatggattttccatgccaagcgttggacgaattttctcttccatactatttttcatgtacttctcaaatgcttgtacaacgatatcacgcttttgattcaattgttctttataatctaaatgttgcagctgacaaccgccacactcctcatatactggacacggtgctttcacacgatgcggtgaagctttacgaacttttttcactttcgcttcagcgaagccacgctgaattttcgttgtttctgcaacaacttcttctcctggtaatgcccctggaatgaaaacaacttgtctcttaaaataaccaacgccttctccgttaatcccaagacgtttaattgtcacaggaaacgtttgaccaacttccaacttactctcatgttgcttttgtatcattattacacctctactctatacttttccataaatataacgctgcataactgcagtatggttcacactcttgtttcaatttttctaaaaatgcatcatcaggtttatcatctaattgaaatataccttgcactgcacgctgaatcccaatgtccgctttcgggaacatatttttccgtccaagcccaaacattaaaaagttttgcactgtccatgcaccaattcccctaattggcaacaattgtgctgaaatgtcttcttccgtcccattttctatactcgctaaatttaatgtaccactgacaatacttcgacctaatcctactatatattcagcctttcgctgactaaacttctgctctctcaattcttctattgaaatatttgctactatttccggagtggggaaaaagaatacaccgttcttctctgttccataccgtttcacaaattgttctgttaacacagtagcaaatttcaaatttatttgttggtgaatgatacagcgaagcagacaagcaaaataatcaaattctaaaataattggagtataagcatatgtttcaaatagtggacgtaatgatgtgtttaaaaaatgattttgtatatcttgaaacggttcattccaatgaaaaatggctctcattcgtttcatgactttctctggatctcctgtctgactagaaatccaaaactgtggattttgaacagtaccaatcccttgtaagcgaacaacaacctgttcctcgtcgatacaaagcgggatataaataactttctcatctaattgaatgacgttaagaggatcaaaagataaacgttttaatacttcttcaaaatgatacggatactctaacgtaacatgctcgctccacatacgtttccccatcctttttacacatcattatagcatgagaaaaccgtaagcatacatgcttacggttgattgccttttactaagtcatctagacttttaaaatgataccctttctcgcgcaaatcatcaatgatttttgcaagtgcttctgcattatcttttgatattgcatgaagtaataaaatagatcctggatgaatcatcgtcataacattattatgcgcatattgccatcctctttgctgatccactttccaatccaaaaatgcaagtgaccaaaatacattataatagcccatttctttcgtaagagctaacgttctttcactaaatacaccgcgcggaggacgtacatatttcacttctttttgcccagttacttttttaatttcttccgttacactcgttaattcttcacgaagtttctcatcatttaccgctgtaaaatcaggatgactccaagaatggtttccaataatgtgtccttcatccttcattcttaacaataaatctttttgtgttttaatgtaatgccccgttacaaagaaagttgctggtacttttttctcttttaatacatctaatattttccctgtgtatccattctcatatccattatcaaatgttaaataaatatcttttttcttcgtatctcctaaataaaacccgccatttttttgtagtaaatctgtatataactttcctgcatctggtactgtttcatttttaggacgcgggattccccagttatgtggagtatttgtataagccagtgctgaaactggaacaagtgccatcataattgaaaaaatgagaccgatatataaccatttatatttcataaatagtctcctttccatatataatcgtacttgtagtttctgttgcaacgcattctttcatgctgaacatgtttttctatatataccaaaaaaatgcatctcgaatcattcgagatgcattttttatttacttaaatactggctctttaaagctagctaatttttcaagtgatgttttatcaacatctgcatgtaagctattaccatgagagtccatcgttacaactgctttaaaaccgtcgatacgtaaatgccacattgcttctggaataccaaattgtaagaaatcaacatctttcacttctttaatacattcagcataatattgcgctgcaccaccgattgcgtttaaatatacaccgccatgttcttctaaagccgctaatgttttcgcacccataccgccttttccaatgacagcgcgaataccgaatttcttcataatatcgccttggtacggttcttcacgaatacttgtcgttggacctgccgctttaatttgccaattgtcattgtcatctttcacaacaactggaccacagtggtaaataatttgtccatttaaatctactggacaatcattatccattaaatgcttatggattgcgtcacgacctgtatacatcatgccattaattgttacaacatcaccaacgcgaagttcacgaatttgctcttctgtaattggtgcttctaatacaatctcacgttgctctgttttttcttgtacttcatgctgaagtgtatcttccccttcttgatatagccaatccataatgtctcctgtttcaggatggattttcacaccaaggcgacgatatgcccagcaattatacgcaacagatacatagaaactagctggcaaacgattatagacgccaattttacaaccaagtaaagttgtttctccgccaaatcccatcgtaccaatgccaagcttgttcgcattttctaatacgtactcttcaagatgttgtaactctggtactggattgacatcatctaatgtacggaataattgattttttgctaattcataacctgatgtgcggtctcccccgataccaacaccaattacaccagcgctacatccttgcccttgtgcttgatatactgcatgaagaaggcatttacgaatcccttctaaatcacggccagctcgtccaagtccttctagttcacacggtaagctatattgaatatttttattctcacagccaccaccttttaggattaaacgtgcatcaatataatctttttcccattgttcaaacttaatcaccggcgtacctggtcctaaattatttccactattatctccaaaaagagaatcaacagaattgggacgaagtttaccatcttttgtcgcccgctcaagcgcattatagatagcttccttcaactttaattgattcacaccaactggtgtataaattttaaacgttggcatccctgtatcttggcaaatcggcgagatgttatcatcagccattttaatattatttgtaattgtgccaagtgccatcgcagaacgagtccctgcattttctcgctctttcgcttgttgaatcgcacgacgaacatctttcggtaagttcgttgacgtttcaacaattagttgatacatgctttcttgaagcttttccattgttacttccccctcaattgtgaacgctaccaaaacgttatgagctgaaaattcaattgttatgctctttagctatttatttcacgctattagagcataaatgaaatttttcacaacttgattatacctctttttctatcgtccttctattacccgaacagaaaaaggctaccaaattggaattggtagcctttttaatatattattcgtcttttttaaattgctcacattttaattctaattcatctaacattgcaagaagacgatctacatcttctaattctacttcttcgggttcaattgtatcaattacttcaatgaacatatttaaacgttcttttaaatatactaattgtgtatctttatcttgaattgcttttcccatgaaggcactctccttttaattcgagttgcttttattataccgcaaaaacgattgctatgggcatgaaatttcatcaattttgtcacagtcatccactataatgtaagccctctctcttttcatgctaaaaagtttcactttataaaaagcacatattcttctattatagagaatggacaaattgttatttcaatagtcaaaggagtatttcatatgatgatatcacaaaaaatgaagccgattactccttcttacgatccatgggaagcgtatatggaccttgaagagtacggcaaactactattaacaaatgttgagtttacaacgacgacgttatgcaatatgcgctgtgagcattgcgctgttggttacacgttacagccgaaagacccgaatccgcttccgatggatcttttattaaaacgattagatgagattcctcatttacgttctttaagtattactggcggcgaacctatgctttcaaaaaaatccgtcgacaactatgtaacaccactcttaaaatatgcccatgaacgaggcgttcgcactcaaatcaactctaacttaactatagatttagcacgttacgaacagattattccttatttagacgtattgcatatctctcataactggggaacaattgatgacttcgttgaaggcggatttgcaatgatggagcgtaaacctacttacgaacaacgtgcaaaattattcgaaagaatgattacaaatagtaaggctctatcagatgcaggtgtacttgtatctgccgaaacaatgctaaacaaaagaactctaccacatattgaacatattcaccgccaaatcgtcgaagagatgggctgtaaacgtcatgaagttcatccaatgtatccaagtgacttcgcgagtaatctagagattttaacaaaagctgaaattcgtgatgcgattgagcatttactagaaattcgcgatgaaaatgtatggatgttatttggaactttacctttctatgcttgtagcgatgacgagcgagacattgccacatttaaaaagttacaagagagcaaaaatgtaactgttcgtaacgatccagatggtcgttcacgcttaaatgtaaatatttttgatggcaatattatcgttactgattttggtgatgttccacttctaggaaacatacaaacaaacacattacaagaagcgtatgaaaaatggagcgcttcaaaaacagcaaaatcattaagctgtcactgtcctgcagtaaaatgtcttggaccaaatgttcttgtaaaaaacagctactatccgacagaagatttcttatcaaaaacagcaaatattacattataaaaaaacgtcagcttataagctgacgttttttcatgttattgcgagtgggaagaagaaatgaatttaaaatacaaataatcatgaattgggatagcagcaccgattccttgagaagtaatattttttacaacaagccttttttgatttccttttaatacaaggtatacttctccaaatgttacttttcctttttcatttactgctggtgtataagcatataaatatccaagttgactcggactaatattatacacacgctcatgccctgtaccataaccaatagtcgttttaaatgaaagcggcaattgtactttttcaagtgctttgagaagcatcatttttttcacatctgcagcatctttcatatctgctgttaaatcgccttcaaccgtcttttgtgtttcttgcttatagcgaagtggatataaacggtctcctccgcgattatcatacacatttcgattcacttgtttatattcccaattaatcgatgtgtctactgattcataatgtaaagcccattgacctaaataaatttttgcccgataccctactgcaagcggcgcatttgaaattgtcgtttcattaaacatccgaattaagtctggattttcaattttaatattagccgttttcaatagctcttgagcaaatttacttggttgtaaacgtggcaaatcttgcgcatcatttggaaatgtattgtcttttgaaatatttaaaacagatgaaggcatttttgttcctactgttgtctttgcaaaactcatgttaggaaataataaaataaacgagaccatagttgaaagacatatgctgtatactcgtttcacctgtctggctccttcctatgtaggtatatatactacttcgtttattgttttctctgagcgcaattgttatgcctatttttcataataaataaaaaccaattcccataatgacatacgccgctagtaaagtgccaccttcaaaccagtttgtatctccatcatttgaaatcgcaatcgttaagaaaacggctgtaatcatagacacaagttctggtatagtaaatactaaaggcatcctttgcgcgaagaacatagatagcaatactaatacaggagcaacaaacatggcgatttgtaatgtagagcctattgcaatttcgactgcaatatttactttatttttataagccataataattgcagacgcatgttccgctgcattcccaacaatcgcaacgataataacccctataaataactctgaccaaccaaatgactttgcaacagtttcaaaagtatgtacgagtgcctctgacacataagctactgccagtgttgctatcgctaaaataaggagcgccttcccttttgaccactcttgctcttcttcatgcgctacttcgtcacttttatgttgatatacaccacggtgcgtaactaacttaaatagtaatgcagcaaggtacatgataatcataataatagaaacacctatacttaattgatacgtcttgccagcgtccatcttcattgaaaagatctctggaataacaaaggccacaacaacagcaaatattaataaagctgaattatgccttgcatcatatacattaaaactttgtcttttgtatttaagacctccaacaaagaaagataaccctcctaccaataataaatttccaagtacagaaccggttaaagaagctaacaccacttcaattaaccctgcttgaagtgcaaaaattgaaatgataagttcaacagcattaccgaaagtagcatttaataatccgcctattctaggaccagaaacaattgctaaactctctgttgctctccccataaaaccagctaatgcgataatcgtaatacaatacacagcgaacataattgtttctggccaatgaagtgttttgccaagtacagatagtggtacacctataagtgctactataagaaatattttattaaacatgcttttcatccttccatcgtatgtatttctcctcaatattattattattcttctcctaacttgtccgatttcatcacgattacgtttaaaaaatcgacttaaagaaaacagtatgaaagatatttaaattatcttgtttaaacagagaaaatataaattaggaaaagaggtaaagaatatgcacttaaaagagaaaattgcaactattattcaaggacaacgtactggtgtattatctacagtacgtaacgagaaacctcatagcgcctttatgatgtttttccatgaagattttgtactatatgttgcaacagatcgaaaatcaaaaaagataacagatatcgaaaaaaatccaaatgtacatgtactacttggacgtgaaggaaaaaaattagatgaagattatattgaagttgaagggttagcttcaatcgaggaagactcaacattaaaaaacaagttttggaataatagcttaaaacgttggttactcggtcctgaagaccctaattacgtattgataaaaatcaatcccgacacaatttattacattgatggtgccggtacgacggagcctgagtttttacgactataaaataaaacaagcccctccttaggtgggcttgttttgtcgaaaagttctttttgaaaaaacaataaaataggtggaactttctaaagattctgttatataatagcagtaacttaaataaactgtattaaaacagattgagaggagaaataaaattgatgaagagagaagaacgcaaaaacatgattgagtttattgaaaagaaaaaagggattgagcgtgacgaattactgtttatgacagacgatgaagtagaacatatttataatgtaacgtactttttatatgaggaaattgcagagtagtataataatccccaccttattaaaaatataaggtggggattatttcgttatttagcccactatttgcaggcagtaaaactcccaccttaaaattcaggtggagcaagaagttaagttgaagtcgcacttcctataaagctcaattgcttcaactttatacatgagaatcattttcatgtataatactgtaagattggaggaattttactatgagttcgtggctcttatttgcactattatcagcaattgctgctgcccttgtatctatttttggaaagtttggtttagacggaatcgatgcaaacgttgcaacaacaattcgatctattattatggcattatttatgataggcgttattatcatacaaggtaaatttcaaaatatcggcgacgtactgctaaataaaaaagcactgctatttatcacattaagtggggttgcaggtgcttcgtcatggctattttattttcttgccctcaaaacaggaaaggtttcacaagtagctcctgtcgataaattaagcgtcgtattttctatcattctcgctatgattatcctcggtgaaaagttaaactttatgaccggtgttggtgtagtctttattacagctggtgtattatttattgctttcagctaaaaaaaaccgctattagcggtttttctttttctttatgtacaaccatacaacacatgtaacaactgctgaaattaataaaatccatattccataatgatgtaaactatactcaacgaagcgccacttctcgcctaacttccagccaagcccaataaaaacacttatccaaataagcgcaccaccataagcgtacaaacaaaaacgccaaaatgtcaaatttgatactccagcaaaatatgccgttaaatgacgtactcccggtataaaataaccaatcattaaaagaaatggcccatatttttcaaataaaatatgtgttttttcaatgtgatgttctttaattctaattttcggcccatatttctttaaaacagggagcccaagttttaaacctaatatgtagcttaacgtgatccctaacatcgcaccagccatcccacttaaaaaagcagcagttcctgacataactccttttgaaacattataaccaacaaaggtcaataaaaactcgtctggtatcggtaatccgacaatcccaccagccaaagctataacaattccaaaatagccataatgcgcgattaactcgccaatatgttgttccattcggaagacacatcctatgcacgatcgttattccacattgtaccctttctatctttaaggcaaacatggtatacatattcactatacattgtttttataatgaactctacttctattctttcctttaacagagataaagtgaaactttaatcagtgggagttttgtttatcctctactaattattaacctatgccaatcttgcttctatagacatcccgactcccacataacttacttacattcaacaattttgagattagattcttactgcccgcaaataacccgataaaaaataaaaattcatatgcgtgtttttttgttacaataaaggaaagttacttttcgcaacggtttaactctcaagaaaaatgatatatctagcaaaaacatagtttggtctatataatgcaacttctacctattaaaagaacatacacccttttacatacgacatcatttttctaaattatacaggggggaacgaacatgaccattgaaaatcaatttattcaaaaagtttactataaaacatttttaacagaagaaacttctactcctgcatcggaagtactcggtgaagcatatataaatgaatctaaaaatgaattctccaacatttctaatattcgatttgctcaaggtgaattttattatcaaaataaagattttgaagcagctatatttaaatgggaaaaagtaaataatgctcttgcactttgggcgacaaaaaatattgcagatgcttattttgaactaggattcttaccaaaggcagaagaaatttatcaatctattcaaacggaagatacaactcttacgatggaggtttccttacaacttctttctctttatatcgaacaagatcgtttaggactcgcttttaagacgattagtgaagctgttgcattccaaccggattatccaaatattactgcaattgcacgttctttctatgaaaaacaagaagattggaacaacgctatcgaactagctgttcaagaaggtattcgaacacaatctttacactggtttgatacgtt

SEQ ID NO: 1391 - DNA, 35829 bp, Bacillus thuringiensis
cactaaaggaatatttaaaggtttttaaaaaaggaaaaagaaggtttcaactgaagtaaaaggttagaaaaatactgtttctaattataaagtttctgagaatacgaaagtgagcgttccagcaaacaagcagtatgaaatttccgggaccaatatggatggggttattgttacggttcaggaatagaaaaaaaagtctgtgccatttgggacagccttttcttatataagaaaggaattgaagtttttttgtcggtaaatcgatattccttgtcgaatcgttgatatattgtaagttatgatagatataattgaaaaatcgttgatataatttcctatactattaccattttggaggagcatctttttattcactttcaaacattataacgttatatttacttctccctttttttgtgttacgctaaacgtgtgaaagacatataaaatgaaactttaatgtaagcgtattcttatggcttcttatagaaaagggtggaagtacaatgacagaacgattcgtactacgtaatgtaaaacgtgtgaacggggaagagattgacattgtaattgaaaataataaaatcgcacaggtgacgaaagctggtgctggcgagggtggaaaggttcttgattactctggtacttacgtatcgagtggttggattgatttacatgttcatgcttttccggagtttgatccgtatggcgatgaggtggatgaaattggcgttaagcaaggggtaacgacaattgttgatgcgggtagctgcggtgctgatcgtattgcagatttagtaaaaagtagagagcaggtaaaaacgaatttatttgcctttttaaatatttctcgtatcggtttgaaacgaatcgatgaattatccaatatggaatggatagataaagagaaagtaatagaagcagtagaaaagtataaagatgtaatcgttgggttaaaggcgagaatgagtaaaagtgtcgtttgtgatagcggaattgaaccgcttcatgttgcacgctctttatctcgtgaaacatcattaccaattatggtacatatcggttcagcgcctcctcgcattgaggaagttgtacctcttttagaaaaagatgatgtcattacacattacttaaacgggaaagaaaataatttattcgatgaagaaggcaaaccgctacctgtattactagatgcagtgaatcgtggtgttcatttagatgttggtcacggtaatgctagtttttcttttaaagtagcagaggcggcgaagcatcacggtattgcttttaatacaattagtacagatatttaccggaagaatcgtatacacggtcccgtgtatagtatggctcacgttctttcgaaattcctttacttaggttatccgctagaagaagtaattgacgcggttacgaaaaatgcagcagagtggctgaaaaaaccagagcttggccgcattcaagaaggagatattgcaaacttaactttatttacagtgaaagatgagaaggttacgttaattgattcagaaggggatcagcacattgctgaaagaaggattgatacgaaaggggttgtaatcaatgggtcattcattgaatgctaagtacggattaaaaagagtaattaatgcgagcggtagaatgagtattttaggtgtatccgctcctacagatacagttatggatgcgatgaaacatggtggacaaaattatgtggaaattgctgatttagtagataaagcgggagaccatattgcgagaattctagattcagaggcagcggtcgttgtgaactcagcatcgagtggcattgcgctttctatcgctggtatcgtgacggaaggaaatcgccgtaaaagtgaaagacttcatcaagaagtaatcgcgaaaaacgaagtaattatgttaaaaggtcataacgttcaatacggtgctccagttgaaacgatgatttatttaggcggcggtaagcttgttgaagtgggttacgcaaatgaagggaaagcagagcatattgaagatgcaattggtgaaaatacagcagcgattctgtatgtgaaatcacatcatgcagtgcaaaaaaatatgatttctgttgaagaagcatgggaagtagcgcagcgaaataacgtaccacttatcgttgatgcggcagctgaagaagacattcaaaaatatgtgaagtattcagaccttgccatttatagtggttcaaaggcaattgaaggacctacttctggtattgttggcggtaaacgaaaatatatcgaatggctgaaagtgcaattacattgcatcggaagaagtatgaaagttgggaaagaaacaactttcgccttacttcaagcgcttgatgagtacggcgtaaaagaagataaaagtgagcaagaaaaagaattgctacaagtacttatgccgctaaaagaattaaaaggtgtaaatgtaacgatcgttcaagatgaagctggaagagcaatctttagagcacgtattcatattagcgaaaaagagttaaataaatcggcaaaagacgttgtgacagcattacgcgaaggggaaatcgcaatctatacacgtgattacggagtaagacaaggattctttgatattgatccacgtccacttcaaggtgatgacatacatgtaattgaagaaaaattgagagaaattgtagggggaaactaaaatgacaaatattcaaaaacgtttttataaaggccgcgtagcattaaatgtattagcgaacaatacccgaaatgcgaaagatatttttgaagcagcagaagggtatgtagtagtgggggtattatcaaaagactacccaacagtagaagaagccgttacagcaatgaaagcatacggaaaagaaattgatgacgctgtatcaatcggactaggagcaggagataatcgccaagcggcagttgtagctgaaattgcgaagcattatcctggcagccatattaaccaagtgttcccttcagttggagcgacacgtgcaaatcttggcgaaaaagatagctggattaatagtttagtatccccaacaggaaaagtgggttacgtaaatatttctactggtccaattagcgcagctggagaagaaaaagcaatcgttccaattaaaacagcaattgcacttgtacgtgatatgggcggaaattcattgaaatacttcccaatgaaaggtttagctcatgaggaagaatatcgcgcagttgcgaaggcttgtgcagaagaaggatttgcattagagccaacaggcggaattgataaagaaaacttcgaaacaattgtacgtattgcgcttgaagcaaacgtagagcaagttatcccgcacgtgtactcttctattattgataaagaaactggtaacacgaaagtagaagatgttcgtgaattattagcagtcgtgaagaagctagttgatcaatatgcgtaagaaaattgcagcgtttggcgaagtaatgatgcgcatgcaagtacctggatatgaattgttgtcgcaagctaacacgttaaattactcattttcaggtacaggtgtgaacgttgcagcggcactttctcacttagggcatgaagggcttcttatttcaactttaccggaaaattcggttggagaggcagctgtatcttacattcaaaagttagggattcaaacttctcttgtttcaagaggcggtaaatatgtaggtatgtattttttagaaaatggattcggtgcacgtgcaagccgcgttacgtattcgaatcgactagaaagtagcttcaatacggcgtctgaagagatgtaccaatttgaagaaattgctaaggaaattgatatcgttcatttttgcggtattacacttgcgatgaatgatacggtgcgccatcatatgaagtctttagcgagagcagttaaagaaaacggaggaaccgtcgtttttgattgtaattatcgtccatcactttggggagaagacggatatgaacaggcaaaaccgcattatgaagaaatgctgggacttgctgatatcgttatgatgaacgaaaaagatgcaatgttcgttcttggaatgaaaacagaagagacagagcgagaggcgcaacttgttgatcttattccaaaggttgctgaaacatatcatatcgctacaatcgctggtacacatcgctctattaatagtgataatacacactcgctacgcgggtttatatgtaaagatggtgcgttcacttttgcaaaaacacttgcgttttctgtatatgatagaataggtgctggagatgcttatacgagcgggattattcatggcgagatagaagagtttgcaccagagaaagctgtttcatttgcgtcagcagctggaatgcttgcacatacaatcgtcggtgatacgcccatgtcatcagagaaggatatacttcgggcaatgacggcatcagtaggtgatgtagaaaggtagtgggtgtaacggtgaacgtaacgaggaaaaaaggaccattatatttacaaataaaaaatattattcgtgatcgaatattgcatggtgtatatgcgattcatacgaatattccttctgaaccgcagttagaagaagagttcaaagtgagcaaaattacagtgcgtaatgcaattaaagaactcgctcaagaaggatatttagaaaagaaaagcggtaaaggaacgaaagttatccgtaatacttctgcgacaaagttgtcaaaaggtaagaaatttacagaagtgttagtggaagaaggatataaagtacaaaagaaattgctaaaagcagaaatcgttcataatgaagaaggaacggtgccatttcgattattcggcaaggagagttttcgtattgaacgtttatatacgttaaatgatgcaccttacattcattatacgcactatttctcagcaggaatggcaagtacagatttatcggactttgacttgcaatcgctttatgatttagttgaagaccgaggcattcacttagaaaacttcagagatgaattcgctgttggactcgcgcctagtttcgttgcagaagcgctaggtgaaaaagaggggacagcgttattaaaacgtatgcgctattcttatgatgaagttggcgaagtaattgaatatagcgaaggctactacaatacagaaatgcagtattatgtagtgaattatgacgtataaaaaagaggggatgttggtcatctccctgtcaagtagacagaaataaaaagagtattatgccacggccttttcccgatattctatcggggaaaggccgtgaagtttttcttggaatctttctgtattataaaattgaatatattcttgaattgctcggtaggccatttcatatgtttttgggcacactaaatacaacttctctgtttttaaatgtgagaagaatgattcgatacacgcattatcaaaacagtttccacgtctagaatgactaccgacaaatcctaatttctctaactgttttgcgtaggatttagatgtatattgaaacccttgatctgaatggaaaaggggcttagtagttaatgacttcccttctaattgacgtaatgtagttaaaaccaaatctaaatcatttcttgaagatagcttccaggcaacaatttcattgttgtataaatctaacacagccgacaaataggcaaattgttctccgattcgtacataagtaatatctgttacgaatttttgattttgcttttcagcttgaaactctcgattcaaatgatttttaaataccacagatgtttttcttccataaaacggacgtttttttcgaatgatagattgaatacccagctctctcataagacgacgaacacgtttatgattcattaccattccttctcgagccaaagcacgagtcatacgtttatacccatagtaagggtgctgacgatgaatagataaaatatgttctttatgccacatatcccttttctgacgtaaacgctgcacgttatgatatttccgccatttatagtagccagccttagaaacttccgcgatttgaagcaaccatcggagtggataggcttggcgtaatgaatcgataagagaaaatcgttctttctttaggaccattccttcccgtgtagatttggattgcgcttttttaaatactcaacctgtgccttcaaataagcattttcttcttctagactattaaaattctttcgattccagacaccacgttgatcatcaaaggactccccttgttgcgcacgttttacccactcaataatctgggcatcgctcttcacaccgagttgttcacgaatttctcgcaatgattttctctcttctaatcgaagacgaactgcttctcgctttagttcttctgtatatttttgaaatgattgtccttttcttgccataaaaaaatcccctccagataaaacagtattgagtccatcatatcagatggactctttttttactgtctacctataggggataataccatgttccctctttttttataaagtaaaactttaattagtggaggagggcatcatccactaattattagctcacaccaatcgggataaaagtaaggggaatgagagatggatatatacttattaatcgtcacgttacttgcgatcacaattgttattttaggggtatcatggtggaaatggcatgcatttattagtttaacagttgcgagtttatttttagctattatgtctggactgaatgtaacgaaaatagtggctgcctatgaaactggtgttggtagtgtactagggcatttagttggtattttagcacttggaacaattttaggaaaaatgatgtccgattcaggggcaggcatgcaagttgcagatttctttattcgatttttcggtgtaaaaaaattaccttgggctatgttatttgcagggtttgttatagggattcccgtattttttgaagtggggattgtcattttattaccactcgttatttcaattcgaaaaacgacgaagcaaaatatattattaattgcgttacctgtcattgcaggattatctattgttcacgggctcgtaccaccacatccaggggcgatgacagcaatcggtatttataacgcgaacttaggaaaggtacttttatattcattaattatcgcgttaccaacagccattatcgcaggcccaatatttgcaaagtgggtacataagagggttatacctgaaaatgaaccggagcttgttcgagttacgacagtatcaactgatttgccaagtcgtaaagtttcattctttattattttattaccagttgtattgatgattttatcagtagttgcaccatatatttcattaccgaaaaaattgactgaattttttgtgtttatagggagtccagtaatcgccttacttatttcatgtttcgcagcattttatttacttggtatcaaacaaggtattaataaaaagatgattaaaaaattaacagatgaaagtttattgcctgtcggttctattattttaataattggtgcaggcggtggatttaaacaaatattaattgaaagcggcgttggaacagctattgcacaaatggcagaacatatttcgttatcaccaattgtattagctttcatggtagctggtttaattcgaattgcaacaggttcagctacagtagcattaacgacagcagcagggattgtttcaccagttattcagcacatgtctggtgtgaatttagagttgctagttattgcaaccggtgcaggatcattaatgttttctcacgtaaatgatgcagggttctggcttgtaaaagagtatttaggtttgacggtgaaggaaacatttaaaacgtggacggtactcgagacattgttatcatttattgcatttggttttgctcttttgttgaatatgtttctttagggagaaaagcccattttaattaataaaacccacaggagaaattcaatttctctgtgggttttgctattttttaatcgtagttacttacaaatatacagggcaaggtgctttttatatcttttttctattgtcctattatttaatagaacggacatactgattttctccatcgtctttgacaaagactcctagctcattcaaatctttgcgtaaatgcttcttttttttcgagtttccttctcgaagggcatttcgtctttcatacaaaatagtatttatgcttttattaaatcgcgcatcctctaatttccataagctatactcatgtttataaggatcttgttccacccaggggaagtcgtgcattaagaaagtatctttaattttgcttggggtaatgtcagatgtttcacgtaaccattctcggtcttcttgatcaatgataaccacttgacgcttatctacaaaaacggcttttacatttgatctggtgatttgtttcttttgatcgtccttattcacgtgaatgctttccgaagtaatgttcatttttaaagcttcactataaataattaaagaaaataaaattcctgcaataacaccaattagcatgaggataataggaagccagaagggattaataaaatttaaaagttctataatttttgaatcagaaaagagaggaatcttttttataatctctattaatttaggtgaaaaatatccaataacgcctaaaaggattggacttactatagcaagtaacttttctaaaaaacctaatccaatgacagatgcctttttcatgtgtagttcatcctttcttatatatattttttaaccagggcatgttttaaatagtgagttttttcaccatttttatgagctcatctgagtaattttctatggatatagatgaatttgccttcaacattctttcttcgattgctcctaaaataaatgaagctaatgtgtcggtttgaaaagagttagaaaacacgccattttgttgtccagtcttcaaaatatctaataacatcgttctaagagcatcctcttcgtcgtcttcgattctgtaataaggaatgttctcttcatttcttgcattaaagacaatctcaattaaggcaatattatttttgtaatgagtttcttgataagccaagtgtgcttcaataaaagcctctagtttatttatttcagattgagctaatagtactcgattactaataaattcatgttgtttggcaactaaaaattgtaatgtacggttcataaggtaaagcttatcattaaaatgataagaaataagtccggtactaatcttagccttttttgccaccttcgttaagctcaagttgttatatccaacctcttctaatgtatcaatacatgcaagaataatttgttcacgcctagcctctgcaataaaagaatcagtcacgctattcaactcctgatttatataatttgaatgtataatcaaaaaattgattgatcgttcaattaaatattagtaagaaattattagtatgtcaaatgttttatacctacatcttgataaggctcattttctgaaacaagcccgtttttaagaaagccaagcttcctattcgccctgaaaacatactataaatggaatcccctcatttagaacaagaggaacttgttatgaatgatactaaaggaggaatagggtaatgagcgaaaagtgtgaacacagacatgatgattgtaaccgcagacatggttgcggaggcggttttgcgcttctaatcgtattgtttattttattaattatcatcggtgctagctgcttcggcggaggcggcggttgtggttatggcggttacggcggctacggatatggtggctacggcggatattgctgctaattattaaaaactattgaaaatggccttgtgcaatacgcacaaggccattttattcatatttttatatgctgtgataatttattaatgtacagagaacggattaagaagaagaaaatgatctcgataatcccgaaaaaggtgagtacgatacatgtctcttttagtaaggagaaagaaaacatgctttgtaaaaacttaaccgcaaataatgtgtgaacaccagcaacgatgtaaggaacgaaaaataaaattcctaattgaatcgttgcagagcgaaacatttctgattcagttaagccaagctttgtaatcgtaatatacttttgtctttcagttgttaagtcattatacatacggaagtatagaacactagccgcaccgataaagaaaataaagccgagaaatgcccaaataaagaattgagcaactgcatttcctttaccgtaaatgagttcatccgtagccgtatgtatgaagaaaggaacttgagcgttctcttctgtatgcttttcgtagaactcacgcgcatcgccactaataacacgtaacatatttttggttggaacgattgcattttcccagttttctacgaagtagttatagattacagttgtttcaatatgaggaatcatattatcaaatacataatcttgtacgacagctaaatgtgggaatgcaaaggatggttcgattcccttattaataaaccctttaatatgaaattcttttttattagacccgagtgtaatcgtattttgctttgcaaatggattagatacgagatcgagaagttctggtgagtgccgagaaataatataaacttctgtagaatcgattgttatttccggtcttttcaattgtttagcaattgcgttataatcactcatcttcataagcataatatcttctttggaagctgtatcttttaatactgtaaacttatattttttgtaaagaaaattattagttgtaagctccgtttcaattgtagaaatatgcttttgttcaagggaattgtcaccttctgatgtatacgtgaagggaacgggatatcgctctaatactgatgccttcgtattgttattagcggcgaataatccaataataatcgtaaatgcaagtgcagatagcatagaaacaataaagagtacattaatattactgcgtgtacgagaaactaaatctgaaatccataacatatttatttgtttcaaataaaactttctgcgcttctttaaaatatagatgaaaagaaggaatgtttgtgaaaagaataaatatgtcccgactattacgagcggtaaaatagataacataataaaaaagacagatccattttgcacatttttttccgttacgtagcctcgcggataaccagcgatataatagcatagccctaaacaaattaaagcgaataaagagatgagtatagatggtcttttttcagctggcattttcttgttccctttaatgaggtgggctgtctttcgagtacgaataaacattggtgtaaatgtagaaacgattaaaaataaaatgataaacgttacggttgtaacgataatcgcttctgttggccaatataaatagagacctttcgcacttgttaatttcgaagtgactaataagaaaaagttagaaaatacaagtccaccttgaatgccgataaagatagataatatcccaattatcatgttttcggtaaataacaatctttttaattgtctctgtgagataccaagaatagtgagtatcccgaattgctgcttccgaacatttaaaaatgttccaattgaatataagagaaagaagaacgagaacataacgatcacaagttgtgctgtactagctaagttcattagaggatcacgttcttgaaagctttgtacactctgtaagcgcggatgatacgcgtatacagtaaatgaaaagaaaaccatgatagaaaaagcactacttacaaagtaggcgaaatatgctttcgaattacgtgagacatttttaaatgcgaattgccaaaatgtcatccacgtcttcctcctaataacgctagaacatctaatatttcttgataaaatttctcgcgatataatccgcggtgtagttcattgtaaagctctccatctttaatgaaaataacacggttacaataacttgctgcaaacggatcgtgcgtaaccattaaaatcgttgcatcttcttctttatttaatttcgtaaataactccattacgtcaattgccgcttttgaatctaagtttcctgtcggttcatcggctagtaagagagaagggtgatgaataacagcacgtgctactgcggtacgctgtgcttgtcccccagaaacttcaaaaatacgcttgtccaaaatatgatcaattccaagcttttttgaaatgttatcaagcttttcatccatttcttttaatggaacattatctaatgttaaaggtagtacgatattttcaccgattgttagtgtatctagtaggttaaagttttggaaaacaaatcctaactcttgtcttcggaaaatagctaacttctctctacgaaatgtgtgcggtttttttccgttaatcacgacatcaccagaagtcggagaatcgattgtagagataacgtttaaaaatgtagattttccgctaccagatggtcccataatggcaacgaattcccctttatccacgtgtaaatttatattttttaaagcagtatgagggactttcccctcatatacttttgagacgttttttatgtgtaatacttcttccatagtaatcacctttctactttttaaaacttaatgtgttgtgataatttttgcatataaaaggaacgaattaaaaggaaaaataaaatttcaactgttccaaaaatcaacagtacgactgtaatttcagcgaagaacgagagatgtaatatttcttgtagcatctttgtcgcaaacatcgtatggattgatgccataatgtaaggtacgaagaaaagaatcgcaagctgaattgtcgctgaacgtttcatttcagtctcagttaagccgattttcgtaatcgttatatatttttcttgctcatttgttaaatctgtatacatccggaagtaaagaacactgccagcaccgataaagaaaataactcctaggaaagtaccaattaagaagaacgaagcgacatttagttttgtcttatatagagaatcgctcgcttcacttgcatggaaaggtggatgctctgcttgaattgctgcattatcgttatggatttttgttataaacgatgaaccgatattatgtgctttttcccaatctgtaactttaaagctatatacactcatttgttttgaaacgttggataatgcttctacattttcatcagatagtatgagcaattggtatattaagcgatttgggaatgggttataacttttatattctttcacttgtagttgtaaattgttttgagtaagtgtaagagtatttttgttgtctttattatgaagcgttccaataacttgatcatctaagtctttcataagaatataagattcattcttattgaccgtgagcgtttcccaatttaaagccttagcaagtacattatagtcactttgtttaatggcataatagagctgcgtgttatcttcagccgaagatacttcatatatatccgttttaaattttgtataagtaaagtgctcttcattaaatttctgctctaaccagtttaaatgttcatcagctaacgtattttcagtatgtgataaataagtaaacgggaaagggttttgtctaatttcatcaaactttgtaaacttcccgaatccatataagaatgtaatcattgtaaaagcgagcgtcgatagcatcgctacaataaagagcatgttaatgtttgtccgaatacgtgatgctagatctgaaatccaaagcatattaattcgtttcatataaaactttcttcgtgtttttaaaatacgaataagtaaaaaactaatttgtgaaaagaaaaagtatgttccagctgcaataagcgatgggatgacaaatatactagagacggcatataaaagcccaattatgtcacctagcgacataaaatacagcggatttgcggctaacgcatatccacatattaaacaggtcgcaccaaatagagagatgagcacggatgcttttctttctttttgttgttttccttcttttaaaagacgtacggcttttctcgtgcgaatgagcatcggtgtaaaagatgatacgagaatgaagaggccgagaaagatgatgatagttaaaacgatagcacttgtaggcggatataaatataaaccaggtacgtgtgtaattttggcggtaactaacaaaaagaactgtgaaaagacaagtccaagttgaatgccaaaaaatatagaaagagcaccaattaacatattttctataaatatgagtcgctttaattgtttttgagatatgccaagcactgttaaaatcccgaactgtttttttcgtacttttaaaaacgtcccgattgaatacagtaaaaagaaaaatgaaaagaacacaatgacaacttctgaaattgtcattaatatgttcagagaaaaattcacgtctgtcatatgcaatttaggatgaaataaataaactgcaaatgagaaaaagattgcgatggagaacgcactgcttacaaaataggcgaaataagctctggcgtttcttgtgacgtttttaaatgcaaactgccaaaatgtcattcacctaaacctcctaatagggtgaagatgaaaagagtatgagagatactcttttcatcaagtttgttttaaatattttgtccactcgtgtaatgtgataatttttgcatataaagtgaacgaatgaataagaaaaatacgatttcaacgaatccaaaaataataagaacggctgaaacttctttgaacagagataaaccaattacatcttgtagcatttttgttgcgaacattgtatgaatggatgccataatgtacggaatgaaaaataaaatactaagttgaatggttgcagatcgtttcatctctgtatctgttacaccgattttagaaatcgttatatatttctcttgttcgttcgtcaaatccgtatacattctaaagtaaagaacgctaccagctccaatgaagaaaataactcctaaaaatgtcccgattaggaagtacgcggcactacctgatgttattttgtataacgatcctgctgattcaaaggaacgaataagaggcccttcatactggtatttatttcgatctttttgtaccttttctataaaattatcagcaatttcatatgtctgttcccagttttgaattttgtaattgtatgctgatatatgttttacggtgttaggtaagttatttacgataacatcaggcaacactatcgtttgatatgaaaagtcagatgggattgcgtttacatgctcatagcctttaactcttaatttcgtatttgtactagagagtgtaatgtaatctctattgtagctttgctcaaattcgttgaatatggtgatataagatgtccctgttaacacatatgcttcgttatcatccataaatagttgtttcattcgtaaagaattcgcaagtttgttatagtcactttgcttaattgcgtatacgtcattataaatagctatatctttatcttcttttagtggtgtttcatatatatcagcttttattttttgataagggaaatgctctttttgtaattgttgctcaagccaatttaaatgctctgtaacaaaagggttcgcatcatacgagaaataagaaattgggaaaggggaagttctattcacctctagcttaataaatttcccgaatccatataggaacgtgatcattgtgaaagcaattgtagagagcatcgctacaataaaaagcatattaatattcgtccgaatacggtttgctaaatctgaaatccaaagcatattaatccgtttcatataaaatcttcttcttttctttaaaatataaatcagtaagaaactaatttgagaaaagaaaaaatatgttcctattgtaacaagcattgggataacgaaaatactcgaaaccatatatataacaccgatttgcgggcttactgatacgaaatatttaggatttccagctaacgcataaccaccaaataaacaaatcgcaccaaataatgaaacaagtatggatggttttctttctttttgttttccaccatttgtttttaaaaggtgtaccgctttttttgtacgaataagcattggtgtgaatgcagatacaatgataaaaagactaaggaaaacaatggttgttaaaataaacgcgttagtaggaccgtataaatatattcctggaacatgcgtaagtttggctgttactaataaaaaaaattgagaaaaaacaactccaaactgcatgccgaaaaagatagataaaatcccgattaacatattctccataaaaacaagacgatgtaattgttttcttgatattcgtaaaatggtcaaaacaccaaattgtttttttctaactttaaaaaaagtaccaatggaatatagtaaaaagaagaaagagaaaaatacaattactacttctgaaaatatcattaatcctgaaatttcagaggtcatgtcaaagttttgtaatttcggatggaataagtaaacagcaaacgaaaagaacacagcaatggaaaaggaactacttacaaagtaagcaaaataagctctcgagttgcgcgtgacgtttttaaatgcaaattgccaaaatgtcatagattatacctccggctagaagatatagaagtagttgtattgcaaaaaatgtatgagagtgtgttctcatacattttgcttgcatatgttacgatcatgcttcggtcaccttctccgtatgttctgcttgattatttgcagcgttgtggaagatgattttaatcgtcgttcctttaccaacttcagaatctagtttgacagagtgacctaaataatcacaaattttacttacaatataaagccccataccagtagattctccgaatgcgcgaccgtttttcccagtgtaaaatggttcaaatactcttcgaatatcttcttgcggaataccaacaccttcatcacgaacttctaaaataatatcctttccgtttcggtaagcagataagaaaactttctttccgcgctcaccagagtaacgaacagcatttgtcattaactgatagatgataaattttagccatttcgcatcagaagcaacttttaaatcagaatggacttctaaaacagggaagacaccattacgaatgaatagttcttttaatccgttaatattttttgttaccgtatcttttaatgaaatcgtctcaacatggaaatcttcatggaagttatttaacctagccatgtataaagccatatcaagcccttggtttagacgctctaattcttttttaaactttggaattaaatgctcgtcttccatttctagcaccataagctgcataacagaaacaggtgtcttcatttgatgtacccagtggttaatgaataattgatgttcttgttgttttacttcatacgattgtagttctttttggaagaggcggtactgcgtacgcacgagttcattgacaccgtgaggcatcggagcagttgctctttcaataaacgcatcttccattttttctggttgctcgcttaatctatggtacattctacgattgcgaacgtaacggtaagcgaggaaacaaataaataaatataaacttaaaacgacgaaataaaatttattgttttgaaatccatctactgcatcataaagaacgaaaatgataccgaagtttaaaacgtacagtaggaaaaatgcaaaatgatcacgtaaaaatagcttcatgcttattcactccaagttgcgttaaagcgatatccaagtccacgtactgtttcaatagagttctcaataccaagctcattaaactttttacgaagacgcgtaatgtttacgtttaatgtattttcttcaacgaagctttcgtcatcccaaagcgcagctaataaatcttcacggcttgctgtacgagggaatttagataataacatttcagctaaaatagcttcttttttcgttaaaagaacttgttcagatccgaagtgaatttcaggacgttctgggaatagttttaaaccttctacttcaacgatacgttcagaaatatttggtgcataatcaccgtaaatacggcgtaattgtcctttaatttttgccattacaacgtcgtagtggaatggttttgtaatgtaatcatccgcaccgctttcaattgccataatttgttccatctcaccagcacgcgctgaaatgaaaataattggacaagtagattcatgacgaatttgacggcaccagtagaaaccatcgaatttcggtaagtttacatcaagtaaaacaagatgtggtttcacagcgttaaacgattccataatatcatcgaaattctctgcaacaacagcttcataaccgtacttctgaatgtgagattgcagtaatgatgaaatatttggatcgtcttcaacgattaaaattttatacatatgtatattcctcctcagaaaaacaattgtagctatagtgtatcatgtgtttcaagtcttttcattatgttgaaagataagctagtaaacagtataggttaaaagtgagaaaagtaaaaagggcctcgtatataattgacaatcaactgaaatcattttaacatttagataagtatctaaatgtctaattatcgaaaggaagaaagacattgaatcaagcattcaaagcattagcagatccaacaaggcgaaaaattttagacttattaaaagaaggtgatctaaccgctggtgagatcgctgaacatttcaatatgacaaaaccaagtatttcacaccacttaaacgcacttaaaaatgctgaacttattcaagatgaaaagaaagggcaattcgttgtgtactctttaaacacaacggtctttcaagatttgttgacttgggtgtttacatttacgaataagggggaagaggggaaatgagaaagcatatatttccgttactattaatagctttaacgattattgcatggtgcatcgcgtggccgcatttaccgggagaggttccgagtcattggaatgtgtctggtgaggtagatgggcgtatgtcaaaaatgggcatgatgattttggatgttgcagttatggtttttatatatgctttattgactttattgcctaagatagatcctaagcatgagaattatgagaaattttctaaagggtataatgtaataaattatagcgtattattcctattatttttagtaagtatcattggaattggagctggattaggttatgacattccaatgaagagtacaccatatattcttgttggtcttttatttataatcatcggaaactatttaccacaatgtaaaccaaattactttgtaggtataaaaacaccgtggacattaagtaacgaggaagtatggagaaagacacaccgttttagtgggaaggtgtttgttgtattaggagttattatgattttaagtatttttgctccggcagcgtggaaaggtttcctaatcattggcattattaccggtgcagtaggattaacaatgggatattcatatattgcttataaaaaagaaataggggcttaataaaaaattatgggggagagaggatgaaaagacacgtattaccatggagtttaattattggcattgtaattggatggtatattgtatggccacatttaccagaacaaattccacgccattataatgcagcaggagtagtagatggatatttttctaaagtagaagcaagttctgtttcaataggaagcatgatgttgctgtatttgatatggctagctcttgggtatattgacgtaacgaaagataagtataaacagcatgctaaagtcctttccgcaatccgttatgctattcttttgataggattcggctgtaacttatttgcgctattagcagcgtctaattatattgcatcgggctcaattgcatttaattttggacttggaacattgtttcttgtactaggtaattacatgcaacaaacgaagccaaacgggttagtaggcattcgaatggactggacattagaaaatcctgtagtttggaggaaaacacatagatttgcttcgagggtatttgtaataggttcactttgtatatatgccggggctttgcttccagatccatttaatatttttatagggattggaatcatattaatatgcattatcgtatcaacaataaagtcatatagtatttataaagaagagttgaaaatgtaaataaagctgcttttccttttagggaagagcagctttgttttttatcacttcttcaaaaccggtatccaaatttcacttttaaagtttggagaagatatatctttctgtttattccacaatatctccggtccttccgctagttcatagttcgaagaagggaaccattcagagtaaatacgtccccatacattttgtaatgcatcaggaaatggaccgacagcttcgaatatagcccatgttgaagcagtaacttcaagctgtttaaactgctctggacaatcctttgttgtggctactccaatgtagtgatcgagttctcccttttcctccattcttccttcagaaaagttagtagaagcactaatgattccagtaggttcaatgtttgaaagggactttaatgtttgaatagaatctgggtttaaacttttccacatagaagcaatttcttcatttacaccgttaaaaacgattggtactcgttttgtaatacctataattcgaaatggctctttttcttcaattcgatagttcatttcatttcctccttgaatggataattggaaggtcattggtgaataagccttcaaagaatggctactatttcgggcttcagaaggtgttataccgtgcaagttttgaaatgcacgagcgaatgaatctggtgagttgtacccatattttatagcgacatcaatgacttttgcatcgctattttttagttcaaaggcagcgagagtaagacgtctacagcgaatataatcagacagtgatatacctgctaaaaacgaaaacattcttttaaagtgatactcagaacagagagctagcctcgcaacttctttaaaatcaatttcattcgtaaggttatcttcaatatagcgcattgcagtattcatatttttaagtgaatccatattatgacctcctctgtacatagaatagcaggaacgaaatagctccatccgacatttcgtgcacaactttgtaggggacatttttaaccttacaaaattgtaatgttcctgtaaggagaatgaatggatggtatgatatcccaatgttatagtaacaaagtacttttgttcagtaggttaaatttttatatctttacttatgcgtcttacataactgtcatgtttgtgtaagaaacatcgatagtggcaagagtagagagtgtatatagttgaaaatagagaatagaagaaatgagggatgtcgagatgaaaacagtgttagaagcaaaaaatattgaaaaagtgtacgacacgggtgggaataaatttgcagcgttaaaaggtattaacttacaagtaaaagaaggtgagttcgttggaattatgggaccttctggttctggtaagacgactttactaaatgttctttctacaattgataatgcgacgaacggtgaaattttaattgatggaaaagatattgtaaagatgaatgatgataagttagcgttattccgccgtgatcatttaggtttcattttccaagattataacttattagatacgttaacggtgaaagagaatatcgctttaccacttgcgttatcaaaggtgaaagcgagtgagattgatcgccgcgttcttgaaatctcaaagaaattcggtattgatcatattttaagtcagttcccatatcaagtatctggtggacagaagcagcgctgtgcagcatcgcgtgcaattgttacgaatccaagtatgattttcggagacgagccaactggagcacttgattctaaatctgcaacagatttacttgaaagtatgaagtcgttaaatgaatatgataactcaacaattttaatggtaacgcacgatgcgtttgcagcaagttattgtaaacgagttattttcattaaagatggtgaactatataaagaattacatcgcggtgaatcgacgcgtaaacagttcttccaaaaaattgttgacgtaatgtcttctatttctggaggtatggctgatgaccttatctagcattgccctccgcaacatacagcggaactttaaagactactttgtatattttgcatctatgatttttagtatcgttatttattttacatttaaagcactgcaatataattcacaaatggaaaaagcagcagaagcttcaaaaaaaattagcggagcgttccaagtttcaagtgtgatgcttatcattttcgtagcagtgttcattatatattcgaacggattctttacacgtaaacgtaaaaaagaagttggcttatattcgttattaggtatccgtaaaagacaaattggtaaaatgctcttttatgaaaatatgttaatgggattaatgtcattagtaattgggattgcgatcggtagtgtcctttcaaaattattccttgagttattagtaaatatgatgggattaaatttaaacgttcattttgaagtaccgatggctgccattattgatacagcaattattttctttgtgattattttatatacatcacttcaaggatatcgtttaatttatcgctttaagttaattgaacttttccgtgcagaacgtgaaggagaagcaatgccaaaaggatctgtcattatggcattaatttcagttttcttaatcggttcaggttattttttagcattaatgtacatgaaagcagttatgtatgcagactttatggtcgttgcattatatattttattagcgacagtagcagggacttatttactgttcatgttcttcacagtatttgtattgaaacgtgcaagaaataataagtcagcattttataatggtatgaatatggtaacgacatcacagttactatatcgtattaaaggaaatgcgaaatcactggcgacaatcgctattttaagtgcggtaacattaacagcggttggtacgtcagttacgatgtattacaacacatttacgcaatcaaaagttgctgcgccgtatagttattcctatgagaaaaaagatgcagcattagataaaaaagtaaatgaaatacttgctggagagaagaataatcacccagtcacatatgaatcagaagttgaaatgattcctgtgaagggaacatttaaaggtgaaagagctgatcaagttctgaacacacactataatgttacgaatcagtaccagcttatttctcaatcaagctttaatacacttgtgaaacatttagatgtagaacctgtaaatttaagtgcgaatgaagctttcgtatatgatagcttatatattgagaaacttgattttggtcctctttatacaggaaatacagctgtattccctgttggaaacgagtcaaaagaattaaaaattaaaggtgtaaataatagaagccttacaaatttaaatgaactatttgtaatcgttcctgataaaacatatgagcaagtgaaacaagtaaatgaaacgcgtactgtaaaaaatattgatgtaaaaggtgagcgaaatagtaaagagttaacagcaaaattagcaagcattatgccagctggagaatcagaagttttaaaaccatttaacgatttctatacaggattccaaatggggcttgaaacaacaggcttaatgatgtttattgggttattcttaggattagtattcctattagcaacaggctcaatcatttactttaaacaattaacagaagcaagtgctgaccgtgatcgctacgttgttcttcataaaattggtgtaacgaagcaagagatgaagagagctatcgcaaaacaagtgagctttatctttgctattccgttagtaattggtattttacacagcctatttgcactaaaaggtttatcaaatatattaccatttgaaattatgattccgcttctaattagtatcggagtatacggcgcgatttatattggatattacttcttaacagttcgttcttattataagatcgtgagtgcgaagtaataagggacagctatcgctagaggcgatagctgtttttttattcttcataaaatcttaagaaatctcctcaatttttgttaagaaataatagttatacttagaaacaagttaaaaactattgaacgaatgaggagaggtttatatgcaactcataacattcttacatgaatttattaaacatccgaaacatactggtgcaattgcgccaagttcaaaaatattagcaaagaaaatggtagatgtaattgattttaataaagcgaaatgcattgtagagttaggtcctggtacgggagtctttacgaaagaaattatgaagagaaagaagaaggaaacaatatttcttcttattgaaattaatgaagtgttttgcaaggaactaaagagaaaatttaaagatgagcagaacgtcattgttgtacacggttcagccgaaaatataaaaaagtatatagaagatctcaatatagaatgcgtggattacgttttatcgggattaccttttacctctttaccagaagaagtttcaaagcgtattttaaacaatgtaatggaagggatacatgagaatggtgaatttattacatttcaatattcacttgtgaaaaaaggatttatacagcacttctttcctgaaattacgctagagaaagtgtggctcaatttcccaccagcgtatgtctttagctgtaaaaaagagctaaggagagcatatgcataatggaattacatgaattattatcttatattgaacaatacggttattgggcattatttttctgtttatggttaggtattattggtatgccaattccagacgaaatgatcgtaatgagtggtggctttgtatcttcactagggatattaagtgtcattcctgcatttttattaacatatttaggtgttgtatctgggctttctttaggttatatattagggaaaatatttggtacgaaagtacttgataagctaatgaaaaagaaaaaggcgaaatatcttttgaaatctcaacaaatggtagagaagtatggtcattatgcgttagtcacaagttacttcataccagttgtaagacatatcgtaccgtatttagttggaatgaataacatgccatttaagacgtatgctttgtattcttatacgacaggatttgtttggacactcgtttactttgtgctcggtgctttatttggacaacacattgaaagtattgtagcgattgcgatagaatatggcttgtattttggcgtgattgtttttattgttacaggtattctttatttatatagacaaaaaagaatcacactgatgagtaaatagaagtaaagaaagtttcttccagtatgaaggaaaagataggattataagtataaaattatctttatttaatggtaaaatataggtaagtagttaagggaggaagagcgttgtgctactcatttttagccttatcttaattggaattatgtgcagtatgaaaatagtatctttacacatgatagaacgacaaaaggtagaggaatgatatgtatattgtccaaaatgtgatacaaaaattagaagaggaaattcagctcctttttgttcgaaatgtaatttaatatttttaagtaaacattaatccacctagttctctttcgtttgcttattagctaaaatggattatgaataacaatagtatgtaaacgaaaataaatataaatgtacacatggagtgttatatttggagattttaatcatagtaggatgcctaaactgtatggatgttaacctttttagagaaagatatcccagctaatttagtttggaagattgaaagaatagattgaaaatagatgagaagtggagtgcatatgatggagacacaaatcgttattggagtacctggtttatggaaagatagaacagaattaatacaagaagttgtgaataaaagtaactatatattagcgggaaatgttatgcaccataaggagaaagagattggctttgaaattgatatatatgaacaagggattgagtatacgaatattattgaaggatatcccattattatgaagtctttcgtagagatggattgagaagttttgagggttttattacctgatgacagggggattcttcctactaggccagagtgtgatgaatgttataagactcaattggatagtattgaggaaatttgataaaaaatagcttgaaaccatttaagctatttttgaattattacatatgctgtaaagtaggttttcgatttgtagtaatatctgctactgaataacgcttcgttttattagtgccagttagcccatttcgtatttagcatatttttttcttcttctgaaattatattgtctttataccagggtaaatgtttacaggtgaaattatcagctacccttacggcattataaaaaccgttactaataaattttttattgtaaacagcaaaagttgtatcaattccagcgttgaaaactttaggtttattgtatttagttataggaaaaagccaatactgcatttcccattctgttactgtacatttttcatttgacatgagctctctgttgaaattagaagtaggtataatgtctaaagcaaggccggctttaaagagtgaaagctcgattgttaactgctttaaatactctaaaaagttatctgacattttttcattaaaagataaatcaggatcagttacagcaaaaaaatctggaagtaaatcgaaaatataaggaacggcaaaaaaacgtggtccatagttggcattatttttcactaaattatatttagttgatatttgctcataaaaagcaagcaaagcgggagcggttgaattattgtcccaaatccatatatcttcactttttatctttttgttttctaattgttttaacatatttttcacataagtaaggttattgaaggctattactattataggaatgtttgaattatattttaagttttctatattagagagacttagttcgttcttacattcgaacacgatttataacacctccgagcaaaaataaaacacactgcattagaagcaacaatattccaatatatgcgtaagtaagagaaatggaatcggtgtacggcctatatatgatggaagtaggaaaagcatttttgttaagatagattgagtatacgaatagtgatgaaagaggaatttttctagctacatgagagcacggtaaacgttagataatattaatgaaaaggtgatacatgtgcaaaaagagattttaaggttattagataaaaagcaaagtaactatgaatttcctgcctttgataatgaatatatggatatttcacaagtgaaattctctcttttctttaaagatgctaaggattggctaatggtgtttcaaattgtgggtgtaggttcattaggtgtatgtaatgatattcaagtatatggcgatagaattactcattcaatgggtgatgattgcattttacaattaaataatggcgattatgagttgtttgatgatgaaggtgaatttataccgaatatttataacggcagtttaaaaattcgcgagcatcattttgaatatgaatttacagaagaggattatataaataatggaatagaagtacaaacgacagagcattatccaacatactttatgcgtatgctcgctactaatgaggaagctcaaaaattattgtggtgggataaaggagaaattttagaagagttcggtttagaaggcgactgggaagtagcgtatgaaacggaagaatggaaacatgttgaagacgaaaaagtaagtgaaaatgaattcttccaatcagtagccgctgcaatagagaagaaagatccaagtgttattgtgaatgaaaatgctaatacgcattggagaaattgggtagagtttgattgtgactgaaaaggataggagaaagaatgacaaatgaaaagaagaagaaaatccggagaaaaagtacaaatgcatcgttttgcactacctctatgctacggaagtgaagcaccatattattattacgaggtagcgccccatgaaagagaggaacgcttccatttaacatcagatctttgtgtaatggatggtgaacattattttattagaggatgtttagagattcctataattgactaccacaaaaatttcatatggactgtgtgggtatcacttagtaaagaaagttgtgatgaagtattagaaaagtgggatgaaagaggcagggaaaatagtgatctttattttggatggttatctgtagagataccagtttatccagaaacattaaatttaaaaacaaatgtacatataagagaagtaggaacggcaccgtatgttgaattagagccaaccgaccatcctttagcgatcgaacaaagaaatggaattactttagagagagttaaagaaatagaggaaatgatccaacaatataactagattagaagagaaaaaacgagtgctagcactcgtttttttattacacaaccgcaggattataaatcatcgtaaagtgtcctggtaataattcaatgtgacaaggtgtatgaagcgagttttctccatctgtatctacttctttttcttctttcgtttcaatatgaatggatttcgcttttacgtggaagatgtcattttcatttgagtcttcaaatagtttctttccgatgtaatctttaaatgcttgaatacctgttgatttgactacgaaaatatcaagtgttccgtcatcacattttacgttcggaataaaggatggaataccaccaagatattcaccatttccaaccatgacaaggacagcttcgtcttcatatacttgtccgtcataagtaatttttactgggaatgtttcagcattttttacagttcgaattgtgcttaaatagtaaccgattttaccaagctttgctttttcttctgcatcgatattgtttgatacttcagatacgagtccaatgccccagaagtttaagaaatgttgttcatttgcttttgcaacgtcaactggttttatatgttcttttgtaataagttttgccgcttctgcaatgttttgcggaacaccaagtgtgcgagagaagtcgttgcaagttccacctggaatgattgcaagtgtaggtctagtttcgagaggtgctaagccatttgtgcattcaaatactgttccatcaccaccaaagacgataattaaatctactttactagcaaactcttggcaatattttgttgcatcaccttgttttttcgtatgaaggatatgtagatcaggaaaagctgcggcaagaggtggtacgattttcgttaaatttgtatgtaagtcaccttgaccagctttcggatttacgatgaggagtactttttcaaattttgtctttgtcatatttcatctctccctgtagtttgtaatggaaagaaaggagctgttcccatgtattttagaacagcttctccctattaattgggtgctaagattgtcagttattgtcggtaagtcgatatattaaaaaaatcgccgatatacattttatgtactatcgattttttaagttatacgattattccgttacaactgaagcaatgaatggtaagttacgatatttttccgcacagtcgataccgtatccaacgatgaattcgtctggaatttggaagccaacatattcagctgttaagtctactttacgacgttctggcttatcaagtaatgtacagaacttgagtgcttttggtttatgcataaagaagtggtcttttaggaaatgaagtgttaaaccagaatcgataatatcttctacaacaattacgtttttcccagtaatgtttacgtcgatatcttttagtagtttcacttttcctgttgtttctgtttgatttccgtagctagatgcagaaataaagtcaattgttacatcatttttgatgttacgaattaaatcagcagcaaatacgaatgaaccttttaatactgcgataactacgatttcttctccttcaaagtcacgttcgatttgaagtgctaattctttaacttttgcttgtaattgttcttcagaaattaaagtgtcttttatttcaatattcattgtaatcctcctacagtgtaaaacttacgaacatttcgactgtaaaggatagaatagaaaaagtcaaaggagatagtaattttttacaaagataacgacaaaatcatctgatgatatgatatactaagtatattaagaaaacgcttccataaagggtgaatatgatgaagaagaaacagtacacaagtgtaacatttataaaagcattacttttaacaattgttcttggcctgttggcttacgtaattgatgtacctgtgattcgtatttcattaattggaatgactttagtgttaggagcaatttcgcatggtatgatgtcgcagctaaaagaagctggacttgatgatatgagagatcatatagataaaaagtgagaaaccttcattatatagagtgaaggtttttttgtttcttacaaaaatgtaaggtagttgtaaggcaaatcgatagttgcataagagcattttggataaactatgggtgtaaggtaaaaggcaagcatattttaggtaaattaagttttaggcactctatatgtgaaaaaggagtaggagggcatggagaaacgttggacgaccttttcttttttagcgactagtaacaccgtaatgctagatggaaaaatggattttttgcacttgtttgatcgtgaagatgatcattcttcttctaaatttacaatgaaatggaataaatggagcgagagttgtaggtttgaagaagaggcccctaacgaagagcaaaagattattttaacaaaccctattaaagcgtgggttgttcaacgtcgtaagtgtaacgtcaaaaatcacttcaagaaaactgagccgagacaattagttatcgctccggcccgttctacttccaaatcacgcgaaagtaacatgtaaataattgagacacacacccgaaaaaaacatcgtacatattgcgatgtttttttctttttctacaatgaaatctttaaatgaaatatatttcatctgcatcttatatttatatctcttgcttattctagtaatacatccgatgcgagtagatgtgaataaaatataaggagagagtgaaaatgaaaaagaaactattaccaatttgtgcaatggcacttttaacagtaggatattcttcagtagcgagtgcggatactggaacagtaacaaaggaagaagaagcgcaagtacaacaggataaagctaaaaaagaagaagcaatcaaggaacagcaaaaaagtgaaatagagaaaaagcaagcagcacaagtacaagaaaaaaatgatatggctaaaaaagaggaaacaataaaagctgagaaaaaaagtgaagaagagaaaaagagaatagcgcaagaacagttaaaaaacgatatggctaaaaaagaagcagcgataaaagccgagcaaaagaatgaagtagctaaaaaagaagaagcaaagccagttgtacaaggtgaaaaattaccaaatacagcatcaaataatgtagcaatgatgggattaagtgcatgtcttgtagcggtaggtacattatttggtttgaatcgtcgcaataagattaaagcgtaaataaaatattttcctataaagaatgggataatttcatatattaaaaatggtaggttactcctaccatttttggcatggaggaatgaagaatgaagttactcaattatatcggtatcatattgatggctatagggctattcatgggatcctattatgctgtggaatggtataaaggaagaagctctgccgggcaattaacggcagaagaaataaagagccttaaaaatatacaagatactcaactttctcatgaaacacctgtaacttctcaagtgccttcttctcaaacagaacataaagaaggagaaaaggtagcgatgttaaacataccgaaaataaagaagaagttttctatatattggggagcagatgatacgactttgaaaaaaggagtgggtatgttcgttagtgatttaacgacaactccatctggagggggacatactgtactgagtggacatcgagatactgtatttacagatttagaagagttgaaagaaaaggatacccttgttttagagtatgataataaaacgtacacatatgaaattcaaaagacatggattactcatgcggatgatcgtactgttattataaaaaaagaagaaccgatattaacactgacaacttgttacccatttgattatataggggatgcaccagatagatatattatcgaggcgaagttaactggcagttattcaaagtgaaattatagtttctgaaagcgagagggggatatataagttatgtcaaaaaacattttaattgttgaagatgaagacatattacgcgaaatattaaaagattattttttaagtgaacaatatgtagtgtttgaagcgagggacgggaaagaggctttagttgtatttgaagaagaagaggttgatttagttattttagatatcatgttgccagaactcgatggatggtctgtttgccgaaggattaggaagacgtccgaggtgcctattattatgctgacggcgcgtgtagatgaagacgatacgttacttggttttgaacttggagcagatgactatgtgacgaagccgtatagtcctccaattttattagcaagagcgaaacgattattagaaagtagaaaagcatcgaagaaacctttagagaacgaagatgatacgttatcgattcatggcatccatgtccattttccgtcgcgtactgttactgttgatgaggcagatgttagtttaacgcatacggagtttgaaatattggtgtatttcatgaaaaatcaaggaatcgttttaacgcgagagcaactcatttcaagaatttggggatatgaatttgctggcgatgatcgaacggtgaatagccatattcgtaatttaagaaataaattaggagagaaagcaaagtatattacaactgtagtacgaactggttataaatttgaggggaatgtatgaagaaaggaattgtactaaaattatttactcttacaacagcattatgtatgttgattttagcgacgatatttattggacaaacgatattttttaaacaatattatgcgaatcgaaaagtggaagatattaaagtgaatttaaattcttttgagaagaattatttaaattatgcaggaaatgcagaagaaattcagaaactagagcaagactttttaagagaaaataatacgtggattacgacattagataagaacgggaatttaaaacatgcagatgatttttattttgaagtaacgatagatcgtaggcaacaaaagagctttggacaacaaatatttaaaattcccttaggtaatctcgtcaatatagaggaaattgataataaattatcagagcagtttttagggcaagaaatttatttttctggagtgagaaaagaagatagttttattccattctctttttctttatctaagcagaatttaagtggatctaataaaccgttagaaaaagcatttaatgagaaaatgagcaaattaaatgaggagaaaaagagagcagttgaggaacaacttgttaaggaaaagaaaccagctgttcaggagcaagctgctcaggaattaggcgtttacataggaggacgtgttacaaaagtacagttaccagatgtaaaaggtcctgtgaatccaatttataaaaatggcatcttcttagatagcataaaagaatttcaaactaatttattattaaaagagagcaagcccatacaatatacaacacaaacaatggactatgaaaaaaatgatattaaatataaattattaatcaagccaatagaaaaagacggatcagtaacatatatttatgcgatggcttctttacagcccgtagatgaagctgtacaaatggtgcaagattattacatctatatcattgcatttgtagtcgttcttattttgttagcttcgttctattactcaaaacaaattgccaaaccgttattaaaaataaatgatacgacgaagaaaatagcacaattagattttacagaaaaaataccgattacttcaaaagatgaaattggagatttgtcgaaaaatattaatgtgctatcaaataaactccattcacatattggacagttagaagaagatattgaaaaggaaagaaagttagaaaatacacggaaagaattcatttctggtgtttcgcatgaattaaaaacaccgctaagtattatgaaaagttgtatttccattttaaaagacggggtagctgagcataaaaaagagtattattttcaagcgatggagagagaagtagacaaaatggatactttaattttggatatgcttgagctagctaaatttgaatctggtacatataaaatgaaaaagtctgcgttttatattgatacagtaattgaagatatatgtgaacatctatctgtggaaatagagaaaaaagaacttcatgttcataaaaatatacattcatttgaagtgattgcaaatcaaggccggattgaacaagtcatcgttaacttcattacgaatgccatacgttatacaccaaataaagaagatattattatttctgcaatagatgagaaggatcgtataaaagtttgtattgaaaataaaggtactcacattgaagaagaacaattagataaaatttgggatcgtttttatcgcgtggatacagctcgtcagcgttcacaaggtgggacgggactggggcttgctatttctaaaaatattttagaattacacgatgctgaatatggagtgaaaaatacagaagacggtgtattattttacttttacttaccgaaaaaagcgtagataatgcatgctacgctttttttaatttattttcatattatctttacctaatctttatttttaagcgatataatctggttagaaaatgaggttatgtaaggagtcgatgaaccgtgcatagcaattggctaagtataatggtatttattttcttttgcgcatttattgtatttttaattaatattacgatatgaaaaaagagcgctcattaagcgccctttttttgtgtattcatttgataagcactgatgcttttgaataagcgtggggaagtgaggaataaaaatataagtaaaactgtacataaaataaaagaaccaagcattgtacttccatttacgattaatgaatataacacagctgattgacctttcggcgcatattgtccccagaaaataataccggcaataaagtgacagaaatagcgagcaaagctaccgacaaatgtagcaaggataatgtaaacaaggattttcttaccatggttttgttttgctgaaggtttttcattgcgactacctaaacttgaatgttcttcactattttcattagacgttaaaagtgctttttgaattggacgatagaataagccagcaaatccgataaaagcaaaggcaatgaagtactcaatgaatgcttgaacaggtgttaaaatataagcatcccccacgactatttgtaatagtccccaaactaaaccacctaagaaagctgatttaaagccccagcggtaagagataataaaaatagga

SEQ ID NO: 1392 - DNA, 11774 bp, Bacillus thuringiensis
  unsure (1)...(11774): unsure at all n locations
aactaatgaaattttagcttaccatgtttcagattttatgacattagagctcgtaacgacagcgctccataaactaaaaagggggccgcggattcgattgactgaaggtgcttatattcattcagatcaaggatcccactacacaagccctacctatcaaaagctagttaaaaagctaaacctaggacaatccatgtcaagaagaggaaactgttgggataacgccccacaagaatcattttttggtcatctgaaagatgaagctcatataaaaccttgcgtgtcctttaatgaattgaaacaagagattaagaaatatatgacgtattataatcattatagatatcaatggaatttaaaaaagatgactcctgttggatacagaaaccatcttcttgatgttgcctaacttttttcaaaatgtcctttacaaagggtacagattaatttgaaagagtccttttttatacgtgatgacaagcaacaaaatgctctacaccaacattacggaattctggtactgtttttttacaaacatccgttgcaaatgggcaacgtgtatgaaaacgacagcccgaaggtggatttgctggacttggaatatccccttctagtataattcgttctcgcttcactgttggatctggtattggaacagctgataacaatgctttcgtataaggatgtagcggattggtaaataactcatcacgcggtgctgtctccacaatcgtacctaaatacataattccgattttcgtacataaatgttctactacacttaaatcatgcgaaatgaataaataagataatccccttttctcctgtaactcactaaataaattaataatttgtgcttggatagatacatctagtgccgctacaggttcatcagctacaatgaattctggatttaataccatagctcttgcgattacgatacgctgacgttgtccaccagaaaactcatggggataccggtcaatatgataaggagctaatccacataactccaatacttcaattaccttttcacgcacattttctttcgttgctaatccgtgggccaacattggctctccaagcgcttctccaattctcattctcggatttaatgagctaaatggatcttggaaaacgagttgcatattagggcgatgttttcttaattcatccttggataaagaatgaacatcttttcctttaaacttcacttctccctccgttttttgaacgaggcgtaaaattgtttttcctattgttgttttcccgctccctgattcaccaacgagaccaaacacttcacctttattaatagtaaaacttactccatcaactgcttttacatgcccaattgttctactaaatacgccacccttaattggaaaatatgcctttaggtttttcacctctaataatggttcactcattgttccgcacgctcctcatataaccaacaagctactttatgattttcatcatttacatttagatttggggcttctttttcacatatttccatacaatgctcacaacgcccactaaagtaacaaaactcacctaaaccaactaaattcggaacttgccctggaatagaatatagtttatctattcgttttcccattactggttttgatttcaataatcctttcgtataaggatgttttggattttggaatatctctagtactggggcttcttcaataactttcccgccatacataacgacaacataatcagccatttccgctacgacacctaagtcatgtgtaattaataaaatcgacgttttaaattcttctttcacttgtcttagtagatccaatatttgagcctgaatggtaacatcaagagctgttgttggttcatctgcaattaataacttaggattacaactaagcgcaacagcaatcataatacgttgtaacatcccaccgctcagttcatgcggataagaatggacgatttcatcagcgcgggctatgccaactttacgaattaactcaattgccttcttatatgcttcatttttactaagtaattcatgctctcttaacgtttctacaatttgctcccctacagtgaagacggggtttagcgatgtcattggttcttggaaaatcattgcaatatcattgcctcgtaaactacgaagttctttctctttcattcctaaaagactttttccttcatataaaatgtctccacccactacactaccagattcagcaataagccccataatagataaagctgttacactctttccacaacctgattctcctactacacaaactgtttccccttctcgaaccgcaaagctaacatggttcacagcctttactgtcccctcgtcagtttgaaaatgtgtttgtaagtctttcagctctactaccgctttactcatatcttctcacctaccgtctcatctttggatctaacgcatcacgaagtgcatcaccaagtaaattaattgatacaactgttataaagattgcaaaaccgggcggaatccataaccatggacgcttttggaaatcgattaatgagttagctgcgctaatcatgttcccccatgatggtgtaggtggaacgactccaagacctaagtaacttagtgcggattctcccaaaatagaacctgcaacacctaatgtggatacaacaattaaaatgggtaaaacattaggtattaagtgatatataattttccggtaatcttttattcctaacacatccgcagcttgcataaatgcttgctccctaagtgataaaatttgccctcttacaaggcgtgcaagccctggccaacctactaggcttaaaataatcataatgacatacaaacgataatcagacggtactttccactctgataaaatcgcacccattataataagtagcggtaatcctggcattgacattaaaatatctgcaagccgcataataatattgtccacaataccacgataaaaacctgcaatcgctcctaataaagctccaagtataaccgataaaaccattgaagctaaaccaatggttaatgaaatacgtcccgcttgcataagccttgttaaaatatctcttcctaattgatctgtaccaagccaatgagaaacactaggtggtttgttaatgagcgcaacttgtattttccctgatgcatatggagaaaagaacggaccgataaaacaaaataaaaacataaaaattaatgcataaaaccctacaagtgccatcttatttttctttatctttttaaaagcttgtcgccatggtgatgattcgcttctgctctttttttcttttttttctgtaattactgtaacagtctccatttctttccccccttacttcaaccgaattcttggatcaacaactgcatatacgatatctgctaaaaagtttgaaacgattgttaaacaagaaagaaacatcgtaaatgccatcaatactgtatagtcacggaaatttaatgcttctaattgaatattaccaatccctggccagttaaaaatttgttcaataataattgccccagaaaacaatcccggtaattcaaatgctaataacgtaattgctggtaatattgcattttttaatgcatgcttataaataaccgtcttctccttcaaacctttcgctcttgctgttcgtatgtaatcttgtcttacaacctctaacatacttgttctaaaataccgagttagcgagccgaccccatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggatttccggccatttttctttagtagggtaaacaggcggattaaaacctttgttattatacgggtgtttctctgtatcgcttgatataacagggatagatgatcttgaatcatcccaattgctttatattcgcttagttctcttttgtgcttttgcaacagaagttggcgcatcttaaacatcgtggaagaacatataaaaatggcaatgagttttccatacacatggcattctaatcgctcttgtttgatagtttgccaatgatgaatttgaaatagagatttccacgttttaaatatgatttgtcgggtaaaagactggcgcggtatcagttgtgatccgtttccagcctctccccataagaactgctcgtgaggttttccctcaagcagctcaccccataaacttcatcaaaagggttatgagacctatcaaatggcagacactttcatcggaaactctctgcacttttcaggggaaggactttccagtcccagtaaagccccagtacaccatagagatattcgttactccatctctgccatccgatgctacgctttcgtcgtcgtttccttctcgttaacagtgtgcgaattttcatctccgtataatcacgtacttcactgaaagcttgactagagttcccaacccggaagtagttcacccatccagtcagtacggcattgatttgttttattaagtcttgtgctggcttcgctcctgcgttttgaatgagttcgcgaatttttgctttcactgtcgtgcgagctttcttcttcgggatcatgaaaacgaagaatccattcttatttcggttcggtattcgtctcaggtcaaatcctaaaaatccgaaggattctccttttaggacattgaccatctgagtcttctccagattcagttcaactcccaaaggctttaactgttcccacagtcgtcgtaatgccagttcagcccatccacttttactggagtgtccgcttacagcgataactatatcgtcggcaaaacggtgatagtttacagcttcgtaattgccatcagctgttttacgtcgaatggtatcaaatgtccaatccacttcattgaggtaaatgttcgcggctagtggagaaaatggtcccccttgcgggacaccgatctttcctgttgccttaattacctgttttacaagatgcataacctgtgggtcttggacacgtttcgcgattttctccaataatatgttgtgtcggattgtatcaaagtagcgtgacaaatcaacatcaattattatggtcatacggcgcaatatactgcgtcgtacttctgccaatgcctgatgtggagagcgtttcggccgaaacccatacgagtttggacagaaatcagcttcaaaaattgcttctaatatgagttttagcgctccttgtactacacgatctcgtatacacggaatttgcagagttcgcattttgccgtttgtctttgggatttctacttttcgattggcttgtggttggtatattccagcttgtaattcttcttgaatacccgttaagaatgggataactccttctagttctatatcagcaaaactttttccatcaatgcctggggcaccattgtttttcctcgcctgttgatatgcttcgtgaagggttgtaattttggtaatgtgggtaaatatcccccaaaaccggtgcgtaggttcagacttcgcctttcgatagattcgttgccttagttcctgcaaagtgatgggtgtttttgtcatagcacccttgcctcctttagtcatacgaaatgtttacaggttcggatcctttcctccccgcgtgttttgctgcacgcagatctctggtactacgatccgttccgccaccctgacacctaccgttctcacttcccgatcgcggttatagagacggtctcctcgatgagatttcttcatcgggtgtcgagggcttctccagtttccacattatctttctctccatgtcgccgctgataccccgccggtgagaactgccgttccagactcgtttcggtcagttcttgttgctttcgcacgttatcgaccgtctcagccaccggaattgcgtgtaacgaggctacatctacgttcactgtacgttacaacctggagatttgcccacatgccttttgcatgtgatgtcagagggcttcgccatgtcgctttcacttcatggcgcctctcaggctacgggagtggagtctattctcccgattggactttcaccaactagataatgtgtccttatctggacacgccgatctgccagcggagggagtaaaaatcatggatttgttccatcggaaccacttcccaaggcgtattcgtaacatatatgttgatacccgttaatcgtttactcttttctgaaaatgtaatcccctttttactttcggtatagctttgtttttttctacgttccagtatttgttcctctgttaatcggtagataattactcttgtaaataatctttgattcttgccaatatacgactcttttatttcatacgtttgtcctggttttaacgtgtgcataatgttctctaaatcaacttggatatactgtgactgttttttgattgtcccatttcgaaagtattctggaaatggatttttcgtatagacggtatggtttaacttaagtcttgatatatagcacacgccacgttgatccatttgatctaagtcttccaatgaaaaatatcctaaatcacgaatacacagatcacccggccgtaaggtatctaagcaatctgttccaaatgttttatcattattttttccaggacctacctggaagtttaaaaactgtccgctgtgtaagtcatattctaattgaatcttgatacctgcagtttgtgcacaaccacctgacccaggatatacatgtgctaaatgtttcggtacttggaaaatcgtcgcatctaaaatacggattcgttgaaaatacgtgagtgctgcacttgaaatggctgatgttttacaaagtttacttttccataatgcagaaaaaatatatttcaaaaattcaaccgcttttttatcaaagcgtttattgagtccttctggactcataagagtgcctgtggcggcgtgtaattgactgcatagtcgaacgagagaatcactcgctgtacgttgactgacccagatacatatggtagctaattcatttcctgaaaactttcgttttctttttacaaaacctaattctttagcgagttcttccaaaagagaaggggttaaatgacgatacagctcttcagaaaatagttgtaattcatcttgaattgaaagattcataaaaaatgtcatcctttctagctagctttttagaaagaataacgttttttgacacttgggggtagtgcaaattcttaagttgatgggcatggggtagagacaatataagagattaagaatgtgtaatctcatccaaatataatcgatgtctttaaaatcagaagatgctcataatttctaattaaaaagaaggaaacttaatattcaaaatcagaacacttaaaaaccaatcttttaaatgtagaagttgtaaatactcccccttttttctttattagaaaaatatagataacctattctatttcactattgtttaacagcattattattctgataacattttaagaaaagttgttgccgcccaaatgaaatacgcaagttgcgtaacgatatacatcgtaatttcaaaacctgtaagctttcttaccttttttattttctttaaatatctataaaaacaaaatgaacataaaatcagtaaaacaatagacatttgatatagattttccactaaaagaactgccatttatttcatcacctttccaataaagtgaaactttaatcagtgggggggttgttcatcctccactgattatcagccctcaccagtcgggatttaacgggataaaaaatatatagttcaagcatatcattttaacggaactaattaccggaattttcaaattaaatgaacttcctaagtaaaagaagtaactttttggaaatgtttcaatacaatattatgtaattcaatacgctctatataatattagattaggttttcttttactgtacatgcttagaaggaagttttacatgcaattgattcataacatacaaaaaacgtttaataacctatgtaactacgatacggtcaatttaatacacgctattcaatcattaaatatttcacttcataaaatatctccttttattacttcaccagttaatcttgaatacggacggaacgttatctatcagtctgaatttgtagagattttagtattaaatttccccagcaaagcaaagacttttgtgcacgatcacggaatatctgtaggatgtatactaatagtcaatggtacgctacaaaatataacgtacgaaaataatagcgagcggattgaagagtttacagagggaaatattttcacagtaaaaaaagatactgtgcataaaatgtataatgctacagattcggcagtaataactttccacgtatattcccccccattaaaagatgtccaaatatatgaatagtctttagaaggaggaaatatgcaaaatttgaaagattactatataaagagcttacaagatggtcgtaacgttgggctctatggacaaaaagtagatgtaactacagacaaacattttgcaggaacattaagtaccatttctaatttattttcattgtttgatgatccaatacgaagagattctattggatatgttagcccaaaaacgaaagaatttgtccatacggcctttttaattccgaattcctataacgaattattaatgaggagaaccgcttttgaaacgtggagttatgctacagacggtgtaatgagtagactatctgattacgcaagatcgagacttaccggctggtacgtatcaaaatatttttataaaaaattcgatgtacagtttccagataaaattacatcttattatgaagaagcgagagataatcacttgttcttaagcgtagttcaacgtgatccacaaataaatcgatctacagaatcaatgttgaatacaaatgacttaggattactaagagttacgaagaaaacttctgacggaatttatttaagtggtgctaaaatgatcggtactgcttctccttattcacatgatttattaatctatccattagcaaaactgactgatactcaaaaagatttagctcactttctcattgtggcagccaattctcctggattacatatggtttgtagagaaccatttgcgaatacacattcaattacagttgattcccctcttagctcacagtacgatgaaatggatgcactattaatctttgataatgtatttgtaccatgggaacgtgtcttactatataacaaccctgaagcgttatgggcaataaagtcagatatagcttctagtagtttagcttatcaccaagcaattgtacgattagtagtaaagctagaatttataactgcaattgcttgtgaaattgctgaagcaatcggtgctactacttatttgcatgttcaagagaagcttggggaattaattatgcaaatcgaaacaattcgcgcacttttaattgctgcagaagttgaaggtactacaaatgaaacaaaaacttatttgccaaaatttaaatatatcgaaactgcaaggaatcttggttccaaatattatccccgtgcaatagaaattttacaattaattggagcaggtggtttcattcaacttccttcgagctcgaatgacttccagagtccaatagatgatttattgaaaaagcactttaaaggaacaaatatagatgccgaacaacgcacaaaattatttaagttagcctgggatattattggaagcccattaggatcaagacacgaattatacgaaagattttacgcgggagattcaatacgaaatacagctacgcaatatgtaaattatgataaaaatcattttaaaaagatgctaagtaaatatttacattaatgaaaaagagcactttttgctaagagtgctcttaaaaaacatatagtaattcagttacatatatagttgctccggccacaactgctacttttctccgtaatcgtttcattttattcagctttataacctctggtatatgcttcctatcatatttcctcatataggcttctccatctggagtaactaattgtaaaacaatctcacaacaaacctcctaattcaaattattactttctaaactgaaaatccaactgtcttgattgcttgatttcctcaattactttacgaataccttcttcaatcttatcttcttttacattcgaaacatttaattttaatagtttttctttaggaaaatccctcatataattcttatcaatagtatcgacacttatttgaatgtcacctaatttttgtataagtgtttctgtaactatgtttttctgcatttctaaacaagtgtgtattccaagtgtgttttgtctattatatgtaaataatgatgaatttttattttgcactttttctaatgtttctgctagttttattgatctattgtagtaggaagaattaattttacttttatgacgttcaaacataccactctttatataaatttctaaagccgcttgagaaatcatcggactatcaatatctagtatttttttgtatgtatagaaagcatttgcaatggatcgtgggatgaccgcaactccaacccgtaaacctggaaaaataatcttcgaataacttttcaaatatatgacatgactacaattatccaagctatataacggatctgcttttgaatcagtttctaaatctgctaaataatcatcttccactataaatacattgtatttcttagccaatagtgtgattttttctttctcatctttagaataagacgttccaagcggatgatgatatctcggtatcgtatagaagaattttatttttccggtttgaaatatttgctccaattcattcaaatcgataccttcattcgtacgtttaataccgattacaggaactttatttatttctagataatcaatatatagatgatatgttggttgttcaattaatacagtttcatttccattcggaaatggtatagaagttaatatagcaagtgcctgctgaacacctgacgttataaaaatattttcttcttttgtaaagacttgataatttgctagttgtttttgaataactggtattaaagatggtaaccctttcggcgttccatatacaaacaaatcttttttataggtatcaatagccttattaatcgaatgttgaaaatctaaatatgggaaaacatctggatctggtgctgaggaagcaaaatcaattatctcgttattttctatggtactcccagatttcttaacaacgtaatatccactttgagggacagaatatataatatgacgcttttctaattcatgaagcgcacgtataactgtcgccttattacattcatattgcgtaacgagtgaccgtatagacggtaattactttccttcatttatttctccattttgaatcataccttctatgtcgactaaaatatgttaatacttattcttattacacctccttgagcaatttaatattcaattatatccttcatatattcatatggcatcctttcctttattagttattttccttgaaagatatttagtaaattnccattagcgtatgaatcattttcaatccatttctttactgcttctgttttatttaccccttcaacttctttttattacacctgtccaagattgattcgcccctactt

SEQ ID NO: 1393 - DNA, 21742 bp, Bacillus thuringiensis
catcgtcgtatcttcatcatgtccaacagcttttattgtattacctaaatcgcgcatttcgggcaggggacgaataagacgatcgtgatcacgctggtgtaaaccaattgaaggttcatcaagaatataaagtacgccagttagacgagaaccaatttgcgtcgctaaacgaatacgctgcgcctcaccacctgataaagttcctgcggcacgacttaacgttaaataatctaaaccaacgttcactaagaacccaacgcgctcctgaatttctcttaaaattaaatgagctattttttgttgcttctccgttagctctacattcgagaagaattcttgtacttcttgaactgaatacttcgttacgtcagcaatcgttttattgccaacaaatacagctaagctctcaggctttaagcgtccacctttacacttcggacaagcttgttctgccatatacttttccatttgctcacgaatgtaatcggagctcgtttcacgataacgacgttcaatgtttggaataacaccttcaaataaaatctcattttcctttacttgaccaaattcatttacatagcggaaataaaccttctcttccccgcttccgtacaacactttatcaaataaatctttcggtatatttttcacaggcacatccatatcaacgccgtagtgattacatacagattgtaaaagttgcgggtaatattgtgaacttgtcggttcccaaggtgcaattgcatgttcatttaatgataaatcccagttcgggataacaagctctaaatctacctctagctttgaaccaagtccatcacaagaaggacatgctccgaacggactgttgaatgagaacatacgcggctctaattctccgattgaaaaaccacaatgcggacaagcatgatgttcactaaatagaagttcctcttctcccattacatcaattaacactcggcctccgccaagctttaatgcactttcaagtgaatcagcaagacggcttgcgattccttcttttacaacaatacggtcaattacaacttcaatggaatgcttcttatttttatctaacgtaatatcttcagatacatcaagcatttcaccatcaacacgtacacgaacatatccttgcttcttaatatcttcaagtactttcacatgtgcacctttacgcccagacacgataggagctaacacttgtaatttcgtacgttcaggatattcaagaacacggtctaccatctgctctactgtttgtgatgtaatttcaatcccatgatttggacaaattggcgtaccaattcgcgcaaataataaacgtaaataatcataaatctccgttaccgttccgacagttgaacgtggattacgactcgtcgttttttgatcgattgaaatcgctggtgacaatccttcaatcgtgtcaacatccggcttatccatttgtcctaaaaactggcgcgcatacgcagataatgattctacgtatctgcgctgcccttctgcataaatcgtatcaaatgctaatgatgatttccccgaaccagacaatcccgttacaacgacaagctgatttctcggaatggttacatcaatattttttaagttatgtgctctagcaccttttacaacgataaaatccttgctcttactcacttttttcacccttccgcttttaattctaatagtaaatctcttagttcagctgcacgctcgaagtctaacgcttttgctgcttctttcatctctgcttccatcttcgcaattgtcttttcgcgctcttttttcgtcattttcttagaaggagttgcttcgtatgtttctgcctcttcagcagctgtcgttgcacggataacatcacgaacgcctttttgaatcgttttcggcgtaataccatgctcttcattgtaagcttcttgtatactacgacgacgcttcgtttcttcaatcgcaattcccatagatttcgttatacgatctgcatacataataacgcggccgttttcattacgcgcggcacgaccaattgtttgaattaatgaacgttctgaacgcaaaaatccttccttatcagcatctaaaatagcgacaagtgatacttccggaatatctaatccttctcgcaataagttaatgccgacaagtacatcaaatttaccgaggcgaagatcacggataatttcaatacgttctaacgttttaatttcagagtgaagatagttaactttaattcctacatcttttaagtaatccgttaaatcctctgacattttcttcgttaaagtcgtaattaatacacgttcattttttgcaatacgatcttgaatctctcctaataaatcgtcaatttgcccttcaattggtcgtatatcaattggtggatctaaaagccctgttggacgaataatttgttctattacttctggtgactgctctaactcgtacggtcctggcgttgctgaaacgtaaataacttgattcgttttctcctcaaactcatcaaacatgagcggtctattatctaaagctgatggcagacggaatccatgatccacaagcacttgtttacgtgcttggtcaccgttatacatcgctcttacttgtggtactgatacgtgcgactcatccataacgattaagaaatctttcggaaaatagtctaataacgtatacggcgttgcccccgctggacgaagtgttaaatgacgggagtagttttcaatacctgaacaaaagcccatctcgcgcatcatttctaaatcataacgtgtacgttgctctatacgctgcgcttctaacaacttaccgttatcatttaactcctttaaacgttcttctaattctttttcgatattttcaatagcgaccttcattttctcttcacgtgtaacgaagtgagatgctgggaagattgctacatgatcacgttctgctaatacttcacctgttaacgcatttacttcacgaatacgatcgatttcatcaccgaaaaactcaattcgaatacaatgctcatcaagtgatgctgggaagatttcaactacatctccgcgtacacggaatgtaccacgcttgaaatcaatatcattacgtccatactgtacatcaacaagttcacgaagcaattgattacggtctttttccataccaactcgaagcgaaacaactagctcgcggtattcttctggagaacctaagccatatatacacgaaacactcgcaacgataattacatcgtcccgttcaaataatgcagacgttgccgagtgacgcaatttatcaatttcatcattaatctgcgcatctttttcaataaacgtatctgtttgtggtacatacgcttctggctgataataatcgtagtaactaacaaaatattcaactgcattattcgggaaaaagtctttcaactcactatataactgccctgctaacgttttattatgagccataacaagtgttggcttttgcacttctttaatgacatttgaaatcgtaaatgtcttacccgttcctgtcgctccaagcaacacttgctttttctttccactattaattccctctacaagcttctctatagctaccggctgatcaccttgcggggaatacgctgagacaatttcaaattgacgttccaagaaaatccgacctcctcataaaaatctgtattattattttaccacgaatacctataaaaaacctaaaaaaacgaacagatattcggtaaagttttcgacaatatacacatagaaaaaggaaggagtaaatacttccttcctctactaattctattttttaggtacatatactaagtcatatccattgcgcccagcttcattcatacaatctattaaccgataagtacttcctgattcgcgctgctctttaacaatacctttacaactatctttatgtaaccctttatccttcccagcaaatttgtcttttctattatctgacacataaaatatatcgttcccactatactctaacgtttgaaaaatcgggtccccttcaagggtatactgtacaattcttattttatcaacttccctttgctcgacattcaaaacgaacttttcaaatttatctagattgagaattcctgctccctttacaatgacatcattcttcttatcaattgtagtgctagatggtgaacatgctactaaactaaagagaaatagacttataaaactggttctttttcctattgtcatcctctcctataaaaattatttgtataccagaaaagctactttcaattatgaaagtagcttttcttttcctttctccttcttcggaaaaatcacatatgaaaatgaaatcgctgtatcaactaaaaatataatcgcccacacttgactcacgcgacttgcagctttatttaaaacgattcccgattctaaccaattaccccattgttcaaatggaataaatccatacgcgaagaaaaaaaatatgtgcacaccaacgaataaaacaagatgtaatacccaattttttatttcctgctttgcataggccatacctgttaattctacctgttcttcaataataggcgccggttcattacgccatttcgcaactgatttttgtacaaatatatcaagcttctttaaatcctttttcccgtagaaaactgcatataataaaatgattacagtaataatctgaaagttagagaactttcctgtttgataatagtccactacccctaaagttaaaataaatacttcatttacgaggagtacaatccccataataaaactcgcccttttcaaacggaatccgtagcgaagtaaaaagaaaccgatagctgataaccaaaatacaatttctgccccaattaaaaaataccaacgatattctgcgagtatactcatttatccttctccctttcatcataaatacgaaaagcctcatccatatatgctaaaagttcttcttcaattggatacatgctcattttctgtgaatcttccttcgattttctaacttcccataacttatctaaaaacgcttcgtcaccattagccatttctaaacatttctgcattaatttcttcgttgcctcttgtacttcatcacttgcgacttctttaccgtctttcataaaagtacgtaattgctttaataaatctacccattctaaaacattcggatcttcctcactcatatttggcaaattctgaagcaatttttgttcttcctttgaaaatacttcattttgaaatatttcacgtatacgaggggactgttttgaaagctgaataagttcaaacataactttccaatcaagttctccctctacatctaccgaataaacaactgcttgtaaaacacgctccattcgattaaatttcttttgttcttcctgtacaaaccgaagttgtttttcaagcgaattttttaaatccagctcaccttttactaacatattcgcagcttcttttaatgaaaatcccatttctttcaaaaataaaatttgttgcaaacgaataacgtcattttcactatataaccgatgtccaccctctgtttttccgctcggctttaataaatctatttgatcataataacgtagtgtacgtactgtaacccctgtttctttcgtcaattcttgtattgaaatcactaccatcacctcttccctctcattataaaagatgacgttacgtaactttcaagcgttttgtaaaaaaaatacaaaaagctgtttatacaaagtgtataaacagcttttatggaaataaccccttttgtatggcgcgcccacaaaataaaataagtgctccaacgacaacactcgttgccgttttatgataatgggctaataataataaataatacgataaacctacagtaccaatcataatacaaatgctcggcactggattacgagaaaagttttgcattccccaaagaagcgaaaatatagctgtagcgacacataacaccggtaatcccatcccagttcccctttttctatctattattccttgttgctaacacgctcgttgatgcgatactaattaataaatcaaaaccaatccttatatatttaaacgtttactctaattgaaatctctcaagcttatcatttattttctttctccttactccagcgtaaatatttcctccaccttcactccaaaatacttggcgatttttaaagataactctagactcggattgtaatgatggttttcaatcgccactatcgtctgccgcgtcacttgcatcgcctttgccatttcaacttgcgttatatgattttgctttcttaactcttttattttatttttcacacccataggctccaccttcaaaagtaaagatatctttacttaaattataaatattttccagttataagtaaagatacctttacaaattttagaaaaacgtttcactgaacacctactctaataaagtacaagagtaattcaatttatatcagcgcaacttaaattatatcggcgatttcccaaatatatcagcgcaactccatttatatcggcgattttttaaatatatcgacttaccgacaaatatcgacatccgtagcgctactataatcataagaaaaagctgtccccaaataccttcgggaacagctttctcctctactacataaatcctagcgcatatacaagaacgtatccaagaaccgataagcaaaccgagccaatcagccccgccacgaacgctttgcttcctaacttacggaacgttttaaactctacatttaaaccaagtcctgccatcgccattgcgattagcatataagcaatgacaacaatgtatcccgcaactacttctggaataatcccgagcgaatgcactgcactcatcgctaaaaatccgaaaatgaaccatggaattggaaggtcgcgccacgatcttttttccttgcttccttcactctttccaaaccataatccaattaaaattgctactggtacgagcattgcaacgcgcgttagcttcacgataactgcgatgtctatagccgtacttcctcctggcgccgcggctgcgataacatgagcaatttcatgcagcgtggcccctgagaatacaccgtaaccatatggagataggccaagcactggatataacaacgtataaataagcgtaaatatcgtacctaaaatagcaataattgcagccccaactgccgtttcatcatcttttgctttcacttgcggcgcaattgccacgaccgctgccgccccgcaaattgctgtaccacatgcggttaaaatcccaagtttcttttctaccttaaatactttcgttagtccatatacaacgaaaatcgtaaatgtaataacaaccgctgcgatgaccaatactttcggccctgccttcgcaatatcaacaagatttaatcgcattccaagtaagatgattccaaagcgcagcaaattcttactcgcaaagttcgtccctgcaatcgcatcttgagggactccaattgcagcgcgccaaaccatcccaattagaatagcaattactaattgtcccataatatttaaaaatggaagctctgctaaatatttcgcggcaattgcgattaataatgtaatcccaattccttgcgaaaatccaaaacgcttcttcttttgtataacaagtgtttgttccattttgaaccactccaataatcgtattggaacatgcatgttctttctacttacattataagagagtttctataataagtttaataccaataccaaatctctatcattagaaatacttatgataagataatagaaaaagaaaggagcccattatatgaacgtagacattttaaaaatttttgttactgtcgttgaacagaaacacttctcccgtgcagcagaattattaaacctttcacagcctggagtaagtatgcatatacgcaacttagaaaacgaatttggcactacacttattcaacgctccccgaagcacgtccaagttactgaagctggaaacatattatatatacatgcaaagcaaatgctctctctttacgaagatgctaaacaagaaattaatgaactacataacgttgtaacaggaacacttcgcattggtgctagttttacaattggcgaatacttacttccaaaaatactggctaactatgcgaatgaaaatccacacgtcgaagttcatactttcatctcaaatacagaagacgttttgcaaagccttcgctctaatcaaattgatatcggcctagtggaaggacaagtcgtatacgccgacgtagatgttgaaacatttatgcaagatgaaatgaagctcgtcgtcccgccaaatcatccattactccgcacaaatgaaataaatgaaagtacactccaagatcaagtatgggtattaagagaaagtggttctggtacacgcgcttatagtgaccgctttattcatcaacaccatttaaaaatgaaacgattctttacattcagtagtatccaaagcgtaaaggaagctgttagtgccgggcttggcatcgctatcctttctgattggactgtacggaaagagctattagcaaaagaactattccacgtcgaagttccaaatgaacaactaatccgtccgttctccatcgtgcgcggtaaatatttcattccatctaaagccattcaagtgttcttaaatcatgtagattcttttgcgaaaaaacagagttgaccttcacattagtgtgaaggtttacaatacatgtaaaaggagtgaaatacattgcgaattggagaattatcaaaagaaactggcgttagtgaaagatcactaagacattacgaagaaaagggcttactcccttctaagcgccttgcgaatggttaccgtgattttgatgaaagtgccatcgaaaaagtggagcttattcaaatgtacttacaaattggcttaaatttagaagagacggcaaggatgctgcgctgccttgaaattgaaccgcacctgtacgacaatccgtgcagcagtatccttacgctttacgaagataaactcaatgaagtaacaaagcaaatctcattgctttccaacatccaaacgaatttgcaaaaacacgtttcactcctaaaacatgcaaaagaaaagggatgattacatgtttgttatacatggcagttcaagacaaaacggaaatacagaagctttaacacatatgatgatagaggacattgaaacagaacaaatttatttgcgtgatcatactgtctatcctattacagaccaacgtcatgatgcagaaggattccaatccgtaaatgatgactatgagcagttaacgaaacgcatgctagaacacgacacgattatctttgctacaccattatattggtacggaatgagtggacatatgaaaaattttgttgatcgctggtcacaaagcttgcgcgatacatcccttcatttcaaagaaaaaatgaaaggcaaaaaaatgtatgttgtcatcgttggcggggacaacccaaaggtaaaagcattaccgcttattgctcaattccaatatatctttgattttgttggctcttcatttgaaggttatgttatcgggaatgcgaatggactggatgaaattaaaaacgatgctgaggcgctggcaaaagcacaattgtataatgatacattcaaaaatagcgaacagaaataagtttgacaaacccttttgtatgcgcatacaataaaagtaatattatgaaaggaaggtactttgaccaatgaagttctaattctcttatttatttcatccatcacaaatagtgaacaaaaatgatgaaaactagcaggggattagtctgtccatttgtcgatactttctttcgaaacgatcatgtaaaaaatcgtttatttatgtacgatttttttacatacaagggcgacgtttatcctctctagtgaaactagggaggtttttttatgactattttattcgcaagtaatattgaaaagagctttggtgatcgcacactatttacattaccatcactggaaattcaagcacaggatcgcataggaattgtcggagtcaacggagctggtaaatctacgttattacaaatattaagtaaagaaatagaagctgacagaggcatagtaactcatcatagttctatcagcatcattcctcagcttagcgaagaactaccggaaactgcttcttctcttgcaaaaggaaaatggagtatttcaaacgttaccgacgcaatgagcggcggtgaacgaatgcggctaaagatcgcccatgctctcgaacaaaatgcaggcattttattcgctgatgaaccaacaagccacttagatatggtcggtacagagcaattagaaaaggcactttcgtcttataaaggagcacttgttttaatatcgcatgatcgtgaatttctagataatatatgtaccaaaattattgaaattgaagacggtactattcaagagtacaaagggaattattcaaactatcgaaaacaaaaagaacgtgaacgaatacaaaaacaagcagaatatgagcaatatgtacaagaaaaaaatcgtttagaacagtccattctacaaagaaagcaacgtgcttctaacatgacaaaaatcccaacgcggttcagttcatctgaatctagactttataggttaagtggggctcatggccaagaacaggttagcaaagcagcgaaggcattagagacacgtctcgaaaaactagaaaagaaggaaaagccaaaggatctttctcaagctcaatttgacgtgcaataccatactcccattcatagtaaggtggcagtacaattcaataaagcaacaaagaaaataggcgaccgcacactatttaaaaatatgaatggaactattgcccctggtgcaaagcttgccgttttaggggcaaatggaagcggcaaaaccactttgttcaacatgcttctcacaaacgagcgtggcatgcagctatcgaaaagttgtaaaattggatacttcgaacaaacattatctattttaaaaacagataaaaccattttagaaaatgttctagaagaaacaaactatacagaagcattcgttcgcacaatacttgcacgacttctattccgccgtgaggatgttcataaacctgtgcatgttctaagcgggggtgaacgaatgaaggttgcactcgcaaaagtatttttaggaaactataatatgcttctgctagatgaaccgacaaactatttagacttagcaacgcaagaagaattagaaaccatgttacaagaatatcctggcacaatacttttcattagccatgaccgtgcctttattcgctctgttgcagaccatattctacaagtagatgagagtgaaccaagaatcttccacggtaattacgagcaatacacaaaaagaaccaccggagcttctgtaaacgctactgagcaagaattgttacgattacaaacaaaattaacagaagtcatcggccggatttccattccaaatcatcacgatgacatcacatctctcgaacaagaatacgcaaaattattaactcaaattcaaaaatgtaaagaagcgctctaatgtcttccctatatatcgacggggccttccacatttcccaagaaatattgaaacttcgacatacaaagtaaaaagccgtgcatcagcacggctttttactttatatgcggacagcagtcccgctcaccgcaaccattaacataccttcgcgaactacttcgtaatccacgtcgataccaacaattgcatttgcatttttttgtcttgcgaaagttttcatctcttccattgcgatgtcgcgtgcttcttttaatttactttcataagcgccagcacgaccaccgacaacgtcacgaacagaagcgaaaaggtcacgaacgatattcgcacccataatcgcttctccattgacgatatcgatatactcaataatttcttttccttgaattgtagacgttgttgttacaatcatactttatagcctcccatatgagatttttacctacttatggtgcactaattcagtacaaattatatttacgaactaaactgagcttcgtataacctactgtatcctccgccttgctcaattaattcattatgtgaaccttgttctgcaatgccatctttatttacaacgacgatgcgatctgcatttttaatcgttgcaagtctgtgagcgataactagcgttgtgcgaccgacagctaattcagcaagcgatttttgaatcgcaagttctgtctctgtatctagtgcagaagttgcttcatccaatattaaaattggcgggtttttcaagaacatacgagcaatagctagacgctgcttttgtccacctgaaagtttcacgccgcgctcaccgataacagtatctaaaccttccggctgtgagtaaattaaatcttctaactgcgcacgttttactgcctgccaaatttcaggctctgatgcctttaaatttccgtaagcgatattttcacgaattgttcctgaaaataagaacacgtcttgctgcacaattccaatttgcttacgaagtgaagataatgtcatatctttcgtatcaatcccatcaatttgaattgatccagatgattgctcataaaaacgtggtaataggctacataacgtcgttttcccagctcctgatggtccaacgaacgcaaccgtttcacctgcatgtattttcaaactaatgtcatttaaaattggttctttattttcatatccgaacgtaatgttgttatattgaatatcaccatgtacatgtttaacttccattgcatctttagagtctacaatgtcaggctctgtttcaagaagctctacatatcttttaaaaccggcgattcccttcggatagctttcgattaccgcgttaattttttcaattgggcggaagaaaatattcgttaatagaacgaatccgataaatccaccgtacgttaattctccttgcagaacaaaccatgtaccgcatattaagacgaagagcgttacgagccgcatgagcatataactaatcgatgaatttaacgccataattttatacgccattaatttcgttgtacggaaacgagcgttgttgacagcaaattgctctttctcaaacttttcatttccgaatgcttgtacaacacgaattcccccaacattgttctcaatgcatgcattaaaatcagcaacgtctgagaataaacgtctaaatgtacctgtcatttttttattaaagtaaagtgctaaccataataggaatggaatgacgaagaacgttaataacgctaacttccagttgatcatcatcataaatgagaatgccccaactaaagtcattacggcgataaatagatcttctggtccatggtgagcaatttccccaatttccattaaatcgtttgtaaggcgtgaaattaaatgaccagttttattattatcaaaaaatctgaatgatagcttttgaatatgatcaaataatttctgcctcatatctgtttcaatgttaacaccaagcatatgtccccaatatgtaacgacatattgtaagcctgcatttaacatataaactgcgagtaaaccgaaacaagcccataaaataagcgtccagttttgccctggcaataacttatcaataaattgatttacgataagcgggaagccgagttctaataatcctgcgacaaccgcacaagaaaagtcgagtataaataaacctttatacggtttatagtacgagaaaaatttacgcagcatatcttacctccattttccaaaattaaaaagactccctaaatgataaccattatcaaataattattcaagttatccgtctatgaaactgaaaataagctttgcgatagttgtcgttttttgctggaaagtcgatatattcgaataatcgccgatatatttcgagttgcgctgatatattcggataatcgccgatataaatttcatttactaactacccttcccccaaaaaaacaaaaaaggtatcaccacaaggtgatacctctccttctattacatcgcttccgaatcccactcgtgctcctgctcaacgaatacaatacctaattcgtgatgcccaccaacatataatgcagtttgtgcaagacgaagctcaccatttgtatctaatacttctaatttacaaaatgctcctgtcgtcttcgtttgaagcgcatcataaaattcctcggcgctttttggaatgactccatttactttcgtaataatttctccaggcagtaattttagctctgctccaattgtatttggaattgtatctagtacaacgagcccatcattgcgtgcagcaaaatatgctggtcttgtttcatcggcaattttctcttgcatcgagattgtgaaacgcccaagcattgcgactcccatcgcgataattgcaagtacgtgccaccagtaacttgcgactcctaaaacgagcacaagtcctgctaatccataaacacgtcttcctgtaaataataaggcttccgtcggctcataacttttaatctttctcataaatccaattaaaaatggaacgaggaatagagaatatgtatttgaaccgattgaaacgacaggccaccatgaaataaactgcgttaccgcatcacccggtacaagaataaaaataggaacgatccataaacgctttgattcgtgtaaaccaatctttaatccacgcttccccttcctaatcctcggcgtcgaatatcctactgcgtttttagaaatcaataagccttctacaataagcataacgcctagtaaaataacaagggatacaatggtactctcttcaccttctcgaagctgtaaaaaggaaactggtagcttagaagataatagaacacatacaatcgcaatgctaaatgtataagccgccgataaatatcgatacatagccgttaatccaaatagtaacgtccaaattaaaatggcccataagctcgctttagaaacaacaagtccaagcccaatcgtaacaatagatactactaatccgtatccaatcccttcaaatagagaggttcgcagttcaaaccaaatatcataaactttaaaagaaaaatcttttcgttctcttaacatacgtaagtatccaacgaagatactacttattacaaatatatagacagcagggtgtaagaaaaaacgtccaactgcccgcattatttcaaaaatccacgcctccatgaactcattcaccaccatttatatcattctttctttttatattatcataactaaacaaacgtttgtttaacacaaaaaaatacaggcagcaaactgcctgtatttcttcttattttgccattaattttaatgctgactgtaattgtagatcattttctccagaacgaattttttcgataattttagtttgaatcgcttcagctgtctttttatcaagctgtcctgtcgcttccatctcatttgcattttggaatgctttcagagccgattctgtctctttactaaagtatccatcttcacgacctggtacataccctaagctcttaagcatttcttgagcatgttttacttgtacatcatttgaattgtatgaaagtgttttttcaatttgaattggtgtcgcatgataataatttggttgcttcacttctactgttggcgcgattccttttttatgaatccagttcccatccggtgttaaccatttaaacatcgttaatttaatgttgctgccgtctttaaatggaacagcttgctggacagtacctttaccaaatgtcttttcaccaattaaatcgtatccttctccttcttttagcgcacccgctaaaatctctgaagcagaagcacttccattatcaattaatactgaaattggatatggttttctctctttcagttccgtagagaatttcttcttctcaccatttcgctgctctacttgtagcatcggctttttattcgtcataatttcccctagtatatcttctacactatttaaatagccaccaggattaccacgtacgtcaataactaagccttttatatttttcttctctaactcttttaactgatccttaaattctttcgctgtattttcagcaaaagaagtgatttgcatataaccgatatcttttccactctcttgcttcacagaactaaatactgtaaagattggaatcttttcacgcttaattttaaatacgatcggatcagttactcccgcacgtttaatttcaattgcgacagtcgttccctttttaccacgaatttttaatactgcttcttcacgtgataagtctttcacactgtttccatctacagataaaatttggtcattcggtttaattcctatcttttctgctggtgaacctttaattggcgatacgataataagcttaccgtccgtcttgttcacctcagccccaatcccctctaattcgggatcaagcgattcactaaactgtttggctgtttctttatccatatacgtggaataagggtccttcagcgtagacaacataccttgtattgcaccttcaactaacttttcatctttcacgtcttccacataacgtgaatcaattagtgcatacgcctcattaatttttgccaaattcccttgcgcagtgctagcattcccactcgaaattgtttgcgttacttctgatgggttaaccccaaatacagacatgcctgcaaacattccgccagcaccaattaaaaatgcaacaaccattccaataattgcaactctacgtttcaatgcggaattcccctttccaaaacacacaggtggtgtagcaaaaggcatcacacagtgtgtgatgcctttacctatttctactatatgataagcttgtacgaattatgtttgcaactttttatacttttaagaagcgacgaattgacattacacttccccacataccgattaaagcaccgattaacactagtaaaccagctaattggaatacgaacggactgtatggtagaagctcgaaaattgttccgccaagtttttcattaaacacaccttgcaacgaattatacgtaattagaattaggccaattggaataattgatcctaatactcctaagaataatccctctagcaagaatggccaacgaataaaccagtttgttgcaccaacaagtttcataatttcaatttctgtactacgagcataaattgtaattttaattgtattagagattaagaacatcgctgtgaataaaagaccagcaattaacgcaatcccaatgttacgaccagtttttacagtatcaaataatcgttcaacttgcccttttccgtactgaacattactaacaaactgcattttttcaaccttcttcgcgattgtcgctgtatcggttggctcttttgcttttacaacgaatacgtttttaagtgggttatcttgttcaaataactcaaacgtttttccactatcacctaagcttttaattaaacgttttaactcttcttctttagaagaatatttaatagaatctacttttgcaatcttactcatatcttcttctaatttcttttgatccgcttcttttgcagctggatcaatgtgtacacgaatctctacatcttgctctactttcgtcgcaaaatggttcatattcataatcgctgttaaaaagacacctacaagtaataatgtaactgttactgcactaacagaagcaaatgtcatccatccgttacgtgatagattctttacaccttctcgcaaatgtcgactaagggtcttagccttcatatccgtatcctccctcaatctcatctcgaacaatttttccgccttcaatcgcgattacacgatgacggattgtatttacgatatctgcattatgcgtcgccataacgatcgttgtgccgcgctcattaatgcgagtaaaaatattcataatatcaagagctgtttcaatatctaagttacctgttggctcatcggcaattacaacctttggtctatttacaattgctcttgcaatagccacacgttgttgctccccgcccgaaagctcacttggaagtgcgtctgcacgatcttcaaggcctacaagacctagcacttctgttacacgctcacgaattgcatccggttcttcttcaattacttctaaagcaaacgaaacattctcatataccgttaatttaggtagcaatttaaaatcttggaaaattacgcctaattgacgacgaaaatacggaacgtctctttctgccaatgtttcgatagtaagtccatttacattaatagatcctgtagatggtttctcttcacgatacatcattttaataaatgtagatttcccggctccactcggtccaactacgtatacgaattcaccttgtttaatgttaactgtaagaccagcaatggctttcataccattcgggtactccttataaacattcgtcatttttatcattatttatcacccaatacttaatgatttttttcgaaatacttttctgtacatctgaaaataaaagacatccttcattttcatttattcatccttgttgaaggtagtttacttatgctttctcataagcaataccactctatgtaatatatttcagcaaaattctacaaaccccattgtaacatcaaacggtttccaatttggatacatttttgttacagttatgttacataccagaaaaaaggaaaacgagttgactatattatcaactcgtccatttcaccttttttatttatgttcagctaaccattcagatacttttttcgcatcttcaccttgaataagtcctggtgacattgaaccgcggccttttttaataatctcttcgatatctgcagcgtcgtacttaccgcctacttttcttaaatcaggtccagttgcccctgataaatctgttgcgtgacatcccgcacaacttctttggaaaatttgttctgcgctgtctgtgcttgcagactgtttcgaagacttactctcttctttatttccgcatgctcctaaagcaaaaacaaccgatgtccctagcgcaatagccaacaatttctttttcacttctatcgctccctattgttgatattctttttattcctaacacactcattttcattataagcattatctttatatagaaaaactaaggtgtatttcatattcctcaaaaatacagtgagaaccttgataaaataaagctttcataagttgtttcaattctgtgaacaactaaaaaaacttctataaagtatcctttttaaaaggaaaattagaaaagttctatataaatctttaccctattaccgctctattttactattctctactttttacaaaacaatatacagcattgtaatctacatataatcccatcaaaaagagaagttgtcgtttccaacttctcttcctctttacttcatctataaaaataaaatcaaattctttatatcctctattgtcctcagcatgcgccaacaatttcgttggctttttttcgcttattagatgcgagaacgtaagtaagcatcaataaatggatcaatctctccatccataacagcttgtacgttaccaacctccgtatttgtacgatggtcttttacaagagaatacgggtggaatacataagaacggatttggctaccccatccgatttctttttgctctccgcgaatttcatctaattctgcttgttgctcttctagtttcttttgatataatttcgcttttaacattttcatcgcatgctcacggtttttaatttgagagcgctccgactgacatgttacaaccgtatttgtcggtgtatgtgtaatacgaactgctgaatctgtcgtatttacgtgctgcccaccagctccacttgctcggtacgtatcaatttttaaatcttctgtacgtacttcgatttcaacttcatcattgaactctggtacaacttcacaagatacgaacgatgtatgacggcgccctgaagaatcgaatggtgaaatacgtacaagacgatgtacacctttctctgcttttaagtaaccgtaagcgttatgacctttaattaataaagttacactcttaataccagcttcatcacctggtaaataatcaaccgtttctactttgaatccgcgtttttcagcccagcgtgtgtacatacgtaataacatagaaccccagtcttgtgactcagttccacctgcacctggatgtaattctaaaatcgcattatttttatcataaggatcacttaatagtaactgaagctcatactcattcatttcttgaattaagccttttacttctgattctaattcctcatgtaaatcttcatcatactcttcttttaaaagctcatgcgtgatttctaaattttcgaacgtctcatctaactgacggaactttccaaccatatcttttaacgcattcgcttcattaattacagcttgtgcgccttgttggtcatcccaaaatcctgcgcccatcattttttcttctaattctgcaatttgtttctccttagtagggaggtcaaagagaccccctaaaagccgctaatcgcttagccattttctctaattcctgtctaatttctactaattccatttccttcacctctatgtaattgctgttactttcgtatgaaaacaagggaaactctctccacttattacggagagagtttaatccttcttaattatacatttttgatataaaagtttgcaaaacagccaaagctaccgtcctatattactgaacgataccacagcagtttttatattttttaccgctaccacatttacataaatcgttgcggcccacttggtcaccttttacaactggctttttctttgcttcttcgccatcactagaaggatgaacagcttcaccttgcacaacttcttgacgttctaagttttgttcaatttcagctttcataatgtaacgagaaatttcctcttcaatagaagcaaccattgactcgaacatcgcgaacccttccatttggtactcacgaagtggatcgatttgaccgtaagcacgtaaatgaataccttcacgaaggtgatccatcgcatcaatatgctctgtccatttcgtatctacaacgcggaatacaacaaccttctcaaactcacgcatttgctcttctggcataagcttttccttttcattgtatcgctctattaatttcgcgataatcggttcgctcatttcctcaggagcaaggcgacgtaattcttcttcttttacatctccgtcttgaagaaggtttgtatttaagtagtcaacaagacctttaatgttccaatcttcttcaatttcctcttgtgtatgaagggcaacagcacgttctactgtagatttcatcataccttcaataatgccgcgtaagttgtcagactccattacctcttgacgctgtttgtaaataacttcacgttgttgacgaagtacatcatcatattgcagtaactgcttacgtgcatcatagttatttccttcaacacgtttttgtgcagattctaccgcacgagaaaccattttactttcaatcggctgagaatcatccataccaaggcggtccatcattgctttcatattatctgaaccaaatcggcgcattaattcatcttccatcgataagtagaactgcgtaacaccagggtccccttgacgaccagcacgaccacgtaactgattatcaatacgacgactttcgtgaccgctctgtaccgat

SEQ ID NO: 1394 - DNA, 282 bp, Bacillus thuringiensis
aaggtgaaaacatattcacttgtttttaaacatcttttaagaattgcaccggcattacgtgatcaaccggaaatcttaaatttagaagaacccaccaatggaatagatccaactggtaatccgccaaattctggatatttaccacggttaaccaaagaagaaaaaattgctggaaaccgatcaaggcacttattgaggggaaatggaattaagggggaaaccccttggtattattaaacaaggggaaacttgtacaaaaagtacaactgtacatggaaaaaa

SEQ ID NO: 1395 - DNA, 212 bp, Bacillus thuringiensis
tattactcgattttcctgcttgttcagatgcttggcccattacgatgcggcctacgatgccgatcgtttgacctactttcatcggttgccttgcgccggcttctctgaataaagggattgcaagcactatttagagagcttcaattatgggcgggaacgggacttgcgctcttgataaaattaaaggttcgagcagatcactcggaataagt

SEQ ID NO: 1396 - DNA, 222 bp, Bacillus thuringiensis
caaatagaagcacattaaggcccgagcgaggtattccaggcggccaaagggcaaacacggaagaggacgaaaactacccaggctaagagaccaatacaggaccagactgaacaaacaaaaggcgcgagcacgcgaagaaagccggcgccgaaaatgcatacggtgacgagaacaaacccacccaagggaaagaccacagaacaaaaaaaggcccccaaaaag

SEQ ID NO: 1397 - DNA, 270 bp, Bacillus thuringiensis
cgctataaaccacatgcatggaccgcgaaaggggagagtgtagttccagttgggaacaccagaccggtctataaagacgcggacccggacgtcctggggcgaagaaccgcctctcagggggatggaccactccgtgaaccattaccctgatcaactttctcgctgccgaggggccgtggcgcgctaaatgggcaccctggagggagcccaggattaagagcgtgactcggtcagccctcggacgtgtgcacaaaggaatggaagaaagcg

SEQ ID NO: 1398 - DNA, 478 bp, Bacillus thuringiensis
ttaaaattggattatgagatattttaacttgaatgggggttatattatggcgaataaagtaccgttttcgttcatagtagttattggattaatgttatttgcactattttttggagcgggaaatttaatttttccagcgatgcttggtcaatcagctggagagaatgtatggattgctaacgctggatttttagtaactggtgttggattaccattactaggtgtactagcatttggtttttcaggtaaagatgatttgcagtcattagcttgtcgtgctcacccagtgtttgggattgtgtttacaacagttttatacttagcgattggtccgttatttgcaataccaagaacaggaaatgtttcttatgaaattggtcttaagccgtttatgcccgaaggagtaggttcttacacctttaattttttttcacaattatattcctttactatcaccctgtttttttttcgtttaatc

SEQ ID NO: 1399 - DNA, 122 bp, Bacillus thuringiensis
aaaattcgaagcaatgtcttttttccacaaccactagggcctaataaacagacaaactcattattgttcacagcaaaagaaatatcttttaactctgcaattgcatcaaactgtttatgaaa

SEQ ID NO: 1400 - DNA, 231 bp, Bacillus thuringiensis
gcaaatgcgccacaaagccaagatgccgcaagaggccgctatgactggggtaactggtatgctacgtccgcctgtcaagcctatcaagaatcggcgctcgacttggaggtgggggaagggctcaggtctataaagagtccaggcgggaccgactggagggtccatagagcgctctcacgatacgaccgtgccgtttacgggatacctggccatctttcttcgttcggggag

SEQ ID NO: 1401 - DNA, 239 bp, Bacillus thuringiensis
gccctaagcgattaaatatttttctccatgttcgtttaaagcctataatgggttctcacccatgccggcttccccaatgacagcgcgaacaccgaatttcttcctaatatcgacctggtacggttgttcacgagtacttgacgttggacccgccagcttaatttgtcaattgtcattggcgtctttcacatcaactggaccaccgggggtgaataacttgtccatataaatctactgga

SEQ ID NO: 1402 - DNA, 176 bp, Bacillus thuringiensis
tccgatagtttttaaatatatttttgccatgttcttcctaagccgcttgggggtgcttacccataccgggtattccaatgacagcgccattaccgattttctccataatatcggctaggctcggttggttacgaatacttgactatggacctggcgctttcaattagccaatagcc

SEQ ID NO: 1403 - DNA, 137 bp, Bacillus thuringiensis
  unsure (1)...(137): unsure at all n locations
cggaggctggnaacccgtttaaaataccaactagcgccactggatgagagacaacaacaccaaggaatccatcacctggacgcaccccaacccagttaaccataaaaccatcagcagcataccaaaccacaagacca

SEQ ID NO: 1404 - DNA, 276 bp, Bacillus thuringiensis
gaagctggctgcgaggttttagcttactttatctctctaactcgaaccgctgcagaatctggtgaaatggctgagtgaaatgaatcgggaacaggaccaaacgcaatcgcgttcagtaacgaggatgtagttgctcctgcgaaagtattaaacgacttcgctaaagatcatgaagctttagaaattaaagcgggcgtaatcgaaggtaaacctgtaacacttgatgagggtaaagcaattgctactcttacatcacgtgaaggcttactttctatg

SEQ ID NO: 1405 - DNA, 416 bp, Bacillus thuringiensis
cctttcctgttgcctcaattacctgtgttacacgatgcgttttctgtgcgactggtacacatgacgcgattccctccaatgctatggagtgaccggttgcatcaaagtcacgtgactaatgaacatctgttaccatggccatacagcgcactatactgcctggtacttctgtcattgcctgatgtggacagcgactagcccgatacccatacgagtacgtacagacctcagctccataaacggcttctactatgatttcttgcgctccttgtactacacgatctatgatacacgcattttgcatagttcgcctttcggccgtggtctccgtgatgactacttctcgagaggctataggatggtccatcccagccatgataattcttcgccggtacccgaacagaatgtgataacta

SEQ ID NO: 1406 - DNA, 281 bp, Bacillus thuringiensis
gtgagcataatctgcctcccattcatcatgttagatttaactttttggacctacttagacaaaacgcatcgctggaaagggagtggctacactaactaaaccgcctgtaattctactagatcctaaaggtgtctcggtccgatggagagctgacacaccatcttcgcgtcgatgtacattcattaatcactgataatatgtagtagcctccactgaatgtggttaacaggacttttgcattgtatcattgccgtccacaatcgtagatagtgcgcactttt

SEQ ID NO: 1407 - DNA, 388 bp, Bacillus thuringiensis
gtgaacgtcgaatggatctcccgtttgatgacgaatgtacatatttgcggcgtgcccagcgactatccaaagcgttttcatcaatagcgataagagccaatgcgtgctattggccatatctacgactgggtcgttcataactgatatgctcttattaagccggcaaccaagactcatgatgcattatactggttatacttcgcatgcatagcattgatcaaagatcttagcggagctgacttgaccatgggcctgtcttctccgttcttagagatccacattgatagacactgagcattcggctctataacagacgatgagcttcaaccacttgtttaactctgcattacgaactgacgtcttgagatattaccaagaacacactggc

SEQ ID NO: 1408 - DNA, 488 bp, Bacillus thuringiensis
cattactctcacgcaagaaattgtgttttttggggagagcctgcgagacaaagctgtcggtttagatgaccaaatgattcgccgcgctttaacacgaattagtcatgaaatcgtggaacgaaataaaggtgtcgataattgtgttcttgtcggaattaaaactcgtggaatttttattgcacaacgtttggcagaacgaattggtcaaattgaaggaaaagaaatggaagttggagagttagacattacgttatatcgtgatgatttaacactacaatcgaaaaataaagaaccacttgtaaaaggttctgatatccctgtagatattacgaagaagaaagttatccttgtggatgacgtattatatacaggaagaacagttcgagcagcaatggatgctcttatggatttaggtagaccatttcaaatccaattggcggttcttgttgttggaggtcattgtgaattaccaattcgcgctgattatg

SEQ ID NO: 1409 - DNA, 267 bp, Bacillus thuringiensis
gacgtgatgaattggctgtaattttaggcgaacttacaagtcaaggaaatacaccaacatatcctgagtggatttattgggagttgctgaggctgttgctgctggcgccgagtttgtaatagctgattccgccgaaaacggacgaacaccttctgacacaatgtgatctaacgtaagcggcgcccctttataccagcgagccaatgttgtcgccggtgaacttgcttcgttcatacccatacaaaatatatacataggctggtgttc

SEQ ID NO: 1410 - DNA, 397 bp, Bacillus thuringiensis
ggaccccgcaaagacgccccaaaaaaaaatagcactctaactggaataccaggggtagacagaacgagtaatcatatcacttgcatcctggaacggaaaaacaggtaaaatacggaacgtaacccgttaaacaaaagctacccaaccaccatgattaaatagcaagaacttgtaacccataaaaccgcacgctagcaagcatgaactacattcaagagacctctactgacacgccaacgctacaaacacaggagaatgtatcatcaataacaggaatcggcgtattcacatgcgaaaagccccaaccacccgggaagagatccggagcatgaacactccaatctactgtatgcggcgcagatatcttaggaaaacaactgcgccttgacaggagtta

SEQ ID NO: 1411 - DNA, 534 bp, Bacillus thuringiensis
  unsure (1)...(534): unsure at all n locations
ctgccatcgtgttacgaccaacgttannatcgatacgtaccattgcttctgctaaacggtttgcatcttcatccgttttcataaatgcacctgctccagtttttacatcaagaacaattgcatctgcaccagcagcaatttttttactcataatcgaacttgcaataagcggaattgagtttactgttgctgtcacatcacgaagtgcatatagctttttatcagcaggtgttaagttaccactttgaccgataacagcgattttgttttcatttacaagacgcatgaattcatcgttttcaatttccacatggaatcctggaactgcttctaatttatcaattgtaccaccagtatgtcctaaaccgcgtccagacattttcgctactggtacatctaaagcggctactaatggacctaatacagtgttcggtgtatcaccaacaccacctgttgaatgcttatctacttttacaccttcatagctgataagtcgattgtatcaccgctatttanattggcatcgtaaatcgc

SEQ ID NO: 1412 - DNA, 347 bp, Bacillus thuringiensis
cccacactgtggtctagagctggctacttacaattctttcttacaataatactcttaatatagcatatcccactttctttatacgttgaatgttagaattaaatgggggtttctaactaacaccccttatagtgttaacaacaaaacctacgtttgatgctccggaaccattataacctttcgaattttctttccgatatacattgcacacatcacctaagtcaaatgatccattggtatattctacaactaaaaatgctacaactgactgaataataattacctgctttatacataaccttgttaacattactataccgagttatacctcagattgtacatacaat

SEQ ID NO: 1413 - DNA, 235 bp, Bacillus thuringiensis
ctcttcttggagagggaactggaagtactttgctaagtgcacacgcacagaatggtaccggattcatgtagtggttgtaccgaaacagggatgcgcacacctacagcatagcgcgttgcatggcagacgggctggcttgtcgtggacatttcacacagacgtaatgttattgcgctttaacacgggaccttacgttatccactaaatgatatgggtgtcaatttaacgaaggcaa

SEQ ID NO: 1414 - DNA, 299 bp, Bacillus thuringiensis
aacttgatcatggcgaatacattatagcgcgaatctcttattgttccaaggccgtattcatcagccgccaccctatataaaatgaaagccgatgcgcaactgataggggacagctattgtaccactattgctaagacgcttggggcctatgacctaacactgctatggattggcgcgatcattggtacaagcgacctagtatttgctggatgcgattcatcgcgatatcctggacctgcagtgattgttatcttcatgattgccaccatcgtgtgcggatgtgcctcgtcttgtatctc

SEQ ID NO: 1415 - DNA, 169 bp, Bacillus thuringiensis
gaggaccggtaattacttaaatcactaggctgagtaaggtgctatattaaatagcgtgtagaaggaatactggcttttcatggttttgtgaagacataaaggctatcacctacagagctttgtggctaactccgagaaggttcaccgcgcttagcgagaagaactgtat

SEQ ID NO: 1416 - DNA, 508 bp, Bacillus thuringiensis
  unsure (1)...(508): unsure at all n locations
cgtgatcngtcattacaaggccttgctttacctggtctgatcttatgtgtattaaaccggaaaggaaaagctatcatttctcacaaaatggacatgctcttcactcatttcggcctatccggacccgctgctcttcgctgtagtcaattcgtcgtgaaagcactgaaaaagtttaaaacgaatacaatacaaatgagtattgatgcattgccagaggaaaatagtgagcaactatttcagcgcatgctgaaacaaatgaaagaagatccgaaaaaaggaattaaaaacgttttaaaaggttatgttcctgaacgttacttcctattcttattagaaaaaaatgaaattgacggtagcgaacaagctggacaagtttctcacgaaaagattcgtgcacttgtgaaagactttcaagagtctactgtgaatgtaaatggtacccagtcaattgaaaaagcattcgttactggcggtggtgtatccgtgaaagaaattacccgaaagaaat

SEQ ID NO: 1417 - DNA, 224 bp, Bacillus thuringiensis
ttttagaatgtagaagcccaccgcgcttaagggatcggttgagatgataacgtgggcacggacctacaatgggctctggatctatgcctccaaactaatagtacaagcgtggattccgaccaatgctttctggcattgtttgaattttctttacctgatttagaagccttaaaagccccaatttcatccaactcaatatcattcattttagagcccattcaagg

SEQ ID NO: 1418 - DNA, 515 bp, Bacillus thuringiensis
taataatcgaactccaccattcccatgcatgacctgcacatgctctcgctaccagggatatattttatgaattcgctgggagaggcataactgatgagaactgggccgtctacactttaccgctaccataccacttgttatgatgccttaccactacgcgctccagggcaaatgtgaactcgtcccgcgatacatcagactgagccgcgctggccccgcgctgatcactcgccgtttgatgcctggactatactgaatgtgcctgctacatatcacatggcttgaaatgaaccgcatccacctactcatgatacaaaagagcgctcgtatatcactgtgcgtacgccggataagaatgacttaaatcggcagaagatttgacgatacgtcggataaaatacgaaatgttgagatgacagctggtacatgctctgcttgatgttcgactaatgctacagcagtaaaggaaccgtcttcaaaagcatcactatactgtgcagtaggctcaactctgc

SEQ ID NO: 1419 - DNA, 436 bp, Bacillus thuringiensis
ccgctgcatacgccgccgtactcggatcctccatacttgatgtcactgtaaatcaaggacgttgcattgctgccgaataccaagctaacgtggatatttcggggaccagcttcagtgaatcccgaaaaaatttacattatgctgagcaaatggcccttctctgtctttctgagctgcacgtgtaattccgtacataacatgcattactcatctcaagattgctagaagggaatcatcctgacaccacacgttaaatatcagcggagagacaaacggatatttttgtaaatacacaataattgctacgagcaattgcaccgtgctatactgttatcaagagatggtcgtaataacgaagcttaatcatcacctttaacgtgtgcaaggcttgatatttcttccggttccttacaaatgaccaacgtcttacgctaat

SEQ ID NO: 1420 - DNA, 348 bp, Bacillus thuringiensis
cctccgctgctcaagacgctcgacgacaacagataaatctcatgatgattgttgaaatgaaactacatgaacaaactgcatatggaaaggctcctgccagtgtctcggtgcgtgcaacaagttcctgtgcgcctgccatagctatcggcgggtctgaaaaatccgattatagctgtgtgttcgacaaaggaaccaatgcggagttttatattacaaccagccccttgaccctcgcggacgcctataacgtaccttacaacaatatttgcctgaccacccataatattggcatcttatggagcatagcgtcagaaaaacacttctataatgtacgagagttttattatt

SEQ ID NO: 1421 - DNA, 381 bp, Bacillus thuringiensis
ctggctcgacggcaacacagttacgtacgggctcacctgacgcttatatggctactattcctttagaggtacattacgggccaggctgcagcacctttgcttggtagcgatggattatacgaagtcggggttggcggaattacagatgctgctaccacgaatgattacgatacccgtgcatgacagtatgttttatcaatagtgcgagatgctcatacgtcgccaataccagccgattggaaccagtcgggatcgatataccaggagatgcacaaattgccgaggccaccattttatttactgcagaagctgataatccggggtccaaaccagaactcgtgccacacagcgcgaaactcatagaggtggctaaagcagtta

SEQ ID NO: 1422 - DNA, 309 bp, Bacillus thuringiensis
atccttcctctgttttttccgcatgttggtgatcacctacctctggaatattcgggtctcacatcaacagactactgctatatatggtttttgtgctgccattgggccgtctgaaacagactctgtcagaatattaatacggactgcaagcattgtcatacctggaggaatgctgccgcagttcggaatgcaaatcatgccgtctaaccagtgtgcatgcacgaccgagtatactgaatgtgcaaatttttctcgactcggaagagaatgacgactaccgatatgtcccatggcaatactcatggacaa

SEQ ID NO: 1423 - DNA, 167 bp, Bacillus thuringiensis
tcttgtgacaagggtgacagaaatcgacgctggggtcataagtggagaaactggccaggacattataggtgccaagcgtttgcgcctggaagcttgctcgggcgctcttgtgggccgaccctgacggttaccggacacctggacgacattctccctttgggaagcgt

SEQ ID NO: 1424 - DNA, 491 bp, Bacillus thuringiensis
gcgaagcaagcttgccaactcagatttatctgcgtggaaagttgcttttccttagtcatgtgggtcttgattgcgggaggatcatgttacagtcagaccttggcacatgaacggaaatggttgagacatgtatcattatgatattactatcacgtagcgagggactttgactatgcaaaggttggttagattcggagtacgagagatttgtagggtaaatagcattaggacctaatagcacgaaacacattacattatatggacatacgaggtcagatccgctcgggagtggagatcaaatcatccaatcattactagccactgtaccaggaggataaattgtattcggacttggacatagtccactaacagacatttatcttcctgcaccaccaactgacgatatatttgcgaactgattcgagggattaagcaatataggggggtcatctggggagagaagagttactccattatcattgctcccgatt

SEQ ID NO: 1425 - DNA, 423 bp, Bacillus thuringiensis
atcggatcccccatgcgagatgtacgatcccccctaggaacatagagaacgcaatgttttttatgccggacttatctccacatggtaacacaggggatatggagcggaacactgagccgatgtcttccgatgattaatagttgtgcgcgcatatctacctgaaatacattcgtacctgtatgtatgactaattgaagttagagacatgacatcgtgcgctgacactcctccggtgtaaacaataaagatgacatgcattacacaaattggagctacaccacttctataaccacggaggcctgttttgcctactaaatgtcctgccaaatgtggcattggatctcgaaatatacttcctgcacacaggtgattgcatgtgcgcgtatcacggcggcaggctacattattttgcatgctacggac

SEQ ID NO: 1426 - DNA, 212 bp, Bacillus thuringiensis
acccgtttttttgaattgttaaaactggtggttgggttgtttgaaaaaaacaggggggggaaacttatgcatatcgaacaacatctgcatatgaaggcgctgaagctggagctggtgtatccattactaaagaaatggatacacggttacttgcagcccctcatgtcggaggacatgcgttaaaaggtgcaatatgtacagcttattggtta

SEQ ID NO: 1427 - DNA, 442 bp, Bacillus thuringiensis
cggggatgtgcgttaacctatcgagcatgtgataacggcctggcgctattgctacaacatcaattttatcagacgtttggcaaccaatgatgccttcatcggtcgctaccttgctttgtactgcacaaccggccgcttgaaaggagaacatgctccattcagagacagctttatcacctcattggatgacattggatatggccccgtttctcgctgggtatttgcaataaatacctgatggttcgcggcatttcataccaacggaatcgtttacagtctcaccacgcttcattttccccactggtgcgacgcaccgatgactgcgaggcatgtggagcatgagtgccagagttgctctgaccacagactagtttgtcacatctttgcgtgggacctctcctccagctactcgcagtatagacgctcactgcgtacttattta

SEQ ID NO: 1428 - DNA, 186 bp, Bacillus thuringiensis
cgaagggactatttagactgttcgatttttacttactcataataagaccctgcgagtaagacgggtgatatgaagcaagatgatttgaagccagggatagcaatatggactgcatatggtactgtaacgtttgttttagccatgcttgcattgagtgtaaacgaacctggaatgttatgcaactgc

SEQ ID NO: 1429 - DNA, 249 bp, Bacillus thuringiensis
tctaatgcctcatcaagtttttttgcctacataccgtacattaaacggagggtttgacactcgacgttcatcaatcggcctgattcacgtggagtcacaatacagcatcgcaactccttatttacctgcacgaccaagtacgaccggtaccgagaacgtatgattacggatcttgaggaatattgaagatttatacgggccaaacgactgaattcctaagaccacgcgacctttcgtctgttgcaacaa

SEQ ID NO: 1430 - DNA, 255 bp, Bacillus thuringiensis
atatgtgtcttcgagctggcaatcgtgcgccacgggggggtatgttagcacgagcgcgtgctcacccatgacggtgaactcgccgtcgttcgtcgcgccgtgcacgctcacgtattcgcgaaatacgcagcgctcgccgatgcgcacgcccggcttgccgcccttgtatttcagatcctgcgtcttgccgccgacgcatgcatacggaaacacctcgcacgcgcgaccgagcaccgtgttgccctccacgcacgc

SEQ ID NO: 1431 - DNA, 507 bp, Bacillus thuringiensis
aaccattcctccggtattactcccgagttgaatttaataacacgtatcttattgagtaattcagtagtctatagctccattttttgctgtactatcagatcatgtaactgtgattggatgttgcgccatgttatgaaaacgagcggtcggagactgagtactataatgaccccacgcgtgtgacaaaaacgggtttatagatgtagtcattgggagatttaacacatgatggtgccggtgatgcgataggcaagggctatcctattatccttaaaaacggaataccaggtgaagaagcgcaaattcaaattattaaagtgaagaacaactctgcattaggatgttaaatgaagtttcatacagaatgtccatatcgtaaagatgcagtatgctcagcatataatcagcgcggcggttgtgaatgttagcacttaacttatgaaggatcgtccctggggatagaaaaacatgttctggacgtaatgcattgcattggccgactagggt

SEQ ID NO: 1432 - DNA, 210 bp, Bacillus thuringiensis
acatgctgcgtactcggatccagaagtagccagataaaaggatggggcatacgcttccaagataatggaataggagaagagagcgtatacccaaacgacgaacaaggatctcattatgaggcagatgggaacggatttatcgtattaccagactgagttgattttacgaaagataatactgatatgtataaatattagaagacaaaaaaa

SEQ ID NO: 1433 - DNA, 349 bp, Bacillus thuringiensis
agagaaggcgacagtgcacatgctggttctgtttgagcaaccatagtctctgatggaccaagaggcgcaaagtgactggatgctggaaagaataacgccagggattgtttggcacgatattagccgtgattaaacgaatactgtaacacctgatactgcctgatgggggcagtcataacttagcggaggatcagctcccatatttgttcagtcgcaatacggtgaccacacagaccaggttgcctgaaatgtaagttcttctatcactttatacattctgcatacctattatggtacgacaccttcacttatgacgctaccacctacgggatcagatcaacatactaga

SEQ ID NO: 1434 - DNA, 352 bp, Bacillus thuringiensis
tttctttaacaagcccaaaaacatcattccgaggagcattataaaaacgcggggtttaacaacaaacattactacaggaccgactacatgtcgctactcatttacgatgtacccagtataataaagcgcttgaatgacccattatgcacccatctatccaagcaatacaaattgcaaaaatggcgtgcattaacaaacctgtatttatatctgtaagaaccactctcttgttcacaaagcatgatccatgtgcgcacataccggcagcatgaatgatcttacagaatacactggatcattaaactatggttcatcaagatgataaagcactccaacatccccacacaaacga

SEQ ID NO: 1435 - DNA, 243 bp, Bacillus thuringiensis
  unsure (1)...(243): unsure at all n locations
aggggggaaacccccaacaaaaggtccaaaaaaaattttttttgggcgccgaaaagcgnnnaaccggggggggtataaacaaaanagggccagacacaagcggctgcccgattttcacaagcggcgtcacaggaacaccgccattctcaaagcggtggtcgaaaaaatacccgccccgcttaatcgcgacgaccaaccatgctgagaaggcataaacaaccgaggccccaaccccgggccaac

SEQ ID NO: 1436 - DNA, 423 bp, Bacillus thuringiensis
gttttttaagcaggagaacatgtttggattggatgagtagggtatattatggcggcaacaggtcttcctatattaggggttatctctattgcaaaagcaggaagttttcaaacgttagcgggtagggttcattcttcatttgcaattatttttccatgtatcgcgtctgtatttattggacctgggcttggtataccacgtgcggtaagtttagcttttgaaatggggccaggtcatttattccctgaagcaggaaacggattattattgttttacacagggattttctttagtattgattactgggtaagtacatccgcatctacattaatgcggttgttcggaaaagtgtcgacgcccctattatgacctatgattgcactcatttttataaagagcatgcttacgacgggcgtagatatg

SEQ ID NO: 1437 - DNA, 418 bp, Bacillus thuringiensis
cgtgatgacggtgaatgaagtgaacaacttcttttccttttaataatgccatacatggtgaggaggggttgtatttatccgaggttttcacacatttttgcaggagcatctttatcttgacctgcgaatacagttacaagatgatcaggttgtttttcagcacgaacaaccgcttgacctgctgatggacgtgctaaaccagctgcacaaccacaaacagagtttacaactactaaagttgtacctgatgtattttccataaattctgttacagcttcttctgtagttaactcttcaaacccagaacgcactaactcttggcgcattgggattaccatttggcgcatgtattcttcataagcatttgacatcttggaatttctgcttcaactttattccaaattcataatattacgct

SEQ ID NO: 1438 - DNA, 270 bp, Bacillus thuringiensis
tggtaatgaacggtttcctaacagcctcgttccataagcgatagaaacaacttggggctcttattaaagcttttgtcaattctggctctggagctaagtgtaagtacgcgaacaagatcaagccctcactgaagcgtctgcacccgcttccaattggtcccctaactctcataaccactcccatgccccaagcctccttcagctgcctcaacaactccctgctcccagctcccacatacctgcgcgctccgcgaatcccagaccctaaac

SEQ ID NO: 1439 - DNA, 379 bp, Bacillus thuringiensis
aaacggtgcatcactcaaaccatttgcttctgaccctggacgcggcccaccggggggggtatataaaaatacgtgggttacagcagcacaaacaagtgcgaacataggatgtacacgtccagctagcccatcaatatgtccctggaaagcaataacaactactagcaataaaggacgcccaacgcctgttgcgataaagccaaacagcgcgaaccatacgtgcgttcacaacaccttgccctaacgcaggaggaaaaatcatatgacctgcgccaaaaaacagtgcaaacaacagagaacttattgcacgcatatgcgaaaacgtcaaagatgacttcattcccactaaccatctaaaatgcttcataaacaaaatatg

SEQ ID NO: 1440 - DNA, 316 bp, Bacillus thuringiensis
agatatgatttggcgcacgataatgattcgctaggggcacttgaatggccgactggttgacatcaactaccactagacgaattaacggtacaaacttattaatgagtgagccttgaatgtccgcggattgtactaatacaccaatgccagcaacatcaccctcaaactcttatagcgtactgatgataccttgaattgttatcgcagctgtgatgaagtgatgaagcattaaaacatgcgacccttctggaagactgctgtctagtaacgccattagctggattcaatgagactgacccgacacatagctcatgct

SEQ ID NO: 1441 - DNA, 328 bp, Bacillus thuringiensis
gggcgggtacggacgaccatttgactctaacacaccagtagtaactccagctgcgcatacgacattgccagaagtgaccttttaggatacgtcagggggtgcacctccactaaaaacggcaagacctgatccaccaatgaatgggtcacctggtacgccctctgtacaaaccgaatgtgttacccccacagtttttagaccgtcgtataaatcgatctccttgccagcaacgatcgtcacaggaagaccagttaagaaagtaacaccgggcgcttctaggctaagaagcgcacgtccgaataagtggcctggtactaccggaaggatt

SEQ ID NO: 1442 - DNA, 280 bp, Bacillus thuringiensis
ctctgcgcaggattatatattgctgtgacggactatgagagatgtggaggaagatgtgaaggggaagctggatgatagcgtgaatgcactagcacatttgatctggggaccacttgatcgcttgtatatcacgttggaataggataagactagtgggaaggaagtgacaagctgcatggattataccttgctgaatccacatgaaccatagtataccatggaacaacctgaatattgagattgatatgcacactttagagaagagttactggattacttc

SEQ ID NO: 1443 - DNA, 441 bp, Bacillus thuringiensis
ctactgaagtttcaccgactaattttttttcagcggataatgatactaaagacgcccacgctaaagaacttcctaacgctggtagcgagcaatgacacactatgggtgtaggaatgctttatgctttaggcgcagttgtattagttactgaaataaaaattaaagcgctattctataaatatgaacataagaatgggagatctgcacatacatgagcggatgtacttgttgtatattgaccgagcatggagaggcgtcgatattgcggtcacatacatcaagtataatcttgtcatgagtaattatagtggctgctatcgggctctctttcactctgcgttagatcattacaacaagttgctgtgcgcagttagagttgaagcttgccgtgggctcaggcgctgagagcacatctgggtggtgcatgaacgcacgggcgac

SEQ ID NO: 1444 - DNA, 541 bp, Bacillus thuringiensis
gacttggttcgaatctttttgagctaacacaattagactcaattgaataggaatgtgcagcggcgccacagtgttacaagcatcatcaaatcgctttttcggtattgggcttccagttgagcttggtagtacatgcacagacgttgaacccaggattgcagtcatttacaaatacacgagtgtactgtatatagggagcaaaactagctgcagcgaataatgctggatcaagagcaacatgacgtgtaagagctagcgaaaatgataacacctgttgtagcacggtctgcatccactgcaacaggagatacactcagcgcatgcgctcgctcatgaagggcaccaccaagacctgcgccacgatgacgccctactggatcacttacatcaaggaatatgagacaaggagcatatctctctgcattatcagataaatcaacggcacatgatgcacacgcaccgacagacatgtttacaggtcagaaccactgatagagaaaattggacgccggcctcacctgcacagcagcggctaataaag

SEQ ID NO: 1445 - DNA, 248 bp, Bacillus thuringiensis
tgaagtgggcgcattttattcatggcggacgagcatatttagatggcacgggggtttgcatacacatggcagtgttatcgctcttgactgataggatgccaatggtgagtttggagatatagattttcacgttctaaatatgagtctgatgtgccagcggctggagcacaaatcatggatttgagccatcggcaccacttccctaggcgtgttcgccacatacttgctgataccacataatcgtctac

SEQ ID NO: 1446 - DNA, 542 bp, Bacillus thuringiensis
ggaattatgattccagttcaagatgtcacaaaacattttttgaatggaaaaggtttgtttcatattacatttgatgtaaaagagggagaagtatttggttatttaggaccgaatggtgccggaaaatcaacgacgattcgtaatttaatgggatttataaaaccgacagctggtaaagcgacaattttcggattagattgttggaatgaagcagcgaaaattcaaagggaagttggttatctaccgggtgaaatttcttttattgaaggaatgaacggattagagtttttaaaattaatgcaaggaatgcgtggattaaaggatacgaaaagacgagatgaactgatagagcgtctgcaatttgatgtgaaaacaccgattcgcaaaatgtctaaagggatgaagcaaaaagtagggatagtcgctgcatttatgcacgatccagaggtgttattttagatgaaccaacatctggacttgatccacttattgcacaagtgtttattgatttaatatttgaggaaaagcacagaggaaaaaca

SEQ ID NO: 1447 - DNA, 256 bp, Bacillus thuringiensis
tgcgcgtatagatgctgaacctttcttttttgtctctacctaaaaatcatcggcccggactgttaaatatgcgggctagaataacagtgccaaatgatcttttaagggtgtgatgccttcagccataatgttcctcatcagcccaatgggctttaaggaacacggatttaatctttttacatgaatcaatacacctacctggcgcacaattattttttatgtgctttttcccttctttcagcgcaccttttccttt

SEQ ID NO: 1448 - DNA, 396 bp, Bacillus thuringiensis
atttgatgtgggcatctaaacaaacttatattgctttaggtaatatgatgacgagcgcagctcaaatcggtattgattcttgtccgatagaaggattcgataaagagaaagtagactctttacttcgtcaagaaggcattatacagggcgataactttgaagtatctgttatggttgcctttggttaccgtaaagaagatccaaaacgtgataaaacaagacagactatagatacaattgttgaatggattaagtaatgtagcacacacaaataatgctcctaatagctggatacttatactaaagaactattagtcgtttttcttatgtatgaatttggtttttcatggaaagatatattagtatgtatgcagtttgagcactctattttttaga

SEQ ID NO: 1449 - DNA, 388 bp, Bacillus thuringiensis
gcgtcggctctagaggcgcgtggacgcaaatagagaggagagactgtgcgtgatgaacgtgatacatcgctacgggtaccacacggtggagtgtgcattattctgacgaaaaggaggctgccgagaagatggaggggaatggccatcgggcgtgaatcaactggtgacgccatacatagtacaaaagcgtgacatttctgagggcgacaagatggccgggcgataccgcaacaagggggtctgttctggacttacaccagaggaagatatggcgctcttaccagaccggacgtcaccagagatcgtgctctacccagggggggtaccaacgcgtgggaatgttgttcaggtgttagcgcgagatgatgccatgcaagcagagagccta

SEQ ID NO: 1450 - DNA, 448 bp, Bacillus thuringiensis
cacattataagttttgggatcagaaaaggtaacgagaggaccaagggcccaagatacaaaatatttactaccctcgagagagcctttctcgttgtaatcacagtttaatacgcaagccttatctcaggcaggataggggatggcagggatgacaacgctttcagacatatcacaaacatgatggcaaagttacatatgtgaaatataacatacatcttctggagactcagtgtcgatcgatatgtgatcggtaacgagtgggatgaacgaaccactcactgattaaggtttcactggattatgttgattgggatataggttgctactgtgttacatagaaatgtttagaggtcgatatattactagaataacgagtgactttgaagtatatgaataataaccacaagggagtctgtggtacagactgacagtctgactcctagtccgc

SEQ ID NO: 1451 - DNA, 228 bp, Bacillus thuringiensis
gagaaaggggaagtatctagcgtacgtatgtaaacttttacgacgaggtcacacgcgccaccactaccgcctttaccgttaacgatacagctgactgttaccgaaaaagcattaaagtcagataggttgcggttaagagcgactctgtgtccaccgtgtttagctgcgttaacacggtaggatatacccgtttctggggatccgatttaaggacaagaaaacgttttc

SEQ ID NO: 1452 - DNA, 305 bp, Bacillus thuringiensis
caacattggaccctatgtttcttatttttgggctaccgccggtggttctaccaatagggggaggtttttctctttacttttcaatatatgcagcttgtttttattttaatccttcaacgatgtctgatagttcactccatctttccatctgtttttctagctcttcttctgttttctgctgtgcttcagataattcttgtgcctttgcgaagtcagatccaactttcgcaagttcctctcccattgactcaattttttctttaagttcggcaattgtccctttaatcgtttcccattcacgctgc

SEQ ID NO: 1453 - DNA, 278 bp, Bacillus thuringiensis
tgttaacttgttatgtagatatacgtttttggaaagaaaatcacgatgtaaaatgtaagatgtctatgtgcatttgaaaaagtgtagctcctacttattatggtatcgtttttatattctttcataagtagtagctgagtaaaaaggggtcgattttttggcacaacttttagggcaacaagcactgattgccattgtttcgcatttattgtttattaccattacgtggtgggccttacaaggcattcacattgagcgtttaatgaagtccggaaaag

SEQ ID NO: 1454 - DNA, 366 bp, Bacillus thuringiensis
agctacgccacgcgtctggaagctcgtcacctaatgcatacctaggctcggagccaattcagattagcgcttcatatcccatggcttgcactacaagcactgggaacgctacactgagcgcgggatcaacaatagctggaagcatataccaacggggttcataaccgggtataatcaatactgcaagaccactccgtgggcgacttgctagccaccgggcatggtgggggagcattaccagaaccgaagtataagcgattaaagcacagtgagcctatactacttctatatggctcgttaatgcatggaactaatacggcgctcaaaccaagagcgtaccggtgaacagactgaacagctctgata

SEQ ID NO: 1455 - DNA, 419 bp, Bacillus thuringiensis
  unsure (1)...(419): unsure at all n locations
aacgaagtgaaacacaaagacaaaaggacaccaagaggcgaattggagggaaaaggccgggcaacacacngcgagagacacggccacaaagaacgcaagagggaaagaagaagccacncaagaaagcgaagagcaaaggccacccaaaaaaagagaaaaacaaaggagccccacgcagaaaaaagaagaagcgcccgcgacaacaggccaccaaagaaagaagcaagacggcacccaaaccgaaaaaaaacgacaggcgccagaaaaaagcaacaacaagggaggaacaaaaaacacaagaagaggacggacaacggcgacgcaggaaaccgaaaagccagggaaagaacaaacgccgaacaaaaggacccgccaagacacagcagcacgaggaaaaaaaaaaagacaagggcacaaag

SEQ ID NO: 1456 - DNA, 248 bp, Bacillus thuringiensis
ctcgcttgagtactaagatccccagcgttaatatatctacggccttaataaacaccacaggggggatttagttcacacgcgcgctaaccacaacaaacgggtagtgtagaagaaccttcttcattgggtaacctaaaaccatacaggtctgattacagtcccgcgatacgatcgcgcggtgaacgccacttttcgtctgcggtgtgaacgtacgatggaccagtaagttaacaatacccgtacccgat

SEQ ID NO: 1457 - DNA, 291 bp, Bacillus thuringiensis
gtgataaaaggacgcttctgcagctgtacaatccgttattgacacaattgctaatgcattacaatctggagataaagttcaactaatcgggtttggaacttttgaagtacgcgaaagatctgctcgtacaggacgtaatccgcaaactggcgaagaaattcaaatcgccgctggtaaagttcctgcatttaaagcaggtaaagaattaaaagaagctgttaaataaaaacaagaaaccagccattttataggctggttttttgcttttatttaagcaatttgctttatatt

SEQ ID NO: 1458 - DNA, 419 bp, Bacillus thuringiensis
cctaaaattttattgtcatacagcaagggggataagttttgtggaaaatggacagcttgctggggcagacttaacgaaaaaaagtgaatcaaagtttaagttcaataagaagttacctacatgttattggcgcttattagcattgcagaatattttgcaagaggaaaaattctcaggttatgcttgttactgatggatggtatgcggctggcaaaggtgggccatttaagcagttgacggatcattctgacccgagtggattccatgtaaatccagattttagctggtggctagtgatttaatccctgctgtgtttgcaacgtcatctggcgcaaaatgtcacaattcctgcacaatagcctgcgggaacgactcgtgttctttagtcgtgaatggagagcgcgcttaaggatttgcta

SEQ ID NO: 1459 - DNA, 290 bp, Bacillus thuringiensis
aattcagaaaaacttatgcttttatcatgaatgagaagacgcattggaagattttctggcgtatcgagtattaaaactacatcattcactgactcttacatgtcttgaaccgttacatggggcagaaccggggttatttccatagcataagcaatctgtcttaaatgctctgatgccgctaccgactacggtttagacattacccgcatgttcttcatgatatcagggggtctttgtaaaaaactccattctgcattatcacgatcagaaatcgttacttttgaacaccc

SEQ ID NO: 1460 - DNA, 158 bp, Bacillus thuringiensis
aatccggtgagtttggttcaaaacaacgcatagttttccaaactggaacagcaggccagggattattttaatcataaaaggggtttgcaccaacccaaccaatattcatgcgcgattgcacctgagcaagactaaattcacaagcgctgataaaagga

SEQ ID NO: 1461 - DNA, 425 bp, Bacillus thuringiensis
gtgattcagcactccgtgcttttattgccaaggccttttttctgccacacgcgacgaggccctagcgcggggcctatgtatagaccacacggacctaaacgcccagctagctgcactgtgcgttgtataacgtcacctagacgggcgaacacttgactggacccagcttaacaacgtcgcgactgataaaaccctggccggaccgaactatatcgacttggaccacatccacctttcttccgatcgggtgctcacgatgaatggcgaacggaaacggctagccaacagatgctgctaacaggatgggtgaaaggatagtgaaagcagctcaattttgaaccaattggccggaaatgggagataaactagcttaatcttaagaccaaaccgagaaaagggtgaaagtccgctccgaatgaaacgag

SEQ ID NO: 1462 - DNA, 345 bp, Bacillus thuringiensis
aaaatcctggaatgaggtctattacgcaacttgtttgaagatgtgctaacgaatgacatgggatatagaaagaagaggtcgcgtcctaaaacgcacaacccacactattcaatcgcagaatccgctgggcctcaccacctattaacggataaggggtacattttacacgaactgattgataaacagcagttgatcggatcgattcacgctggcggaattgcattaaaaacaccagggctaggtcaatgagacacaacctaagttcatcaaacaaaagcaattcgggtgcgtttagaacagtttgcaatccatacctttggattacaggtgaagttggattattac

SEQ ID NO: 1463 - DNA, 252 bp, Bacillus thuringiensis
taagaccgatagggtgtttgaagaaattgtcactccaatgcttgagaaacccaagataatcattggtcagaaggaggcgaatactttactcgaagaattgggatgctcatcagcttttaacattatcttcacttattgaagaagaggcaactggctttacagatcgtcaaaagagtctttagtgccattttattactcgcttatgcaaaaaggtatgccgttttagacggatccaacgggattatatgcact

SEQ ID NO: 1464 - DNA, 389 bp, Bacillus thuringiensis
gaatccgagagagggtccttttttgaaaaccaagccaacccgaggtaattattaaggaacgtattgtccagaatcaaaggttaataacaagggtgatatggtaccgggcaacaaacgaacctattcgtggaacgtatatatgttcaagtctttgcggcaagaaggacggaaggtacattctcagaggagagtcaactatttacggttatcaacatagctgacacaaatgcgcattgagaggtggttcctatgcaacaggaccaagctttaggctcccttcgctggcagatcctaatcacatcatgaagcgtgggcatctatgagggaaatgcctcattggcgaacgataaaagaagtgcgttccaatagccaggtggatggaacaccca

SEQ ID NO: 1465 - DNA, 285 bp, Bacillus thuringiensis
ggttgttctaaggctccaccatatatttcattattaattttaatatccgaatacgatccgtctagattcgggggcatagtaaaatgtacacgttggctcttcgattaactgctcgctgcaccaatgagcgagctattctaaatagatagaggcatgtgttgccatacccatgtggcgatgatgcaaataaccattcccatcgaacatatagatatcgggctgcttagttagtttttgcgctgccgctttaattaaaggcgactcacgacgagcaaggcaacctga

SEQ ID NO: 1466 - DNA, 228 bp, Bacillus thuringiensis
cccttcttacttctctgtctaaaagactggattcttcaaggtgacgggctgattcaaatgctaatggacatcggcttttcttatgctggtcatggaggagctatcaatgcacttcacaagttgtgaacttccggctattggtcttaagcttcacatccatactagagggggcgaaaaaatggaaattgttattcatgatgatggtcggagagaaatgtatcaatcttt

SEQ ID NO: 1467 - DNA, 237 bp, Bacillus thuringiensis
catccaaacgactgattcatgccctgttgcagcaattgcaaatgaggacaagaagattttcgcagtgcaatatcacccagaagttaaccacacagttgaaggtaaaatattaatcaaaaacttcctttatgaaatctgtaaagcagatggagattggacaatggaaaacttcttggaagaacaaattcaaaaaatcagaaaaactgtcggcgacaaaaaagttttgttggcactatc

SEQ ID NO: 1468 - DNA, 341 bp, Bacillus thuringiensis
acatcaagtatgaacttcgatgttaaagactatttccgcttaaccagaactattaagttaattgctacactataccatttaacaggatccaaagaccataacgttgaactgcgtcaaaatgcgtaagataaacgcgagaaaattaaggagtgcagtgtacataacttctgaacaggtgatgtgcaaacatgtgagactgaataaaacttctttggtaataaagggctaccattcattacgacagaagtgcctgtataatggaaaggaaatgaattgattcaagggggtccgaacctaaatcaaactttcccatgtatccgggggtttacatatgcattcaa

SEQ ID NO: 1469 - DNA, 534 bp, Bacillus thuringiensis
ttcaccaagagataaatcatctagataataaagcgacatatttcttctttgtttttgcgttaacaacgattgataaaaatcaaataaatagttcattctcgttgttttttcgagcatgttggatcatcctttgttaagtgatttccctttacatgaattagtttacatgtagtccaaaagagtgtcaagtttttttcttaacatcatatattttttatagaaaaagaagcggaaataccgcttctttcgcttatacttcttctgtttctactaagttcgcaaataaaccatacacatattgttctggatcaaactgctgcaagtcatccatttgctctcctaatccaacatacttcaccggtacatccatttcgttacgaatcgctaatacaataccacctttagcagttccatctaacttcgttaaaacaataccagttacattccttgcttcacggaatgttttcgcttggctaaaacccgttttgtcctgttgttgcatcaataacatgcaatacttattgaggagcacct

SEQ ID NO: 1470 - DNA, 389 bp, Bacillus thuringiensis
tcaagacaataagagttaagctcgttcatactgtattttttgcaacctcattcggcgttttttgacgagcagctccttatactaaagaaatcattttggctataaatgaatcaccaggattactcgtgatgacaattgtgctttcatcacttacgaccatcgttccacctggtacggaacaaaaatcaccgcctgcttcttttataacaggagctgattcccctgtaattgcagattcatctacagatgctaatgctttgattacttggccatcattcggaatcagttttgcttgttttacgataacagcgtcaccttttgacagatcagttgctgaaacttggacaatgactccatgttcttttacaacatttgcacacgcatcttta

SEQ ID NO: 1471 - DNA, 558 bp, Bacillus thuringiensis
actaaaatttataacagtgatccaatctttttttaatactgtaagggataatgtattactagttgtatccgaatcttttttcttatcaagattcggtaaaagtaatgtaatgaatcctgataaaagaaatgctatagcatttatatatatagcaaaatctggtgtactcgcaattaataaaacccctgctatcgccggaccaattaaagatgcaccagatcctattaaactacgtaatgagttgaaacgttgtctttgttctactggaattaatttcgtcatatacgtcatagcagttggctcataaattgcactggccatacttataaagaatacgaatacataaacaatccaaagtgacggaagtaaaggtaaaatagcgataaataacgcccgatatatatcgaggtgaatcattaacttccgtttatttaaacgatcaatcatactcccagaccaagcgtttgtaaataaagtggctaagggttttattacatataaagtagcaacagctaaggctgagccgcccatatgatagacaagtacattcaatgctat

SEQ ID NO: 1472 - DNA, 229 bp, Bacillus thuringiensis
tctcaatcgtaactggttttttatttaaagtaagatgcacccttgacggtccgaatgcaattacacttgtgtgcgtatttggcaccggtccagagtttgttggactcactcagaaaattatagaatcagcctttaactcaacgtgaacctttcaaccaattattgagtttaaattcatctatgctggccttcttacaaacttgctttttatgtttgatagtctcgggct

SEQ ID NO: 1473 - DNA, 235 bp, Bacillus thuringiensis
gaccaatgattgccgcaccatggtaaccgccatctgttttttttttatctccgcctaaagctggcatgtgaggagcttcaaccgatagagctcaggtttgaatttgggaccccgcatcattcatgctacactcacgagagacatcgctacctgctatttgctaatatgctccatacagtgttacctactgccgcaccacgtgcatgtcctactggaacgtctcccgagggattat

SEQ ID NO: 1474 - DNA, 407 bp, Bacillus thuringiensis
gctctcgacggataaatctatcatgttgtaagcacatcttttaatcagcaattacttatcattggcatcgttgccgcactttactctattctgggcacgactggcactatcgactataccgttatcggtcctaccccgatcggggtgatcgatgcacgcacatgaaaatgggacgctgtcgacagtgacgcaacgattaatctaggcacttatgctggatatagcgcttctattgactccccatcagctaaaggcatttcacagaagaccgcagaactggcgaagatatgaggcacagctgcacccacagttatctatacagatcccatacctgccaacacactatatattgaagggagcgtacagcgctggagagtattgtagcctggaagcattcctggcgacgg

SEQ ID NO: 1475 - DNA, 309 bp, Bacillus thuringiensis
cgtgatgaaacattcttcttctgccacttgatatacttgttcatggggctcaacctttggcaccagcggctcatactcaactttcaggcgttcatgatgagctgaatattgggagaggggtgtctatgatgtacgcgaggcaccacttaacacgacatccggtgctactatacctggagcatttgtgccgaactcttacttcacagatcacatactcgctataacagttactatgggtgcttaatctatgcttgcgactgcgcctgcatcatatgtcgctgctagcgctgccattgcttctgttagatc

SEQ ID NO: 1476 - DNA, 188 bp, Bacillus thuringiensis
gccgcaagtgatgaaattacaattgttaatactagcaatcctggcgaatcatttatagagggaatgttttctttagtagtaggagctgctcccccaaaaacgtcgaatgagattgctttaaatacagcattaacgtgcttaacccttatttacttgatcgttgttgtgacgttgccgattatcacaaa

SEQ ID NO: 1477 - DNA, 371 bp, Bacillus thuringiensis
actgcgcgcacttttttctcaagtctacatgatatcgaagggggcgggtcaaatacatctcgggactaggccctcacttcaaaaactaacctttttgccttttattgcatattgcacgtgcatatacctaactgaacaaaggtggattgctcacatgtaatacataatcccctacatggcaaatgtgtccgatccagggcgacaaccttatgcaccatatacaattacacatctaccaccgacgggacaaaataagaaaggctttctgtgctaagctttctaaacaacacgatccagccgagccttgtatgctaatgggtgcaccttaccgacatatggaagggccaccgatgatgcataaacatccacca

SEQ ID NO: 1478 - DNA, 533 bp, Bacillus thuringiensis
gccttattatcaaacgcacaagccacatcacagttggggtatcttaaaagaaggagggataatcgatgggtcaaaaggttaatccaattggtcttcgtgtcggcgctatccgtgactgggaatctcgttggttcgctgtgaaagatcacgctccattattacatgaagacatcaaaatccgtgagtacattaatgtacgctcaaaagattctgctgttgctaaagtagaaatcgaacgtgcagcaaatcgtgtaaatgttacaattcacactgcagaacctggtatggtaattggtaaaggtggcactgaagctgaagcacttcgtaaagctcttaaccaattaacaggcatgcgtgttcacatcaacattttagaagttaagagagctgatcttaacgcttaattagttggcgaaaacatcgctcgtcaattagaataccgtgtatcattccgtcgtgcacataatctagttattcaacgtgctatgcgtgcaggtgctaaaggtattaatacacaagtttcttgtcgtctt

SEQ ID NO: 1479 - DNA, 440 bp, Bacillus thuringiensis
ccccccatggagggattgctaagggacgcctcggtgcttgattacgcggagcgaaactaaactgagactaatgaggcgaagaactcactcgtccgctagccgcgtaaagctacttacgaacggatagacataccttcacgaagacggaaaccagcgattgattttttagcacgagatacaacaggtttttgacctgagatacgagttaattcttctactgcgtggtcaaacgctttggagttagataccgagtcaccaacaccagtgttgattacgatcttttcgatttttggtacctgcattacagatttatagccaaacttgctcactagagcaggagtaatctccttgcggaacttcgctttaaggcgattcaatgaagtgacctcctttcttaagaaaattatttatctaataattcaccagatttttttgcaata

SEQ ID NO: 1480 - DNA, 461 bp, Bacillus thuringiensis
ccagaatgagagattccataactatcaccaatttcagatgtgattctttgaaaccagagccggttatatacacagggcaattctgcataatgactcagttaattaaacgctaatacgacatgcatcgaactcataaactgaggagatagtgccaacaacgctaaagcataaagtcgaacaccaggaagatcctctgctagtttgcaaatacaagtcaaatgacgaaatgtagcaattgcaccaactgatgctactgaaacatagaaaggaactcgagttgatcacaagcgtaattccataaatattttgcagttcgcgtaatggtacttaaaccgaatgcaatacttattttatacgctaatgaggcatatacaagtcaacatatttaccgatcaaataactttcaagaacgctatttttaaatagacgtgacgctatattatgaatcaacattacgaaag

SEQ ID NO: 1481 - DNA, 224 bp, Bacillus thuringiensis
tatcaggcgttttttctacagccccacaagttgtaaatgagggggacttattaaaccaaaggtgtacgaccaaatgttccaccccgctaatctcggtgctggcaaattacacccgcgcactgttgagatcgctctaaagcataaagcacctatagaagttggctaacgtatggaacaagtaaaccgaacagctgtaaaaagtgaacgcatcaacattccacaag

SEQ ID NO: 1482 - DNA, 367 bp, Bacillus thuringiensis
tgcggaccggtttgttttatatgtctgcggagctgggcttgcatacgagctactccttgtaagggggcaaatggctacgtgatattatcgtgtgcaccgaatgagaagactggtacagaatctacatcagatgctttcgctcataggaagaagatggctctgtctggcgggtggccaatgatcgtgcagatcttatagcctgtttgcccggtaagcattacatctacggtcattaaatcgatgatgcgtagcttaagtagagataaagctatatcagctgatggcgcctatcaagcatgagaacagcctacgagttcacgaatggtaggctgtgaccgccacaattgctgtttcatcatcagcgagt

SEQ ID NO: 1483 - DNA, 457 bp, Bacillus thuringiensis
gactgtgggctcggaacaacttttctttagatgtttttgttatgatccctcctcttacttcatctaatatgacatggtggctaaaggctctttcctctccattggggataattgtctcaatgttatatttcgctaatccccatcatagaaatcttgctccatcgtttgttttgttcctaatagtccgatacgttctatactctgatctaccatttctttagcacttacatcaccaatgtgaagaagcgggatagatattgcttgttctacttcttcggcaaatagatgtacggtctttgaccacattaataaacattcggccccagatttttcacctttctttgcaacctgacctaggtcatttttcacttcttcaattgatggttttgtcataaggtggttactttaccaagtccatactatataaactaactttgcattttgacgtattggagag

SEQ ID NO: 1484 - DNA, 187 bp, Bacillus thuringiensis
gtgatgcatgtgtaatcccgctattttgttgttgcgcatacacaggcaacacatgggggaatgagtcaactacacgggcggaaaaagcattgcttgaaatctatgagcgtccaccttctggtgaaccacctacagcagaaaatgctaagagctcacttgggtcttgactcttcgaaccaaagcgcta

SEQ ID NO: 1485 - DNA, 402 bp, Bacillus thuringiensis
aggcagatagcctacaattatcggcatagtataatacatatgatatgaccagtggtgtacattgcatacatgacttatgattcggtgccccccgagtaatccgctacgctctatccacttgctcaggccacactgagcgcattaatttggtggggcaatgtgatctatgataaagaaagtgattgatgtgaacgcttcatcactgtatgagcttaataccaagcgatccagcgattccacatgcgactttactctttgcgtatgtcgcagggcgatctatacttaccggaactacttacgatgactttcgctttacattctatagctcaggcaggcacatgcgtgtgatgagagaccatatccaggatacgtataccttgttggttctttacaagttacatt

SEQ ID NO: 1486 - DNA, 288 bp, Bacillus thuringiensis
ataaactttcgtctcatccaactgatgaacggcgataaagggatggtgagaggagagcgtctggcagctgatcactttgcagtaggccgaccagaccgtctaatgcaaataccacatgcactccgcggggaggatcatatatcagatacaccgaaacaaatgatgatttatgaagccttcgggtgggacacttcgcacatgggccatatgactctaaccgccaatgagagttgtcgtatgagaagttggtaggatgaatgcttgagcctaagtgttgagagcgataaa

SEQ ID NO: 1487 - DNA, 117 bp, Bacillus thuringiensis
gcaaaagcaaatgtattacttgtctattgagttccagctaggacgcaagcttggaagcaacaactagaaactaggcaacagagaagtatgcgagcaaggggcaactgaacaagggaa

SEQ ID NO: 1488 - DNA, 387 bp, Bacillus thuringiensis
tgtgagcagatttccatttacgagccagaagccctaaataggacgtgggggtgtcgtttatgcataggtgggcggctgctgtctagcgtgacacgcacattggcacaaaacagaagtggctctgcccgaccggactacaaagacaccaggcggttgccccaggaagctacggcaggcgcttttatgcacctgccatgccggtcaccggatccctgtacatctctctcctttacggaagctatgatgcgtctaatagcttacactgaaggcatgacatgaatgcgctggtcgatgagcacaaggccagctgtgtggacgaactaactgcataggcactccgttgcgacattgctacacaacataatcgttgtggccgacgcatacaga

SEQ ID NO: 1489 - DNA, 221 bp, Bacillus thuringiensis
acggaggaatgaaaatggtgaaaagggtcaattagaagaaagaattcaagacaagggaaaaaagtaactaattggtatgaaacaacggcttggaaatgggcaggcgctccttgggaatacgaaaatggtcaaattagatgagccaaacaaagggttagaaacagcagggggtagagaaactagggaaattatacaaaaggttgggaaagaagaaaaaatga

SEQ ID NO: 1490 - DNA, 351 bp, Bacillus thuringiensis
ccaaaaaaccctaaaaactactgtgcgaaaatgtctattaaaacatcagcaattcaatatgaaaatgatgacattatgcaccctgaataccgccatgaatacggcattgcatgtctgcgtatctgcaatgagaaacggtaaacaaatgcagctcttcggagctcgagcaaacttagcgaaagcattattatatgccaataacggtggcaaagattaaaaatctaaaacacaagaagaaacttaaaacccaccaattacttatgaaaaattaaaatatgaaaaaactatgcataagtacgaaaatgacaatggaaagagtggccgagactataattaaacacaataaaagtt

SEQ ID NO: 1491 - DNA, 457 bp, Bacillus thuringiensis
  unsure (1)...(457): unsure at all n locations
gcccaggaacaggcccacaaaaaacgacaggcacccgcaacgccgccgcaacacacaaagaaaacccgcccggccacgcaaacacacaagaagcaacacggaataatccatcaacatccccaacatacccaaacancattaacgcaacggaacactgcaccagaaaacccaacaaaacctgctataaagcaccaaaagacccacaaacgacaacaacttggaaaaaaggcaccgacataaaagaatggcaaaatcctaaaacaaaacctaaaaccccaagagcacctgctacaactagtaaaatctccccattnccacataaccgatacccaacacacatgaaccccggatccacccccaactcaaaactactccgaactggaaaccccgacccaacaacctgtcccgcaggcacaccgaaaccaaccaccaaaccctcacaagacccgtgcaacaa

SEQ ID NO: 1492 - DNA, 455 bp, Bacillus thuringiensis
ttactgcataaagtgcttgtgatattataatcccgattattccagcaaaggtacctacccctaaaattaggataataattgttaatgggtggatgtttaatttcgagctcataatacgtggtgaaataatattactttcaaactgttgtacaattgttacgataataattacgtataaggcttgcattggagatacgaacagtcctacaataacagctggtgctgctccgataaatggacctaagttaggaataatgtttgtaaatgctgcaataattcctaaaacgaaagcgtacggtaaatcgataattaaataaccgataaaagtaaacgcacctacaaattatacaaacgagcgcttgcccttgaatatatgcagataatgtttcggtcgtttccttaatgatacgaagccccttttcacgtaagactctggtaataaacttaccgctttt

SEQ ID NO: 1493 - DNA, 388 bp, Bacillus thuringiensis
gggcggattccccttttccccatgccgactttacattgtcttaaatatgtaacaccttttacgtcattccaattaaaagagttttggatgttgcgtgaaactaaatatgtcccatcagtctgtgtgagccgggcaaagtacatgcccgggtctttatcttcttggagctgaacggatatagacattcaagaaccgacgagtgcaacaacgctatcgtccgataatagggcggtcatagtcgcaccgacaccatctgctggagggggggcattgtttagtactgcatctttagacatcctgttccaatcccgccataaaatggggcacacgagagagagtgggcctacttagcacaccaatgttttgagtgcgctctaaccactttctg

SEQ ID NO: 1494 - DNA, 298 bp, Bacillus thuringiensis
  unsure (1)...(298): unsure at all n locations
aaccaccacccggaaccganngggggcataaggaaaaacagggcgcgccaacaaccgggacaaaccaagaaaggaaagggactggacacgaacaccaagacaaaacagagacaaagaaacaagaacaaacgagaaaagactacagagcgaaagcatctcatgaataaaagacaccgagaacctccatgaaagggacaccagaaacacactcagacggagcgacggataaaaaaaaagtccgcgaacaaaacctgcacaggaccataaaagaaagtgagcgcaagcaaggaacaaccga

SEQ ID NO: 1495 - DNA, 512 bp, Bacillus thuringiensis
gagtgaagtaaacgtatgcggcagtcatattacagctggttcagatcgcctcgcacgaaaaggattagtagaaagaaaacgttctaattcagatcgtcgaatcgtgtatttagaaattacagagcacggaagagaagtaactgaaaaacttgaagctgtgcgtaaagaatattataaagagagatttaaaggttggagcgaccaagaaatagaaatggtcttagaactatttggccgcgtattataataaatgaggataggaagcgaaagcattcctatcctttttcttttgaataaaaatattttgaaactccgatactttaattaaaagatcggaggaaagattatgaaatatattgctgcacttaccattatttggtggggttttttctattttcaaacatttacgtacgcagatacgcctattcaagtggtacgataagatgtgaagtacattgaaaccgatatacagtcttatattcgaaatatggggttcgttctatgcaaaacgc

SEQ ID NO: 1496 - DNA, 289 bp, Bacillus thuringiensis
  unsure (1)...(289): unsure at all n locations
caanaaaaaaaccaacgcaaanaggaaaaagnagagcccccccccgaagacaaggaaaaaggaacnaccggcgaaaaagcacaagggaaaacacagccgacggaagcnacacacgaacaagcganggcgaaaccacaaccaaccaaacaagagcgcgaacccagccgcagggaagaagaccccggccaaacaaaggggacaggaccaaaaagaaacagccccacgaccaaggaacgaaccanaacgaaaaaaggcaaaaaggcgaacccaacgcaccccgaacaacaaa

SEQ ID NO: 1497 - DNA, 234 bp, Bacillus thuringiensis
gattatttatttagacaactttttgtataggagtgttgatatgttaaacaagttcaaatttttttgctgtattttagtaatgttcttacttctaccgatatcccctttccaagcacaagcagcaaacaatttaggttcaaaattactcgttggatactggcataattttgataacggtactggcattattaaattaaaagacgtttcaccaaaatgggatgtaatcaatgtatc

SEQ ID NO: 1498 - DNA, 355 bp, Bacillus thuringiensis
cccggaagtcgagatagcatgctatctttagttcaaacaaattgattattcccacgaagtccaaagtttagctctggctaaactgaaggaccgtcgggctttacaaattatttactgataactctgaagggttcgacgtaggtatctaaaatattccatttctcccacagaaaagtacataaaaccaacacctcccatccataccaattgattgtgcaccgggttacaaagctgatccagctgttgacggaacaagtttataatgattaattacggcaacgttcggaaaacgcatcgtattaattggtggtacaggttactccaggaacaagaaaaaatgaatcttctctattat

SEQ ID NO: 1499 - DNA, 387 bp, Bacillus thuringiensis
gccgcacacacgagttgaaacttccaagaggtttgttccgacgagagaaacagatccacatgtgggaatcttaatgagactttaaggcgaaaacactgtgggtaagggcaccgtcatctactgagatgcaccatactttatagccaaccgcttcggttcatgaggactacttggtacttttaacgataggggctgacgctgctatagcatcggggacgtcgactctagatcaggcgcacatgctggtcgcgcatagagcgactggacgctctacatagatgtcagcggcatatatacatgctgacacattgccaagaacgtatagaattaagggcaagaaggcgatcgggaggttgaacaagtgccagctgtcatgcatagacgtgc

SEQ ID NO: 1500 - DNA, 390 bp, Bacillus thuringiensis
tgaatgtatacacaatctggacttcatttatttttcacacattatactatgtgtacatgggcgagtacaataagcacaatcactcgtgaggtaacgcaatcggatagagttattcgatccagtgtcgagccaataagtgaagcatgagcgagaaacattttatctcgaatctcattacgatcactcaatggttgacccgtcgtgagagaaattgctaacgcccggatgacacgtagtacattattagcgagaatacccaccgcactgtccggatctacttgtggcaggaaaatatagtgcatattccacaccgcgaagtagagctaactttaccatttgctctctgtttattacataaacagcgttatctgttaactgatgatggaataa

SEQ ID NO: 1501 - DNA, 317 bp, Bacillus thuringiensis
gaatgttttttagaatgccttcctggagttcaagaatgcagggcctatatctttaaagatgcggcacatagcagatctggggctacgttatgtaggcgtcctcgttacattcccgatattactagtcgagctggcaagtgaacgtagcttcgatgagcgttcagcgatgaatcaccgccgcaaggtgctggcgcagatattattaaatgagcgatgattattatggcgcgacgtttatagcacgaaggggtacaggaacggcatgttgtgcaagtacagcgcgaatttgattccgaagcgcctaacgatgaaattgt

SEQ ID NO: 1502 - DNA, 441 bp, Bacillus thuringiensis
tattatcacctttgtttacattgacgatagatacagcactgcaggggcattgtcatatagtagcgagggcagatgatgcagtgaacgatgctgcagcgatataatccgcgcttattgggatagcgatgggaatttcaggcacagaggttgcgaaggacgcctctttactcgctatactacaccatcgtgttgctccaattaaattaccattttaagaaggaagaaccatccatgacaacatacgcatgctcattcgctacttagcgtcgtaaaatgttgcagaggtgttaaagatgcaatttgcgatgatactattagtacccacgccgatggttaatattcagagcttatgggtgaactaatatactgaacgttcaccaatgatggtatttatgtttgggcaccgatgtaagagatgagaggaagtgttcaccgcggcgc

SEQ ID NO: 1503 - DNA, 245 bp, Bacillus thuringiensis
gctcagaagcttgctttcaattcagatcattcaaatgttgcgaaagctatcatatcccgctgggtatcttttaggaacaggctggtgttcccttaccagggattggtacttgttcacactccacagttttggacttctagtcagacaggagattcacacaccgctcacgaaaccattgacagccatccttcattggaatgataccgcttcaagatcttccaaatcattttttaaaccccatcatt

SEQ ID NO: 1504 - DNA, 383 bp, Bacillus thuringiensis
tccttaaacgtcaaatcacattcactaaatagaccgtcttgtagtcgatctttaatagggcgtttgcaccaaattattaaggggttctggcgctgggtgatccatagaacgtaccgcagcttctacactatcagcaataccaacaattgccgattctttcgaagctgcttttgaacctggataccggaacaggtcttctgtatattcctctacatccccaacaattgatctataataacactctattccagacccgctggagcgcgacgctgcccagcgatatcaattaacacgcttgcggaatatgatactctttgagcatactgactccacccgtcacgcgagcactcacaatatctcttctcgatacaggctcctaactt

SEQ ID NO: 1505 - DNA, 376 bp, Bacillus thuringiensis
aaatcaactgatatctctgcacctcaaaaacgtggtggatgtactcgtgatggtacaatgactccaaggaaacctaactcagcgttacgtaaatacgctcgtgtacgtttaacaaacggtatcgaggttacagcttacatcccaggtatcggtcataacctacaagagcatagcgtagtattaattcgcggtggtcgtgtaaaggatttaccgggggtacgtttaccacatcgttcgtggtgcgcttgacacagctggtgttgtcaaacgtatgcaaggacgtttttaatatgggactaacagaccaaaaacctgcttaaaaatattacctttaaaatgaatggaggaacctcacttgccttgtaaaggtccctgt

SEQ ID NO: 1506 - DNA, 403 bp, Bacillus thuringiensis
ttaaaaccatattccacattacgatatataggtcccgaaggtggactttagagtacagtcgcttcaaaagcaggtctaccatttcaatctatagtcttaaggggagttaaacggaaaatatctgttgatagtgtgaaaaccggaatgcgttctgtaagaggtgtacaggattgaaaacgatgcattctgcgttggaattcggatattgggatcggaacgggtggaactggatgtggaccagcagggtacacggcaggcaaattaggtattccaactattgggcatgaaccaaagagaggtccaggtggtacgaacaactttttaagcccgtatgacgataaagttgctgactgtacagaagcaactttggggtatattagagagtgaaaagtggatatgacag

SEQ ID NO: 1507 - DNA, 413 bp, Bacillus thuringiensis
tcttaataatttagttttatagagatagaatgagagatagagtgacacatcgaagagggggttacaacagatatgaaaagactaggacttgcatggcaaatattaatagggcttgcgcttggtattgcggttggggcgattttctttgataatccagctgttgtgaagtacttacaaccaattggtgatattttcatccgattaattaaaatgattgttgtaccgattgctgtagcaagtattgttgctggggttgctggtgttggcgaagttaaaaaactaggtcgactaggcggaaaaacaattctttactttgaaaatattacaacaattgcaattattgttggtctattaatagcgaatattttccaccaggaaaaggcgtaaatatggagcagtttacaaagacagat

SEQ ID NO: 1508 - DNA, 330 bp, Bacillus thuringiensis
catttccaaggaggggctatatgtatgcctgggcggccacacatagccttgtatcctccacattatacactgcaatcaaatggagaatcatctttaacgaacgcgctgaacataactcccaatttaaagggaatattctcgcatgaataagtctactatatgaatgaccctctacaacaattgggctcgggaccgattgaaaaagtgcaactcatggacttattatcacactcgatgcgggcttaacgtgcgcatagcctgattcatatattaaattagctactataacgacccttacccctgtgttctctcgctatacattcacttgat

SEQ ID NO: 1509 - DNA, 549 bp, Bacillus thuringiensis
  unsure (1)...(549): unsure at all n locations
ccaaccaattctatataatgataaacgggaggggatacaaaatgctagatcaaattacttggggaacgccaggcagcttattatgcttagggttctttcttgcgggactaggaatcttcttaagaagcgttacgtcatatacgaaaaataaataagaatatcctgcttttaaacaaaagaagccctctttttacagacggcttctttcttataactgtatgttattaaaactttaaagcaataaataagcaatcggcgtaataataagtaacgttaaaatcgctctctgcacatataaaataataagttcagatacttttaacggaatatctgttgataatatacaaggaatggaagcggagaaaaacaaaatagatgatacggaaacaactgcaataacaaactttgtcacaattggtgcacttactactaataatgacggtaaaaacatttctgcaataccaactgatgcggctttagcggctaagtctgcttctgggtaatngtatagccatgtaaacggatagaaaatataactgatccaatcaa

SEQ ID NO: 1510 - DNA, 180 bp, Bacillus thuringiensis
tgaaccaatagttgctcctatctccgatgaatcaacgtggattcttttcggtgaaatggggttcacaacaaagaatctgaaatctatccaatctccgtacatgccgtgaagaaggaatggttgaagtatgcgatctaaataacacatcaagcattacatgcccgattcttttgaagaact

SEQ ID NO: 1511 - DNA, 424 bp, Bacillus thuringiensis
ccaccgttttttaccgggaaatccggcaacgcgatacggatacattctgttcgcgggtgagtatcccatgattacgcctcttctgccgacgtataacttgctatcacgatggctggtcctggagtgcgtatgccattactggggtggtatgtatgccggatggggaaatccgagatagatttacctgcgcactgcccggatttctcccagggtctactgataaactgtagagccattttagtggcggaaacatgagaaaatatcacgaattgctgtttatgtaaataaagagaataagtaggctggctgaactactacaaatctgaacgctgtacatggatttgttactactgcacaatcgcttgttattgtatatagctctaacggaagtgcatgattacgctgtcacattgctttatcatct

SEQ ID NO: 1512 - DNA, 215 bp, Bacillus thuringiensis
  unsure (1)...(215): unsure at all n locations
tatccctggttacttcggaccaaaattatcgtcgaattgcgcggcaattgtgaaacaacgcgaacgcgctcgtggaccaacatgagaaattgcgaaaactggttaaggccaacaccacgctgctggtgagaaaatgatgcactgagcaccgaacaccgacttcaacaattcggcctaaatcnnnnnnnaaagcatggtggcaaaataacctaccg

SEQ ID NO: 1513 - DNA, 185 bp, Bacillus thuringiensis
ccggtaattgcactgggatatcgaatagcatggttaagcccagcgcgtgcccgctcgcctactggcatccctcaacatacgcagccgtcaatgatgatgctgccgagtgtcacttcatactctgggagacccataatggcagatgataaagtcttatttactcgtgttcccgtaggaccccatca

SEQ ID NO: 1514 - DNA, 255 bp, Bacillus thuringiensis
ccttgggaagtggttccgatggaacatttctatgatttttactccctccgctggcagagggaaatcatatacaaaacgtggggaactctattgcaaaggcatcatggacaaactaccaagcaagagcgacaaaaaagccatgagggtggaaaacgcagcgccattttacatatgtgctatcaagatgtttactatgcgcttttatacgtagaccctgcaacaaataggtctaagcgattgggaagcatttgatcc

SEQ ID NO: 1515 - DNA, 265 bp, Bacillus thuringiensis
  unsure (1)...(265): unsure at all n locations
gtgagtgatagcaagagattgcaacgctctattaaanggtgagcagtcattacaagccttgcattggggggggttttattaggaggcgcttgatttacaaaagcagggactggtcaaggaagtggaacccaacgggcactgagaaacggggaacgcgctttcctgatggggctaaaggaaactatgctcgagagccggggcccctaataccatngggaggccgctcgacatatgttgaaaggggagttgcgtacattagagctgt

SEQ ID NO: 1516 - DNA, 297 bp, Bacillus thuringiensis
tgggacgacatatgtaaagtaatttgcaacgaatttttatcttgagaaatatgcagatatgattgtcgtgtgtgatgtaaaagcgcacggtgctagatttcgcacggattcgaatattgtaacactgtatagaaaagttggaaaagatcttgcgttggcagtcctaatgcaaacagaagttgattttgaaatattgaagcaaattgcaatgaagttagaagacgatcgtttatgaagtttgcacgtgtaatatgccgatgtacctgccagtgagtcagatgcgaccatcatattaca

SEQ ID NO: 1517 - DNA, 248 bp, Bacillus thuringiensis
agagtgattattcatgcatcacgtgagctgcatgaggagtccgctgttacaagcgtaccggatacaacttgagtacaagatacaaacggactagttcacgtggggattgctatcacaaatgcacgtactgtattaacaggagtttggccggcttacactggagtggacacaagtgagatggacaatctggataagccattacttacaatggatgttgcaggagtccctatggaagggcgccagggctt

SEQ ID NO: 1518 - DNA, 339 bp, Bacillus thuringiensis
aacgggaacggagggactctggccgtcctctcccgcgcaggagtttacgtcagaggatcgcacagaaacggactgaggccccggtcactatgagcgcgtcatacacattgactggaacaaaggcagccgcgtgtcaaccgggtagatacactctacagtgatttagaaagagcggatgggagaatattgaggcggaccagtggacgtagtgactgacatgcctaactagcttaaggaagccgtgtagtagcctggctgagaaacacatgccgatgaccgtcgcacgcacattaggaggaactgtgggtgacggcatgcgtctaccattcttagacgcca

SEQ ID NO: 1519 - DNA, 440 bp, Bacillus thuringiensis
tgatgcgtatattttttcttatatgcgatatactcttctcaagatgataagttatattcggagtaaggtttaaatcttagcgaaataataatatgacattggaagtgtgaaatgaagaaagtcccttaaaaaaagcgggacgacggtctttgctgtatggtgtaattcaatgcacatgccgacagtcttttttcattcatagtatggggaggtgaaatcatgagtagtacagcttggatactcatctccattttgcttgcaacaacagttggcgcagctgttggcttttttgttctaaagtctattgctgaagcgaagattaatggtgcggctaatgaagcgaaacgtgtactatacgaagcgaatcgtgaggttgaagcacttaaaaaagaagcgcttttagaaacaaaggatgaaatttatacaccttcggcagaagc

SEQ ID NO: 1520 - DNA, 348 bp, Bacillus thuringiensis
cggccaaagaacagatcattctttaccgaaggcaaattgacacaacgcgatgtgactttataagtgaaaacagtcccgaactacattcaggctataccaactcgaatgaacaagtgaaccacgtcgcttcatgatatataattgtgaagcctgtgagagcgaaatatccggaagcgaaaaccagttctcctaacgcagaatttaatgaagagccgatagaggtgacaatcgagaagagcgttgttatacatagatcacaacgtgtgaacacgctaaagcaatatataagatgaggtatagcaccattgatgctccttgttaaaagaaagcgtaagcgcaacatctcta

SEQ ID NO: 1521 - DNA, 353 bp, Bacillus thuringiensis
agccatacgcgctaaatgctatcttggtacagacgcatatcctaataatggggttgggtctaatagtgcaagcgctgaccggacactacgacgagcggtacaaagcgcatctgctactgatacataatttgcaacacgaacactcatccgtcctacatagagcgacaaacgtcttccaattttgcagagtctcgattgactcctttaggcggaccgtcttgatcgattgatagaataaggtccacatatcgtggctaacctaattgtgcaaactatcctactacttcaattggaggtttgactaaaaactccagagatgatggaacgattttatctgcaataataacggatac

SEQ ID NO: 1522 - DNA, 136 bp, Bacillus thuringiensis
actaatgttaatgtataaggggggacagttgtatctccatcactgggggaaccagaacttgttgtgcgtgatagaccaaatggccccgacggtctaaaagcaggtgcgctcaaattagctggaacagacgaacaga

SEQ ID NO: 1523 - DNA, 188 bp, Bacillus thuringiensis
tcaataatagctaataggtctacctgtctagcaagagtagtcttttcctcaatatcactaattcttagtagtgggttcgttggcgattccacatacaaagctttcaaacatgcactaatcgcattttcaactcccactaagcaagcagtctatacaaacgtatgctcaataccaaaacggttaaatac

SEQ ID NO: 1524 - DNA, 159 bp, Bacillus thuringiensis
tttacaccaagtgatagccttgttttttttagttacttcttcaacctactatacagggtgggggatactgatgatattgtccatttatgacaccgaattacgcgtaatggtggagaactattacataatcaaccccgaatcggtcctactcgtatggaa

SEQ ID NO: 1525 - DNA, 410 bp, Bacillus thuringiensis
cgtgatgatttatgttaagaggattccgaaccgtttttcctgtaattgatccggtactactacggggtgcaactatcggacgaggggtctgaactgctccaagaagctctgtcctaatgagatcacgcagtcattgagtatagacgctgcagaagaacaggtaccgcaatatctttcagagattcgttgttatataccacaaggtgttgcaacttatctgaaaccctcggcttttgttgtgctagaccaattgcctttatcaccatatggtcaggaatacataatgacattacctgctcctgaccctcttgtactgcacaatgagagagtagcttgaattgcgattgaacaaatattatgtgatatacccgcaaatgttcttggtggctaccgaattatctttgacgatg

SEQ ID NO: 1526 - DNA, 397 bp, Bacillus thuringiensis
ccttcaggcaattctaatcaaattttgtttgaaatatagagcgggacgccagctcctgccttcacatcacgccctgctccaactcgcgcacataatactcaatgcccatcggctcatagaccgtctctattaagacctgtaacattgccattgggacctaacgtacaccatcaaatacaggattaccgatggtcactcccacaagccactactggtttagcacgccaccctcatcgacctgtaaaggcaccaattcctggaccgatggcaacagctccacatcagggaccgatgtctcgaggatcgacccttcgatttcatacactacagtcactgcagatgttttggcctcaactactttagcttgagcagccatactacccatcactggctcttg

SEQ ID NO: 1527 - DNA, 212 bp, Bacillus thuringiensis
aagttacccgctgggattaacagctcaggttaatacacacttacacggtcgccaccgatcaggggtgaaatatcttgtacagggattttctacacccttctcgtttagtaaaccgtttttttaaagaagaatcctgtgtctaacggacgatttactggttgcatttcttctatttctttatatagatcatttttcacgtcataatatgcatc

SEQ ID NO: 1528 - DNA, 478 bp, Bacillus thuringiensis
aattgtttgtccttgttttaaccttttaatcgcaaaggaaatatgatccgttaacgcggtatgaatatgttcatttagtggagatttcgctttttcttgaatgtacagcataatatcggtcatcaattcaattaatttttcactaatatgcggcactaataatttgtattgttcacgatcacgttcattttttaagacaaacattttttcgatttgttcttgctccaatacatctttcgcttttttcccaaatccaattcctttgccaatcactactacttcctcgtgttccggatggctagcaatgatgacattattatttaaaacttttttaatttctagataattactcatataacaccaccctcgtacttaaatagcctacttttatgttacagaatattcttctttgtcgtcaatgtaaaacatctgccatttaataaaattcatttttagactgtttatatatgatgcgtat

SEQ ID NO: 1529 - DNA, 182 bp, Bacillus thuringiensis
taaatgttcggcaggattacctgtttcttctccgccaatagaaatagatccacgggggggaatttaaccattccgtgctgcatccgatattacataatgaatatttgtcccactactaattccagaatcccaaacctgcgctaaaccgccactataatcaaattctaatctccaattattaa

SEQ ID NO: 1530 - DNA, 371 bp, Bacillus thuringiensis
ctacaccaacgtatgataatctattttgttctggaagtaagaagcctaattgttcaggcgaaagtgtttcgatttttccaagagcatttcgaactggatcataaagctttggaccgttgaatgccgctataccttcagccttatagtaatcaagatccagttcattcatagcttctgttaacatacctctgggctttttctcacatcttatcatccgtatatttctttttaggatctgctgggtcgcggcttgattgtcagcttgagtagttttttaaacagtaatttttgtgcacttagagagcttagtgctcaacacgtttaaactcttgtttaatttgaactggactatcgaaaatgttcgcatcgtt

SEQ ID NO: 1531 - DNA, 452 bp, Bacillus thuringiensis
atgctggcgaactcatataactctaaaccaggacagtatgttgtttctcccatcatgttgccatacgcaacattgggagggttatgccacgttgtaaactgaaagctcactgaagcatcagaaaccgctaatgcttcatatccagacattatagcgggaagaggtgtggaagcatcacaaacttccgtcactacagccgttatgataagtagaatatacacaccaactgagggtgctttcacggaagcatcaatataccatgcatcaaatggtgcaccacgtgctattgatggagcttgctgtgagagaggaacgaatgattgcgtgaaagggccattaaggccgaaaaagaaacttgttgatgaaatagctggtaaagactaaaccttgacagaaggaccaggggctagaacatcgatcttgaatccataaacaccatagtcacgtactac

SEQ ID NO: 1532 - DNA, 182 bp, Bacillus thuringiensis
ggacgcaacatctataacagttgcttgatatcctggcgaagatgtagaaactatcttactaaaaacaatacaagcagctgactatgatgtaaagtaagcgcgaaaaggaatcatccatattgatgagattgacacaggggcacggtagtccgaaaacccatcaattgcacctgatgcatctg

SEQ ID NO: 1533 - DNA, 145 bp, Bacillus thuringiensis
gaaggaaggggaataaatccaagaagcgtaatgaacaaatcgtgctcagggaaaatcgcaagcacgaagaaatgggcgagctgtgctgccaagccccgcacattatcgcacatcgtgcggtcacaaaaaacgttaccaaacgaat

SEQ ID NO: 1534 - DNA, 315 bp, Bacillus thuringiensis
gattgactgatcaggactacttgcggatagacctggacatggcatagggttctcttcgacaaacaagatcactggctgtgcacgctccaccagtcgtatacgaggggaacaatcaggtcatggtcgggcatttactcgctgctgcagagcatccggatattcatgcccttagaacgggtgaacagaacgccaacaacgcgtccggatctgtaacacgggcgccgtggtgacgctttgaaaaaagatcggcttgctgggaattgatcatggaaaaaggagctaagcgtgttgtaatcgctactctacatggttata

SEQ ID NO: 1535 - DNA, 212 bp, Bacillus thuringiensis
acacggggttctggctgcctacgctcgagagctgcacgaatcaattgcctgaacgtacatatgtaaacatggagagaacgcatacttcgattcgaacggggacttacaattaagtcatgatgcgcgggactgtatctaatgtatttggaaacatgcaccagcgtctacagagtgttgcgaacccaaatgtgacctcatacagacgtttagtg

SEQ ID NO: 1536 - DNA, 521 bp, Bacillus thuringiensis
ctgtatgtccctctacaacaattgggttaggtacggattgaaattttccaactaattgacttattatccctttcgcttcgggcttaacgttcgcatcgcctgtatcaaatattaaattatctactataacgacgcttacccctgtatcctctcgatatacattcacttgactaataccattattatctacatatgcttttaacttcttatataattcatccattctcttttttgaaatcattttttcatcatttttttcatgtgaaatatccggtattgtattttccattacttttgcatctacttgccccgtatcactaaacttttcaagcatctttgacaattttactgcatcttgctttgatgtagcaactagtaatacaaagaaagttaataataacatcgttaaatctgtaaaagtcgtcatccaacgaggcgatcccttgtgcggtcctttactcatcataccactccttgaaatattaagctgctccttttaccttgtttacctttgtttcgta

SEQ ID NO: 1537 - DNA, 351 bp, Bacillus thuringiensis
cgtaacttaaatgctaaagcagtgcctgatgtacaagggatagtcaccaaatctgcaactacatacattgcagttgggtgttttcactgcaacgcttcttgaatgactcaagctactcgcaggtatgctagtagatgaaacggactctttagtctatgatccactagatgcaactaaagtataggcacacgacctctttccttttatggcaggctggacagtgacggtaaatacgagttcgacaaacttttttgaagaaatatatgaagttaccgattcttcacgaactcatttatagggtgtttacacatcagcagataaatttttactagggccttttttttcttgccc

SEQ ID NO: 1538 - DNA, 433 bp, Bacillus thuringiensis
cctcaatcatgagggacccctacggaaacacactgatcgaggggtcctatcttaacctccgaacttaacgaagttgacaaacgaattatgacatgccgtactttttgcagccacactgatattaggctggaaactctctaagactgatcggctctcacccgttgatccgctcaccaactatgtgccattctggcttagcacgagagcgcttgcaataccagagtcatagttcattcctaatgagaaagcgtttacttctatatcatctcccccttgtagatgcactgaatgttaagcatggtcaatcgcacagttatcgacctaccccatgtgtcgccggtgtaagagtaagacctctgtcaggcgacgtttatcataaaagatcgtgtattcaattattgcgcccatactctgtaatacttcataagatgga

SEQ ID NO: 1539 - DNA, 437 bp, Bacillus thuringiensis
tactggatatttttgcgcattttgcgaagtcgagggaaggtaagcttcaagtagaattagctcagttgcaatatacaatgccgcgtcttatggggcaaggattgtccttatcgcgtcttggtggtggtattggaacaagaggaccgggtgagacgaaattagagacggatcgtcgtcatattcgatcgcgtattgatgaaataaagaaacaacttgcagttgttgtggaacatcgaaaaagatatcgtgagagaagaaatgatcattaagtatttcaagtgtcattaatagggtatacaaatgcagggaaatcgacactgtttaatagattaacggaagctgatacgtttgaagaaaaccttatgtttgcaacattagaccccacgacaaggaagatgccgctaccttttcggtatccaggattactaactgatact

SEQ ID NO: 1540 - DNA, 317 bp, Bacillus thuringiensis
  unsure (1)...(317): unsure at all n locations
aggngaacaggcatgttgaaacctgggctaccaccgcatgatgagtggaatgcatgatgacaccctttacgaactatacggattaccaaggcgaatggcgatggcatgatgcataccatatctggtgttgcagtcaccggcatatgcgaagtggctgaagacataacaagcattcctaggtggcgctgctctttgagagagagacacgctagtgtaccagagaagacacactccgctggttgcccaataacacaagcacctgatgcgattactaaaaaagtgttaatgaaaaggaccataggaatatctctttccca

SEQ ID NO: 1541 - DNA, 357 bp, Bacillus thuringiensis
acaggaacaatactcataacatttggctgcgaccataagagctagcgggcttagcgacgcattgctaatcgcttgattcatcaagaagacgctctcgttactcttaatataaaccttgctgatgcctgattgcttacccatgttcacattgatcaatcagtattaaagctatcatacgaatgtacagattcacgacaatatggtgtggttgcgtatgaccacaaacgagcactaccgctgatgcactctgtacgtaatagtgaccgaaagagagatcgtgtaatctgtctttctgatgtggaacaccaaatgcatcacagtgtgtgtgctgcaagttatatcgagatcgagagagct

SEQ ID NO: 1542 - DNA, 145 bp, Bacillus thuringiensis
cccgcgattacttgttaatggcgtggcaggtacgaaaagggggggggctagcgcacgatgcataaatgccaaaacgccgggcatacggagcgctacaacagcaagcgcgacaacaacaccgttacgattaaaggcactcaatcca

SEQ ID NO: 1543 - DNA, 357 bp, Bacillus thuringiensis
  unsure (1)...(357): unsure at all n locations
caccactgcaagtactatggagccgcgactaccaaccgagatgggctagaactgtgacccagggctattgacagatagtgaaagctttgaatacaccgaaaacaaactaagaccatacttcaccggataaggatgatcggacagtcttaacagaggatacgagcacacatgccacgttggagctaacgaccgacaccggactgagaggcctacggcgtgagctgtgaaagcagacctatcttncacaatgggatatgatagtcaggtaccacggacagctggaagtacagacctagaaagcacacaacagagcttccaaggagcaacacgtggattaagtatagaactgggagcaac

SEQ ID NO: 1544 - DNA, 399 bp, Bacillus thuringiensis
ccggaccggaattcccgggtcgacccacgcgtccgaaaaaaaaaaaaaaaaaaaaaaaaaaaaaaaattttttaaaaagaacaaaacaacaaaaacaggagaaaattaacaaaggataacgggcaaaagggggggggccgttttaagggacccaagtttcctgccccgggggtgcaacgtaaaactttttttttgggggcaccaaaattaaattaccgggccgcgatttaaaaaccatgggattggaaaaacccgggggttccccaattaaatgcctttgaagaaaatccccttttccccagggggggaaaaaaaaaaaaggcccgacccgatggcccttccaaaaaggggtcaccctcaaatggcaaaggggacccccccctttaggggcaataaaag

SEQ ID NO: 1545 - DNA, 770 bp, Bacillus thuringiensis
  unsure (1)...(770): unsure at all n locations
nnnnnnnnnnnnnnnnnnnnnnnnnnnnnnnnnnnnnnnnnnnnnngctttacaaacccaaaaaaaaacccccccctcaaagcgaaaaaaaggcaaaacaaaccaccccaaggaaaaaacaaaaaaaaccaaagacaaaacaaaaaaaaaaaaaaaaacccacaaaaacaaccaaaacaacaaatccaaccccaaaaaaaaaaaccccaaaaaaaacaaaaccaaaccaaaaaattaaaaaaaaaccccaccacaccccaaaaaaacacaacccacaaaaggtctcacaaaccaaaaaaaccccccctcttccgcccaaaaaaaaacacaccaaccccccgggcgcccgaaaaaaaacaccaccagcgcgcccaaaaaactgaaaaacacaaacgaaaacacaccccccacaaacccaaaaaaaaaaccccaaaaccccccaaaaaaaaacaaaaaacacgaaaacgcccccacaacacccctgggaggcccaacacaacacaaccccttggacaaaccccccccaaaaaaaaattaaaaaaaaacaaacggattacccaaaaaaatcacacccccaaaaagggcaacataacaaaaaccaaaaaaaaaaaagaaaaaaagaccacaacaaaacacaactaaacggaaaaaaaaagcccacaccttaaaaaaaagaccagagaaaaagtccaaacaacattaaacccaaacacaacccggcaaaaaaacaaaaaagtggcaaagacacacactccccacacaaaaaaaaa

SEQ ID NO: 1546 - DNA, 274 bp, Bacillus thuringiensis
ctgatgccacggtaagaaagttaagctcctattgtttaaggaccgtttactggaaggagtggacgactaccgagaatccctagtacgtgatcggattcaacggacacgatgtaaccgtgaactcgaatgctaacgctaacgcctgcatctgtgcctaaaacgccgttagccatggcattcgtacggatatcgacgccgcctctttgctggatagcgcgtttaacaccagagcgcatagcttagtggcacccagctaagatcgcattgccaggtt

SEQ ID NO: 1547 - DNA, 514 bp, Bacillus thuringiensis
ttgtggtaaacgtctcattatctggccaatatataattattatatcctccaggttcattactaccactatatctttttagtagtacaattttcccacgagcatctccaagctttatatttccttctgtttttaaaaaaataggatcaacaaaatattttttttcaaacgtgctactaaatgaatcttctgcccctttcatatcctcatactctttttttaaagacataataattgtttcactcgggttatcttttaaaaattgtttcgcttcatttatgaattcatgcagtgttacgtaaagatataatggcccatgatgaagaactatcgtattatcatctgttaaacgtcctcttatatcaaaaatgcgagctccatggtccatttgatagcgaaaatcatattcttgcgtcattccccatacttgcttaatcggattttgcaacttgaacgtcccatatcgtgtgttcctggaattgaaattcgtgctaacgggatattatcaggataggt

SEQ ID NO: 1548 - DNA, 414 bp, Bacillus thuringiensis
atgacaaaaaataaatttttgggggcatttttatgaaactaacaatagctcatatcgggggggcattttgagatataggtaggtcaatacattcatatgaaaatgcgttactacgaactttaatagaccgtcacgtaagtgaagctcctggtgtggcaagtgaagaatccattcttgaagaggctggcgatagaattgaattacttgcaccggcaaataatacaccatcttcaattgccccagttattaaacaaaaaggtaaaggtgtacattacgtggcgtatcgtgtgcatgatttagatgtggctctagaagagttaaaagaacaaggtatccggacattaaagcatacactacgcatttataagcacggtagaaggataatttatcttaacccagcgcttacagaaggaa

SEQ ID NO: 1549 - DNA, 400 bp, Bacillus thuringiensis
ggtgaacatatgttgtagcttcttgcttctgtttatactctatagaaggcgaccctccagtttgaactgagctcagaccactagacatagctcatgagctgctactagggcttgaactcagtattgtacagggcacaatcgtgagactaaagatggaacacgctggtgatagatgtaatgaatataagagactagttgcagcttaaattgagacgcactttcaaacatattaagataggcgaatggactctgtgagaaggcatagaaaccgtgcaagactgcataatatgagcaattatcattacaggagatactatggataacgcgatgttacatacgcgactgacgatatagccacattaagataagccagactatgtcccagcgttaaatgggacat

SEQ ID NO: 1550 - DNA, 395 bp, Bacillus thuringiensis
ggacccgccaaataatccccgggcggtgcatgtttgtatggtccaaggaaaatacagcctgcatgtaatacataatctacagcgttcatcggttctgttatatgaaactctaaatgaaccggagcaagttcatcggttcactttagcgcctcctctaaggcagcaacaatgaacatggctccatgtctatttatagatgcacgtgcaattgcacttttaggtaacacatatagctgacgagctaccgcttcaactacctgattagctagagccatattcttagaaacacaaatcgccgcggctctatcatcatgctgagcctgatatactaaattcccagtgatatactctgcattacctgttgcatccgcgaccactacaatatctgatggacc

SEQ ID NO: 1551 - DNA, 423 bp, Bacillus thuringiensis
cggtggacgcttttacggttttgggggaatagtcaatgatgaaagcggtgccgcccactggctggatttatgagaagcaattagtcttggaacaattaatgatttgccagcgtgcgggggcagatttgactatcacgaatcatgcagacgatgcatcaggatggctacaagtgggaggcactaaatcctgaaaaacggtggtaagtacattgcagcctctgaagaggcgcaagactgagagcctgcaggcgtaaatagctcggatagtgccatgaatactgcaggcatgaaaccgtcgatcatggggcgtggaaaaggctctaaacgatgtgatctctatgggaatgcatacatcaactgcatgtcatcatggggcactatgattggtgggcctgcaaacgatcccgttgtacaagcgcgagg

SEQ ID NO: 1552 - DNA, 289 bp, Bacillus thuringiensis
gacaacagtacctgtgtacactacctgtccagtaacgcatgatgttttgcaattcacatcgggcgccccaatttacttatatgatgaggcaatcatcgatcttgcaaacaacacaatcttatgcacggactgtgtcgtcctcgcttcatttgcagaaagagccgtgtcttcattattcgtgtgttcaattacactagcaaatgaagatgctggtgaaactacgttaccatctgacctaggcaatagtgaccatacagccagaaaaacgtgcggcattttatatatcatt

SEQ ID NO: 1553 - DNA, 400 bp, Bacillus thuringiensis
cctcaagcttcatcccacatattcttttgacaacgagagcggtcgtacacgttatttgaatcatggcatatatacataggtcaagggcagtacggccagaccactctaaggaggccaggacatccgatcccatcccttgccgctggagcgactggtactatacatactctcgcaacaccgaaagcacacgcatacacccggctgcagcacatggaacagtattaatcacaaccacaagcaggtgcgccgctgaagatagaccagacgcatgttgagcaagcgtccacgactgctatcgttcaactcggggtagtgcaactgctacagaccactcaatatcgaaacaaacaagcattgaaggcagggtcatcggatctccatccactgataattctatcaa

SEQ ID NO: 1554 - DNA, 505 bp, Bacillus thuringiensis
aggctcggtaattacaaactgtttttacgaatgaaaagtatggatggggtagcccggttactttcccgcagttttcaattttagatccagttcatactacttctgtaccgaaagatcaaacaatttacggtatggtagatattatgtcgcacgtattagaacaatatttccatcatggaacgaatacagaactacaagatcgttattgtgaagctgttttaaaaacagtaattgagacagcacctaagcttttaagtgatttagaaaattatgagcatagagaaactattttatattgtggtactatggcgttaaacggcattttagcgatgggagtaaaaggagattgggcgactcataatattgagcatgcagtttctgctgttcatgatataccacacgggggtggccttgcgattttattcccgaactggatgaaacatgttgtagaggaaaatgtaagtcgttttaaacagttcgctatttgtgtatttgatatagaaac

SEQ ID NO: 1555 - DNA, 293 bp, Bacillus thuringiensis
gatccgcgggcgcagctataggcggtgcgatatcatgagcgatttcaagtggtttaccttgctgagctgatgctgcagctccttctgcccatctaccaaacacaaagggatcgccgtactgaagtccagatacaacgggtatcctagttagcatactaaacgaagaaacgaggcaattgactctggcatcatacggtgatagttcgggagttttcacgactaaattagatccgcggcgggctatgcgaggcaaagccgctaatgatacacaagtggaggatataaaataacat

SEQ ID NO: 1556 - DNA, 329 bp, Bacillus thuringiensis
ttctttttttattcgcgccagtgataagtttgtcatatccaaggaagccatacttgggtgcgtgggactactagatagcttgatacataattaagtggtatcctccttctagagtactaagaggctcttgatatggaaattgggccgcattgacatcgcggtgtacgttatctgtgcagagtgaactacattatatgcaccgtgtgtcaatgctaaccacgggaagggcaatgccaagctcagatgcgccccatgggcctgatctaccaaaacggggattttatgcgcatgcgcaaaagaggtgctcgccttgagatgctttcccttcc

SEQ ID NO: 1557 - DNA, 324 bp, Bacillus thuringiensis
ctctttttttatacgcgcgtgagctacgtttttatttccaaagctgccataggcgtatacgatggactactgcttagattgatacataatatatggttaagctcttattctactactatgtgtctgttcaactggtaatcatgcccccacgtcatcgctgtcaacgttatcttatcagaatgaactaccttatttgcactatgggtcatcgcttactgcgggagagggaatgccaagatcagttgagccccatgtgcttccactaccaacacccgaattatacgctcgtgctaacaagcgttgctcgcctgtagctgccttccc

SEQ ID NO: 1558 - DNA, 331 bp, Bacillus thuringiensis
ttcttattttattcgcgcctgagcaaattttgtattaacctaggatgccacaccgggatacgatggtctactgcattggttgatacataaatcagtggtatcctgcgtgtggacttctatgtgactatttatatgttaataggaacccctggtcagcgcgggcaaggttttatgagcagactgaactacagtatgtggaccatgagtcaatgcttactacgggaaatggattgccacgcacagatgggccccatgcgcctgctctaccaacataaggattttattctcgtgcgccaaagagattctcgcctctagatgctttcccattcca

SEQ ID NO: 1559 - DNA, 290 bp, Bacillus thuringiensis
ttggtgatccctcgtattatccctgaacgcgaagtgttttttgatcaatgggtgaacgttgtccaagaggggtgtatgattcgaacggtattatccaaacacatgtatgaaaaatcagggtcttgaaaaaccggtttccccttttacgatgtaaccccactatataaagcgatcatttcagccatatactctttcgatattttctacggccatgatcatatcactgatagggctcgctgccagtcccggcactgacatacttccgatatgaagacttatgcccgtttctg

SEQ ID NO: 1560 - DNA, 251 bp, Bacillus thuringiensis
tccatagtgaagggcaaacatcagcgacatgctccttggccgttgtgtccgctcaacagggggaatttgtattagtaatcgatgcacatatgcccaaaccaacattgcattaaatgagccaaggagacaatatttgtggactaacgaatgtagttacacatagtgagcgtctatagaaatgggtgcaaacaacacctgaagcaaatttacactgttcagcttgtagatgcaaaccccctgaacccatctga

SEQ ID NO: 1561 - DNA, 379 bp, Bacillus thuringiensis
agaaaaggcttgctccgatggcaaaaagaattcttttcagccattgcgcgaccataataagatgggcataaatattattgttgcctagccaaaccatatattattcggctttatgctctttagacaggcttctgcaactcggaacgtcgaagcatgtagcctctagatttatggtgctcattattatcacggcataattcccccatgttatttaaagtcatagcttgaatcatatctttttccggaaaagaatctacttctcttactagactctcataaaacagtagagcatgtacatattgtgctgcttcaacataacttaaagccattatgggctgacaatttatgacataacggactgtataatcatgacgggacc

SEQ ID NO: 1562 - DNA, 532 bp, Bacillus thuringiensis
attatcgtttgaattatattatcctttatgtttaaagaacatcaattaagagatgatcacttcccagaagtgaataataagcgtccactgcgtaaaaaaatgtgggatgtatgtacacacgctgttgaggaattcttctcaatgggaaaatatttagtactaggtgcgttaattgcagcagcggtacaaacgtttgtacaaacttcaacacttcttgctattggacaaggcccattttcttcatcagctgttatgatgggacttgcttatatattatcactttgttcagaggcagatgcatttatcgcttcttcgttccaaagtacgttttcaacagcttcacttgtcgcgttcctcgtttacggaccgatggtggatattaaaaatatgtttatgatgcttgcgacatttaaaacgaaatttgtaattgttgttatagttacagttactcttgttgtttatgcaagctcactactcatttatgcgatggggtggttggttatgtttcgagcatatatattattaggtttta

SEQ ID NO: 1563 - DNA, 191 bp, Bacillus thuringiensis
ccaccgaagtatcaacgatgattgcacgtcctgctaaaccagcatcaccttgtggtcggggggtttctaagcggccagtgggattaatgaagaattgcgcttcgccatccatcaattctgcttgtactacagctttaatttcgtgccctgttaagcccagaccgagatctacccaggtaacatccgtatga

SEQ ID NO: 1564 - DNA, 300 bp, Bacillus thuringiensis
cttgctggccaactcagacgaatgcgatttttttagctgtgaaaaacggcgatcattgttttattaatggatcgagagtgtggatatcacttggtgacggatgaggtacatacataggattcaggttctaccatttcatacgcgggatataggggtgtctgcgcatttatcggaagaaaacgatacacctgggttaatcattggaaaagatgaacgtaaaatggcgcttctcagctctagtgcagttcatcttactttagaagatacgaaagggcctgttgagaatgtacgtgggctaca

SEQ ID NO: 1565 - DNA, 398 bp, Bacillus thuringiensis
tgtgcctcatcctctacatagggaatgggctgttttaaccaaccgattttttgatagatgggcggctatttggctatgagggtttcgggccagttctaccgatcgctgcgctcgtgcatgtaggaaacagaggagttgtacaacatatcgctgactatataccgtgcggggaacacgggattatgaacgacgtctgtatggctgtatctgaaactgggcctttaaagtcagcacgtaccggcagggacattgaccatcgtgggtgtgatatccggattgcaaggagcaagttttttaggcatattaattgctgggtccattgcccatcttttgggtacagttctaggccgtggaacagttgcctaaacaggactgaggaaaactgaaaatttttggac

SEQ ID NO: 1566 - DNA, 272 bp, Bacillus thuringiensis
ttaatcggttaatctgttacacttccaatcgttggcggggggatttcttttcttgctgatgcagacgcacaaaaagaattatgggccgggatacacgagtttacgccagctcatgaccccgaggactttgaagtaggcaaccgatatgacttaccacacatattcagcctgaacgaagatggaacaacgaacgaaaaagctggtcagtataacgggatggatcgtcccgaatgccgaaaagaatctgttggagacttacacgaagctggcgt

SEQ ID NO: 1567 - DNA, 379 bp, Bacillus thuringiensis
gttccgttggctgcatggggaccgcttgttctttgggccacacaacatacacgcttatgtggtttgataacacggggattctgaacttccagattggagccatgttttcgggggtatacaagaactgcaagtcactgcttgacaaaagacaacacgtatactcaagaagataagggcatcccggggtaccttccgcgccatgaaatctagatacaccctggaggtcaaggcgaaccttatgaccgttccggtctgggacttctaggtgatacaaaagcaacattgaaccccgaagatcgggtattaactgtatcagctcactaagaaggtgaactcggtgaaaaaagatgttcatataggcgtacctgccgttttaaat

SEQ ID NO: 1568 - DNA, 396 bp, Bacillus thuringiensis
gtgatgatacatttacgccacatgcatttcgatcccctgtattccctgtcggttgagtcataccagcatggggggattccgaagcataattgacgctgcatctgttctatgaaccggcgctgtacttgcttcaagaggcacagtgagcgtagcacagattcctgctctaatcgttccagaaccatctgcatctacattcgggccatcaccgctatcggcacccttcggatcatggagtccatgctcagtattatcccgactaaactggttcccaaattaatcagattgcggtgctttacactcaccactatcgtgcacatgtatgcctagcgggcctgccgtgaaacctctctactatatttaaatggactccgctagttggctgagactactttc

SEQ ID NO: 1569 - DNA, 219 bp, Bacillus thuringiensis
ctgccatacaacactcaaaggctcatcgaagagcctttaacaattacatggctgaatgcactacaatctgtaaaagcaacgataataccgttatctcttgcaatagcaatagaatcatttaataaaattttataaactcatgctgcactaaatgcatactttctagagcgtgcaaagcttgaagggtcattctcgaccatatcaaatttcatcctaatc

SEQ ID NO: 1570 - DNA, 205 bp, Bacillus thuringiensis
caacagtcacacttgggttagacagggggggacttattaaacacgtcgacccgttcggccttgccacacgaagtgccttaccaagaggttttgcgtttaaatggcgaaaatcttttgctagagcttgcgcagaacccgtggctgtcggaatgatagattgtccgcaaggccgagcccttctaaaatccttatgaggggtatcaat

SEQ ID NO: 1571 - DNA, 395 bp, Bacillus thuringiensis
cgtaatcgaaccatttttaatgcctattcaaacgtttataccatgatccgaaggacgccattcccacagacgagaaagtgaacaatctccggctttgtcatgacaaggagcaggtatgcgtctggtaacataggattggtactggataaaatccacagataaggatttatggtatgacagccaactcagagaaaggcatgagacgaatgacagccacatttaattggaatgaaccgtgccaggatgtacaaactcataattgaaacacaatgctactgacactatatgaaacacaagctgatacttgctttatattagaacgagactgttagctagcatgctctgctggctcattcaccaagctaatattttgaagtttgctacggtgtaaacag

SEQ ID NO: 1572 - DNA, 536 bp, Bacillus thuringiensis
tacggaccgatggaagcaaattatgtatatattagtccgttcggaaaagcatgtcaggcgtacgcaactatgtttttcgaaaactgggttatattatcagcgaaacatggatttttaagaccaagtgatattgtattagaaaactatgatcttgcatttgattcaaaaagcgatgaggtaataagtatagagcaattacaaaaacagatggtagataaaagtttactacagtttgacgaaatcgtcttactagcagggaagaagcataaaaaagtagtgacaaagttatatccagaagaaatgattacatatccgctagaggggtgtaaaggaattgggtatatgttgcagaggttgaaagaagctgtgaaggaaggggaggaaatatagttgtagttttagtgattttaaactctatttatttagggagctgaaaagtaaaatagagtttttaggcatcggtcgaagggtgatgcttttttgttcgtgtcgtattcatgtaaaagtaatttagagaattaattattcgatttatg

SEQ ID NO: 1573 - DNA, 268 bp, Bacillus thuringiensis
ttcgtttcctgttttagggcggacactgtaatcttactttctttttgagagaacgattgatatattcttgcagagaggatacgtacaaaggactgttatgttacacaagtgaaccttccatggtaagcatgaacatcgttttgcggctgcagaggagcttttacctttccttaggaataaggtgaacccggaatacaaggtcgttgcgtaaagtctcatacatgagctacatgggcacgctctgtgttaaatttacctgtactgggcg

SEQ ID NO: 1574 - DNA, 410 bp, Bacillus thuringiensis
gcgacagggacattataaacctccgctgttgagacaacgcgttttttttaatcagcaccggacgcttgacgtgccggaacctctatctgaccgaatcgctggccacccaactgtgcttgtccttccagagggtgctgcgtttcaagtgcgtatggtccctttgcactagcatgcagtttatcgtctaccctgggcgctagactgattatctgcatgacacctgccgaatcgcggttttcgcatggtttaccactgcttccgacaaaccagaatgttttcgggacatttgccataccagcttcttgaattgcgccccaaccatctttctcattcgcaccatgaaatactggtggcgctatgagactgcctaggtgtcatggtgccctaccattattaatcccttgtacctg

SEQ ID NO: 1575 - DNA, 328 bp, Bacillus thuringiensis
gtatacgccagactgtatattaattgcctttgggatttttttttatggaactttaatacagcctgatgcgctccgactgggcatgcaattgaaccctaacgggtcatttttcttatgcagcttcttttgtttctcaagccattatctatgacacaccatatataagatgtgttttcaatcgtgggattcggcattttttagagggaaacaggcggttaagacctgtgtgattatacgggtgtttctctggatcgctggatataccagggatggatgatctggattaatcccaagtgctttatatgtcgttaggtttattttgggcttt

SEQ ID NO: 1576 - DNA, 269 bp, Bacillus thuringiensis
cactcgtgctctacacttcatctatggtaaagaacctggatttttaatactgattatagtcctcactatgccccgacaattacggtggctctgactcgcttatcagctgcgaacacgcccgagagcatgattaaaaggattgagttgtccatacataacagcttgtaacatgccctgcttggtgcttgatcgacggttttctacgagagaatactgctggaatacataacaacggacatggctcccccccgcgatgactatgtgctctc

SEQ ID NO: 1577 - DNA, 248 bp, Bacillus thuringiensis
agaaaaacagaaactcttgggctatcacatgttcatcttaagggttatataaccgaactgccttacagaggaatacttaggaaaattgaaaagggtaccccctggccaattcaatcaaggaagaatactcaaacaggccccggtgcttcatactcggctggccccctggaaccgggggatagcttggaccagggaagtattactggcgttatgaatgaaaaggattctgagggcccattacaagggaa

SEQ ID NO: 1578 - DNA, 334 bp, Bacillus thuringiensis
cttggcacgaatccagatcggatagaatttccactatttcatgactaagaatggtcaaaagtaaattgggattacctaccagatggcctcactgctgattctactcctcgcggctgaacaaactctccacattcacatttatacggtagctgctccatgccaagtcccaataacatcactctgagccgggtcataacctgtccctcttttcgtaataacgtgaaccaccactgggccttttgccttctatgcatattgcaacggtccaaataagacttcatgtacaagcccctcgcccggacctagttatgtaaagcctaactcttccaaaaac

SEQ ID NO: 1579 - DNA, 364 bp, Bacillus thuringiensis
gaaacgccaaaactttttttcctggaccgacatttaaattgactccgggcgcagctatgtatgggagctgtggacctcgtccggagcccataagagggcatggcattcctgcgatgggaagggactctaacggcatcccgttctacaggaacacttggagagtacacattccgacaggacccaggcagatgaatctaccgtaaggatcattactttttgctgcaagaaggattattcgaaacacgagttagagaccaggcgtggttatgaccctcggcgctagaaatacaagatgttgagtgacctttgtgaacataaagtcgggctgtggcttcggtaacattccttgtccattttcccaccc

SEQ ID NO: 1580 - DNA, 271 bp, Bacillus thuringiensis
tcagaatcacaggcaagtgtagggaatctactaaggagcggactcacaggtggtttaggagagcgatcctatcctgcctcaggatagcggaagaggggggcccccttgcttacgtacgcacgttaagggggaccattattgacgttctccgacatgaactggttgctttagactgtggcgaaacgcggttggatataagattagagggcgctttaccaactttatacgcctttggtggagaccggccgtttaccatccagaggcacaaacc

SEQ ID NO: 1581 - DNA, 360 bp, Bacillus thuringiensis
cgtaagcgtaaacttcttgtttagcaaattgaaggtaaaaaacgtatgaagtctgttgggtctgtagaagtaccgcaagaggcatttatggctgtactgaaaatggatgacaactaatatttggaataaaaaagaagacgaatgtgcgggttcttttatctgaataataactttttagacatctgagcagctctcatttacaataatgagagagcttgttagttcatatagagttaggagattgttaatgtccgaaaatattcgaaaagatattcaagataaaatacagaatggtcattttaattgtgaaaaggaattgacgctttctattattagtggaaagtggaaaggtgtgatact

SEQ ID NO: 1582 - DNA, 182 bp, Bacillus thuringiensis
acgtgaggtctagagccagccgcggcaggagaagctagccgacgaagccagatgcggacctacactttttgttttatacacaggaaatacagcagcaagggggggagtaaaaggacctatggaggggggggcaaatgaaaacgtaatgaatacgccaactgaagatcggagaaaaagaaaac

SEQ ID NO: 1583 - DNA, 459 bp, Bacillus thuringiensis
caatattgatcatttttctttaattgccatccttgttcatgcttccaatctttaagaacgaacggtccattataaactgttgtatcagactctataccgaacttctcgcccttttctttaacgaacttttcgtttaatggataatatgatgggaatgctactaagtttaagaagtacggtactgcttgctctaactcaacttcaagcgtaagatcatctactgcttttactcctaattcagttacaggtttttctcctttatttactacttctgcatttttaatcgggaatgcgataaatgcatactcagcagctgtttttggatctaatagacgttgccaagcatatacgaaatctttcgccgttactggatctccatttgaccattttgcatctttacgtaggttaaatggatattttttaccatcttcactttttcgtgctagattctgctgcagc

SEQ ID NO: 1584 - DNA, 266 bp, Bacillus thuringiensis
gcgatggaagcgcttgactggttaactagctgactgcggacgccacctttctctaagaagttatgcccgaattagagacgtattagagttaccaattctcatcgctagtcacacctattcttatccttggtatcttgatgagggttagcgtgtcaagattcaagacattgctacctaagaagaccctacagtaaatatatccttggtgattaacgtctccttctattgtgccactcaatgctatatatacctttgcatatgagcgc

SEQ ID NO: 1585 - DNA, 391 bp, Bacillus thuringiensis
gtcaaacgagatcaatacctttttagtacatacctcacccccctagtccaaagaaagggtgaactttatacaccccggtaatctaataaaccctccgacgataggagagacatccaacatatggcttgtgatgactagcactgcaaagaagagagtgatccttcctagcataccatcaaaccgttcttctaaaggtactcaaggattgagggaggggacacgaacaaatctatctagaccaatgcgatatgcacagaacgaggctcgaacgggcacatagggaaaccaccaacgctcaaaaaccttaacttggcattccaggaggtgatggaagccgattgcctccggattaaaagataagctgaaaatgccatacctttcgatttggaac

SEQ ID NO: 1586 - DNA, 245 bp, Bacillus thuringiensis
agcctgaattaatggtagaaacaattcgcgatcgtttaggccgtagtgcaacatataacgaagtatacggtggttattcaagagagaaattcaaagaaatttcttgcgtaattaaccgtttagaagaaagtaaaatgaaagaacttattaatgaaatcgatccacacgcctttattacagtttatgacgtagcagaagtaaaaggcggtaatttcaagaaacgtgatattcattaatcgttatat

SEQ ID NO: 1587 - DNA, 354 bp, Bacillus thuringiensis
gtctctttcggttcaaatactccattcacttttttttcaaatcatgccggaatagaacgaacggcaggcgcttgtccgatattaagattgatatctacatcccaaccggccccgtgaggtaaggcatcataatcgccaccacttacgtctgacgtgagaaccggtgcatattttcttactgctttcgtagctatcactactgctccgtgagttcactcttgcaattgcaatcttagttccaaatgtttataacgcgccttattaccatccctccccgcacagtctatacctacatcgctaccaccatgggaaatcatcttccaatgtccttccatattgtggaatcatgtccac

SEQ ID NO: 1588 - DNA, 282 bp, Bacillus thuringiensis
cattatacactgctctgacatcccggagagccagctctattatgtggaaggatctcgcatcctgctttgtagagcaatcgagagctaaaatgggcacaccataaccatctaccgtaccactggccagttatcagatagtgttcctacatatgcgccatctggatccatcagtagctgaacacagtagaccctgcccggttctaatccagggccattatttggtggaccatagcgcgaagatcggagggcacctatgtttgtcttgccccaattcgtgcccaa

SEQ ID NO: 1589 - DNA, 295 bp, Bacillus thuringiensis
ttctagaaaaactctttggctcaaatctccattatcactttttaaactgcccctgcataaaatgaatgggaggggcttgacccatcataagagggatatttctaacccaacaagccccgagtggaactgcatcataattgccaccataaacacccgttagttttaccgttccatattttctcactagttttgtcgccatatgaatagcgcccagagattccgcctcttaaattcccaattttgattctgaaattctaaaggcgacttttttacattcaaccccacgcaatcaata

SEQ ID NO: 1590 - DNA, 293 bp, Bacillus thuringiensis
cgcgtacgttcttatcagaatccgcgatagtatttttatataaaaataaaaaaatcagctcccctagtgggttctgattttttcacttcattattcttgtgaagaagaatcgttagatgattctgtagaaccatttgctgatttttcttctttcttcggttcttcttttttgtcactagttgcaccgcttgttgatttctcttatttctgagacttgttttctgtgttactttcaggctttctgtctctttgactttctcttattttcgcagaattcgccatacaattttttt

SEQ ID NO: 1591 - DNA, 447 bp, Bacillus thuringiensis
atatttttagtgatgagctaacgaaactgctatacagaggagtactaaaaattatatacacggtaacattttgccaacttcattttgggaagaatacgtaaatagggtccgatacgatatatgcgcatggccctatgggacccggttgttgtttgtacgaaggaaactttgctggtacaaccgatgtgataaatactgagtggccattaaacggtaaatcatacttacgtccactgaagactactatacaggctaacgcatttgctcactaccacacgaagtcgcttgaactcagtaaaaaacgaggcgctatatgaaaacgtatggaactatgcgttatgcagcgcatattactgaacaccccgaatccaccagatagggtgctacttctggcgatgaccggccgctatatcatatagcatgagactcgttaacatatggatcctt

SEQ ID NO: 1592 - DNA, 368 bp, Bacillus thuringiensis
cgatgaatgggagctgcccattcctgtagctatagcaaaaatccaaaacgttattgcagtatgagcgatccatgctcacgtagaggaagagtaaatacatacaacaacttgctctcattcttactatttcccagcattttttgcaacacgtgatttggatgcgtgagcacacttggatattgacttaattaatgcaaatcgacaggagctattagtgctagaagaacattgaaagagctgattgatccttgctgactggattttacacgactaaagagatctggggcgaacaggccatcctattatatcgcaagatattgtcagatcttgtggtgatcaagtcaacttaatctagcctttgaaccgtt

SEQ ID NO: 1593 - DNA, 250 bp, Bacillus thuringiensis
gggcctatctattcgaaaaaacaggattgacagtattttccatactaagcattataggagtattaactactattcattgaggcatcttattgaaggggacaattgagtgaagaaaaatccaccgtagtacaatgaaattttttatgcagtagttattgagattgccgagaatgcatgccaccaaggtcacatttctaaaatcttgaagcaagctgggttagctgatggcacgatcaatttatagtttaaa

SEQ ID NO: 1594 - DNA, 362 bp, Bacillus thuringiensis
acctgcctcaattggggctttttctatacataggctgcggtataaaggaagagcttcgtcacgaacatatcgtgatgggtgcacgatacgagaccttttcgctaaaccaaattgttcctttacaagatgaactggtacaaatgcaactggagtatcagaaattagcaacataccgtaaaatatctgctacttgctgagcatttttcatacgcaaataagcacgctgaggcagtggaatattaaatgagttcaatagtacatgtgcaacaccagcatagtggccaggtctttgtcgaccgtataatacgatcgagcgcttcaccacttctaccgcagaagtgcgatttgctgattgcaattcg

SEQ ID NO: 1595 - DNA, 328 bp, Bacillus thuringiensis
agagcatttttctggtaatcagtgagtagggggaacaagtactgtttgaggaacctactaactatgcagacgtggaaaatatggattggctaccagattgtggatacgaaattcgagaggcctacttacaaaagtctcacgatatggcttaaataaactaatatgcggatgtggttgaataggtagacttaccagacttaacatcttgtgccgtcgcctatgagaaatgcctagatctagccgaacttaatataaaataacatatacacgcttatgaaaaggagtgcaagggtataaaacagcctagccattgattgcgaagaacaag

SEQ ID NO: 1596 - DNA, 341 bp, Bacillus thuringiensis
taaaaaccagtcgaatttaaaatacgatataataaatcacgcatcggaatgattgtacgccttagctttgataaatctgtacgtatatcaaatacctcttctaatacacttcctgctgtctcccccgttaaattatcatcaattgcatttaaatgatcctcaatgtaatatacaggcgcaaaatagtcatctacaatttggtcgataattgtatgagctacgtgtaaaggactatttttaatacgcttcttttctccaagtgttttccatactctttcgattgcattgttatgagaaaagtggaaagaaacaatataacgatcactaataaaataatcgat

SEQ ID NO: 1597 - DNA, 433 bp, Bacillus thuringiensis
cgctgacaagtgacattcgggggttaatgcatgaaaaacctgcctttaccaagacccatatatctggttgaaatgttctgatgatataaatatacacgaatgcgatcacattttctatataaaactaaacctattctgagggaatagaataaaactcgcattattgcatgatatagattctatgcagaggaaaataatggagaaacaaggaagaaacccttacgtatattgtaagagagagctaacttctaatcttcttgatcgaattgataaactataattgacgatggatgacatacaagctactaatattagatgccgaatactgttattcacaatcagcccgatagtagtttgagcgttatgcataacctaagggagtgatataacacccgctagcgacgaatccttcacgatgcaatagattgactga

SEQ ID NO: 1598 - DNA, 478 bp, Bacillus thuringiensis
agcgggatcatggaaattttggccattgtacatattctatacaggcttcaatggcacggggatgcgtcttaaactggtcttgcagaatatatgcatactctacttgcgttggctaatgtgaatttagccgacaccatacagaatggccgttctttggttcttctagagaaacatgatgtcatacgtgatccggctttgttactgcgcagattctaatcataatttcacccagtgttatcataaacagagcatagtcgaaagagctaaggagaaatctcctcagctgtttgttaatagttcattacgattccgtgtactaaagttggagcatctacgagttctgtagagatattcaagttctcagaaaatttcgcttttacagctgcaacatttttgcggtttgcgtaaattgcaacgagagattcaccttgctgcactctatcgcctacttttttgcgcaggatgagaccagctgcta

SEQ ID NO: 1599 - DNA, 230 bp, Bacillus thuringiensis
agttgaagttttttatacgttgacggatgctatattatatctgagtgcacaacaagttccagcgggagcacttattagatgattagtggtgtatgcatatacgacgtctgtattagtagtaggaacacgtatgacggtgtatgtagtgtttggtggcctggcagtaaccaccgcgatgcgggcatgtaggggaggacttttctatgtccgaaacggtcattatataaggc

SEQ ID NO: 1600 - DNA, 469 bp, Bacillus thuringiensis
cgaactaccgctgtagacaaaatatctcaaggggtgcgcatttgtacatttatttcaaagcgttagctgtattcattagcctaccattctcctactcagcagttacagagtcagctacggtacgtgggtcatcaacgtgacgctcgcggtgaagtgctgcctactgtgagacatgtcgtaatgggatacctgctactaacggggctagcgcttcgcgtacagctggtaatccgacgctgccacctggcatttctatgcctcgcattgatatgatacacgggttagccccccgtgctactacttcctttatgtttccaggaagtgcaaggcttacgtgcacttgaggctgaagggctataactgctgtgccagtttcaatttccgcgattggtccggggtataactctcctgcagcgaatgcttgtggttggatgtacgagatctctcttagtgataacgcaccttctag

SEQ ID NO: 1601 - DNA, 184 bp, Bacillus thuringiensis
ccacaagatgggatcgttcacaggtgggacaaacacaggtccacatttttttatttgagcattaatgattccactcgtcttagaccttggagggaaagaccctggtatcgtacccgaagatgccgactgacaagatgctgcggaccataacgacagcggcgctgacttttactctggtcaacgc

SEQ ID NO: 1602 - DNA, 227 bp, Bacillus thuringiensis
gaatcggatatttgccatgttattggaatggatcgtacttccataaacaacggatctagaattggagctattttttctatgctctagctttcttacatggactataacaaacatgctttttaccaatgccctaacccctacatagcgcgttccaccgtgggcagctcttccttttacacggagacgaaaccccatggtaccttgtcgcttagggaaaaactttatat

SEQ ID NO: 1603 - DNA, 380 bp, Bacillus thuringiensis
gcgctcgaggcgcgtcgacacaatttcagataccctgttgtatgctcagctgaatgaactgaccttgggtaaattttgctgctaaatatgcataacatacaactcgattaaaatctacatatacgcaatttcccactgcgtgagaattataaacttttggtgggatagtatctacactacgtttcgtaccaaagattgatgagtattgcgctcttacataggctatttcgtatacatgtgaaacgtgcttaggctatgctgcttgtaggctgaccgatgctacattacgcttaccttcatgaacacgacccggacataaacatacatttgctaaaaagtcatatgcaaacgaactcgctggattatcatatacttgttcc

SEQ ID NO: 1604 - DNA, 244 bp, Bacillus thuringiensis
acccaccctaaacttaccacaagggggtgatatatggcaagcacctgggttaacggcagcggatgtagatctttcgtgcctcacacttgctatacaaacttttgatccttggcttattgcaattattgcaagtgcgggagcattaacagcattggcttcccaatcgacgctagttatacctgcgatgaacactgcgaatcaaacttctctttaagggcccagtattaatccaacttccaaatcc

SEQ ID NO: 1605 - DNA, 359 bp, Bacillus thuringiensis
caacatagatgccccaagaccaaactgttttatttcaacgataagaagcggcgagcgtggttattcagctggggctggaagaaaactgaatcctattatctacaaaaccactccatgagttgctattatcacatcactcagctgaactaaaagctttggccttatttgactatgtgagacaatgtcttgcaagctcaatattgaccacataaggacgattaaggcagggacacaacggcaagtatccattgaaaattgcgcgagaatcgcctgagctgatccggcatgtatcgaaagcaaagacgcttcgataagaaaccatttcaaatttgcaatggaaagattatatgctagctggg

SEQ ID NO: 1606 - DNA, 501 bp, Bacillus thuringiensis
atctcatacaactgcgtccgggacattattttcatttaaatttaactgaacaggatgaactagctctaaatgagtatgacacgtttctaagtctggaccatatgcgaaacccaaagctactagttcctaccaaacgcgaattacttcaatgtatggctgaggcgcaataacagcaaggactatgggagtgagtggacgtggtaccgcatcagttcgaagctttgggacggtacctaagccatgtgcaactgcttgtgcctaatggaacacttggtgttgaccacctgctgttactcgatgatcgctaaccgcttgacgctcatgagacggaccgactacgacatgctcactgcattacggaaagagatgttgatcgtacagaggctgaacaacagcgataccgtgtgatggtgcactcttgtacaggagctgaacaatgtgagcgttctggaatgttactcggagcttaacggctaatggatgcaggaatgctttcaccca

SEQ ID NO: 1607 - DNA, 290 bp, Bacillus thuringiensis
acaaatcctgatcgcaacgcatcaccattttttcgatcatcccttgcaggcccatgcgctggccgtcctcggggctgtagatgcgggccacgccatagtcgtgcagctcgcggatttcggccggcacgatcacgccgccaccgacgccaaacacctgcacgtgcgcgccgccgcggctcttcagcagatcgaccatgtacttgaagtattcgacgtgcccgccctggtagctgctgatggcgatgccctgcgcgtctttctgcaaggcggcggtcaccacctcatcgacg

SEQ ID NO: 1608 - DNA, 580 bp, Bacillus thuringiensis
atcgcatcggagttcgtgatccatccgctagccctcccgaaaacctatttttatacgaacacattctagcatatgggtggttttaaaaacaaaaaggagggttcccaaaaaggaaactcttcttccctgttaatatgtaaggattatttaaccgcatcttttaacgctttaccaggtttgaatgcacgtactttacttgcagcgatttcaatctcctcacctgtttgagggttacgacctttacgagccgcacgctcacgaacttcgaagttaccgaatccgatcagttgtactttatcaccttgttttaaagcttctaagatagaatcaaaaacagcgtctactgcttttgttgcgtcctttttagaaagggaacttgcttctgcaacagcattgattaaatctgtcttgttcatgccattcacctcctcccaaagataagactgtataatgatcataaaatgagtcttactttaattcgaggcaatttttgccaattctatactacaaagaattagataaatcattatcaacccctattttataccaatctccttatattccatattttctaagaaat

SEQ ID NO: 1609 - DNA, 294 bp, Bacillus thuringiensis
attatgtatagacatgtctaatggcaaggatgtggtaaaaatacctattagctctgtagatgaacttaagactagatacacttatgacatatataaacatgttgtgcacggaaactgtgacagcaaagatggcgatgttgatgcgagagatggatccaggaggtcaaatacaaagtgggcccacaatcggagccaaggagcatgagatgcatgtggcgaagtttaccatgaagctggagtctgtatttcagaattagagcacgcgttgtttcagagagccagaactagctaatt

SEQ ID NO: 1610 - DNA, 127 bp, Bacillus thuringiensis
gtacttgctgccatccgggttcgcttgggttttcacacgttgctgctgattgcgccgaagctgctgggccaggctgcgggcaagttttccgcgctctgctggctgcagcttcctgagtagcgggcct

SEQ ID NO: 1611 - DNA, 223 bp, Bacillus thuringiensis
agatctattatttagtgatattaaacagatctattactacaaacatacgttgtggatgtgtctcacatacgctgaccgttcaaaacgtcaacagtctgaatctctagctgattatatccgataggctgaaaaacgatcatatgatgctgagtgtacacgaatgtgatcatgtcattcagtgagtgaacgtaacgagacacctcatgatgaacaagctcaatta

SEQ ID NO: 1612 - DNA, 379 bp, Bacillus thuringiensis
cgaagcggcacctcgggttctaaaaccgcgcgcatatggcgaacagccggggggagtaatggccaaacacgaagggaatacaacagagatgaaaacgggtgaaggaaaaacggaaacatctacagaaccagcatacataaaagcacgaacaggaaaaggtgaccacgacggtacagacaatgaaaacgaaccacaacgagatgcgagcgaaaagcgacaacctcatgagttccgaggccgaacggtaggaatgaactaaaaaagcatgccacgcgcagagaaacacgaggcgcaagcagccgagactacgcagagcacagataatgagctgggaggcgataacgtacgagagaacaagagcggagataaagagcagagc

SEQ ID NO: 1613 - DNA, 346 bp, Bacillus thuringiensis
cataactgcgctactcgtctgtatgtacaaacggaattctggttcaactctagcccaagcgaagcaattagagactccaggtggaactgcacactctatatcggtggtgttttatgacggattcacttcattgggatttcacctgtctggtatgtcacatttgggcaattccggcaccaccctgtgttcaccgtgagggcatcatagcttttaaggggcaacgggtggcgctgatcctaaagcatcgacctgccattaagatgcatgcgcgaacagactacgcgcagtccatgggatgtacggacatccactcttctaaacactggtgcaatggttggaggcccta

SEQ ID NO: 1614 - DNA, 346 bp, Bacillus thuringiensis
aaaccttggttttactcagttaaatgcattagcattaccagatcttaatcgcaatttatccaattggaatcgtacttatcgtattatcacttgttgaaaactacgttcgtcttccattagcgatgtatgtgggcgggattgtaggagcatttgcaataagtttctttgatggattacacaatgcaaaccttcaaattgcagcgctagcacctattttagataagattccattatatagtgtaggaattggttgggttagttcccaggctattcggtataggatttggttctttagcctctaagtgtcaaaagccggaaattgcttgcgaaaaatagagaaaagagg

SEQ ID NO: 1615 - DNA, 368 bp, Bacillus thuringiensis
tttctttacagagggtcacaacagcggccgcaccatctagtggccagcggtggacatctgatgcacaggttgaaactatactccgcccttctacttcgccgagaatgacatgaatgctatcaccaacgccacgctaacacataggaacgcacggatcttcactgctagcactatcacatcctaaatgtcgaatgccaattgtacgcgttaaaatcatgttagtaaaatcagctgatttaccaacaggagtgaattctaataccaagacgcctgtatgaacaacatgacctagaggtgaaatcactacaccgccatacgaatgtgggatgctgcaagttggaccgaaaatcgactctgacagaacgtgg

SEQ ID NO: 1616 - DNA, 442 bp, Bacillus thuringiensis
atacggtcgtctattgcagtgaagcgtacttaaaaaagggtatttcttgcctagctctactaaaatactatttaggtgtacataggaacccagtgtcattgcaggaaaagtggcatgttcataatgaactacaatacctgccccttatgttaatgctgactttggcattggtctctcccaagcgcagatgtgccacatgtgccttcatctacctgaacagggattatatgtccaagcgcaatagcgacgcttgcgactagatacagacgcttaccatcctgatcaagatgctgcaaaaggcgtgcttgcgcctttggatacttaccgactgctttgttaaggaactccgtaccaactcccaccggtgcctcatacgcttcatgcagccgcaggtatagatttacggggttcgctcccggaagctttaaagcatttattagcg

SEQ ID NO: 1617 - DNA, 321 bp, Bacillus thuringiensis
ttttcattcatataacgcaatctcaccaccatgtagatttatctcccaatacgtaactcggggggtgttcccggtttgcgcggatattcctctggtgaatagcgccttccctcccctaacaaaaaattacgttcactctattcaaacggcaattggaacgaagacattaattaaaactctccgactagccacctataaagcatacttgtcatattcaatttcttcggtcgctgactaacccttcattgcaaagaatgagcctccaaatttgacaagcggaaaacaaacttcaccttataccacaaagactcccaactgcac

SEQ ID NO: 1618 - DNA, 458 bp, Bacillus thuringiensis
  unsure (1)...(458): unsure at all n locations
acctttgggcaagaacagtaaaccctcctaaagaactggcgataggaattatggtggctcttgttggagttccgttcttcctctatatagcacgtaaagttgggagggagttgtaagtgaagaagattttaaacacagataaaacgagagccgttactgtaactacaatatttggttgtattagtatcgctgtcattttgcttagcttaaatacggggacacttagcattgcaccgctcaaagtaattcaaacgcttttcggtcatggtgattttgagagtgcaaccgtgctgtacgattatcgtatgccaagaattataatcacaatgttagctggtattggccttgggatttccggtgcgattttgcaagggttatcaaggaatgcgttggccgatcctggtattcttggactgcattcaggtgcatctttcgggctaattatattcgntactttc

SEQ ID NO: 1619 - DNA, 291 bp, Bacillus thuringiensis
gtgctaaatgaggtttatgaaaatttgatacacctttttagcgcactataccttcttaatacaattgcggcaaagatcggaacgaatcaacatacttccttcttaccggtcaatgtattaaatataaaaatacatagtgcatgtgtaattgtttcaaacatcttttaaacgcctctaggtgttttctacatatcctggatcggcgctgcatacatttggtgtaataaatagtatctttctcttggaatggactgattcagcgtatacgacttttcggcaccggatttcatt

SEQ ID NO: 1620 - DNA, 484 bp, Bacillus thuringiensis
cctgcttgggctattatgggacatttcgcttttatgttcattacgatatgggttgtatcaaagggtgtacaaaacggaattgaaaaagcaagtaaatatatgttgccagcattgttcgttttatttgtcgctcttattattcgttcgttaacacttgatgatgcaatgaaaggtgtgaagtttttcttacaaccagatttctcaaagattacttcggaaagtattttgttcgcaatggggcaatcattctttgcaattagtatcgggatttcaattatggttacgtatagttcctatttaaataaaaaagaaagtttaccaaaatcagcaataacaattgttggattaaatttatttgttttcattatttgcaggtcttgctatttttccagccgtattttcattaggaatggagccaacagaaagacctggattactatttatcgtattaccatctgtttttagtcaaacccattccgtggat

SEQ ID NO: 1621 - DNA, 345 bp, Bacillus thuringiensis
attggaccgtctagcgcttctggtggtatctcaattggagatgcatcagaggctattgggcgaggtgctgctgatgctatgattacaggcggggcaccagcaccgatcacacgtgtggcattcgggggatttagctcactgactgcattcacatcaaatgaagacccagctacggttggccggccattcgataaaaaccggacctggcctgtaaggctagaaggctcagggattctaattccttgggagttagagcacgcattactgacgtggtgcatcacattgacgcggaaagtgctggtctttgtgcaactggagatgcatcaccatattacagtgcctgct

SEQ ID NO: 1622 - DNA, 469 bp, Bacillus thuringiensis
ttattttgaacagaacaaaatcgaaaaacgtataaaaaccacggagcgaaagagccgttatttggagttagttttgcgaatttaaaattgttaaaaaagaagataaaaaaagatcatgatttagcagttggattgtgggaaacgaaaaatatggacgcaatgacattagcaacttatattttagatccgaaaaaaataacgacagaacagcttaatagttggattcaggatgttgattattactgtttgatggatgttcttatgacatctatatgtacttcgccaattgcaatagaaagaatggaagagtggacaaagtctaatgatgaatggattggaagagctggctggtctttattagcaaatatagcgattaaaaataaaacgttacatgatgatttcttctctccgtacttagaagagattaaagaaaatatacatattgaaaaaaattgaaaaaaaggagcga

SEQ ID NO: 1623 - DNA, 288 bp, Bacillus thuringiensis
ggagggggccctagcttatgagacactgtatttattaacaagccctataaggccgttcaatgcactgatcgttggattaccacctggagactgcgaaaaccctggggctgcccaacagaaatgacttgcatacattgcccttttgccacgctggcgtaggagctaaaaggccacaaccgactcggccttccagcacatgtccaatctgtgtggcaagtggaaacagtaggctattgtgctttgttaaaaactcaccaatatcatagtgaactactctcattttataac

SEQ ID NO: 1624 - DNA, 372 bp, Bacillus thuringiensis
ctcggctcacgacgatgaattacggtttttcttcatcgcgcgaagtatccggggggttcattcaatcctttgccgatgcttctatcttcaaatgcagctatcatactagcgacgcaggtgcaagggattcttacttcgaaacgctatattaaggagattgtatagggagtgaacatagccaacagagcagactgtgcatatgatctaggcctcgctctcatggagagtagcgaagcaatctcggaatttgacatcgctcagtctggactaatcgcagatgtccgagagacttcatcgatgaccggtaggaccgagttggcatcgtggccagctcgatgcacaacgtgtgaataaacaactgacaatcggagc

SEQ ID NO: 1625 - DNA, 411 bp, Bacillus thuringiensis
tttttcggattcgatccactggattcaaaagtggcgttaggtgtggatgcttcaggatcactgacgtggatggaatatttattaccaattggtgcgaacattgacttcgatggccgcatcgaccgtgaatatatgggaaaagaggaaaaccgaatcgtcttacgtattattgactactgatcaagttcaaaagcgagagatcaaacggacgtgtattgcggattaacactacatatgactacgtattgagatctttgtactatggagtgagcatacgtgaatgaaatagggtcacgcagcatctccagagtgctgtattgagtatccatattcataacccaaacggagagattagaggtgacactttcgatgctcatatggacaacgatgctttaaagaagtttaggatga

SEQ ID NO: 1626 - DNA, 337 bp, Bacillus thuringiensis
ttattatccccccacacagcgcattcaagggggggatatgtaatagctggggcggcaccaacaagaaatacaactggatggtttcaacgacggtgacacaaatgatatcgttcttgtattcgcacctgatgctagagctaacaattgatgtcctaagcaaatactgaataatggaactttaccgattctgacagttaacattctcatacgggtgttgatgcattgtacgtatctacaggtccaactcttaagataagtgcatcagggataaggcgtaaaatttcttcagatggtgtgccgaaaggaactgcaattacttcacagtcacgcttattta

SEQ ID NO: 1627 - DNA, 356 bp, Bacillus thuringiensis
gacattattttccctcacctaacgcacaccgtgagggagcgcatgaccgcggcaaagccctcccacagaaatcaaaagaattaattccgagacaacagttcgaagcgccaattcaggcgactatcggaaataaagttgaagtacgttctacaatcaaagcgatgccgaaaaacgcacctgcaaaacgaaacggcggtgacatatactcgaaagcgtaaacttctagataagcaaaaagaaggtaaaaaacgcatgaagtcagcaggttctgcagaagtaccgcacgaggcatttatggctgacctgaaaaaggatgacaaccaaaaactgaaataaaaaagcagacgaccgagcgg

SEQ ID NO: 1628 - DNA, 210 bp, Bacillus thuringiensis
catttgatgtaagcccccgatgaagaggatgaggaggggttattagaagaatgaggggatatattataacaaggaatgcttgatgctcaaatcggagaagatgaaggggggttctctatagatgatatcattcgaactctatctgcgaaaacggttcgttgccatccgcatgtgtttggtaatacggatgtgaacagcgctgatgaagtg

SEQ ID NO: 1629 - DNA, 537 bp, Bacillus thuringiensis
aaagccagaacacacaaatacataacaaaggaaaaaacatacccaccagcaccacaaccaaaacaaagaaaaaaatgcttataaaaagaaacaaaaaatcaaggaaaaactccaccaaaaaaaggacaaaagcccaaaaaaaaacgcccccgataaataaaatgaacgaaatcaccaaagacctctaaaataaaagaagaagcccaaaaaagtgcaacaacaacaacgggaaaactaggaccccaaaaccccaactcccagtccaaaattaaaacccaaaccaaacaaaaaaacccttaaaaacccaaaaaaaaattcataaaacaggaaaaaaaaggcaccccctccaaaaaacaaaccaatttgaaaccctcccaaaaagccccaaaccgaaaaaaacagcaaaaacaaaaaaggtaaaaaaaaaaggaaacacatgccccaacaaaaaacaaaaataaccctagaaacaaaaccatcccaccctttaaaaaaaaaaaaccaagccccaaaaaccgtggaacctgaaaaaaaaaa

SEQ ID NO: 1630 - DNA, 676 bp, Bacillus thuringiensis
  unsure (1)...(676): unsure at all n locations
aaacagcctngataaaagccaatccttccaatttcattagaaaggaaaaaacatttccaccttataaacaacacaaacaatgaaaaaatttgctaatcaaattaaacaaaaaaaataaagacaattttcaccatgaaatgaacaaaagacgaaataattaccccccattaattctaagttaaaccaatttaccaatatctaataaaataaaaaatgaatgtacaaaatctgtaaaaaaacttctaaaaaaaatacttaacccaaaaaccccaactacgtgtcatataatcgaatctcaataaaaattaaaaaatcccattataaattataaaataaaatttaaaaacttgataaaaaaaaaatgccctataaccattgtaaaaaccaaatttaaaccctttcctataagatccattaaccacaaaaaaggccaatacaaactttgtaataaaaaaaaataatacaataccaaaaatgttaacaattaattcttttaaaaaaaaaaccaacaccacctattataaataaaaatattcaaacccaaatactcgtttaaccaaaaataaaaacaaactatattgtcccctaaaaccataaaactccatattttaatcaaaaaaaaacaaataccgtttatccttaaaatataataaaaatccccaaaatataccaataa

SEQ ID NO: 1631 - DNA, 464 bp, Bacillus thuringiensis
ttcagagtatattacactttgacattttttaaagatagctgctgcaattgatacaagtcgcgctgaaaataggctgttacaagaatgtgaaatgtacgtgaacaactaacttgaaaatcggatagggcgccgactgtctactaatgatcgttattgcaaatgaccagtgaagcgtgaactgttccatggccacgcataaagggggagcccatcgtatatttcagaaataccattcacaaactatctcactattgacaaatcattgatactctttgaccataacgcaaatgttacaaatgctgaaactgctcaagggtatacaaagatgatggatgctgcatatgttataccgctagcgaattatgatacgacctgtaatgatcgtgaacttatacgctggcatgaagatgctggtcacgtaactgggaagtctcaaataaccaacagatccatgtctgtgcaat

SEQ ID NO: 1632 - DNA, 405 bp, Bacillus thuringiensis
cctaatataggatggtgtgtatatactgtatgtggaggtatacacagtatggacgcaaactggaggaaaacatgaatattattatttcgaattcttcccaagaccctatttatgtgcaaataagaaaacaattaagccagcttattttaaatggcggtttaaagggtggagatcaattaccggctattcgtagcttagcgaaggaattacaaattagtgtcattacaacgaagcgtgcatacgaggagcttgaaaaagaaggatatatagaaactgttgctgggaaggggacttatgtttcacgtaaaaataatgaactattaaaagaacaaaggcttcgcctattggaaaagaaagcggaagagattgcgaatgaaagtaaagccgttgcgctttcacttgaag

SEQ ID NO: 1633 - DNA, 258 bp, Bacillus thuringiensis
tattacattctggattataacagctttctatgcgctcacaaggtccacctgtaaattgttctttatcaacgataagggggtcttttagatttactgctacatatataccctcatttaacacgaaacaatccccatcccaaagctcaccttgtacttcagtatcttatccgtaccttaccattccgccgcgatacctaacctacatcctcatattctacactacactactaaccataaatcttttcatatccaattcac

SEQ ID NO: 1634 - DNA, 301 bp, Bacillus thuringiensis
gagagaccgtccacgcggcagatgctctgggctacggtgcatagttaacttctataagaatggagtgacgcgggcggggtttatgggcatgacggaatgaggcatgagctctttgcgcagcaggtggctgggacgcacgatgcattggctatagtgagtgagggtggagcgcgaacgtatcatgaactaagtggaaaactgagtgaaatggcacatcgtctacaaaaacgaagaataggccctgcggcagcgtatggtgtatggattgaacggtctactgagtgagcaatcggacatttgg

SEQ ID NO: 1635 - DNA, 380 bp, Bacillus thuringiensis
aacctccgacgtttacgcctgttttcaggtataacctgaggatgagcgccatccatttatttaaaaacgataatcatttacgatgattaaggttgcgaattgaaattccagacccgtaaccttttttaaaaacaaatttaattattcttacttaacgatgcccatacttcgttcagtacctttaaccattcgcattgcagcttctacgctagcagcatttaggtcaagcattttaatttcagcgatttcgcgtactttatcacgcttaacagttgctactttattacggttttgttcaccagaaccagactcaataccagctacttttttaacactaacataaagatgaggagtttttataatgaaagttaataaacggt

SEQ ID NO: 1636 - DNA, 310 bp, Bacillus thuringiensis
gtacattttgtggagtatgttgttcgtttgaagtgtggactaaggggcgtaaaatggtttaagttcaggtcatgatcatatgccccagctaatgcatattgtactagggcggaagttatataaaagggacggattgggaatattgtaaggaacgcaatacgaaaccgttaaaacttagagatggaaccgtagaaatttatgaacattttgacccagggaatggttcagcgctgtacctaggtgctgatattgtagcgcgcggattaggacgtgtcgacattaatggtcattaaaaagggtcaaagggggt

SEQ ID NO: 1637 - DNA, 278 bp, Bacillus thuringiensis
tgatttatatttatcacacgaactatgacttgtagcaggggcaattttaaaactttgtgattaaaaagaataaatggacgcattaacctaacaatttttaccatcaacgcgctactgtttcttcatcatccgtagagtagacttctacttacgataagaaggtgctctaaaactaaaataaatcttttacatccaaccaaaatgattccctggaggttacttaattcacgggacaatctatttaattgaaaatggttcaccactgtttctgcacttgc

SEQ ID NO: 1638 - DNA, 530 bp, Bacillus thuringiensis
tttccccagcctctcttaatctcctttttcatatccattcccaccttataaagcgctttttaactcaaaaaatatatcactgcacaatatgtttccatgcagtgatactatttttactgtgccttgttcggttgttctactggaattgaatttgtatttgatctatttgtttttaattcaaaatacgcatccaaaatctctttaccaatcgcagaattaattcctgatttatcatcattcacccatggtacaacaactgaaaaagctacttccggatcagcatcatatggtgcataaccggcaagagttaaattataacatttttttcggttgttgttctcatctcttccaatatcactttctccaccatatactgtctcagctgttcctgtttttcccgctggtttatatggtagacctttaaacgttccggtacctgttccgtcagcttcttgaaaaactcttctaaatccttcttttacatgattaatgtacgaagtgtccatatccactctatttaatacaactgg

SEQ ID NO: 1639 - DNA, 135 bp, Bacillus thuringiensis
gacatgcgatcgttctattgactcagcttgacctataatgtatgcttgcaaaccttgccatttatatttatcgtgcgccaaccggtgctttaaacatatcaactggcattggtccggaagaaggcttcgcacagg

SEQ ID NO: 1640 - DNA, 141 bp, Bacillus thuringiensis
cgaattcgcttgctctttttttttgtatacaatacctgttacatcactgggaaggtcatctggggtgaattgaacgcgagaaatactaccaccaaaacttttggaaatgggtttcgccagttactttttgccagtaccagg

SEQ ID NO: 1641 - DNA, 427 bp, Bacillus thuringiensis
caatgacactagcgaggaagtggatttatatcccatttatagcaacattacacatattaaagagtgcatcccaagaagtgcataaatttctggctgtgcatcaggctaacgcatatgggctctattatgtaccgctggttaaaacggcattagaggcaggtgctacctggctagctgctgcttttgtagatgaagctgaactgcttccgaggtctgatgttactgaaccgactgtaccgctaggtgcgtctcactcgcgtgatgattatgtaactgctcaaaatgatgacatcgctaactgacattcaaaaagaatgggtggacgaatcgattagaacatgggatggcacacagggaaagaaatttcgcattaactttgctagtggtctggggagaaaactaaatcgtggaactgaaagagctcaac

SEQ ID NO: 1642 - DNA, 500 bp, Bacillus thuringiensis
atgtaaactcaataaaaattcaacaaaaacgctattttattagactgcgagatggtgatatgagtcttacttttatagagatatttgtaggtcgtgagagtagtaccttcacgacctacactatccctaattcctttaatggcgtttctagtcatcttaataaaatttcatgttctggttctaaatggattagtatgtgagcacgattaaattgtttcttaatatttttctctatccgatcacataattcatgggcagtttcaatgttatagtgagatgaaacgacaagatgaaaatctatgtattcagctggaccagaacgtcttgaacgaaaatcatgaaactcaatatattcatctctataagattctataatttttatgactttttgttcctctactggtaataaacgtgcatcatttaatgggggaaaggacttcttcattaattcgaaggcttcagtcatgatataaacagctaaaataattccaatgattggg

SEQ ID NO: 1643 - DNA, 411 bp, Bacillus thuringiensis
tgcgcaaagcatagccgaagcaaatgaccaagagcaaataaaatcactaacagctcgaatcacatgagcggatctttttatataacacggtacaataccagaaccaagacctaacgctggttaatcaggacagaaagcggattataccataccagcgcatacggatgctataacgagagataggccatcatggagcatcacatgtgtcgaaactgcaacacacggactttcaagccattgaatacagggctcaggagcaccagctttcagagatgacttatatgcggttacggtgatgcaacagaacagttttgtgcggaaggatgacatgcaagcataattggatcgctcgcatatatcgaatatatccatctaaacaacgtgggcgactaaggacacgaatccggggtg

SEQ ID NO: 1644 - DNA, 556 bp, Bacillus thuringiensis
ggacctttagaacaagtggaacctgcttctctccttatgtatgaggcgatagccgatgacccagcatgcgagggtgctctcgattcaccaatgtgtgtatcataattgtgcgcagcagagtgctcaagtgttcatgatcatccgaaggagcttatgactaatgcttgctccgatgatcaccacgagcgcgtactgcttgaggacctaccatttcatataatgagtgagcttaaatcatgtccattctatggagatgcttgcgtcgtgtgtataacggaaggcggaatggagacacgcacaacatacttacctcgtgcctaaaatgcaaatgctcgtgtgcctcatgtgcgagactcgcttacatcatcaggtgcgagctctctgatcgatgtacatacagcctaacgttgtaaggctactgcattaatgcaataacatcatcgctcgacgagaggcggtgtgaaaatagcacgctctaacgctgtctcgatcactgactgtgtggtgttggacaatgatgctgcaccagccatatcaactctctcgatggttgaaa

SEQ ID NO: 1645 - DNA, 272 bp, Bacillus thuringiensis
actcttgggcgggtatgatcgcagatcgctgagccgcgaaatgcgttcgtggaggtgcatcacttagttctatgacaatgattatcttttatatgatcgcacaatgagctggcgcgggtgcgcttatttaattataatcagggattgaatataccacctcggatgtaattgagggagcacatactctggtgattgttcatctatggtggtatgaacacacacgagctgggtacagcatcgtgatggctgaattacgcatgggcggtacgtac

SEQ ID NO: 1646 - DNA, 275 bp, Bacillus thuringiensis
gtgatgaccactgtttctttcttcctatggaagagcgtataatattgatgtacggtcatgatagatttggccgtcagtactcaaggtacgtacaccgtgtgaggtccggatctggaggattcaacgatttcattgggggcgctacattatatgctgaccaggttcttcgatctaacacacgtatatatgaaatgcgctgcaaagaagtaagtgctcgttatggtgaatttggatccttcttatttggaaacatctcaccagactaataagtagag

SEQ ID NO: 1647 - DNA, 262 bp, Bacillus thuringiensis
cgatagatcttgttagaccacgagcgcctctgccttcaatgataactggtgggtatctcatcgtaaatttagagccaaggtgtccgaccatccctactatctctgggctagtttgacatgccgctcgtttagtaactaggtatgtatacctctgcacacccagtaactggattggttgtataagcctcattagccatcttttctagcgatgatatctactgccgagctgagacgtgatcttgatgtgtacacgggttctata

SEQ ID NO: 1648 - DNA, 290 bp, Bacillus thuringiensis
gttatgcagtgtagcacataccagggacgttgtccctagtccactcatatgcaatggttccgggactataccgcctgttctaatgatattctggcccttctttatttcaacctcatgaactaccagaagcattggaactcctgccgatacatattgatcaacacgtacgatctctactgcatggtaatgcgggatttgacaaataaacatcattaacgatatcatccaaagcaccggatggcctaaacatggatcaattgttgcccatccaatcaaatgaggaactgcac

SEQ ID NO: 1649 - DNA, 319 bp, Bacillus thuringiensis
  unsure (1)...(319): unsure at all n locations
ggacggaaacgcgacagcacgggagccggggaagaagagaaacaagaaccggagaagcgcaacgagagaaaaagggcagaacagaaacgacgacaagcaacacgagccaaggcaagcacaagaccacacgggagggggcccgagcacgcggccgcagaanacaaaagagacaccaaaacggccgcacaaaacactggccgncgaaaaacaacgtcgagacagggaaaacccaggcgaaacccaacaaaaacgccaagcagcacaaccccccaacgccacgaggccgaacagccaaagaaggcccgcaccgaaacgcccc

SEQ ID NO: 1650 - DNA, 267 bp, Bacillus thuringiensis
ataccgtcagggatggcgacatccccgtactggatctgcatccgtacatctttgggaccaacaaccgctggtgtagacacaaatcgtgccataggtgcagtgtgcgatgcccggccaccgacttcactaaatacacctgctgcatactcactgtctaacggatcatgtatgacaaggagataaatcttcagcattgatgattaccgcttgacaaattgtaccaatatttgataaattagctccccgaacaagtgcgagaacgcttta

SEQ ID NO: 1651 - DNA, 294 bp, Bacillus thuringiensis
tcatccgaactcaacgatgtttggggtgaggtggttaatgcgtggagaacacgatccgtttgtacaagccacgcaattagagagaggaatgacagtgttagattgtacgctcgggatggcatcagatagtattgtagctagttatgttgttggtgaaagcggaaaagtaacaggacttgaaggcaatgagtatatggcttatattatggaaaatggtttgaaaacatggtcttcatccgtttctgaaattgatgaagcaatgcaaagaattcaagtaaagcaaacggagcattt

SEQ ID NO: 1652 - DNA, 445 bp, Bacillus thuringiensis
aaaccgcctatgatggcgacatcgtcgttctggatctgcttccctccttcttacggaccaacaacagctggagtggggataaatcgtgccataagtgcagagtgagatgtccggccaccgatttaatgagtgaaaccttttgcatactcactgtctaactgatctgtgtcacatggtgtgcaatcttcaacattgatgattacctcttcagagattgtaccaagattggagaagtaaacgcccagaaaatgtgcgagaacgcgtcatgttacggcacgaatgtccgcgggacgtcctttgatatattcgctatccatgctgtcaaacatataactgaacattgtggcacctctgtccatagcaaattcagcatttacttagtcggtctctactcaatctctgactggggttactagtactggatcatttaattctaataaatggg

SEQ ID NO: 1653 - DNA, 259 bp, Bacillus thuringiensis
cagaagcaacaatgggcggcggaggtgatactcatgatccactcggttgtaactttgacggacataattataccaattccgcatcggagtctgaagcgtccggacctcgcattaaaggcgtccatgatgtggcgggcgtacaaaaaccaactgcggcgtatgattgcatatccgcacaaaaagagacaggggacacaccaattcaacagcgctcgcacgaccccagtggaaatggtctattcacggttccgaaggcaat

SEQ ID NO: 1654 - DNA, 440 bp, Bacillus thuringiensis
gaacccgcgatggctcgagtcaatggttagtggttggttcccctaaccaccgtttcttaaagcagacaaggagctacctagctgggaggccgatagatatgcatatgaagaagtactgacctcgatagcggtcagtgcaccgcgtcattatgggctgacaagttgagcacttcgactggtacgaacgaaaagaatggcaagttgaaccgccacaaaaaaggctgttgacccaataagaatgactaccatcgatcatcatcaaatatgcacatatgctcagcaacttccttagcttaagtcacacctcctctgaagaagaagattcactgcaggttctgcaattatgggaaggcaactaccaataaaacccaccaattatgaaacctcatacaagcctaagggtaacccatcagggtctcgggaaaagacgaggtcctgac

SEQ ID NO: 1655 - DNA, 503 bp, Bacillus thuringiensis
gcacgtgcattacaaagtacgaagctcgcggcttatcaactttggattacagctgccccccatcaacggtatataactgatgaatatgcattgtaatcccaaagtctaaaggccctgtcgttacttcgcaaattacatttgacgacttttaaattgttccaagtccttcatttgcactgtccaagtgattgatcatgccagcttgaaataggcataatgatgtacagtactactgcccatctaaaccgaatactacttacttatgtgatccagatgctccaacacttctaacggcatttatattacaattctacagattgcctagccgacgcaggtgcgcctcaaggacccggtggattatctgcagatgtatcatgtccacatggaactaattcacgtcttacttctggaaatcaccaacttaagttttctcgcaccaaacattgagaagatgtattaccagggtcctttggtggtggattgcgcacgaaaattctagatgt

SEQ ID NO: 1656 - DNA, 595 bp, Bacillus thuringiensis
catatcagcagcgctaacaggttctcgatcctgacataatggggagctgccagatactcgtaccctatggtcatcactttctatctcgctacagcagccgttcaagcatggttctatgtccatggcggattagctaggcataaatcagattctctactgtaatgctgcgatctaaaatactcagacttgtgctagtggcttgggtgctagccataccacactctatggtaggccaactacacatactctatcagcgcctacctcgtatacagcggctaacctactacacagaatgcttgcacttggatgaggcataacaccgcctgctactacaataatcttcacatcaccgatgcgcatattcatagcattttggtatggagatcaacaagtcgcgcatgcatacctggaataattaccatgattaggtgaggaaataacccccgtacaaactctagatatctttgctgtgccacaaagtacacattgtactcgcaaaacttgtgctaacgactacactactaagggccctcttctctatggtttacactgcacacatagagtaccagcctgagcataactcacataggatatc

SEQ ID NO: 1657 - DNA, 344 bp, Bacillus thuringiensis
  unsure (1)...(344): unsure at all n locations
aggaaccgcaaaaaggtaacccctttggcgacacgccaaaggcaccgccccggggacgaggaggacaaaaaaagaagagaagacagaggcggccaaacccgacaggacaaaaaagacaccaagcgangcccccaggaagcacccgcgagcgcgcgccagaaccgacccagccgcagaccggcaaccaggccgccaaaacacccaacgggaagcgcggcgcaaacacaaagcacacgccggaggaaacacaggccggagaaggacgaacgcaccaagcagggcagagggcacgaaccccccgaacagcccgaccgcagcgccagaaccggaaacaaacggcaaga

SEQ ID NO: 1658 - DNA, 266 bp, Bacillus thuringiensis
  unsure (1)...(266): unsure at all n locations
tatcggaaactcagctgcatcttatacgattttagaagaagcagagaagatgacacgggcggcgcgcgggggngcggatacgaggatggatctaactacaggtaaaaagattcatacgacgcgagagtggagtattcgtaacgcgcctgaaccaggtggaaccggaccgaaccaacaagcgctggaaaaagcaaacggaaatgcagaagaagcaacgagggaaggatatcgcgaaacgcaaaccgagcaggcggagcaaggcggag

SEQ ID NO: 1659 - DNA, 341 bp, Bacillus thuringiensis
  unsure (1)...(341): unsure at all n locations
caccgaggaacccaaanatgcacgaagcaagcattaagcaataaggcggcacgncaacagccgacaaaggggacgggggggaaaaggaaaacacgcacagaacccgggcggcggcacacaacacggcacacgcggcaaagcaaccggcacaggaaaacaaaacgacagaaccagcgcaagaaaacacacccaaaagaaagacgggcaacgcgacaaaaaaaaagacacagacgcgcaacacggagacggcgaacagaggccgaccaaagaggacccnaacgcaagcaccaggacacagcaagaaaccgggcggaaaaaaaacccagcaaccggcgcaggaa

SEQ ID NO: 1660 - DNA, 317 bp, Bacillus thuringiensis
ttcaaaatcaacaagagacggatttaagtaaaatatgttttattaatagtgaatttaaagggagtatgattcagcatcaaagagatgcaaaaattaatgcagcatattggttaaataatatgaagcctcaaattatgaaaacagatcaaaatattataaattacaataatacttttcaatcgtattataatgacatgttaatagcgattgatcaaaaggatagtggaaaattaaaagcggatttagaaaagttgtatgcggatattgtaaagaatcaaaatgaggtagatggattattaggaaagtttgaaagcttt

SEQ ID NO: 1661 - DNA, 491 bp, Bacillus thuringiensis
caaatggatcacaggctaaatgtaaaatgcaaaactatgaaactcctaaaagatagcataggaaaaaaaattagatgaccttgggtttggtgatgacttctcagatgcaatactaaaggcacaatccagtaaagaaagaattgacatgctagacttcatcaaaaacaacaacaaaaatctgctctgtaaaagacactgacaagatgatcgaaagataagccgcagtctgggagaaaatatttgcaaaagacttatcagattaaatactgttatccaaaatacacatagaactcttaaaattcaatgagagcatgaacaacccatttaaaaaatgggccagaaacgttaatagacacctcaaagaagatatacagatggcatatcaacatttgaaaagatggtccacagcatatgtcatcagggaaatgtgaaactaaaacagtgagataacactacacgcctactagaatagtcaaaatccaaaatgctga

SEQ ID NO: 1662 - DNA, 490 bp, Bacillus thuringiensis
gcgaacgtacattctacgtgctattctttaattaagtaaagaattttctttctattaaatagaatgggggaacttgtgatgattaagcctgcaacaatggagtttgtttcactatcgaacggagaaacgattgcatatcaggaagttggaaggcgaaatacagatattcttgtactcattcacgggaacatgacatcgtcacaacattgggatttagttattgaaaagttgcaagatcaataccatatttacgctcttgatttaagagggtttggacaatcaacgtataatcaatcgatagattcattacaagactttgcagaagatgtaaaattatttatcgacgagttaaagctagagaaattctcattaatgggctggtcaatgggcggtggcgttgcgatgcaatttacagcgaaccacccaacttttgtagaaaagttaattttagtagaatcagtacgaatgaaaggttaccccatttttaaaa

SEQ ID NO: 1663 - DNA, 167 bp, Bacillus thuringiensis
tgcacttccaccttcatttttttccacgctacggagaaaaagaaggtttcggggctgttaggaaatctcaccaaagtgaatacactatggaaaagttacataacatcgtaggttcaattgcaaataacgcgaaattatgacactatatgaaggcgtaatccatacca

SEQ ID NO: 1664 - DNA, 504 bp, Bacillus thuringiensis
tggataatagcccatggggttataaaccagcattatgttggattaccactatatctacctatacctgaagtaggtggattggatcgtgcgggacataatcctgtaatatacgaagcacagtctatgttggaatgggactggggccaggatgtggaactaagaaaacgagcccaggaggactagcttgcatgaggaaataagcgagctgtgctgccaagcccgattcattgttgcgcatggatcggacatattaatctacaccaaacgaataaggacgattgctttgcacctttactaaaattcgtctcatatatgaagaacgcttctcttctattgaatatcttgcttagctcaacgaacgcttcagattacagttacactgcatttgagtcacatatacatgatcgcgcgctctttttgtgcacgcgtattgagcgactgctgggtctccgtctgacttcagctcatatacctagggagatacagctggaagttcaaacgact

SEQ ID NO: 1665 - DNA, 407 bp, Bacillus thuringiensis
gtctcaggcacaatgttgtttgctatcaggcgatttgctgctcgtgttatgtctgctcctcatcacattcggggtgtatcaaaagaaggaacattgccaaacactcatgagttctatagagatgtgccagtatcgatcatgtatggcgtgtcatctcgcttattctatatagggtctgcagagctggcgatcgtattcggtcgtaccaagggtcgtgtagaccaattattagatgcattaaactctctaggatgtgctgcaataggattagacggggatttaactcacgccatacctgtgactgatttacgtacagctggagtaggatctattgaagatcttgttgccacagacaatgctgctccaggtgttgatattgcgtgcgtcacgcacggtgcactctatta

SEQ ID NO: 1666 - DNA, 206 bp, Bacillus thuringiensis
agttgcagtggtccattttttcttgaagcgctagggaaagaattactggggggacctattaatcaaaaagatactgttccaccctcgaatattttacagttgattaattcgcggatggggataatctgagttcaattaaactggactgcatctacggatagcggaggagatacggaatatgaaacgagctaaggccaatggaaatg

SEQ ID NO: 1667 - DNA, 451 bp, Bacillus thuringiensis
  unsure (1)...(451): unsure at all n locations
tcgttaaaaccaagtgttacattcgttccatctgttacaattggacgtttaatcaacatgccatcagatgctaaaagctcatacatttcgtcttcgcttgcatctttcaacttatcttttagaccaagttcacggtaacgcattccacttgtattaaagaatttttttaatggtaattcacttttttcatgtaaattacgtaaatcttcttttgatggtggattttcaacaatatgaatcatctcatatgctacatcgtttgcctcaaaccatnttctttgccttttgacatgtgccacactttggatatgaataaaatgttactgtcataaattcacctacttttttactaacctttacctttatcatatagaaaacgttttgttatttcaaaccattattcgctaaacttttacttatttcgtgataatttttaataatcctgcgaatt

SEQ ID NO: 1668 - DNA, 445 bp, Bacillus thuringiensis
cgtgatcggaatggaactctgtgtcgcacaagcgacaatccttttagatttggtctaattcttttgggatggaaggagcgcttatgagtatctaggactcgttgaaatagtatcatacgatcaaactcttctagataaagtatgtcccactttaataggcctaggagactgtccatgactgcattacctaagcaattacccttactgtacatactttggataacgtgatcgaatactaagccactgatgatattggcacattggacaatgccaaccttgatccgacagtccattctgcgaatacttatccttgcttcatacatgccccttattccacatcggagcaacacaggagatatgcagagtctatgggctatatggtgcgctatgacatcaacaggatatcagactaaaatgggcgatagatatacgtctctaccatgta

SEQ ID NO: 1669 - DNA, 301 bp, Bacillus thuringiensis
tggtgcgatccgaattgcttgttcatgaggagatttacataaaaaaccacttgcttttagttttgcacactaaggacgagctggtatggataatactgtaccgaatactgaacttgtactgccaactgcagcgatcaaacatgaatcactcgctattgattgcgcacctaataaattaactatttgaagagaacgctttgttaatgctttttgttctaacacttcagcgaactgcgattgaaacaggacatgctcgtgcgttacgcatcgaatgtagaatcaggagaacctctatcgaata

SEQ ID NO: 1670 - DNA, 434 bp, Bacillus thuringiensis
acatctttacactgaagggaccaatcaaagttgccgtttttttttgcgctatatatggccctgtctacgctcgcgcacctgatgtcggtattggcggtgcacgtgcataggtatttttattccgaaaagggcgggtctctcgtttagtcccaaagggaacattggttgaagaactgaaaaaagactccgcctcaatggctgctgaactggctgctgcacgagcccaagaaaaagagacgcaagaacattaaatagaaggttgccgcgacatgtgtgagctacctccttttctactttaaaaagctcgggagttatctgaccgacgagcttttactgtgcacattttgaacaacgaccatatactacaaacttatgccgcgtgaccgcataaccgggcaaatctctattcataacatgcattgagcaggacgtga

SEQ ID NO: 1671 - DNA, 435 bp, Bacillus thuringiensis
cctacacctcattgcgtaatcaaaacattaccatgtcggtctttaaccgattacttttgttaatcgggtcccgaggctatatgctaggcttgttttaccgaaaaaaaaattttacctgggatagcgacctgttaaaagcacatgatcctgtcccctatggcatcccggaactcaccatgtgcgggcccgaacaccttgggtgtcataatccatagcataacgactgcttctagtgggctaccgagacctgacacgtgaacttgtcttatgccgtactacacaactacagcgtccgctctaactagcgagtcagtaagttttgatacacatattatattacccggagttggcgaggcatctgtgattacagcttcgcctttacgaataggaatatgaatgtgtgctgggggcgccattctagatagagcagccatc

SEQ ID NO: 1672 - DNA, 238 bp, Bacillus thuringiensis
gcgatcttctccggcaggtccagtagcgtgacgtgctgggtgatgaacgccggcgacttgccgatttccttggcgatatcgcctttcttcttgcccttcgccagctcgcggccaatgaagtcggcaatttcgcgcggggtcagctcgttgcgttgcaggttctcgataacctggtcggcttcgttgtagtcgttgtcgatgaacgccgggatggacttcttgccggcccacttcgagc

SEQ ID NO: 1673 - DNA, 403 bp, Bacillus thuringiensis
gggctggcggccgtctatggccctgcaaacgcgccagaaacgccgtcgaagccgtgtgcgagacaccgcggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgaagtgggacaaacccgggggattagtggccctggagtattgacacttgaggggcgcgactactgacagatgaggggcgcgatccttgacacttgaggggcagagtgctgacagaagaggggcgcacctattga

SEQ ID NO: 1674 - DNA, 293 bp, Bacillus thuringiensis
gatgtggctgcatggcttgttgcggatgcaaatacttttgatgccgcttctaatacaacggtgatatcttggggagctgcacgaggcggaaatactgacctgctatagtcatatcttacgaacgtgtctacctcgcactggtgaaaagtcgatgtgatcaaaacaggatcgatcacagcgcctgatagggagtcacggttctataggttgtgtcatcagagcgtctctatcatctagctcatcacctgacacattctctgacgagttcaatggctggctataaggaccgaata

SEQ ID NO: 1675 - DNA, 475 bp, Bacillus thuringiensis
ctgctgaagctgcgtcgcgacttctgctgattgcgccagggtatcggagccggtatagctcatattcgttctactttgcacaactcactcgtaacacctgccgatactgaccgttacgcactttcttggtctagagctggtgcacttggcttccgtggatctcgtaaatctactccattccctgcgcacatggctgctgaaactgctgctgaagctgcgatggaacacggtttaaaaactttagaggttactgttaagtggtgctggtgctggtcgtgaagctgcaattcgtgctcttcaagctgcatgtctagaagtaacagcaattagagatgttactccagttcctcataatggatgtcgtccaccaaaacgtcgtcgtgtgtaatttgtccgtatagaattttcccttttgtctataatggatatgatgcattatcgagaaatctcgtacagaaacatcgcttgttgtgca

SEQ ID NO: 1676 - DNA, 559 bp, Bacillus thuringiensis
ttaacagtattattaccgattattttcttagcagtattaatcgggattctgcaacatattaaagttttaccgattatcattcgtgcagtcggtttcctattaagtaaagttaacggtttaggaaaactagaatcatataatgcggtagcagctgcaatcgttggtcaaggggaagtattcattacagtaaaagatcaactaagcaaattaccgaaaaatcgtttatacacactttgtgcatcttcaatgtctacagtatcgatgtcaatcgtcggttcttatatgaaaatgattgatccaaaatatgtagtaacagcactagtattaaacttattcagtggattcattatcggtcatatcattaatccatatgaagtaaaagaagaagacgatattttagaattacaagaagacaagaaacaaacattctttgaaatgttaggcgaatatattatgcttggtttctcaatcgctgtaacagtagcggcgatgttaatcgggttcgtagcattaattacagcaattaacggtgtattcgattcaattttcggaatcacat

SEQ ID NO: 1677 - DNA, 306 bp, Bacillus thuringiensis
aactgcctcatgtatgctgtttttatagaaatttttaacagaagctaacggggacattgagaaagttgtcgtctatctgccgggaaagatggggcgctaatgcagctacataagatgacctgatggctgttgaaggtcttactacgagagtaactgaccgtctccacgctgtacgcctataattaaaccctgaagctgatgttctggcgaaatacgaatgttcccaaacactactacaagaattttgtgctcactgattaacaacccaaccagctaacgttgaggaagctctggatcaaacactgg

SEQ ID NO: 1678 - DNA, 282 bp, Bacillus thuringiensis
gaccgttgattccgaaggggatgtttattggggactaacttattcaagtagtaattcactgtggtggtaccgagcattcgatgtgcacacgcctgccaatatgggcactttgtggcgacaggcacacttggcatctagcaagtgagctctgttgaagtcggggcaatacacgtatgtagaccaaaactcggaatatgcgctttggcataacatgacattactaattcctcgctgtgcggttggacggaggcacaactctggatcaggaagagctcttgtcat

SEQ ID NO: 1679 - DNA, 187 bp, Bacillus thuringiensis
tagtacgaacgtgtattttttagactctcatcttcagctaaaaccatggggcgtatctggagatctctatataggaggatggagtcttgcacgcggatatgcaactagtccggatctcacaaaggggcgattgatttcacatcctttcaagtcaggagaccgcatctattatactagaaacaaagcg

SEQ ID NO: 1680 - DNA, 380 bp, Bacillus thuringiensis
gctgctctgatctgcactgcgttagatctgatggaacgtgttttttagcaacgttaatgccaacacggtatgaacctgtttctttagttccaattttcaggtactggtgctgaccaatcgcccgagcaaatgaatgaacatgctcaatggcgtgtgggaatcgaacgcgttcttgtagctatcaatgaagctgaaaacatttgagatactgcagaattactaactgcagaagttgaaaacatggctgtgctgtacggtttgccagaatacactctgatgcgggctcttggaagtgcagacgctttcactaatgatctgtaagcgagtgtagctgcatacttcttagggcagaacgctgtatattaggacaactaggcact

SEQ ID NO: 1681 - DNA, 227 bp, Bacillus thuringiensis
cgggtggaaggggggtactttttgatgcatatctgttctgcataaagagaggtgttcgtacctagttgaaacaggtaaaacgatatcagaattctgtgctggctcagccatacggtattctacattaatgagcgaatcaggctttccttcagctgctcctggatgcccctacctttcctatgctcatgttgaatcgctggcgtcattcattaacccgtttgttggac

SEQ ID NO: 1682 - DNA, 343 bp, Bacillus thuringiensis
caccctcgaaaactccttcttgcctcactgacattaccacttacccatcttttggatcttgcaggtctcgccgttgctcatatgccttcaaacgcaccattaattccatcgccgtcagaacgaccaccgacgagccgattaaaacgtatccaatctatgcgaagacatgatcgcgctgtttacagtcacgatacactaaatcactcactctatccgcggatgaattactcacgttttacaatcctagaccaacactctctgtatcggtatacaattgtggagcaagagtcacttctagcagaccaaggaatctcatcctttccgatgctacctattcgcttgc

SEQ ID NO: 1683 - DNA, 464 bp, Bacillus thuringiensis
cacacaggcatgtgcctgctctatatggggcataccactattagtacacactactggaataggatggtatatcacgagattttgaatcatatacactacttgttcctttacatgttctactgacttcataggaaaagaactctcacacaattacgctctgagggttggagccgatgtccagcgctcatcgcatggcttagagacgggatgaatcgcctcagagtctaacgcattactactgagagaagccttatagtctatgacgtggaaatcaatgcagtggatcctcgtgctttgtggatcgattagatgcgtatgttgctcctggatctgatattgaatttgagtataaccctcggtacagcatagtagctaacgacatgaaccatatactaccgggaccatttaatagtaaagtgctttgtctaacatctagtcgtagactataaggcagaatctacctc

SEQ ID NO: 1684 - DNA, 501 bp, Bacillus thuringiensis
tctggatgctttgagccattacgcattgcgggtcaacactcattgttcgtaggtgaggcggctgaacttgcatagtgcttcattcaatttgaatatgtggtttcaaatttattacgatctgctattgctgcaaatgatctacgtggatcagaagaggcggccaaacaactgcaattccggtatcgcattgcaacaatcgtaggcgacgtaaggtatccttgcgctctatgactggaggcgcggaaaagccagctaaatcttctatattaagacgcctacggtagctggaagagtgagctcgcaagttgactgatctgtgagagaacgcagcctccttcgaaaactgtcgaaaagccgtctatcaagagattcacgcactacacgtgctattacgctaactaaggcatactgtgtaagcatatcgtgtagatgtgcataagttcagagaagagatccctcgtttataatctggacagcataagcttaatgatcgggcgccta

SEQ ID NO: 1685 - DNA, 449 bp, Bacillus thuringiensis
  unsure (1)...(449): unsure at all n locations
taacgaatcaattgaaaagtccactacccagaagaaancgngaaagcaaaagaggtgtgcaaatggggaacaaggggacagcccccaaagaagaaaccgaaattcttgataacaatgagcaagcgatcgaagacttcaaaaacggaaaagaccgagcaataggccactaagaagggcaaactatgaaagctacaaaaggacaagcaaaaccaccacagggcaacaaaaacgcactagaagagaagaataagcgacaacagcagggaccccaaaagattaagcagaaaaacacccgtacatgggtgttcctccagggcaagcaaacgtgcgttcaaatgagacaacagcggaaaaacaaacgccagattaaccgccaaaagcggaaaaaagcccgcacagcaaccaggggccgaaagacgcaaaaaggagggaacaacgaaaaacccaaa

SEQ ID NO: 1686 - DNA, 476 bp, Bacillus thuringiensis
  unsure (1)...(476): unsure at all n locations
atncaagagcgaaaaagccnatttcctgaannaaanggngacaaaaaaggaaaggggcgccacgagaaaacaagngagggacccccaccganacacgcaacgaagagacgcaagcgaaacgaaccaccccaagcccagacgagaaagaagggcgagccgcaaaggggggaaacgcnacaggaccacaagacggcgggaaaccgggagaaacagccgaagcacanaacgaggcaggggcagaagaaaaggcaggacgagaaaacgacagcgacgcacgaaggaagaaaaacgaccacagagggcgcagaaaaaacagcagccaaagcaagaaccccccaaacgcgaggcggggggaccccaagcgagaaagagacgcacaaaccaccaagagcnggagcacacaaagccacaacaaacccagcggcagagcgaaacccgaagcccaaagaagaaggggcagaacaccccggagcaca

SEQ ID NO: 1687 - DNA, 284 bp, Bacillus thuringiensis
  unsure (1)...(284): unsure at all n locations
gtaagaaaacacaaacccgagaaccagacagaagcacaacaacaacacaaagttccattccgaaacgaaccaaccaaccaaccgcggggggcgacagaaaaaaaaaccccaccccaagcacacaacgaagaacaaacacacaaaaaacgccaaacacacaaagcccgacccccacnaagaaaaccggccccccaagacgcaccaaagaaccacccaccacccggcacaaggaaaccaacaacaagagcgacacaacccaaacccacacaaagacaaccagcacc

SEQ ID NO: 1688 - DNA, 419 bp, Bacillus thuringiensis
  unsure (1)...(419): unsure at all n locations
gtttcaatcaaacgtggctatttgatataacacggccataagtacttgctagancaacaaagncaccatagttggagcagttaagagtgtatagccgtgtctgacaaaacaaaacgtgatctgaccggattaaaatcgttgaagagacgatgcaacctcattatcagttcctacatcgaactatcgaaagctaatattgcgactcttccatagcgtcggtatgaccgaaaacagacgctcgctcatgctcaacgctaaattacatatgtactgcacaagtaagactcctcactcttagaagctgaacaatgaataagcccgctagaataccatttatatacagtactccatgatgaaatagatgtatttatttacaaattacaacattcagcgaatgaccttagcgaattatacttact

SEQ ID NO: 1689 - DNA, 446 bp, Bacillus thuringiensis
gctactgcacgttgtgtgtttcgttcatgcgctggggcctctcctggtgcctgtggttcttctgtacggtggccatctggagtatctccagctttctcaccggatacaacgcctgatgtgatagctgagatggacactgtatgcacagagccaccgtacgcttcatgcatacaaaggatatccattagtgcatgtacaagatccacagctattcccatgtacacgatcatcagcgtcaccgtgtgcaggcatatctgcttctgtctcgtaacgctctgcactaccatccgcatctccaattggacctacttcagcgtatatgattgcacttactgaatctgctactactgattgaccctgctcacctgttgccatttgccgattgacgattgcatcatgaagctgccgatgaacatcaaccatagctatgtttatcatgcatgcat

SEQ ID NO: 1690 - DNA, 203 bp, Bacillus thuringiensis
tcggaaaaattcctggcggattcattaaacgtgaaggtcgaccaagtgaaaaagcaatttgggccagtggtcacaaagaccggaccctccgcccacttttggcagatggatgccgtgacgatagccatgtctgtagcatcgcaatgagagctgatcaagattcgtcttcataaatggcacctgtgcgaaggttcttcattagc

SEQ ID NO: 1691 - DNA, 348 bp, Bacillus thuringiensis
cgtactctatatcatttatttttctatcttttttataagccacagcactaactcgcatacctttactatttagtgtctcacttagttgtttgacatttgaacgtatttcctccgtgagtgggacgattttttcatccacttcagtgtcatgacaaattgataaaatttcttctacggcacctttacaaaccattgaatgtgcacctgaactatcctttaggatgactgacatacgttggcgggcgaaatcgaatggaagtttaactagcctttgaaaagcctcatgggttaaattttattgtttgtgcatgtgtatgcttaaataacgggttttaatttatttaaatg

SEQ ID NO: 1692 - DNA, 175 bp, Bacillus thuringiensis
caactcgtgctttaatcggaaacatggttgaaggtgtaactgaaggtttcgcacgcggacttgaattagtcggtgttggttaccgtgctcaaaaacaaggtgataaacttgtattaagcgtaggttattctcatccagtagaaatgactccggaagcaggtcttgaagttgaagt

SEQ ID NO: 1693 - DNA, 360 bp, Bacillus thuringiensis
ggaatctgtactaaatcacattacatggagcatcagaccatcctctgttcattcctccattagctcaacagactgggggcatcctgccaacaggtcgtgtgcacttaactagggtccacactggatcatatagccaaacgctcccagtcatcgatcataatcactgagaacgctgggatactaatcatgcacaagccactaggggctacaaatcctattgggaacgctactgactgtacagcttggatgaatgcaccagctccaatagcttgaatttatgctgtaccgcgtgcgccaataacacctgcaggtgcaccagctacacaataagggaccggcgacgatttaactttaaatatt

SEQ ID NO: 1694 - DNA, 429 bp, Bacillus thuringiensis
ggagatatatcagagcaagcacaagcaatgccccatgcatttccattttttactactacagggtgagcgtgcggatggtgactggtaccgtctctttgatacatattagctccggcaccatgtgaaacaataaatgctggcacattggtcccatcatctgctttacccgccagcggcaaccgttctacttgttcgtgacgaagtgtacggagacataatattaaggctacaagtatgttcaccatctgtgctactcttaatgttgattacgccataacgggctagacctcaagtgccagcacaccgaaggcatgaaaataccgtacagcaagatcagaaatctgacctactagcagggtatattttttaaccaaatccacagataaccaaacactttctatagtaaaccgtttcatggcttcgctatta

SEQ ID NO: 1695 - DNA, 299 bp, Bacillus thuringiensis
gaaccgctgatgtttcttttggtctaaacggatgaactggatgcgcaggagtgtgataatccgctgctgcatgtagaaccggggatgtaaaacccgctgtgtaaattaatgctgccgcttgcatgaatattccaccagccgcttgaatatccgctggcatattttcatgtagtggcaattacctgttaatactggcgagagattgccactgcgtatatcctaatcctagacttgactatgtttcttgatgtggaacatctggcttcgcatcttctcatactcgcggttatgccggttaa

SEQ ID NO: 1696 - DNA, 317 bp, Bacillus thuringiensis
aatgcgatagcattgacaaaagaagaagcgtgtgcgttatatattccaaaaataatccgtatgctcctactcggcggtggctatcttgctttattactagtcgaatcatcatttgcctacggaaagcactttttctggcaaatggcaccgacccaaattattcaaattatcacggaagatgataattctcatattcaaacgttggcaattcgccattgagagcattctcttacagggataattgtgtaacgtgtaacgagtgatactgtcaccattcgccatctatacataacggttcttcctacatatgactctcg

SEQ ID NO: 1697 - DNA, 501 bp, Bacillus thuringiensis
ctaacatatgtgttgaggttcgaattacatgatgcccctgatcagcgattccatatactaatggtggtgcacaatcatatatgagtgcaaagctactttacgtgtttcattcattatgcatacatgttataccgctgcacagtgatcaatcatgatcatgaaactactgagggtcagctatacacctactaggtatattctatataatactcatatcgcactatttatgcatccatacttacttaactttgaatactatactgtcgccaagcttatacctgagactgataattgtaatcataatgcactctataaagcactgatcatatctaccattaattgcttgacataaggtcgtggcttaaagtcttcttgcaacatgcgtggagcgaagtgacttaatgaccatctacctgctgccccggttgaagtactacctaacactacatctggattcaatccaaccttcgtcgcgtaagcgacagctgcacatactccaat

SEQ ID NO: 1698 - DNA, 492 bp, Bacillus thuringiensis
gaacattttaaacggtgattgctggttatatactgccatatcactcgtttgtagtagaagagttgtttagaatcactagataaaatagctgcggtcacttcataatatgtatacataaccgaatgattagccaactgcccactggtgagaccctcgggtctgtcctaatctatggttcgcctatccacagttccttctcgcgctattaaacgaccgtttctcactttttttaagttcccaattacgtttcgcataaaatgtgtagatgtaaagactgatgcccaacgtctattgttagaaaatttgcctgaatttcatgctgcgtctcattaataacgaatcacagacgggagacccgactggaaatgcacttctcggcgttgaagcacctttttacatgcagcaagattatcttcaataattcatgaacgcgctaccgaagtaaccttgcgattcagatcgtaaaatgatgacaaccgtgcatacatacga

SEQ ID NO: 1699 - DNA, 410 bp, Bacillus thuringiensis
ttcgcaccgtggttagttggagcgtcaaacgttattttaggtggacgctttattccacaagcttggtattaaacactgtgagataaccgggtgacacggttgggacacagcacacacacagttttctatatgtaagtgagagctgcacaacacgcatttaaaatatgtcacttatcacaagcgcgccacgtataacgcgtgggagagcctgaaaatacaaaagtaattctctggggtataaacacattgacgacttcttattcatgatacgtggaggacgacagaaacaggagcacaaattatttgctactaccgtggtgtaaaaatcgcgccaggctcaaggggtaaaccaattccaggtgagaaagcagttattgttgataatgaaagatatgaagcgccttcttaca

SEQ ID NO: 1700 - DNA, 395 bp, Bacillus thuringiensis
cgttgactgactctctgctttttgctccttgaccgagcgtactggtggcacgccacccatttgcactgttcccgatgtcctccaaaccttgcgaattcgccagactgagcctgctactcagagggcaatctaaggccatgaaccctttgcggtcgtactgcatggagtgatctataagcactgacctcccgacgaacatatcacatacttgctgctcaattaagaggtggccataccccacagacctatggatataccagccgctgtctcctcgaagcaccctcctgcggtctcagggatcgagcatgccgttctccgagtaccagtacaccttattcaacttcgagaaccaatgaatgtctgatcgcacactctgtacgtgtctgacacatgta

SEQ ID NO: 1701 - DNA, 248 bp, Bacillus thuringiensis
gaatggggaaagccgttaacgatatgactcacggggccatgtccgatgctagcagcctgggcggcgaagactcagaaggagatgaatggacatgaaaccgatctatgtactgggacaccaatacatcccacgtcaccaatttagaaattagatcgtgctacagaatgagcaatcccagttatgcgcactacgatataaacacatgcctattaaagaccacgtggactacaagatatgtatgagaaggt

SEQ ID NO: 1702 - DNA, 299 bp, Bacillus thuringiensis
taacgcgactgttgtttttttcatggagaacatcaatccacctggtggtgacacctgtggtgagactatagtacccccatcccgaactgtactcaaccgcggagattatgaggtgcatcacacttctttattacaaattactcgcactacgaagaagaaggtgtgtgtgacgcgcacattgcgctcgatgacatatagctctccatactctgtgatctcagtgaatccacgggtgagacgctcatatgcgctctcatctaaagcgactgtgtatcccctttcgaaattttcaccgcaaa

SEQ ID NO: 1703 - DNA, 293 bp, Bacillus thuringiensis
atgatacgatcctatcacgctgcgtgctgcctcaatctaatatagctatacgatgcataacctgccgtgacccagactggcgtatgcgacacagaaaatagctcccagtggcgccttataaaccgtgcgattgcgaggagggtcatagacgtctcgatagtattgcttaatcttacacgtggcagaaaaagaaattggactatcactgcccaagcgctttctgatgttcccagagattaacacaacataccctggtgtatcacagtacactttacttgctcatttgcaatcaa

SEQ ID NO: 1704 - DNA, 459 bp, Bacillus thuringiensis
caaaacccgtgatgctttttgtactgacccgtgcgatgcatgcagcagagtgtcgattgattgaacacttgcgtacagtgactatgagctgttaccatgattggcgacatcaagtgccctctctgattattcaccggatctattacccttctattcaaaggatagcacgatgggaaaccgcccattatacgcttactgcatgacaatatgtctactcagctctgtgaaatgagaaaagggagataccgatatggaaaaaggtcatccaactagtcgagcgccccgaggtacatagttactttacgaaatggtgggtgcctgatgctgcactccgtatgttaatgaacaattgcagatcctgaaggccgctgatataccagactaattatttgaatatggcggaataggccgtgcagctcggaactgggaaagtttttatgcgggttgtaaattcattaa

SEQ ID NO: 1705 - DNA, 189 bp, Bacillus thuringiensis
cacgatgagtgcttatttatggaatccaccatttggactacctttatgcgtaaatccttatgggagatacatcttacattctcaggctaaaaccatacgttgcaaaccctgtagcacgggataaatttgctacactatcaattgaatcatccggaaaaagtggatctgtatacttagcatagaacaccg

SEQ ID NO: 1706 - DNA, 539 bp, Bacillus thuringiensis
taaatcaaatatccagcccagacagctagtatgccagggataattggataaataaaggcgagaaatgaaacaacgaaacaggcaatgatacaaattgttaataaaacagtcactttatagctcctttttaatatctagtttatgtacagcaacttttttgacttgatggccatcaagttctaatactttaaattgaaaaccagcatattcaatggaatagccagcttcaatatttaagtcaactgcttgagaaagaagccatcctccgattgtatctaaatcactatcatcaatatgtaggccaaacatatcatttacttcagaaataagcacctttccatctaaaacagtaagcttaggtgtacgcttttcaatcataggtgattcatccgcatcgaattcatcttgaatttctccaatgatttcttcaagaatatcttccatcgataaaagtccggcagtaccaccatattcatccataacgattgccatatgaacgccaattttttgagatggactaacgttttacgaattgaact

SEQ ID NO: 1707 - DNA, 313 bp, Bacillus thuringiensis
ccgcggccaccctgggctgaaggacgacgcgcgacgagctcattacccccttacatggcgcgctacatatatcgggggaagaacgtgagcaccaatacctgaatatgagccccatccgaatacgcataggtcagtattccaacatgatagaatatcacagattaaagctcaaatacatttgctacacgaacagcaagagcataaaagattgccgtgacctcctcattcccaaagatgccagccaagcgccgctctgtctgtgctaaccactaaaccatggaacgggaatacggcccggaaacgcaggtcgcgg

SEQ ID NO: 1708 - DNA, 204 bp, Bacillus thuringiensis
  unsure (1)...(204): unsure at all n locations
aacaacgaaaccggagaagcaaaagaacaagangagcacacgggagcacacccacgccggacagagacggaaccatccgncacgaacggcgcacaacgcgaaaccgcgacccagacagancgcccggcaagcggagcccaaagaggcaaagaggagaaaaacggaaaacggggcgaaacagcaacggcaagaccaaaccacgga

SEQ ID NO: 1709 - DNA, 378 bp, Bacillus thuringiensis
aagggtggcaccctaccggcggtggggtactaacccgacgggtaattactctacaacccgaccgcgataaacgggggatgctatcactgaacctacagaccacatgtccttgcacactaccgaaatgcctaaaccttgcaaaacctggcaaggcaacaccccgacgcgctccctgacggttgctcatagagccgagtaccagctaaacagtcgcgagtacccctgaaccgctgatttccgggaataaagcaccacccttaccagagcgcccaccgtctccagccaagacacagaaaccaacgtgcttttgagacatgatgataatatactcccgtaccaagactggtttaccgaccacggccccaccaaataggtcga

SEQ ID NO: 1710 - DNA, 197 bp, Bacillus thuringiensis
agactttgttggtagttggtgggaatacttaaactaaatgttgacggaaaatatcttcaacctcttttaatgcgctatctggatcctggagcacgattcctagagcttccaggatcttctttcatgactgtgacatacaacttgagatcacgctctgtgcggatacaccgaactaggtattactgctcagcttctgg

SEQ ID NO: 1711 - DNA, 213 bp, Bacillus thuringiensis
tactggtatggcagaatggtatcgagtacaagcgcgtgtcattttgattgcgaaggggtgtagttaacatcttgcccgtatctctcgctgagcatcgtgttccaattgagtttctcagtgatgaattcgagcgtatggatggagacaacccgctgtgaggagacgtgtctactcaccgagatcgtgtacgaatctaccctgcatcgcactgcc

SEQ ID NO: 1712 - DNA, 207 bp, Bacillus thuringiensis
cctgatgcagaatctataagttttttctgcaagtatcaactgcatccgggacaaatgctgatgaaccgagagtaccgtctactgctgcaacgtacgtatgaccaagttctgcaaattttataacctggaaaacaacttctttcggttgaaagcctcagatgcgaatagcacgtacacctcttgcatcgaggcgctgagataatccat

SEQ ID NO: 1713 - DNA, 254 bp, Bacillus thuringiensis
tgaagtggaattggcgtatctactgttcgtctttttatcgaagaaggtgcaaaagtagttattgctgacttttctgaacgtggaaaagaactatcagatgaattgaatgcacatggatataatacgttatttattaaaactgatgtaacaaaagaggcagatattaaacagctaattcatgagacagtaagtacatacggtaaattagatattatgtatgccaatgccggcgttgctgatgatgcaccaacaaa

SEQ ID NO: 1714 - DNA, 164 bp, Bacillus thuringiensis
aaccaatttgcgtcgcttttttattacactgaccctcaccacctgataaagtgcctgcggcacgaattaacgtttaataatctaaaccagcgttaactaataaccctacgcgctcctaacttacttttaacattcaatgagctattctttgttgctactgcgat

SEQ ID NO: 1715 - DNA, 451 bp, Bacillus thuringiensis
cgcgtatcccaaaaatcacttttggaaaaatggcgatatcagttacacagaaactcacatcggcgacattttcaatatgccatattttcaaatatcgatttttccaatatcgccatctctatcggcgataaacaccactatcgcgcgacatgaatttagtcggcgacagaaatctcaaaacgcgtatttcggacaaacacacattttattattcactgcagtcaccgtccttgacacgaagctagatccagacatgaattagatacattggtgagtttgggacaaacccccaactagaatgcagttgaaaaaaaatgcttttatttgtgaaaatttggtgatgcctattggctttaatttgtaaacccattataaagctggcaataaaacaagtttaaccaacaacaatttgcatttcattttatgttttcaggtttcaaggggggaggtg

SEQ ID NO: 1716 - DNA, 380 bp, Bacillus thuringiensis
  unsure (1)...(380): unsure at all n locations
ggcagaaaaccacgagtgaaaacaccattcgtcnnacatcacaaacgacgcccgaagaagcgacacgagggggganacaacgagacacagaacaggagccccaacacaaggccacgcagcgaagcgataaagaagaacagcaccgagacgacccagacggagaacacgcccgagacacagcacaagacacagaggagcccaaggcaaancagaanagaccagagggcaacaaaaccgcaagcgaagcccgacaccaccagcagcagaagcaaagaagaccagcgcgaggaacaggaaaagcgccngcagccaancaagcgacccgcggcaaaacccgccgcggaaaggcacggaagaacaaccgggaggccgaaaaaacc

SEQ ID NO: 1717 - DNA, 249 bp, Bacillus thuringiensis
ggaacctggatcgaagactactacacctcctggacagcctgtttctttttatactcacatagatttcgccggtagggcgggttttggtcttgctgattggggtaatactgtattacctgaaactaaagcagctgttgataaaccggccatacatgtgaatgggaagatcctaggagaaataatgacatcttctcaagaatggcttgtaagagaaactattatacgctattggccgaccctctactggaa

SEQ ID NO: 1718 - DNA, 248 bp, Bacillus thuringiensis
tcggccatgcgataatacaagggcaacggatgtatcttcgggtataccgagccttcgatcctcgcgagctggcagccagaaccgtagtactgcacctgtaccgataataatcccgtcccaatacacaggaatcggtcccagatgcatcgctccaccgtcaagctgcggtacatgggctgacagaatattgcatctgacctccctgtatgaagagaacgccagatatggtgacagaatagaacatataa

SEQ ID NO: 1719 - DNA, 463 bp, Bacillus thuringiensis
cttactgcattacttgcaccgtttccagtataccgcatacatgggagagacttattagcggccgatgaccatattgacattgctgtgaagtgtccgattgtagagtgtgagaaacgcgatccgcccggacttcatttaaaggccagaaaaggtgatcttatggattacaccggcattgatccgccttatgaagagccggagcatgcggaactaatagtagaaacgcacatatattctatcgaagaatgtgccgaaccaatcgtggagtaccttcccgcagcgtggttttttccaggggggataaccccctgtgttacgataaagtttgggctcccccttgaacaattttttcagagcccctacaaactgattgagaaaaaagatggcttagaaattcattgtgatattccttaccatgcggatctttggtttccaatctatccccgaaagatgagtgggatgc

SEQ ID NO: 1720 - DNA, 231 bp, Bacillus thuringiensis
tacctataacacttctattcaattagtaaacacgaactttcattacgctacggtcacattctccagatcgatctaccgcttctttgccatctgcgggaagtcgtaatgcaatacttttctcattgccgtcaccggctatgatgactggtacccctaagtactggccactatacccatacttagctcgatggtacgcaatgagcctgtatccacgagcgggatcttgtaaaa

SEQ ID NO: 1721 - DNA, 253 bp, Bacillus thuringiensis
agaacaactcaccgtgctttgattcagacatggtgcatttaccgcttgaaagattgcataacgcatgaccggttttgcaatggaataccatcaaatggacgaatcctttaaatatttcagcgaacaacgcgccgattaagacggtgatagtgtcgactaataaggccctaatcatcgacaccttacaaacacaaatgaaaacatttacctcaatgatcattctgcaccttgtgcgggtacattccactatcct

SEQ ID NO: 1722 - DNA, 427 bp, Bacillus thuringiensis
  unsure (1)...(427): unsure at all n locations
aacaaaaaagaacatgngatgtttgtgacttttagggtggaacccgctatcaaactcatacacctgcttactaagacgaaatgctcccatatacaccatagaaacaatcatattatgatctcgaacatcaatctaatagatggtcagtccatcaagcgctgatactaaggagaaccaatcataaatgctgaactcgagtacgtcaactaaacgacgtgccattcgccccaatttgaaatactctaggtatggcgccaaaaggcgatcagctatacttcatttatatctacctcaccaattactgatcaattgagacacgccaaactgtcaatgtaaacgatatttaggtacagacacagccaatactatcatataacgaccttctttacaatggcactcagagtggctgaagaaatgttgtacaatt

SEQ ID NO: 1723 - DNA, 248 bp, Bacillus thuringiensis
agcaaaagacttctaccgggggggttttctaagagatttaccgctagaattaaaagccgacgggtgaaaaaagtgagttagaacaagggttttatcgttgtgaaaggtggctcgagcacattacttaaaaaaaattgatgtaaccaatcccagaaatcaccttgtggttgccaccggaatgcctgggtcggggaaatcaccattaacatttgattcgatttatgcataaaggcaccgcagatacctat

SEQ ID NO: 1724 - DNA, 413 bp, Bacillus thuringiensis
gtcgagcctatgatcactctcaagcacatttgatggggcccaagctctacacctcaagagggtatactgacaccaaaatcgcctccctctacactggccgcagcaacacaacgtctcgactggggataccctgtatctgccgatctatatcccattgctgaacatccagatatccccagctggcgtgctaacacagaggcccgcacgcatcgcgcttaccaacaaatgctctcactgcaggcacaaggggaaccgcctgcgttcatatcatgtctacctacgaccgcaccatttgcttgcgcatcacataatgtagccactgggcctaactccacaaactgcctctgatacgtagcgtcccacataccatcatgtaacaagttatctactaatgctacaagcattcactcata

SEQ ID NO: 1725 - DNA, 187 bp, Bacillus thuringiensis
atgcttaatcatataagacttttgtatttttttggaaacaagcgggtgtatgtctttcttttcctgtgataggggaaacactgaaaacttaccagtcgcttgatgagatgcatgcattatacttgcacactgatacttgcacaaattcgtgtctgtgcttcaaaagagaaacttgctggataagcat

SEQ ID NO: 1726 - DNA, 352 bp, Bacillus thuringiensis
gcgttagaaacgaaggcatgctttgaaggttttttggcatgcacaccgagtacttcttcggatgcagagttggggatgcactggttgagacgcgtctaatacatagagtgatccctctgaatggatactacctttagcccgtgcgcccaaagctcacaagcctttgcctagctctcttgatgcctgggcttctctactatcgcctaatgcaagtcatggtcaatacctcgtgcgtagctcttcgataccgaataatacaatgggtaccgatgcgagaccgacgtgaccaccatgagtaattgcaatgccaccagctcgtgacacttactctgcctttcacgcgaaggttact

SEQ ID NO: 1727 - DNA, 363 bp, Bacillus thuringiensis
  unsure (1)...(363): unsure at all n locations
ttgattagtcgcaagttcttgagggttattcctgactcttcatatacttcacgataagctggttcttctggtgattcactaagctccattagcccgccaggtagcccccattttccgtacggctctgtccgctgctgcaataaaacatattcattttcatttataacgagtaccacagcaccaactaaaattaaagggcgatgaccaactatttttcgtaattcttctacatatcccaccgtatcgcctcctttttcgtgtgtccacactatttgtatcatatgtacgaaacgacaaaatgcgtatatttttcatttttttaacaaaatatttattntatgtgattcatctactggagctaac

SEQ ID NO: 1728 - DNA, 314 bp, Bacillus thuringiensis
tacgatccgtattttatgtcgcctaaggcgccgaagggaacctgacgttcctgtgccccatttacagcaaaagaattatagttccactctgtgaaagaacgggatatgcggtaaaacaagatatgacacatacatcatttcaaactctcaacctacggctaggggacaaatgcgaggcgttatatatacgatctgactagccgtatcatgatggtacacagtattcgatgcctctctactggaggtgaatatagagaacgctgtacttgcccctgaagtacaggggaatggtgctgatcttcttaaacgcagat

SEQ ID NO: 1729 - DNA, 357 bp, Bacillus thuringiensis
gtagagttgataacacgtcaagagcattcgaatcctgtggttttgataggcggcgaaccagctgcaggaacggcgtatatgcacgaatagacgcgaactgaatatccggtcatagacgcgaagagtgctagcgaacactaattttgcgccatagcaactgacatgaacatagcaccatctgtaaaggaacctgtcggagtctgctaatccgacacaccatatagctgaacacctaagagctttggtatagtcaataatggaatatgtggcgtgtatcctccataaaactggcatcacgtggatatgtatccaccagggaaatagacgcatattgtgcaagtactcctttatacatat

SEQ ID NO: 1730 - DNA, 197 bp, Bacillus thuringiensis
agaagcttgtcacaattctgatatataatacaacgttttttattgatcatatgaacgtgtcaagaatgggtaaatttatatattggatttaatggaggcattgatactggctgtttctacattaacggctaaagacttacacatatcaattgttggcaaagaaatttacaagggagttaaccttgaagtaaaatgtg

SEQ ID NO: 1731 - DNA, 229 bp, Bacillus thuringiensis
attgagtgatcctacgaagtttggtgatccagaccattattttaagcgttacactggttcaagtgataacggtggcgttcatacaaacagcggcattattaataaacaagcttatttattagcaaatggcggtacgcattacggtgtaactgtaaatggtatcggcaaagataaattaggtgcgatttactaccgtgcaaatacacagtatttcacgcaatctactaca

SEQ ID NO: 1732 - DNA, 396 bp, Bacillus thuringiensis
cgggtcaagaaacttccctaaattcgttacaagattatactttcttgcgtaatgtccatcaatccaatctgtagctgaagcaatgataaagataagtgcccccactaaatgttgaattggcaaatcaacatcaccaattttgtatgaaccccaatcaaagggcgctaacataattaccataaaaattggaattaagaagattctagatattgtaattttatttggtaaattcacagctattcctccatcatatcaaaaacatttgttcatcgaaaaaaaaagccatcgaaacgaagactgttattgggccgggttgctctaatcccttgggttttaaatcacccaatccttgggtgatattcttttttggggggtccaaacggggaaagcaaggca

SEQ ID NO: 1733 - DNA, 319 bp, Bacillus thuringiensis
tctcgcaaaggagactggaattgcgggtgctttattgtgaacttcaccgctgtctttaatgtccaggtgtgcgagtctttatattattaacagatcactctaatcgaactggactaaactaggtttacggtatgccttgattatatatgcattaaggcataatcaaaggggtatgtgggcggaattcagttgaataaattaaagtgttgttagcccatgaatattatcacatatgcaggttacctcaaattgggactaacgaaaccgaatatacgttacttgatgcgctgattattgtggggctagctgatcaagcaat

SEQ ID NO: 1734 - DNA, 287 bp, Bacillus thuringiensis
attatgttgccgatgtacatcatgggtggcgattttgggaggtatcgccccgttatatattaatggcgtgcataaagattattaaaatattcattctcaaggtcttgatacgctatacgttccagttgaacaaatcgatcaagttcaacaatatgtaggatctgaacgtcaggatccgaaagtttacaacttgcgtggtcttgataggataacggctaaaacgacggttgcaaaatctgtgcaacacattgtggatgacctaattacactatatgctcatcgcgtaa

SEQ ID NO: 1735 - DNA, 219 bp, Bacillus thuringiensis
atgagacaaaagaacgtgcacttgccgagccaccattgttagaacatatggttgacgccgtaactgctttgaatgagcaagacaccctacaaatactgttagaccagctgtaaagaatcctgccgcatacactaatgtgcgggaaattgttgaagcgaaaaaacttggccttgccgaaatacgagctactgctgacaaattcctagaggaaagaccagg

SEQ ID NO: 1736 - DNA, 278 bp, Bacillus thuringiensis
  unsure (1)...(278): unsure at all n locations
agaaatttctacatttaacacgcgaagaagcgccccaaccaggggcaggggggagcaaagcgaaacaaaagcgcgagggcggggcagaccaaagaaacgcaacgaccgcngccgaacgcgcaccacaaaaaggaancaacaccggaaaacaagggaaaacgccaaaagaagccggcaagcgagcacgaaccgacanagaagcgccacagggcaccaaagcacccccagaagcacgggcaaaagcgcaaaaagaacggcgaaaaaaaaagccccacccc

SEQ ID NO: 1737 - DNA, 309 bp, Bacillus thuringiensis
cttcaggatccactgtatctggtgcagtgaagagaaggttagcatctttatcaaacttatcgatgcctactacatgatgatcaactgggacgataccagcttcttcactcgcttcaccgaatgcttttggaaaaatgatctctaaagcatcttggtatacagactcactaccaaatcgttgctccaatcatggacgcagcatttttcctttacagtaacctgttacgttaataaggcagactactttcttgaacgcagcgtctatagagatgtgtacttctttagcataaacttcgattgataaaacgc

SEQ ID NO: 1738 - DNA, 264 bp, Bacillus thuringiensis
gaacaaaaagaaacaagcgcaagaaaagaggaaacagccaatttccacttttaacaagcgagagccaaaacagcaaaaagaaaagcgcgggcagaggaacaaaagcaccggcacccaccaagagaaaaaagaggaaaagaacccggagcagcaacagaaggacaccacgggcgcacaacgaacaaaagaggaaaaaacgcagcccgcaacggaacaagaacaagagcaaagcgaaacaaaagcgccacccaacccaaaaacaac

SEQ ID NO: 1739 - DNA, 379 bp, Bacillus thuringiensis
  unsure (1)...(379): unsure at all n locations
cgcgacaatgcagacagacagaaaaccccnggatatatagaatttaaagaaaaacacaaaacacggggggacaatggaggtacagctacatacacacatacgactacgccacaagaggattcaaaacgcaagcaggcatgccaagctaattgaaccgggtctccaggaggcgtctcataacggacacccaccgaaggaccggaacaaatacgctcccccgcatcaaaagatgcgcgaaaggcaggcgaactatacacataagcacgaaatgcagaccgtgaacaataaaaaccgcgaccgactgtaagaaaccgccataacactcgtctgcagtaaaagaaacgcatagaagcacaagaaaaaagagctgcaagcactt

SEQ ID NO: 1740 - DNA, 403 bp, Bacillus thuringiensis
  unsure (1)...(403): unsure at all n locations
ttatggaacacgcatatgagatcttatatcgacgcagccgcgacccccgggggaagaatgggctngctctccatagcaccaagcgcgcgcataaagaaggaaagcatacgacaaaagaagcggcgacgatcgctacaggattttctacagtatccgctacatttatgatcatcatcgcaaaaacattagatattatgcatttatggaatgtttatttttggactacgcttgttgtaacattcatcgggactgctatcaccgtaagaatcccgcccctcagtagaaaaccagatacatatgtaacagaagaagggttcccagagcctgtttataaagaaaaaatgtttgaacgcgcttgggaagatccctccaagtatcaaagtctgcaccgagcattatgaaa

SEQ ID NO: 1741 - DNA, 311 bp, Bacillus thuringiensis
  unsure (1)...(311): unsure at all n locations
cggaacctggggctcgagggcgccattaaaaacgaacattgaagcngtgattanacgggaagacaggggcgcgcgaggaagggggggaaacaggggccacgccacagcgacccaacgggaagcccgacgcgccagaaaagnanccgaaacaaggaaaacgcagagcacccaaggangaggcagacgagaaggccagaccaaacgggcngacagaaaaaatgccaggaccgaccagcaagcataaaaaccggacgccgggngaggcatagncacacaccaccgcgacccccggaaaaacagcacaaccagca

SEQ ID NO: 1742 - DNA, 320 bp, Bacillus thuringiensis
acgggagccccgaagtaaagcgagcggagtggcacccggagaaacagccattttttttatagcagcagccacaacggggacagaggcgggggcggggaacatggcggcagcaacacgcgggcaccacgcaaagtgggcattgacaaatgcgctcagaagcgtttcagcgattaaaccgagccgaccctctaacgcctcgccaaggggcggggcaaccatacggcccatactacgccgtgaagcacgcacgatatacaataactgccccgaaacacgaggcgtgacaaatagcagcgcaaaaccgttactacccgcacgac

SEQ ID NO: 1743 - DNA, 333 bp, Bacillus thuringiensis
tgctggatatttttctctcgcagattgcgatttcttagtcgtggataatttgagaaagtacggggatgctgccgggtcacggactggaattggagcatttattaggccgggcatcgtgtgtggcgcataactgttagctccatttcttgaccgaggacatgcaagacctgccttgaagcgacctgtagctcatggatgatgcctgcagcaattgcacctattaactctataactgggagaatctgtcacacaccgcgcactggtaagctgctcagaaacatggtgcaattgtcaacacatcccctgttgatacacatgatgctggctttaaat

SEQ ID NO: 1744 - DNA, 345 bp, Bacillus thuringiensis
tgcactcgagcagtgaaagtgattaacagaggtttttttgcataccagtatgcattaacactaggcggagtaatttaaataccgctacaggtgcagttattactaaagttagtgcagccgcatccaatacgttacgagcgtggccatattcatgtgtagatatcaagacctaacgctgcaaattgttgcagagcgcgctttgacgcattaaacgtacctggtaatgaaacgagctggaacacaacaccacctgtcatgaagatgatacgtagtaccaacagaccagacatttgtgcatatatacgccagaggactaacgtttaatacatataccaaccaaagttt

SEQ ID NO: 1745 - DNA, 389 bp, Bacillus thuringiensis
ggggaacttcttttctcatggtgaacgtttatagatattgtgcgggtccatcaaccgtatctgccgcaatcagctactgaagcatattgagcaaatgcgcaaggttgattagaagggactgaggcattgagattagtatcctattattcatttgcaaatacagggtctgatggtgaaacaacatataatatacgttgaggcggatgttttgatgcaccgtatgggcatgtattggtaacggaaggactaaaattagctgttagtgcacaaacactggacaaaggtgtgattctacactctggatcaatttcattcgtaatagatttagatgaactactagtaccattcttattccaaaataaacttgtacatgaacgcataaagagtat

SEQ ID NO: 1746 - DNA, 388 bp, Bacillus thuringiensis
ggatcccgaccgtcgtgatgctccttattggccatagctagttctaatgctgacttttttgtagatcatgacacggacgcaagctgaggcctgtttatacttattagcgtccgtacacattcatgactatgtactgtggctgatgtcactccgccagcgtttctctagaagatgtttgaggctaacttttttttaatacccctatagattgtagaggtacggcaattgcctccggaactattgcacctccagtttgaacaacactgatcataattcggccccagttggagtcttgacgatgtattgctgatttcacacgtattgcagcggctatttgcgtagcgcctattgtagcctattcagtcgcttgagcttgcagcacatttac

SEQ ID NO: 1747 - DNA, 132 bp, Bacillus thuringiensis
attcggatctaaccatccagaactcatcagcgtggcgagcttcttctgagttatctgcacggaacgtaggggggggggtgtatacgaaacggaatgctaatgcacaagcctcagcgatcaactgtccactca

SEQ ID NO: 1748 - DNA, 102 bp, Bacillus thuringiensis
aatcatcacgtcccctgcgaagagccagcctctccctgggctctggcttctggcatgctacgggaaggcattcgagcagacggctgctgagagccatcccgc

SEQ ID NO: 1749 - DNA, 286 bp, Bacillus thuringiensis
cggtcgtatgaaatagataagggtagcacttctggcaatctctcacgctctacaccaatagatagggagctatgcctaccgaagccccgtgtagaagggtcaacacacccacgcgagcaaactggtacaagatctacgctatgcgtacgatcagaagaccaaccacgccatactttgctggtacgtaagcgactaacgaaccaagatgcccagacactattaaaagacgaacacgaacgagcaaaccccatgtttgctataaatagttcaagactgtggaagcact

SEQ ID NO: 1750 - DNA, 421 bp, Bacillus thuringiensis
agcgaagaatgtctttgaagaaacagtagaagcagatctttctccgaaatttgttgtaggctatgtagctgaaaaagaaaaacatccaaatgctgataagttaaacatctgtaaagtagaaatcggtacagaaacattacaaatcgtatgtggtgcaccaaacgttgatgcaggacaaaaagttgtcgttgcaaaaatcggcgctgtaatgccaagcggtatgttaatcaagccagctgagcttcgcggtgttccttcttctggaatgatctgctctgcacgtgaattagagctttcagatgctccacaagaaaaaggtattcttgtattagaagatagctttgaagttggacaagagtttaaattttaattgatataagaaaagaagaggttgtccttttggaacagcctctcttttttt

SEQ ID NO: 1751 - DNA, 302 bp, Bacillus thuringiensis
tcaggattattacttttactctatgatgctaggatcagtcgtaacagcgcagttaggtggatttttaacgactaagctgagctaccgaaacattatgattatttctgctgttattatgttaatcggatttattcttattaagtacatttacgcctgaaacaagtcttgcattattaacgtgttatatgattattatcggatttggagtaagtttctcattctctgtactaagtatggcttcatttcatatcatttgtttggatctgtttgtatcttttactacaattagtttattttattta

SEQ ID NO: 1752 - DNA, 474 bp, Bacillus thuringiensis
agctcccctgggttggagaggttggtcgacaatttaagatggttcttttttttatcccccgtttaaacaatggtttttgattgggccgccccgggggccccggcccaaataataggcacaggcttttttttaattttttttggccttttttttccaaccccagaaaaaaattttggtttggaatatggttccggaatgcaaaggcccctttttttatcctcttatataaaacattgggattttgggacaatttttggcatttttttttgttcgttaatccaaatccctattttttttattaatccatacatttggaataacattaaatacctcctaatccaaaggatttcttttaagaggttttttaacatcaaacccttttgtcgaaaataagcacgtataaaattttccatctgccgaatttttggccttggcacaggagacacaaagtgcctcaaaaccagttgtaataaa

SEQ ID NO: 1753 - DNA, 290 bp, Bacillus thuringiensis
gacaccttcagaacgcccatgtgctgtatcagtgtttaattgcatctacactagcttttactgaggcatcgatgcgaagcgtagcattcgatgttgcaccaactgctgctgcaactaaggagggttcttgcttatctttagcagggtgcgggcatgcaataacttatgcaatatttcagattggaatgagcctttgtcatacaccgatgttatcaacaagggggcgattttaaaatgtatactctggtcggacctttacagcttctagcagtgaggtaccaacaggggct

SEQ ID NO: 1754 - DNA, 339 bp, Bacillus thuringiensis
tgaactttagctctaacagtacagggggagcgatcctttctcagtgcgatgacaaacatgctgaaccaggcactttatctagcgctgatggctccaggtgacggtgagcactaaatgcttacgttaacgggcgccttttcacaacggcagcactgggaacttgtcctcatttatcatcggacggacctacagcaccagataggggtctcggtggaggcgctggcaacacttcttctgtttgagccggatatatacacactccgccagaaaaaggagaatcactggggagagctagtacgtataatattcctaattgatctaaataacccttgccgacag

SEQ ID NO: 1755 - DNA, 263 bp, Bacillus thuringiensis
aaagcagatacaatttttgagctcaaggaagaagtagacctctgcgggaggacttacaatttcgaggggcgtacaattgaaacgcaataacacttcattgtgtgcttaactgcaataaaacatatggaataccacgtatacaatgcgcaatatgctgatgctcgcgtatgccatatcctacgtataggcgactaattaggataagctgcggagggagcagtgcactattgacgagttactcacgagaaagaaaagcaggtgct

SEQ ID NO: 1756 - DNA, 382 bp, Bacillus thuringiensis
aaacagggctggagtatctaagcattcgaagaaggactgattacagggttaggaaatatgattcggagcgcaaggatcgattaaactacatctgtcggaagatgtctgactgaggcatacattaggggcaaacagaaccatgtgacgaagtaccagccgcaccaggagagattcacatacagagcacaggtcgcgcgaaagcggatccattggaaggaagaatgtctcacgatatacgaatggcaagaagcttattaggtaagcaacttggagggaaagtaacaaaccggacaccatgcggataacagcagggggggatggtctaagtgaagtagaaaatgattttgctatcgttagaaaaacgtattcgggcgaaagaaat

SEQ ID NO: 1757 - DNA, 348 bp, Bacillus thuringiensis
atcatccatgtcgtattccaagaataattaccaggaagaccagagtacggcgactcaaggcgagaagatatggcagttgcgagagaaaccataacggattatgacaaacacaaggtgacggatcaaatgagtcgccaaagaaaatggagcacttacacacagtagagtgattgccccatcacaggagcaattatgctgcttatacagcgaagcaaaggcccgaaacgtgaaagcgtttaaacaaagatacgttaacgatacagggtattcgaagtatggctggcattacgagattgcgaacaagctgaacgaaacctgcgctacatgctgatggctaccaaggtagtt

SEQ ID NO: 1758 - DNA, 398 bp, Bacillus thuringiensis
tacatatccccaggactggattcttttgttatctcagccagtatggtacgccgatatgaagccggagagtttgttatctcatgaaacacacatggtgtatacatcaggaaagcatgggataccgttgcaatgcgagggactgctatccacgaccctgtcttacataacgtattgacttgaagtggcttttttacagagatacatggcggaaaagtttctccttccggcgttggctggttgctacatataccagcacgttatgtaggaactgcacaatctgcaacaaattatgcagttctatttgcggaatcatactagccgctcagtctaaaccatcctattagttcattgccgaatgctagaagattagtcggtgaatctgaactcgagctgatgca

SEQ ID NO: 1759 - DNA, 238 bp, Bacillus thuringiensis
actcttgcatgttttcttttgaatactgcgtgagttacctacgtatctgtcaacccatatgcatcagaaacttctgcgtcgtacatctcttcaacatcatgaattgctggtaaacaatgctaagaaaatcacggtgttattccctgttgcttttatccttttcatagttactcgagaatgctccaattgctggacacgctcaggaaataatacttgtgcccacagtgacacccatgca

SEQ ID NO: 1760 - DNA, 206 bp, Bacillus thuringiensis
agccgattctctttcttcaatacggggacgcactgtctatgggaactatccctgattgctcacctgaccatatgggtgcctatttggcggactccaataagcggacgcatgtctggggtgaacttatactacactccgcgcatgagcgcactgcaaaccttaaaaatcgcgctacactattattcgtctctcgtggaatgcttgaa

SEQ ID NO: 1761 - DNA, 377 bp, Bacillus thuringiensis
attccctgaaggtcctttgttatgctggaacagccacctataatcggtgaaacaaacggtggctcactgagatgagcatactctacaggagaacgaacgtggtcgaactacagcccgggaataaagaccatgctctttaatacgtatgagcatatgtgccacattcccgagtgacgagaactgcatcatatatgtttgtgagaattgaacaggggagcgattggtgacactgtcctggaagaacgtcgcgacactgatgacgttgcttgcgtacattttgcttctgtatatcgccaatttaaagattgaaaggcgtttatcgcagaatgtaaagatatactgcagacagaaagaaagtagaagttgtattttattct

SEQ ID NO: 1762 - DNA, 312 bp, Bacillus thuringiensis
cgccgcttgtagctgtacaggacgatgtcgggccgtctatcgcaacgagctctgatcgctcaccagacgctgccggtgcatgttcagcggactcaaataagcgtacggatgtttgggttgaccatgcactacataccgcgcatgagcgcactgcataccttagtaatcgcgctcacgaatatccgaattacgtcgaaggcgtgaataaattacgtaagcacggatttagagttggctctcatacgacgaacggtcctgctcttcgagatcccgacacgatgatggacacaccatgggaaccagcgaaacgcg

SEQ ID NO: 1763 - DNA, 257 bp, Bacillus thuringiensis
ttctactctagactgaatgactctaactctccttctcatgacaacaaaacatacaaatgggatgccttataaccatcacgcatccattacttggaaccctctattcaataatgcggcagaatcaatcgctagtctagcacccaataaccagtcagtgagctccaaagcatctatagctcgcaatgcttgcatattatcacgtgtttcatcacggaatgcacctcccgaagctgtcacgaataacccctcaattaatc

SEQ ID NO: 1764 - DNA, 440 bp, Bacillus thuringiensis
gattacacaacgtggcctcaaacaaagttatccaatgcatttttttgatcggcgcaacccacttgaaataagtggcctacatagacaactctgttaataaatctatggatgacgcgcagtacacgacctaagattgcatgctcttattcttgtgttgcactaatctctactgttagcatttgacgataaaatttacgcatctatccatttttttcactggatgtgtacctgcatcaactccgcaaatttgtactttgtttctcgtcaaagcgagccctcctatcaggaatggctgatcaagagcaagcattgccctcaaaggggattacatgcatgtggctattttgcgaaatagtatagcataaatcttatctgctacaactatttagacaaagaccgaccttcatcacggctggtcatattcctacaccatacatgga

SEQ ID NO: 1765 - DNA, 311 bp, Bacillus thuringiensis
ggtggtgtcactcgttcttttacttgggacggacatatgtgtgcgtcgcaagcaacctatggtattgcagcctataaagacaatgccaatcctcttattgtaatctcaaactatcacttattatactgggttgatgaaaattcgcccatgtttcacacattccgagaatgtgacaacggattccactagggtgttcagagtcatcaacggattgaatatgcgccgccagttttaagtgaacttatacttcgtaaacgctacgacatttataggctagataagtaactgcgttcatgggcatatggttctgg

SEQ ID NO: 1766 - DNA, 409 bp, Bacillus thuringiensis
atgaagaatcctttgtagagacacttgccaaactgacaaactatgagatcgatgtacgagagcaaaatctgatacatcctatggggaaaatggcctcatttgctcaaaaacggacgcgatgagtcgtagtaaatcgcagaccggtattgagtgaccacagagcttggattttgtatatgtacaacgcttatatcaacaagcagccttggtgttttgtggacctactggtgttggtgcgacccattatgccacgtgtatgcgtttagcagcagctcctgagcgaacaggtgctcatttaattaaaagtactgatttacttaaaaactatacacgcgccacaatggaccatggcctctaatctccttatggcactatgcacaatacacattacttattattgaggacagtt

SEQ ID NO: 1767 - DNA, 372 bp, Bacillus thuringiensis
tgcaagatttgtcttgtggcagacagaccggcaaaaagaagagggattgcatcaacatgatcaatattcgatggaagaattatgggtggaactaccgagatggcacgaacacatagaccctccgttacctgcggtataaacccatcggggagcaaggaacacctcgattgggtcaagtacctgccaggcgctgctataagacagcagcatgcaagaagggtgcgctggctttatgagatggatcgctggatggaatggctgagcatcgcgatatacaggacaggacgacctgataccaggtagccccatacgcactcgaaatgataaacaatccgagggactcataggaccacgagcacatacattacttat

SEQ ID NO: 1768 - DNA, 400 bp, Bacillus thuringiensis
ccaatctcatgatgcttaggcttattaaacctgctaaaggcacgattgaaatataacagagagaacggacttcaaaatcagaatgatgttctatgctaaacatggtacgtgctccatgcttctagatttccagaaaacttcactgcaaaagaccacctaccaattaatgcgaagaggacaggggttcacaaattgaatgctactaaacaaccataagaaataggaggcttgcagcttgagacacatttgcacagtacgagcgctttgcttaggaatgaaacctcgcttcggaaatgcacgcgcaattatgcattagcccgagcttctcatattggatgaacccactatcggactataccctattggtatcaaacatatgctaaaacttattcattcctta

SEQ ID NO: 1769 - DNA, 507 bp, Bacillus thuringiensis
agctattactgattcattctacttattatataaaggattagaaataacgtcaggggcacagcgaattcataattatgaaatgttactcgcttcgtttaaagaaaaaggattacacccagataaatttcaatcttatttaaatacatttcgatatggttgtccaccacatggaggtttcggaattgggttagaaagggttgtatataaacttttagaattaacaaatgtacgagaggcgagtgcttttccgagagattgtactcgtctcataccgtaaaaagaatcttcgcgattatcgcgaagattctttttttatagttcgtttgaaaaggtgaaaatatagactctttctttttctaataagcttagtaaaagtcagttgaaatatgaaccatttcgacaaaaaaatcaatatacccttgacagttacaaatataacagatatacttcatattaatttcaaaagaaaatatattctaaatatttaaatgtgttgaataggagtag

SEQ ID NO: 1770 - DNA, 235 bp, Bacillus thuringiensis
catatcaatttgtggattatttgtgcacgcgtgtactaagtagaaccgcaaaagggagcattcattttggagcatgcaatacattaccagatcatgatttagataggggccgtttattcgtattcttaattgacgcgttactggggaaaccattcgagcgccaagatgaaggaatggctcactctatcgggcttgaatgattaatgcaactcatgttaggtgtaacttggaatga

SEQ ID NO: 1771 - DNA, 235 bp, Bacillus thuringiensis
aaatgctcacttgctaaacttttctctgaagtgtcagttgcagaagttaatgcagcatctaatgcatcacctggaggccacttaaaaggtatccctgattccacctaacaaccataactatctatcgactctaacggatgtgcatcctcttctacaatacgagcattatctacactggtaatggaaagtatcacggctcaagtactttgtgtgggcaatcacgaaactgggtact

SEQ ID NO: 1772 - DNA, 148 bp, Bacillus thuringiensis
acacatatggtgtaatggcagcttccttcttggaagcactgatgccgatgaccgctatgaggattttatggggagataagcccataaacccgaagaagtgtatgaacatcactataggaattgctcaagtacgagcagggactgcaat

SEQ ID NO: 1773 - DNA, 506 bp, Bacillus thuringiensis
gtaaccgcggacctcaagctaaaaacgttgtaaagctataattcaaacaataaaaaggttgttaccagcaaggttaacaacctttttaatatataactaaaattttttacataaaaggagtggttacatgtatcgcaatcgaaagaacgatgtagcagaagtaccaccagaacaaacccctgtttgggaatgtgaatcagaggattgtttaggatggatgagaaagaacttttcatttgaagaagagcctaaatgccctttatgtaaaagtagcctgaaaagccgaaaaaccgttaattacctaaattaggttaatttataataaaaaaaaacctcttttaattaagaaggtttttttttattataaattttatggtcctaaacatcagtttcgcactattagaatacaaacaatgcatcggtgttgcttattttccttgaagaaaattatccgcgcaaatagccctttccttttgggaagcccattttaagataacatttctaca

SEQ ID NO: 1774 - DNA, 286 bp, Bacillus thuringiensis
  unsure (1)...(286): unsure at all n locations
ngatatggagagcatataaaaagatttggtgatcactagcgcggcctgttttatgaacgcacgacgtgtttgatatctggctctgaaagactaaggggcatgagaagatacttacattccaaaatgtcaaacaaaacggtatggaccggaccaataaccacatggtcgggcgcgtagagcaagactcttactgattatcactgacgacactggcatcgcgaatagacatgaggcgagtgttgcagaccgactcggactagatctaattattacagatcacgatgag

SEQ ID NO: 1775 - DNA, 186 bp, Bacillus thuringiensis
cgtgggctctgtgccggcagcgagttacgtatatgaacaggtacgtaacactgaggacgtgtgcgggcaagagctggtgctaaaaaccatgcgaatgtaaagccagatagcaatctggataaaacaggacatggtggaatcggatctgcagttgcaagtaatggagagcgctggatggcacgctca

SEQ ID NO: 1776 - DNA, 247 bp, Bacillus thuringiensis
gatcctgacagcatgctggcaatgtgtgtagggagatatatcgttgttgctaccggatactatgctgacaccatgctatatgaacgttccaggtggggactcgaacatagtcgcttactattttaaagaggggcctccctattttgaccgagacgtactatttaccggtcgtgaagactcccgtgctcacgcccggtgtgatcttgttaaatatggtgctcgtgtaacggttctgtgtcctgggagt

SEQ ID NO: 1777 - DNA, 459 bp, Bacillus thuringiensis
ctggtggattatcgttacattcattttaatgcagttatctggcgttgttggattgccacttctcctaaaaacaggactctatgataatagaggatttaccattgaggaaaaaggacaaatcataacgggacactgggcaattattagcttctttgttgcattatgtatcgtactttggttacttagaacagatattcgtgacaggcatttagatccaaagcgctcttctgctccagctactattggatggattttcatcgggttcttcttagctttcttttcacaaatagttgccggtatgatcgagatgcagctgctaggaattaaacaaggttcaaaaaatacaatgaaactaatggagattgcaagaacgaccccttggttccttattggtggatctataaatggacctatcttagaaagaaacgtatttagaaaaaatttatttggggcacttta

SEQ ID NO: 1778 - DNA, 334 bp, Bacillus thuringiensis
atgatttgtcagcgctggaccatgcaggggttggcttcgtatttatgttaccatatccggtgatagccatacttgaattattacttcaccaagtacactggcgtgtaattacagtatagcatgtaccaaattgagcgaaagggcgaacgatggatgtgcaagagtttgttgctccattgcaaccgtctgatgtacgtttacatgatctcactggagtaccagctgatgatgtgttggctccacttatttaagcattggcgaacctgggtggagaggactgatcaaatgaatccataagtgactggatacctgtggattgatcactctgtgcaag

SEQ ID NO: 1779 - DNA, 302 bp, Bacillus thuringiensis
tgctatgatgttttgtttaacggaagaaatgggggagcttgcgggagaggaaaatcattattatggggagaagccgaagaaatcaactgagatggaaagaggtatagaataatagctcggtagaagtattaatacgacatgactatgcagtggcgcattagtatgaaatagttgagtggggagacagcgcatgaccttgttaagattaattgtaatacacttgctgaatattgttggacacgtaaagatgaggggcagaatgaataatggaagaaattaacgttcttatcgacgggccaaga

SEQ ID NO: 1780 - DNA, 271 bp, Bacillus thuringiensis
aacaccgtaacgcacgccatcttatcgtgcaaggttagcataagcttcataagaggattgtaagtcatacgttgcttgagcgtattcagagtgtggaaccgatactttttcccaagttgctcccataccttttaatacctttatagcatcctggtactggctcactagcttctttgccaacacctccgcctaagtatctctctcggaacacgcactgcagtaagctcttaatcatcgccttgtttaaccagcttaaatattgttccaactt

SEQ ID NO: 1781 - DNA, 455 bp, Bacillus thuringiensis
gaagtacgtgtgttgcgatctgaactaggaatccctgtggatttcgcgtggggtgaaccatgcccaggaccggggcttgctatttgggtatgaagcggaagctccaaacagaaagctgacatcttacatgaatctgacgcgagtgaacgtgaagaaattatacacacgggcctagaccgacaaagatggcactacttcattgcactactcggtatggggagcgccggtgttatgggtgaccagcgtacttaccagtacacagaatgtatatcggcagcaacatttatcggctgaatgacaggtgactgggcacgtattccttgggacgtattacagaaaagctgtgttcgtatcgttaacgaagtaaaacacggtatccgcctcgagtatgatgtgacgagtaagccaccggcacctgttgagtgggtataagagaatagactgctgcgaacgtt

SEQ ID NO: 1782 - DNA, 253 bp, Bacillus thuringiensis
gaaaaacgaagagaaagattatagtgaatacttcgcgagtgtatattttccaccttccttaaaggaggctaaagagcgtgggaaagaagaagttagcattgaacgggattgtggcttacctgcagagtttcttaattttggcccaggaagattgttctacactggtacatatggctgccaaatgaatgagcctgataccggacgaatgtgtggtgtatacacttcactacgatttgaaccaaccctttcaact

SEQ ID NO: 1783 - DNA, 472 bp, Bacillus thuringiensis
cgtaaattgtgaaacacttcgtaatggctgcacactactgattgaatgcactcctgattcactggcagctaaaagcataactgcatacggaccgaacagtacagcttgtaccacattatatgcctccatccttgtgggaggaaagtgaaccaccatgcatggacccatttgtgagggggaagtgacatatgactacgaacgataacacgcctgaatcatgacgctgtgatcaagcggtaagcattgattcagtagctctactgctacgttgccccttgcagtcatgataacgcctgctcacccacatatacgctggagaaactcgaatgcctccatcgtttcaatttttgcaagtataggaagagacgcccctagacactgtcgcacataatcacgcatttaaagaatacgactaggagtccgtactaaagaacatgcgatacactcaacatactgctacaaaagaaactga

SEQ ID NO: 1784 - DNA, 377 bp, Bacillus thuringiensis
cgagacactcgaccccacatcagtcctgtgcctacattacgttctaatatagcggaagacgggaaccccaatttgcgctgcaactgctccaatcggcgttgcaaagggcgggcctataacgcgagataacctatctgcacatccaattacacgcaccgcctgcgaccgcaaaacatggcattcacccatctatagtaccgagcctacaagagaactagtcatgtgcggcattacgagaccaccgtattcacctgatcctgccatggatactgccgaacccgataaaacactagcaggtactgtaccgataaggcagatgcaggtcgcatttagaccaagtccaattgcaaattctttaccgaagctggaaattgtta

SEQ ID NO: 1785 - DNA, 291 bp, Bacillus thuringiensis
gaatggtgttttggacgggtcaggatgtatgccctatataagatgtggaatatgtaccataccggcattgacatcttctgtatgaatatcgtcccacacatatttgaagagctgtgtttttgtaaagacttgccctgggattgaagtaaagaatttcaacagaatcaattctttaccggcaaatctaatttcttctttgcttgtatgaactgcgtatgtatttaaagtgatacgaatgccctttaaacgagcaaagtggatttcttgttgagccgtattgttacttccgag

SEQ ID NO: 1786 - DNA, 453 bp, Bacillus thuringiensis
cgcctggggatcgggctggaatagtgttaccggtctgcacatagatttgttttatatgcctaaccagcctaagcgatgcatagactactctagagcacggcccatgctactgacaaatggatgaatggtgtcaccataaaggctatacaatcgactgttcaaaccacatcaaccaacttgactgtaacagaacccatggagtcatatcacttcagaacatccacatttacaattcccgatttaagccagcgcggcatttatagaacgagaggcccagacctatcgaccatcataacatgggcacctcctgttgcccgaagggtaaatgtaggcatcaaaatattgtgagcattgcgccaaataagcgcgagagtctctcatgtaaaaactccgactccagcaaaggcgcgatctcttgttaaagcacccactatacttatattgggccgagtg

SEQ ID NO: 1787 - DNA, 148 bp, Bacillus thuringiensis
actactaggagagtactcctttaagcctacctctccatcgcgatcaacaaatatcggtaggaggtctccttctcgaagacctcaagtgcgactactgtctttctggctcgctaccctgcctaaatcatcaattcgacgtacgattcca

SEQ ID NO: 1788 - DNA, 523 bp, Bacillus thuringiensis
cctgaatggcgtagggcgcctgctagcgcaaagcctacgttaaagtttgcgttataggttgcttcattctcatcatttactatcccaccagtccgctttggctgaatcccttgtaaaccgaatgatttgaccgcaataacggcgagtgtcgcatctgcttggaccaagagtccactcttaaaggactagctcatcttggctagtgggtgctcaaccgaccattacggcgaacgcaccgctaccagtgccatcaccctagtcatgtaattcgatgtcccagtgcctaccagtactagcttggaaccctaacgggagcccctgattgataggctgcacttgaatccctgtctagcgagcgcgtgaaaggccgggataacgccgaacagtgctgtcgctagggcactggcgtgtgcaccgggcacgctgctcggtaagaccactccacaatgagctctttgcgccgctactagacgcgtcatgtggtacctccttttgacatgagcacagaacgcatatgtgatta

SEQ ID NO: 1789 - DNA, 371 bp, Bacillus thuringiensis
ggggtcactaaagcaggtgtgtgatgtgcataaacgccacgttttttaatgcagagtcagaccagcacatgtgtaggggcagcagtattgttattaaccagtaaatgaagaacatctcacaggaaagacgcttgagttcacaccacggcaggcatatggtgctacagtaaaagaggtactgcctgaagcaatagcaggagctgcggaagcggcgcccggggtgcttgtaatgcgtacatagggattacagctggtggctggtcttacttcccataaagggagaaccattgagatcataacggggcaaggcaaatcctcaacgtcaacatcgcctgtaggatgaaaggcctaaacaggaaaaggggaacatg

SEQ ID NO: 1790 - DNA, 270 bp, Bacillus thuringiensis
ccgaaagattggacagttaatgatgtggaaatgtatattgtacctgaggcgattgtcaaaatacttcgtgaaacagaaacgacacaaggtgtatttgctgtttgtgagaagcatgagaaagaagtagctcttactgatgggaaattccttttattagatggcctgcaagacccaggtaatttaggaacaattattcgtacagctgatgcagctggtattcacgccgttgtgcttggagaaggttgtgttgatgtttacaatagtaaagta

SEQ ID NO: 1791 - DNA, 373 bp, Bacillus thuringiensis
cgaacatgtctgccttggttctcacccacgacgctacttcgaccgaatcaactcggtcttcgacgcccagccggcagccttacaagcctgacaagggcacgggtagcctcaattcgaaacttaattggatacgtgccgcatggctgggcgccaacaacggcgtcatttcgacagccggcatcgagatgggcgtcgctggcgccaccggcaaccgatcctacctccctattgctggtgaggctggtctgaccgacagcgctgtgtcaatggctggcggcaagtatgtctgcgtgagctaccagcgcgacattgaaaagaccgtcatggctaaagaaaccgatgagctacgcgacttccgtgacgagaagcttga

SEQ ID NO: 1792 - DNA, 287 bp, Bacillus thuringiensis
ttcctttgcagatggtctaaagaggcctaaccttaatggtggaaacggaccttgggctgaagatgacccataaggatcacgaacgactctcggaatggattgatcatgctcactgagaactggctcatgtgactgtgcagcgcaatgagtctatagaaccgtattcaatcgcaaatcccttgactaagcctcgaacgaacacaccacgatatggactgctgtcgaccggacaaggttctaatgggacccccgtgacagtaagacacttgcacaaccatcaaccaaaa

SEQ ID NO: 1793 - DNA, 240 bp, Bacillus thuringiensis
gttgaccaagcgctagaaccacgcgagtgtcaaatgactttctctcagattgaagcaatgggtgcacgagaccgaggtttactgttaggtgcggcatgtcacgaaacacaagatttattgccactcccaatatcggtagctcacaaattaactccccgattaactgaagctcgttaagatgatacattatgatacttacgtgcagatggaaatacactagttacagatgagttttatgaa

SEQ ID NO: 1794 - DNA, 249 bp, Bacillus thuringiensis
tatgagatggcaaaagctaatactcatattaacaatattggaatagaaaggttgtccattgctggtacgggcgcacttgataaatttatcgaagaagaattaccaagcttatacttaactggtaacgatgctgaagatttaacagtttgctttgggaaaggtgaaatcgaaccctcttattaaagcttcttaaactcctgggcaaattaacttaattggaagcgccgtttaacgtataaaacatataat

SEQ ID NO: 1795 - DNA, 423 bp, Bacillus thuringiensis
caatgttcattgaatgccacgcactgatgaagcccttaatgtttttggacatgactattattttagggtgtcttggcataatgaaatatgaacaaatggttgcgatggtcatcattaacataacttcaagccgcgcgacctcggtattatacacgattgtatggaccacttctgccattaattacactgcaaacgacttgacagatttacgtatgttggccacgcaccacttgactgtaaaactctcactcttactatacttggtcgtaacctgccgctcaatgcctgaactgcacataccctcgaacgagtggaccgatggataggctatcctgacctatacaaagagcgactccttgcataccgaaggcgtgctagctctagctgttcgggcgatacctatgcacatagtactcgatgact

SEQ ID NO: 1796 - DNA, 336 bp, Bacillus thuringiensis
ctgaaaataaagggtttcgacgttcagatccctctggatcgatcgtactttcgctttatgtcatacatatactgattttgcacttattcattttggattgggctgaaaactccaatcaagtcatgctcatgtacaggtttactgcattaatggccgtgaatctgataacatgcattacggtgtaacactgcttattgatccttctatgctaccagttctgctatcacttgcatgctcaaagtatgagcagcggaaataatggcatgcataatatcatctccatcggggaatgttccagtcctattgacaaattgtcttggaattttcaaagtttca

SEQ ID NO: 1797 - DNA, 254 bp, Bacillus thuringiensis
aaacaagcgaagcgctgagagatccactaataatttgctctatgcggagccatgtgtgaataactcatgagctattacggttgcacgcacgatgaagtactacattgttattgaccagccagaatgccacatgactctcatgcctaagcgtactgatgagagatccactggattactgactgcgttaacctggaagcgctggatccaacctagcatgtgagcttggacgcgctcaagccaacgtgtaatttgaa

SEQ ID NO: 1798 - DNA, 453 bp, Bacillus thuringiensis
ccatctagaatcctgtccttatagtatcgcctttgcgcattgcgtagaacccacgctccgctatgatgcgagctgttgcaccgtgccgatcgctggatcccagctgttttgtgcgtggaagtgctcttatattacctacattcgctactactgagcatgccatataaactgtgatgccagctgtgcgtaagaagatgaaccacatttcacaccattcattgactgattgtttggttacaacttggcgaactggtcgtgccacaatgatcagtcgttcatcctacgctcgaatggagccggtttgcagtagtggctgcatcaacgcgcttcaagctggcttacttcgctgccataagatgcctccgcttgtaggagcgaactgcttttactaatgagccgtctaagggacgtccgattgacatagcttcaccagatgctataatttgtgttcca

SEQ ID NO: 1799 - DNA, 185 bp, Bacillus thuringiensis
cattatcatcagctcacttatttttccctaaaccagtttacaccgttgctgccgcggaattaacaaaggctttacctgaagagaggctacttccgtgcttgcccgatgatgcgtaaagccggtttgtcatagctctcgcattcccgtatcactaaacggatggcctgggcaaccctgctgccata

SEQ ID NO: 1800 - DNA, 470 bp, Bacillus thuringiensis
atcgactactaattatcatggggtcctttaatatattggtatgcaaatgatcgtgcggaatgagcgataaaatctcgtgctgaaagaggtacaagctacggacgccccaccagaaattgataatctgtgactaaaacttgccattgagcgcgtgccatcaattgtgattgacgccgtatggagaactatggaccggaagcaacatggagtgcactacgttcagctcgtggctatacaggtacgtatataatctcgacaactatcggttgcatccacagatatggcgattcgttattaattaaagccggttctggagcggtgactctaggaaaaccagatgggcctggggtcctacaaggagtagcgttcattacgcacacgggagcttatgacgatttacaaagtgtaacaaacccaaacgtacaattcggagatgatatagctcgagtagttgttgaaccagtatcaag

SEQ ID NO: 1801 - DNA, 467 bp, Bacillus thuringiensis
agtttctgattttgaatatgatatgcaaatgacttctattaatcgaaaattagatgaaagtattgaaacattttttattatgacaaacaaccaatattcatttttaagctcgagtattgtaaaagaagttgcgaggtatggaggaagtgtagtggatcttgtacctcctattgtagagcgtgctttaaaagaaaagtttcaaaccccgttaaagtgaacggggtttttctttatacgtgcgcaaaaataataaaataacatataagtatagaccaaaatatgtaaaaattggtccataatgtataaaagatgaccaaatttcatgtagtatagaaagatgctcggataaaaaatacaggaatatcttttggcataggtgagaaagaactcactttttcataaaatggggtccaaaatacaaatgtaaaaataggggcaagaatactttgaaaaatttttgcgaaaaa

SEQ ID NO: 1802 - DNA, 460 bp, Bacillus thuringiensis
ccgtacttagcatctgaattgcttgactttgttggagatgaaatagccatatctcaactgactacgcctatgcatggaaaacaatgaaccgctcgtgcagccgcatgggaagcttactacggatgtccagccggaatggacgaagatcttgatcgaatttatgacgagctcgttcctgcgggatcaacaatcccttgatctttcggtcctaaaaactctgcagctcctggatttgccccaatgtaccgaacagattatgatgcggaaatggaggctaattaccgtctgcaggcgctaaatgatactggacactgcagctacgggattaaggcagcgacaccgagcacatctatgtgcagacaatttagctaatcactaccagatcttccattctgcttcaggaggcccgacttcaaaaggagacgcccattgtgcagaagcccatggtgctactctgatt

SEQ ID NO: 1803 - DNA, 480 bp, Bacillus thuringiensis
ggatgacactcttgcatcttatcaagaggaaaggaacgtgcaattggccttacgtactacaaccaacactattgccatcgaggttgggacaccgttcataactgaggactatagagtgtgaatatactggaaaaaggacactgccgggtgttatggggccaacttcatcgaccgtggcggaatgcgccataacagctcaacgcgtgtggtgggggctatcagggctgtattaactatcctggatgtgcccctaatagacagcgatggaatgactgtactatctgaagtaccagaattgattgatgtatgcacgactcatgaggtatatccatatataaaggctgaactctaatatgaacatgatcgtggcacggtggattcttctatggaactgaacattgcagcaccacaggaatatgtacgtagaatgcgtgcatctgttcatgtaatgggaccactgtgtgctcgtaacggccacgc

SEQ ID NO: 1804 - DNA, 287 bp, Bacillus thuringiensis
gagcggcgtgccctctataagaatttgcaaggtaagccatttaacgggacacggaatctaacatccttcattggatcatagtaggattagtgcgcggctctatgatctaacgatcataaacaaaacatctactacagacgattgttacggcagtatctaacacacaatctcggcctaacaatgttcgcagtctgcgactcgtgcttatcttgatacgaaagcctgagcttagagctaatggtgaacaggggaagcgatttttgtcgggtcattcaatgggtgtccgc

SEQ ID NO: 1805 - DNA, 228 bp, Bacillus thuringiensis
tatgcttccgcatgtgaatgcataactcaaccatatcaactcgctaaaagagctagtatcccttcctacgtgaaggaagctaattggtattgtgccggctgaatcactttagcatgtaactgattctcactttctggcagtacgcgcattggctgcttactagctccaggggctactagcgtgataacttgcactgaactattctgccccattcgatacgcaatatcc

SEQ ID NO: 1806 - DNA, 449 bp, Bacillus thuringiensis
gtacgacagattgtttattacaatcgaagtatcgaccaatatgaatatctgaaagaaacgaacattgaacatctacattctgatggtatctacacggcacaggataacgctgactgtggacgtgatggattactttattcaatgcaaagcggcacgtatacagaaaacaatgcgatgttggaagatttaaacaatgggtttagtggacatcacgcttatgaccttggaagcattgtaccatatgaaattggttctggattaaacaccgcagaatttattggggatcctggcgttgtagatcagatggagacagaagctcggataagtggtatagatggcatggaacgtgcaagtatattccatgcatgaaacgaaagtgcacaccgtcgtagagtagcttgtcgggcagtccacagctatgaggattaaaagttattagttgcgcatat

SEQ ID NO: 1807 - DNA, 259 bp, Bacillus thuringiensis
gaagtacgtgctggacatttttaaccattaccccgtatttaaaaggagcttcctaagtatgggatttgggagggtaagttccgtccagactctatggaggatacatttccgcatatttaatctatttaccaggatccggtgaagggacaattaattgccgatgtccctatggtttgtctgttatcaggcggattaaactctagcggttttactgcacttgcgggtcaagaatttgctgctgacaataaaacagtgcata

SEQ ID NO: 1808 - DNA, 290 bp, Bacillus thuringiensis
tgaaacatgatagggtattaacggatcttgcactggcactgtccagcctaccaagaaatctatggaacctatgtacagtgatccacgtggtgacggtatcgaattttaaatcgatgaagctgatggatatgcgtttaagacaatgcacgtgcgtactcgtgctaagtaagatacgcttaatctataaaacgacattaactcgcacgaaataactgggaacgttctagcgcctagagactattatgaagcacagaaacaagaggattcagttattatcgctgcacgaaatg

SEQ ID NO: 1809 - DNA, 213 bp, Bacillus thuringiensis
caatccttgatctacattatgaagatgtgaatcgtttctatgaaggggatggtcaaaaggaatcagctgaacttcactgataataaacactgcgtaagcaatgtgaattagaggacacaaacgttgtaactgcatgtgcttctgaaccaattccattataatacgtagatccttaagctggtgtaacatggggcgacgagtttaggttcaata

SEQ ID NO: 1810 - DNA, 415 bp, Bacillus thuringiensis
catacggagcgccaggatcgggacttgaaagaggaactgcatagcacgagagcacaatcaaacgcttcgttggtgacaagcggggctacttcctacagggtacagtagacgacgccgccaacgatggtgctcccatcgccatcgagtacacacgtcggcgtaacttattctacgcaacaccaaccgaacacgtatccgatgagatgactgtaggctgcgaatgcccatgcgggccacaccgccctgccctccatgggtagtccaatgaacccgccgttgatgtcgcttacagatcagaggacggctacctagcgagtgacctcaccttatacattagcaatcgattggcgcttgctaactgaatccaaactggttctgggcaaattaactgacactctgaccgcggtcctgacca

SEQ ID NO: 1811 - DNA, 205 bp, Bacillus thuringiensis
ataaatgaagcggcattatatgtcaacctgccggctcttttaatcccgctagtatgtctgcattctgaagcgtttgcccagcagcgccttgcacgatattgcctattacagaaacgaccggcactatttacgttctttcatcttaagctatgccagtttcacagttctttgagcctctcacttattttggacttggaaattaccc

SEQ ID NO: 1812 - DNA, 435 bp, Bacillus thuringiensis
gcgacgcgattgaggatgttcccatggcctctgtaataattgggaagacgcgtggctatgctgccccagttgatcagaagacggcactatctgtagacccggtcgctaccccgtatattccttctatactgaaaccagccttatttttgtttaacggggcggaggagcttgcatctgcatgactatgaggcgctggctgacaatggcgacggcgagtcgcttatattccgtacgcatgagctagcattagatcacccacccctggagctaaccaaccagccgtgactccgagtggacttgctgctggcgccaaggaaccaggaaccttgagacaaccagcgccgaccatgttaccgacagcgaaagctgttagcacccataagctgaactaaatctgtcgcctagatgaccatctgctctgctagagccaccgac

SEQ ID NO: 1813 - DNA, 224 bp, Bacillus thuringiensis
agcgcatgcataagatttttttgtaacatttgctgaaacgtctgataacgggattattataaaagcatccctcggtggtggcggccgagggaagcgtcttgagcgcactatggcggaatcaggataagcataaactcgatccaaatcagaagcgaaagcagcttttggtactgtggcattatatcgcaagagaatacgctgaaaaacctattcatataaaagtc

SEQ ID NO: 1814 - DNA, 169 bp, Bacillus thuringiensis
ggccaggtgacctgtagattctatgatttaggatacttttttttttaagactcaaatcaaatggatcaacggggcgtatgctatatatcaagacttatgataaaccattccagctatacgaaacatacatttccggaatacgttagaaccgtgacagtcaaaatacata

SEQ ID NO: 1815 - DNA, 245 bp, Bacillus thuringiensis
gaataaatgcacatcatagtcatcatcattcataccctttctatgcacaccacgtcccccacggatctggggggtgtacgtaaaaactgggaacctgttaatatatctgtactgagttaacgtaatctctatgcctagttcaggaataaaatcttcattctctataaattccattccgccaatagaaatttctgtaccgttttttatcattgaaacactcttttaccttctgtgtatacttcacc

SEQ ID NO: 1816 - DNA, 384 bp, Bacillus thuringiensis
cggaattaccccccccccaacgaaagggaaggtaacaaaaatttttgcactaaatatgccagggacagagaggaagcaggccacttacagttcaagcaaccagtctccgagaacacccctctgggtgaaaagtaagacgaaggctaatccagcgataccaggagacacagcaaacagcacgccaaataagagagagtaatacccgatctcctttaggctcaaactttggaataaacacacgcggccgatcccccaaatatagcggtaagcggcacaccgattaacgcaacgagagacatcccactcattgctgaaaaagcttcttgaaatggaacagcggcacagcatacatccatcccacactaaaaggcttgcagaaccata

SEQ ID NO: 1817 - DNA, 377 bp, Bacillus thuringiensis
attccacggtaactacaagacattctggaaccgtgacgatatttataaatcatttggttttaataaattctttgatgcgtcatactccgatatcgaagaaaaagacgtgttaatcctcggatttctagattaaccgctctttaatgaatctattccgtcatcacaaccgtcgaatcaccccatctataccaagtctattacattatcctaccatatcccttatgcaatcaataagcgcatagcaacgattgaaccagccacatcaggtgattcatcagactatacgtccttactaacagctcgcttttcagacgaatctgacaaaggcttcatcgacttactttgaagcaattctggtgttatactgattaacttca

SEQ ID NO: 1818 - DNA, 458 bp, Bacillus thuringiensis
gattcttttatacgcaaacgtagtatactatcgctttttcagtgactttattacgttcccgacattaacacaaacgaataactttggagatttaggtggtagtattcttgcgttgctacatctttatgatccattatacttcttagacacgattatattaattgtgttagtcgcaacaaaatttgcaaatccaaaaccaattcgtgttgcgaagcataaattatctctagtatttgtagtaggtattttattattcagtgttaacttaggtcttgcagagtctgaccgtcctgaattattaacaagaacgtttgaccgtaattatattgggaaatatttaggtgcatacaactacacaatttatgatggaattcaaagtgcgaaagcattaacagaacgagcattagcggatggcgataatatgacagaagtacgaaattatttaacatcaacttatg

SEQ ID NO: 1819 - DNA, 227 bp, Bacillus thuringiensis
cgtttaggcatgggaagttttacacgttgaagaatgtataaacaagcctgtgaaatattgcacatgaaaatggtgtgaaagtatacgtagccatgaacgctatgttccacaacgataaagtagaagaattaacagattacgtttcatttttaaacgaagtaatgtgatgcaattgttttcgagatccagcggattaatggctgttcgggaagtagcaccaaatatgc

SEQ ID NO: 1820 - DNA, 262 bp, Bacillus thuringiensis
gactaacactggatcccttacaaggcgcatctgttgaacgcgcgccgccgaccgcggaatatgacgcgagtgatatggactagggaacataaccgcaattgatgcttacagagagagatgagcatccacttgcaatccctcacatcatacaaaccttcagcatgaaagtggcgaactggggtgcctaacgagacatcctcactgcgataatagatagcgagcgcactgacctcattgcatgtggaacgagtgatcaggcagg

SEQ ID NO: 1821 - DNA, 467 bp, Bacillus thuringiensis
cgagttccgtaaaacttatttgcgcaagtggagcatgtaacgttttgtccaagtgccactggaaacggttttgagccatcgcaagatcaatgattacgcggcctttgattttcttacgcctatacacagggttatcgattaggcgcaaattactctcaaattactgtctactgcccatgcgcaggtgtgcgttatttacatcgcgatggggcgccgcaagtaaagtaagaacccatctacatgaatctactgaccgactcgatgtgcatagaattcagttgacgaggcatcttaccgagattcaactatgaaaggcgtacgctctgtctctcgagataaaagggatgaaccaagtgagttcacactatcaggtgagcgttgccgagcattctcttgagaagagcttgatgactaaattgcagtcttatcaaatgagctaaaaaacgtgggtgaacgcacaaaattat

SEQ ID NO: 1822 - DNA, 203 bp, Bacillus thuringiensis
ttcggatgtagcgaaagtcttgactatatagcacacgctccgttgacccatttttctaagtcttccaatgaaaaatattctagggcacgaatacacagaccacccgggcgtaaggcatctcagcacgccgtatgacatgtgtaaagatactgttttccaggacctacctggaagtgtaagaactgaccactgtgtaagtcata

SEQ ID NO: 1823 - DNA, 420 bp, Bacillus thuringiensis
tatcccgcctctcattattaagcaattaccattttttgtttaatcaacatttttggatgcacaatacattgatactccccattagtagaaagctgttgtgtatttaatccaattaatactttgtttacaacaatagaactaccttcatggtcaacttgcacactgtcaggcttaattgcccacaaaaattgactctctacccctactgcacggaaaggaattaagcgtaattttgtcgcccaaccagaatcattttctggtatttgaggaatttctgttttggaataaatttgttctgttaaccaagatggtaagcaatgttctaatgatgaaacatgcataatcataacgggtgtttttgttaatgggtcataaagttggttcccactgtcaataagacctgccagttctagttctttt

SEQ ID NO: 1824 - DNA, 189 bp, Bacillus thuringiensis
ctgcctctaaacttttttgtagtggataatgtcgtggaaagaaaatgatactatccacagctacaagatgccctaatattattaatagaaaatgaggcggatgctttccctactggcacactttctgggtaaggtgcatatgcgatggatgatcaatcaatcccgaaaattttccaagcgacaggaaga

SEQ ID NO: 1825 - DNA, 160 bp, Bacillus thuringiensis
cgggggatagatatctttttgtaccatgtatgcggaactcctatacatgtgacacccatttctcggttggtcatgatgcgtgagagcttcgaattaaaattttacgagcgtacctcccgacagtccatatatatgaacgagattttcaaaatcgaccaca

SEQ ID NO: 1826 - DNA, 379 bp, Bacillus thuringiensis
gcatggactgacgactagtgtgtctattatacatttacgcgagcgccttttacattttttaactgcatggagcctttcagtgaacgcttacccaccaacactgatgaaagctcaacactctgataatcacctgggtgcacaagcgggttaactagaactgaatccttgcacgaagatgatcctggctatttcacggcccgaataacgtcatactttggtgagcccttttcatgtcctgatatgtggagcgaaattgtcgcgaattgacacgaggactcaacaactttgtggcctgatgcactctatcgagaaagacttgctagttttctaaccacgatcagagcaccatttgactgcaggcgcgacactcagaacttta

SEQ ID NO: 1827 - DNA, 206 bp, Bacillus thuringiensis
ccttcgtgatccgaactgcactaaatattacccctaactgaagctttttttttaaagcttgaccgtgaaagccggctattgtgactagaaaggacgggtttaaatctacaggagcaggcgctgcggctctggcatgcgtctcggtctcccattgcgtaaacacatcacccggcaagattactgcgccacctcatgtcgcatcaaga

SEQ ID NO: 1828 - DNA, 388 bp, Bacillus thuringiensis
gttgatacggttttacctattataaatgatcagatcgatgttttaatcgataactcaccgtattttgtccatgcgatcgcacaagcagcacactgattcggggaaagatatttactgcgaaggattgatgagaatgttaatggtgatgtggctagtatggtgaaagaatgcacagctgattttgcaaagtcattatcgtcagcagctgggaatgaccctggatttttgagtcctgaaccagaatgcttaaactcagtggctacggtgccattaagagtgcgatatctttcaaaagatggcgagcagatgccgtaccacttttttgagtgaatttcagaccaccgacatcctgccgctatgagaaattctgatgatatgcattatgcga

SEQ ID NO: 1829 - DNA, 461 bp, Bacillus thuringiensis
gcacttgggggatgaagtgatagtgaatcctgatactgtgtatgattattttgaagcacttatcaaccttagacatcaagctcagtacctagctgtgacacttatcacccatatgcacacctttaatcaactagccgaattatgactcatgcatacagaacctgatctcggacgaacatgattataatgcggatggagattctgacgcggagcagagttatatcgggatagatacactgactgatgcaagcagccaaaactttcgtacatatgactggcgcgcacctcttcagagtgtgtccttcgattattcagcacgaccggatgaatacagtgcacctggcggagtgatacacggtgatgtggagaaaaaattacaatccctcattgaaattggctagagtgaatctatgctcgatactgagccttacgattggtgatgaaatgttgcagcgagcgct

SEQ ID NO: 1830 - DNA, 427 bp, Bacillus thuringiensis
atcacgcttgccatccatccgtttcaatggaacattatcttgcgataaaggcagcacgctcttttcaccgattgtcagagtctctagccggttaaagtagcggtaaacagatcgtaactctagcctccagagaatcgccaacttctgtctactacatgagagcggcttttttccgacaatcaccacctcgccagatggcgtagactcgactgttgagagatcggataatattgtctattcctcgatccctaatggcaccataaaggaaaccagcaccactttatccccgggttacagtatatacagtcaagcagggtgatgctctttccgctcatatactttagcgacgatttggatctgttacactccctacatagggatcacctgtccacattggaaagttacagagttgtgatactgcttgcgt

SEQ ID NO: 1831 - DNA, 306 bp, Bacillus thuringiensis
atgtttactttagtagataatattatcgctttttgtacaagtttgggggatcaggaagagaatgatatgctggaccgtatgctaaatgtacacgataaggaaacatgggagaacattgataaatgaccacatgggcttgcaaattctaacttttttaatcggtgtgcaagagacaacaaggggattgaaatctttggcgatgtacttattattgaacaatgccggataaatggaagagagcctatgcagaactggaccgagttttgtcagagcctactgcaacataccagctagtaatgaaactga

SEQ ID NO: 1832 - DNA, 279 bp, Bacillus thuringiensis
ataacaagcaaccttatgctaagcgtttcagaatgcgttgattcttgtcttaaagttgcgacagcaacccacatcgtgttcccagtcaacaattcagcaccgccatatttggtatgtaccagagcattcccgggtaacatagaagcggataaatatagcgctggtgaatctgcaatgtgaaataagctaccttatgtataacttacggcagtaaaaaaaccgatatatataccagtaagtgcatcacagaatgaaaaattgcatggggtttggatttac

SEQ ID NO: 1833 - DNA, 327 bp, Bacillus thuringiensis
aatcgggattgccagatatatggtgataccatctgaatgcataataacgcggtcgttttcactaggcgcggcacgaccaattgattgaattaatgaacgatctgatcgcaaatgtccttactcatctgcatctaatagatcgacaagtgttacttgcggattgtactattgagctctcaataggactgtgcggacggagtacatgatagaaaccgaggcgaggatcgcggataatatgaatgcggcctaacgtcagaatctcagagtgaacagagtggacgaaaagtcctacatatgtaaagtccaacacaaaatcctctgacatat

SEQ ID NO: 1834 - DNA, 358 bp, Bacillus thuringiensis
gtagccccagcagcttcagtaccccctgtaggaccagtatgttcgagaagctacagtaccccgtgaggtgcagcggaaccggtaggtccatcaggttctgtcagctacagatacgccagtaactccagtgaaaccggtagtcccattgctgtacagtggaaccgttcgcctcagtagcccaagttgttccagtagtcctggtatatgccagatgatccattatataaatgtgcaatcgtaacaaccattgagcccagagaacccagtaggtccagccgcccggggaggccccgtatgctcttacaatcctgtagaatccgtaagtggagcatgctcagcgaatccaatacctaattta

SEQ ID NO: 1835 - DNA, 421 bp, Bacillus thuringiensis
atcactacggaggaacgcatatgctatatcttgcagcattattaaaagtggcatgaacggcgtatatactgtgaatccccgtgtattgacccacaagtgcaggctctcacagcagaaaccccggctatattcatcaaagctcaactaatccattagtgcacaggtactgatattggtgcggtgccacctgtagcgaaaaggccacggactactgcttatgctggacaacacattacagacaccttatatgcagccaccattaacagagggggctgacattgtactatattacgcaccgacatatttagggcgacataacgatgtactaatcctgctatgtcctgcaaaaggataggaactttgtgaggagatccctgattatgataaaccattatgtgcacaattaggcccatatgactca

SEQ ID NO: 1836 - DNA, 296 bp, Bacillus thuringiensis
atctaaaagaggtgtttcttgttgtttgagcatgcaatggagagtcggtgcatgcgcctatgagtttgacggactggaaattaaacggtatacagccacagcagcgaaaagcgttacacaccatatatggtccactggtattaatggcctgtgctggttgtggaaagacacgtgtgacatcacatcgaattgcgtatatactaggtgcagaaggcgttgcaccacggaatgtactagctcttaccttaccgaattaagcatctcgtgagatgcctgagcgtatcgatacacatgtg

SEQ ID NO: 1837 - DNA, 324 bp, Bacillus thuringiensis
  unsure (1)...(324): unsure at all n locations
ccccccccccccccggggggcggggggggnttttaaaaannnaantttantttcccatctatacaaaatgtgaatgtacaataatatttttttcttaaactaaacagcccccacacagggcaccattgcccaacaataaatgcggctaacaccactgcttgccctggctcacccgagaagataacaccacgcacgaccaacgctacaacggcattatattcacgcaacctgttaccttttaatccacctacgatagcaggcaccaacaaaatgccccccacacccaacaaacaaaacgacccatacgcggccatgccggaaccc

SEQ ID NO: 1838 - DNA, 400 bp, Bacillus thuringiensis
  unsure (1)...(400): unsure at all n locations
ccccaccaaccccaaaaaccccgnatantnttttcaaaaaataaataaatccataatacccataaacaacacccataacaccaaaaataactctcacctcatatcgatgagaaccccaaccaactatcaataccacggtaaacacgccgataaaaaccccagctactatacgggagttccaccctaccgcttaacataacacggacagacgatctccaatcaacccaattgccacatactcacaaaacactctaaagggccctcacaacaaaacatggcgcaccttaaacaccgaggaagaacatataacaacggcaataaactttccatacacacggcatcctaaacgctcttgatcaaaagcacgccaatgaacaattcgaaatacaaaaacccacgc

SEQ ID NO: 1839 - DNA, 522 bp, Bacillus thuringiensis
taagtaatgagtaagaaaaaagagattttcatagtataaaatatttattatagctacttttaacacctgctactaatagtgtgctataatatgaattagcaacaaaaaggaaaggaattagaacaatgaccttagaaaatactaaaaatttaaaaaaacaagttgctccttttgaaaaatcaatgattaaaaaaagtgtttggcaactgatcaacacaatcgtgccatttattattttatggtaccttgcttataaaagtttgtcagtttcttattggttaacattagttccagcactgttagccgctggatttatgacaaggattttcattatttttcatgattgtacccattattcattctttaaaagtcgacgtgcaaatagaatagttggaacgtgtatgggtgttttaacattattcccatttgatcagtgggggcatgagcattctattcaccacgctacgagtggtaatttggataagaggggtacaggggatatttggacgcttacagtagatg

SEQ ID NO: 1840 - DNA, 321 bp, Bacillus thuringiensis
ttaaaataagagggtgtgaacacgccacagcataccgtaaacaaaagattaaaagtgttgcgggttagcattatacttgtcgtgggattgataggaatcgcattgaaagaacggaacaggaaaacatggacagagcagcttgcaaaagacactgtcggtgtggtagaacgagtattccaaaagccagcagaaatacgtacgctggatactacgaaaatgtagaggatgtaacgcgcacgtgtgatgagaacagagaattaaaagcaaaattagattatcacgcatgtctactgagggaaagtaaaacaatcagaggatgag

SEQ ID NO: 1841 - DNA, 379 bp, Bacillus thuringiensis
  unsure (1)...(379): unsure at all n locations
aaancaaacccccccccctataaacggggaaancatttaaaacaccaatnnattattacttaaataacgttgatgcttactacaataaatcaaaattaccttctccctcaacaacataaaaaccgatcccatacgaaaaactaccccgctcaattcaaaatcaaattataattccagaaaatgccaaaaaacctttccatcaacagattctaattcccatttcttcttattcccatcaaggacaacgctttaattatcattcacatgaacctcttctcgaatcgattcaaaaaaaactatttgccgacttaaaagatatagtcaaaatcacaacgtcaacaaaaactcctcactaaaaccatcttaagaaaatcaatga

SEQ ID NO: 1842 - DNA, 489 bp, Bacillus thuringiensis
ctcttcagaatgagcaagttcactttctttcgcaggttctaatccgagtaattttgtgaaaaatatagctgtactattgagtagccaaatgaatgggtacataattttatcaaataaaataagcggtcttgcaaatttgagtgtgatcgcttctgctttttgaattgcgaaagactttggaactaattcacctaatacaacgtggaaaaatgtaataacactaaaagcaataacaaaagataaagtgttagccattgttccagtaatattaattttttcaaagagcggtcgtagtatatgttccacagtcggttcaccaagccaaccaagccctaaagaagtgattgtaattccgagctgacaagctgataaataaacatctaaattagataggacgcttcttgcagctaaagcttgtttattaccttcatttgcaagttggtcaattcgactttttcgtacttttacaacagcgaattctgatgcaac

SEQ ID NO: 1843 - DNA, 369 bp, Bacillus thuringiensis
ccgcgcaatattctgggcctaaattactttgatcggctccagcgaatactgtatctgttttaccagtacgcatgttaagggaagacgacttaaaagatcttttgtctactcataaggggtacactctgaatcttgaacatgcggtagaaggtgctgagaacttttacctgatgtactcataacgtggcacacgttatccaaaaggggttgagatcacttctaactgccttgatagctttacatattgggctgttgacgatttcgactagaaggcgggcctgtattcatcaatcaggcgccattctgattcgagtgatctgtaatggctgtttacccatcattagtcacacgcggttcactttgggcaat

SEQ ID NO: 1844 - DNA, 446 bp, Bacillus thuringiensis
  unsure (1)...(446): unsure at all n locations
gtatcgatccgaattcggatttgaaacccacttggactgccttcttctggcacactaactcatggtattattacacctactgaacgtattgtccccgttgatgtagatcaggatggaccttatgattggcatgtaacagtgttacaaccagacgcagctatatatcctagaaatagtggcgagtgcgcttgaagtgcagcaggacaaataagcgcgtttaatccatggcaaattagctgcagcagatgtagaaggcttcggccttgctattcctgtcactagagccgttgcgattatcaatgacctcgctgaagaccgaatgtgttaccttccgtatctcgcgattgaaccgatggcactagcttgattaatgaactatctactgctaacacacagtactatccactctacacctgtcatcatngtgtactcactcgctgcacatg

SEQ ID NO: 1845 - DNA, 395 bp, Bacillus thuringiensis
caggccatattagaagattgacagatggctgaaacgaacggcattactatgaactactaaggagcggccgtaaaactaggaccagacatgcatacatggggcgaagcgacgctattaccaagccagcattctagagctaaagagactattgataataacgcggtgcatgtccatggtcatgcagttggagaagcgaagttatatggacccggagctgtgaaggactgactggtgcagcagtagaagtgatacaatataaactgctaatagatatcactgaggcatgcactaataaaagtgcgttaggaggaccatgatttacatacacacgatgagctgcagaagaaataacgagcgaatcggtactcactaaatctgctgatgagcgtgcgatg

SEQ ID NO: 1846 - DNA, 256 bp, Bacillus thuringiensis
caactggcgtcactaatttaagttgctacaaagcactcgtacctgctaatattacgcgagagaactctgcagcaggtgaccgctacgtactgacagaactgtaccgcggccgtaacagactaagaggacaacaatcagcccatatcatctaactggactacattacaactggtgatggaatgaaaagaagcacggcaactagcgccacattagtgaaccaggcggaaaaagtcccttactctgaacatagcagggg

SEQ ID NO: 1847 - DNA, 374 bp, Bacillus thuringiensis
ctgtacgcagcaaggcacaagtccatcttttacttcagcatcttcaccaatgataccgcgcccgtcaaggttaccaagtgctgctcctacaacgttcgcaccgtcacgtgtaattttatctggtccaagcatcgcctcacgagctcctgactgatcttctccactatgcaggtgaagtgtacacatcatctgtcacaacgtgctcactcatgatgagcgcatcctcgaagttgtcaccagcccacgtcatgaaaccaacctgcacgtcgcgtcgcaatgctagttcacctaatttcatacaaggcccatcctcaaggatttcacctgtcacaactgcatttacagcactcacgagtggacgttggttgtaacaa

SEQ ID NO: 1848 - DNA, 445 bp, Bacillus thuringiensis
ttaaatcgtggtgttgatgtaaaaattctcgtgccatttaaaagtgatgccatattgttaaaacaagctgcctatccatatttgaaagatatgttacatgctggagcggagatttatcactatcgacatggattttttcatgggaaagtaacaattattgatggagaaattgttgatattgggacagcgaattttgataatagacgtttgtatttaaattgtgagtctaactggatcatatatgataaaaccggtgttgatgaaatatggagacgatatcaggtagaccctgattagttcaaatgactctatgaagatgatctggtgaaaaaaacgcgaagggacatggtttgcatctgatatctcggacgttgcatcattttgtctataccacgtagcatgttgaaaaggttggctctctataggacgcttgggaaagggctat

SEQ ID NO: 1849 - DNA, 362 bp, Bacillus thuringiensis
ttgttgttacaggtttttgagacgacatgaatcaaatcattgctgaatcactatcagatgtgggggactgattacatcgatacgtgcattactgaagttggcgctgatttagtttgaatggcaatcgcaccgctattagctggtaccacgcgcttccctgtgactccttttataatcgttcttggaatgtccagtggacctcatacaccgccaatacgtgctatagacctcaaatatattgaacgtgcacgtgactttcccttgcttggacgaattggcgttgtatgccttatgttctatctaggataagagtcttgattgactaatctatttaaatctgtacgctctattgcgattggcgg

SEQ ID NO: 1850 - DNA, 139 bp, Bacillus thuringiensis
tattaggaatactggatcctacactgatcccgtttgcattatatcacattccgtatctatcgtactggtagcaatattagcactttgctaatgcagatcgctaactgatccatggggaccaaaaacacctgatggcaca

SEQ ID NO: 1851 - DNA, 386 bp, Bacillus thuringiensis
tataactgtatggcttacttttggacggcggctattgatatgactgatggatggtcccatgtagaatgatctaggtaacgagggtacggctaaacaatgcgctgactctacatcatgctggaagggagcgcattcacactgagactgagacgcagtgataacttgtacaggaggtatctaccgggattattacacaatgtaatatatgatgacggagcaacgacgcttgattgatacaaggatggggtgacaaaaacttagtggaacggggaaaatatgtgctagatgaatattacgggacattgacggatcgtaaccattaagccacggataactacttgccaacaaccgcatccatacgattgtggcaagcattaaacaggaat

SEQ ID NO: 1852 - DNA, 220 bp, Bacillus thuringiensis
aatgccgagcattcgctggctgctggagggattacttttttttattgttcacgaaatagagggtcgatcgtggctagtgcgctatccgtacctctgacgactgttcctagagctgctgaggtttctttcatggtggggattaccactacacattcgtcctgtgcagatgctccagcgttatatatctggtcggcttatggaaggcctacttctatcagat

SEQ ID NO: 1853 - DNA, 328 bp, Bacillus thuringiensis
taagtcagagacctgtttttgcacgggattgaccaaggtgagattagcgtcttaacacatgattgacatgtcacgtggaatgttgcggttggtacacacacaactactattggggtcaatgagcacggcttgggcactatgttgattcaactcgtcacgcagcagggggacgagctgcacaatgcaatggctgaaatggggtttgttatggcgggagcttacttttgtgaagaatagctggagcgagggataagtttactgttaggatcgcacgagacattcgcggcgagtgattggctgccgcagaccgaggagcctctctagtgag

SEQ ID NO: 1854 - DNA, 450 bp, Bacillus thuringiensis
aatataaataagattagagcaaatagagtaataactatcaaaatacttttttgagcgcctattttatctgataatacaccgccaaacgcaccgccacttactgcagctataccaaacactaaataaaatatgctaatccaataagggcttaggtgaaacttattttctaaaaaaggagtaaaataagcatatagagtatagtgtcctgctaacataaacatggtagctagatgggcagatcctagtttaagactacaaacggcctttaattggatagataaaggagttcggtttttctctccaggtattttatctaaaaatactgaaattaagataatagaccccaatgataaaatagctatacataaaaaaataattcttcagccaaatgtgtttgaaattaatatgcctagtggtactcctagtacaagggaagagctaatacccata

SEQ ID NO: 1855 - DNA, 297 bp, Bacillus thuringiensis
cgattacatgtgttctttcatcagaggtctctgtatcacagctatcattacttgcaacaatgactgtctgtaaagttatatggaaagctatttccaatcctgttccagggatatcagagggtcaagtacctgggacaccaacgcgtgggtactcttgttccgttaatatgtactcgcctaggtccgaaccattttcaccagtatcatcaagtactaggataccatcaaactttaattgcacgatgcctgatactcgtacttctgggtctttatactcaagacatgatgctgaatata

SEQ ID NO: 1856 - DNA, 403 bp, Bacillus thuringiensis
tcttggattgatacttacttagacgtgtgcattacttttgtaccatctgctttatcagatgctgtcgatttaatacaatgaatcttttcctccttgacactgtgcctaacgatttgatcattctgtttaatcccaaaagagaacgtatcttcatctactacataaccgaccggtgcaacagttaccttatatgtgtattctccaaatgggaacttttcaaaattagcgattcctgtatcgaccgcttttgcttttactacttctttacctgcttcgttataaatccgaaatgctgcatttgaacgcttgttgtctccatcagctacatctacctttgcaatggctagatcacctttgataagatgaataactgcctataactcaataacctgtccatggccct

SEQ ID NO: 1857 - DNA, 544 bp, Bacillus thuringiensis
gtatctacagatccaataacttttctagcttcatttcctcttgctagaagaacgggtgtcgtaatcggcccccaaccaccgccaccagttgaatcaacgaatccagcgaataaaccaagcggcacaagttgtttggcagacatacgcttatttgaagtgacaatttgtttttgaatgatgaatcgtaataaaatataaacccctaaagtaaataaaaatacggaaatgtacggtttgattatatctccaggcaaattacttaaaaaacatgccccaacaaatgcgccgattgccccaggtaatgtaagcctggaaactgtatatttatcaacgtttccaaatttgatatgagatgcgccagaagctgcagttgtaacgacttcagctaaatgaaccgatgctgaagctacagccggtgcaataccaaacattaataatagtgaagtagacgttaccccatacgccattccgagtgctccattcgatcaatgggcgaaaaatccaataatagcaaagacaattaatttctgcataaataatcccc

SEQ ID NO: 1858 - DNA, 226 bp, Bacillus thuringiensis
gcgaaacgacagttatcggtttagatgtttgggtgcattctgactacttaaactaccaaaaccgtcgtgcagactacttctgcgcatcctggaacgttgtagattggagcgctgttgaaaaacgttaccaagaggcaaaatacttgtagcatatatagaaaaagcttggggagagcccctagctttcctctatgctctgcttaaacataattgggctcgtccttgg

SEQ ID NO: 1859 - DNA, 376 bp, Bacillus thuringiensis
aaattttttaacaacattggtcagacgtcattcgttatacgttatacgaccaataactcgtgggagaagtggaggattcacatatgaagatcgcaatgattctagacggtttacttggaagtgccgtactaggtgttcttatcagttcagatcgtaagaaaattaaatataaaccaattgcacttatgcttgtgattcaattggtacttgcgtatttcttactaaatacaaaggtcggattcgtattacctaaaagggatcgcctatggatttggcgctattgtaaaatttgtggaagctggggtatattacgtattaggtggtttagcaaacgatggacaagcaccgtacgagttaacagtatgactaccgatta

SEQ ID NO: 1860 - DNA, 624 bp, Bacillus thuringiensis
cccacacctatggccaagagctagcacgcggtcgacaagctgacaactgaacgaaaaccggttttggacgtttctaaaaatgaagtggcaccaacagccagccgaacgcgcagacaacaagcgatttgagcgagagttattcgatcaaatggctggccatggtttaactggtatatccatgcctgctaaagcaactcgaattggaggccaatatatactaaaatatatttttattgaagccatagcatccattgagcgttcagcacagtgtacactaggctgagcaaccttcagtcatgggaaggaccataactaaaattatgaccgcagacagacaccgaatgtgtcggcgctgctaagcttgaaggaacaaaatggtgtgaaaaccgcttagagccacttgctactagcactaggcctgctagatgaagaacgggccctgctttcaaaagctattttttgggaggactatgtaccacaaagtatccgtacgtaaggacgcactggccgccgttcatccacacaatagacagagaggatcactgtttgagctactgggcttatccccataggccgagcgtaaacaccgacgccagccgatacattggcaaaaacagcgttctt

SEQ ID NO: 1861 - DNA, 379 bp, Bacillus thuringiensis
ctacatgtatatggactctgtggtgcagccatcgtagataacatgcccctttcgatctgggcacgcttcacctatttccaacgttgttaaatggagttgttctcatcggctgttgttccgaagctaaataaccgtcttgtgacagccgcacgcattcggctccttgacaccgttaccataatagcctggtgaactactacaattggaataaacatgtctgagaatgatggagtaccgcgctgcaccgtgtcaagtcatcctaaatgggtgctagccaccgcagtttggggagttaaacgacttgccggtggcccaagcgcactatgaagccacgggtgtgctgacctagattggcccctacctctgaagaggctcgttg

SEQ ID NO: 1862 - DNA, 274 bp, Bacillus thuringiensis
ggaaaccagcgacatagaagaaaactacaagtcgaaacgataaaagaggcgagcgctcagaaggctctaatacaaaagaagcaccgcaagcaattgcaagcggaaacaaacataacggaaaaaacatggggagagaaaaaggcgtaagaccagcaacaacaacgaaagggcagcgccaaatcgagacatcaataccgctagcgaaaaacggaagtgctggacccagaactaaagcaggcgaagaaggtgcaagaacaaaccgctagaaaaccac

SEQ ID NO: 1863 - DNA, 450 bp, Bacillus thuringiensis
catgcacgccatagtttttttctgcacacaccatcactccagagcacttaaacgaaagaaccatgcactgccgcaccagcagactccagggcacaggataggaaaccataacgcccatatagagtgtcagcagagaacacaacttgcagtactgctaaccaagtttcgtaacacgaccaaaaagtattcattatgatgtgaataccaaacagcaccgcagccatcccataacccgtaccgtgcagcgaaagaacagtggaagaggcgcacagccagtacagatctgacgccgctcttgcaacgagcggcaaagccaaaccaaccaaacggtgaccaaagcgcatagggagtggtaggaacgacacatagaacgcatgaggcgatatatggacttaacccagcgaagctgcgacggagggcacaaggaacaacagaagtacgtccacttgt

SEQ ID NO: 1864 - DNA, 511 bp, Bacillus thuringiensis
ccggccaacgaagacaaaaccctacaacacgcgaatagttatgcatgaccgacaccagcaccaacctcggcggcgaagaccacagctaccgggggccgaaagcacagaaaatcagccgacacatcgacaccatcaggacaggaagcacctaacaataattcagcgaccgcaacgcagacgagaacaccgaccaccgcacccacaaatggggagaagataaaggtcggaccggcgaacactacatgacgacaacggaagagccacgctaaggcgaccgtcattccaccgcccaatctccctagagtgaagcgttcacacacacccaggaaaaggcctggcacggccaggcggaaacgaaaaaccgactgcaatacgacaccaaccaagaacaaagtgcccacactcccaaaaactagcgagacgaaaccaaaaaaagacccccgcacaaagggcgcaacttgatatgcaccgactaaaacgaaagcaaacctaatacgatatgggagcgcca

SEQ ID NO: 1865 - DNA, 293 bp, Bacillus thuringiensis
  unsure (1)...(293): unsure at all n locations
cacaaaacgctattcctcanactaagctagctagaaaggatgacattggttatgtatctgtgaatcctagacgtattacaactcatttgccgaagagctagcatcgtcatctaaccccacctctcttgctaaaaactcgaccaaaaagtatggtttgtaaaatgccacggaagtttcggggaatgatttacttcccgctggtctctgggtcagtcaacggcccgcgagtgatccctttgttcgactatgcagtctatttcacaccgccacaggctctcttatgagtccataag

SEQ ID NO: 1866 - DNA, 248 bp, Bacillus thuringiensis
gctcaagatgctcgacgactacttcagatcaacaggccggcattttgtcttgtaccatcgcttggccaccttgctggcatcattccatactctccaccgcctgataccttacaagatccgctctcaattcagggggaggaacacctgccccgactataccgagacctggctgtaccccctgcaagctccctggatcgctctactgttcctaccctgccaccatcccgatacctgaccctgtacctccc

SEQ ID NO: 1867 - DNA, 527 bp, Bacillus thuringiensis
tgtctgtcgttctaggataccaccggttgcagggcaccaaactggacatacactatcgccgagagctctgctcctataagcgtggatgttgccgggaccagtatccagatgctcacctagcctatagctgaacccacctcttccggtcgtacgcccattaccgcttacacgttcattcgggagaccagattcttggcgagctgcatgatggaaatagtctgcagaggatgctgctatttaggcgacgccatctgatccggtatccataatactgcgaacgaggcgcatgaagattgtggcgtttgactcaacgaaatcaaatcatggatggcctggctcaaggggtaatccatcggctatatctactatgacagcatcttgacaagcgacgtagctgcctttacgtgctcccgttggagctggggcgaaaggaacaacatgactttacaccattgcttccccattatgctacgcttcatttacatggactgaggcaaatcctgcagcttcagctagggtcatcatgc

SEQ ID NO: 1868 - DNA, 229 bp, Bacillus thuringiensis
gaaacatgtttgtcggctgttttccgtatttaggcgagcatttatttgaattgcgtggtgtagggcttatgatcgttatgacgttgttcggtgccggggctgttcaaatttttaagcgttttacactcgatattaatcttgaaattatgggatcaagataaaaagctcgaccgcttaagtgttgatgaagagacgatgaaaattatgtgatacacaacttacgatatat

SEQ ID NO: 1869 - DNA, 383 bp, Bacillus thuringiensis
  unsure (1)...(383): unsure at all n locations
ttaaggaagtgtcaggggnattatatctgtttatgctccacatacaaacatcaaaagaccttgtgtgcaatggatggctataactagactacaatctaccgggccattctgggaccacaagggaatgaagaatagaacattgtggaagaacggagcaaaagagggaactactgaacatacacatgacacgctagacacggaagcttaataagaggactatggctgaaacccaaaagagattatcacgtgtgaaagacgagatgtaattgccaacgcattgaatcaatggcatgaacgtgctccaacagaacaaatcgccacgggagatgtagtggcaatataaacgatcattgagtccaagacgactctacagtgacactgta

SEQ ID NO: 1870 - DNA, 322 bp, Bacillus thuringiensis
  unsure (1)...(322): unsure at all n locations
ccaacatgccggaaacgaaaaacgaaaaagacgcgncgaacaacggnacaacgaaaggggacaagaagaccgcccacgagaaacaaggncagcgaaaggaaaaacaagctacgaaacanaggagaagagtcacggaaaagaagcaagaaagaaacgtacaaccgagaaacggaacggaaaccacaaaggactaacaagacggaccgaaaacgggacacagagaaaagcaaaacaaaaaacgaccacaacgcgcagaaacaggcaagtaggacaagcaaaaaggaagcagtgatagagacaaaagacaaacagcgcagaaaca

SEQ ID NO: 1871 - DNA, 443 bp, Bacillus thuringiensis
cggcggcattttacaagttcttgaagagaaaactgaaattgatgcggaactaacgagcgctggagcacaaacaaaaaaagtcagcaaagtgggtcgtgaaaacactggcctaggctgaaaagaagctaaacaatgacgtgacaacactccaaaaggaatcaaggaagcagctgctaaacaagaacctgaacaaaccaaagccaaacctgaagacagaagagcgctgcatgccagaagtgaactaatgaacgagcgaagctacaaaaaaagctcgctcccaagcgagcgctttccagaacggaaaccaaaagaggcggccatatggcagaccatgatcaacgctaacgaccgaggctagtaaaagtgagcgcaagcgatgggagttcgccctactggatctcgacgcacgttcttacctgaccagggagcgttctcgaaaaacg

SEQ ID NO: 1872 - DNA, 214 bp, Bacillus thuringiensis
  unsure (1)...(214): unsure at all n locations
gctggagcccaaacaaaccgcgccagcaaagtgcgncgtgccaacactggcctaggctgagacgaagcaaaagcaagagtagacaacgctccaaacggaatccaggaagcagctgctaaagaagaaccagaccacaccacagccaaacccgaagacagaggcgctgcagccgaggtcgcctaaagaacgagccgacgccacaaaaaaaagcgcg

SEQ ID NO: 1873 - DNA, 457 bp, Bacillus thuringiensis
aatatcccaataaatgacctcgcacaacggcggggaacggtcactgatagtagacattaggagccacaaagcgggtggcttccgtggagggatacataacggccatgcgtcgcacctcatattgcttagatggtgatgacaaatcaactgccccacataaaatgaacccaaactcacgggggcactgagaaagaggctttaccatggctaaccaaccaaaaaatgccctctctaccgacagtgttacacacgatccatccttcacacataccgtcctacataccgtctttaaggaagacagctaacgctctaggaactctaccaaccatgaatctatcatctacgggaatagccataccgatcacatcgatacagaccggcaagacagctcacaaaatgaacgagaagcctgtcaatatccaacagttaccgaccatgtgatcccagtcactgcatc

SEQ ID NO: 1874 - DNA, 184 bp, Bacillus thuringiensis
cttattatgagctgaacatctactacaaccattacgaacgtaaaattccacaagaggtaactgaaaataaaatttcaccgcttactgacgtggcgtatgacaaaccgacgacacgctacaaatgcgaaccttcttaataaaaaattttaaaagaactattgccacactacgcacatagcttaat

SEQ ID NO: 1875 - DNA, 205 bp, Bacillus thuringiensis
atcctccccacctgccttgaacctgcacacattgtatgaacgcattcgcaggtggctacttgtttattgccacttatgccggtgacgcataaggcggtttcattgcacctttatcgcctcaagtgttctttacactgcgttataaatgtggtttgtccaacctcatcaacgtatcttatcatgtatggaacccgaggtaccacag

SEQ ID NO: 1876 - DNA, 469 bp, Bacillus thuringiensis
gctgttttgcgcacggtatacatcaatctgtgtacgctttccgtatccatcatccggtacaattagaacttcttccgcttcttcgacagtattcatacctgcctgtcgatcttcattgaccagcgttatatctgctgcacctgcattattgcttcccatagaacgaacgtgccgttcagcgagacgaagtagaataccgacacttggtccgacacttatatcctgatcacctgatgttaaacgaacagatattacctcaccctctttactaggagaaagcgcaactacaccatagcggcgtatgttagcacatgatgaaagaggcattctcttagaaaccccctgctttgtcgcatagaatcggaactgagcggggccgcatgctcgaatcgtaataatagcggtgatccactcacccttatctaccactaatagggtaaagatgggaagtccttctgcagaacgacta

SEQ ID NO: 1877 - DNA, 490 bp, Bacillus thuringiensis
actatatcaattgcaattacataatttctttattttgtactacaatacatttactactatttattaattttccctcctatttatttaatttatatttaattaggatattactaaacagaaataacatctaaaaacttacactttctgtgcgtaatatcctaactttttcaactgtttacttatcattttttctcaatatagtccaaactaccaaatatttgccgaatcccctctttatgctgaggaaaaattagtgtcaccaattcaatactttctgaaataattgatgcatacgtgacacggcggtctttaggacatggtttcacctcttcttttccaacctatccactacatacgtgatacaaaaacttgcaagtaatattttgtccccaatttttttataggctgatcagctttactgtatagtagctcaagcactgcaaattcaagtgcattaagtccataaatttttagatccctttcaatacgt

SEQ ID NO: 1878 - DNA, 382 bp, Bacillus thuringiensis
ggagcacaggagaagactgcggcagctgatgggacacctttgttagaatcaaataagcaaggtaaccgtgcgcaccgtacgttcgagtagcaacaagtccagcttgtttagaacacacagaagggggcagaaaagctaatacagcttaccttaacgggtgaccggtcatctcaataggcatccagattggtacatcaaatggaacggctgggggagctaactcgtcagctactagaacgggaatggttccggcctgcgcaagatgaaagggaggttgggcaccattatcatggttaagggttgtcctgttatgcaagccttcagatgacctgacatcccgtacgcctaagtctgaatgggaaaaacgaccttcaggacacac

SEQ ID NO: 1879 - DNA, 419 bp, Bacillus thuringiensis
ctgattgtaaatggccccttcataacaagggggaataggggatatctataagggattcataccatcactgacactagggtcgccatcatacggagcgaatccagactaccaatatgaatcagcgacatcattgactaaatatactaaggctggcttactagacaaaagaatatgcagtggctcaaactgccaccacatatttatcaagaagaacctgctacagctcatttagcacatatgccatacctaccacgtgcattaactgtaccggacttcgggatggttgaacaaggctctgtggagacagtagcgcactattactacagcaatgcctatgatgcgaatgtggcagctccatgtgaggcacaaccagatccatcatatgaaactgtcctcaaaggtgcagcaatgattgaatg

SEQ ID NO: 1880 - DNA, 388 bp, Bacillus thuringiensis
ggcggcactaccgttaacaatggttgctgaaattggatgtggttttctctctttcaaaaccgtagagaatcccttcttctcaccaactccatgctctacttgcagcatcggctctttatgcgtctttatttccgctagggtctctcttaccctatgtaaatatccaccatgagcaccacgtccgtccataactgaggcatttatatgagtaatctctaactgtttcagctgatccttatattctttcgctgccttttcagctaaagaagcgattcgcctataaccgatatcttttgcactctcttgctggacaaagctatatgctgaaaaaactggaatctcttcccgctcatttttagttgcgatcggatcagttgctaccgcacgc

SEQ ID NO: 1881 - DNA, 366 bp, Bacillus thuringiensis
agcagtttgagtgtaaatattgataacagcccctcgctctggactgaaatcggcaggctattctggaagagtgccagttggcatatgtactagcgaatatacatagagactctcttcattatatgttacaatacctaatatacttggcagttcatatggaatttcaccggtaacgaaaacatttttatgcagcgcacgggctctagaggttgttacaaatgtactaatatatgtgtgaactggaggggacatttgtaagcgctctgattttgcaggtgcttcataatcttaggcaatatgagcggcttctgcatgatcatatacgcgattgataacacgataaagtctttgcatgcctggagtggg

SEQ ID NO: 1882 - DNA, 596 bp, Bacillus thuringiensis
attcggatctgttacaacaccaagcttcttcgtatctatcaacttctctttagcgtgcggtaagaaatcttttaaatctccaccaataacagaacctactggtgtaattcctaatgcaagtaaatcattcgttaaatgaatagacatagaggcgatttttgggtcattactttttttcgtttttttcgttgcctcttcattagatttcgtttgaccacatgctgctagtactaaaatacacatgatgctaaataaaatagtaagtttctttttcatatgttctcctctttgaagtatttattttgtttttgtaagtaaataaagaaaatacggcgctcctaaagctgccactactacaccagctggaatagagtttggctcaaatatagaacgacctatcgtatctgctagcactaaaataatcattccgataatgccagctagtggaaggaaatgttgatacgtagtacctactaacttttttgcaatatgcggagcaacttaaccaataaaaccaatccctcctgccattgatacactcgcgcaggataatccaaccgctgtagctaaaaggggaacccgtctttttgaacaga

SEQ ID NO: 1883 - DNA, 159 bp, Bacillus thuringiensis
ttctccaaggagcatcgagaggccgccgtcaccggacaccgaaataacctgacgcccggggtgggaagcctgggcgccaatggcgtgcggcagggcattggccatcgatccatgcaggaaggatccgataagacggcgggtgccaaggggatcgatata

SEQ ID NO: 1884 - DNA, 144 bp, Bacillus thuringiensis
aagcaagtggtgcgagaagctgctgttgaaaagcgtatcgagcaacttgaagagattgagggtcttaacttaccaggcggcgaaagtacaacaatgcgccgccttatggatcaagttgctatcatggaaccactttcctacatt

SEQ ID NO: 1885 - DNA, 388 bp, Bacillus thuringiensis
actccaacatatgtgtcttttacacatgtgtagtacacttatccgaggcatatgaagcactgtgacctttcaaattgttgcatgctgtcagacatactcccggtgaaccatctccccctgatacagatcaacctgctggagatgtatccactattgactcgatcgaaagatactatactcatgaatctgatattatgctacctgctattgggaatccatcctttacaaaagaagccccgagctctaccacattcagagatgatcctccaactagttctgcaaagggcgccatcgtgaaaaacacaatgacagtacacggtcatactggtgcagagtgaccacaactcacacaagatgagtgatcaatacttacgccattgggccatat

SEQ ID NO: 1886 - DNA, 278 bp, Bacillus thuringiensis
cgtcttctttcgcttccacttcaattttaaattgtgcttgtggcaatttatatgggtcatcaacaacagatgcgtcgccgccttgcgctgataagaacgttcataaatgattctagcgcttttccgttgttcattacttcaattagcttttcacgtgcatcttctaaagatgaagcttggccagcacggtacaccatttgactttcaagtgttaaacatagcttttctaaatctttcgggcctttaccttgtaaatgtatcaattgctttcttgaact

SEQ ID NO: 1887 - DNA, 269 bp, Bacillus thuringiensis
cacaaggccaataacctttttcaggggaccctgaactcgcgggtccataggcagcgcccgcccgactagagtttctaggagtgacgcccttcgctggagatgatttcgcattgctgactcggtatataacaatcatttctctaagtgatctagtttcggtgcccgcttggtgcttattatgccttgcgcggatgccagcttatcatacaactcctggaattttttatcatgctgcaactgaacatctgtcagtacattgagtcgtcgtt

SEQ ID NO: 1888 - DNA, 255 bp, Bacillus thuringiensis
acatggcggtcaacataggtttagtttttctacgctaagccactgagcgaaagaagcgacgaaacagcagggaatccaacgcaaaatgaaccacccaaacaaaacacaaagggcggcatcggaaacgcgtgcgacttacaccgggtgaacggaggggtcacactcatacacaacaacgctgagatcaaagggggtaagcggcatacaaggacgggaagtgccgccaatcaaaacttaaacggtaaaaaggcggat

SEQ ID NO: 1889 - DNA, 152 bp, Bacillus thuringiensis
ctggtctactaaaacgttaactcgaaatggaactccctgatattttttatggaactgcaaaaattccatctggggcacgtgaagctggcgaccgctctgagatctctgtatatgcacagaacactgatggggatccaccttgttattgagta

SEQ ID NO: 1890 - DNA, 465 bp, Bacillus thuringiensis
aaggcgtattcgtaacatatatgaggatacccgttaatcgtttactcttgtctgaaaatgtaatcccctctttactttcgggatggctttggtgtgttctacgtcccagcatttgctcctctgctaatcggaagataatgactcttgatcataatgtctgaatcttgccaatatacgactctgttatttcatacgcaagtcctggttataacgggtgcataatgttctgtaaatcaacatggatctactgtgactgctataagagtggtccacttcggaagaacattggcaacggatatgtcgaatagaccgcctggtttaacctaagccttggaatcttgcacacgccacgttgatgcatgtgatctacgtgttccacagaaaaagatccctaatgacgaattcgctgatcaccccgtcgtaaggtatttcaccaagcagttccaaaagtattatccttatttt

SEQ ID NO: 1891 - DNA, 447 bp, Bacillus thuringiensis
tggaggtagatgtgctacaacattacactcatgaactgtggtttagctagcagcagagactgcatgaatggatcccagcatggtccatagctctggcccgttatgaggagccgctgcagcaatgattaacaggacacccgctacatattctctcggaagtggtacagcactggatgcagcattgatgaatacgagcatatgaaacatcactgtgatgatactaatctctgcataccatgctgtcacttccgatactgtgtgatggctagctgatcccagctccatgagtgacgcgttagccaaaacttcacttaacaaatcggaacaatgagcgattagactcccatcgcagattaggacactacaagctccgctcaaacgcgtggtgagaccaaccgcaagaagaaccgcttggtcccatgaacgttacgtaccgacgaaatgtgt

SEQ ID NO: 1892 - DNA, 600 bp, Bacillus thuringiensis
atcccatctacatttacgagtgccataccaccgacggacaatccacactatacaagacactgaacatgcacgaataaaaacacactcacggattgagggaataacacccacgcactgcgggaccaacatcacttgagcaaatggacacacactgactgcttggactccaacacaccagggagtggccagttctacacaaccatacgccgtacaaataaagcgatctagaccagactattcaaatccgaaatccataacgaatactacaggcggtaatggatctaatacccgcgactagctggttcgtattatagcacatgcaactgataacatagagaagcatcatactgctgcaaatcttatataccattggtacaatatgttatcattccgtaatgaactatgaacataaaagttcacttacattcagctgcagataccatgtctgttgtagtaactagatgaatgcccaataacaatcttcatctgatctactgtaaatacaacaagtctagctggctttccctggatatcagcctctttgaacgaactaatatacgtgctcatataccgggaattcaactatatggctcgcgaaaa

SEQ ID NO: 1893 - DNA, 420 bp, Bacillus thuringiensis
gcatctgatactaattgtaaaataggagaaccatctttttttttgaatataaaggtccactagtcttatgtatgaacaattttaaaataccctggcaaatcaagagaacctggaggtagcgtcccttcaacatacgcaattaccatggtaacatgtacggcagacccagatgatgaaatcatatatgcagatacagaggcaaatgttgcttgattcccactaaatcgtataggcataaacctggatacaaaggcacgtattgatacaccagtatgcttatctgtattgattggcgtaactataggaactggttcaatagcttttacttgaacaccttccggagcctattgtatcggtaccctaaatgttaggaatttatcgtccgcttgactagttgcatatttcacatgaggagggaca

SEQ ID NO: 1894 - DNA, 306 bp, Bacillus thuringiensis
tgactaccttaatactgacctactacaccattcattagaattttttcactaatgcgagcagcttgcgaataacctactataaacctacgtggtaacatacaaacagatgctgatggcatatacactacatgtggaaccgatggataatataatatatctcttactttcagctctgcatcaggaacatctagcagaatcatatatactcgatattgagctgtcagctgaacaatatcatatgctacatctttactaacttcatcatctgatatatacgcaccttgaacacgtacaggtttggatgct

SEQ ID NO: 1895 - DNA, 460 bp, Bacillus thuringiensis
cagcgcgacgcgtcggatcccgcagaacgcgagataattttagggttaaacaccgaaccaatgtgatagcttttgtcaacacgtgatatatgagctacaatatgaccggatcaaaaagtgtatataactaaaactacaggaaagcacttagcgtgtgcaccatatatgaatcatttacatagttagatgtatttgacttccccaaaaaaaccttcaggtatgcacattataacatagagatatgttgtatactcatgaacagcttgcccatcttctaacatacaattttctcaactaactactttttaactggtgtatataaacattaacttatcccactcaaactattgcagcgatattaaaaattctaatttaatacctaagctcaaaagaacttgtatgaatactttcaagctcgaggtagtttaaggtgacgatacgggccatacagactaattta

SEQ ID NO: 1896 - DNA, 449 bp, Bacillus thuringiensis
gtgtaatgaatgattgagttagggtgggatgatatgttttgttatcaatgggaacaaacgccagcaggcggatgtaaagtaatgcggtgtgtgctcgacagaatgaaactattgcgagtttacaagatacgattgtgtttgggctaaaaggaattgcagcttatcgcacacatgctgctcagctaggatatacggatgcatttgcagatgctacaacacaagaagctttatttatgacattaacaaatttctaactttaaccgaaccaagaaccttattgattttggcttttgaaaagtggggaaaatcagcttttacgggttgatgggaattaattagaatgaggcacaataccgaatcaattttggttgtgcccagagccctgtacaaattacaccaaaattcgggtagaaggtaaagcaattgtattttcaggtctatattttatt

SEQ ID NO: 1897 - DNA, 356 bp, Bacillus thuringiensis
gacattctttatctggtcagtcaaaaccagaacctacttttactttgattaacgaattctgatggcttacacttcggacatacatagtggggcggaaaagggaatacctctgtaacatccatcaccggtgcaacgaatgacgacccatccgagccacgcaaacctactaaatctacgtctacgaacaagtttaatacaagcgcgtgtgaaaataaatcaatcacggggaaagcatgcccaacaataccgcgtaattctttatctgaaccagctgctacaatatgcggttacactatgacataactgctacgcgcccttctatgactcacatgacgcgttacatcatcagcaccgtc

SEQ ID NO: 1898 - DNA, 190 bp, Bacillus thuringiensis
catatccagaaaatcattttcataatgcagaaaaagccacttacgctaggattgatatatctcacctacgcggccccataagatggccctaacctggaatcggtctaccattcctacactcccatcatcaacacatcctagattttcctcctcctcaaaaaaaatgttactaagtgagtaaatcactatt

SEQ ID NO: 1899 - DNA, 198 bp, Bacillus thuringiensis
gtatagtctacagttacccgaacctgtttcaaggactgatttatacgcttttctcactactgtatcaattaattgactaccgactcttggtgtatgaacattcaagcacgcgtgcaatgtaaacaactgttatgcactatatttcgtcgtataatttattatcatgtacgcttccttatgagactgcgagtttgctta

SEQ ID NO: 1900 - DNA, 148 bp, Bacillus thuringiensis
attatttgaaagcttttggtgcttcaattgcttttttccatccagcatatagctcttcgcttgttttcgcttccatcgatggttcaaagcgtctggccatatgccactgttctttaatttcatcttggatcgcatccataccaacata

SEQ ID NO: 1901 - DNA, 188 bp, Bacillus thuringiensis
accttggtggcgtatgctttatcgtgggatgtatgcctacaaaagcgtctatcaacgcatgtcatcgatatgagagtgcaatgcattcttatgacacgggtatgactgcataaaacttcattcttgagtgctatcatttcccagaatgtaatttcggcgttctttgttaaatacatggtccgagtttg

SEQ ID NO: 1902 - DNA, 496 bp, Bacillus thuringiensis
gcatcaaatcataatacctttcgacgttgaacgaataacttgtcattcatatgtttcgaacgattaaaaaagtatggtatatgtaaagggactgccacgattatcagacctaatatatcaaactgatttattcacgcatgagaaccacacgctaaatgggtaacacatgtgacgccgaccctgttacatggaaaatcactatatctatcacccataaaagacttctctgactgacaaatcatagcttacgttctacaacatagacctgtctattgccttgtttctagaatgttaggcacagcgcttgaatgtatgaatgattcagacactcctatattacactccgagaaaggctggcattatgaagtgccacagtgtcatcattcgcttaaaaaacattacgttatctaatgcatgttctgaaagggatattgctcacatcatgcaatcatggtaaatttctttggcgaatcatagtctgaactactttatctta

SEQ ID NO: 1903 - DNA, 171 bp, Bacillus thuringiensis
catagtgaatgtaagtgccttgttgtatattaaacagcggcggctgtgcaatctggatatgaccgcactgaattattcgacttatctcccgatggaggatcgattatgactgggtaccaatctgggcacaatggacttgtgattgattcttaataacaacgatatgataga

SEQ ID NO: 1904 - DNA, 150 bp, Bacillus thuringiensis
gagatgtaagacaagttcactcatcgatgaacaggatgcaagatgcgaagaggggggatccaagtgaagctgaatctctagactttacaattaagggggatgtaacattaccagaggtgacgagagcatcgcagaatcatatgccaacga

SEQ ID NO: 1905 - DNA, 199 bp, Bacillus thuringiensis
cataaccaacggtatgactattaaccgtgtacatcaaagctacatggggtggaatttgcgggacagtctcgcgtgactgttgatcagggcctatttatattccagctgaagaacattcttgaacgcatgcgcaagcacctgtggttctatgtcatgagtttaggggataggaagtatagattggtgaaggagtcacctt

SEQ ID NO: 1906 - DNA, 481 bp, Bacillus thuringiensis
ttgaaggacagggttgatgttactaaaaaaaatgcatcgctaacagaaagagggggagtaaggatacgaagaacaatgcaaaaagttagcacactttctgacgaacaagcatcacaaaaggcagagaaaacagtaataaaaaacgacacgggaaccataacaaaacctgaggaaaacaagaatgtatgggaatcatacagacataggaatctcacaatggagaagcagggccttcgaacagtctagttcttaatactggtaagggttagcacaagatgactcttcttgggatgacagatcaccgagcgaactaatacagatggaagaaaacaagctgcacacgcgtgtaacgcatgtcattatgacacatgcgcacgctgatctagtcggcggtatagaatcggtgtcagatacaggcactagtgcgcctactgcagcactcaccgctaaactagcagagaacagtggatatgaagagaca

SEQ ID NO: 1907 - DNA, 415 bp, Bacillus thuringiensis
  unsure (1)...(415): unsure at all n locations
cacaaagaaaacaaaacgcaaaaaaaaaaaccaaccaggcgaaaaaacaacccccacacccaagaacccgaagaccccagcccggcaaccgaaaaccaaccggccgaccaaaagcaaaaacccccgaagacaaaacaaaccaccncccccgaaaaaaaaaaaaagaaacccccccaaaaaccggccggcaaccggcaaaccgccggaaacggacaaaacacaccgcaacccccccccccagccccaaaaaaaccccaaaaggaacaccnccaaaaccccccaacaaaaagcccccgacaaacaacaaaacagaccacccccccccccaaaacaacaacaaagaaaaacccccccaaaaaccaaagcccccgcaaacaaaaaaaaaccccccaacaaccccaaccgccaaaaaaaa

SEQ ID NO: 1908 - DNA, 483 bp, Bacillus thuringiensis
aacccagacatacacggggaacacggaccaagtgctataattcctactgcgacgagaagctcaacacgaggagcttgacgggaatcaaacaacttaaacgagcctcgcgcacaaaagctaataatagacgccacagggagacgcacgaccctggcgacgctgtattcaatggagccacctataagggcgcgcatttgaccggccgatataatgcgccgcgctgaccgagaaaccggtgacgttacaccactaactgaagcgacagcacatggcgatccagtcgcctggcgtattagcgagaaggccgcgacagaccgtcgcatataccacgtgcacgcaccacatggcgcgcggaaaacaccggagatggccaatagtaaaagatcaacaaggaactgggcaggccaaactcattaaaccaccgataggccgaaatcaggagaacccctattaaatcgaatgtccgggcctaggtgggagtgc

SEQ ID NO: 1909 - DNA, 394 bp, Bacillus thuringiensis
cacatttaccagcggcatgtacatccgttatattaccgactacagctggacgggccataatggagtgcataccagccggaatacctcgcccatcatccgtgacacgaatactagtatcttcttcgatactaacataaattgcatcacaataacctgctagtgcttcatcaatactatcatctacgatatcacacgcatgatggtgaagcccttttggacttgtagaaccaatatacataccatggcgtatacggactgactctagaccttcgagcacctgtgtgtgactttgatgatatgcattttattgcattagcttttgttccatggacacaaagatcacctacatttccattaaaacaggggttaatccctatctattgcacaatctaca

SEQ ID NO: 1910 - DNA, 421 bp, Bacillus thuringiensis
gaccagatttatgaaataaaaagattgagcgtgcaaacaaagatggcgctgaatgtgcatacggggaagataaaggagacatagatggtaaatactccaaagcaaatgttggcggtaaaaaacaatgtggaccacgtgcatacatcagagcaagcggtgccaagtatacaaagatagcagcaccgggcgaaccagaactcagctggaccaggagtatcagatggagcagtatgagacgcgcgcactctgccaaggaaaagaccctatcacaatagggggcggaaacgctgctggcgcagaaggcgtgttcttaacacgctgagcagaaaaagcaacgaccgccgaccgcagagacacggctggagcgcagaacaccatacaagaccgtgccacccaacacgatgtagcagataccatatgg

SEQ ID NO: 1911 - DNA, 161 bp, Bacillus thuringiensis
gttactcttgaccgtttttattaccttatagtaccgcaccacatagaagagctttaaaagcgctaatcattggcattcgtacttcgagccgaagactcttatgggtcataccgctgttgcaaaccggtgctaggaagccctctcctgcacccagatgatct

SEQ ID NO: 1912 - DNA, 272 bp, Bacillus thuringiensis
aattcgagattttaccgatacactaccaacaacggcatctttaccgcggcatccagggctaacacgtcagaagcaggatcggcctctgcaaacccaagctgcacgcccacagataccacgacctacaacgcgagacccccggcagacaacgacaccaaaacaaagatggtcgacccattaacaacccccatcacaaccgtaaccagaaccgaggaaagccccaccaccagactggccaaaatcggaaaaacccctgacacacttcgccgcat

SEQ ID NO: 1913 - DNA, 583 bp, Bacillus thuringiensis
  unsure (1)...(583): unsure at all n locations
cgctaaattatatcctattccaaatgctatatataaggacataataaacatagttaaacgatatggtatcaatatacttgtttgattctttaatgcccaaaccgatatgaaactatctttcggcagtggtggaaatgctactattaaaaaaaagcttcctactataataaatggtaacgccgaaataactccatcacggattgcttgtagatgcctctgctcagaaagccttgccatcgggccagataagtttttatcaagaaacgtgacaaacttattcataacgcttcctcctaactaattaattcatttacagtttttaataaagtcgggcctccaagtggcgtgtatgcttgcggtggaatgatgccacacggaatagattcctcctctgcaaatttttttacagagtcaaatcggtgtcttatttgaggtgccaccattacgacatcccagccattctttacttcttcctctacctcattcgttccaattgcatgcacttccatgttcacaccatttttctncgcttcttttttttaagcgtttacaacaattgcactggacatttctccagaacaga

SEQ ID NO: 1914 - DNA, 285 bp, Bacillus thuringiensis
  unsure (1)...(285): unsure at all n locations
gaacgaaagcaacgaaaccgaaaggacaagcaccagacgaagcaacagcaaacancgacacagaaacagaagaggccacacaaacagcgncgcaacaaaagcgaaaaggcagaacgacgacagccaacgcgcacaggacacccacaacgcaagacccagaccaaaaccccgcgacgcacgacggagagacagcagaaagaggaacacaccaagaacaaccaagagagcaaggcacgcacaacaaaacgcacgcgcaacaaaacaaagagagacagcaaaaggccc

SEQ ID NO: 1915 - DNA, 282 bp, Bacillus thuringiensis
  unsure (1)...(282): unsure at all n locations
cggaactggacggagcgcagaacacgtgaacaccacaacgaaagaacatttacagcatgggccatataactcgtactaagaaatcggncacacataaccaaacttggcaggttatgccgaacaaaaagaagggaaatcatgtagcccaataaaagaaagaactgcttcaactatagagttgatttcgagcgggtatggatatagacataccgaatgcctacggaatacattccgagtcttcgataataatacaccgaaacgaaattctgttctctcaacacc

SEQ ID NO: 1916 - DNA, 380 bp, Bacillus thuringiensis
tgagcacttgcaaagatttgttgttatgcaagaaaggagccataagcgacgggggacgataccaaaccaagaaacgtttagacaagaccgattaaggcaaatctcattccttgcctgccactcagtcgataatatttactaaaccgaccacaagatgatcaaggatcactactgtcaccatagataactccacacctgacatcaatgatgcagcatcgaacgaatgatgactagctgctaacattagtccatcccgcccgaacaatacttcttgatgtgcaataagccctgaccaacgtacactatgaatgcgaataccgtatacacttgatacacatgcgcctgcaacaagctatacatctacgggatgaccatgctgc

SEQ ID NO: 1917 - DNA, 240 bp, Bacillus thuringiensis
  unsure (1)...(240): unsure at all n locations
aaagaccgacactaacaacaatatggaaaacngctcttggctttacatgccncgccacgacaacaaccaaggaaccacagggggacacgaaagtgaggccaagaaaagacccccaaggaaaggctgaagacaatggaaaacacaaagggcaaccccacgtaccagcgcaagatgagagaccctttgaaacgcacacaggggaaaaagaaacagaagggaaaaaaagagcagaagggcaca

SEQ ID NO: 1918 - DNA, 411 bp, Bacillus thuringiensis
  unsure (1)...(411): unsure at all n locations
cagaacgcgagacagacccccagacaggacgaaacacgaggagagcagagaaaacctgttccaggatcctccatgaccacangngcaccaacgaaaaacagggggaaaaatgcggcagcagcaccaacagcgccaacgagggaactcaaggaaggaaagcaagcacgcacggagatgcaccaatcaataacaccgacagaaagccccagggcggaatcaagaacaattgcgactacacccgcctaaactaaagcatcgatgcgaagcagagcagccgcagcaacaccaacagcagctccaacaaataagcgcccaggcaaaacatcagcagagttagggaacccaacgaccctaacaacagcccccaacggaagaagcccccggaaaacaccggcagcaccaacaagaggg

SEQ ID NO: 1919 - DNA, 212 bp, Bacillus thuringiensis
ccggaccaacgggcacaacagaagcgggccaacatagcagaggaccccagcgacaggacacacaaaacggacagcgcccacgtcacgcggaacagaatagaaaagagccagccaagtcggaagaccacgcccgaccacaagccggccaactggaaaccacatcgcacacgagcgcacaacagcaaacagaagcggaggcacgaccgaagaca

SEQ ID NO: 1920 - DNA, 205 bp, Bacillus thuringiensis
  unsure (1)...(205): unsure at all n locations
cacgangaaaagangcgccaactgcnggngcataagcacaaaagagaacgaagcgaatataaagcaangggganganncaagaacanccanccccgggagaccaagcgaaacagagaaacacccgcagaanaacaaaggccgnaaaccgcccgaacaccccacgaaagaaaaagggccggaaaacccaccgacangagaagaaaa

SEQ ID NO: 1921 - DNA, 417 bp, Bacillus thuringiensis
cgtataaaaggtgctggaacagatggaatcccactagacggggtggactctttacatggaggagaccatgctaccatcccagatcggattgaagctggtacgtgtatgattctaggagctgcatcaggaggagacgatgcggttgataacgaaattctgtcagcgataacaatgagtgactgcacagctcctagaacgccggggttcaagtagaaacgaacgacgatcaaataacggtgaacggcagagaaagagaaggccgatgacatcaaaacgctaggtatccagtgcaaccagcgcatctacagcagccgcttacaacacataataacagagggagcacgggatgtgcagtggtaacagacacagaatactgcgcccgctcaatcacattgatgaatcacgacgtgtgaatgc

SEQ ID NO: 1922 - DNA, 500 bp, Bacillus thuringiensis
acaaaccgcctaccatatgcagtctatttctaggtcggggggcgagtcagatgctattattaaacttcttgatgagaaatcaaagcaagtaggagctatttctgaagcaattcaaaacattgcaactcaaacaaacttattagctttaaatgcggctattgaagcagcaagagcaggtgaacagggacgaggatttgctattgtagcagatgaggttagaaaattagcagagcaatcaggagagtcatctggagagattgcaaatttaattgcagaaattaaggcggatattgaacatactgttaaggcgatggataatgtgaatggagaagttcaacaaggccttgatgttgtaacaaaaacgaaagtaagttttacggaaattttaagttctactacacatattgtttctcaagttaatcaaatggtagaaacaacgaagagaattgctggagatgcaaatgagtgacaaatgctattgatgaaaatgcagctgctgc

SEQ ID NO: 1923 - DNA, 254 bp, Bacillus thuringiensis
  unsure (1)...(254): unsure at all n locations
caggggnacaaaaagactgaanagaattttaataaaagctcacagtaatcgctgtgagcggggggatacttacggggctgaatccctaaaacggatacggtcaggcaagataacagagtgatcctccactattaccacgcacacatacaccgttaatagacgcattgctgctgcaccgagatcatacatcggatgaacaactgtagaaagccgcggaccaaccattaatgcaagacgagcgtcaccgaaaccaa

SEQ ID NO: 1924 - DNA, 319 bp, Bacillus thuringiensis
gtgtatggaaggcgggtggattaatacaacctgacgggggtctaccacttggtggaatagctaggatgccagctagagctactctgccaatactattcattaagatgatagcatctaccttgtgctgtacaagacgcatggcgcgatctaacacaggctcagctactttcatatgattttatgcgcctatataaactgtagaacttacaacttttgctttaacagaacgagtaaggggtgctacttgatatggacgctcatgaatgcaaagtacaattaattctgcttgcggatgattagaggcaacggtatgcgcgat

SEQ ID NO: 1925 - DNA, 459 bp, Bacillus thuringiensis
aatctactcttttgtttgctgaagaaggcggattaaatgtgggggggggtatcacacacgacgctctgtctcctctactgactggtgacccctggttaagatactgtttcaaacatcgtacatagtatgcgcgatcttgcgacacaggcgtcgcgcgtgactcgcaacgagtaacatctgacacatatgcgcatgcagtatcaatcactaccgcaagagatagcacataatgactttacaacaaaatgaaatcggaacgcatgaatacgagggggcggagggaaagatcatacatatcagctgtctgacgcttggaatgattcactgaaaatcacaattgtcgatccatcttgagatacacctggtactttagcggctgcaactgatgtgacagagaaattagaggccacacctgcagacgctgaaatcacggatctggacactgctattcaagaaatt

SEQ ID NO: 1926 - DNA, 263 bp, Bacillus thuringiensis
cagtaaacgggaccgaaaaaccacttggacaaataaacaccacagggcacacccctatccatctatcccagcaattgcaccttgacctaaaacttacgattgccagaaacgtacaaaaccctcaccaaccaaattcaaatgaccaccccaatcactagaggcacccaaagatacgacaattaaatctagaccaactgctgatgccgtcgccacaagcgtgcgcccagccttcttcgcaaagcctgatccaccccccgttgcaa

SEQ ID NO: 1927 - DNA, 553 bp, Bacillus thuringiensis
gtacaattggtttgtttaaaatggatgagctcgttgatcagttttttgataaggaagtgtatgtgctagtggatgctgatgatgctggagaaaagttaaggaaacaatttcgaaaagaatttccgcaagccgagcatatctatattgatcgctcgtaccgagaagtggcaactgcgccatctacacacttagcaaatgtattatggggagccgacattgacgtttatacagaatatttacggtaaggaatgatagaagtgattgattggacaggagccgaagctacagccctaatagagaacgaagaaaaaacagtattatatgtatatactccaatgtgtggaacatgccaattagcaaaaaagatgttaacagttgttgagatgacaattgaaggcctcaaaattgggatgttagatttaaattatgctccgtatttagcgaaagagtatgggattgaaagtgtaccttgtttacttgtttttgaaaatgggacactgatgaagaagatatacgcatttcatttcggtgaatatttatataccgaattaaa

SEQ ID NO: 1928 - DNA, 182 bp, Bacillus thuringiensis
caggctcggaagcttggcaacaatacagattttacgaaatcatagagcgagaggcgacgtttgcgggaccagtgcgagtttaagtgctgttaaccttcaaggaaactgatgaagtcaaacaacatgatgggtacatggcagataaaccactcatgacataaactggtacacacttatttaac

SEQ ID NO: 1929 - DNA, 244 bp, Bacillus thuringiensis
ccatcttttaacacctcaaaattcaccaaccgctaaaattgtacaaattaaacatttatttcctgaaactatttttgaagcctaaaaaatagcacaacaatccgctcaaactttatcagaacttactaattataccgccatcgctcttgcaccgaagtccacaacaaattaacataaaattcatctttaaacgccgcttgatcaacaaactgctgccgctattatctgtaccaatacaggacaa

SEQ ID NO: 1930 - DNA, 365 bp, Bacillus thuringiensis
ctatcggcggtctcgctgactgtgttggccaggttttctcaacctgagctgactctgttgtactggctgctggagggttagctgagctcgcagaacaaaagcgcttcgaacaccaaatgcataaccccagcaactcgtctgatggtcttaaagcattccaagacgtgtcaccaaacgtaccagatgtacgcaggatgcgtgcagcaatagaccaagcactgcccgaatctgcatggcgatacagctgaccatatgagtcctaggaaacatctagcatccgtgaatacggtttccacggaacttcgtagaactatgtcactgagcgagcggcagaattatcaggacgtccagttgaaagcttaagc

SEQ ID NO: 1931 - DNA, 475 bp, Bacillus thuringiensis
acgcgtatgcagtcggatccgcaggcgtgatgcaccaggttgtctccgctcaagttcacagcacaatcttttctgtctggtactaggtctattccgtggggggaagtcctatttttctctgccacagcacggatagattgcaccggaatatcgacaccatttagagttgcatcggatggtttcttcagaacctttcgcacacctatactaggttccgctattcgtacacacgacactgatcattgcagtctcttaagagactggttcttcatgtaaacgttgatacgatgccatatccttatctctaacacccgctgtagaagcgagacttcgcagagccccttccgttgggtcacctttcacattccacagatcgtctctgtgccctacactgctattattgcaacgaacactaatctgcagtgcgcgcacaaaatagggatgcactaacggcttttgagcactttaatgataa

SEQ ID NO: 1932 - DNA, 345 bp, Bacillus thuringiensis
aacaaatcttctattttcaattgcactaaccccttcatatctcattccaccactttcaactctcccttttacacctttaccaaaccacattgaacctttttacttcacaaaaaactctatattactaccctctggaataataacaccatatgctttatataccggaaatataaatattaatatccctactccaccactttccttttctattacacaaccaaaataaatgttaccttttaatccaccactacattcaattattccttccatcacaaacataaattcgacaattcccccctttatatccatctttccaatgccatatatacaaaattctattttatc

SEQ ID NO: 1933 - DNA, 368 bp, Bacillus thuringiensis
gagtggcggattttctttgtatgaatatacttgtcactcacgtatagaacatattgcaccatttatagaagatgcggtctaagacatgagacgagacgggattgcgcatgcgattagtatagaattaccgccacattactctacattcagcattaaagcgtataaggaccgagctatacgaatctcgcaagaaattggtggtaccgtcattgaaccaagtgaacaacggtgtgacgaaccgcgattgattatggatcgggctgaccatacatatgagacgcctgcagaccttgatactaatgtgaatgcaggggtaaatcttccagcgcatcgactgccagacatggtcattgctgacggacacccat

SEQ ID NO: 1934 - DNA, 406 bp, Bacillus thuringiensis
ctgaagcatcgccaactcttggtctacccattgattatttttcaatatctgcatactatgcacgttaatatgccgaatccaataaatgacctacattgggcacggctgttgcaataacttactaccgcctactatgctctgaaaaaactacgacggcttcctctttattatcaacagacaggacaccttctaaatataaattctggccagtactaataaaatttgagcacatcatcccattgatcaattacttcatggacaggaccaccaatatctagcgatagacgaagagcgagggcactatacgctgtgatgctcaatgctgatgaatgtggcacatatactatactaaccgcttgctcagatccctcacgcttataaactgctaccgcatcatagattgctg

SEQ ID NO: 1935 - DNA, 151 bp, Bacillus thuringiensis
cgtgattggagattctgcttatcatttagcccacataataaagaccctttaactggcaaaccaatagggctgtttaatgtacaatgcgcttcccacccattgaagctggcctgccaacaatttgttcagaaacattgtgtaggatcgtatc

SEQ ID NO: 1936 - DNA, 395 bp, Bacillus thuringiensis
tttattgttgcaaagtatttacatttagagaacggtggtgaagtgtgggcgaaagtttctaactactatttcggatcatatggcggagtattattaggattaatgattacagtagcttgtttaacaactagagtgggacttgtatcagcatgttcttcattctttcataagttattcccaaatgttccttacaaagcaattgcaattacgctatgtgtatttagtgcaattgttgctaacgtaggattaacacaattgatcgcagttactgtttcagtattaacagcaattcatccacttgcaattgtattgattttattaaaagtgttccttgttatacccctaggctaacatgaacccgtcataaaggttcaagtccgtcagtagaggagcga

SEQ ID NO: 1937 - DNA, 377 bp, Bacillus thuringiensis
ttcgtgatgtatgtgtatgcggatttttttctttctcatctctattccactcaacaataactccatctctaggggggtgttatgcgtccgaagctatttttcgctcttcatgcggatcttttgcgcccctagtaaacctctgtaacggaccagtgtaaataactttgcccgagatgtaccatactacagttttaacttttccggcattatctgtttgctcctcaactttccatcctggcactggtacatactgttggaactctactccagacggtattttcagtgttccttttgtcgttgctacatttaatttcaactgccactttttatcgtaaaagtggttccaagaaccaacagtgagaagttggctggtttta

SEQ ID NO: 1938 - DNA, 345 bp, Bacillus thuringiensis
gacccacggtagtatgaagtgctactcgaaatctttgctacccgtctcgttccagttcctttccgttaggtgtcgatgcccatgggcgacactcacacctcgctcacactcgggacagcctaggcggatccatgctttccaacgaagcacgcccatccaacctaggcgagacaagggttcacatttcgttcatcacccttggccggctatcgaacagccggactcccatcaaaagatggttgccaagaacatcttcgttacggtttgctaattctcggaataacatcaacaaaactcggaaggtttaaaaaacccacggtagtatgaagtgctacctcgaatctt

SEQ ID NO: 1939 - DNA, 395 bp, Bacillus thuringiensis
caccatatgacagacgttaagacaattactaccgactaattgctagagcgtgtacaaactggagaaacgctattcttagtggacgaccgagaagatgaggagctaacggctgggaagattacagaagccgcgcatattaaaacggatgatctcccacataacgtggagctcgcgcaccaagagaacgcatatatcttcagtggtcggtcaggaatgcgcagtgtaaatgcccgacaccatttaaaggagctaggatctataacagtggacatggtctgtggaacgctccaagctgaaggtgtaccgaagagaaaggctgtgcagaacctgcagccagtacgtatcgagatgttattcttgcgcatacagaatattaatggaggatggcgaccatg

SEQ ID NO: 1940 - DNA, 298 bp, Bacillus thuringiensis
gtcaatagcgatttttacaactacagaacctggaaacatcgattgaatcatttttttagttacaagatgtaggtgctttcgctcctggaattaatgctggcttctataacaagcgacagattctttaacagtttgtgtaaacggtgcatggattagacattaaagtaatcacttggaatctgaaaatctcgtctaataggcgaagactcttggctattaagtgaatgatcgttacattggcacctataccgacaggcatattcactgcgacagaaccatcttgacgaccaaccgttat

SEQ ID NO: 1941 - DNA, 471 bp, Bacillus thuringiensis
aggcctgccaggcgatgaaatagagtatcgtaatgataaactgtatattaacggaaaggcttatgaggagccgtatttagacaagcagaaaaagcaaattgctgacggaccgcttacatatgattttaatcttgaagaaatgacaggcaagaaaaccgttccaaaagatcaattatttgttttaggtgataatcgtcgttttagtaaagatagccgttcaatcggtacgatttcaatggatcaagtaattggtaaagctaatatgttatattggccgttagaagacgcacgtattgtgaaataaatgaaaaagaaggtggcaacatggtaattcaatggtttccagggcatatggcgaaggctagacgccaagtaacggagaaattaaaattaattgatgttgtaattgaacttgtagatgctcgattaccattatcatctcgaaacccaatgattgatgaaatcattaca

SEQ ID NO: 1942 - DNA, 520 bp, Bacillus thuringiensis
  unsure (1)...(520): unsure at all n locations
ccaaggtatgcgattatagcaaatgatgtttctgatggaggatatgagtgaatttatatcataattccaggtataatcattatgaatgcttatatagtatgcatagtggacaataaaaaatggataagaatacaaaaaaaactggacatatgaacatattaatgtggataagccaaaggaaaatgccttacagtagttgaacagaaggacagcacttcatcccatgttccattaaggatatttgaaacgggtgcttacattgtggtgtatttataatacttatgcaaaaacaatgtaaaaataaagtatatgtatttggaatggtatgatgtacctgattatggattggggtcttgaacacttgttcaccattaggctgatactgtgaaacatgatatggaacatgaaagataaatggatccatgaccaaattgactgatacatgaaagtaacaattattcatgcacatcacgaatgtagtggtgagtagaaaaagaaacatntantattttaaaataac

SEQ ID NO: 1943 - DNA, 387 bp, Bacillus thuringiensis
tcccggggcgataagcataccagtagggttgatagagaatgtgcggcgcatcataactacatggataccacgacgagaaccgtaagagttaaagacaactggtcagtacgctcgtctctaataaggagaggacagctggtgtatgctaaccgatcgaacctgctggggaaacgtggtcggccgttacagagtcaccaaatttaccaactacgcgaaggcctgataatgattcaactccacctggctctttagataaaccttcaaagaatggtggattccgaatgcaagtagaatcattatccccaagtatataaagaattcgtttgaagattggatttcattccagacgctaatgctgaaaatacttgtgcatatatcttcttgaac

SEQ ID NO: 1944 - DNA, 325 bp, Bacillus thuringiensis
acaattatataatacattatatagaattgcatggggagaatctatgtgttaattaaaacattgatgggaggccaaaagataattatgcatacgcttatgatgaacaaacaattcacatccgagtacgtactaagagagatgatattcaaagcgccgatcttatttacggtgatccttacaaatggaaagacgggaaatggatatcatcaagttcacccatgaaaaaaacgggtcctactgcattatttgattattggtccattgcaatcgaaccaaaatttaagcgcttacgttatgggtacgaataaaaatcttaaacagacac

SEQ ID NO: 1945 - DNA, 355 bp, Bacillus thuringiensis
aaaaattttttataaaacaagaaacaaagggcgttttttgaagaatttttccacctatacccaaaagaacatatactgtaacataaaaaaaaactaatttatatctaaagtaaaaatgaaattactttatcatataaaatctaactaataacgcttatcaacatatataatactaatactccttgtaaataatcccctatggaacaaatccatgaaatttactccctccactgtctgatcgaaataatatttaaaacgttgaaatctctatttcaaatacatcatagacaaaccttacaacaaaaactaatttaatgccaactttataataaacacatttccatttttaatattt

SEQ ID NO: 1946 - DNA, 355 bp, Bacillus thuringiensis
gattctccgaaattagaggcgttgaaaatgaacaatgtaattactataaacattgtaaatccaataatttttgcaatagttgcaagtagattcatatttccagctcgatcaatattttgcgaaagaatatattgaattccccacagcataaggctacatacgaggaaagttaatccttttccgagctccagtgaaaatccatttattgaaaaaagaatttgcttactttgtaaaactggaaagaatgttgataaatatccagcaaaggaaataataacagatgctggtgcagcccagttagcagcccaatatccccatgccatactatatcctgcaactttaccaggtttttttg

SEQ ID NO: 1947 - DNA, 437 bp, Bacillus thuringiensis
gtgatacgttatacaccagggctttgtcttcagatcgatggttttacacggtacaccctattcaatacggcaggtaccacctatggcgcaaacgaacagaggaattttatgctagtttcttaaaaaacaccatccaaccgagcctttaatgcacatggtaccaccttaccgacaactgggagggcctccgatgatgcattaggaaccaccaccgacacattttatacagccatattcactgcttgacctatcgacaaatgagccgctacatccaccgtatttaccatacatgcagcatcatcctgcgcatatgattccgcctgaagaggttgaattactggaaacgcgcggcggattatctactggtgaccggacagcaggctatgtgatatgaagattcttttctgacctacattaggatcttgcttggttgcaaa

SEQ ID NO: 1948 - DNA, 333 bp, Bacillus thuringiensis
agacttacatcaaactcaggagcgcttttataacaatatatgctgacttaacacaaaccataccgtctataccaaaaattcatttccagaacactcccaaaatgggacaatcaacaaacagccacagtacatccaagtttattcagagaacaccatgcacacattaaaaccaggaccaacctctgaaataaaagacccctctatcgtccacgaatcaaagattattcacaagagtaattatctacccattaacacaggaacaaactctggaacgtacaaaaaaaccaagcctaacccaaagtaaaaaaggcgaccacatcttcacaacagact

SEQ ID NO: 1949 - DNA, 186 bp, Bacillus thuringiensis
aagagaagggatcggatacatcacacttcccactataatcggcattccagacgtcataccgcctaggaggtcttctgcattattcgctcttcgcgcatatccatgctcctcatcccacagagatttcattcatgatactttcagcttgccttggttcttatgccgcttgacttctaaatacccaat

SEQ ID NO: 1950 - DNA, 319 bp, Bacillus thuringiensis
gctgctctgcttagtttgattcagggaagggcggtaaactccctcataggaaaggagacgatcgtctacatgttctgatgccaccgctacgatagagcttgtgatgaatgggccgacaatgggccagaatcccaacctgggccatttggatagctggataaggtaccttatgatgcttatacgcgctttacaaatgtccacactgaatgtataggtgtgcaatccggactggacgatgccactaccgtgctgggactgctggtagaacattcgggcgcactcgagtatcaaccctatcagttgcgggatacccaaacat

SEQ ID NO: 1951 - DNA, 267 bp, Bacillus thuringiensis
gaagcttggccacaaattcacattagaacaatgtaagggacgaggataaaactgcgggggaaatgtggcattttacgcctaacacacggaatacccattacaaaacagacaagttcaacttgtacatgggaatgcaatggaacttacctgtgcagataaaagaatcgactatacgacgatcgagtgagaattacacaacatacctggatacatgcacgaaacaacagaattgacccgtgaaataaaccgagggggaaaggacagctg

SEQ ID NO: 1952 - DNA, 291 bp, Bacillus thuringiensis
attcgcgatgcatgatacatgctatcgtacttaaaaaattgggattttacattgtacataataggctgtcaccacggttcgatggggaacacgaatcagtaattgcgaacgtggtaggctagcatggtgtggatttcgaccagacgggtggggaaatgtgttaggggcctatggatcatgtagtggaacctaatagtccttgcacttaagtggacgcaggtggactacgctgtgactcaaataacgatggcgctgctgatctaactaggcgtgtaaaagatgcttctgtag

SEQ ID NO: 1953 - DNA, 405 bp, Bacillus thuringiensis
tttgcttctttaggtgtctagattggaatcggttttgaagcaacacatactccaggaagtgacgttcatgatgaaatcctgcgggatgcggtgtaagcatttccccgaagaagaactaatgcaggtgggctataaggctgtatgactactgtaatgccaactgttgcgcgcggtgtgatgaaacctatacctacactttatttacctatccagagtgtagatattgagacgaaagaaccatgtacagcctgaatagtacgctgagatcagccgcgcaacgttcagcagatagcgtctatatacatagacctttgaggttaggaacactggatacaggcttcattggaacgataaagatgcgactggctggagctcagttgaaggtatattgagagacgttacgca

SEQ ID NO: 1954 - DNA, 450 bp, Bacillus thuringiensis
cttgcgaagttcccatttgactagtgcaggcttcctcttttacatcgctgcggcttgcaaggaggagggctgattgttgatcctgcgtagcgaatccgctagtacagtgaaatgagagatgtaatcgcaggagacattatcagaacctgttatggacgtgtgcctaaggtgcgccgaacggatcatagagtactgagtttgtagggtatgctgcacgtgcccgggctagggcattacgaggacgttgtcgaccaaatatttgcgctggatatcgcttatgagagccatccatttgtacgagctttaataagtcgtgtaccatctcttctatagactgcagatgctgaattaaagctgcatttggtggtctagagcgatgggcgccactcgacaagacgctcgtacggatgatgagcgcatactgctgacagacgaagccgtcttgcctgt

SEQ ID NO: 1955 - DNA, 332 bp, Bacillus thuringiensis
tgcaaacctttatcaaaactgcaagacgaccctgctaacgtacgtgtttataacgggtgcctttctctgagaatgcaccaatggaccatccagggactcccctattcgcctgacatgaccgctacataatcaaccgtgggacaaccaccgagggagcgactacaacagagggtgcagaggacactctatgggattacgaccagtacggtgaaaagaaaaacgaaacggttgaccgagcagaacttgaacagcacgaaagcgacattcctggtcaccaggtggccgctcacgcaaaatttccctatgaagaagagccagagcgtcaaaaacta

SEQ ID NO: 1956 - DNA, 385 bp, Bacillus thuringiensis
atatgatcgccattttacacatggttcagtctaagatacacgggggcgactccactgcacttatcaagggaacgactgatgttatgacaatcatcatttacctcatagcctacagaggaagtggactgaataaaccgaccgattattatatagaagggcttcaaagcggctttaaaatatgcggactcagtattcctagcgctgcactcttatatttaagagatagacacttcgtacaaattataggcgactattgaccggacggttcacacgtaatgagttaacgacttaagcaatagttgtatctcagcactagtgcctttatatccaatatgtataagcctagggacatctaaccatatgtaaggagatcattacaccgctt

SEQ ID NO: 1957 - DNA, 307 bp, Bacillus thuringiensis
catgtgcagccttttttgctaaaaggggaaactcccaaccgtgaggagcatatttgaggccacccgccctttacatccaaagaggaaaatgcaagaatcgcagcggctatgcttgcgggccatacagcgaacacgaaacgcaaacccgaaaaagggacgaaggcactcgcgaaagggaaaaacacgtgacacgaggcgaggggtgctcatcaaatgcatatgcaagacaggcagcctgacggagccggaaattgacatccagcggaccgaaacagccaaaaagcctccgttctaaaagacagaagga

SEQ ID NO: 1958 - DNA, 441 bp, Bacillus thuringiensis
aaggggaacttcttgagtacgcagatgttaactttaacttcaatctctatttacatgctcgggatgttagtaatcggctatttcgcctataaacgaacgtccaacttaacagattatatgcttggcgggcgtacactaggccccgcagtaacggcattaagtgctggagcatccgatatgagtggttggcttttaatgggattaccaggtgcaatgtttagcgttggattaagtagtagttggattgcgatcggcctaacactaggcgcatacgcaaactggctttatgttgctcctcgcttacgtacctactcagaaattgcaaataactctattactattccagaatttttggaacaccgttttcacgacaaatctcatatgctacgtttagtatctggacttggtattatgactttctttaccttctatgtagcttca

SEQ ID NO: 1959 - DNA, 477 bp, Bacillus thuringiensis
gaccccacatttgtaacgttacaggacgaggaatacaactgacaggaacgcaatagctaagaaggatagctcatggagagataacatgctcttgctccttgattaaacggaacatggatttgatgatgctttttcggtatcttatacttgaggccctcaatggaacgaacagattagtacgcacaaagtccacccatatttaaatacattgatgggaatgaaatgagagagaatcacacttcaccgagagatacattgggtgatacagcatgtactgtatacatgacaccaaacacaacccaaggtctgaggacccatttcagacataatacaccctactgcatctccgatgaatggaagacaaattgcatacaccagatatttgaaataccacgatcgttacggtaaacgatctttcattgataagagccatccggacgctcctataagaagcatgagtggtgcactcattcccat

SEQ ID NO: 1960 - DNA, 472 bp, Bacillus thuringiensis
cactgaactcaagacctgttagaacaggtgctttcacatgttgttatgggtgtgcttctgtaggcataagaggtggccctgttaaatattcatgcatgtgtgtcccacacataccacacgatttaactttgatattcactgtacctggatagactgcagaatctgggacttattgtactcgtacattacgtggattatgccaaagctgtggtttgattctatccatgactacatatgactatacttagcctggcgaagtttacaataatataatggtactattatgcatgttttgtgaccaaacaacagcatatctactaatatgttccatcattcggtcaatattttgtgactttgtacttatattcacatctggtaatacaatgccatttgcaggagaaattagcattatgccatactagcataagacaggcgaatatctgtcgaaagattgtattcacattatcagtat

SEQ ID NO: 1961 - DNA, 246 bp, Bacillus thuringiensis
tgccagcgtctgtaactgcgctaactcgagttggatattgcattgctaggcatagacctgcttgcgcgcgcatcgagactgccaaatataatacatctccaccgtggatgaagaggctaccacctgctactacaggctttgagcgacccataatggcagaagatacaggaagatttacctgcgccggtaggtcccataaatgcgtggataagtccagccgggacttcacggtatacaccattaaaa

SEQ ID NO: 1962 - DNA, 264 bp, Bacillus thuringiensis
gtaccttcagccgcggagagctatttttttagtggaacatgcccagtttgatctgcgtgcgttacctgcgtcgtcttattgccaatagtataattcattgccacaggtaattatactgggaacggcacacgctgtttcaccatatgagcaaacgatgttacgtacgttaccatcattcgccctttttagtggtacagcatattttaaacggataaaaaaggtgtggaacgagcaatatggatgacaagaaacgttctcattacc

SEQ ID NO: 1963 - DNA, 471 bp, Bacillus thuringiensis
cccccgcgtccggtctacgattattggtgacacacttgctcgcatgcttttattttcgaaagtgaaagttcttcggcggaaccatgtttttgactgggggacacagtttggcatgctgattgagttcctttttgaaaagtttccaaactttgaagacgccactgaaacagccattggagatctacaggcattttataaagcttcaaagcaaaaatttgatgctgatcctgcatttaaggagagaggctcaacaggcagtggcgcgccttcagggtggtgaagacaaatatcgcagggcatgggcacagatatgtgaaatcagccggactgaatttcataaggtctatcaacggcttggagtccatctagaggaaaagggggagagcttttataacccatacatgtcaggggtaatagaagcattgaataaacaaggattagtcaaggaaagtcacggagctcgagcgatct

SEQ ID NO: 1964 - DNA, 450 bp, Bacillus thuringiensis
ttaggacgccccattgatctaacattctcttggaaactcgcagcatacagacagttccgggaactattaatacccgagcaggtagtgctgggttcgcttgctggcggagcaacattgcgcggtcacataatgttgcggacgccaggtgggtgatcagaggaacttatgcttgtacagctacgattaatacccacgcgatcgacttacggtcgaataatacagacacacatagagtgtttcggcgtaacgcaacgctggtctgatcttggacccagacgtgtggatattcggtcgcgccatggacgagcggcgttatgcttggaggttctacctagcgcacatcatggtgctccaccatcattgccatggcagtacgcactactatgtgtacactcacaggtgctaccactacctgatcctgacatacatagaagaggtccaatcgttgac

SEQ ID NO: 1965 - DNA, 515 bp, Bacillus thuringiensis
tcggatgggaacacggggaaccctgcctgtcccttgatgaaatgatttatcatgattgctcatagtattggcacaacaataagtcgttcttcaaacgagagcttcgcttgaaccgcaagaacttatgctagaacttgcatcggcgcttatacaaaccctctgttatatgctcaaacagcgatacacggtcgctcctataatacaagacctcgagcgaagtgcacgaacttaccgtcaatcgttgctgtaaagagggatgttggagacggatacataaccgactaactaataaccgagacaaatacctgcggatcaccaccagacaaactaaaagccattgggataaatgacattataacacttagaggttctgtaacaacacaaagatacaccttaagattaaagatggacaggggagcaacagctacaatcacatatacagctataactctattgattaaccaaccaatgctctactcaccagctacaggagcatgtaatccacgaggcgtatc

SEQ ID NO: 1966 - DNA, 192 bp, Bacillus thuringiensis
tatttcggtctccttaacctggtgtcggttttacatgcgttactaatggtacacctggaccctctgtcactgttttaaatggccgagctagaatcgaacatagagggaggggacttggtgtttcaattaaaaagagtgcggtcgtctgatcaccgctcatcataatctgtccgacttttaactcacggatta

SEQ ID NO: 1967 - DNA, 553 bp, Bacillus thuringiensis
agtatcgccttttttttcaggaatcaatccgatttcagaagctttcccattcgttgcaagaccttttccattacgatcgtatatttcaccacgttttggctgtgttgtctgcatacgcactttactatctttcgtcatgccagggaaaataaaatcaggagtccaatctattttccaagattctttatctccatctttttcttttaccatttttgcttcatgaccaaatgtgattttaccaccaactgtatccatgcttactttaaaaggaacaggaccttcatcttttttatcttcttttacttcccctgtttctacctttaagtctttcacttcgataccagaataaattttttcatatttctcagtaaactctttctttgaaatatctttttttgcattttttgatagttgatcatacatatctgcaaatttttgtttattccacgcttttacatatgtatcaaacgcttcttgtggtttttcttctttaccacatccaactaacatgaatgttaagcaaagaaaaagaatcccccatatctttctcaat

SEQ ID NO: 1968 - DNA, 380 bp, Bacillus thuringiensis
ttttcaacctgcaattaaaatgggagcttttgatatcatttaaaataaatcccccatccactcctgctaactcatataaactaacacgaaagaattcgcactcatttgaaaaccaccatcaacaattctttatatctgctcattatacccaataacaaatatatctcctcttttttcactatatacatctatctatcccttttctcaactttatttccctcgccaccatcttcataatattaattatacttttgacaccttgcttatttttcatccatagccctaatcctcctaacgtctaaccaaatcgcttttcctaaattaaaaacacctacaacctcaactccttttttaaatattccacccctcctaaatttttt

SEQ ID NO: 1969 - DNA, 371 bp, Bacillus thuringiensis
cgtatatcgatcaattttttttaatttctgaacgtgaccagatggccgggcgatacggtaacaaaggtgtattttcttgcattctaccataagaagatatgccttacttatcagacggtacgccgattcatatcattgttaaacccatgtggggtaccatttttgtatgaatatcgtccaggttttagagctttattatggtgcggcaccaatgatgccttggcattgacattgcaacaccagtattctatggtgctcgttgtggaaaatgtttggggctcaattgatgaatcttggtatggctactgacgcgataacaatcctgcatgacggacgctctggagaaccactccataacctcttatcccttg

SEQ ID NO: 1970 - DNA, 356 bp, Bacillus thuringiensis
taccgagtctagctgtgccatgtacaggtacaggtaccttttttggacgctggagacctgagtgaacaaggacgcgtgcgctcatcaactgccttaacacaggccagtcaagctgatcgcgctactaccttaccgaacgacctatccggtgggccaatgcggcgagtcaccgacgcacatgcagacggccatatgcctgtaagggcgttagccgatcaagcgtgcggagcacctgattcgaaaacacgcgcacaatttatggacctcttttacggatgaaatacgcacggctcaacattcctgatgataacccatgaccgtgtaatcggtgaagctgcatcacgtcaaattgtaaa

SEQ ID NO: 1971 - DNA, 321 bp, Bacillus thuringiensis
gagccatagtacaccgaggtacaggagaaggacgtggactgtactgacctggaaaggtacgtacactgagggtgacaaccacagtagcggaagcttctgactgtctggaacgtcatccgagtgcaggggatcacgtgataggacagaggattcaggaaagaccatctatccaagctgcataccacgatgtaaccgacatcattcattcactcgagacgaaagggagaaaagttcccggtatggggactgtaattacaggtatttcagatcacacacaactattaacttcaaatgcttctattgaggcttcacgtgcgggaa

SEQ ID NO: 1972 - DNA, 277 bp, Bacillus thuringiensis
gatacgtatcaacaggctgacttttagcggcctgttgtgcatgcagattatggagggagatcttaagatcgacaaaaagcattaaatacgatgtataaaaaacaagacggggaagcaaaaacagcaatgtctagcgcggttcctggcacaagtgagcatcaaactggactagctatggatattacgtctcaatctgctaaatttcagttagagacggtttttggggaaacgaaagaaggtcagtggctttctgaaaatgcccataaatttgggtttt

SEQ ID NO: 1973 - DNA, 332 bp, Bacillus thuringiensis
ctgtacttattcattgcttgagtaccacagaacccacacttgtttgcactccaaagtgactaccttggtacgcttgattttcaacagcgcttattgacacacctgctaacgtgcggcctagcataacaacatgtgctcctgccgctcatgctatcactataccaccatagtacttaataccacattcagccatgagtggcttgccgtgcttacgagcaggacttgcgcatttcaaagccgatgccaatcgtggtacacgaacacggggtacaacgcatgttgtccatatagaacctggggcaatacctactgtaactacgttagcaccaggt

SEQ ID NO: 1974 - DNA, 233 bp, Bacillus thuringiensis
tcattagactttgatttaccataaggtcactatattaaattatgggggagtacattgcataagcctgagtattcttccatggaatatctcaactatgaagttggagtcagcgaggcacgtcactatgggaaacacctctttctgtatatctgaatcaaccaaacaataatgtgatatctacttgctggtggaagtggccctatgcgacaggcaaataccgaaaatttaagatc

SEQ ID NO: 1975 - DNA, 334 bp, Bacillus thuringiensis
gaggtgatttacatgcatgttctggaatgccaatgcaaaagcttgcggtcggtactgctaaggaactctttcataccaaagttaaaaaatgacaacgtagacaacagctatcgaatgctgaacgtattaaaagccccacggaatccaaagtcgcagattatgtcatcgatgccaatcatgggataggctagttttgaggtcttgcgacatcagacactaatggcggtcataaacattatctaaatattaaatctaaaggtaatgacaaggtataccttccaaacgtccagattgttcaacgccagaaacaagtaggagctgaaagtcaggatcc

SEQ ID NO: 1976 - DNA, 367 bp, Bacillus thuringiensis
catttacctattcctatttttgcaacggaaacaaaaacacgtgatgtgtgcgtatataaggattaataacccccattccactttattgaaaaatcacactatcatacgcattttattgaactatgtaaagaagaaaatcctgaagaaactgataaagaatcgttgaaaaatcaaatatctatgccattcgattaaaaaaaagacacattattaactgaagcacttattcaattagaaacaactcgcttcttttggtaacataacatccatcacaatgcaatggatgcctatggattttcactttttatacaaaaatggtcgatttaatatacatcacttctttaaaaaacaaactgcaatgataatc

SEQ ID NO: 1977 - DNA, 206 bp, Bacillus thuringiensis
ggcttattcatcttctttgacttaaactaacaatttcttccttagtgagagctgctaactgcagctggtgtactacgtaaagaaccacatgacatcgtggtccttatggcaccacctctagtactgtgtgtagaagatctagtgtgggctttgcaccatatggacgctgtattatcgctaggattgagaggctgatccacatttgg

SEQ ID NO: 1978 - DNA, 566 bp, Bacillus thuringiensis
aggactatgaaagttgtttatatgaaacaaagttctctagacaattcgtaccaacctgctaatttcttctggtcatagtatcgaattttccaagttgaaaggcgggaaaaaatgagttacttctctattccaacataaaaaaaagtcactgcaaacacgatttggctatcctacgttcaaacacaaatttcatcttatcaaattatcaaaatgccaataattgaaaaacttaacctgcatcactcgcatcaaatttcactgccgttttgtttcctagtaactcgaagaagacacttcgtactacactcaaaagctatttgatcattataccatatgaaaatccatattatgaaccgtttcattcctctttagtaagcgactttgctactacgaaaccggcctccttgcatttgtgctctttttctcgctcaacgcttcagcaaacgcgcctatgatctgctgctgtgactcaagcatcatctggcaatgcttcagctccatctccattctcgacttctccatctctctcatcatctccatcttcgaattctccaccctcacaaaca

SEQ ID NO: 1979 - DNA, 460 bp, Bacillus thuringiensis
agacggatttattctcagagtatatgaacatagaagaagtgcttcattttgcagaggattttgagaaaacaggaagagtaaaagaattttcattttatgatgaaatggacgcagaatggtcattaaaagagatgaaaaagttaagtaagcaagtagaggaagagccccaagaaatactcgtttattttgatggggggtatgatgtgcaaacgaaagaagctggcgttggtatatgtgtgtattataaaaaaggaaatacaaactaccggattcgccgcaatgcatatatagaaggtatagatgataataatgaagcggagtatgcatcactattatacggtatgaatatactcgaggaattagggatttaatatgaagcagttacacttcgcggcgaatctcaagctgtattgcagcaattagcccgagaatggccttgttttgatgagcatttaaacca

SEQ ID NO: 1980 - DNA, 366 bp, Bacillus thuringiensis
caaatcgatgttgtttgacataaagaaaggtttagccacactgtggctgactgtgatgatcgtagggttatggcccaccttggttcacctgataggccagtaccaattcaatacacacttacatatccgtatagattgcctctttcgcacacacaacagtttatcttgtggcaaatagccaccatgcctttggtgagaatggacctagaacgatgccgttgttgacaacttgcctctgacgtttgtaaagcaggcggacttttgccagctcttatgaactcaccgtgggacgtagctggggatgcctttctacattggaggagagattttttaacaaggtacgaccttatcgatagaactatcaac

SEQ ID NO: 1981 - DNA, 394 bp, Bacillus thuringiensis
agagctctggttttatgacgggaaacacacgaggcctgaatgggtaactttcagcgtcagacggtgtattaaaaactgtctggatcggccgtgcgctgctctgtctgggttgtgcggctgctgctcttgcagtaaggggagccgattatacaacccactgggttgctgtacttggctcaacaggctgtcgcgctgctctcactctggcctactggttgcatgtggggctcgatttctactaatacgcgatcttctgggcggtgttttacttatattcgacggaaggcgcagcgatccattgggttgctcttaccacgtattgtgtgcatggtcacgtctgacggcattactagtatgcgtgggaagtcatgacggatacctactacaatggcat

SEQ ID NO: 1982 - DNA, 299 bp, Bacillus thuringiensis
  unsure (1)...(299): unsure at all n locations
agaggcncaaanaaaagagacaccggcacagcacacgacgaaagaacagaaacagccacggncgcacccgccaaagacaacangacgaaaggcgcggcagggcaagcgacccaaaaagcaaacanaanagcgggaccagaagagacaacaggcacacaacaaaagccgccacaacaacaagggggacacgaggaccaaagcagcgcccaccacaaaacaagaaaacggaccaaccggaacgccgaaaggcccaccggcaaccggaaccgcaaacggcccgaaaaaggacccaggggcaa

SEQ ID NO: 1983 - DNA, 529 bp, Bacillus thuringiensis
tgagacacatttataatgcggtcttatacataaaaccggagatgggggaaaaatgcattctgagggatatattgaatcgttaggccgtcatgattaccaggcgagaatgacggtctatctagtggggttggaataaatctctcattgtcgtataactaataaacaagtagaacatgctggcgttagcgatcaaacagatgctagcggtatcgaccgctaaggtgcatatgcggtaacggaacagaatattagtaccgctgcactccgaaagcgtttgcgagatcacttgccagactataggataccttgttgtacagtttatgtggaccaattacccatgactgcaaacgggtaattaggcagaaaagcgctcgctacttcggggaaacacaaatatagcgagttcattgacccaggagccgaaacggaaagaatatgaactagccttgggcccgaagtctcctcatggacaagttggagaacatgatcatttcttgccttaggtggatattgataaaagcgataaagt

SEQ ID NO: 1984 - DNA, 503 bp, Bacillus thuringiensis
tgacagaacggaactactcaaggaagtcttcaaccctaaggttaacccactgactagccttgatttttatgaatgcatgcgctgaatgcgaaactaaatccgctattccacctttattagagagcgggccatggtgtggagatggatgctctaatacacaatacatgaagtcgtgtatgttctactgcaacaaatgttgtaccaagtgcttgagtgtgcccccagttacttatggcaataagcaagtatggccttgctacatcaactggaacaccaagagcggtggaccaaaatgcccttctttattcctatgcattactttagcatatatcaactccatgtaatgcgctgatctacctatcataatttatatatgcattggactcttccataatcacatctgttgtttgtgattatgaggtcaatcattccacagtgtactgctttaatacatttactaaccgcgaatcaactacttgagagttgtgatgtcagctcatcac

SEQ ID NO: 1985 - DNA, 488 bp, Bacillus thuringiensis
taggcgctgatgggtctaagtcgctagtaagggagttggctgggttcattacgactggatggaactactcacagaacgctataatttgtactagagagcatacagccgaaaactacacagcatggttacggatcttacccaatggcccaatcacacttcttcccattggagacaagtatagcaacatagtatggaccatggacccaaaagaggcatcagatcgaaaattgatgaacgaggatgacttcatcaaagctgtaaatgatgctctggattctggatatggtcctaatccagagactacaagttcacgggatagtctctcttggcttacaggagatacgaccatatctgccaaagagaggtttgaaactcctcccaaggttgtgaagctttcttcagagagaatgatgttccctttgtctttaaggcacgcaaaagactatgtgtcaaaacgtgtggctcttgttggtgactcagctcataca

SEQ ID NO: 1986 - DNA, 309 bp, Bacillus thuringiensis
gccatctttcgttctatttctatcttgaagctttcgtaaacgtgttcttctctctctggtctagtggacttagactcagcttcatctacattatattcaggatccactgaggattccctactttagtttctcatgacaaaacctgaaattagatggaacacaaagaaaaatgttaatacgatagtcccaacaaaaccaaaacacaaaccaatcgagtataccgatcaagtaaactgagcaagtaaaccgatcttttttttggcttggtgaattgttgatcgagtgattccttgagtgagtgaatggagt

SEQ ID NO: 1987 - DNA, 482 bp, Bacillus thuringiensis
ggatttgcgccttgggaacgcatacggaggcaacacttgctcgggttatcgatcaatttcagtgattaggcgatcccgggccatacagagatggtgggtgctttgagggaaaatgataccctcaatatcctattcgagtcggtaccacggggcaacgatgtcatcgatctctgagaacttcgcaccttttgctgaatcagcattacacgctcggattatgatttgctaaaacacttacaatgtgtgcattgcttcagtggggagaactatcgactatggctgaccggacatacacaagggaactgcttttagggtagaagttcctgcacaatcatgcaattatgcacaaagacatcaaggctacaatctggactcatactttaggagggccaacgatctccagcccttacccatgagactatatgtctctatgaatcctcagggggctaatatcctcgtggatagtacaggatgcattaagt

SEQ ID NO: 1988 - DNA, 401 bp, Bacillus thuringiensis
tgcccttaggattaccaaagcgacattgcggtccatttgcttgaaggagacgcccataattggtttttattcgccgagaaacgcagaggggactaggtccggtcctttgcggatttcgaagacgagtttaacaagaagtacttttcaccagaggcttgggatatgcttgaatgtgcgtacctcgacctagttcaagggaaccggacggtgcgtgaatatgatgaggaatttaaccgcctaaggcgttatgtgggacgtgaacttgaggaggaacaagctcaagtgcgccgatttatacgtggactaatgatagagatccgcaaccattgattggaccggacattcaactcggtttccgaattggttgaaagggccacaatgattgaggaagggatccagga

SEQ ID NO: 1989 - DNA, 561 bp, Bacillus thuringiensis
tccgtgtgtcctcaaggctagggagaaggatgttagctctcctgtctgtagagtgctcaaacctttacctttggaaatcgtcaaccattgcaaactccaggaattcgcaatgacgtaggtgctcgatatccattgctcgcggctcgagtccagcagaaatgattgggactccacaagctatcagaatcggtgtcacaacgccacctatgcacaaagcgcctcgtgctctcttgcggttattggtgacagcccaactcttgtatccacacaaatggatcagaagaagtacagctaggggtgtgtcattgatttcaccctggaggggcataccattcttagtttggcgaagagttcccttgagggccattgcgatcatctccatatcagagttagtgacagtccttgtaatctctcgggagtagagtacgttggctacagaacgctggaagtacctgatgacagggctgcgtatctgatagctctttgacctgaaagcattcaacggtacatagctgccaatggtgatccacaagtctttcaactcttatctatcatactttg

SEQ ID NO: 1990 - DNA, 183 bp, Bacillus thuringiensis
atattttaaataggcaagctagttttactgctttgcttatagagatggcagatttatacgattcaggggatgtttaagtcccacatgctgtattaaacattcattttacaaaaggatcagacatggtaaaaccctccttgtttctaaatcaagaaagttgtaattgccccattgcccgattta

SEQ ID NO: 1991 - DNA, 514 bp, Bacillus thuringiensis
gagagattctgcgtccttttctggattgaggttcaaatctaattgaagctttcataaggcgattgcatgttcgctcatgattctcactgatgttagcagaggggggaagtccattatcagaattcagttgctcgagcaacttgcgcgcattgacttctttctacatctgcttattttccctcggtagcaacagggaacgcctaccgcggtcgttagtgccgaagactgcacaagaacaggatgggtcagtgtgtaggacctatcccacttggggatctgtatgcaaatgatgcgaggacagccatctctatgtcgtgggagctttgtgggtgtcggggatagcaacagtgcttcaacttcagggcacgtagatctgaaactagagacagcacgatccagaagataaaaactagacgcagaagaaaatcaatgagctttgcaacacttggcagcacactctcggacactgaatagtaccagggccctaattcgattctaccgtcattatctacga

SEQ ID NO: 1992 - DNA, 128 bp, Bacillus thuringiensis
attcgtgatttgttttctcaatccattattttcatagacttttctcataaccttaaagatagttttcttttgatggggattggatttccggtcattcttctttaccagggtaaacaggcggattaaaa

SEQ ID NO: 1993 - DNA, 375 bp, Bacillus thuringiensis
cagaccttctggattcggttctaaagttgattgattatttggagtgaacggacacaaatgacgattaataagctctagtaaaattcgtgtatgctccatattaaacgctggaggagtttcaccgaacacagaaatagtcggtatactatcagacagaattttcagaaccgcattaattatttcctgctctgaataatgtaaagattgagcgaccggtgggggttcaataaacactgtatgaaaagcacaatagtgacatatgcgctgtcaaaacggaatatgaatatatgcagattgacccatatgtaacttactcccttggtaataagaatacctcagtactccggagggttatatactgcattcacggattac

SEQ ID NO: 1994 - DNA, 558 bp, Bacillus thuringiensis
gtgcatttgttttcgcatttcttcactgtcacctttattagttaactcaagtttatcccataatgtatgattgtcatgtgcttccacataagttaatacctgttcaggatcttgataggtagacgaatttgtatcatagtcaatacctgctgtaatgccttttttaatacgatcttccatgttttgctttccatttacaaaaccattttccttttcctcaaatacactacctttcaacccatcacgtatattatcgttaaaatgagcaatccctttcattttctctgcatttttttgatttgctttcaactcagctgcaagaggtgtatttaaatcccatccttctccgtgtagtataatagaagggtcaatttgattaacagctttacgtatttcattcatcgtttcataatcatgaatacccattaaatcaaaacggaatccatctaaattgtattcttttgcccaatatgttacggaatctatcataaatttcctcatatttttcttttgaaagagtatcattcctacttcagttccattgcaaatggtccatct

SEQ ID NO: 1995 - DNA, 426 bp, Bacillus thuringiensis
ctcgatgctactatctttgccatagcaagtatgacagctccagggttcgtatacttggaaataaagtgtcagttatatatgctgacgtaatcaacagattcatgatctaaatatagatagaagaaagagaggcgaaaactatctctactctgttctgaatctctacaagtactgatttgaatagcactcaagggagatctaagtcacacctttgtgccctacttttccaggaccaggcactactacattaatattggtatctcgttccaacacattttgaaccgatggcgaccagtggttgacataagcttgcgcaccgtttcctatattttttgagtgcgtagatgtgactaaacagtctgcaactaaaagagtgatttgcggtatccataccacaatttcatcttttgactgccctaggcctgg

SEQ ID NO: 1996 - DNA, 326 bp, Bacillus thuringiensis
taaatgcggttcctaaacgaaattggctacaagatgtggcaccctccgcagcagcaacacgagctgagtattatgatcgtaactgtgaaggttgaatccatacgtgagacgggggccactgtgcgcatacactccattacgacgttgcatgtcactgacatatttcaacaacggttgcgacgctttcttcggataagctacaacagctgataccacatgaggaacaccattatatacagataactctaccattatcggcgtcaagcattaaaagtgttacttcatgtggttttgccagcatcaaaatactacaaatactgcacgta

SEQ ID NO: 1997 - DNA, 457 bp, Bacillus thuringiensis
tcctggttctggttatggcgctgctggtcggcgcgcagaacgtgatgagcaccttcttcggtcgtggtgccgaaatcgcggccctcggcaacggggcgctgcaccaggtgcaagtcgcggcggcggatgccgtgcgtgcggtagcggctggacggctcgcctaatcatggctctgcgcacgatccccatccgtcgcgcaggcaaccgagaaaacctgttcatgggtggtgatcgtgaactggtgatgttctcgggcctgatggcgtttgcgctgattttcagcgcccaagagctgcgggccaccgtggtcggtctgatcctgtggttcggggcgctctatgcgttccgaatcatggcgaaagccgatccgaagatgcggtttcgtgtacctgcgtcaccgccggtacaagccgtattacccggcccgctcgaccccgttccgggagaacaccaatag

SEQ ID NO: 1998 - DNA, 442 bp, Bacillus thuringiensis
aagtcactttattctttgaagaagctatttttggtaaggaattaaatgtggaaattccagtagaagatccatgtgatacttgtaaaggtagtggagcaaaaccaggaacttcaaaagaaacatgtaaacattgttcaggctctggtcaagtgagtgtagaacaaaacacaccgtttggtcgtatcgtaaatcgtcaagcttgtggtcattgttcaggaactggacaaattattaaagaaaaatgtacgacatgtcacggttcaggtaaagttcgtaaacgtaaaaaaatcaatgttaaaattccagcgggtatcgataatggtcaacaaattcgtgtgtctggaaaaggtgaagccggcgtaaatggcggaccagcaggagacttatatgttgtcgttcatgtaagaagtcatgaattcttcgagcgtgaaggagatcacat

SEQ ID NO: 1999 - DNA, 348 bp, Bacillus thuringiensis
  unsure (1)...(348): unsure at all n locations
actaattatatcacaaggtccacaaacnacacgaaaaganggagcgagacacattgggggagcaagccggcgaaaccaaacgcgaaaaaaggagaaacgcagccgaacgccacggaaggaccgcacaaaaaacagaggagagnagccaagaacaggacaggcacagaaacgaaaacaggcacgaacacacggcaagccacccaaagcaaacacccgacacacacacgcaanagcgcgagngaggccangacagcaaaaaaacacacaaggcacggaaaacgcccagacaagcagccaaaagaaagagccaaaaacgaagggcgcagaacaagccaggcagggacggac

SEQ ID NO: 2000 - DNA, 283 bp, Bacillus thuringiensis
gctacgttcacacttgtttgtgtagtagcagacgcttctagacgatggtgggagctgcggctgtacaaggataagagggagggggtcgtgctcttgatgctatatctcaccctctctcttttttgataaaaactcctctatctcaacctctggaaaacgctgctctctcaataaaagctggagatatatttgtgagagcagtaaatcgcctctttacatgtggggcatatgtttagattttacagtgcgctgtcggacttgtgcactcatctcaaattgcgaa

SEQ ID NO: 2001 - DNA, 475 bp, Bacillus thuringiensis
ttgcgcctacattcagtgcttcatcccctgtttatttaacacacgctgcatttcacccaataggaggaatggttatgccatcttcagaatccacgaaagcccaaccagagtttcctactacacagagcggtacgtgcatattctggagcatgctgaagatggctggactttaaggatttcacgcacatccgctcacgcttcaaacgaaccagctacaccacaaaacgtgcgtaccgttcgagttgtcttagtaccagtatcactcatggtcggtggctcttctgattccgtaatgagcccggtatacccagactcaacttccgtaattgactctaccatcggttcaagaatatcggggcctaattgcgtcataaaatcgtctccaccgagcatctatgctcccattaatgcggtacaaggacaaatcatttcacattgaccgctgcttatgcatgaagaagcattcatattgact

SEQ ID NO: 2002 - DNA, 274 bp, Bacillus thuringiensis
agacagatgtgcagcattgatgcatcatagagatctatattgccactctctgctgagcacttttaaggggagacgctcgagtttaaagaacgcgtaacacaaggtgagacacaagatgatctactacctgtagctcttgcagatgttctcgaagcgggaactcgtgttcttgggatgcgcgcatatagcgcacacagaatgggtgggattgcctcacacgtagggaatatttctgtgatgaaaacgggtgaaggtgaaacgcttacacctacac

SEQ ID NO: 2003 - DNA, 207 bp, Bacillus thuringiensis
  unsure (1)...(207): unsure at all n locations
ccaagggccttttttacagaaagaacaccncagacaaaaaggggccacaaactcaagccacggcggggaaacaccaaaccaaaacccgatacagcgaacaaaagcaggacccggaaaaccccacgttggagcgaaagcagcacgtacaagcgcagagcactcagaaaccaaggaggagcccggaaaaacaacggaagaagaaccaaa

SEQ ID NO: 2004 - DNA, 423 bp, Bacillus thuringiensis
atccgcctcatcttctttatgaaactgcgagtttctccattacggcaatcgccgctatcgggttggtgttctctgccaggtcatcggctaccaagagagaagggtgatgaatatccgcccgcgctaccgcggaacgctgtgctcgtcccccagaaaccataaggagacgcccgcccacaatatgacctaccccaagctttcacagcaatgttatcaagcctttcacccacttcttttaatggaacatgactgaatgatcacgggcgctccacaacttaaccgactggcagggcatccagcatgctaaagctgcggaaaacaaatgcaaaccctcgtcttcggaaaatagctcacattgctctaccaaatgtgagcggatttttcccggttatcacgacatcaccagaagtcggcgaatcgatt

SEQ ID NO: 2005 - DNA, 163 bp, Bacillus thuringiensis
  unsure (1)...(163): unsure at all n locations
gaacaaccagaagagttttcgacaacacnacaccaacnaacagggaagttcgaccaaaacgaaaaggggcggcaaaccccaaaacacaaaggcgagaaaacgagggagcacggagaagagaacccagaaacaggagaagggaaaacacccgagacagaagaag

SEQ ID NO: 2006 - DNA, 214 bp, Bacillus thuringiensis
agcctgggcacgcgaggctacgcaaccaaatcagaaccagaaaactttcgtaatgggacaaccaaaaaacagacacgggggggccaaataaaatgagagaacggtatgcacaccctaaaaccagaacaaacgtaagagataaaagagccgcatattgggaagaatcaaaaaatgagtgacacggatagaacatctaccgaataaccagaggaac

SEQ ID NO: 2007 - DNA, 308 bp, Bacillus thuringiensis
ccaaagggccaaaggctgcacacgacccaaaaacaaatgctggaaacacaaaaccggaaacacctaaaccagaccaagccgaaaatgcgagaccaacatcaccaacttcgccaccgacatgaagagcaccgaaagaaacaacgcgaaaagaaaacaaaactgcgaagcgtcgaaccaaccctcatacggggctggaaacagaaggaacaccgatacccgtaccatgaacaaaaacacgaagtcctttaaaagcaccagcaaaacctaacatacgacgcacataattatagcaagaaacgcccgcaaca

SEQ ID NO: 2008 - DNA, 350 bp, Bacillus thuringiensis
taccaatacttgattaaattaaagggaaactactttctaaaaggaggcgaaactgtagctattaaagctaaaccgcataggaaggcctactaaaagcacagatggaagtgactcttctggagctaacagaatatctggctgatgctgaaaagccaattatgaaggtacgtagcaagaggatagatcaacttcgaggccaaaaatgaacgggagcaatggccggttaaacgggaactaccaatttagatgattatttgtccgcctgacagctaggtattccattgactgctttaggcctcgggtggataggctatccaagcataacacactaactcgtgccggaggtctta

SEQ ID NO: 2009 - DNA, 463 bp, Bacillus thuringiensis
tttattaaccatgaccatgctttgacgataaaacttttttgctgatggatcgttaccgacacgaacgggagatcttcagtgagcactagcttcatatgctttctcaaaagggtcaacgtcagcagctggcgcaacgtcaagtcctgggacggtcaaacggttcatattcgtttgagtacacgccgtcattgcaataatatccacacgcacttttacatgtttcagaattgcaccgcacgggaccacgcggagtagacttgcaacttcgaagctgtggtttaacttgtgtacattgactgagatagcaggatcacccagacctggaccgtgatcggatacacgtttggctttataagctccaggcaaaccgatcagaccgcgcacattattatagcaggcaacggactgtagaaatgtttcagccatatagtctgcacgtactggatcaccacgtaatagaata

SEQ ID NO: 2010 - DNA, 362 bp, Bacillus thuringiensis
attcggaaacaataccctgccaaactgtgctcaataaccagacaacgctccactataaagggggggctctttttaaagaattgattgcttgtaccacaaacgcaagaattggttcatacatactacccgctactttaaactgaacgggtaatgctagaaatatagccgcgcctttactcataaacggtacaccgacttgctcatttgcatcagcaaaaaccacaagcaaaagcggtaaatccccaggcagttctttatctgatacgctaaaacctgattttatataaaggtgagttaactctagtaagtcaataccatcttctgtttgatcaccagagtacacatacggcagaaacatacct

SEQ ID NO: 2011 - DNA, 471 bp, Bacillus thuringiensis
agagcttggttgcgtatgcgcacgtccgaaagattgataagtggaaccatctgatttgattctttctttttagccatgagattatcatcttagggggatccttctgtcgacggatgctcctattacactcggagtctctgaaggatgagaaccagctatgtaggatttacattgagaattcaagtctttctggtatacgtcattagtgcgatcctttgcaggaactacccgtgataacaaacttgcaaaatggatccgtttatcataaagagattgcgggttcctgaccctaggataccttaattgatacttgaacaagtcacagttctgtctatggtctgcgtggcgatagcattggtcttctgtgtgtgcatcgaggaatgatatatccaaacatctcagagattgatcgagagggcggaattatataaacgaaccgcactccttctgatacggcaggagtccattgat

SEQ ID NO: 2012 - DNA, 532 bp, Bacillus thuringiensis
ttcttgtttaccttaaacttcctttcattttaatgttgaagcagaacaacctttcttttatttttttttaatcgacatgaagctgtccttttcacttggtttcaatgctctcacgttgcttcttcaagtttgcatctttgctcaagccaggatttctaatgagactgatatgcaagctttgcttgagttcaagtctcaagtttctgaaaacaacaagagagaggtcttggcttcatggaatcactcctccccattttgtaattggataggagtcacatgtggccgcaggagagaaagagttataagtttgaaccttggaggattcaagttaaccggtgtgatctcaccctccattggtaatctctcctttcttagattacttaatcttgcagacaactcttttggaagtaccatccctcaagaggtgggaaggctatttaggcttcagtacttgaacatgagctataatcttctcgaaagaaggattccgtctagtctttctaactgctctagactgtcgacccgtgattta

SEQ ID NO: 2013 - DNA, 358 bp, Bacillus thuringiensis
caaataaaaaagaaggtcactccactctatctcttcattttacccatccccaagttccatagcttggagtgcgttatcgctatcccgagcatgattttcctacccccccggagggaaaggaccttcccttttgggccggatgtgggcgatgagggattcgaacccccgacaccgtggttcgtagccacgtgctctaatactctgagctacaagccctaccccgtctccactggatctgttcccatgagtgccctaaaaacaaggaacctttcctctccccagccatatcggatgagaaagtgccttactctctatacgaacggtgcgttccagggtgtgaagtgggatgatttcataa

SEQ ID NO: 2014 - DNA, 515 bp, Bacillus thuringiensis
agtcctatgtttagaaaagaaggatgtgaattcacatcaaaacagtctagaaaagacgactttctatatgatgaaaaaggagcttaccaagaaagggtcattgagtactcaattacagacttgtcatgagagcatgctgaatttgatgttgtatctactaaggaaggagaggatacgtcaattctactctatcaccctccttgagcctaatgagtgtgaggagtcaagctagacacttaaaacaagctcacttgggaggaagtcccatgcctatccttgaatataggttttatttttgttacttttgatttgttttgggtttgtttttgattctcaggaaatgaataacagctggagcaacaatagggatgcaaccaagtgttcaaataaaaaatttcaaatttttgatgaatcactctatcgcaagacgagagtaaaagctcgagtgtgcgatctagtggttttgggacaacatctttctcaacgacaatgtcatactactcgatcgcaacatg

SEQ ID NO: 2015 - DNA, 433 bp, Bacillus thuringiensis
aaagttcccggggcttcgaaaggttggccgccaattcaaaatagttttggctttttttggcccggggggagaggtttttagggggtttgtaactaatgcagtttctaggggggcaatggaaattgaaaccaaaggtgagtcccgatggccacaggggatcccgctggttgtcccgaaggaaattgcccttccttaaaagtggcataagggtttaatggcagtccaaaattgttcagctttacagtgggtaacagcttttaagccgtttcaaaaatatttcgtttaaaaaggatttttggttaaaacatataaggccgtatgggtttctgcctttaaggcgtttaaggatttacaggggcgggttaggtttatgtttgttggtgaagaggtgaaaggtatttttttcccggggaaaaaggataaaaacctttcc

SEQ ID NO: 2016 - DNA, 436 bp, Bacillus thuringiensis
ggaaacgtgtattttattgtgccatacatttattaattggtgtagcttacaaactttccaatttatttttgaggaagcttgtaggattctacctgaaatatgcggtccagaaacctaccccaaagttgctcaagtcctgttagaaagggataaccctgaaacagctcttatggtcctgcgttggtctggacgtgatggtgcatcacaattggtttcaattggtgaagctgtcacagatcttcgtgtgagagtggaatgcggtcttttgagtgaagcatgcacataccaaaggacactctgcttgaaggaaaaggaaaataatttgaacaatggagctgtagaaacatgcgtctgatgatctagacatatggagttggacggaatggatggagatactcgccaatgaattctgctgtctttctattcagagaaactt

SEQ ID NO: 2017 - DNA, 463 bp, Bacillus thuringiensis
  unsure (1)...(463): unsure at all n locations
gcttggngttgatttatcgcagccttcagcacaacctggttagacttccaagcttacactattccttttcattagctcaaagaaaaaactaacttattgaagtttttcttgtattgcaactgataatattaattgttaaccatctgtatagcactatcttcctggaatagaagttagattataattcatatacgttttcttcagccagataattttctctggtcatgtcctcaacttattggcttcagctgcagtatggcctgtcctaactataacccgaagaaaactgtaaaaattttagtgaagataagtgtagtgataagttatgtagagagttagggatgttcagctgtgaagtttcatcatatattctaaatcgtcgacccctttgtttacccctgcatttttcaatttcaggtgccatgcagccatcgcaagctggtgcggatattcttatggatct

SEQ ID NO: 2018 - DNA, 411 bp, Bacillus thuringiensis
ctgctgaagactttgtaaatcatattgcaaatgaaatagcgccaatagatattttaataaatgttgcaggggttttacgtatgggaccaattcattcgttaagtgatgaagattggaataaaacattctctgtaaatacgacaggggttttcaatatgtcccgagcggtaagtaaaaatatgatgttaagaaaatcgggggcaattgttacagtcggttcaaatgcggcaaatacgccaagaatggagatggctgcgtatgctgcgtcaaaggccgcaacgaccgatgtttatgaaatgtttaggactagagcttgcggcatacaatatacgctgcaacttagtttctccaggttctacttgaactgagaatgcaagaatactatgggctgatgagaatggagcttaaaat

SEQ ID NO: 2019 - DNA, 556 bp, Bacillus thuringiensis
attctgttcaaagaagaatcgacaataagcacttgcaatatgtataactgttaatgttttcatttagcaaaaatacttgaccacatgtcacctttaggaaaaattgctcgccggctgcaccatgattttccagacagcacacatccataacttaaaggctctacattgcaattgattctcctcacgacctttgcaatgcggggacccttttggcggatgaacctatccggactattattttgcgaacaagacggtgtaactgaactacttcttgtcccatccacaacatccactatagccaaacctccagagtttttggatttacaactagtaggttttccaccaccgtggctgttagttgccattctgttacatatatcttgagtaagcccagtagcctccgcattaacttccgcgtgcgaagtagaactcggtacatcccttctcattgttttttggtcattagtaggcaatgatatagtgtttcgtgtatcacgcagcgaatctccttccctttggcaaattggagcagcaattttggcagaagcttctaacg

SEQ ID NO: 2020 - DNA, 422 bp, Bacillus thuringiensis
gagtgagatgaaaaaccaatttcgttgtgtaaagatgagttctttaactaatatttatattttttttctgtttactatgccaagttaatacttatccgtatgtgtggacttccttacataatctttgtcttgatatctgtttcagacatggaagtgatgaaagaaagattcgcaactctgcttcttggagaggacatgtcaggcggagggacatgggagacctctgcgttagctttgtcaaacgccatcaccaaactcgctggtaaacctttaacactactaatatgatcaaaacattaaatgtctaataacgatctgaatggttaaaataagtcacaaactaattaatgtggctttggtattggcatgcacattgaatgtttgtagagcagatgaaattgcaggctatgtatccggagaca

SEQ ID NO: 2021 - DNA, 395 bp, Bacillus thuringiensis
cgattatagaacgacctattatcaagggcagatacgctctgtgtggggaagcctggattagagcgtgctaatgctcggtccatcaagaactttttagcatcaaacatatgggggcacagctgattaaatgcttcttttactaaaggtgggtgaggtctaccccatatccgcactttcgaggtgagaaaggactatacgtagtactacaaatgcttatactgctctgattggatggaagtttggtgtacagcctcataccataaccagctgttatcggtgagctaatcacaaagctggtatcgaatgcgtcatcaaaaaagagccagatcggtcgattcctttaccaagggcattgttcatgacgcctgaatatagacagactcaatttaacgatg

SEQ ID NO: 2022 - DNA, 347 bp, Bacillus thuringiensis
agacacagacgagattgcctcttacatagctgtttttttttatgagtttatcatacacttaccggggggttattacactgccgttggcgaacgagcaacgaatctatcatgctccctaaaacgaatcttgtcattcgcaccagtgtttctaatgaatcccagcactcatatattggcttgcacaacctaagccttatctatataatctgacagcactattcacttggctcttcacacttttgctacctcccggacacctattatcatcccacactgattaacgaccatcacccatggcttgaccactatttacatcgaagaccgcatagttctcatgactgaccccc

SEQ ID NO: 2023 - DNA, 412 bp, Bacillus thuringiensis
gcacccgacaccagaaccggaatgtgacttagatctttttccgcagaaggggagacacccagcatgaagggcattattaagtgaccaaataagcattgaaggggctatcacgatgcgcgttccgaaatcgaggaaacaaaacttgagagaaggagtacatcttggggggatgactcaaaaaaatacgaggcaaaggggaggtcaaaaggtcgctcggagatcaaatgagcccaaatgtaagtaattgagaagagaatggcttaaccagattagaacatccaagaaatgcaaacgctatcgtcagcggaggagacgacgcatccttgtaacataccgtacatataactgaatttagggaagaatacttatacgcagggacttctacgaaagccgaaccattcaagtacggtga

SEQ ID NO: 2024 - DNA, 407 bp, Bacillus thuringiensis
ggttagagtagagtacacattctcagtatgctaggtggttgagtattgtttgatagatcctttatgtgtttagttgttcttaatgcctattgctttgtgattaactagaatttgaacccagacttttccacgcccaaaaggtgtttgatgaaatgtctgaaccactaattccagagattcgtggccctgtacaaaggtattggttgaagggagcgttttggctttaacttgttgattcgttatgccgtgatggttagctctcgttaatggtgattgagtctgggactaggttaacttgacggtctctgttgcagtggcacttagatacgggtaatgaacttgatgactagggttaatctattgaacatgtacttcacctgtaaactgaggaaacgaaactactcaat

SEQ ID NO: 2025 - DNA, 267 bp, Bacillus thuringiensis
tggcttgtgctcttccttatggcgcattcaatcttactagggattccgtacgggacatagcttttctggtattcatccaagtggatcgattacgctcggaaactatttatgctcaacgtgcccgattactgagctgtacattgctcacacctgtaatttctgtagtgtaagccatcatgctactactgtgccctaatagccggtgcgacttcgtaagaacatccaataacgtgctgcgctacatgaaacatgcggcatctaccctgg

SEQ ID NO: 2026 - DNA, 375 bp, Bacillus thuringiensis
cagcgggcttttttctggataagcagatccaaacgcccagaaggggccgcttacagttaaaacagcatcctgaaaacccgctgtatacagtatacaccacccatattgcaacaccgagtgaacccatactgcttataattttgcccatcacttcctatgtataaacgtgaagcagacgccattgatctggtccaccaaaatgcatgccgggcatggatattgcgctaatcacctggtccacatgaagcataacctgtgaaccgtgaacacaatcaggcagaaaaacgaacaatgcgacttgccacgaatggacacaagcaatgccaacacattagcacaaaatcattgtggaggacctatcaaatatactggagt

SEQ ID NO: 2027 - DNA, 354 bp, Bacillus thuringiensis
gtattacggatgggggtggggaatttatgggagttttttagttattgcctgaacaaaacattgcggggacgttatttgagatcggtggtcttaagaggttaccagcgtctatgtacaaagcactacatgcagtgtgggatcgtgggtgttgcataggcaatggggttacgaatagaagatgacttatgacgaacatttatgaacaccgtttactaatgaccatgtgatattctttacaaacaaggtgagagtggaccagacgaacggacatcagattctagtgtttagcccgactgctgaaggactaccgcacagtaacctgttaggggtagctggggacgagaggaccaacgc

SEQ ID NO: 2028 - DNA, 319 bp, Bacillus thuringiensis
tactcggaagcaagagctaagagggctaccaatgtccaagaagctttcatggccgtgactgcagcaaccaaaaccaactaactaaccaaacattatccgtattaaaagctcatctattaattacatttgcagaccattcgttgaccaaccaccttaaccatattctgtcttgcaaaacggcgagcctacctgcaagaggatctaagccaccagcgcaccaaatccgcagacaacctgttaaccagcaatcatgctgctgctcctctaaaatcgctttgataacacctagccatattatgtcatgagcttgcatgtaaga

SEQ ID NO: 2029 - DNA, 327 bp, Bacillus thuringiensis
tctatggtgaatttttgtagcggcgttcgtttaagggggtggagcactctcaagaagatgtttatgatcttgggtcatgaacgatcctgctcaagcgatggacgattcatatagacgtgggtagagcttatggaaacagtgtgcgactgctgtcttagctggagagctacctcgattatcgatggcatctatgctgacgtagcgcatgttatgcatatatgggccggtgaagagatacgtctcccgccaaactactggtatagtgcttcgggctgaattaaaacgataatggatgatgtctttgacatcggtatgaatttgaccggg

SEQ ID NO: 2030 - DNA, 471 bp, Bacillus thuringiensis
tgatacctgctgaaatgcctaatgcttcacctccacttctttccgatcataagggcactccaaaaagcgggtcaattttacttacaccagcctttcgaaaaaaactacctccaacatcacctaaattctcatataaaataccacacatacccgcaccacacataatatatcatatatcactcataacaactaacacatccaactctggaagtccaactcttaccacaataaacctataaacatcaattataataagctccacattaaccatagcccacactacattctaacttatcagtattacaagataaaaatgagagttacaaggcaactagcctatagttaaaccaaacatgtctaaatcattaacatattctccaacacaaatctaaccagtgctggcctataatttagattgtcacacagtgtctatagctatgcatataagtcaccaaatctaaacatatcaat

SEQ ID NO: 2031 - DNA, 400 bp, Bacillus thuringiensis
atggggcggaagggtgcgtcatactccactaaacgtcaagggttttgtttagaaaggttcatggaagacgcaaggagcagaaggatgatacgtcctccctagctgatgatatcacagggcgggaaagtaccaaactatttgtgaaggcgctgcatacccgtggtacaggtcatcgtcatagagtggaggctccattggcctaggaggcactgacagggacctcctaatgcgaccacggcagagcaacatatcttggccgtcggcatcgggctagaaggagcaaccgcaggtctacatggtatgagctgcaccagcgacggagaaaaatgtcctgctggatgctgccacacactcctagcgcaacattggtggctgagtgcttgtgagcacccctcttgtt

SEQ ID NO: 2032 - DNA, 352 bp, Bacillus thuringiensis
cttatttccttccccctaacaaaggtctaatttgtatccaacaagacgatcatgtatacgtatagcctgttgtacattcactagattcattttatttgcacgaggatgttaaaaagagtctttgatcgcatttatcttaatctcattaatcacaacctaggcaattgtttcatcgttcacatttaatcgttttctcttattgccaagcaatcgctctcctttcactgtctggattcggccgcgagatacactatctttgcttttttggcccgcatactttcattcttttaatacgggtcctttgccagcgaattggtatatacttttcggctgaaattgttctttactttta

SEQ ID NO: 2033 - DNA, 540 bp, Bacillus thuringiensis
caggcgttttttgggagatcattggatgtatcatcgtatgttaagcggaggaaagaaaaataatgcggacgtgacagatacggtgaaagatcaagtgtacataagcagagatgaattgaagaagcaatggggcaataactacgaatataatttgaagaaaatcgaatatgccgattcgaaaacagtaggacaagttttaacgtatgatggaaaaccaatttcagcatccttcttttcaacgagtaatggccgaacagaaaatgcagctgactattggggaaatgattatccgtacttgaaaagtgtagatagtccgtgggatcaagcctctccaaagtttacgagtgagcaaacatttacagtagctgattttcaaaaacgtctcggtgtgaaagtgttagcagatcgggaaggttggaaatattaaagaccttacggaggaggcgcgtaaggatgtagcttttcaaggaaaaacattaacaggaaaagaggttcgtgaaagttagattacgttcttctgatttacgtggaacacaggag

SEQ ID NO: 2034 - DNA, 515 bp, Bacillus thuringiensis
ggataagtttagtgcccaaccttatcaaacggaggcgacgtacgttgtattggatactgtatttccggcgaaataattcagaatcgccggggctttttggttaggaagaaattaacataagacattggcttatatataataaatgcagaggaacattattaaacattataacatgatgaaatacagaatgaaaccacaaaccatgaattcaaagagacgaatgcattcaacaaagatgaaagaacatcgagatcaacacttagaaaacggaactttatggttctactttagatcctcaaaagcccaagcgttttcgcttacaaatcgcgtgttcttcttcaggtgtgtaatcattctcaatgttaaagagttctcgaacttactctggcgacatatctttcatgtgatctgcaacggtctggcaagtgagaccaagatgatcttggacggtgagatagatcgcatcgagaatgagtttcatgactgagtccatatcaaatactttcatgaactct

SEQ ID NO: 2035 - DNA, 465 bp, Bacillus thuringiensis
  unsure (1)...(465): unsure at all n locations
ttgtgggaaatatttatacaaaggcagagcctggatatggtgtatacaataaaccaatctttgatttagcagaaaaatatgttcctgaaaaagtaattaatttaacaggtagagacatgcaagatatatataaagtaattagttctggttctccggtatgggtcattattaatacgacgtttaagccgctagctgaaagtagttttgaaacatggaatacgagttcaggcgaagtgaaaattacatattatgagcatagtgcagtagtaattggatatgatcaaaactttgtatatgtaaatgantcctcttaaaaataatccgcgcttgggctgttccgcgagcagaatttgagaaagcttgggagcaaatgggaaaacaagcaattactattttataataatgaaaaagtcatcttttggatgngctttttttttttagtttaccatcatgaaatcagaagat

SEQ ID NO: 2036 - DNA, 360 bp, Bacillus thuringiensis
cagatcccgtgaaagggttgaactttggttcaggttcatccacaacctccgtgctgttaaatttggaaagaaaagaacacatgggaatctaacaacttgaagctgatagtaagtccatctgatgatttcatgtccatggatacatacctttggccggacccttagctgcagcaggtgctgagggacgttcacgctccttgtaatcgaggggaggtgcgaaatcaacctcacagcctggttctatgatgctgattgcgttagcaggctttgtttcaactatatctatgaaggacttcttattggtgtatggaaccatattgcgttccccactagttgggcatgaataatttcttaaagcag

SEQ ID NO: 2037 - DNA, 277 bp, Bacillus thuringiensis
aaacaaaaagaacttgttttaagaagaaaaatacaagaaactgaaagggggggaaaaagaaaataaaagggagcgaaaccctaaaatgctaggagcagcgaaaggaaaaaacgtaaatgacgcgaatgaggaaaaatgggagaccgctctaaaaggggaacaagtgaacgggcaagaagttacaccataccaaaaagaaaggaaaaaggaaaggtatcactttgaaaactatttccatcaaaatgggcaagggaaaaaagccgatacagaaaaaaga

SEQ ID NO: 2038 - DNA, 430 bp, Bacillus thuringiensis
aaactactttcaaggaatgggctatatcccgttactggtctcaataacagtaggttatggacgttgttctaccacttgcatcaggaacgtacatgctgattctcactgaaccgattgacataccagggagtcgtaggaaatctctggaaaagcatttaggtgcctcattctgaacaactttgtatgatcttactcaggctgaatagcatgtattgcctggtgctcgtttttacaattatgaagcataggtgaatgatgctaatcacattgtacctattgctcatgtggatctgtcactaactgaacatgaagtcctgcatggtgacgtgagcggacgctaacgtggtatacatattaactcaagcttgtcacagaagaagcgactgtgcaatataacttgtgaattgcaactttattgtaccggcaaaga

SEQ ID NO: 2039 - DNA, 305 bp, Bacillus thuringiensis
tgaaaaaacttatgcatgcgtgagaaaaatccgtgtacgtgcatactacattcacacaatgcgaccttatctgaaggtatcgggcagttccgggcaccagaaactaaaggtctcgagaaaattgaagggttacgcggacacacatatggttatgctggaacgacattctgaagtagatgccccaggcggctggcggtaaaattgcacattaaccaaagtatttaattctacaaagggcagataaagttgggcttagtaactttgaaggggttattacaaccgtatccagagtcagagagttattt

SEQ ID NO: 2040 - DNA, 408 bp, Bacillus thuringiensis
attttttaatgataggattgccttgtggatggtgatgttagctccctttggcatatcgctttagctttacatgaacttgaggtttaaacattgtcgttattctttacatctcgtcatcacaactatcatctcattactaactcttcctatagctctctttcggagttatatcaaaaatgagggcaaagggcaaagcatcagctcgtgttgcagacattctaaaccgcatgcaagtggaggaacctgtcaattcgaatgatgtaaaatacctgcaatagtttgaatgtcataatcaccattgatttcgctatcttgtttttgtatccttttttcactatactaaatgatgtccggtctatttcaggtgggaaggcctgaagtggatacactcattctattggatagaga

SEQ ID NO: 2041 - DNA, 290 bp, Bacillus thuringiensis
aaagcggttgaatatatgaaatattttttttctgccctgtggacacgtaaacttgggaagcattaaacattgtaagagcacgactgccgtctcctcaacgaatccgtgtatgagatgcgacaatttgtcacgcaccgaagcatgtagcacatggatatgctggctcaggtggttgtgcacaaactgcatgtgtcgagattcaagaagaatgtgacttacacagtggacaggtttcaaacttccaggtagggtcctggaaaaaataatgatggaacatttggtacaggttg

SEQ ID NO: 2042 - DNA, 584 bp, Bacillus thuringiensis
atgcatacctatcgttgtcgtctgaatgattttattataatttccttgttcttctgtcgctttttctaacgacaaagcaacagaattaacatcggccgtacgtgcagcaataagttccttcgccttatctactgtacgattggctacatcaatctcttttacacctacatcagcaagagaaaaataaatagctcggctagcaccacctgaaccaagtaacaaaatacgtttcccttgaagtggttcattactaattgactgcagcgctcgaacaaaaccaatcccgtctgtgttatagccaattaatcttccatccttatgaaccactgtatttactgcaccgattttccttgccaatgggtcaatctcatccaaatactccataatagcaaccttgtgcggagttgttacattaaatcctgaaatacctaatgcttttaaacctcttactgctttccctagcaattcctcttcaacaaggaacgcatgataatgggcatccatattcaagtgttcaaatgcatcgttatgcataacgggtggatatgaatgtccaattggatttccgattacaccatataatt

SEQ ID NO: 2043 - DNA, 317 bp, Bacillus thuringiensis
ttatatatatgaattgctgacagtaatcgtacgctttttttattcaagcatacagagccatgcgatggggtcttgttataaagtgaacggagctgcatctactaaatgaggacgacccatgtatatcatatgtacaagtgcatgtacttgttctagaaaagacttcactcacttcattagcctgctggaaagacgtgacctttactgagaaacccaatctacatgaagcgccgaagaatatggcgcatcacaacctagtgacatgttgacaacctcatagggatgaatgtgcacagcacattcagtccccttgacag

SEQ ID NO: 2044 - DNA, 590 bp, Bacillus thuringiensis
accgacgcggccgcccacgcctgcgcggccccctgggcgagcgtccactttatcaccctagctggaaacagtaccttctttgctgacaagctctccgggcagtctgcggcgtcgagtatagaagtgactgactgtgaggatgtggagatttatgtcgagacagttgggttgatgtactgcagtgatgtcaagcagaggcttatcaagcaaaccgttcctcgtgttcttcgagtcttgaaggttgcagagctgctgggtttcccagcatgtgtcatgtcatgcttagactacttggaagcggtcccttgggtcggggaagaagaggagaatgtggtctcgtctgtccggaacctgcagagcgagagctatggcgtcagtcctgtgctgaagagggtagcaccatctgatcgaacaaccccaccaaacgatacgttttcacatatcatcgaactggtcttgagaagcagcgaggacagggggcggcgcgagatgaaatctctggtgcagaagcttctgaaggagagtagcactggctgcatgagtgggtctttcgacctgtgttctgcggtcctctacagatcatgccggaa

SEQ ID NO: 2045 - DNA, 292 bp, Bacillus thuringiensis
cactgaatatttttcaaggaggtatcaagggtcaactgtatgtactaagcccatagcaggcggatgcccaagactgcattgacggcataggtaccaaatgctgcgagcattgttgtggcctactttacgagctaggtaaccagcttcgcatccaccgtaaaagttttctacgctaagaccgagaaagccgatgccaccggtggtggcaatcactgttaagtcacatacgcaatgtagcacctggcctcggccgattgcataacctgctaccaacgagataactggtttagga

SEQ ID NO: 2046 - DNA, 404 bp, Bacillus thuringiensis
tatcggatcccgagggcgtgatatgggcctggtgcagcataccaaagtctacctgtttttacagcgctcgtgtcatacccaacttcgggggcattatatggcgcgcgcatggggacttctgtataagtatgcctgaactttaaactcccggcaacatatagcggttcatcatcggctgaatcacttacgtctacagctcgatcatgcctgcttacttcccatacagacacatgattgagccactgtgctggaaatacgccttgataaccatcatcattaatatgatcacacataccacgtgtatgacgaattccacagccgcgtcctgtcatgtttaaagatgcaggtgattcgagaaaacatgtatgctgatgcgccaagcgcaccattaccaaagtctgcat

SEQ ID NO: 2047 - DNA, 293 bp, Bacillus thuringiensis
tatcggatcccggaggcgtgattgtactcatgaatccttacatcggcccccacttttttaactccttggcaccttgtacatacaatggggtgctcttcctgttaccggggggtcatcacaatcacaatcagtattgtcataccataatggacacaaaactataccgaccgtataaagcgcatccttcattgtgaccggtggaggaatgcacacacactactttgtagcaaacaacctacacctgactgacatacctacagatggagctatctcttaattaacacacaaactaa

SEQ ID NO: 2048 - DNA, 294 bp, Bacillus thuringiensis
agcaccggatattacgatgggcctacaccattatgcggaaatgtattaatggagcatacaatgtgggaggggctaccgacatgacacatcttatatgcagggctgtgacaaatgaaatggctagataagtaatagaacgtgagcaaaaagcaacaaggatgaacacttacggaacaacataagctactgtcgttataacatgtattcacgttacataagaagaggtcaatcaatacaaaccactgacagttggctggagcagatcagactggcggcttcgtaccatgaaagaag

SEQ ID NO: 2049 - DNA, 283 bp, Bacillus thuringiensis
cactttttgctttattctcctacgatttgagaggggaccggggggccttatgagaggtttggatgggttatacgccgaaagggccgcctaacaaagcggcggatctcgctgcgtataatgaagtggttgcagatcttttatctagtgattctaaacttactttcgtctaccaacgcgcggtagggcgagatgtaccaaacgatcactggtaagcatgttcacaccgtgtattttttgtttctgttaatggcttgcctgaagtgggaacaaactttggttatgg

SEQ ID NO: 2050 - DNA, 478 bp, Bacillus thuringiensis
gggcgtgatgctgctcggtactgtacacatatactccacatgatttggtggcacaatacttaaatatctctgtggggacttgttaatacacactgtggatccagaacacagctgccacctgatcaattggaggagcattttcatgatctacagcacgacagggtccgttgacttctaaagacccagctgagcagtaatcggtgatatactctatggggacacagtacttcttagagaactactaataaatactgtcctgctttcttaatatgggactagaaattctagcaccatatttcatgccatcggtgacactatacacatatcatatgcggttcatgatacaccgtcctcatatcttaagtgtgaagttcacaactgttgcacgcatgggtaaggctgatcctcttaacgagcgactgccgtaactgagcgatcagtgataactagtcctgcaacctgagagatattcatcgat

SEQ ID NO: 2051 - DNA, 431 bp, Bacillus thuringiensis
tggaattgtgatttatcctctaccttcgcgggggaggttatggggttggttgggaggataaagggatgaagatgacaagtaaaaagatgaaagatgagctaataaagaaattatcttgcccacaatgggactttcagtatgatagtgagaaagaagtcttacgtattgaacaaaaagactccaataaaggtattaacgtatcgcttccaggagttgtggcaaaatgggaagtgatcaaacaataggcaattgaagaagttgcttattacgtacaagaagcgctaattgcgatgcataaagaagaaaattagcggagcgaaaattgtacctggtattcgctctacttctttcccggaacaagcataagaaggaaatctcgttattatgacggatcatacggcggaaacacgtatttactatgcgtttgattc

SEQ ID NO: 2052 - DNA, 463 bp, Bacillus thuringiensis
tcctctagagcggccgccctttttttttttttttcacacgcagcctaaattattgtttcaggcataaagcactatgttacaatgttacccagttcattgattattcgagaattaagtggatagttcccatgttcatcacaaatgttacacacatacttgccatgcaagaaccttaaagtacactccaagcacaacgtatagcacaggcagctgcatgcggccatgcttattaattcggaattgcgcagtagttcgatctcatggcaaccacgggggcaggaaggtggccatgcatgagctagtcagggcctctgaaggataccctatctgaagggggggttcaccagcaccatcgaggggatggaaagaagttattgccattgagctgctgcggctgcacttaaaaatgccgctcgttttgctcccacgcatgctgccataaacctggtggctctcctccagt

SEQ ID NO: 2053 - DNA, 279 bp, Bacillus thuringiensis
cacgcctccccgcatcccaataaaaaattctctctaacgttgttttcaggccgaccgtgtttcgatacacaaactgacataaacgatgacagcgcgcgtaccgcactgcaccatgatcttgaactggtgggattcctactgaattcgcgtaattagacctgacgctttaatttggacagggccattgtagtccttcacatacgctggaccacaggtatatatcagttgaggcctttaactaacgggacattctttattaatgggatgctaaaggattgc

SEQ ID NO: 2054 - DNA, 608 bp, Bacillus thuringiensis
  unsure (1)...(608): unsure at all n locations
tctctgcacgcccggtccggaattcccgggtcgacccacgcgtccgggctgctgagggtcgtgcgtggcactcagcgccacttatcggggctgcccaagcaggcggctcaggtgccgtcgctcaggacggcaagaaaaggaagaaaaagaactgtggcaacgagaagccgcactccgccgctctggtcgtggcagctgcgactgggggccggggcgaccgcaacaaacgcccacgacgaccgaggggtaacagcggcacatgccccgtgcaccccagcggtcgccatagtgccgcagaatgccacgagatcatcgacctcgcgaaacgtgtcagcgcgtggcgcgagcagtcttccggggatggctccccacctcgtcgccgactcggcaaggaaaaggccgacgacaaagaggtggccgtggccgaaccggacctcgggtatcaatcacccgagggggtcctgaggatgtcttcactggagactccaattccggtgaaggcaactagacggaccaccagggggccccgtgctacttggcctgcggggccgaagtctgccttccccncgganacccttctggactccccacgggtccaacctttcgat

SEQ ID NO: 2055 - DNA, 551 bp, Bacillus thuringiensis
  unsure (1)...(551): unsure at all n locations
tgcttggatcctctagagcggccgccctttttttttttttttttttttttttttttggcctcatttgcagttttgtctggctgcagtttggatattgaaatcacacagtattcaaagtgaccatagaacaataattcaaaccgtacaactacattccaaatcatacaactacaatttaaatcatggacgaaattttcttcttcttcggtgtcattttgcgtacagctatcctagtttgccttggaggggactcagctacccttgcagaaggctgcgatgaaccggcgtcttccaatgcatgagacaaggcgagtggtgtctgttaccgttcaaagctgtcgaatcaacactcagatatggtctgcatccttgaagaaacccttttatgcatggtccaaaagcacagaaaaacctactgaaaaacacctttccatcctcttcttgaacatcaatctcaataacactatctggcattttttccaaaaccgcctncttccaactaaaaatagtcaaagctgtcctcccagcaccatgcaaataagaagggcttt

SEQ ID NO: 2056 - DNA, 120 bp, Bacillus thuringiensis
aattcatgatgtgctcctctttttactatatctgttgcatgcatcacaaaaatttgatctgcatggtgacttgtagataacctatgcgccatggatatagtcatcctaccttgacgcata

SEQ ID NO: 2057 - DNA, 592 bp, Bacillus thuringiensis
  unsure (1)...(592): unsure at all n locations
agccgtgtcccctagttttgttcgacggcgatgcagtcctatggctggcagagccggccgccgtagatctagctccgcagctcccagatgaggtggatgtggaaccagacggagtggatccggcatccccgctgctcgtcgttagccccagcctcggcgtggatcctgccccaccactccctctcgattgcaaggtggatcgacacagagatgaccccttccagcccgccgtggagacgacgcttgccttccagtctgacacggagaggatcctgctactgcgttctctgtccatccccaggacacaggtgacagcgatgacagatcggcatacttgtacttcaagtgccaggagaaggaccaccactcccactagctcgtgggttgctggactagctcttccaatcttgatgaagaaaccaaacatgggtgccaaagagttacaaaaagagttgcaagacaaatggaaatgtaccatttcctatgacaccgtttggagggaagagaaaaggcctttcttgatttgcatggtgcttgggaggacangcttcgactattatttagtcggaagggagcggntttggaaaaaatg

SEQ ID NO: 2058 - DNA, 275 bp, Bacillus thuringiensis
gaatgcgacattttgtactgcactagcggtgtaaccgctggggggtcgacagcgactcattgatggcacgcttaccaatacagcgaatggcacggtcaatagggcggcagcatttgcatgccataactatagacgcgcgatggaccatagcggttcaagaaagcagagggacttacatagacagctagaccgtgtatttttacttccgatacactgtcattgagaccaacatgaattggagacttgagtagactacacaagacatattgatgatc

SEQ ID NO: 2059 - DNA, 374 bp, Bacillus thuringiensis
tagccatgaagtctacttgctatttgataaactcactcttttttccataagcgttcaaatgctgataattattgatctctgctcgatctaggaaatcatcatatgtcgctgtatagagtgtcactacagcgaagcccaaatggaaaatgacatgaacaccttagtttataaactccggcgcatgagaaattaataagaatgcatgaggcctttccatgaaacaactggtagaccaatgaaactgtccaacgtcgaaatagttgctacgtccatcaagcaataatacttcaggctggtcaaggtataaccttgcaagacgtacgctttgtacgtagatcaccacttagtgcagagacatctcgatccaaaccaaa

SEQ ID NO: 2060 - DNA, 287 bp, Bacillus thuringiensis
gctaacgccctcttctaacgcttgccacgcttttgttttacaccaaatgcgagcaggcctcatggatacactttgtaatgcatccctgtcttccaaatcgatgctggcaacgcactcgtttcctagcctgatgcagatactactttccctatgccgatgtgcatcttacctgttcttgccttttactggcttgagaccacattgatagcttgaggacgtcgcaactactacatttcttctatcctctaactgcagcctcattgcgcaatgaccatctagctgctttc

SEQ ID NO: 2061 - DNA, 292 bp, Bacillus thuringiensis
attcggatatagtatcggcacttggcgttataccctttgttgtcaaatcgaaatcgcacaccttgggtgcgttaatttaagggacgggtccataggaaagccatgcccatgttctacatttggaatattacaagcagggctacctttatctggtgagtgcaaagccagagccttctgaaccattattaacgaatgcttattggttacacttgagacatacataatgggggggcagtgggcttacaactgtgatatctaaaattgttggaccaagacatgcctctaccgatgc

SEQ ID NO: 2062 - DNA, 435 bp, Bacillus thuringiensis
caaaaacggtgtttacacatcatagctgacagatccaaggtgtgtgtcctactgaagcaacgtacgactagctggaactcggcgatgactatacccacagtgagcagactgagctgtatgggaatgcgaactctatgaaggggaccagtactgggctttagatcaaattacacatggtgagcccctcatatacggatataaattcacatatgccgactgttggtgagaatgtagatggaggactgcgatcttataaagagaagcttagcggatttggaaatgggagagattcgagcgtagataaaccagaagctgacgcctgtgctaaggctcaatatgatgcactgatcaacatctgaaaagaggggcccatagcgcggattgtaatgacttgcacgattgccagcatatgaggagacacgaataacctctatg

SEQ ID NO: 2063 - DNA, 169 bp, Bacillus thuringiensis
cgcgacgaacatttctcaatgatgacccctttgggagctctgctatgtgacgctgacttatcccgcattgactcctggcaagagctgctcggtcgccacttacactatcctcttaatgactttgtttgagtactctccagtcacaaatatgcttcttacggttggcatg

SEQ ID NO: 2064 - DNA, 373 bp, Bacillus thuringiensis
ggactccgtaagaggtgttacgtgtatggtatctgatttcagtattacgaccgtctctgctatataaagaagagcattatacctataaaatgattggtcatatcaaacatcaatatgataatgagaggcgtaacctataatgatacttgaggagattacaagggatttacgaccactaggatacaatagagctgctagaacggaagtacagttcacatacgctgctgagaaagtaaatgttgcagagtctactctaggtcagcaaagacctgcattagagcatgaatgaagagtgcctctctacgagggaattggttaaaggatatctataactgaagcagggaagggtttgttatcgcatagacataccatc

SEQ ID NO: 2065 - DNA, 406 bp, Bacillus thuringiensis
ccacacgtgtggagagagctccgcggcgcgctagaagctcgttccctaatgcatacaaaatacgtttttcttacccatctcacataaccgtgcaaggggggggttgtgttgcaacgtggggtaaccaaatcctacgcgccatgcacagctaactacgaacgaatgagatatcctatgcgccagctgcccataaaccatatgcttctactccgcctaaacgatcgattccagggaacgcacttgtatatgaggaatatatgccatggacaactagtgcgtatgctgtaagccatgatgatgcatgaacagctcaaaaacgcgacagaactcgcgatgccatcccatcaggcatagatgaaccatgcttgcctgctgtaccaacaataatgattcgaagaggcaattc

SEQ ID NO: 2066 - DNA, 214 bp, Bacillus thuringiensis
gctggacttgaactatgcgcatagtaattgtctggtttaatttttttagcaggtgttggcgctccgcacaggccgacttcatgttgtccagtcacgcctgattatcgtgtattgggttatgttgatttttataattgttttaacactttggaagcatgaccacattctttacgattgttgcaagcttttgtcaaactattgctctcccttgtta

SEQ ID NO: 2067 - DNA, 525 bp, Bacillus thuringiensis
catgatcacaatctggacctaactgtaataactccactaaacacgttcaacatgcggggggaaaaagacctactacgggcttctgaaaacgcttcatgtcctgcatccaagttaacattgcatcatcgacatgcaataactttggccacgctgctacttcggctccctgacgaactgctatatgctaatggcattctattattacttcaccattgaccaaacggtccccattttggaattcctattgttcatcaaaacgacaccacctatccatacgcgctggaatctttctaaagtcatctaatacacgaaatgccttctaccgttgtaatgtgaaatataaaattcaattatcactaatgaaaggggatgggccaaactgaatcgcatgaagcgataaagttccaggaatatataagcgcatacggtgtgcatgacagtctatgtaactaggaactccatacttgccataacatataatgacttcacattcatggcggttcactggcaagcttttccccttca

SEQ ID NO: 2068 - DNA, 207 bp, Bacillus thuringiensis
tattacacccccgtgatgtaccccccgaaccacactccacctccaacgcccattaaaaacactttcgcgcgggtccccacccccatatcacacctctaaccgctcacggccgcaacgatcaccacgacaaactccacacggaacatacacatccggaaggaaacgcacaccgactacaataacccccatcaccacggcacgcttcac

SEQ ID NO: 2069 - DNA, 392 bp, Bacillus thuringiensis
ctgtggattaaacgcttctgggtcagctacatcctttttgttcgcgggaacaggccagtccgtcgtcgaagacacataaggcgtcgccgtagttcagggacgctggatgcctactagatcccatggatgttacagttgagtcgatctcagcaacggtaagagccttgacaggaatggacccgaagcacgcattccattgtttatcgcttttgaaggtctccaatggagggcagaagtatgccgtaacgacaacggccaagagacactcgtacggcgcgcacactattgtaagaaagacttggttgatgccctacgactcgcaagcagtcgctttaccgatgggaccacactaagacaaaaatgcagcactgccatatgcatgaccgatgaca

SEQ ID NO: 2070 - DNA, 457 bp, Bacillus thuringiensis
gaagtggtgatgcaacgaacacggccgagttagtatgtatgctttttgaataacgcaatctatgggagtggcggtggacgatacgtagcgtctccgaagtatacaagatgctgacattgaggagcacggtataacgccgaatacgattcagacaggcgttagtgatgctatccgagccacgacagctgctgatgaggctgcatcatctaggcaacttcattataaacgcattaggagggcctagcgaggcgggatggttcagcatgacggagcaggaatgctggagactgcgagcgtgccgctggactaagagatgcactattagagatggaggtcggtgtgtgataaaagagatgtagagcatggattttatcgcagataaggtgctagtgcacatggcttaaaaagtattggtgtagccatgcctagaaagcagttagacggtgcatcgggattg

SEQ ID NO: 2071 - DNA, 630 bp, Bacillus thuringiensis
tcccggaccgagccaggcgtcctctcaaccgacatcaagtacaccggctctgtcttttggcatgctatagggggcagccaatacggggagtctgtttagcaccagggggccttaagttttttcaacaccaacatttcaaccatggcaccgtgctcaaacttcgaacttattctccttccaacctccaattcaaccagcttctacaggtggattccctggtttttccaatactacaaaccaagccttgatgggacagccaactcctaccctgtccagtatggtcatgcagcctgctcctgtttcaaatccatttgggatgcttccagcaatgcctcacatgtccattggaaatggtggatcttcaccttcagttcaatatggaatatcaagtttgccggttgtggagaagcttcttccaagtagatcattgtccatggcgtttcctaggcatttggcacagagaaggataaaactgctgccgagaaaatataatccaatatctgatggcaaggttccattctttgctgatgatgaagaatctccagcacaccaaaggcagacgctttttttgtccctagagagaacccaaggaatctggtaattcgttcaattgagcagtggcctcgcgag

SEQ ID NO: 2072 - DNA, 508 bp, Bacillus thuringiensis
cgggccggaattcccgggtcgacgcaggcgtccgggccgccctttttttttttttttttttttttttttttggccaacatactcttttcaatctatataaagcacacaaatcatatatatataagtatgcgtaaataaacccgcgtttctgatgatatggcctggccggagggtacaatagtagtagatgcaacagctaaattcacacgtacaaatgcacgcacacaggggtggcactcacaaatatatataccctaacaggtgcactaatcacaattattaataattaagcaaacgtacgtagagttacttgagatctcgatttggcacatgatataactgcatgcgtgatctatctcgattgggggccgggcgccgccaggtatagcgctgatttcatcatccgagctggagggttgtaggttgcagctgatgggagtagtgctgaggcatgctcacttgcagaaagtttctcgagtcgaaaggggccatgtggtcgtactcgctc

SEQ ID NO: 2073 - DNA, 405 bp, Bacillus thuringiensis
ccacgtaagcttgtatcctctacagcggccgcccttttatttttattcttttttttttttttttttttttttttttttttttatctttttcttttttttttgggtttcttttaatttattttgggcctcctttctaacttatcttccaaaaccccaacccccaacaccccttttttcgcccaaaacaacggcacacccaaaaacacccccccccccaaacccccacaaccccccaacccccaaccccccccaaacaaaaaccaaccccaccgccaaatccccaaaaaacccccgcgccaccacccccgggctcccaaaaaacacaaaaacaccaacaaaaaacccctaaccgcataccccccaacacaaatggggaccccaccccccccccggctgcaacccccc

SEQ ID NO: 2074 - DNA, 605 bp, Bacillus thuringiensis
  unsure (1)...(605): unsure at all n locations
tgcacgcccggtccggaattcccgggtcgacccaggcgtccgattcatacttcgctcttgtcctttgcataggttttgtatcccattgctgattctatcaatatcaacaaagagatttggaaaatgtattttgatgaacttcttccaagattggtgaaaaaaggaagtgatggtaatgctggatccagtgctctttgtgacacgacctgcttgcaggtacagatgatattcatgttaaatcctacactcagttttatggtctgtttggttcctttagtcctgggactaaagttgtccctaccaacaggttccaaggactaaaagtattcaaaacgcattaaatgactttataagaataccgaaatgccccttaccgttctaccgtctttagttcaactgaaataaatgatggacaaaaggtagaattaatatgttttagtcctttttagtcaccccttgaggggctagggactaaaataatttagtctttgttttagttccactgtttgtcaatttagggactaaatgtgattaaaatagaaggactaatctttaatncctggaaccaaacagacccttagttctttgggtgcacatccactttt

SEQ ID NO: 2075 - DNA, 629 bp, Bacillus thuringiensis
ccggtccggaattcccgggtcgacccaggcgtccgcccacgcgtccgcgaaggaaaaacaacttttaatgacgtttttagggtctattttgctctgattttcacagcttttggagtttcccaaacaagtgcaacggcaacagattcaacaaaagcccaggaatccaatttcaatactaactattatagacaggagatctaaaatcaactcgactagtgatgaaggcgtgattatagaaaaagttgatggcaacatagatttcaggcatgtaagcttcaaatacccatcccgcccagacgtccaagtgctcagcaactttactttggccattccagcaagaaagactgttgcacttgtttggagagagtggtagtggtaagtcaacaataatttctttgctcgagagattctacgatccagattctggtacaatctcactggatggaacagaacttaaaaaactaaagctgagttggttaagagaccaaacgggcttagtgagccaagaacctgtacttttcaacaacacaattcgcacaaacatagcatatggaaaacaaggagaagtaagagaggatgagatcgttgctgcggccaaggcagcaaatgctcatgagttcaatctagct

SEQ ID NO: 2076 - DNA, 652 bp, Bacillus thuringiensis
  unsure (1)...(652): unsure at all n locations
cgccccggaattcccgggtcgacccacgcgtccgacgaaggtgtcaaggtattgatggcagcaggtgatttcttcagagcagcagctcgtgaccagctaggagtttgggctgagagaactggttcagagattgtcattgacaatgacaagaaggcacagcctccagcagttctttcgcaggcagtaaagcgcgggaagcgtgaagggtttgatgtggttctatgtgatacatcaggaagacttcatacaaattatggtttgatggaagagctggtttcttgcaaaaaagtcctagctaaagcgcttcctggtgctccaaatgagattttactggttctcgatggaacgactggcttgaacatgttacagcaagcaagggagttcaatgatgttgtaggagtcactggattcatcctgacaaagctcgatggcactgcgcgcggtggctgtgtggttagcgttgtggatgagcttggcatcccggtgaagtttattggggttggtgaagggatggaaagacctgcaaccttttgacgccgaggcatttgttgaaccatcttcccatgattntgggttttggagagataatttatgctttactgaaagctttgactctcccgtgttttgctcgttggcaggtttttttttgtgg

SEQ ID NO: 2077 - DNA, 641 bp, Bacillus thuringiensis
cggtccggaattcccgggtcgacgcccgcgtccgatatgcttggaaggttgcttcatgttcagcattcttttgcaaagcaagctgtgattactgcaagtcgaccttttaggtcgagctggtattagtgctgctgaaatgggaatctcattcccactgaaacgaagagatcagttactggagtacgttttaactctaatgggtagggatcaaagtaatgatctcactgatttcaacactgagcttttgcacacacagagccttgctttaagtgcctgtactactcttgtctcgctagaaccaagattgccaatggaaacaagaaaccgtgtcatgaaggcaacattaggtttttttgctttgccaacagagccctcaagcattgttgagagtctcgtaacaaacctaattattctgttaggtgccatcctgcttacaagtggtgaagatggtcgaagtcgagcagagcagttgctgcatattcttaggcagcttgatccatatgtatcatcatctctggaacaccaaagaagaagaggatgtgttgctgtacaggaggtgttaataaagtttcgcaatctttgttctggtgattcggtgcatgcgcttctatccaacttcacaatgaataaacaatcgatcg

SEQ ID NO: 2078 - DNA, 529 bp, Bacillus thuringiensis
ccccgtcgtagcttggatcctctgagcggccgcccttttttttttttttttttttttttccagttaatttttaatgaaaaattctattgctgtacaccacaggaaaaccaatacagtacggcaaaatgtgtcaacactaattagcccttggagtagcaacaaggaaaacatttggctacctcttatctaaaactgcatccaaaggctctgcaagaatggcttgacacatgggttacgaaatgttgaccccgtgccatatagttcttccgacattcaaatacctatctacaaagaacaccatcactatgcctcaaatttacaaagaactacaatagttggtatttctcagaattgttatcgtatctattgtaattccatagacccactctttagtctctccattcgtgcttgcagcccagatagagctcgctcatccatgggtggtatatacttccgtgttggggttcaccgtcaattcgagttccccatgcaccatatacttccgtcatacttgccaacggcgagcctg

SEQ ID NO: 2079 - DNA, 652 bp, Bacillus thuringiensis
cggtccggaattcccgggtcgacccacgcgtccgcccacgcgtccgatttgaacgttgaaaacaaccttttctctggtcccgtgcctgtgaaattactgaacttgccaaacttcaagaaggatgggaacccattcaatacaagcatagctccatctgcgcagcctcccatcgcgccaacaccattaccgtctatcccaccttcgtcagggcatgtcccctcaaaagaacctgcacattcttctagtgttccaggtggtagtacttcaggatcaggaaaacatactacactcaaattagttggatatattcttattggagtggtattagcagtagttcttgtgctaattgcaatgtactgtttatccaagtacaaagaaaaaaggtcgagagatgatatttatatgaaaaacaagataggaagggtacctcagaagcttggagagcctaaaatcaaggagccaccattaaaactcaagaatgatgctgagaaagctccgaatgttgtttctgatggaagagaggagcataagttaaaagtgccaacatcagaaacttcaatgtggtttatgatccaagtccaagggatgggcagaacttagattcatcaccgacagctgtacctttgcttgtacaatgaataaaaagagcatg

SEQ ID NO: 2080 - DNA, 310 bp, Bacillus thuringiensis
gagatccatggattgatccatacatattaggaggatgacatgctttcattctttggaccgtgaaaaagcctggaggaggagtgcgcttgcgcacgtgttctaccgcatgcatatacacattgagcttacgccggatgacaatgctcgaatgatcgtggtgtaggacatgagattcatcaccgcgtatgcacagcgtttatccaagaagcgcaaaaggttgcggatataggtgtgctaacaaaattagcggacgaagttggactttctgaggctgcatttaacgatgctttactagctagtacatataaag

SEQ ID NO: 2081 - DNA, 409 bp, Bacillus thuringiensis
ccgggtcgacgccaggcgtccgcattatcctgtgttctagccatagaggccccattatcttcctctctgcgacgcacgataatgtgtgggccatttcaactcaagccgggttcatggaaaacagcgccttattctactgtgggtcccttgccaacccacccagccacgtcataagcactgctcggcgactgtgtagaaccatgcctacttcaacgatccttatgcccagtaattctgctttactgtcgctgagattcatgcatctgctccagcttgtgcaccgcctccactgaggctgccctgccatgaccgagccaaactaaaggtacgtattgtcaacaattggccagcggaacatgatgaataaacacactggaccgtggtccgtgaccaacacattccggcacat

SEQ ID NO: 2082 - DNA, 571 bp, Bacillus thuringiensis
cccgggcctggaattcccgggtcgacccacgcgtccgggtgtgcgtcttttcctcagcagcaaccggagtgcttctgctcgcctgctcctcctcctagggaaaggacagcggcggcggcggcggcggcgagaagttgggcctgaagcccggacgctttctcccgagataccgcaatactgctagagcactgtcactaatgtttgcttatgacaatggagtcacctacaactgccgctggtggtgaactggagagctacttctccttgggtttgacagtatcccactcacagaaagataatgctgaatttccaaaggttctgttgcttctctcagcgtatcttgacaagacagttcagcagaatgaagagttactagactccagtaaaataaaggagtcgaccactatctttcatggtcagagggtgcctgaacttagtataaagctgtatgcagagcgtattttcaagtatgcaaagtgcagcccatcttgctttgtgctagcacttatctacatggagagatatctacaacaaccaaacatttacatgacgtcatttagggtcatcgcct

SEQ ID NO: 2083 - DNA, 619 bp, Bacillus thuringiensis
ggccccgtccggaatttccgggtcgacccacgcgtccgcggagatcgccctcgtccaggcgcgctggagattcttgttcgcggacgagtgcctgatgacgaggatgcgaggagatgtccctggactaccacttcaccgtggagcaggaagtgagctcctccgtctgcgccttctttggattcaacggcaccgccggcgtgtggcgcatctccgcggtgaacgaggctggggggtggaaggaccggaccacggtggaggacatggatctggccatccgggccagcctcaagggctggaagttcgtctaccttggtgacgtccaggtgaaaagcgagctgccgagtaccttcaaggccttccggttccagcagcacaggtggtcgagcggcccggcgaacctggtcaggaagatgctcatggagattgtgaccaacaaggacgtgaccatctggaagaagatccacggcatctacaacttctttgtgagacggaagatcgttgaacacataatcacctgtttgttttactgcgtcatcatcccggcaaccattttcgtccccgaggtccgcatacccaagtggggctgcgtctacatcccctcggccatcaccccttctta

SEQ ID NO: 2084 - DNA, 481 bp, Bacillus thuringiensis
agaggtgtcatctctagcactgctaataaagctcttattttttggcgcagcatctagttccttatgagcagtttcattaattctcgcacgtatagaagcttaacctaccggcattgcctgtacatcaaactcatctgcactaactgtaaaatactgcggatactaataacactgcaaaatgcacgtacaaagatgcgatccgcacagacctaagctctaatgcagccatatgtgcttgaggtaacaagaatttaagcatctaccatgaaataatataccaataaggatcaaacttatgtcataggttttttgactataaatgatactgcatctgccagtaccatctcgcctgatgaacttgatggctatagtaagatgtacactcctactgatagatctgacaatgatgctataccatctttatctgactttacttactgtactactgctgcagctaaatcacgcacttgaaatactacgc

SEQ ID NO: 2085 - DNA, 630 bp, Bacillus thuringiensis
  unsure (1)...(630): unsure at all n locations
ccgatcggaactccactcctcttaaacgacaccacggcttattcctcagggagaaagctcacctacgtgggcggcgaggcgacgcatgagtgggaatgatgtcctgacaggttttactacacacgtacgcataatgggtttgctgaagcgactgccgacagactagcggtggtcacaggaggaaacaaaggagttggcctaaaagtatgctggcagcttgctctgacgggagggacagggatgcttacagcaagggatgagaaacgaggaaaagatgctgtctagacccttacctcagaatgccaactaccaaagtatgatattatatcagctcgatgtcagaaatgaccctagtgccaccacattggccctgcatgctgaaagaagatatgggaagctcgacatcttggagaacaatgcacctatatcacgaattcgaagcagatgaagaaggcctgaaagctctcaacattgatgcagagacatggacatatggcatggcagctaatcttctgaagaagtattacagaataccaatgatgaggcattgaactgtctgaataccaattactatggatgcaaacggntacagaagccttctccactctgagctattacataggagagcag

SEQ ID NO: 2086 - DNA, 612 bp, Bacillus thuringiensis
  unsure (1)...(612): unsure at all n locations
ccccgtccggaattcccgggtcgacccacgcgtccgcacccctcctgcatttcaaaataatatctccctgcttttttcctagccctttgtcatccaaggatacaataaacaaccggcgcttttacacccccgccaagaacaggagcaacaacaataaggctcctcgcaacaatccattctcatccatggcgaagctcatgaacaagctggtcgattcgttcgagcacgacgagatactggacgtcggctgcgtgcgcgccgtgctggccgagctcgtcctcaccttcctcttcgtcttcaccggcgtctccgccgccatggccgccggatccgacgggaagcccggcgacgctatgccgatggcgacgctggcggcggtggcaatcgcgcacgcgctggccgctggcgtcctggtgacggccgggttccacgtctccggcggccacctgaaccccgcggtgacggtggggctcatggtgcgcggccacatcaccaagctccgggcggtgctgtacgtcgccgcccagctgctggccttctccgccgnctgcgtnctccttcgcttcctcagcggcggcatggtgaccccggtgcacgccctgggcaggggca

SEQ ID NO: 2087 - DNA, 683 bp, Bacillus thuringiensis
  unsure (1)...(683): unsure at all n locations
tccggaattcccgggtcgacccacgcgtccgggcaaagtgtgaaagggaaacgcgaaaagaaacgtgtcctggtcccaagtcacctgccatactgaacacgattgatcgcagaaagaaacacgttctggtctagactgacagttttggagctggagccggccatgcgctcgatcagagttccgctgcagccacgacctctctcccgaacgcgcacgagaagaccaggtggaacatatgcaagcaggttctagagcaataaccccatgaatccacatcgggggtctgcatctacacgggcgtgtactccgcaccgctcccctccggccccgaccgccgtgtgctcgttgtagccggggtcgacctcaaccacgacgacgatgcggtctccttgccctaggctcgacctcctcgctgacctcgccctgctccacctcaactcgcgatgaggattgtcggcacgttcacaccgcgccgttgcagaacgttggagcctctcagaactctagaagctgcctaccaccacgcaccctaagataggggcatatctgtgttagtcgcctgcacacatactgaaatatgggcatatccaccatgtattctactcttantatgtagataggctttacttatcattactgatctgtctgttttagcttcattagctngtcacagctatgtagag

SEQ ID NO: 2088 - DNA, 652 bp, Bacillus thuringiensis
gaggccccgtccggaattcccgggtcgacccacgcgtccgcccacgcgtccgtcttgatttaatcacgggttgtgttgtcatgccggccgggtcaccccgttcttcttctcttccacgagttcaggaggtagagtgagagagaacatggaacgacaggggatggagggcaacaatcttctgcattttcttgataccccgagcgcccattacagaaggacatgcgacggatttgaggcccaacacggcggcgatgaacactctgagacatcagatactgatccggcgaatgcaagggaaatgctggaatatttgttgaaccaaccagcaaacaaaatctgtgcagactgtggctctccagatccaaaatgggtggccctgccttttggcacattcatctgcattaagtgctctggaactcatagaagtcttggtgtgcacatatcaaaggtgatttcagtgaatctggatgagtggacagatgatgaagtcaactgtttagctgaatcaggcggaaattctgttgtgaactcaagatatgaagcctttttacccgaaaacaaaaagctaaaacaagattgctcaacggaggagcgtaatgatttatcaggaaaaataccagtttcaacagttgtgtgtgaccacattttcatg

SEQ ID NO: 2089 - DNA, 308 bp, Bacillus thuringiensis
ttactggtaagaaaactggcctaacatagtagctcggctttaaccgatggagctggtatgcctgaagttagggatggccgtgagaaaacattacatcctaatattcatggcggtctatcaacattgtgtgattacgatacacatgaagcactgtagattgagttaggtattgagtctattgactttgatgatggtcacttatgcccatttaaagaaacactcgctatgtctgatgtaacatacgctgatgcaaatgaaaatatcgatatcggaggcccatcaatgattcgctctgctgtgaaagaata

SEQ ID NO: 2090 - DNA, 377 bp, Bacillus thuringiensis
cgtgattgcatttttgctgcaattgagcgaagatgttcaggttcttcattctgaactaagacgtctccaccaggaagtgctgtttccaccatgagtgctcccgcttcaacacggacaggaataatagaatgattcgcaccatataacttatcagcgccttcaattcgaatcgactcagttccagctccgagtacttcatctgccatggcatgtaagaagttagctgagtcagcgttttctggtgctttcgctgcgttatcatgaatcgatgtccctttcgctaatgcacactccaacataatgatctctggctcgcctacgcttgttacgcctaagtagattttagctacttctagttctacctgaacatatgcctc

SEQ ID NO: 2091 - DNA, 625 bp, Bacillus thuringiensis
cggtccggaattcccgggtcgacccacgcgtccggaacgggatcatcagggagaggaaggccgccgtggtaggcaaggacctgctcagcgtgctgctggccaggatgcgggagcagcagccgctagcggagggcgacgacactaggttcaacgagactgacatcaaggcacttctcctgaacctcttcacggctgggacggacacgacatccagcacggtggagtgggcgctggccgagctgatccggcatccggacgtgctcaggaaggcccagcaggagctcgacgccgtcgtcggccgcgaccgcctcgtctccgagtcggacctcccgcgcctcacgtacctcacggcggtgatcaaggagacgttccgtctgcacccgtccacgccgctgtcgctgccccgcgtcgccgccgaggagtgcgaggtggacgggttccgcatccccgccggcaccacgctgctggtgaacgtgtgggcgatcgcccgagacccggaggcgtggcccgagcctctcgagttccggcccgcccgcttcctcccgggcggctcgcacgcgggagtcgatgtaaagggagcgacttcgagctcatcccgttcgcgccggcggagatctcgcggcct

SEQ ID NO: 2092 - DNA, 100 bp, Bacillus thuringiensis
tatctgatgttttacaaagctttctttttcatattgcagaaaaaatatatttcagaggttcaaccgtttttctatcacagcggttattgagaccttctgg

SEQ ID NO: 2093 - DNA, 188 bp, Bacillus thuringiensis
  unsure (1)...(188): unsure at all n locations
aagcaatctccaattagggagccaggactttttgtttatgaanaagcagatgcattatatgaccgcgtaggacatcacgtgctggtgagtgatcaacatcactaacctcgcagtatcaggcgtatcgaaaaaagaattctcgattgaccgtgatggcgtgttacttcgaaaaacctgtgcatgaacta

SEQ ID NO: 2094 - DNA, 362 bp, Bacillus thuringiensis
gaaaggtttttattgtatatgaatcagccaacgcaagacgagatacggttagtttcagaagagctgtatcgtcattcaaccctttctctattggaagaactcgctaaagaattaggtgatgcaaaaagaaaaccaaagattacaggaattgaaatagctaccatatgtagccgggtcaggcaacgtacagcgagtgatgctcgcgtgagactatgcatttaattacacgccgccacaagtccctttatgagtccagaagggcttaatgaacgctttgataaaaaagccgttgaattttggaaaccgatatttgctgcattatggaacagtaaacttgggaaaacatcagccttttcaagagc

SEQ ID NO: 2095 - DNA, 536 bp, Bacillus thuringiensis
cttggatcctctgagcggccgcctctacgagtacgccaacaacagtgtgaagtccacctttgagaggtacaagaaggccaacagtgactcctccaactctggcacagttgcagaagtcaatgcccagtactaccagcaggagtcctccaagctgcgacagatgatccacagcttgcaaaacgcaaacactaggaacatagtgggagattccatccacaccatgggcctcagggatcttaaacaaatggagggcaagctggagaaagccataatcaagattagagctagaaagaatgagctgctatacgctgaagttgactatatgcaaaaaagggagatggatctgcagactgacaacatgtacctgaggagcaagatcgctgagagtaatgaaacggggcagccggcgatgcacatgacgatgggagcgccgccgcaggcgagtacgaccacatggcccctttgactcagaaacttttgcaaggacatgcctcagcactactccatcagtgcaactacacctcagtcggtgatga

SEQ ID NO: 2096 - DNA, 401 bp, Bacillus thuringiensis
tgcacggacttgtttaccagcaatcgtctgctacgccgacggagacaggtgacgcgcccctacaatttgacatgtataccggatggggagcacgcggtcctattcatgctagctatcaagcgtctatatatagagcggtgcaggcaacacacacttaactttgctcttatggccgtaggcaaatacatgctaggctatgatgcgctgccgacgttaatgatatgaggaccagcccaggaaccaacagtgatgtacctgtcgacaaaggcagttactcctgcgttcgaacatgaacaggatcattcagttgatgtgcaaacgcagaaggtgatgctaacagacgaagggatgacgaaagcggaggaagcgatacatatcgagaacttatgcgatgcaaaaca

SEQ ID NO: 2097 - DNA, 522 bp, Bacillus thuringiensis
cggaattcccgggtcgacccacgcgtccgcccacacgttcgctatgaccttgcctgagggccgtttgttgagtgcaatgcagagaacaaccctggggggtaacacatcaaacatgcgtgacgctgctattgacgctgccatttccactggaattactatacctgataattgccgcaagatgagctacaacgttagcttcatgtctgactccacctagcgatgggctgaggcattgcgtgagatctcagggcggccggctgaaatgcctgctgatagtggctacccagctcacttggctgcactttaggcatgctcttatgaacgagctggtaaggtaaaatgtctgggaagtgcagacaggactggcagtggcacaatcgctggagctggctgtcctcctggagacgatgttacagaccctgctaccttcatagccctgagtattggacaggtatattgaggtctagataaaaagctggctcaaaggaagcattatcgatctgtgaattggctcatttacta

SEQ ID NO: 2098 - DNA, 267 bp, Bacillus thuringiensis
aatagaccaacgcggggtttattgctttcggtcacggagtaagactataggcaaggatcccatccctacgcgagcaccgtgagaaatagcaaaacagccagccgaccagaagcccatcaagataaggacagaacctactcgatcaagacataattgaaaggaccaaactgttacgcaagggaatactatacaaagggagcatacgaaataaaccctaacgggagtacatgtacgaatcttatgcaggcttttatatagttaagctca

SEQ ID NO: 2099 - DNA, 225 bp, Bacillus thuringiensis
aagcattggtaattttttttccaagattagccatttatgcttcaggcggatcgaattcttcagattgaattggcttggtcccacgtggatataccttgtggtaattctcagaaccgtacatccggctgattgcctgttcagcggttcttagagtgtctgaagccgtatgcgtggggataggtcgtgatttatgccaatgtgaatattcaacatcgagtctgctta

SEQ ID NO: 2100 - DNA, 531 bp, Bacillus thuringiensis
  unsure (1)...(531): unsure at all n locations
ggagtccagactatgcggatccaatgacatttattgatatgtttgaatcgaagagcccgtacaaccaaatgagttattcaaatccaaaatacgatgaaatggtaggaaaagcaggtaatgaattaatgagtgatgcgaaaaaacgctgggaaacgttagggaaagttgaaaaattattccttgaagaagatgcagggttagttcctttatatcaaacaggaagatcgtatgtaatgaaaccgaatgtaaaaggaattgtgaaacataacatcagtccagaatatagctttaagtgggcgtatgtaactgaggatggcggaaaaaaataaagtgaaagcatttcaaaagtggctgagctgcttttgaaatgctttttagtatgtataagggaataaatctcgttagtctattgagaatcgggtaggtaattaggaaggttctatcggaggaatttagagaggtcagtaagtagtaatacagatgataggtagagacctcatgctaatangaaaaatatagaacgtagtaata

SEQ ID NO: 2101 - DNA, 253 bp, Bacillus thuringiensis
cgatatacattggttcattcacgaatacacgaatccatgcagtcggtagtgagatagcatacattatcggacaggaaaagtacggaccgctgacatatgctgaaagagctttcgcattatgggcaaagtacaggccggaggctactaagcgtacccgacatagttatggccatcacaccgcatgagcttgtcctctaatagccatcctctgggacgtacaatgagtacagctgaaaacagattacatctacta

SEQ ID NO: 2102 - DNA, 340 bp, Bacillus thuringiensis
ggttaagaacagactctacaacccggaccaaccaaggattgaagcttactttgaacatgggagctatcattataaaacgtaaacaaatagtacgtacagtacggattagtgagctggtagtacgtgatcaggggaaacaggggaacttatcgacacatgtgaatggggtccaaactgggaagatgactgatgaggccgacatgtaacacggattgctagaacgactcggatacgaaacggaagctgggactaacacagatcttgaaaacgttaggatgatgtatgaacgacgcatatgagaacaaagtatgaatcgatcttgcggacaatatcgtccact

SEQ ID NO: 2103 - DNA, 296 bp, Bacillus thuringiensis
gacgtgctcccagaggatctgtcgtgaccaggcctttctttggagcttatcgggcgaacaccagatatggaggacctatagccacttgatgatcatgctctagttgatgttctaacgaagccccaatatgcccttgtcttgcatttccaaaggctatgggagcttgacgaagcgtgccagagcatagagagcagcgctctgatcgaacattgcgaaaaaagcaaaagaccgtagcacgggtgccagtggacttagttgcatcattgaaggccgaatgcgcgacgtaatggtcgaac

SEQ ID NO: 2104 - DNA, 547 bp, Bacillus thuringiensis
  unsure (1)...(547): unsure at all n locations
cgtctgcaatcaccttcgcacctttatttaacgtatgttttgatatgaaagggtcccaaatcgcccatgcatctactgatcctgattcgaatgcaggctgcgcttcatctggttgtaattgaatgacatttacatcttttgcatcaataccttctttatcaagtgctcgatataataaattaaaggcactacttccttttgctactgcaatttttttaccttttaaatcttttacactcgcaatcttactatctttttgaacgagaattccagttccttttctcgcataacttgtattggcgatttcggtaaatccaatacctgctgcttgcgctgaaatgactggagaattccctacttcaccaaagtctaatcggtttgatgcgattgcttcaaaataaggaggtccactttggaactctgtccatttcactntaactccttcttttttaaactcctcttcaaaccacccctttttctttgctagtaatagcgggcttaatcctngttgtataccattttgattgttacatcttctttctactac

SEQ ID NO: 2105 - DNA, 463 bp, Bacillus thuringiensis
taaacgaatgaaagagcataactgaatatgtgtgtctttcagagtccacggaagtatgagaatagggtccggtttcgcacatgtaatctctgctggagattatatgggaatacgagaggctggtagggggtgcgtatgtttgaggggcttgggatctactgtatacacaaaaaattttttacctattgcgccataattcaacagggtggtttcttcatacggggcgccgtagactaggatgagcgtggttgaagctaaagctttgataagaaactgctatatataaattgtcaagtgcaccactcggtgagaaaaccggccatggaaccccaatgcacactgcaggagactgacttgcttttggggttagataggaactatccgcctggaatacggattgaggacttagatggattacaatagaacatggtgaaccatcctgtggcgaatgctcttctacatg

SEQ ID NO: 2106 - DNA, 484 bp, Bacillus thuringiensis
aacgtcaagctgttcaaaaagcaattgaagaagaaattacggttccgaagaagctcgccaggcagaagaggctcgcaaacaacaagctactaaatctgctcaagcaactcaagcggccccaacaccacatgatacaaacatcggtggctttatcaaaccagcagctggatcaaaaacttccggatttggtgtacgttctttagataaccataaaggaattgacatcgctgcttcgggaacggttccaattatcggcgctgcagatggcgttgttattcgttcagaattatcatgctagttacggaaacgtagtgtatttatctcaccggatcaacggaaaaacatatacgacagtatatgctcatatgaatagccgttctgtatcgaatggacaaactgtaaaacaaggcgatcagcttggatttatgggaaacacgggccaatcatacggacaacatttacacttcgaacttcatcttggaga

SEQ ID NO: 2107 - DNA, 171 bp, Bacillus thuringiensis
tcagacgataatatatctgctgcgcggccgcgttgtcgttcgatgcacttacgggaagcgtctgtgggtgtgtacagcagtggagtgtgccacactggactggacgaagcgaataatgatgcaggggacactgacagacgcaatcatggtcatgagggtgtaggcattgtt

SEQ ID NO: 2108 - DNA, 278 bp, Bacillus thuringiensis
aaagagactgagagggtgagcaacagaagactaagctggaggtgtaaaagccgctatcgcaactgatgcagttccttgatgcggagaatcatcaacagcgtgtgaaacgctaaaaaatggcttaggaactatcgatactttgaatgaataacgctggaatttctaactgcggcaaggagagagaaccagacatcgctgatggggaaaatatcattcaagtcaacttaaagggtgaatgctctgcaacttgtgcagctttaccgagcatgatggagcaa

SEQ ID NO: 2109 - DNA, 313 bp, Bacillus thuringiensis
gctcaaactaactctaattttggcgccgtcatattccgtgatttagagcgatttaaaaaaaccaacgctcgacccgggcatggcgtgggagatacctcagtactagaagcagcagacagattacgcggatgcttgcgttcaaacgatataggggatcgtcacggtggcgacgagggcactagactcttaccagagagggactgagaaaaacgtgccacccgtatagctgaacagatggtgactattgtaaacacaccatccttcattcatggcgaagaactctctatgacaccacgtctgggcatagggatgt

SEQ ID NO: 2110 - DNA, 387 bp, Bacillus thuringiensis
tcattgatttggttttctactattgattctccatcatggggagaaatagttattaatgccccaaaccctttccaattatcatcagacgaattagcgctattccgcagaaagcaattaggatgtgttaaccatgcatttaatcttcttagcacacttactgtaaaggacaacatcatgtggcggcagactttagatggggcttccgtgcaagaagtgcacaagccgtagggggagatagcgatgcactaaaattccacaggtatgttgaattaaagaacgtttggaatatccggtggccatgcccaaataaccagcgctcgtttgtgccattggtaataaggcggatttattacttgcagaggaaccaacagggaacttggactttaa

SEQ ID NO: 2111 - DNA, 495 bp, Bacillus thuringiensis
cgtgtaaaattgttattggtggaggcgtgtctaagctgtttatcgctattagaaccaattcaacgctatttcgagcaatacgctttctcacgtgctgtaaagagcacgaagttagctattgcaacacttggtaatgatgcatgtgttatcggaggagcttggctcgtaaaaaagcacaaatacgaagcgaagatgatataaggtgcgaaatatgaaaagaggaagggggaacccttactatttttgtgggaaatgtcgctgtataataatgcgtaaacgaatttagctgctggtggatgccctatatatataacagtcatgagcgttaaccatcctaaaacgagtacagcttgcatttgcaaagaccgctcgcgaaaaaggttttttcacgaaatggtctaagcgtctcaaatacaggtaacagagtgactagtgtaaaagttataacatgggccatacaatatgctcctatgtctacccatatcttattatgag

SEQ ID NO: 2112 - DNA, 385 bp, Bacillus thuringiensis
attccgaggtcggacaagacgcggtggctcatttttactatgcattgaaggacggcgaaaaactttcgataccgagcaccactctactgggaagaacggacataaataaggagtgcgcaaacgttctatatccgagggacagaaaataaggatcgcaatgccgattacaaatgccatgtatgcagagacctggccaagaatagctatagaccacacgaaccggagtccctagctctaagtcatagcatggtgtagcatatgctccaagcacggacactgctacgtacgaagttacacatcgcacagacagacctacctcaagtgcaacccgaccaaataagatagcggaacacaaccctgctgccaactataacagcagtcggag

SEQ ID NO: 2113 - DNA, 546 bp, Bacillus thuringiensis
ggtcaaatccttctggtgttctttctcctgttttttatgctttatcaacaggatcaatatcgctggtaattatatcagctgcatccgtatctgttcttgcaacgataattgtcggcactcccattacatctgctgcaaggcgtgcagaaattaaattgcgtactgctgtttgcgttggtagtaatacttttccgcctaaatggccacattttttctctgaagataattgatcttcaaaatgcacacctgatgcacctgcttcaatcatacctttcatcagttcgaatacatttaattgcccaccaaatccagcttctgcatctgctacaatcggtacgaaatagtctgtatcatcgcttccttccatatgctgaatttgatccgcacgttgaagcgttcgattaattcgttttactacagcaggtacgctgttcgctggatataaactatggtttggatacatatgcccagaaaggtttgcatcagctgctacttgccaaccacttaagtaaatcgcttttaacccagcttttacttggtgcatcg

SEQ ID NO: 2114 - DNA, 349 bp, Bacillus thuringiensis
ctgaagatcagttttgtcctctagggcatcccccatcaccggagggttcatttcatcagacgctgcgtagtcttctcgcccaaaacaggataacccgagtatatgcttcttcatgtaagtctcggcgcatccggttggaggataccttgatcaaagcctgggtccgtttgcagcttcagggcttaccttcaatgcctctggatccactggaaaatctttcgtcttgctgacctttctgctgaaaatggctgttaaaccaatgtttaacgttccatttaaatactcgactcttaatcggtcgattttggattccacctctgcctacacaagaggaggggcgaacttacaa

SEQ ID NO: 2115 - DNA, 166 bp, Bacillus thuringiensis
catgtgaactttttctgcgcgagcacggcgtatacctttgcgcggaaagtttaagattagacggacgtgagtgcatgagcggatggtggttctcattccgcggagcgcgccgtataaacagtagaacacttaagggaaggctgctagccctttagtacaacacgac

SEQ ID NO: 2116 - DNA, 416 bp, Bacillus thuringiensis
aattattgggcatcaacaacatgtttttgaagggaagatttcatggtatacgggccgtgcacattcatatccaacgtctggttctatacagcactccaggtccaggatagacacgcatagcctgagcgatggctgcgagtaccagaacgcggtattgcctatggaaggctgatactcacacaaagaaagacatgagcgatgtggtcccagaagcaaagatgcatcgacacctggacccaataagagaggaggtccaccgtttcgatgtggtcccgcatgactgtgacctacctcagttacatagtagagtgctgactttaaatggggcgaccacaagcgatccatacgatgctataaacatacgcgatacacagcaagagtcaagacccctgaattgcacgcactcgcagaagatg

SEQ ID NO: 2117 - DNA, 254 bp, Bacillus thuringiensis
acgtatccgtttacttctcagggatataaacaggcggttccaaagattttaaacaagggcaaaacgttagcttctaaatcaaaaacgggaaccgtggacctcaagctgaaaacgtagtcaaactctaattttatagctgatgatggccaaaaggacggctaatgccatgctttttttgcgggggagaaagctttttcagagcctgcttttatatgatatagatgctttttcaatgttacaacggggaaaaaatt

SEQ ID NO: 2118 - DNA, 360 bp, Bacillus thuringiensis
gttagcgtttgcagatggagttgcgggcattttaatataaagcgaccgggatccggcacgatctggttattttaaacgcccttctcgttctgccattaatggttcagagccggggtcacccagtggagcaaccgcgttttcactatatgcgtacactccaggttgcccaagtggatccacgccttatttgaagacggtcatcgcacatgcgtatttgaagaaggatacgcggcaatgcgactggggcctcatttagttcaggaatatggacgatccagtgtggtgctcccccgtcggtgtgtgcaagtgaggcacgcgcgtctgcagttcgtgtcaacgaagtctacagtttcaccagca

SEQ ID NO: 2119 - DNA, 430 bp, Bacillus thuringiensis
  unsure (1)...(430): unsure at all n locations
ctgggtcaggngtgtaaaagaaaacgactactacatcaaatagtggggaagaaaaaaaatctgatattaaatatgcagcgaaacaagtattaaatcgtacggaaaaccaagaaattccgacgatggatacttctaaatctactgatacattaggttcgcaaattttagggaacacgatggaaggcctatatcgccttgataaagataataagccaattcctgctgcggcagagtctagtacgaaaagtgaagatggtaaaaagtatacgtttaaactgcgaaaagatgcaaaatggtcaaatggtgatcctgtaacagcgaaagatttcgtttttgcgtggaagcgcttacttgataagaatactgcagcagaatatgcatttattgcttactattttaaaaatgcagaagcgaataataaaggagaaaa

SEQ ID NO: 2120 - DNA, 343 bp, Bacillus thuringiensis
gcggatcaggattgtacctcaaagggcctccatccatcctagggggtgatttaaacaaggtagcgtttgggaatctccggcaaacacctatcgcaactttgatgcaagggataccggcatattcgggaaacgctcgaatcttagagcggcgggaataaacagcagtgcccatcaacaaaggataggcacatgatcacgactgttgcgcaaaaatgctggtagctcctgaagcgcgtcaagcgtcggaagaagtaatgcgcgcgtagcgtaagcccgcatggggagggctacaaagagaaacaatcttactgtctggcgcgccgctcgagacttcaccgggaat

SEQ ID NO: 2121 - DNA, 301 bp, Bacillus thuringiensis
atcttcacataatccttctcaaaacacgcgttaattatctgcaataccaacaagaaccgctggaacaggaggtgcatttggcccacccgcagaaactccaaacgctgttggctctagtcctgcaacacgtgaaggtccaactgagcttactaacgttatcgatgtctctgcagcaataaatccgacagcctgtaagcgcataatcaaatgctcactctattgaaataccatgagctccatcagcgaccgcttgagctaagtcaacatgctccatatttctcattggcccaagccataatgc

SEQ ID NO: 2122 - DNA, 420 bp, Bacillus thuringiensis
aaagcgctatcttcaagagtccgccgtatatttgcttttaagcactaattgagtactccttgggcaagtgtaccattattacctaaccctcaaactctagctgtgtcgtcggaaatggatatgaagacgcttgtagcacacgcacggtaggcagtgggacacatgctgttcctttcttacgattaacaccttacccagcgcgttgtatggatcattatagccatctcaatgagggaattggttgggaaagttcctcacaccacaattagtattaattgtcgatgagcattgatgaatggctacgatcagaacacttggagcgtcatattcgccgattgctgtctacaaagaaaaagctttatttggtagatttattcaaggctacctaacgatggatgcagtcagcgctctcatatttgg

SEQ ID NO: 2123 - DNA, 356 bp, Bacillus thuringiensis
tagaagagtttttttggtgaattgagagctcaggagatagcgggggcacgtttgagatatacgaacgcgataaccccagtaaaagcggcttgggagtacaagcaaaagagccagccgagacaggagacgacacgcgaagaaggttgaaactaaagggttggtctggaatgggcagatcggagcagggcgggttgaacgatcattcgatactgtaggaacgggtcgcaacattgggattgggataattgctggactgatatgaccagtgatggtcttaatctctaatacaatgaggattacaatatatgctcgttaaacaaaaactgaaatgatgaaactggttggcgcaacaaact

SEQ ID NO: 2124 - DNA, 370 bp, Bacillus thuringiensis
tgctgaagatggttgacgactaaagcagatagaaagcattttttttcccgctttgcatggactgaggaacaggttgctgttcgcgcacaagggataggtactgctgaacttccacagaattggatacttagtcacacaggagagccatagcaagtcatgacgcgtatgagagccactcttaattggaatgaaccggtgcaagatatacaaactcatgatttagacacatcattacctacactatttgaagcatatgctcatactccaattattgctgaatttgcaaatttagctcgtgtgcttcggtgtgtcattcagcatcaaataaatttgaaggctgctactgggttaacagaccagtttgtgaaac

SEQ ID NO: 2125 - DNA, 203 bp, Bacillus thuringiensis
ttgcgccgtccgttacacacaccaaagcttttatctcctccagaagcacactcgctttaccgcggggttatgcacaatacactatgcctcccgcaaactgtggcaatagaactccaaaaaccaccccttcagaaaggtcgaattcataaactgtcgtcggtatatcagacgccacatcagaaagcgcgtaaattttattttcc

SEQ ID NO: 2126 - DNA, 391 bp, Bacillus thuringiensis
gtctcctatcttttgaagagacgcgcttcattgctgaaccatttgcagtgttaacgcaaaaagatgcatttgtcctgaatacagtagccaatgaatatctactaagcggaattaaagtgcgtgttgggaatcgcatcaatgccggtagttaacagaggagaacggtctcgcattcagcgtgaattaactgaagaacagatcggggcgctgcacatgcgcatcagagccgaagacatcagcgaactgatgaagcaacaaatttgagtatctatcatctccgaaactgaatgtcagtgatgttggttcagctatccacgtcggtgagcggcataccgcgtgctcatactcttgctaacggaatggctggggaacttgtatagttctctaacgg

SEQ ID NO: 2127 - DNA, 315 bp, Bacillus thuringiensis
ctgcggcgtctgccgcactctacagtgcggttatgctcgccgagtgtccactcgctttcccgtgttgtagtgtgccattgacttggctgtctgagcactgtggcaatggggctgctaaaatgacttctggggaaggtgctcattcatcatctgtgccggatctgtctgccgccccatcagtaggctgggaaaaggtatttgccgctacctctcgtgcaattttacgtacgtattggttgacgctgatgtacaggtgttcatatgcaccatctggaagcattggaacgagctcgagaaccatggtctttaatatca

SEQ ID NO: 2128 - DNA, 229 bp, Bacillus thuringiensis
ctgcggcgtccgtagctctcttcagagcggttttctctgcggagagtacactggcttcaccgaggggtattgtaccatacacttagctttctgcgccctgtggcaagagagctgcacaaattacttttgtggaaggtcctcattcataaactgacgtggagctgtcagacgccccatcagaaagcgggaaaattgcacacgccggttcctttcgtgcaactttacttac

SEQ ID NO: 2129 - DNA, 236 bp, Bacillus thuringiensis
agaaagcactttatatcccgcccggtaccgacgaggcacaggggggcgtattaaaacaagggatcggtaccagacaaaagccacacagatggagcgcaagacgcacaggcgaaccagaggaaggcatgaaacgcatgaaagccatcagacatgggacagaaccggttcgagacattcgcaaacaaaggtcaagcacaacatgacgtccacgatcagaaacgtaagctcatactccc

SEQ ID NO: 2130 - DNA, 174 bp, Bacillus thuringiensis
cgtgattgtagtacccaatgaaattgaatcggataacatgacgacggtctttggatgaagctcccacagaacactttacgggagcgattaacaattagcttgcccaatatgctcatgactgcggatttaagtgtcaacctcgaatcgcatggcaaccatattcctatgggatag

SEQ ID NO: 2131 - DNA, 430 bp, Bacillus thuringiensis
agccttactccgagccgctgtttctgcccagaaacgtgacccttttttgcacgctttctatgccaagaaacgcatacaaggaaagcactaccatgtttgaataggagctgccactagaaagttgtgaggcttcatctgtgccattctaactcacaggaacacacgtatctgatgccctcaatattcaaaacaggctcagggcctactatgtgttgatcgcctcttaggggcacgtggcgcacccttctgggaactacctatatataaagctcctcttgccttctcataaacggtcattttcagcggtggatggactccgtctatcggttctcctgctctagccgccgttgaaacaacagggatagtatctgctgaggctactgttcccttgcttggcgcatatgggtttgatggcgtatagttatactgg

SEQ ID NO: 2132 - DNA, 375 bp, Bacillus thuringiensis
agaatggaatatgacgaaacaagaattacactatatcgttgtatattgctaggatatgggaatcactcctttggagtgacgctgctatctacagcgcatatacgtgtgaagggctataaggcgaaactttacaattaaagccattcttaggagataacatgcgcatctttacaaagtgagaaatcgtaccaggattgtcgaaatttgaagagcagtttgttgcttactacaatactagcgcaaagcatattgagcaaagtggtgaaacttaacttatcaccatacatgcagattctattgtcggatgaccgatgcataggccctatcgcttgatggacacaactgacatgcctaaagttttttcacactacaaac

SEQ ID NO: 2133 - DNA, 438 bp, Bacillus thuringiensis
tgatgatctgggggaagtgaatgtcgtttaaacggatttgtatcgccctgggaacggactaaaacacggggggactttatatactcagggtctgaattacgcacgaaaactgtcgcaacaactggttcatataacacccgacctagtggtacttaggcagaaagaatcgaatgtaatagaccttcgtgtacaacgagctaacgggatactaaatgacggaacaccgatggaggcataacttaaatgaaactatagacctggagcaatgtgtactaccacttgaggcgccatttgcatgagcgcctcaaacacttcatcggtataacaagccgtgtctactaaagtcccttcacgatatcgtgagaagagcgatctaagcgcacgtggtacaccgtaaatgtcttttaggtgaggctaagaaacaagtttatataaatt

SEQ ID NO: 2134 - DNA, 489 bp, Bacillus thuringiensis
gacgaagaaaatgtaagcattagtagaagaaattataaaaaagaaaacacgccgaataataacacgggaagaacaggttgaaaaaagaagagacgatgtaaaaaaaaggcaaaaaaaggaaaaagcgggagtaacagaagaaacaggataaaaggatatgaaaagggatgaaacagaaatgaaaaaagtcggagaaaaacgggatgaggaaacggcaaaaaataagaaaaaagagcaagagttgacaggacatctaaaaatgacaacgctgaatacaaaagatgcgaaaggagcaaaaaatcgaaacatggaaaatggcataacgaggcaagagatagaacagaaaataatggcagtaggagcacagcgactagaggaaaggaaaaggccgataggcagaagaaagtgaaaaacaagatgcaaaaaagagaggcaagtaagggaagaaagcaaataagagccacaagacgaacaagaagctaaaaacaa

SEQ ID NO: 2135 - DNA, 351 bp, Bacillus thuringiensis
ttttaaccaccaaaaagcgacccacgggggggtttgattgcagctgctccccctactgaccctaaagaaatctgcagccgcaaacgagtgccaaggcaggatgctaacagacagtcacggcagaaaatgctcacacgcgtgcagcccgagctcacattaaccgaaagccatgaaaaaaaacatccttcgacgaggggaaggggataacatcagggcactcagagggagtcgcgaaagagacagccaccagagaacaagggcaattagacgggaaagaaggcatacgaccgggaaccaaacgaggacaagacgcaaatgtgaagggggctggacgtcgagtggccctctggc

SEQ ID NO: 2136 - DNA, 345 bp, Bacillus thuringiensis
tgatcatcaccccgctttactaatcaacacgcccagagcccgcggctgtttggttatattcaagtactaccgcattcttcaccacaactgcagcacatagtgtactatacgataccaaatgcattcgcacccgcgccatgctatattgctgagctgcaaatgatgctacaccaagcagcattgcacgtaaatctacgcaagtaagacccaatttacgatcagtccactcctttaatgcttagaatgccgcatcgagctccttatttggaaatacataaccgaaatgtctcatgtattccgaaaacgcatgacggccagagtgtttcccaagtacaaagagatctt

SEQ ID NO: 2137 - DNA, 218 bp, Bacillus thuringiensis
gatctcgttttttatgactcgagccggtgaacgggctgtaacggcctggcttcctatacaccctgatccgggcccgatatcaagttatttggactcaaggatcgacgagtgctcatcgtggagcgccacaagcgacgaatggcctccatcgggcatgtctggcatggtgcgaatgagacgatcgatcccacgctggtgtaaagcagtcgaaggctgat

SEQ ID NO: 2138 - DNA, 248 bp, Bacillus thuringiensis
acagcttttacttctgcgaccgacaatacctgcatacgtacgggttgactatacagatgagaggtcatacggcccacttccggtaaggtgaattgagccatggctagccgacccattacggtggagcctgacctagagctgactactttgcgcccaactgtaccacgaatcgctctacttaacattgacctggatgcgattgctgcgaacaaactaagcatccagtacagcttaccaaatccaacaat

SEQ ID NO: 2139 - DNA, 308 bp, Bacillus thuringiensis
caacaggcttttgttttggacgaggatattgcaaagatctcggggggcattgaagaaatgattgcgcaggtactgcggtaattacaggaacgagagctggtccgagacgaaggacagcaaaaaacaatactgtcgaacttagtaaaactaggtcagacgatcgataataccacatgttgattcaggaaacgtgcatcatttagaccgtgcggatgcgatgtatcgcaagatgttacacaacacgcaaggcgtagcgaatgcgcagaatcgacatcaataaccggcagttcattatgcgggcaactgat

SEQ ID NO: 2140 - DNA, 334 bp, Bacillus thuringiensis
ctagagttaatactgatatactcttgactgggagtcttttctataacacctttcggaacgcacatgaaagagccaccgaaccacactgatgagcggaatgcacagaaattgttgcctgctggcgggactactaaaagcgagatgatcacggaaaagatgttctatctctttacaagcgctatgtgtatctgtggagacgacacactacagcttctagggctactatcatgatgaggcatacaaccatggattcgtcctgatcagactcaccaactgaatgtcgtagctgagcttctggaatacctaaattatcaaatgttgctttaattctatg

SEQ ID NO: 2141 - DNA, 530 bp, Bacillus thuringiensis
gacgcgtatccatcggatcccaattcgcgagagccatacgtttgcggctttcttcacgctcacgttattattggcccccaattggttgtgtgtcttgcgggcctattgaaatcatgttgcaagtggcctcaagggataaccatgcagtaatactagagcgataccgtgatacatgttcgactgactacgtacacgtgggcgagagcgatattgcgggcatttttcttaaggaaatcattggtacggcaatccagctcagccatagacttcgcaacatgctagctgacgcatcgcatgtaccgctagaatgattccattttgaaaaataggaatttgagagcctaatgctgcattaacttgaccaattaatttatgatgaccacgatgcatcatacgaatttgtggcgctggaagtagcgcagccatactcgctggctcataaaaatgaacacgttgctctagaattaacaccgactactcaagggtacgtaatcaatacctgcttattgatcattatgacgcacacgctg

SEQ ID NO: 2142 - DNA, 403 bp, Bacillus thuringiensis
ttttggcatttggagcaagtaatgccagcctttgttttttcttcaaatgccatatagcaaagcgtaatcctctattacatagccatagcatgaatggtctcttctaaaaaaaacaattcgacccctgtagcactggtagctcgtactttgaaagaaggagtaaaatatatctatcgtgtaccaccttgcagaggctgacataccgctcattgcgcagagggtccggtatttcgaacgccataccgtatagcgtggtctatacaggttgcactttactcagaccaataccaaaagcttgatgggagaaaagcaccgtgtgttggtgcgcgactagcagcacaaacattcgagaaacgtggctgagacagctcaaggagtggccctatgacatgaacgatccctt

SEQ ID NO: 2143 - DNA, 272 bp, Bacillus thuringiensis
ggacgccttacatgtcaggtgaccagcacgcctactgaagcaggctctccgtaagctggccggggcgctcaacaaatcacatacaatcggactctctatcaagcaaaacagagataaagtctgagttatgagcggaaaccccccaacaactccatgtggacacgcgtcgaaaccctatgcaactgttcttcttgactctcgtggtgcgaccctaccaattaccggatacgacatcgtctgttttcaatcaaaaagcaaagtactttataata

SEQ ID NO: 2144 - DNA, 423 bp, Bacillus thuringiensis
cccaatcatatactatgtaggatcgttcgcaatttttaagtaacagacccttatccccaacatgtaattatcacattatacaatccaagtcagtttaaaaactttagataaaaattgattctggtactgatattttcacagaacacggtgtttctccataatttaaacaacgcgcaaaataaaaatgtttaacaacaatctatgccacttgcccatatgttaccaagacacatgaccttatcgaagctaaaaaaacggaagggtatcatgtaatttatatcggaaaaaaaaatcatccatatccataatgcacatttggtattgcacctgacatattttcaccttattaaagaacccatgatttaaaaacataaaaaatcccaacacataaaattttaatttacaaatcaaacaactattatt

SEQ ID NO: 2145 - DNA, 264 bp, Bacillus thuringiensis
acaacagtaacatgggtgtaaggaatgggagcgggggaatttacgacttcaaccccggggacagtacgaaaaccgttcgtgaaagactccagggcattgcggagacacgcgcaaaatacggatacaaagcataaactggagctgttctaacaatctacacgacgagcagactgatgacatcatgatgggtgttgaccaagcgctaaaagcacgcgcaggacaaacgactggcactgcgattgaggcaaaaggggcatgacacca

SEQ ID NO: 2146 - DNA, 143 bp, Bacillus thuringiensis
attgattgcatatctctaatgaatgagattcgcatatttggtcggaaacgacgcatgatataaaagcgcgggatctctgctaattaagttgccattcgtttataaataatcggttgcatattggcagcgtcgacaggtgattt

SEQ ID NO: 2147 - DNA, 268 bp, Bacillus thuringiensis
catcggaagttatttacgcacgtactggggggggacgatcatattgtacacccacccaaacgaaggatgatgtatgaagcttgcgggtgagataacccacacggcgtcatatgtcttgttgtgaaagaaagtcgaaagataggtaagcggcgtgaatatattattcaacatattgtggagcattatgaggtggtggggtatcctccagcagcaatctactactttgctgtactacgagggtgttctgcgggaggagaagaagaaatct

SEQ ID NO: 2148 - DNA, 547 bp, Bacillus thuringiensis
  unsure (1)...(547): unsure at all n locations
gaccgcgcctgatattcaatccaactggtcgccaacggcataatccctccttcgaaatcgaaatacaagatccatcattgtctcaacgcacgataatgtcaactacccgcggacagtatacgacaccgcgcgcacagagaaggaggcgcgcggagttgcatatacaaaggctaaacgcatgttgggaagagatagttttgtgattctagatggaatgaactatatcaaggggtaccgataccaactttggtgtgaggcaaaggcgttgggtacaacgtgctgtgttgtatgctcccgcttttcccaatttcgatatgaggttggtcaaagtgctgacggcttcttgctaggtccacgttgggacgccggttgatcaatgtattgcgatcaacgaagcgcgactgcggaaaaagaacgcctcccgaccggacggctccgcgaaagagagtagagacgagaacccaaagccagccactaacccttcatcctcacccgactccacctcatncacagaaagcaaagatgaaagcgaccgctaccctccgga

SEQ ID NO: 2149 - DNA, 533 bp, Bacillus thuringiensis
  unsure (1)...(533): unsure at all n locations
gtccgcacgcccgatcgcagcataagactattctgcaaaggtgcagatagtatcatttattcgcgtcttgcaccagggaagcaacaggaactacggaaaaagacagcacagcatttggagacttttgcgcgtgagggcttgcgaacgctttgtgttgcagaccgcaaactctctgaagaagaatatcgggcatggagcaaggaacacgacatagctgcagctgcgctcacagaccgtgaagaaaaacttgaaaacgttgcaagcgctatagaacaggatctcatgcttattggaggcactgctattgaggataagctgcaggatggtgtacctgatacaatatcgctgctagccagagcaggaattaaactatgggtacttactggcgataaggttgaaactgccatcaacattggattttcttgcaacctcttgaccaatgagatggagctgattgtcttcaacattcccggagaccaacggcatcaggcatcccgggaattagacgaacacctncgcaaatccagctgacg

SEQ ID NO: 2150 - DNA, 504 bp, Bacillus thuringiensis
  unsure (1)...(504): unsure at all n locations
agccatttggtgttcgcgttgtaattgagcttgttcaagcaggagaaaatacagcaagtggtatggtattaccagatactgcaaaagaaaaaccacaagagggtaaagttgttgcagtaggtactggtcgagtgcttgagaatggtgagcgtgttgctttagaggtagcagcaggtgatcttatcatcttctcaaaatatgcaggtactgaagtgaaatatgaaggtacagactacttgattttacgtgaaagtgacattttagcagttatcggttaattatataaatcttaaaaaatccaagggggtcaattattatggcaaaagatattaaatttagtgaagaagcacgtcgttcgatgcttcgcggtgtcgacactcttgcaaatgcagtaaaagtaacgcttggaccaaaaggtcgtaacgttgttcttgagaanaaattcggttcaccacttattacaaatgacggtgtaacaattggaaagaaatgaattagaagatg

SEQ ID NO: 2151 - DNA, 540 bp, Bacillus thuringiensis
gccttgaaccttgtaggcctcgctcttggctgcatcctaattgtccccttcgcaatcaagtacggccgtcggtgtatctatatactcagctcggtagtccagcttgcaacggcgatatggcaagcgaagatgaatacaaccgctgagctgctcgccatcaacgctcttaatgggcttgcgggagccgtcagcgaggcgatagtacagatgacgattgttgatatcttctttgttcaccagcgcgcgtccgccaatgcgttttacaactttatggtcaatacgggagcatatctcgccccggtggcggcggggtactgtgcgactgcccaagggtggcggtggatctggtggtggacgtctatcatgcttgctatcaatacgctgctcttacttctcgcgtttgaggagacaaagtacattcccatactattcggacaggccagggaacatgttcataccgacagcagagcccgatacgagcagtccggcatgaaatctagtggcagcactcaggccactggtgagctggccatggagact

SEQ ID NO: 2152 - DNA, 223 bp, Bacillus thuringiensis
tatcgggccttaactaacctcactaaaagatattggccgggtggggtatcattagattgcagatgatgaatcgctagaagcatttcaatcatgaacgaaaaagggaggagatctttcggctttagaaagctgacatgctggtccccacgcttgaaaattagcgccgcgaacgaagaacgacgaaggactcgttgtttgttcaggacgccgcggggacaaagat

SEQ ID NO: 2153 - DNA, 168 bp, Bacillus thuringiensis
aattcggattcaatgttcggatatttaggagtgactagcctaagcttttacataatgttctactacagggtgtgagcttagaccggctgattttatgtcgtacaactaactccatgaaatgataaacatatatcagactatcatatacttgacaaccgacggttttac

SEQ ID NO: 2154 - DNA, 311 bp, Bacillus thuringiensis
tgtgtttgcagtttcaaattcgaaaacaactgaaatgtatcattgattacaaagaaaagcttggaaatacaaaagactggaatctttggttatggggagaaaatgcaaatggtacatcttatgaatttactggtgaagatgaatttggaaaatacgctaagataaaaatagacggtgactataatcgtgtaggatttatagttcgaacaaatgaatgggaaaaagatggtggggatcgctggattgaaaatataaaggacggtcgtgctgaagtatggattctttcgggtgatgaaaaagtatataaactc

SEQ ID NO: 2155 - DNA, 265 bp, Bacillus thuringiensis
ataaaagggtgttataactgctcgaagtgcgactgctgaaggggtaattttagcatgcacgggatcaggattaccaagtacaccagcttctgcaacagctggatgctcggttcttttacttacgacgtcgatagggaccagacgcgctgatctgacggcctattgacgtcgataatactccatgggaaccagaagcattcatattgatacatataagcagaaccacctgagacacaccaatctttgggcctgaaatatgattcat

SEQ ID NO: 2156 - DNA, 421 bp, Bacillus thuringiensis
ccggttatcggttatatttatcatagtgcttttctcaccgccgacaaccgcaaaaatgagggcgttatgctctggagcccgaaagacatcagcaagctctgctttctctgtattaagcactcgaccacgtaacggaaggacggactgcaaacgactgacccgaacttgcttcgcagaaccaccagcagactcaccctgtactcggagccgttccgtttcatgcaggctacgtgcatgagctggtgtacacttccggttaaccgatcctcccgatactccaatcttcttaccactgggcgctcgtattgtagctggacagggtgcttcacgggctcgtgctgcttcaagtgcttctctacaagcagccgtactgcatgaggcttcactaataacccgtctgctacatgctcatatacaatgg

SEQ ID NO: 2157 - DNA, 342 bp, Bacillus thuringiensis
attcgtgatggggaagagcatgctctatttgaaatagctttcgttgctacttaacgagcagaacatatcggtgcggttcttgaaactgaggcacgcgatcggatcgcttacccaacaagtagcggcagggagttcgactatctgactgctcttagtgaagcaaaaccagggaaggcagctccatgaaacgtatctcataagtatgggaaagataatatactgcggcgaacctgatggtatataagaacatgacttagataattgacctgcatttgaacgggcatacctcatgaagagaatgtccattactacattctctcatttggcttgcgaagttttact

SEQ ID NO: 2158 - DNA, 363 bp, Bacillus thuringiensis
cgacctaaagtgatccaaacttgcgggtttttttagtgagagtgagcgggcaacaacccgtactacggtccatttcatcataccttcaatcatgccgtgtccgtcgtcacactccattacctatggacgctgatcgtacatcacttcacgttggagccgagagtcattaacatatagcaggaactgtgcacatgcctgatagttatcttattccacgcgtttacgcgcagactacaccgtgcgagaaaccattatactttcaaacgggtgcggaccactcattccaaggcggttcatcattgcctacatatacacgggactcaaaaggtgcattaattcatcgtccattgagtagaaaaactg

SEQ ID NO: 2159 - DNA, 255 bp, Bacillus thuringiensis
attggtatgaacggttttaaattgactgttttttttcgatagaaacaactgttttctcggcggaggcttttgtatattccgggagtgcatctcaggggaagaatgtgaagaaaaataatgcttcactgaaccgtcggtatttgcttacagttggttccttaactttcataaccattgccatgtaccaagcttgttcaggtgtatcaacactggatgctcccgctttcacatactgagcgtgagaaatccagaccc

SEQ ID NO: 2160 - DNA, 254 bp, Bacillus thuringiensis
caaacgagagtaagctgttcattttttctgaaaatcccattgcatgtccgggagtgcaaggctctatgatggcctttccaatcatttctgctgctgcttgctcagaaataccactggtgattgggcgccataactgtgcttctgatacttgagctactgccgcttcatgctaaagagccacgtcctcttctcggagttggtcgaaaggcatcgtgtcacatgctgatcggtcatccacgactaacgcatgacac

SEQ ID NO: 2161 - DNA, 416 bp, Bacillus thuringiensis
gagcgaaactataatactgaagagagattcgctcagacagccgggggatatctttttcagctttacgcccgacttgatttggccacttattacgataacgccatggtttttccatgccaagcggttgaacaaattatttcttacatactatcggaaaaggactgataaaatgctagaacaaccatatcacgctttggatgcaattggtgtgaatagtccaaaaggagaagctgacaaccgtcaaattgttaataaactgggcacggagctttcagggggtgcgttgaaggtatacaaacttaatgcactttcgattaagccgacgccaagctggattttggtggtttttgaggcaaccttattatccagggaatgcccctggaaagaaaacaatggggctataaaaataaccaacg

SEQ ID NO: 2162 - DNA, 316 bp, Bacillus thuringiensis
agagattctcttttcggagatgaagaaactcctacaatgatgggtcgcgaggaagctgacccattcataggaagaagtattaacgagtctacactgatataaagcctattaggtctgcaaattggtacgaaagtaccaatccacacaggaggctgagaaatgcatgtagagatcggactggtaaccaaaaaaaagagtctactatcgggcgagtgtttttttacggccaatgaaataaattgagtgaaccttatagtgatcggacataaaatgtcaaatagacactgtaagctttgatatgataattagagaccat

SEQ ID NO: 2163 - DNA, 492 bp, Bacillus thuringiensis
acttttgtgtatacgttcataagtgaagtacctcctcctgcaacgataccttcttctactgctgcacgagttgagttaagtgcatcttcaatacgaagtttgcgttctttcaactcagtttcagttgctgcacctactttaattaccgctacgccacctgcaagttttgcaagacgctcttgtaatttttcacgatcgaattcagaagttgtttcttctaattgcgcacggatttgaccgatgcgagcttcgatttgttctgtgcttcctacaccttcaactacagttgtgttttcttttgtaacaacaactttaccagcgcgtcctaaagattcaactgtagcagattttaagtcacgacctaattcttcagtgattacttcgccacctgttaagatcgcgatatcttctagcattgctttacgacggtcaccaaatccaggagctttaacagctactacattgaatgtaccacgaagtttgttcactact

SEQ ID NO: 2164 - DNA, 296 bp, Bacillus thuringiensis
tatcactcaaggattttacgctcgaaacaagagggaagaaacgggggccaaggtagattcaaaacatattgcgagaccaaccaacttccaagaaggaactccatcaaatggacttacctctgagaactgataacgaacacaagacgcagccagtaaggtacaaggacgcactttccctcctccaactgaatgtccatcccgtcaagaggaagaactcatcaacactgccaaaaaacgtacgaacactatatcagttgattaccattgcggagactacaatgtgacaaacccgcgcc

SEQ ID NO: 2165 - DNA, 554 bp, Bacillus thuringiensis
tccagaatgagagatgcttccccgcataactcttaatttttacctgcactttctacattatgaggtgtacacgtaaaagttatcggccctattctttgcatgtccccttctacagcgtgtacaggaccacttaaaaagtgaacgatacgttccgcttgatcagtagacattctctgcaaattaattactacagctcgactaccttttaagtggaccgcaatcccttgtgctttcgaagatgtgcgtggttctaatactacatcttttgacgattgtcttgatgtttcaatactaacaacattttgcttctgaagggctttcggacaacgttacgcctagacgttctggtggatctcgctgataaaagcatgttctgtcggctgacatatccttaaccctatcgagactgatttatttatcataccgagtggaaatcggctctacatattgtaccttaggacctttttctgaatgagaatttaacttacttttacgaaaaaaattctttaatgctttacaaccctttttctactatccaaccttgtaattgaaag

SEQ ID NO: 2166 - DNA, 413 bp, Bacillus thuringiensis
tatcgaccctcactattcggaggccactaaagattaagctggtggcatgtcaactggttgactaaaccatcacggggtaaatttttaaacaagggtgtggacgtgctgttagcagatatgcacgcttggggcagatcaactgttacacatgaaacactcagaagtggatgacttaccatgctggggtagagggaacagaactagatttacgaactataatttcgcctataggccaaaaggaacaggtgcttataaagtggattgagcacaccctaatgtgcgtgtgttaatagtcaagctactcagtggatggagtgtgactatagcgagattatactccatttcactaacgaaatgcccactctttacaagataatccgaaggtggacaagctaaactatctaccataacac

SEQ ID NO: 2167 - DNA, 479 bp, Bacillus thuringiensis
ggcgcacttaatatttcgctattctggagctcgttgtatatttcggtctaccgcctgcccgacggggggcttttttacagcctgcgcggggcacacgctgatggttccgttcattctatgctcgctctggctaggtagcccgataccactagatggccgatcctgggggtctattcgctgaacttgggggcgtggcgcctgttggtgttgacaccaaacgcagcgctagattctgtcggtgtcgcagcgggcctggcggtggcgggttccatggagttcggaaccgtgctgacccgcaagtggcaacctcccgtgcctttgctcacctttaccgcctggcaactggcggccggaggacttctgctcggtccagtagctttagtgtttgatccgccaatcccgatgcctacaggaaccaatgttcttggcctggcgaggctcggcctgatcggagcgggtttaacccactttctttggtt

SEQ ID NO: 2168 - DNA, 474 bp, Bacillus thuringiensis
atgactgtgccactcgttatgtttacttaaaagacctgttcacaacaacccatccttttcaggctttgtcgcccgctaaataattgaaagtggcttcttggcgactcaggcggacccatcgcgaacatcgtctggggaaacatgtccaatctgcatatattctatgtatattcacacggagcatggtgcctctcctatttttagtctactggtgatcccaggttttacgaaattgtagcggctccgtctttggaactagatgcagcttggccatcatgctcatttacggtatgacgcacatcagtttatgcttccttgctcgacattattccatcggccatacctagactcagcggctttatagtaaagtcctttgaatgattcaggaacgcctggttctggtacattgtagactttaccaagtgaattatgaggattaccacgttgcaaccccatcctctgacttgactgttc

SEQ ID NO: 2169 - DNA, 383 bp, Bacillus thuringiensis
gaaaaagctttgctctaaacaaagaggcgacgacgatgggagggattcattaactccaggggaggtacaagcccaagacaaggcaacgctcagcgcaccgacattacaccatgcagaacaagcagcagaccagccagacaaaaatcgaagctcaatcgcgaaactaaaaatcccaccggggccatataaagaccacctgcaagcccgaaagcgttaattaacacccaaagaatttgaaaccccagagtatgcggcgaacaggaagagctacgtgcctacacgaaagcaagcactaacgcctggaccacactatgagtatgacggagacacacaaaatggtggcgaccaccttagccatatgcgcgatcaaaacgaacaaaccc

SEQ ID NO: 2170 - DNA, 147 bp, Bacillus thuringiensis
attcttcaccgaagaattttgcaatcggcccttttatatcgccctctccaacctcaagccaagcgggggcttttgcaccgcatacggcgacgaatacagctaatgcatcgatgtctttaccagtatcttaacttgcctcaccctctc

SEQ ID NO: 2171 - DNA, 194 bp, Bacillus thuringiensis
tggctgggaggctcgacaacaaattcagacaccatcatgcattttatacgcgctaacaatgattcgtgggtactatccactgctatccctgatctaacgggcttatacgcactagacgaatatcctgcgtcaggtaccacgacttactgacagcgcagcttaacgcgtccgctgcacgcgtacaacctagcttt

SEQ ID NO: 2172 - DNA, 376 bp, Bacillus thuringiensis
cataaaatggctgaagctaacaaagcatttgctcattaccgttggtaggattcaacgtaaaataaatgtaagcataaaccgctttatttgtcgcttatggaagtgtggagagggagaatgcctctccctttcatcgggcgctcgttttacataatgagagtactggacatactgacatgtgtaacaatataaagtggcttttttgctacttaaaataaaaaaatccaatccatatatggaaggagcaagacaccaaatggcaagagagttctctttagaaaacactcgtaatattggtatcatggctcacatcgatgctggtaaaacaacagcaactgagcgtattctgtactacacaggacgtattcataaaatc

SEQ ID NO: 2173 - DNA, 471 bp, Bacillus thuringiensis
tgccgagcgtggagaccaggtacatcggccgtcttcctagcttctcatttatagaaagcaaagacaaagttggtaactaagcgctcagtcttcattcctgcattgataccaagctgtgtctggggatttgtgatcccgacgccgtccatgacatatttgaggtagtacgagatcagtccattgccactccactgactgaagagaccaagagcagtgataaggtaaatcctcttgcgattgcctcgggacctaaaaaagtccacccagccggtatggccaatctgcttgtccaatgcaatcgcggccttgatttcggcgtactccagctggacaaactcatcgttctcatcgccttccgcgtgaaattttacgagaatgtcgagtgcctcggggtgtctgtccctatagatcagccaacgggggctatccggcattcaccacactccgatgacaatgacaatggtgcagatc

SEQ ID NO: 2174 - DNA, 542 bp, Bacillus thuringiensis
  unsure (1)...(542): unsure at all n locations
aggaccccacatgttgtatctctggttagaccactcagtacttcagtaactcttcttgatagctccctggaaggtcaggtatatacgcccattaactccgtttacatgcgtgatgcccccaaaggtactgtggacaaccgataaaatcagatcgagttttcactcgtatctaaactagacactagctcagccagactacctcagccagccttccacagacttgtatgtacttcaaccgcccaacccagtataatgtcaatagtagtatcatgatccccggtacgtcgaataattccatggccccaacaacaccggaacatgataatgtctccatccctcctcacccttctttccgcgccctttgaccgtaaacttgacctcaacctctggccagaaactctcgacgccctgggcctcaaaccatggcccgacctcgaatcgtagagcccagtttgtcttgctgtcgggtgcggngagggatgcaagtatgtcgggaaggcgcactgtggcagatgcggatacggatgcggatgcctctgtaa

SEQ ID NO: 2175 - DNA, 259 bp, Bacillus thuringiensis
gtggccgagggaacaattctgtttactgtctggaaatgacaacctgctagtgaaagtactggcctgggactgaagctgtcatactcgtatgtcgagataccgaatgcaccaggtgtggcaaccgcttccatggcatactcaggtgcgacatgaccagattcattggctgctacaacatcctgtctataggctagctcacctaactttctgcagaaggtgcctaattcttcgggcgctacacgaactgcatctgcatttc

SEQ ID NO: 2176 - DNA, 188 bp, Bacillus thuringiensis
aagcggcaattgcaaaaattataccagagttttttacagcagccaatgcttcttgccaagggagtccatgcgtatgcacagctgtgtacgtgaagaatgcatttacacccatacccgggacaagaatagcaggtgcatttgcccaaaatgccatgagtagacatccgacatatgaactaaaaacagtt

SEQ ID NO: 2177 - DNA, 561 bp, Bacillus thuringiensis
  unsure (1)...(561): unsure at all n locations
acggccagcgttgcaccgggaatgccccgtgccgcaactgtcgacagcgcattatacgagcatgggccgcaagttgacggtgaatcaggcgaagacgactaccacaagaagctgctgaccgatatctttcgaaccattcagtcgactgacgaagcagggtcccagccactactcgatttgatccgcaacggggccacattccccgaggtacggtgctggctggaccagaccttaagggggggcccgatgccgaaccaagcctcgaccacggatgtcagagactcgaagctgcgcgctggatatgaggtggagagcggcgcgcccccatttcggtcaaaggttatggatatccattacctgtgtgattccgcgcccgtaaaagtgcccgcgaagccgtggacgacagtaacagatgatgacggattggtgtcgcatttggtttcgctgtattttacttgggactatccattttacgcctttgtcgatcccgccattctaattaggcacatgcgcgaggngaacatgcagagtgatttctgtagcccatttctcgtcatgcgc

SEQ ID NO: 2178 - DNA, 190 bp, Bacillus thuringiensis
gccattcgggatgcacaccctggcgatatcctaacttatgctactttttttgagccggtttcactgcacgaacgtggagttggttctggaacaacgctggatgctgctccggaccgaacaatgctaggacagaacttacaaaatgcacaaccaagcattcgcgcacatatcattgcaatacacggtgaat

SEQ ID NO: 2179 - DNA, 348 bp, Bacillus thuringiensis
gataaactggatttgtacacaaaaacgcaagggacacggaggagggtggttatgaattcgggactctgcaaaaaagcaactaatgagggggggcactgtggccgacgtatgaggcgggaaacaagcactgatagtacaacacggagggtgacaggaactaccggctactgtggcgctacgccataagaggtaacaggtaagaggtgaatgccgatggaagaacagacccaaaaggtaagcggcgtaagcgctgggagcgcataatttgcgaaaaacacagctgatgtgcgagtagaagacgaaggtgatgaaaatatggaagatggaaaaacagaaagttaagaagct

SEQ ID NO: 2180 - DNA, 131 bp, Bacillus thuringiensis
taaaccgtaagtatgcaaaaggtttcactactgatatccgtggacactacatctaactttgcaattatggttcgccctatggaaattccacctgctgttggtactaaagctgttatggagaaaattcaaaa

SEQ ID NO: 2181 - DNA, 327 bp, Bacillus thuringiensis
agtgcaaagtataaacagattgccaatgtgtggcagcaagacatgcgggatgggctttttaatggaacgaaccaactgcctgcagaagaggcgttgatgaatggattagatgtaagccgaattacgacgcgtgaagcaattaggcactttgtgaatagagggtgtatttttcaagtgcgaggccagggcatgtctttacgcgaaacttttgtgacagattgcgttaatttacgaagcgtacgtggcttgacgactaatattgtgccacaaacttgagacacgaaagggtatgagcttgaagtgatagatgcggactaggagatggcg

SEQ ID NO: 2182 - DNA, 384 bp, Bacillus thuringiensis
gatggcagatgttattgaatacaagatctaacccagagggttattaaagaagtagacggcctaagaagtgagcctgcagagtgagcacagatcgatgtacctgaagaatacactgggtctattatggaatttatggttgcacgtaaaggagaaatgatagatatggagagtaacggaaacggtcaagttcgacttacttacatggtttcagcacgtggtttaattggttacacaccagaattcttaacattaactcgtggatacggtattttaaaccatacattcgattgctaccaaccagtccacgctggacaagttggcggtcgccgttcaggtgatctagtttcacttgaaacatgaatagcatcacatttcggtattatg

SEQ ID NO: 2183 - DNA, 381 bp, Bacillus thuringiensis
caagaacaacacgaagacgagagagcaatatgtgttatcacataactctccctactacacttaaacaaagcatcagtggatcacaaactacaatttgcaacctacaccccaaacaggaacaatcatttacgctgcatgtggagattatttgcttaacttctaacgtaaacgctgtacatgtgtatcaactggacgtaaatatgcacagaattcatatcagccatacgtcgtttaacagctggtcacgatcgaatactttattaggagctctcgatcataataatcgtatctcatattctttgcgggttaagtttacgtcattgccatcagtactaacatgacgagcatcgtaatcaatggctaagcgacggaatacagtaa

SEQ ID NO: 2184 - DNA, 414 bp, Bacillus thuringiensis
gggataaccgcccttggacccagagttaaaaggctttattcttccctccgaaaactaagctggggggggggtcatttccgtgggtgaaccttttcccctcccggctaatgggggaacactaacaaacttatcgggggagccctctgccaaaaaatgctttgtatgaagagcttaattggtcgcttaagaatattaaataatacagctcctttgggacacttcatgtctctccaaaaactttatttttttattaggcaaaacgttggcaatactccacacaccatttttttttaacaggtaatacatcggccggaaaaatggccctttctttaaagggagagctaaaaaaaaaccccttgttaaaacccttctttggaaagtgttttttcatgttgcaccccccaggttttttca

SEQ ID NO: 2185 - DNA, 285 bp, Bacillus thuringiensis
tgcaatcgctttatcaatttgttcttcttacacacctaatcctgcaagtggcttttttgcaggctgcgatggatgataaataagcctaagtgcaacaaagacagcaggagcacttctattacgggcaaggtccacaccattacggcctaaaatcgtcccaccttcgggatacaaaagctataatgcgactccatgaatctttcgctcgatccgtatacatagtttcacgaaaaaatagcacatatgcaagacgaatttcgatgatcgtgaagataagcctacctg

SEQ ID NO: 2186 - DNA, 314 bp, Bacillus thuringiensis
aaggaagccggccaactcagacagaaggggttaattttctataacagccgcgggaagagggtggggttaactgatagggagggaggtcaaaaggccgaacaaagaacaactgaacaaccaaagttgagccaaccaactaggcgtggacaacccagggcatgatagccccggaagacctaaaaatcgctgaaggaagcccaaaagttggaagacgcttccaagaactgggagtcggacaagcagctcctgtgtattactgggaattaagccaagaacaaaagggggttacccaacgaaatgacttggagaaaaaa

SEQ ID NO: 2187 - DNA, 428 bp, Bacillus thuringiensis
ctaaatgtatgaccatatatttttccaataaaacaaaagaaagtggtcgtccggcgacttttgatgggccatgtctaaatctagtccaaggtgctattgatgacagaacgcttcataaatcaaacttgctgctgcattagacaagcttaacgaacgaacgtgatgtgtcatcggaaaacgtatacgatgtaccaagtgtgcttcgagtacattatctggtaagcctgctgttactcttccagacacacagtagtaatacctgtcccgcttgctctacacctacgctgtatgagctttctagccatactgcgtgagatagaggaattcaccgcctttaattgtttcatagtattcttcagtcgaatcatattacgtaagttttacgtgctgacactcatctagtccgggacgctttaacattaggttat

SEQ ID NO: 2188 - DNA, 834 bp, Bacillus thuringiensis
cagattcggagatgatagatacacatgcaaatccaccattatggtcttttatatcagatgaaccaacggaatatttcccagattgaaaatactcttttccgttatatacaccttcattaatggcagctgctaacgtaaaaactttcattgttgaacctggttcatatgcatttgcaatcggatcatttaaaaagtattcgatatcacctacattaggattgtaactcggtttactagacatcgctaaaacctttcctgtttttggatcagcaataatgccaattaacatagaaggatcataatgctcttgtgctttgtacatcgcttcttctaaaaagctattaatttgtttatcaagcgttaaatatacgttattcccatttttagcaggttctacttttcctatatcattcgtaagtggaatccctcttcgtgttcccacatattctatatttccgtttgtagagcgcaaatatttatccaaacttttttaagcccaaactttccttccgattttcctttatcatctgggctagcaaaacccatttttttgggaatgccaaaattctttttaaaatttttttcccggggggaaattttttattcccacaccccttttttttctttttttttgggggcccctttttttttttttttttttccccccggggggccccttttttttaaaaaaaatggggatttttttccccccccccccccccgggggggggggaaaattttttttttttttttttttaaaaaaaaaatatcccaattttttcttaaaaaaaaaattttttttttcttttttttttccccccccttttttttttt

SEQ ID NO: 2189 - DNA, 384 bp, Bacillus thuringiensis
tgaccaggaggactgccaaatgatcaaaatcttctaagagcccacgagggcggaaaccacagaagaaggacagcgtaacacacggatgaagaacacagagaagaggcaaagagtgatccatacacatggcagtctgatcgatgtcgaatgatagtctgccaatgaagaaactaaaatagagatttacacgtaacaaacctgatatgtagggtaaaagaccggacgggtttcaaccgtgtgcaacatccagcctcgtgacatacaaactgctacggagccacgtcattaggcacgttacctaacgaccctcatcaaaagggaaatgagacccacgaaacggcagtagaaactcatcggaaacaatctgcacttatcaggggaagg

SEQ ID NO: 2190 - DNA, 163 bp, Bacillus thuringiensis
ataggaccagaattagtgagagatacatagtgctcacatgtatcaccggattagagggcattaccaacgataccatgttgtcagaggcttactgggacaattaaacgctcaaagaacacgtaacattgaacatgccaaagcacacatggtacttttgggactt

SEQ ID NO: 2191 - DNA, 269 bp, Bacillus thuringiensis
aatctgtgtctctagacttttttttgaatggttctgtaaccttaccagaaggggcgggagcctcatgtgatcgtacgccatctattgtccatggatggcactttctaatctgtgtatgaacgaatgcgattcaacaaggatactacccattactgccacgtggccggcatccaatgggattcttatcgattgagatggatccaatgcgagattacgctaacgtacattcatcgaaatttgtagttcgattctagaacataacgagaatt

SEQ ID NO: 2192 - DNA, 164 bp, Bacillus thuringiensis
cgaagatggaaacaccgatttacgaccttttgtatgcaacgagtgctaaacgagactgggaggaattatttgagattgaagcgggttatgatttttttgaagtacacgcatgtatctgttgatgttcaacaaacgttaattgaaagacttgttgagaaagcaaa

SEQ ID NO: 2193 - DNA, 387 bp, Bacillus thuringiensis
caccttgaggatacggatctgggcaggctcgctgatccaattacagcgttggggctcgttggtataaccaatgcagacaaccaccttgacggaccatacggatcatcgtgctgggacatgatctatcggacttgcctcgcttgcagtataaggccttcacttagcccatggggcaccggaacatgtctctttttgccgatcgcctgacttatacatgctaggccaactggattactgtagtacaacaaccgtgcagcacagatctttatgggagattcacgggcactatttaatggatcctgcgtctctgttataccgttacttggattatacatacacggtacgctgttcaggatcaacgttacaattattcttttaagtgcacct

SEQ ID NO: 2194 - DNA, 517 bp, Bacillus thuringiensis
tttgtgggtcaggcattggtatgtcaatcgcagcaaacaaagtaaatggtatccgttgtgcgttagttcatgatactttcagcgcgaaagcaacgagagagcataatgacactaacatgctagcgatgggcgagcgtgtaattggtgctggtctagcgcgtgatatcgcgaaaatctggttaacaactgactatgaaggtggtcgtcacgaaaaccgcgtaggaaaaattaaaacatacgaaacaaagtaatagattctaactatcagtagtgtgaaatataatttggtgaaccaacctgtgaaaggaagaggcgtaatgacagaaatcgtaaaggtaagagaacagctacaaatgtcgctttctgatttccaagaacaagcttcattacaaagcggtcaaatttttgtggggggttgtagcacagcgaagtgctaggcgaagaattgggacatcagaacatggaagtagcagaggcgattttctctgagttaaaacaatttcagagcgaacaggta

SEQ ID NO: 2195 - DNA, 258 bp, Bacillus thuringiensis
ccttaactgctccacttacgtagatttacctctttatccgttggacgacgaccaaacactacaatccaatatgtacctgctttacagcgtataggttcatgtgccccttctacaagtttgtccagctttcaccctacgtggacatgcaacggaaatcgtatatcgacaaactgaactgcttctccacatgaaaaatgcagttaaagatcatgcagatcacccatcattaataaaccgactcatggtacggaaaagaaa

SEQ ID NO: 2196 - DNA, 547 bp, Bacillus thuringiensis
  unsure (1)...(547): unsure at all n locations
aaataaaacttgttttaaatagaagctatgaaattgtaaaaaaaggtgtggaacttcaaaatattgagtatgtagtgtatgcccaccgtgtatatcatgacttggatattatcgtaaataaatatagaggtgaaacgaatatctggggatatacggagtttggcgatgggaaagatataaaagtaattgaacaagctatacaaacaaaataataagctagctagaattctagttagcttattttcttttgtaaatacaatgttcatatattattcacaaaaacaccgtgttaatagtgattaaaatcacaatctgcattataagattcagttaaactaaaaacagttaaggaaatagaggagtgggatacaatgttaagtgcaaaaacaattgaaatcgtaaagtcaacagtaccattattacaagaaaaaggcgttgaaattacaacgagattttacgaaattttattttcggaacatccggagttattgaatattttcaaccatacatatcagaaaaagggaagacaancacaagcgttagcgaa

SEQ ID NO: 2197 - DNA, 341 bp, Bacillus thuringiensis
tgcaagacatttttttactttttacgtaatttgatctgggtgacgaagtgatgagcccagggctccatcacgcctctgatactacggttgtggtaggggatcttgctgtaactcctaggcctgaggaccatgtgcgccaatcgaacgtttacctgttactgaaacaatatgcatcgggtccacaccggaatctatgcgcatttgtactagcgcatgaagcgaggggctattatcacagggcaacagctcattcggaataggcttgggagcctgtccaaaacgagctcccaagcccgaaggatcaataattggttccgttactttgcgactatggaggaccc

SEQ ID NO: 2198 - DNA, 511 bp, Bacillus thuringiensis
cgccgacaaaagaaacgtgacttcctttaattttggattacacgtatcaacgcaggggctcgtatgaatggactttcttacagccgcttaatgcacggtcttaaaaatgctggcatcgaagataaccgcaagatgcttgctgacttagctgttcatgacgaaaaagctttcgctgaattagcaacagttgcaaaaaacaacattaactaattaattagttaaaaccttagaagaattttcttctaaggattgttatttgtattcaaagagaagttagaagtgaaaagaaattctaaagatcaacgactatgtcattatcaatatgacaaaatcaatataaaagttatagcagcttagaagaatatatatatgaagccaggagaatactcctggctttttttaatactgctctcttggaaagaagagtatctttcctagccgaaacgacactgctataatggaaagatgatatggaacttccattagatgaacaatttatgagcgatgactg

SEQ ID NO: 2199 - DNA, 474 bp, Bacillus thuringiensis
atggtaagatcacaattcgtgatgtgttacttcgataatgcggtttgcaattgttttgtcgaactgatggtcatgagatgtgaataatattgtacctttgaatgcaattaaaccgttgtttaatgctgtgattgactcaaggtctaagtggttcgttggatcgtcaagtgtgattacgttcgcaccacttaacatcattttagataacatacaacgaactttttcgccttcagataatacagaaacgttcttcttaacttcttcacctgagaataacatacggcctaagaaaccacgtaagaagctttcagactcatcttgtggagagaatttgacgtaaccattcaactaagtttgtaatcacttgtttcaaagtacttagagttatctctggtgaagtaaatggagaaggtttgtaaccacccatttgaatgaaccgctttccggctccatttcacccataagaattttaaa

SEQ ID NO: 2200 - DNA, 361 bp, Bacillus thuringiensis
ttgacgtcatggctgcagattatggagagtcctctcactctttgattctgcaattgccaagtgactatgcagctgaatttgcctgaggtggctcgtgcatatgtcatggccaaaaccctctggttgcgtgcgctcgagcatttttcacagatggagatatattacttctcgcggaagggacatctaagatcgacacatgtgcagaactgcaagtgcatgcagggctatttaatttattgagcggagttacatgttctcagatgtctcaccgactcagtacacttgaaacagcagatcaaattacggttatgaaggcgggaagaattctagattgagggaagcttgggtctcttaagggtga

SEQ ID NO: 2201 - DNA, 123 bp, Bacillus thuringiensis
atttgccctttctcaatagcaccttttaaaagtttcttcgatagcccatcttctacatgcttggggggcgctttacgtagcggccgagccccatattcacgatcaaaccccttatctgcaata

SEQ ID NO: 2202 - DNA, 268 bp, Bacillus thuringiensis
gattattacaattttgtatgaaatgcgcgaggatatatttataactgcttacgcatcatttatggccgaatcaactgatacagccgcatatgatataaaacatcatcggaattcatgggaaatgatatatgaaacgatggattctatgcgggagggtgatgccccagacaccagcttaagatgcaatcaatacttgagcgtggctttggaaaagatgcttcattccatctttctttccgcgttttgaccccacgcggcatggtacggc

SEQ ID NO: 2203 - DNA, 312 bp, Bacillus thuringiensis
agaaaaacgtttgtctacagaataaggccacacccctgggggggatttataagctaaggggccgtaacaagccaaacaccagataaacggtcaagatacaggcgttaaaccatacgctactaccgtgagaccagcagcttaaaaatcgaagctccatctagaggtttaaaaacccgacaggaccattaagagagcacctagcggcctctgtaagatcataaggggactcgcctgttcctaccctacagtttacctaatacctgtcggacaatctcccttaagaaaagctggggcgttcgcacaaaccacacg

SEQ ID NO: 2204 - DNA, 239 bp, Bacillus thuringiensis
agatgaaaaactggatacttttattataggactagcttaaagggggatttttcaataatgaggaaggagtgctccatatgaattcaaagaataaaaaagttttattattaacagacattgaacacggaatagagcctataatccaacaagtaactaacattcaacaggaaaacatgttgactatacacagctatgactctgaaattgtacatccttatggagatataatgagatctatt

SEQ ID NO: 2205 - DNA, 212 bp, Bacillus thuringiensis
aatccacgcaataatgggacctaacggaacaggtaaatggaggttatcttctgcaattatggggtacccaaacgtggataaaacaaaaggtagcatcatcacctacagcgaagatgatttacaaatggaagacgactagcgcgcacaagacagtgttattcctagcaatgcaatatcccaaccgaaattagccggagtaaccaaacgctgac

SEQ ID NO: 2206 - DNA, 336 bp, Bacillus thuringiensis
gattggtatgacttgcatgaacgcagatagtgaatatttaatagatggacaagaatgttaattaacgggatttgagaaaggaacaacggtacatccaatgataagcgaccaagaacattgaagagctttagatggtgataaaggaccgaattcgggcggaaagggtagcatattgtacagcaccaccaatttctgaaacagaagatcatgaagcgattgagaccgaattgcattcaactggttaggacaatattgaagaagaccgcacttttacaggacttatatactcaggccttagattaacaaatgatggccccaagggaacaggaatttata

SEQ ID NO: 2207 - DNA, 383 bp, Bacillus thuringiensis
ttccgtattttaacgtatagtgagtgtaaaggagggggtgaaaagactacacctgaattataagagcagaacccgtgtattcgtgagatgctcgatgcgtacagtgtaccgggttgtgaattaggaacttatgaaagggttgacatcatgggcacgttagcgaaagatgggagtgtgcaaggggcaggtgttacagttttttcaggagatagagattctacttcaaactcgctggggttgcgcgctcgaatgtattgcgcgacacgggagtacagacgtggatggatattcgaatgaagctgtatttgaaagatacagtttatcacgcaagcaggttgttgatctgaaaggtataatgggagactagtcagcatatattccgg

SEQ ID NO: 2208 - DNA, 468 bp, Bacillus thuringiensis
  unsure (1)...(468): unsure at all n locations
atgtaacgtantttaaacattaaaaaacttttcgagtgaaacaggaaaacaggggaggatgggaccatgaatatccatgagtaccaaggtaaggcagtccttacaagctatggggttagcgctccgaacgggaaggttgcatttacagtacaagaagatgaagcaaatcgaactgtcttatgggcatattttgagaatgtgaaagcacaaatttacgctggtggtctcttcatagctggtggactaaatgctgctaaaaatttacttgaacttccgcacatatgcagacagccttctatgatctcccttttgtacacctttggcagtcactgtatgtaccctcttaaatgtcagactttttaaacttggaaaatatttttatcgtatgaaattaagtagtagcgaattattatttgaaatggagttttcttgtttttcagttacagacagagtctttttttgattatg

SEQ ID NO: 2209 - DNA, 388 bp, Bacillus thuringiensis
gcgccaggtatttattctatgagttggacgctatgcttttcaagaggcagataatacaggactgacgttacgacaaaccttacataactttgatgggtaaatggacactacacaacctgggatacatatagtggcgttccatattgaggaatcggtaggaccaggagctgttaccgaagatctttggccggatgaggaaaccatgataggtgaggagcgtacgcctgtacaacaaaatgtacccgaatataaacctattgaggagaccgttgttctgctcgcaagcaaactagtggaagtaaatgaaaccgctacaactccgttaatggtagcttgaacgaagctctagcatgctgatgctacgatagaagacacaaaatgggttatt

SEQ ID NO: 2210 - DNA, 450 bp, Bacillus thuringiensis
tcttcaccgcctaactctgaaagcggaccttctttatctacagttacaggcgtacacggggagggtattggccctatttttggcatgtccccgactatagcgtgtacagcaccaattaaaaaggtgaccagacgatccgcttgatcagaagacattctctgaagattagttactacagcttgagtaccttttaagtggatcgcatttcctagtgctttcgaatatgagcgtggtactaatactacaacttttgaagattgttgtgctgtttcaatactcacagcattgcgcttaggatgcgctttcagaaacgttacgtattgatgtaatggcggataatgctgctattccatgtcagattgctcacttccataaccataatgagctgtttctttacatgccggaggataaaataagaagatgtttactattgagcaactcataataaga

SEQ ID NO: 2211 - DNA, 228 bp, Bacillus thuringiensis
cataccgactatagttgcacactgacctggctaactggtactgggacgaacatgattggggggtctttatacatcaaatgcgcgaatactaacttcaccgctatctcgcctaatgagggtgtaaaggatgttgaccgcagtggttttatccactccatttgagcctagcagcgtcataatttctacgcacatcacctcaattgccactccttctaaaactctcttgac

SEQ ID NO: 2212 - DNA, 286 bp, Bacillus thuringiensis
attgcaaattttttagaagtacctcatgaagagatagtataggctttagatgcatatcaagatccagtttgactatttgaaccgatttatagtgatgggggtgatcctatctttgttatggcgcagttaagtgatgaataacataaggacgagcagggtgactgtgacttggcatggctagaaggtatgaggcgtataaattatttagcgagaatgattattagaacacgattctttcatgggaaggcacatatggctgatggagaagaattcggtactctctaag

SEQ ID NO: 2213 - DNA, 335 bp, Bacillus thuringiensis
tgcactcgtactatcaatatgagcttctgacatttttaaacctgcaactaacttctctgcagggtgcgatggacgatcaataagcgtaagtgcaacagagacggcaggggcagtcccatcacaggcaagctccacaccatcacggcctaaaagcttccctcgaacgggtgcaacagctatcatgcgactccatgaagttgtggcacgaaccgtatacatattcccacgaaaaaatagcacatctgccagacgaatcacgagcagcgcgaagataagtctccccgacataagaatacaaataagttggtgcctaactgctacatctgatacacgca

SEQ ID NO: 2214 - DNA, 181 bp, Bacillus thuringiensis
gcacgccacgctattttgaagtgaacggtgagcgcacctggagcgtgaaatactgcgataccggtgacacgtctgagttagaagcgtatcaacaaggagtaagacctcaagcgtctcaattcgataataccacacacggttgcaattgaaataaacgatatcattcatggatacatataaa

SEQ ID NO: 2215 - DNA, 267 bp, Bacillus thuringiensis
aactctctgatgaggccggagcccatgttagacactgggggggttttatttcaatcgaggccgggattaagaccaggaaaattccctgattttgtcgtacaacaaaaggcaaatgccgttagtgaagttgaaattttaacggtcgctgcacgaaagatggattatgctgttgcacagcaccctccttgattagagaaacttcgtgtgaaaaaatctaccttaggaccaaatacagcatgggcataaaacactgaagaggcttgtcga

SEQ ID NO: 2216 - DNA, 289 bp, Bacillus thuringiensis
gacttacaagggtaaactctggatcctatgtaatgtccatcgccttctttaaatcttctagtccgagctgaacgagttcttgttcaggcggtactacaaccgcttcattaccagcacgcccggcgtagcaacgaaggagaggttttacttctggcggtggatggggccattacttatgcgatcacatacatggctgaatggtgaaatggcttacaaccgaaacgacaaattctgaaccagtctttttaggctggcgagctcacttttgaccagcaagagccacatatgc

SEQ ID NO: 2217 - DNA, 164 bp, Bacillus thuringiensis
aataaaatcacgctctggttagaaaatcatgatcgatctattcttgatggtctgtaagatgaataatagttgctgcgtcaagtatattacataacttatggatatactcgaccggatcataaccgatcgaaatcacatgggctgcttcttgtagtactaaatca

SEQ ID NO: 2218 - DNA, 200 bp, Bacillus thuringiensis
cgaatatcgtttcctttctatgcatccaagccatacgctcttacaagcgcacctaaaccaccttggaattcacttcctactgcattaaactttccactgtccattatgacggtgttatttacaaaagacccctgctggttccattgagaagtcttcccccctatcaaaaagaagtaacctttttgattggtatttttcgt

SEQ ID NO: 2219 - DNA, 253 bp, Bacillus thuringiensis
ctggccgagggaacgataccgcgtacagcctgatttttttaacctgctaatgaaagtactggacgggggcggaagatgacaaacacgtaggtagagttactgaatgcaccaagggtggcaaccactcccatggtatccagaggtgggtcatgaccagattagttggctgcaacaacatcgtgtcatggcgctttcatacctggctttttgctgaaggctgtgaatccaccggatgcttatccaaacttgcaca

SEQ ID NO: 2220 - DNA, 348 bp, Bacillus thuringiensis
aggactgtgccgctcgtgaagcggacctagaagttttgcacacaacaacccatccttttcagggtgtgacgcccgctagagagttggaagtgcctttttgacgacacaggcggacccatcgcgaacatacgctggggaagctagtccaaacttgattcgttctatgtattatacacgtagcatggggcccccctcatttttaggctacaggtgataccaggcttaacgaaattgtagcggctccttctctggcactagatgcagctagatcaacaagctcagctacgggaggcggcacacgagtcgatgctctttgctggacataatgccaacgtgcatacctagacc

SEQ ID NO: 2221 - DNA, 179 bp, Bacillus thuringiensis
attcgagatgtggcaacccaactgttgaagtagaagccaactatgaaagcggcgcttacggacgcactatagggccaagtgtagcatatactggggagcacaacgcattacaatctcgtgacaaatacaacttttgatacctatacgaaaagtgattgcaccagaattttgccacctat

SEQ ID NO: 2222 - DNA, 256 bp, Bacillus thuringiensis
gaattcgggataactctgttccattcgtatggtgtacaacaaatatatttgccgaacaaagcgcatatttcaggggggagaaatcgcttactcgtgggagtaataataagtaccacaaaaactgatcatggcagtacaacgtctggaggaactccatcatatctcgtatcgccttagttaattatacatataatggagacgcacgcggttctggttcagaaccatttcctggtatcgcaaaaaagtcccgactacc

SEQ ID NO: 2223 - DNA, 405 bp, Bacillus thuringiensis
gtgatgtattgatttccattccaattggaattttagtcggttcatttaatatgtcgaataacatcagagatatcgaagaagatattaaaggtggaagaaagacattagtaatcctccttgggagagagaaagctgtggtaacactagcggtagcctttttcattgcgtatttatggattgccgtaattgtattaatgggttatataagcccttgggcattagttatgttcctaggtttgagaaagccgatttctgcgattcaaagtttccaaaatggggcaatggatcctgggtatatgcgcatcgcaatgaaatcaacagcgatgacaaatacgatttttgggtttttattatcagcagggctattaattagttattttgtttaaataaaaaatatgggtaaat

SEQ ID NO: 2224 - DNA, 283 bp, Bacillus thuringiensis
gatgctccggttccaactaacaaggcgcgctacttgatcctgagtgctcagccaacatggggggtgctcgcgcgggccggcgcgcgacgtcggactacatctgcaatttgtgttgccgctggtcaaatatggatgaagtaaacagcctcttcctgtgcggctttaccgatttcatcattctgcgggtgatgatgaacagttcctgcaagtgtatattctccaaccagtgggggtgatgctaaccccacttcctgtgcccgtggctggatacccctcgtttcta

SEQ ID NO: 2225 - DNA, 377 bp, Bacillus thuringiensis
aaaaacggctggggggggtgcaaccatgccagccgatatggagaacattctctctaatcaaagtgtccatgctgagaatgtgacatcggtttcaacatgatctacaatcgcatgcgccaatccaagaagaggggctgctgatacagaaccttctattgtaataatttctacatcccgttcattatcatgagaataatgctgaacctaattacgagggttatattcgctagcgatttcttatgctttgggttcacactcatgatgatactaggaatagaagcaacacatgacttaccattcaccattattaaagccaggattatataaaaaatcttctgagtgtccattcaaagatctttgtccacgatgtcacaatt

SEQ ID NO: 2226 - DNA, 449 bp, Bacillus thuringiensis
tcatgaactgtttataggatgtgtcgctggtggttctaaagatcctttttcaagcataggagcatgatcatctaatttgttatagagccatgtttgttgacgcactagtacactagcgatacctgacgccgtacaagcggggctacctgtcatggtaccatgttgctatgctggcccaaaccgagcaactggccgcataattcctttcttaccgccgggagctctgatagacatgacgctgtcaataacttaaccaagcgctggtaagtcaggtgacactcgatgcaggtcacgagcaccaccgtccatatggccgaaggccctaatgacttcattatggaatactaatgcgccaggtgcgacaacacgttaattcactgtctgaaggacattgggtcaggctatacaataccgaattgtcagcgatcgtatatacaaggagagctgct

SEQ ID NO: 2227 - DNA, 437 bp, Bacillus thuringiensis
gcatacccggggaaattacgtactgctcgcatcttatgtgacgctccaacaacacgattcattcaactgacctacacattatatgagctacgaagatacctgacgctaacttcagcatatcaattagcgggacaatgccttgttctgctgcatcgagtagcaaattaaacagagctctaataaacgttgctacttctaaaggtacttgaactataacagacgggacttttccagtcgtcatcacggacagatcaacgtatgctcgagaatcttcagcatcgaccaaatataaaacaacacgttgatctgcaacaacagctactgacgatgctgctaaagcatgtttaactggaagattagatacttcttctacttgctataactcctcaagcgctgataccacggctacatatgccccagtcatagcagctgttgtc

SEQ ID NO: 2228 - DNA, 223 bp, Bacillus thuringiensis
actaaacgaactttacgaggagcaatacgaactgttctcgctactgctttagcttgcattgaagtgcctcctctcattatcttctagttttcttatcgacagcaaggtgacctttgtacgtacgagttggtgcgaattcacctaacttatggccaaccatatcctcagtgatgtacacaggtacgtgtttacgaccatcatatacagcgattgtgtgtccgat

SEQ ID NO: 2229 - DNA, 287 bp, Bacillus thuringiensis
gcaagactgtaatttagattaccgtgccgtacgtagccttgggggggatgacaagagcgatcgcggtgtcgagactatgattgcgacagcccctaaaaaggaacagcttatgcccgatgagctactgcgtcactttgggaaggttgtactatcccgcgacgagcattccagatggacacacttgaggcatacgatggaacacctgcctggactaactcatttccatgcgtaccctccagtcgggacacttgacgagtaccacgtggacggactggcgatgatcgagt

SEQ ID NO: 2230 - DNA, 432 bp, Bacillus thuringiensis
accaatagataatgctgaaaccgttaataatgataatgctttcttcatcccaaaaacctccctaaattgtctatgtacctcagtaactgaaaacgtttgcatttaatagtttaattgaagcgcaaacaatatctcaatctatgaaaacgtttgcgctatttgtctatcattatacattcttttattcattttgcaaatattaatttaaaaattatgtcattatactctttatacattgactttatataaaatgaatactactcttataagcaatattaaagctacgagaaaggcaatcgtttgcaatacaggctttattattacacttaagggaatactatgtatagagatattgaagggggattttctatatgtttaaagaagccatttatcataggccgaaagataattatgcatacgcttatgatgaac

SEQ ID NO: 2231 - DNA, 293 bp, Bacillus thuringiensis
aattcgggatcggttctaataaatgcgacaggcatctaaaactttttacctatacaaatatacgggggactctgcggtttgcttgggatacagaaccaatagcgtggtaatctcccggcgccattggtaaatcatcaatttcaaccaatggaagccaaccaagggtgccttccccgctctctaatctgggatgaactgcaaaatctgtcggttaaaaggacaacatcatgcaattaaaaacaactttatcaccttatttgatgacaaaggttagagaccccctcttaacgctg

SEQ ID NO: 2232 - DNA, 240 bp, Bacillus thuringiensis
actatttggcagaacacgacattacagggtccgccattaataggtcaagtgcacatgagaaaattccgcggccactatttgtgcactaccctccttgcaagggaggcattaaactgatgacagtgacagtggcgctcgaataagcgccaaaaggtcttcgtcgccataagataggaccaggtgcaattactacgccaatgggcgcacctacgtttgctgatcctaaataacgtgctgacg

SEQ ID NO: 2233 - DNA, 360 bp, Bacillus thuringiensis
gagcaataacgggtggagtacatacaccatctggagtatgtgaatatgactatttagccacagaaaagaatggatctaatgcactttgtgtatcacgtgcatgcgttgtgttcgcacctggggcacatggatctgcaggccggtggtcatatggagctttcccacgattttcaccgaatacaacggaagatgtgactgttctgattgtcactgtatgaacacattcactgccagatgaatggagaccaagattattaataattgtgcgtacgagagctacggggatcgcatctacacgagcattattgatagagtatataggggctgctgcttaaacaaagagggcacctgcatggcgag

SEQ ID NO: 2234 - DNA, 336 bp, Bacillus thuringiensis
agcaacagatgctcgttcataatagtagtatatttttgaatgaggtgataatagaatggaagggggaacattagactcattactagatgttgatggtggaatgtatcggaacgaaattgcaatagcggcttgcttcaagacagaatacatttattataccccaggttgaccaatgccaatgcattgattgaaatggatataccgtaatccaaggaccttgtgggttatcggaggggggggtgaccagcattattaaaccattttaaggaatgcaatggattgcggtatgccttatcaaagaatggctggaccatttccaagctgtggaaagctaga

SEQ ID NO: 2235 - DNA, 389 bp, Bacillus thuringiensis
cacggaacttattgctgattgagctgcacgagcctccggtgctaaagctacttgctccaaaagctcacgcactacttgatgagacaagaatgggaagcatactaagtctataacaacgcctagcccatgagggtacagccagagaaggcagaacacctccggcgtagtgcgagaagggccaacccaaaaggctccgactaaggccttaccaaactttgcaccgacagctttactgacgagtggcactgttaagaccggatgctactgtatctttgaagagacgcactgaaaagtacaagaccagctgaaaagtaaccccagcgctcactaccaccgaactgcagacggccctcatgcggcggctataaggaacagaagtcaacatgata

SEQ ID NO: 2236 - DNA, 550 bp, Bacillus thuringiensis
aaaaatgcagttttctattaataaaggagaaaaacctgtagcgggattaggagcgaaggcgggggatgattacacgctagaagtagaattagaaaaaccggtaccgtatttcttaaatttattagcattcccatcatactatccattaaatgaaaaattcgtaaaagaaaaaggtgataagtacggtttagaagcagatacaactgtgtataatggtccattcgttatgtcttcatggaaacatgaacaaggttggcagctgaagaaaaatgataagtactgggataaaaagactgtgaaattagaagaaattaactatagtgtagtaaaagaggttgcaacgaaagtaaacttatatgatacaggatcaattgattttacattactatcaagagaggttggagataaatataaatcggacaaagaagaatatggtgagtatgcggaatcaagtacattctttttacgtttaaatcaaaaacgtaacggacaagatacgcctttaaagagcaaaaaactttggggagcattgcattatcagtgataaaaa

SEQ ID NO: 2237 - DNA, 206 bp, Bacillus thuringiensis
taccgccggaataagctcctccacgggattcttcagctaattctttgtgctcttcaggaatttcaacacgttgaatgtctgttcctaaatcgttaccgtacatgtaagcacactcttcaacaaggtcaatgataccattgaactcatcttcagcaccgattggtaactgaattggatgtgcgtttgcttgtaaacgatcgtggatt

SEQ ID NO: 2238 - DNA, 260 bp, Bacillus thuringiensis
gtgggttcaccaccaagtggaacaggccagccattaccctcacgcgagccgaattctgcagctaccaagcacgggaataggtcctacataccaaggggtattacgaaatacgcaggccattctcatcttcatagcccttcggcctagggtaccgtatgaccaacacaatctactaatcgaatattcggccgcaaggatcttatagtgtcacatagaaaccgctttggttgggacaccagctggttacaacggccctgact

SEQ ID NO: 2239 - DNA, 280 bp, Bacillus thuringiensis
  unsure (1)...(280): unsure at all n locations
ataacagcgcaaggggcgcngaacccaacaangaaaacacgangangcannccnnaccaaaaaggacagcgaacggacccccaacgaaagggcctaacacaccagcaaacanaaaggcgaacacgaaanacagggcacnnnncatagataaaccataacgctcaattaagtaaaaatgacagaaattaccgataccggcaccgtaccaagagcgcacaaaagttagaaaaacaagaagtataataccaaattcaatgagtgtccttacaattgcatttta

SEQ ID NO: 2240 - DNA, 450 bp, Bacillus thuringiensis
ccaaattccttttatacatattcccgttactatctgttgaaattgaaagcaaataactagctacacgtacttctacaggataaagtaaattaagagcagtaaaacgagtcgatatttttaacgtgttcgcaatgttttcaagcaagaacttcataaatataggatcatgtaataacttgtttctaataaccgtattagaaatagagattgctacaacatctgaacaagcctcaacgatattatgtgctttgctattttgaattaattcaatatcaccaacaatggccaatggattgataaagcgaaggattagtttcttcccttcaggtgtaatcgtgtaaacttttactttacctttaacaacaaaatataaacgatccatttcgtcatctatattgcaaataagctcgccttttcaaagtgatttaattgaaaataagctgtatctat

SEQ ID NO: 2241 - DNA, 335 bp, Bacillus thuringiensis
tcttcccgatcatatacgaatgcaccacctatgttgaacgcataccgaccagcacgtagggggtgcttttctacttttacgccgtacatcattagggacttctgtactagggcagaatgctcagcagctgctgaatctacgtctgtaaataaaacacctatttctttcgcctcggcagctaacgaaccaaaggctggtgtaccagtgcattgtactaatacgatgccaactgaatagattcggtctatcactgttttcggtagtctatgtaaggacctgacaggctcttgctaagcagtggtggcttttccggataggaaaccatttggtcaagc

SEQ ID NO: 2242 - DNA, 423 bp, Bacillus thuringiensis
  unsure (1)...(423): unsure at all n locations
tttcaccgacttatcgcagcttctcttctttttaccttattttatcgatgaagccaaactgcacctgcagacttgtcttcagcttggcctaccacttcaaacttcagtcctagcttcggtaacttacgtcctgcatcaggaataacgctgttgatgtattgcttagaatcatcaaattttgccactcctggtaatcctttataatcaaagataccgcgtgttggtgaatttactttccatgctggtgtttgatcaaatgagaatgccgcatcggcaatttgataacgcgtactgctcttcacagtanggttgtccgtttaatgtccctacaattgcctctggatgagaatctactactcctaagaacccttcactggatgaacgcctcccagttatctgaaagctttgatccgcataccatac

SEQ ID NO: 2243 - DNA, 629 bp, Bacillus thuringiensis
  unsure (1)...(629): unsure at all n locations
attgtggtaatcggtataccgctaatgattcattagatgtaatacttaatgtaccttctaaataatctgtattttgggggatttcttgcgctttttcatatattgaaagtaattctaatgcataaggatgaaattgatgacctgcttttgtaagtagcacttttttccctaaccgatcgaaaagaggaatatgtaaatcgttctctaaagctttcatatgtgctgtaacagtagattgcgcataacctagcgcatgcgcagccttagaaaaattaccatacttcacaatggcgcaaaatgttttaacatgtctcatttccataagcaatccctcttttattatcatgatttgtgaatgattatatcatgcattttaattttccaaatgattaaattctgtataaaatgaaattgtagaaatattcatacaggtgatattggaggagaaaagatgaaaaaaaagggctatcatgtactgcttgtgggctacaggtgcggtagggcaaaacattattgaactgtagagatgactgaagttactatagttgagtccattgctttcgcaaacatccgttgtangaaagtagattcaagacagagatattataaagagcaaaacactagcttga

SEQ ID NO: 2244 - DNA, 335 bp, Bacillus thuringiensis
tgagtgcgggatctgttcgtgctacagcaaaggcaattgaaacattttttctcgaaaagaataaacaacaagcgttatacacggaagtattctgtctagaggcattacacgaaagcgaagcggaggcgaaagaaacactcatcgtggttgagaagggcgacatgctgcgcatgaagtcataatcagttacgtaaattaacgaggcacacagcacttaacgtagattcgaagaaacgtgaagacgctgcaaaaagactagaagatgagggttatacagtctaatgtgtagaaagaacagttgtcgtttatacggctactgctcgttgaggggcaaa

SEQ ID NO: 2245 - DNA, 256 bp, Bacillus thuringiensis
ctctttatatatatatgctaggccatttttttattatatgggagaagatatggagggtttattggaataggtctataaaatttatttatttatataaaaagatttaattaggaggaaaatgagatgaaacagacggagcaatggacttcgaaattaggttttataatggcggcagccggatcagcaattggacttggtgcgatatggaagttcccttatatcgctggaagagtgggggaggagcgctctttttaat

SEQ ID NO: 2246 - DNA, 355 bp, Bacillus thuringiensis
cgatattttcttcgctcagggtacatgtaccggtataaattacttcgttcgcaatggaaatctatcagtatgtaacgtacagtttgccagaaatttggactaactctgagaatgtaggaagtattgtcaatgataatattgaattcacggaagccgatactggctctctctgaaatagtaagctcaatgcgcacattttttgctcttccgttccccctaacgattttggaccagagaaaatcatgattacttacgtattacactccgataatgtgcatgtgagcatgccacttacatcttgcaacatacgaaccgcggtctgtgtataaagttacagattcaaattctttaataa

SEQ ID NO: 2247 - DNA, 404 bp, Bacillus thuringiensis
gccgaggctcaagaaggtcgactatcttatattatggcgaaaagtaaaaactaaacgaagacacaagcagctggaggatttggtgtgacccacggcggcgggacagaaacaaaggaaccagcagagagcattcaagctgctcaagaaacagacatgggcgtagtagaagatgaggctgacttaacgcctgccagaggcggggaacaagagacatacattaaacacttaaacaaaatggctaccacagtctagattgatctgcaaagagtagcaaaacaagagaaggcaacagccgcaatggcgaaagaaggaacaacaggacatgaagcagtgactcataacttcatagggggacaaaatggtatttgagcgcaggcagaacactcactatacgatgcgaaaca

SEQ ID NO: 2248 - DNA, 154 bp, Bacillus thuringiensis
aactgagagacgcgatacatcgattaccccacaagcgtaaccgtgatctaataaatgccgagctagtcgggatgcagccacgagtacaacttgcctacgttctcgtgataccagaatgccgcaaaactcacatgcctaagtgaactgatgatag

SEQ ID NO: 2249 - DNA, 388 bp, Bacillus thuringiensis
gctctggctccctttatttttttatggattttctcaaatatctgcggcctctattcacttgtcgaattccctcatatcctacctattgaaacgtgagaatattagattcagtacagagagatacatgaaacaatgtctccgtagatactgaggaatcacataatatgatttctcattacctcttacaatactatatccggacttactaccgagtcttccgagcgccatgcgatgaagccatctggtctgattaatacagcacctgcattctctataccatataatgtgctacaactgtcttctggaacaatagagtctccacttatgccgacacgatgccctattagacgcatatctaattcagctgacacagcatgtgctgcctcag

SEQ ID NO: 2250 - DNA, 463 bp, Bacillus thuringiensis
tcagataacggggtcctattgcaagagtgtttttctgatacagaggtcgttcatgagggcggggaattttcaggctagcgcgatatgtcataaaatgaacgcccttccgatgcgctgggtccatgagaaaacctacccgcgtacttatttgtaacgcaatcattggaatctgaaaccgaggataagagccttgtcgcttcctaaacagacgcaccacccgctggtgatattgatcgggtcgatgaagacccatctgctggcgcaggcgtgatctaaacgacacttgcctgggccagagcattagcgcgccggattgtatgtcgtgacgtcatagggggcgggattgtctgtcctactctttccctcatggaagcggacgaaacgcgggaggaaccgaacttagcttctgtgcgtatcactcgcgctgaggcagaggtacttttatctaacaggccgataccga

SEQ ID NO: 2251 - DNA, 386 bp, Bacillus thuringiensis
cattcgtttatctggtaagacaaccgtgttgcctgcggagtaagattcaacattcagtaactcggcgcttcatatacctttgtatgacatgtggacgccgtactctctacactgccggaatatcggttatgcacatacattatcgaagatggacacaacagattgagccatgttgtggccggtataatgaatggctattagttcttcgtccgttgctgttccaagctcaaccatcgctaaaaagggctctgcaactgtacgcgctggtatcactccaacgtggcgactttcactaccaagtgatagttgctctcacgagtttactatagaattagcaattgctctgatgaagtttgttgctgatttcacaccacaacgttctaact

SEQ ID NO: 2252 - DNA, 382 bp, Bacillus thuringiensis
gttttacccagtcaatgcaaacgctttttttggtcaaggggaaccatgacatggggaggaagattcaacatgctttaacggatcaccctcattaagtgaatgaacagacgcacaaagtacaatagctcgtagaatcctgcagattgcgagaataaagagtgctacatacgcccaaagcacaaagataatcgatgcaatcgatcaacggatgaaaacatctgccacacgacccctaaagggacgtctgcctgtacctctaacatggaagggaggtaacaaaaatgctccaaacgccaaccctgacataaggaatgcgtcgattacagtagatgtaccggaagcatacagatccttttaataactgacccaagaataagaaata

SEQ ID NO: 2253 - DNA, 293 bp, Bacillus thuringiensis
atgggggggggtttgtcggatgatgaggtaccaagagaactttcacgcgatgaagtttgcaatacaagcctttttccgttgaccaaagagtttgggtaacaagaaaacggcacattcttggaaaacaatggacgaccctcctcataccaaggactgcacaccatgcaaggagcctttgcattaatcaattacatcctaggagaggacgaactgtatatatagacagatggcgtttctaatacgccaagatatgcgcatgcccaatgcaggttcacaattgttatctaaagaca

SEQ ID NO: 2254 - DNA, 205 bp, Bacillus thuringiensis
  unsure (1)...(205): unsure at all n locations
cacaaacaannaaancncaccacaacgnnggnggacanccagaagacacgcagggcaaaggaaaggagccccaaaacacgcnancgaaagacgaagaacgngnaanaggagccgaaccaggaacccccgacgaaaacgcanggcggcaaccaaacccaggaccgggacnagggaagcgcgganaaggggaaaccacagaagagaa

SEQ ID NO: 2255 - DNA, 436 bp, Bacillus thuringiensis
tttttattcttcatagaagaatccccctaatatttaatatatgtgctttaataatgtaatttatttttctgtaaaaataaagacggaaaacataaaaaatattaaaaaattgtaaaaataccgtgaattttgttgagaaatatttatatagatataaaaacatcccttccaagtaataaggaagggatgttttgcttaactaatttttgagttaggtgtttcatcaatcttatgaaaacccttcatgtaatatacgattgctaagccgataagccaaattggggccgacattaatggcaattcgtgtatcttctgaatacgccattatacataagactagtgcaaggaaggcaagtgagaaatatgagcttaatgggtataaaggcattttatatgataacttttgtttattttgagtaggcaagcttttacggaa

SEQ ID NO: 2256 - DNA, 366 bp, Bacillus thuringiensis
ctcgagaagctggagcacgaatgcagatccatacatccttttgtttattcataactagccttacctccggggcaggctaaaataacaacgcgggggcgcagcatcatcaaatagcatgcttattaaggctcatcgcaagagcgtcagcataggcaaagagcctgtttcgaccaccctaaagaccacgaggagactcaggagcaatatcttgaaggccaactctttgtggaaaggaaatggcaatatactaggcccccactttctctactttatatacaagaatagggacctacacgatgtattctatccaagtcaaatgaagaaagaacctcctgtgcttaaaaaccatacccactaatagacgga

SEQ ID NO: 2257 - DNA, 485 bp, Bacillus thuringiensis
  unsure (1)...(485): unsure at all n locations
cagtggtgaaagatagattttggacagcctaaataaggcgcgcggcggccagaacacacgggcggagttatagagcagattcaacctgcccacaaccgagagggcgcaaggggagccgaaaccgaacngaaaacggaaggggacagagctaacatggcgcgacaacacgtgttacaagcttctaggacgccacgggtaaggctctgttacaagaggggcttgtcgtcgcaggacaacccgccatcgctatgaaggctggccgtgtgacttgacagtggcggcaccggaggaacattcggagcctgtgataggacgcaggaagcacattgagcacgtaccggtggcgtaacgcccggggacccaaaactatccacagataattaaagcgccaagcggatgtaaagcagatctagctcacaggctagaacagcaaattatttttgaggaagtatgtgaaccagtgatagactagcgagcaatgacgc

SEQ ID NO: 2258 - DNA, 411 bp, Bacillus thuringiensis
gtgggggtaatatttgcacttgtgacgaaagcaactcatgcatctgaatcttataatgtaaagctattactgggtgctggtggagtggctgctaatacaggactgacatcgctagcagaagaggcacctgcacaacatgcaagcagtgcattaattactatgccgacatctggatgcaccgagtatgcaccggtgacagcaccggcagggtcaatggctgatgaacaaggaaagcgtgcagcattagccgtaactgcagctccaggattagatatcgaagccatggtatacacctgattgaccacaggatgtggctgatgcccatcttgactgacgctaacgagggacgtattgaccatattacacgcgaaacacttcttattaatggtagatgatgaacaaaagttattc

SEQ ID NO: 2259 - DNA, 623 bp, Bacillus thuringiensis
aaattcctcatcttgtacaattatctgtttatctggaagaatccttttttctggctccgctacaacaacaggacatactaatagtaatccgctaactctctcaaacatctttgcaagtatacctttggctaaatagcctccatatgattctcctaccaataaaaatttttcagtagaaatgatttcctcaataaatgtgataagcacttctactatacgatctgaactatttatccaatttggagcattcgattttcccattccaggtaaatcaatatatattcgcttataaccttcatatttctgaaatactgattccatacatttcatcattaacctatggtcaggggcgcagccatgtatgataatgaccggtttaccctctcccacaatttcatagtatatttctgcatctttaattcgatatatcataaaaaagcctccctatttagtggcaatactattccactctgtaagaatacacgttcttattttacatcctttctcaacattttcacaaatgttaattttcagattaaaaataaaaatctcacaaaaaaagatactcatcattttatatgcaattttgcatctccacttacaaatcactaaaaaaactttac

SEQ ID NO: 2260 - DNA, 475 bp, Bacillus thuringiensis
  unsure (1)...(475): unsure at all n locations
gaagaagggagagatcgnttgngaacaaggcgnatttactgaagaaaacgaaagaaacgngccagcgggggggaaaggaagaacgggggcgaccagccacgattcaaagtaaaaggtgcaggaaagcgtgcgcacaacgccggaagcgaataacgacggggagagtaagcgaacgagccgcaccaggacgcgggaaggccgaaagaaagagagaaaagaatccaaataagtgacagaggaacgggacgttgccgactggccagaagttggcggcgcaaggagtaatagaggccaataagcaaaaagaatcaaagctcaattgggccgcaagcggggctgggaaaacagagacgacggcccacggaaacaacgaagcgctacaaaaaggagaaagaggctggaacgcaacgccgagaacggacgttgcccaggaaatagcaccgagaacgcaagaaggaataccatatccgaaaac

SEQ ID NO: 2261 - DNA, 277 bp, Bacillus thuringiensis
atagatcagtaacaggtaatgatcctggggctaatgctgtattaacgtactcaggaactacaagtgcgctttcacaagcttagttcgcaactagacctgctccaattaatacgtatgggatggttcaatgacagcagctggtgattgaagcgaaagcaagctgcccggggaacatacggccttctatgaagcttagggatatcaaaagctgattgaggaacattagttaacacaagaaacattggcgcaacgactcgggaaatgacacagtacaatg

SEQ ID NO: 2262 - DNA, 340 bp, Bacillus thuringiensis
attggccggtggattattaatgtatctcgctatgcttcgtcttggcgaacccgctgtagccatgcctgtttcgtgttctttccaggaatatgccactaaattcatcaatcctgcaactggctttacaatcggatggatgtattggttaagctgggcgaattaccaccgttcttgaatttacaactgccggtattacaatgcagcgctggtttcctgatattcctttttgggcttggtgattaatattttgtgcgatcaatttttacttctatcgcattatttgcttgtagatattccctaaccttattctcgttttcaagtataaagagttctttcttta

SEQ ID NO: 2263 - DNA, 160 bp, Bacillus thuringiensis
ccgtgattttcagtgtccttaagtggttggtcgcgagcaatttttaatgccattcaactcgctacttcgaccggtgggggacgataatctttggtacgtgtatacttatcgcgtatatatgcacttttatgtggtattaacgctcgagcactgtcataca

SEQ ID NO: 2264 - DNA, 405 bp, Bacillus thuringiensis
agaaatatttttttttatcagacggtatttatgtttctaagggcgtactttggatatattgacggagtcgatacaattattactatgactaccgcttacggaaccgatctaggttttagtgcaacgaatctattaatcatattatttgtaacacaaaatgtcgcttgtccatttgctttactattacggaaaattatctggaacatttactggcaaaaaaatgctatatgtcggtatcattatatatatcattatttgcacatttgcttagtttttaaaaaccacacttgatttttggaatttagcaatgttagttgctacatttcaaggtggggttcaagcccttagacgttcatactttgcaaaactagtacccaaagaatctgataaaggaaacttcggatt

SEQ ID NO: 2265 - DNA, 555 bp, Bacillus thuringiensis
  unsure (1)...(555): unsure at all n locations
gaaaccatctacaacgtcactgcgggtggcgcactcttcgagctctttgacagtccgtgtatcctcgtccgggctggcttgggctctagcaccatctcccatggtcaataaaccggcatggccggttggataggcagggaacggattgtaagccaaaggaggcgatcgcccccctttggcgatattcaacggcggagagaatcccacgccgaataatcgcccacttgccatgttgagagccttggaaattgctgaggtcgcagacgtagggctttggccgtagcgccgctcgtaggaggcatgccggttgtgagccgagtccgctcgggaccggcctgatactacctggactgcttttcttggagaattttgcgatgatgcctgcgtcgttggaagagctgntgttgtttgccttcgaggaagagcaccagtttgtttaccgtggaaccttgggtcatatgccaattgatctgcaaaagcattaacttcgactgcgcgctactacacaacaacgtagtctcgctcgaacgcgacttcttgtgcagctagttcacg

SEQ ID NO: 2266 - DNA, 514 bp, Bacillus thuringiensis
acaccatgaacaacgtttcgacgttgtattccccttgtgatagaagcttgaccctgttccagaagattaggcctagtgtggcaagatagagactttcgcataaccccaataaaatggccgaaacaagggtgattcggatgaacttaggcgaggtgtgcgacaaccgttcatcatacatctgaatgaccttttcctccagcgtgagactggctacagtgcgaatggcactgatcgcctccgtagcaaaccgggcactttctaagtagagccttgtcgtccgttcctggcaggtgatctccagcctgacccgaacatagccggcaagaaataacggtggaagacatccaaagatagcaacgagagcaagcctccatcctaccgccaaggctagtatgcatgaggcaagcacgttgacgactacaagaagaatgaagcccagacagagcgagatcaaatcttctatccgctggggatcggtggaaaggtgacctgtcatcaccccagctgactgatc

SEQ ID NO: 2267 - DNA, 350 bp, Bacillus thuringiensis
  unsure (1)...(350): unsure at all n locations
cccgcaaggaagacaaggaccaacgggggggacaagagcaagcgaagcggcagccaaccaggaggaaaaagagaccccaggggctccagaaacaggaagggaanggaggggccaacgggagcgacaggagaaacccagacgacaggcccccaaggaaaacaagggccgcaaggaaaccaagggccgacagggaaacaaggaccaacgggagccacaggagcaaccggagcgacaggagcccaaggaaaacaaggcccgcaaggaaaccaaggaccaacgggggcgacaggagcaaccggaacacaagggccaaccggagaaacagggccaaccggagccggagccacagg

SEQ ID NO: 2268 - DNA, 422 bp, Bacillus thuringiensis
agtcctgttctggcaaggctcctcgtgtatcgagcgacgcgcgtttggccactcccggaaggttgagaggatcctaatgacgtagctgatgctacttgcttgaccgcgtttgccgttcctccccagacgggaactttatttacttttttgcgagtggggcttgcgaatgtccctttcactttgttgccttttgctgcgccacatgcggcgcctcgagtaaggtgcgcatacgcgataatatcaatgtgtaaacatccacggagaccgatgaaggtcatccaagacatgagtcttaatttggtggagcctgcgattatggccatcctgtttgcgccctctctgttgtaaatcgggttgggaggcatacataaatgagccgaaaactaaccctcgatacatgactaatgaagttatcaatttcg

SEQ ID NO: 2269 - DNA, 361 bp, Bacillus thuringiensis
gagcgtgtataatgttggcgcggcgctgaaggaggacggagatcgcttcgcagttgtcgactttcacggttagctggagaggggtgaagccgttttcgttagtcatatcaatcgaagcacctttatcgagaaggtataggacaattcgcggtcgtctccattctatagctggatgtagcgccgtatctcctgtgccgatattgcgagtgttcacatctaccttggtctttatgccgagaggcacactaccttctaatgctatagctgaccgagctgggtgagacgatgcttgccgctaatgactgacgccttgagcatatactcgacctatgtactaagatatcgcagcgcgcttgaacag

SEQ ID NO: 2270 - DNA, 387 bp, Bacillus thuringiensis
aaggttggccccaattcaagaaaccggggggttgtgtccaggggggaaccttcccggggggtggggttttattccgaaattgaggggaggtgccaagggcttcggtttaaccaatccccttggtcccaaaacctggcggccccaaagttggtaaaacccgaggggggcccatttgggtgggccccagaaaaaccaccccttacggggtctcccaatttggggataaccacagatgcccgccccgttgtaaaatcctaaaaaccttccacatttttatttaaggaaaaattttttgtcttgaaaaggaaggttccttgaacgcccaaaaaaaccgtccagccaaaagggctttgggttcggaatggccaaacttggtccgggggaaaa

SEQ ID NO: 2271 - DNA, 571 bp, Bacillus thuringiensis
ctgaatcgccggtggggtattgtcgcgtgagcagggactgcacgatgtggttgtagttggcgtccgtcccggctttggtgtcgtggatccgcgagcgataatcatgggcgatgtacgctcctcgaacgagcttgatcccgagcgaccatccttctgcttgtgcaagagagagatggcggctgacattctccgttgacgctttgagatatgcctggatggtgttgaagacgaccaccttgccttgacgattgaactgcctcatcaaatcgatagtccagttgtcaatggtctgttggaagatctgttgttccgcatcaatccacaggcgggatccctgtgctgcagctgtcgcacagatctccaagatcgctgcgtgcattcgcggcggtggaatctgatctccccgtttgagagcttcaacagcaactgggccagccccggtgaatctaacatgttagttttggctatggaagcacatgcggtacgtactttacattcatacagtcgccgactcctatcattctaagtgtccgcaggttcccttccttccattcatccacggcgctgtcta

SEQ ID NO: 2272 - DNA, 377 bp, Bacillus thuringiensis
ccccaattcgtgattcactgcagcaaccgggccggcagtgacaccttttttttccggtataacgaagacaacaaagagggggtcttgttgtaccgccacatcaactatgctcaatccaactgcgagcgggaaaccaagccaaaccacatgcaaggtgaccagcttcacatactcaatcagcgacgagtccacgtacagcgacatatgaactacgcctactgctaacaaaaggatgggtacaacccccgcatgacacgaaactggttttaacatatccgcacctgataaacaacgctatgggccatggctcaacaagaagtgaccacacacctgatatactgacccaccgcttgagtggaatacatactgatacaaac

SEQ ID NO: 2273 - DNA, 393 bp, Bacillus thuringiensis
tcgtgatatctaatctcttacataattgcaaaccctgctcttatacctgaaaaaaagtgacccataggggcgattcttattaacatacagggggagacacaaattacaagtccacctgctactgccatacaccacatatgatgaatactaaccacaaatgctgccatacccaagtgaattactagtggatacaacggctgaccaacgataaatacgcggagcacttgtagtaacacatatttgatccttgcattttgtccacctcccattcacatacgaaatgctagtgaagcgctgtaccaaaccgacacaccgtaagcttgcaaggcttaataccaagcttgtggacttaagactccacctaaaataaaagtatgacgatccaactaacca

SEQ ID NO: 2274 - DNA, 434 bp, Bacillus thuringiensis
acacggttcttgcctgcaagctgccgccgttgaggggtccgacggagcagcccaggttctcctcgaggcgggtgccgatatcaatcgtggtcaagtcggcaccatgggaactgcactgatggcagcatgctgcactggctggaagcacatggtgcggctgttgatcgagcatggggcagatgtcaatgcgataggccacaagcccgactgctttccacttcatgctgcagcgtaccgcggttatccaaacattgtacgatccttgctcgacgcaggggcggatgtcaacgcccgggggggcatgtacggaacggctttaattgccgcgtcttatggactcgaatctgatatctgcgagattttgctggagcgaggcgccgacccaaatatcgttgctgggaggtatggcactgcggtggcggctgcgtatagcg

SEQ ID NO: 2275 - DNA, 317 bp, Bacillus thuringiensis
ttcctgccaacttcaagcggctcgtcgccgttgcttagcagcgcgtaatcttggcgtccttcgcctccaacgtttaccgtgtccaggcagctatcgacgccgctgtggcaaacggccgcaaggtggccttcaatggccgttcgatgatgcgcaacatggaaatcgcagagaagatgggcttcttgaaggttccacgcggcaccatcatccccatcgatgaggctgccaagatggctccgcataagaccatgctgattaccaccggtacgcagggtgagccaatggcagctctgtcgcgtatggcccgccgcgagcac

SEQ ID NO: 2276 - DNA, 458 bp, Bacillus thuringiensis
gcccttaataggcagttcacctccacgcaccgactggcaccagcagttcatggtcgttagggtccgttattcacatagctgctccattgcccttgccaatggaaatataatccctgccagttgcagcgttgccgttcactgtacatccaatcgtgcactcgcaaggtccgtatccgatgataattcttgcgagtttaccccagaccgtgcagtctcttgccgaaacagcctcgtctccaagaccaagaccctcaagtgacgagattacgtctgtatctaaaatacgtgcgaccgagggggtaagacccgcatagttaactcgcatgttgcggatcacaccgataatgtcattcatccggtcctcgtcagaggggatgcagagacacccgccgtttccaagggtgagaagcatgctgtcgatactgacgtcaaagcgtaggacgcgaaatcaaggaccc

SEQ ID NO: 2277 - DNA, 436 bp, Bacillus thuringiensis
ggaaggacgattgggaaagggcgcgcctgggtgggctacttccagtaccacacaaccccatgatgtaacggggaaattccaaatcaagaggcctaattgattcacgctgtatcacgcaccatccctacgagcaaaaatggtagcatgtcaagcagtcaatgccaagcgtcaccagctggtggccaaatctaaggcagaactggatcggggcacaaatgaactacttaagaaaaaggcccaaaagatcgcaacgcaccgagtggacatagcgacataatcaggcccttctagtatcaagatggacacacttgaggaaacctggaacattgcttcaagagggctgcatgacacacaccatattgaagagcaaatcactctctagcgtgagtaaagccgaaaacgtatggttaccttaacagcgaataatcaaaaaaga

SEQ ID NO: 2278 - DNA, 493 bp, Bacillus thuringiensis
  unsure (1)...(493): unsure at all n locations
ctcctgatgttgcaagctatccggcgcagcatttttgcaatgcgcaggggtgtttcggggccggatagtttcaagggctggttgaccggcatcggcatcatcgcggcggggttcctggttggcgagctgctgccatcccctgcctccggcgtcggcctggttgtgccaggggcctgcattgccggcttcgtcgtcggctgctggctcaacaggaaaggccgctcatggccgacagccatttacgaccaattggcccgttaccagccgctcaacgagcgggcgtaccgcgacctgcaagagacggtgaaggaacgcggcctcgactgcgatgcggtcatggagtggacctacatcgagcaggccgagttcatgcccctggtgcccaccaaggaggacctagcgcgcgacangttcctgaccgcgacgcgggccgatagggccgaggacgatgcgcgtgcgcgcttcgtcgtgctccatcccaagaaagcgcggc

SEQ ID NO: 2279 - DNA, 166 bp, Bacillus thuringiensis
gtttgataacttattaaagcagagaagcaaatgatcatttggctcaatcaccaacgattgaacaactagcccaacttagaaatgagatccgaatgctctcagtaacacgttctggatcggatgatactctgcacccatcatagaaattataccaggctttacaagc

SEQ ID NO: 2280 - DNA, 434 bp, Bacillus thuringiensis
cgcggataagtgtatgttgctgatagacatgcacgagatgtagggggacatgtaaaacgttgtgtgcgtaaagatgcctgatggagatgaccatgtctaaatgagatcaaagcaactcgagtgaggttgctgaacttatctctcgaaggcagaattgatcaaaacgaacggtttgagaacctttcagttaagagcatcagggtctacgctctgaacgaagattcaagcgttcattaccagatactattccagggatttaaagagcgtagaacaacgctaccgtcaacggtacttagacttaatcacagggagcgcaaggcgtttgaggggcgctgctcttagtacaagaataccggagaggagaagatacttggatgacagctggtatttcgaggtggaagcagctatgatgcatgccattggaagtagagctt

SEQ ID NO: 2281 - DNA, 425 bp, Bacillus thuringiensis
tatattgagtaacgtactatctgcctatccattattaatgtgctgtggtgcaccttccatacatatatgagccgaatcacgtgctacacgctgtccaggaataatgtctaacatagagacacggctactaacgatggcctttgcagcattccatgcgcgagatttaatgagtaacgcacgaatactcgcgccaccggaactcagtagaacgtcttgtacgtgcaggaaggaactggttaaataacgactacgtctcacatatccgcctctgattaatatggaagctgattagatactaacaagcaatccaaggactgctatcatgagcgtaccattgctggcaatatcaacaggttatgtaaaacgacggaaagctctaattggaatgtataccgaactgtcagaaacaacgacaccgttacata

SEQ ID NO: 2282 - DNA, 390 bp, Bacillus thuringiensis
ttcgtgatttaatctgagaggatttcaggtgatgggaagaatgcgtatggaaccgacgcatagatacgggcttagggggcatgtccaatacgctttgcagcattcacagcaaaagatcgtccttctgcacacgcgagcaggagaagacgtttgacagggtctaaaccggctatttctgctgttactggatgctcctgttgggatccagtatgcatacttaagagacagaaggtcctgtgttcatctacaagaaggtcatcagttgctgcatttgtagagcctggtgattaggcaggttgtacagcggcatttgccatcgactattgggttcctgcatctagaaaatgggggaggagctttaaagattgcttgttgaatccggtgctgata

SEQ ID NO: 2283 - DNA, 207 bp, Bacillus thuringiensis
tgactcgttgtgtttgacaactaggccggtccttcgactgacggaattcctatggcaagctggggatacactccatgaaacgggacatgaatctgatgctggaacattacagagtgtaaacgtatatccttcacactgccacgcatcttacgcaccaccagcatttagtggacagactgcggagcctgaggagtgagctgactcaca

SEQ ID NO: 2284 - DNA, 417 bp, Bacillus thuringiensis
tcgccaagaaagaatgagcttgggcagcgaccgagtttcggtgccgtaatatgggtgtgctctgcggtggtttatctcatactaacggctagcaatcataggaacagtagggggttgcgcacgatctaaattgaactggccactaaagagagtcgttaaagggcgagacgattaacgaccgatataccagacgagctgctgaacgcgcaactgctgaagcgaataaattgtcataggctctacactgattgtagaatttgcaaaaccatctctaaatgctgtatgggttacagaagaacttcataagcgtttgcatgctttactgaggttatctatgtagctaatgcagcatgcgactaatttcacttaacgtacagcgtaggtagctccaacgattacactcacatatcggctacg

SEQ ID NO: 2285 - DNA, 576 bp, Bacillus thuringiensis
cataactcttttccaagacagagaatttaaggataaaaccgtaccgataatcaggcgcgtctcggtcacgaaacactaagcccccaataacgccgccaacgccgccggcagcgacaatcaaggccgacccaaacgctcttcgccactgacctgtgatattattcgactggtaagttagtgatgccgggatattggcgttgcaggatccggccagtataaaagccccaaaatatcgcaccccgttgtttttcgcataccccaagagcgcaacccccattatctggagagcggcgttgatgactactactatccctcgcgtcttatatttatcggatagccaagactctgttagaccgaggagtgtgccaaatagaaagcactatttcagagagtcagtacgtaaccgtgatcatggagggaaggacgcatacaggagcagtaagagtctgggcctctgcaacattaaattcaaggccctgcatgaggacaataggaagaaagtacgagacggcatatctatatcgattagttctgaagacgacattgtatcaatgaatgacctctcacataacgatg

SEQ ID NO: 2286 - DNA, 206 bp, Bacillus thuringiensis
ggaaatgtgtttctagcaacaagtccaccactgggggggggtttatatacacaccggctagtaatcacaatagcagcagttcttggacatgacgatccaatcttcactccattccgcggtggtatagaaacagcaacttctgcaggggagctaccgggctactcaccacttgcttttgcatatatggatgtcggatttttcaccct

SEQ ID NO: 2287 - DNA, 561 bp, Bacillus thuringiensis
tgctttatcagaactcttcaccatggcacggcgagtgtcctcatccgcccctgcgtatagtttcttgaagaacccatctacggggtctccgccatactcagaatctacggacccctcgttatcagagtcttcttcgtcttcaccctcggtcttttccttggccttttcatcctgttttgcacgaggtttctttgatttctttgccgtgagagttgaagcaagcttgtcccagtctttggtgccatggcgcgaggaagttgggtaagatggagcggattttggggcggaagaggcagcggtaggagtgatagtagaagacttaatatcggtagacgatgattcgagagagccccatttctgaccgggaacctgcttgcgcaggacgagttcaattttggttgagaatgtggtgactatggaagcggattcgtcgatggaggcgaagagggggtcgagattgaaagcgtagtctgcacccgacgggaggggaaattgtacagatacctagtctaatcagcatgtttaatatgtccagcggagcatgtaagcgtaccgagtcac

SEQ ID NO: 2288 - DNA, 500 bp, Bacillus thuringiensis
  unsure (1)...(500): unsure at all n locations
tggagttattngcactgcatcaaatgtcgatcttcctatcccgcggatcgaatgaggaaggcaatcctaacgggcgaagtgcctttctgtgttcaggcaaattgtgaaggaatcgtcaaacctgctatagttatgttcggcgagagtcttcctgagggttttgacagcagggaggaggagatgctctccactgccgatctgttgctggttatcgggacgagcctgaaggttgcgccatgctcggagatcccgcgacgacttccgagccatgtaccaagggtgctggtaaatcgagagctcgtgggcaatattgggactagggaaagcgatgtctgtctcctgggggactgtgatgcgtggttgagggaggtcgccagacatctgggttgggacgaggaacttgagagcgtttggaaggatactctggtacgcaaggagaagagttcgagggacaaggggtgggatgataaggctgagcagagcccaacggtggaggaatg

SEQ ID NO: 2289 - DNA, 482 bp, Bacillus thuringiensis
gtgtacaattgcacccagaagtacgtcactctgagctctgcaacgatacaatcaaaaactacgcatggggggtatgtggctgatctgcaggatggaacatggagaactttacggatgttgaatcagaaacagttcgggaatctggcggagacaaaatagtactatgcgcactgagcggcggtgtcgactcttctgttgtagcagcattaattcataaagcaagcgccgatcaattaacttgaattatcgctgaccacggctcactgcgcacaggcgacgcacaaggcgtgatgaaagcatttagcgaaggctttcacatgaacgttattaacgtgggtgcaagagaacgctttatgtacatgatacaaggtgtagaacatgcagaacacaaacgcaaaagcatgcgggacgaacttcataacgcatttgatgatgaagcgtataaattacatggtaaggaccttttagctcacggttcactt

SEQ ID NO: 2290 - DNA, 105 bp, Bacillus thuringiensis
gccgcgttcttggaagagctggaagggatcgcccatcgttggggcgaggacgccaaggccaaagcggagcggatgctgaacgccgcccttgcggccagcaaggac

SEQ ID NO: 2291 - DNA, 280 bp, Bacillus thuringiensis
  unsure (1)...(280): unsure at all n locations
ccacaagnnacgcacggccccccttttttcccacccacannnaggagnncnnggagcgaaccaaaaagccctagcgcgttgaaacacgnccgaagggtacatccgccacgccatactgcatcgcccagcgatgaaacggaagccccaaaaaatcgcacaactcccaccactgttaaagacgaagcccctcgctccggaagaaaccgagaacggaaaaaaacctcatccacatatataactcccaagccccaaccaaaaggacgccggaaccaggaagcac

SEQ ID NO: 2292 - DNA, 408 bp, Bacillus thuringiensis
atagcacctcttcacacgctgactcccgtcatcacattgcctcaataaaggcttgctgtgggaaagctattcatttcatctataccaaattggatgcatcatacgtatactaatcgagatatgctagtggtttatgaaggaaagcaatttgaataaacataagcaatgctggaacacgctcttctaagagaaccatcggtacaagctcgaacagcttcgtgtcgattcttacaagtacaacacggtgcttgtcaatatgtatagggaccacttgtaatcgaaggggaaatccctatatactatactaatgaaattgccacactggtgttttagtactagcagactatttttactcgtgcaacctaccgaatgggttgttgtaactaatacagcttttgctacaactgc

SEQ ID NO: 2293 - DNA, 304 bp, Bacillus thuringiensis
tgattctagaccacacgtaaggcgaccaaagctattgttacccgtaacttatacggcagccaactgggggactcaatagaatgcaggtggtaaaacaacaccttgaacggcaaaaccaacagtacgacccctctgaatgcaaacgccgcacatccgcataccctctggggacgccatcattaacaggaccggcctgtacagcatttactcacagtaacaccagcctgaatggctgaaggaaactgataggggaaggactgagccacgatatgatctgaaaccggattagccagatgcccccatt

SEQ ID NO: 2294 - DNA, 181 bp, Bacillus thuringiensis
tgacggatcatacggcggaaacacgtatttactatgttttagattcgaataaaacgtatcgactaattgacgagcgtctattacaaaaattagaacttacagaacagcaagtgcgtgaaatggcattattcaacgcacgctcattaggttatgaatttaaacaagacacagtagcgggtaa

SEQ ID NO: 2295 - DNA, 297 bp, Bacillus thuringiensis
atacggacaggaagtggcgaatgcggaaactactcacaccgatggcgcgcacacggccatgttcatcaagacatgctaatgctgtccatgactcgatgtgtttcccttttacaggccactgtactcaatatcaatctcaatattctcgacctaatttctctaaggaagttccaaatgctatgcgtgttgaattatatacttgacctgtatgacatacttttggggtaacaaataattctgtgcgtgaaacaccagattcacgaatacgcttggcgacaccgtcttcaatttgataga

SEQ ID NO: 2296 - DNA, 304 bp, Bacillus thuringiensis
acgggtcccagccagagtgcgtgatgtggttaaccaaatgatatggtacttactttttcaatcgatagaacactcttgataccggttagtgatttctgaatctgccagaagatgtctgggttgtctggcctaccgatgcttaatcacccggtcatagcgagagcacatgcgcctgaacatacgaatttgcccgctgtctctgatactgctttgtaagcgaccaatagttggtctagataaatgctatgtgaggctcagtactgacgcgattgaccgtctttatcaatgtgctcctacacactat

SEQ ID NO: 2297 - DNA, 366 bp, Bacillus thuringiensis
ctgctgttaaaaggaagaagcggaaccaatgaagggggctgttttaaaagaaatgcggctcaaaaaagagcaggcaattgctgattaacaagagcaagctgattctatatctgttcaaattgcttctaatgtgattgaggaggaatgaacagatgaacaccaagtgaagataaagcaccattatattaaagacgtgcgagaagcgcgaggagcaatgggattgctgcttatcgtaatgctggcaatgtttgtaagattgctagcgaaaaacacgtatcagcattgaatgaagaggaatgacaccctgtacacaacgtttatgtaagagaacggacaactacatagctacataacgcgaccgttcat

SEQ ID NO: 2298 - DNA, 397 bp, Bacillus thuringiensis
caagggtaatcagtaaagcaggaccgcaactggttttttgatcacgagtgccgcaccagaccggtgggcatagaggaacgatttcgcgtgatacgacataccagctacttcaagcgtgcccaaaagaaccatctcacgagcaacaaggagtactgctgttgccatgagatagccaagggacgtggctgtcatcccaagatgaatctctaatacctgacagatcatcatacgagagtgcgacccctgaacgacgtcaacatggaacatatacgacatgcccaccggtgagtaaggcatatatgacttgcggttaagaacaagctagaacactttcacgcccgtgatcatcggccctttagaactctttaaaaatgttaagttgttgaacgatctatgt

SEQ ID NO: 2299 - DNA, 428 bp, Bacillus thuringiensis
gggttgcagcctgacgtgagagacaaatgatgttcacgatcgcaatcaaatgttttttaacaataaccacctatattagatactccgcctacacgccccttatgctaaacaacgttaatcgcactgcatgatccgatacatgataccaacatctaacatccaatccatagacgtataacagccattattctgctttcagcgcattagtaaccataaacggaattaagcagccaggacttcgatacagacagtagatattggcacaacgggtccctataacggtgaatcgatatgtattatagcaagagagagctatcatgtgcgcactcgtcttactcgtagagtatggcctatttggcgctcaaggagatttccgtgcataccacctgggaaatcctaaagtgccatacactctatccgttgacact

SEQ ID NO: 2300 - DNA, 406 bp, Bacillus thuringiensis
gggcctgggatataaacgaagaagacctcatacgactcctacgttagactactaagcgctaagcaatacgctatatgtgcgccataagaaactcgtacagcatctacacgatatatatcttaaacgccagctatattaactgcatactgctcttcgggagcggactgcgcctactgatgatctgtaaccgtaatccactaatggcctccattaccatctagcgcggcgcgcttagatactggagcgacagaagcacatttgactcataagaggatggcgatgcacctatacttgcccttagcatggtggcgcttaatacttgcgagaccgacctgtaatctcattaatctcacgagctatcatcactaaaactcgcacgagtgaatcgttatgtaccgagccacgc

SEQ ID NO: 2301 - DNA, 659 bp, Bacillus thuringiensis
  unsure (1)...(659): unsure at all n locations
taacaaagccacgatcgctcggttacctatattgggccctcgtcctctcaatagggttactaaacagaacagtgcaatttttcttcgtctgccgatccgatatcactccatcagccctagtgctctttcaaaacactccattccggcgaatccaccacttccttcatacacactttctcgttccaacagctctcccatcacacggccgcagacttctctgctggacattctccaaccgcgccgaggcgctggtcaccctcggattctggatccttagtataatcctctgcagtgtgagctatcgcctatctacggacaatatatagtacgttctagtatccctctctgccttgcattcatccgactgaaccgcagttgtgcaatagctggccttccacctccacccaattgattcggtacatggccgatcggacgggtattatttcgttcgcaaacctgccgctactatggctattcgctggccgcaacaacatttgcgcctgggcgacaggctggaatttcgccacctttaatgtctttcatcgacatgtcgcgtggattgcgacgatccangcggtggtgcatacagttctttatcttgtcttggtttttggaagtcagtcctgttcttacccggaggtttcgtagcatggactgac

SEQ ID NO: 2302 - DNA, 200 bp, Bacillus thuringiensis
catgcgatttcaattcctgctggtattacaaatatgtctttactacgtttcactacactaacagcacttgcgattatcccttggtctattattttcatttatttaggtgaaaaactaggtgaaaattgggaaaatattaacgatattgctggtccgtatgtgaaatcattcgctattggtggcgacttacttatactttt

SEQ ID NO: 2303 - DNA, 409 bp, Bacillus thuringiensis
  unsure (1)...(409): unsure at all n locations
gccagagccggcacaanncaaaacaccacggtcacacccccagaaaacacccggacgntgggacctggaagganaggggccgcaacacccaacccaacaggaaaagcaacncacgccccggaagaggccccgaaagagaccaaacacannaaaccagcagaaacccacgccacaaccgcaaaccggaaaaggccacccagacacccagaggaaaaaacagaaaccgcgaaccacgcaaacaccccagcgggagcaccaacccaacccaaacggacaaccgacggcccaacgaaagccccaagggaaccagaagcaggaggcaagaagcacacaanggacggcaagaacacggaaccccacccacaagccgacaagcccaggccccacccaggccgcagcgcgaaccccc

SEQ ID NO: 2304 - DNA, 324 bp, Bacillus thuringiensis
ctgatggcgtttcttttcgctcatcaaacgacgctgctaatgcgggtgttactggagactccgggagttctccaatgtgaatgcctgcactatcttcacccatgaaaacacatccgtccacttgttttccacgcttcgatttaaaaaatggcactctctctctttgtttcgatcacagctacatacaatgatgctccttttggccattgtcgccacatcttccaatccacgcgcaagatctgcctaaaacctactcgcgactatcaggaattataaccaccctactgacgccgccctcttactttcctatcccccttgcttacc

SEQ ID NO: 2305 - DNA, 393 bp, Bacillus thuringiensis
ggatgatggccccagctatttttttttcacccgtcttgtgcaaacacgcctgacacgggtctacatgggggaatttttaaagctcttggagatacgtcccatctaaaaaacggatcgtttatatataacctattctgtttattttgaatagtcttttgtttaccaaagttaactcttccataacgcagaccttttttttattcgcatgaaacacctcatcttatcatctcgtttattgcgcaacttgttaactcaccttacttacatctagcatatcgccatcctgcattggcggactcattgaccacccccttacaccatactgtgaaaagaaaaacgttcgaaaaaatactgcgaataatacaccaactaaaattgctcgtatccactcta

SEQ ID NO: 2306 - DNA, 431 bp, Bacillus thuringiensis
gattgaccaacctactcaaaaagaaatccgtgaccctttatataggggacaggaaaagcaacacaggtaggaattttataagggcattggtcgtaacaacgctagggaccggggcgacaatcggacccggaggcctagtctcaactggatccgccgccagaagagatgccgatccagcagacacttgtttattcatgagtgcagccatcgatgggggaactgcagcaatatgttacgcagaggctagcttctacactgcctgctccaggtagtgtgcacacatactcatctgccacaataggagagattgcagctcatcataatgggatggacatcactatccgaaaatggtgcaacgcctgccgcaatacctggccgatgggctggctacctcccataactaaccgagtggtttagggcctgaaattcca

SEQ ID NO: 2307 - DNA, 615 bp, Bacillus thuringiensis
caatagacttttttgattggaaattaaaagataatccaactcagattatcgataatgtaaagaaacagacaacagaagaagtagaagttgttttaatgcatgaaaaggcgcaaacattacaagctcttcctgaaattattaaattttataaagagaaagggtatgaatttggtgtatataatgacgaggatcattttcgtctaaacttccaaaaagatcaacgtctatagtataaacatagttattttaaaaggtgtttttattactaaatcaataattaagcaaaagtcgatttcctattttataaagaaatcgactctttcgtttatgtattatgtcacaagagtttccttattttctccggaatgtcctttttagaaatctatgcaacagagcctttatagtaagagtatcttgttgggaatgatcaaaaaaatctatattgtaatataaaaaatcgctatgatatgaaaggataccatacaacaatcccaataaattcttctcaataattgagaataaaatcaatcccgattattatattgttattgaaatttatttattgaagaggatcatagatgaaagctcaaaggctttattgaacagagataagca

SEQ ID NO: 2308 - DNA, 349 bp, Bacillus thuringiensis
tatactctagcttctttttaatcaaactaataccaagtctatgggctactggagcaaagagtggtagcgtaccattcgctatgcgacgctgcttatcttgaggcatatgttggaatgaacgcaggtgatgaaaacgatcagctagcttaagaaaaatacctcttatatctcgagccattggaataaacattaagcgatggtatattgcttatacgttgtcgggcgggaaatatttgctcttagcaagctgggtagcaccgtcaagacgcatagtaattaatctgctcaattcccagttacataatcactaacagaggcgatgggtgtaacagtacatcatgctagaaac

SEQ ID NO: 2309 - DNA, 353 bp, Bacillus thuringiensis
tgaacgaaccggtcacacctatcaagagtattctagacgatgctggtacaacaacaatttacgaagaggattgcgtaatatctgtctgacacgcacggcagacggaaagcgtgagagaatcgaggactaacattgcgtagcacgctgacctatatatgggtgtcatactcgctgcgggttgactaggcttaccgactggtcaggcaccgtacactaagacacatgacgctggaggcaatagcactcgtaacatagcttcataagaaggcatagaataacacactgtagtctgctggactaacaccacatcagcatgcgaaagaacattattagacggacattatgtgaaagaa

SEQ ID NO: 2310 - DNA, 374 bp, Bacillus thuringiensis
agcgagtactgcgaacagccaggaaacgatacaggaggggacacataggggaaagaaccgggcaaagaaccggtgagccaaagggagggcaaaggacaaaaacaggaaaaaggcccagaggctacaagaagtagagcggcaccggccagccaacaagacatacaaaggctaaccctcaggaacaacaacgagaaacccaacaggactagaagggggccggcaggcggcccccaaaaggcgacgacgggcgctcacgggtaacaacccacccgctaaccggacgaaacacacgaacaaatcccaaaggaaagcgaagagcacactggaaaggacgcagcaggcgatccaaggcgaagggaagaccccgcacacaa

SEQ ID NO: 2311 - DNA, 243 bp, Bacillus thuringiensis
cttggatttttattgaatatctagctaaatatacatggtgaccatctaaaagtcagggggcgtaatccaattgaaaatgttcatatttattcaagccttaatgtacatatttaagttagcatttatatttttaagtatcaattcccctactcgttccttattttcatcaccaacccaacaactaaataattcgaaatagtctatatcttctaaattacctttcataaatgtaaaagcttgact

SEQ ID NO: 2312 - DNA, 531 bp, Bacillus thuringiensis
agatagtttttagctgaccgtgtagcacaagaattgtttcaaaaatcatctattaaacaaattaataaacaagaaactgttattagaaattctagaaatgttacagttacgactacagatacagacatagcagtaaatgttcaaattcttctccaaattttattagctttactagtaaaattaaatattttataaaatgtttaaccttctttagatatagtgcatcttacaggtaaatattcactgttttaattatagtacaggctataaatatttatcataactggattaatattcaacatcaccaaagtatgaatgtaaacaaacaatgtgatggaaaataaagtttggttattttatgaaaattgaaaagccatttcctttattggatttggctttttaattttaaacagtatgaatttgaaaagataatattaagcttaagaagtaaaatatactgataccaaatacttataaaaatactcgtgttatagaaaaatataagaaacaggtgttaaaatagaatcattt

SEQ ID NO: 2313 - DNA, 198 bp, Bacillus thuringiensis
cacgttctttagaagaaagttatacaaaaagattgtattaaaaattttattgatataattttgtaaggtgagtatgtacgggttttagaatggggatttatcccgcattaacgggcagtaacacccctacctcaaaattcagcgaaagcaaagaagttaggtggggatcaactgcccgtaaaagcccgattggtgaag

SEQ ID NO: 2314 - DNA, 439 bp, Bacillus thuringiensis
caaaaaacgcgtgcgtcaggtgtagtcattacaacactgggaggaacagggggtactatcaatagtgtacatgctgattctatagaacagcagattaaatcagggatagaacaagaaacagataagcaaatcattgtaaaatttaaagcggatttggatttgccatatgaagatggtattgaaaaacaaatacaatctcaaacgaatgataaagtaataaaagatcttttgacagaatatccagatgtaacatttactcgtttattcacatctgtaagcccggaacaaatacaaaaccttgaagtgaaagcacctaatcatgtatctacaagtttattaaactactatattctgcaaaatcaaaatagtgggtatgaagaagaaatagtagataagttaaaggcatgttcttctaataggaaatgcgaatatgaagaaa

SEQ ID NO: 2315 - DNA, 625 bp, Bacillus thuringiensis
tcaaatcctcaggtagctatccaaagaatatatgctactatgatattaagaaactatgcgttcccttaaccctgtatccggccctgtatttattacagggtctttgtttattttattggcttataaaggttaatacacaaccaatttcaattaaaaccgtttaaatgttagttagaatttgaaaaaatatatctattaacttttttaacaaatgtaatctaatattaaatttctaaatctatactgtactatacaccagttaacactatataaatagtattaaccctcttaattgaatattagcaataataagtataaacattatcaatttactatatcttacatttatgtaaaaatagatgtatgttaagcttattcaaaatctttcccctaataaagatttgaagtagcatttcatgattctccttactgttaatatgccttgaaaaagaaccctatagggttctttttcttttcattataacctcagtaagtccttatttaacatgcaaaaggactgctaattacatgcagcccttttacatgttaatatacactcgtattaaatacttaatactttcttgccttaggcgtttatacaaactaaacctgccattattattta

SEQ ID NO: 2316 - DNA, 559 bp, Bacillus thuringiensis
ttcggaactgcattttacgaacctgccgctcgcgctatatttggctcacagccagctcatttgagaaaaaatttatttacatatttaaaccttagctttaattgcggcgcaataatcggaccaattgcaggaggattcttactcttactcgatccactctacgctttctctctaacaggatctcttatgctgttatttgcttttattttttacttacttaaaaatcacttccaagtcactactgaaaacacgtctattacattaggaatacaggtcatcttacaaaacaaatctttgcttctgttttcctttatcatgattttcttctatattatgtttactcagcttactgacgcacttccacttcatatgaaaaacattagtaatagcaatcaacttgctacactcgttattacgataaatgcgataacaggcgtcatatttatggtattattccgaaaattattccacaaatacaacacactttcgattattaaatacgggggtttattaatgagtatttcccttttaactcattcctttatttcaacacccatat

SEQ ID NO: 2317 - DNA, 142 bp, Bacillus thuringiensis
catgcccgcaccaagagggggggctgtaaggctaacaccggtgtcagccacccaaaataccgcataaaggggataattacctcatgggatattacgagcgaacgagctagatgcccggctggaaggttcagttcatgtacgg

SEQ ID NO: 2318 - DNA, 429 bp, Bacillus thuringiensis
gttctttttctttctctggtctttgtgaaggtggtaattgtactaccaacgataacatggccgttaaatctttcattaagaacgtttcaagtttatgttgttgttcaaacatgcgttgctcttgatagtacggaagtgcattcaatactgaaattgtaatatcatcaaccgttctttgtaatgaaggatttattgagcgtttatacgcttgaattgtatttaatgcgtctggataacggtcattaaaaataccaatttgttaaatgataagtctgtcggttttacagattgctgtgtctttagacttaagaaatctttcactttcatcgtatctacattaatatcttcattcgtaagctttttcgtagtttttgccattacatgcactttttttttgcttttttttcggtaacatcgagaagcacttgt

SEQ ID NO: 2319 - DNA, 142 bp, Bacillus thuringiensis
tgacaattgtacaagttcaaaaacctctgcaattcttgtctttttacgttttccctttagtccatacatcgttgctataaaatctgcattttcatatgctgacaattcttcgtataatgcatccgcctgggccatataacca

SEQ ID NO: 2320 - DNA, 305 bp, Bacillus thuringiensis
aatcttgcaggatccttccacaaacctacggtaacagttccattcaatggggtttgctctcctacaccgccataccagttaaggtactgctcagctttatcgcctccagccgtagcgggagcaaagtcgtatgcgccatcgtctgtcttgtttgcgaagaaatagcactcatcaaccttttcagcacctaaagttacaaatccaggcgcaccctgatactcgtcagcagcctcgtaagtaatccatttcgcctcagtggtgctgtaaatgtagtaggcgttgtcttttccttccactgcataaaa

SEQ ID NO: 2321 - DNA, 146 bp, Bacillus thuringiensis
tattgtatacgccaggtcattctccaggccatcagtcgctattcattgagacggagcaatccggttcagttttattaacgattgatgcatcgtacacgaaagagaattttgaagatgaagtgccgttcgcaggatttgatccagaa

SEQ ID NO: 2322 - DNA, 236 bp, Bacillus thuringiensis
aaagtcaacataaatatttaacacctcacatcagaattggcacaccatcactcctgcctcattctattggccaaagcaagacatatggccaaaaccaaagacaagaggtaggggaaatatctttctgaatattatttaagctaccccagattcttatctttcagctctcagagcgctgaggttttaatttcatcctgcctggatgcttgcagtggcctcctgtgtggtctccacac

SEQ ID NO: 2323 - DNA, 179 bp, Bacillus thuringiensis
tgttctctcctgtttggaaatggctcttccccagtaggtccccatctaatttcagcatctggggaaccagcttggacattccttcattaaaatgggtttcatgtgtgtcccactctcctttcggaactccagtactcacggcccctatgcagtgaagagagggtcccaaatgtttgata

SEQ ID NO: 2324 - DNA, 107 bp, Bacillus thuringiensis
cgcaaaaacaattgttatgagaataataggaactaaaaatttcaagtgttcccacttaacccctgcaacaccaccagcgtaccaaaaagctaaatcttgacttaagt

SEQ ID NO: 2325 - DNA, 446 bp, Bacillus thuringiensis
ttatttatttatttggtacatatacataatacaatgttaatatgtgctctatgtgaagttcacataaatttatgatgaagatttacttagccactcgcatcctactcatctaattacccactgcataaaatcatcagttattttaacacattttaggcgtttgtatatactatttataaaacaacttttataaaggggggattcatatgcctacagcgttacaagaagaagtcgaagaagcacgggaaacatatgtcagtcgtatcatcttagttggaggatccgctttatttttagtaggcggggttatctcagcaatttcagcctttaaaacttataatcgtttggagaatacgccgccttctacagataattcatagatattttataaaataaaacgtcgcctccaatatgaagagacgacgttttattattcatacatatga

SEQ ID NO: 2326 - DNA, 470 bp, Bacillus thuringiensis
tacatattactgggttacttgctcttgtttaataggttcttttgatacaatccatggtgtattttcatttaatacgtacggattatgctgaataaacaatatatctgaaaacatatcatacaatctttcattcaaacgtttcaacttactcgttaataaaaatgtcttataatgtatctctacgatgtccagccattcaataggaaagtatataaatgataccttttcatttaaaaggggttctactatattttcaaatgttagcagccttaattttttcataaaatgattccttcctttcttcagttgtcttgattatcaaaaagctagaacaatagttacttaatctaatccatttaaatcaagtatttaaaagaaaagtaaaaactatttatctgaataaaacattatcaaatcgactcttttaacaattaaaagtaattatcatatacagcacctcattatattta

SEQ ID NO: 2327 - DNA, 271 bp, Bacillus thuringiensis
cgaatcatgtaaaaaaagaacgaagaaaatcaatcgtaaagatatttattattagttttataagtatattaatgataccagtaagtttgtattattatgcgacagaaatagaacgaaaactagtaacagttacgtggaatgaaatagaagcttctacaatttctaaagagtttaataataaaaaaatattgcaggtttcagatgcacatttaggaccagagtatacactgaaacaacttggacatttattggagaagatgtttgtatttct

SEQ ID NO: 2328 - DNA, 115 bp, Bacillus thuringiensis
ccgacagcacaggtcctatcccttgtggattggtctaaccagccaataccctgggaggagtactggtgtcagcccagaagcccagcccaggggcagtccttgatgagggaagaga

SEQ ID NO: 2329 - DNA, 907 bp, Bacillus thuringiensis
cgttaattaatggaatatctctttgacgctctgggttttgtttctcagcttcaagcatgccagcaagctttttccctaagtatacttgtttatcaagcgcatgaattttatcgtgcgattgttctttaagcatttcaagacccactgtatcctcttgtaagttatcacggccaattagaagggatctaatgatttcctcgatttgtttatctatagattggtatttatgcacgtatgtttcaagtggatttttcttgaatactttaaacattattttcttcataccacttgctttaagtgaattgggatcaagctctgataccacttttcgtaattctaacaatgtatttggaatttcttcatttttcccattcatcatcgctgttacaggacgttttaatgctgacaacgtttgtcctgctgcttgttgctctttatctcctaaatctcctagctgagacaatacttttgataaatctgtattttgctcgctatttaacttttgtacataaagatcagcttctttattcagttcctctaattctgcatcttttataactgtatcaactactacttctacattattatctttcatgatcgatacaggttcttttttctcgagttcagtcaacaaaatcgctcctttatttatatgtgcgaatttatatgcactatatttcatctattatatcgtatttcatatacattctgattgcttgaaatcgatttttttagaaatgcctgtttatgcagtcattccctgtttcttactataagtatacctgtaaacaacataattttcctcagacttaagacctagagaacgacatgctgaaggcggattcttcgatgttacgtatataaaatatgtcttctaatccttcgactcaatttttgacatacaccc

SEQ ID NO: 2330 - DNA, 159 bp, Bacillus thuringiensis
ggggaaaaaaaggagacaccgcgggttctacctgtgccgggaaagaaacggtttatgtcgacaggacggctgaacaaatatcagatccgactgatggggaagaagaagctggatagagtgcgcaacacgctaggtatggctgggtacatgcgctcaaga

SEQ ID NO: 2331 - DNA, 476 bp, Bacillus thuringiensis
ccaagctgacaacaaatatcacttcatgttcatgattcgaattttataaaatctcgattatcatcaattcatcatctagacaatataatatataaaagaggccatggcataatcatatataagccaaataaaatccaagttcttttcatttattgattataagaaaaacaaaacaataggtctaattaagaaacaatgatataaattaacagtgggtggaggagaatagggattgcgttacacgaatacaaaggttgatacgtacatataaatagctagatgcgagcatacataaagttatacgacattattgagttgcaccgtggcggtaattagccatcatagactgaccttgctcctgctgtggctgctgtggtaaaggcggttgggactgtggttgggactgagtcatatgcttgttgttgaccctttccctattcttatggtagcgaacaccacgtgacttagcctggaaa

SEQ ID NO: 2332 - DNA, 443 bp, Bacillus thuringiensis
tttatgtttatatatctaaaaaactgtgagttcatggaagtaaataaaactgcggcgtaagtactgcagtttgttcctttttcattgagttgaaatatgtaaaattacgtactttaactgtagcggacttgtactacgcgttcatattaattttatagacgtttaaggattttgttttatgggaagtattcttgctgtgaaattaggattgtaaatatagatgaacgtgattcaaatcaaaaaaaggtactcctagaagtaccttttttactattctatatgtgcgaacgctttcaaaattattggatataaatcgatgtacgcattgtattaaatggtgcatttatagatgtcttttggtactcaaaagttccttgttggtgtccagaagcatcccatttataataccagccaacgattggtcttccgccaatttatagtgg

SEQ ID NO: 2333 - DNA, 127 bp, Bacillus thuringiensis
ggatattatgaaaaaagcgaacgcaaatccagctcaaaaagcatttcagttatcgctcatatctgaggctgattataaaaaacaattgactacaatagaagaggaaaaacgaagaaaagaagaagag

SEQ ID NO: 2334 - DNA, 256 bp, Bacillus thuringiensis
gagggggccccagaggatgagtaaggcctacgtagggggaaggaggggaagaaatcctcgaagctggtatgagtgtgagtgtatctgaagcggggtttgctggggatgtttggctctgaatgagagggatgaccacttgttgagcttcccatgtgcccggccccgcagtgacatgtgttagctcgcctcatgcttaccacagccctgagtcaggtctcattatgttcattttgcagatgataaaaccaaggttcag

SEQ ID NO: 2335 - DNA, 425 bp, Bacillus thuringiensis
cttattcttcactattttcatattctagtaggtggggaggtgaagaatatgactcatatcattgattaccaagctactcagcctataagtaaaactggtgaaacaacttttgcaatcccagcttctccaaataaagcaattttagcaaatttaaaattgagaatttcaagtagagattcacgaaataatcgagtagaattaatcgctacagttggtgtagaaggtataactgagatttcccaagttttatttcgaatttttcgtgataatattgaacttttcaatacacaagtaggtattgaatcaacaggttctgaacaattctacgtacaaacattttaagctatagatcaaaacgttagcagtggaacacacgaatattcattaaccgtagaaaacctttactagtggtgcaaggcagaaag

SEQ ID NO: 2336 - DNA, 330 bp, Bacillus thuringiensis
ctcacttgggtttttttatagcgaaaggccaaaaaccgtgggaaggccgcatttctgacatctgctcataaggtcagcaaagcgtaacggaacgataaaaatgggcgctaaaggcataggtggggaaggtcgatagggctagaaagaatctaggcgttataccctgaaagcacgctcgagcgtgctgctgctgcaaatatggcgtttaagggataactgtcggactgtctcaagtctggaagagtgtcactgtcttatcagtcaaaatgtaactttgcgagttctcgatctgtggaagcgtgcaagctgacacgtgtgcacctatctcgc

SEQ ID NO: 2337 - DNA, 716 bp, Bacillus thuringiensis
tagcttggatcctctagagcggccgcccttttttttttttttttttttacagaacagacgaaactttttaccactctcataaacagacaagcaatgctagtcatacgtacaaagcgtgacaaacagtaccgccacagacaagaaatgcacccagcaggagcaaccgacccttgggattcgtgcaagaagcgacgtggtaacttgaaagttgaaacgtataaagggttttgaatccgattcacagccacagaattttaagtacaggcactggtaatgagacacgtatcaaactgccatatgtagtgcagtgtaagcgtttgatgtgattcgtgcagagtttaccagtgctgatgaacaatgaccactgttcacacgctcagttgtcccctcttggttcggcgtcctcgtcgagattgatgcctgagatgctcattttccctatatttacaactgcgtccagtccacacagatttggcatatatttggcaatatgatcttccgcgtctttatcagccttcagcgtctcgcattcaaaggagagcaagactttctgatttccgtgctccttctcaaccaaaccaacaatgtcatcttcccacccatgcaaatggtcaatgttttgtaatcgagcagcatcatggccaaaaaattccaccaacaagcacattctaaggacgggtgggaggcgtggtgcggtcccggcgattccggcccgg

SEQ ID NO: 2338 - DNA, 330 bp, Bacillus thuringiensis
atcaactgacctttattttgccagaaggccaaaaaccgagggagggccgcatttatgacatttgttcctaaggtccgcccagcggaagggaacgataaaaagggaggctgcagggctagttgcgttaggtcggcacggctatcaagatttgccgcattttacccttcaagcacgctcgagcgttctcaacctgacacttaagggatcacgggatacctgtctgactgtcgcaagtctggaagtctgtcactgcctgagccgttaacctgtaagtttccggactgtctgtctgtcgaaggctggcagctggcttgtgcgcacctatcacgc

SEQ ID NO: 2339 - DNA, 252 bp, Bacillus thuringiensis
ttcctagaacggtccagaaaaggaagcccaacaggaaccagaaggttaaccagccgaggatattcagcgacaactgcacgatggcataagttgtacggccagtgtagaagttatgcgctccaacactgcccaagaagaagcacagaagcaacgcagctacccaggacttttggttaccagtcgccgcatattgttgctgaggatagccctgctgcggatagccaccagagtggaattcctgggagtaatacg

SEQ ID NO: 2340 - DNA, 595 bp, Bacillus thuringiensis
tagagactaaaatactgcgcaaaaaaaccacaggaagatacaggtctcctatggctgggcgtgaaaaagccacaggaaagtatacggcctcctgtggcgaatttatgaattaaatgaaataaagtacgattttcaattctccattagggtggtcgaattcatatttaattgtccagaaaacacaggtgcagttaacgctaaagttaatgcatgtaattgtaatttcatcatttccttcgacctccttttagaatttttttcttacgttagtaagtatatacaattaatggataattgtaaacataaaaaatgaaaatttttaattttgattaaaatgcgtatatttaaaagggatttgaaagtaaatattgttattaacgaaatatcgataaaaatgggggatgctaaatgaaatatatgcatcataaacatgatcgctatgctaacaatttttttattcattgcggcttgttctaatggagaaagaataaaagaatatattcgatattaggtcagatgattattaagaaatattctgggacaaaccttgggaataattcaaaagtgggtgcaatggataatcatttacccggtg

SEQ ID NO: 2341 - DNA, 211 bp, Bacillus thuringiensis
gaaccagctttcactaactctcccgccctcttatacacggcctcataataacaatcagagagcactttaaaacgcccagcgcgtaacactccattaaccaaccaactcccaaaaacttgactcccagataaataacattaaaatgctccatctatactaattgttactagactacttgctaccactaacgaccatccttcttcatttatcg

SEQ ID NO: 2342 - DNA, 373 bp, Bacillus thuringiensis
  unsure (1)...(373): unsure at all n locations
cggtcagacattcgctatcacaatgacatgctaatcccgtgctaatatactatagttctatgatctgctagccattaactaggaagatttatgtgtactatacttcgctagaaggatgcatggactgcaccgtagctatcaaactccgtccccaatccgcatcttacgcctactttacaagcactgttttggacgtcgcggctctatgtcttctagccttttgtcgcctttcccagttgcatctcccatttcgcgaagaatatgtccctccaaatgggtatatcaggcatgacgcgtcccagccccatttctaccatctctggggcagctacagcagtttattatatgatcatcatgaagcttgnntgttgtt

SEQ ID NO: 2343 - DNA, 328 bp, Bacillus thuringiensis
ctacaagctaaggaacactataaattgggggaacatacagcggccaataggctaatagaacaggggttaagaacgtctactaaaataggggatcaagagtatatacacagatttaatatattaaaggaattgaataacaaatctgatttaaatacattagaaagtgtaatagaagcaggaatttcctactttgaagtagaagggttaacaaagtgcgttcataaatatgcctaaatttttcgctactatgttttataaagaagcgaacgacataaatatcaggtaaatactttttatattagtaaatgaatcatagaaaacatttttt

SEQ ID NO: 2344 - DNA, 206 bp, Bacillus thuringiensis
aaactttacaaaattaggcattaatattcccattttacatatgagaaaaatgacattcaaagagggctggtgtcttccccaggaccacacagggaacaactgctgcagctgaatttacacacagtttaatcccacgtcatactgcctcccaccaccaatagcttcaggggtgtggtacagtaaaccttagactgagaacttttcca

SEQ ID NO: 2345 - DNA, 560 bp, Bacillus thuringiensis
tcatttgcaaattaaattccaagtaaaagaaggagtaccatctggttcggaaattttaaatacagcaaaaatacattttacaaataaaaatgatgtaattggagaaaaggaatctaaacctgtagtttgtattccgacaactggaataattgagttaacaaaaattgatagtgctaataagaataaattaaaaggtgcagagtttgtacttaaagataataatggaaaaatagttgtcgtagcaggaaaagaagtaacaggtgtatcagatgaaaatggtgttattaaatggtctaacattccatatggagactatcaaatttttgaaacgaaagcaccaacatatacaaaagaagatggtacaaaagcatcttatcaattattaaaagaccccattgatgtaaagattagtgaaaataatcaaacggttaaattgacgattgaaaataataaaagtggatggattcttccggtaacgggtggcataggaacgactctttttactgtaataggccttacgttaatgcttacagcggcatttgttttctttagaaaaaagt

SEQ ID NO: 2346 - DNA, 555 bp, Bacillus thuringiensis
gcaacatctcacgcctcttcctcgaaaaagagtcgtggtttcgagatttcgtctttttctcgtgggatttcgcatcccataatggcgcagcggctatatgtgagtacctagccggttcgacgagtggatttgcagagcccaaagcggatcagcccggcgcattgcgaccgcaacttgtggagatcggtgggttgcagttcgtccaggctgggttcagcttcagaaatacttttggtaccgggaggggcgttctgagattggctaatgtggaaccggaggagtggaaggcttggacggtgtttactgtgctggagcggttaaacggccaagatgagctggaagcaacgagggcagagaaagcggaagcgcaggctggtgcttctggttatggaactgagccgtccagcgtccaaagcgatgacggtggcctgcaggttttggttgttggtgcaggtgagccatttgaaaccaatttcaagtgggtcggaagcaaagcactaacacccctcacaggtcagtgtggactcgcacttgccgcgcatttgcaaaacctag

SEQ ID NO: 2347 - DNA, 833 bp, Bacillus thuringiensis
ttattcgtgtttatttactttataaaagaaatgttggggttagggcagttccatatcatttgaaaaaataagaaaattttttaaggatagcttcgcgaaaatgaagctatcctttttgtgtatatgctatgcataattgcatatggggttaaaaattatactaatataacttcattggttatttgaaagtagtgttttctgttgtgatatgtagatatttcaatcgataaagtgaatcggattatattttgaaataaggacatgaaagcttgaaaataaagggaatgaaaatacttctttacgatatataaacagctgtgtttaaatgaccttacagtacaaaacttatatgaaaacaaaatgaaatttcatatttacgtatgttgtttagtttaaaatgaataatatttttatgtaatatattcactgtgtgaatgtgggaatttcgatgaaatagaaaatttatacaatattattcatactaaacacatatgaaaaataatgaaatgttttgtgacgataagtaagtactgtagcaatacgagagaggtggttcatacatagatcacgttgagaacgttctctattttaaccatctcaaattatgggcaagaaaatagaataataaaatgcgatagtaatagttgctaatacataggaggagttaaagtgaaaaagactttaattacagggttattggttacagcggtatctacgagttgcttcattcctgtaagcgcttacgctaaggaggggcaaacgggagtgaaaacagtatatgcgcaaaatgtaattgctccaaatacattatcccattcaattagatgttagga

SEQ ID NO: 2348 - DNA, 488 bp, Bacillus thuringiensis
ccacaaatagactctactgttcctttgataacttgttcagacaacatccgattttgcatcgatacattaagaacacggaatccgtaataactgcttaaaagcagactagctaattcttcagctgattgcttctttgaaatttcacctgtttgcaatccttcctccatcactgtttcaatagcttgtttaagaagttcaacatgcttcgagaaaatttcttgtaccattaaatcgtttttagcacgttctatactggcattaatcaataaacatcctttttgatccatattctcaaagtcttctttcaatgcccattcaaaaaaattacttaatcgttctttaactggaattggagtatgtaacaatttcttttgttccctaatcccaatttcatggtagcgttctaatacttgtttatacagttcatgtttactaccgaaagtattgtataaacttccttttccaagtcctgtatcactgcataaatc

SEQ ID NO: 2349 - DNA, 135 bp, Bacillus thuringiensis
tctcactgtaatgtttaatcggtttggaaacctcttgcagaattccgcagggatcaacatttttaaggtcaattacacaatcggggtcgatggtctagggatattcacctttgatcttggaacaattcaaaagag

SEQ ID NO: 2350 - DNA, 146 bp, Bacillus thuringiensis
tcagtcccagagcagtctagggcagaggccatgctctttccaccacagtgcccaattggtagtcatactatggactgactagttcaaattctgcactttactcacggtgctcttgaggcctctcaaatcgtcccaagatggaaaag

SEQ ID NO: 2351 - DNA, 137 bp, Bacillus thuringiensis
ttcgcgatcctccagtaccgcggtcttctccgcttcgcgcgcttcccaaatgtttgatcccacaaaatccgctaaccgcaggataacttgtcaaacggaagagatcctgcgatccgacgctcgaataatttccaagt

SEQ ID NO: 2352 - DNA, 522 bp, Bacillus thuringiensis
tgggctggaatactcttcgccaagtgtataccgatcgctgctttttatagtctcagtgcgggcggcgtgagcagaggctccgtcgttcggttccacgctaaggtcgcggacctccagaagctgtgactcgatgaatgcaatcttcatgtacctcaagagaggggcaaagacatagtctacatctatgcgggtgcctaatgcgacagtccggttctggatgccaatacgatatgcgatcttgttcgcccatacttcatccaaagcctgcatacatgttagacgcgaaagcgtatcagccaaggcgtactcacaaagtcgtgggagcacggctccaggtcagggaccctgatcacacgtagtggcttgtcgaatgtgatatcgcggccgtgtcgtcgcccaatctcgacagtgaacaagtacgagatcgacgcttgcttcatgccttctaccgatgccggcaacgacccttccataaccacgtagaacggatacttgtactacccggacgcaccgtattggtgc

SEQ ID NO: 2353 - DNA, 520 bp, Bacillus thuringiensis
aaaatcactctttatagtaaatgaatgtttactaataactgtttgttgaatttatgtggactgaattatgaggatgcgagaagtggttttagggaacgagaatataaccgaatataaaatattactaaacgtatataactaatgaatacaatgtctttttcagttattaagttgtaaatcattttatgataaaatcttttacataatttaataaaggggtagtatttaatgggttatttctcaaatggtttattagttgtgtttgtgcttatcgtatgtagttgtataatttttggttgataatataatgagagtcttatataaaagacagttatcttaagggagagaactgctttttattttatattgagaaggaattctatctttcttattgaagactgttctgagtatttgtacatcgatcagatttgtgtaaagggaattctatgaaatataaacaagctagagaatagggagtgtatacatggaaaatagtatacgctacacaagtgaacaccct

SEQ ID NO: 2354 - DNA, 625 bp, Bacillus thuringiensis
  unsure (1)...(625): unsure at all n locations
ttaaataagtcaatttcatctttctttttgacaccaggcttattcatacatacgtataaagaaagttcatcacaaaactttaataatctataatgcttatcgaacatcgcaaactgttcctttgttaacgttttcaaaattcttttttgtcgttctaattcatgtttataaaatgacatcatctcttcatcttcctcgtttagtgggaatgataaaaaatgtttactacaaagcaatgccccgtatggattagaattttcaatttcattcaatccaatcgtataaaaagcaaaacgtaatgggcttggacaatccataaatgtatatggaatatttttagcatcattcaaaattggtactttatcaagctctatccatcctctgtcatgctcatatattgcatcaactgtttcttttaaatatgttttatcttcaaaaaagtcttcttttatatgctttgcaatctctccagctaaaaaaccatgatcatgttgacgaattaaaatactttccttctcatttttttcacgaaaaatcattcgtatactccccctcatcctcatattaaagctntttatatgcatcgattcttaattaatccctaaataatagaagggattcagtc

SEQ ID NO: 2355 - DNA, 589 bp, Bacillus thuringiensis
aatataagtgggtagtaaacctcctaccccaaatttagctacagcaaagaagttagatggaagagtaatccctcccactgattaaaagtttcactttataattgttgcaacctttttatttcagttaaaagttcctgactttcatgatatcctgctagcttccatttatcttgatcccttttcaatgttacaatttgatactgtccactttttgtccgctcatatacatataaatttttatgttcttcatcatacgacattttcgtttctgaattaaaagaaaacggtgcttcttttgccggaagtaaatattcaccactttgtttatcacttctgctattttcatctgtaaatacttgaaggaaattatctgtaaaatacggtgataacgtctctatcatcttattcatcggcaaatgcttcccacgaattgaaaactgggtttcatagcctttttgtatcgttgtaaatacttctttccgatcgacttccacttcctcttttcctaaaacagtcgtaacactataaccaactagaaaggcaacacatacaaatagaacaagccatattccatattttctcatttttt

SEQ ID NO: 2356 - DNA, 477 bp, Bacillus thuringiensis
gttttatgttacagtacttcgccgcatgccgtatcttctatcaaggtcatatccccattcagtatggatcctgcctctggcatagctcaacaatgtccattttcgttgggccaggatgagacgccaactcctgcggcttcggcccagttaccggtgtttttagggtacgtcgttgcagttctcagaggaggaggatatgcgacaacgagggctcattgaatacttgggaatctgtgcggccgtgtttctcatgttctatggcgaagccagtggcatatataggctatttcctgatttggaggacagcttctttcaactcgtacaagagagtgttaggcgggttattcttacacagtccatccgtagttgcagctcgagtttcgataatcgggtgatttgagtcatagaagtttgcctgatgctcacggaacccatagaagttgacagtgtgcggaacgcgaggatgataagacagcg

SEQ ID NO: 2357 - DNA, 340 bp, Bacillus thuringiensis
catagcccgacgccactggcaatacagaaagctagagggaaaagtccccagtatgtggtgccaaaagtccggccgaggacaatgatcccggccacgatgccaatacatagactggcccctcgcttttccaagttctcaaacatgggtttgaaggagaccgtcggcgtcgggtggaagaggatgttcgttctctctccgtgaatgggcacgtcggatgtagtaccctctgcgatgggatccggcggtgctgtaatatcttggttttccttatattcggatagcggttgattcgagtcggaccttactggctttactcatctgtcaacagccatctaatcta

SEQ ID NO: 2358 - DNA, 173 bp, Bacillus thuringiensis
ttctctccgcattttacgtacattgcaagtggggccagcttatatcaggccggtgtgtttgcaaacgagactgacttctatacaatttacagtctctagaattccgcttctaggcttcacttttccacaggaaaatatgtattccttgtattttgtgaaggtcagaaaaaagg

SEQ ID NO: 2359 - DNA, 874 bp, Bacillus thuringiensis
  unsure (1)...(874): unsure at all n locations
ttgtagggaattaaattaccccaaaatttttttgacagaacaattgtacaactgaaatgggttattaagtaattcaaattatattttaaatataatcctatttccgaaagcatgttttaaattccaaaagttacaaacgctcgttataatattattatgcgtttcagcttggaccgatgttatttgtagtctcgattgtctctaaaatggctgtcaattcaactggtaggatgtatacttggctccccttggccggggcagttattattcatattgtagcaccgctagatacatttaaacaagcaagtgaaggtgcgtttagtagtggtgaaagatccacctctttttttagtaagacaaaaggagctatgattaagggggctataatatatgtattaatactacttattttgatgtattttcaaaatgattattcaattgatttttttgttatgtatggagtaggaactgttttaatgtatgcggttgcaattggagtggcagaattccaactattggcgtactgtagatttaaattcaagtcatttaatatgtcatgggcagagaatgagagaatgcgtgggagaatttgaaaacaaaataagaaattcaaaatgaaaaataaataatatattaatagaattttagtgtttgaaaaataattgaaacgtatagaaggtgaagagcagtgatgtggaatataaaagaagaagatttagataagtttaggatgacatgtaatgatcgtttaagtcctgagggtgctatggttttctttattggagggatagtttatacttncagatttatgttttttatttttatggggnngggtggtatatcaaaacttaatttgataaaacaattgtcaaac

SEQ ID NO: 2360 - DNA, 462 bp, Bacillus thuringiensis
gtcttgtttaaaagagcggggaagacgtaagggtgatacaaacacgttgcccacgagttaatcatcttatataagagatgggtgtatacttttctgtaaacaggtaaggattagaagtacaaaatgggttcactcacatagggagggaaggctatgaccttacaaagtgaaggttgcattgtctgacagacaaaaagaacagaaggtctatctgaatataataatttaatatgctatgaatgagaaaaggatatggtgaatacagagacagatgatccgcaatatataccttatttaaagcagcttccaaacttgagcgtatcatatttttaaataggcatatgcctatcatgttttctgctctgtatagtagatagacaatgaataatgcggaacagatgctgatgaagtcaaaatcgtctgcctttatatcgaggcgcaatacagtttaaagaaagaggg

SEQ ID NO: 2361 - DNA, 259 bp, Bacillus thuringiensis
gggaattacaattcaagatgatatttggatggggacaaagccaaaccataacacttctgacacttgtgttgtagaacttacagggctcacagctttacaatttgctactcacagcatcaagcaactcaccacaagttgaagctctttgatcaaccagtttattatattaatgatgctttaaaactttgcaaactgctatacacatatgccaacagctctccaaaggatcccaaatatctataaaacaactatatagatt

SEQ ID NO: 2362 - DNA, 448 bp, Bacillus thuringiensis
tcgatccgaagtcgtgatgaagaccatgatagacccaactgatacttttatatttcaggcaaatatcacagacaatgggccgttggttaccacgactaagacaacgctagatttaatcagtgaagagaacgaggtcaagtgaataaaactagggctgatcatccctacaggagctatatagattagctggaacaggacgacacacgttgcgggcattatatacataccgttgattcctatacacctccgtatgcggggggagtaactacagtcacactcagtacaactttttgaatatgaaaaacaaatcgctcattaattaatacatatacacggacaactaattggatactgttttcaacatatcaagaaattcataaaattgcgagctcttcccttttcattcattctatcgggtgatacactacaagcctcgctttcacattaa

SEQ ID NO: 2363 - DNA, 507 bp, Bacillus thuringiensis
tcttggatgatagtctatcttcacgcttgcgatcccgaaagcatcaccgatgaatcccgggttttcgagttgtttttgtcacatcctgatagcatcgaggtgcttctgaaccgcggcagcgtctttcctacgccatcccctaagacaaaatccgagtttgataggagaacagcagcgatccatgcggagaccattgcacaagcctcgtatgacctgaaggaaatcaaagccgatgctctttggttgagcgaaaaggctgggattgatgaaatcaacgcgctttggatcacggtcttggaatggcaaacccgtcctggttcacgtctccttggccgactcgctgatgaggaagccactagcttgaaacgggcagtcggagtcgatacttttcgggtgtcacttgccgggccgagtttcgctgacattctcaacgccagacccggtgatggaaacagtgcagccgagtttgtttcggagaagaatagacgcctgcgacttcgggaacta

SEQ ID NO: 2364 - DNA, 433 bp, Bacillus thuringiensis
aattatgtcataaccatatgacaattgatttattggagccattgtatggattctcttcggaaatgtggcgattaacccatcttttccgaaaggaaatatttcaatcattttcaaagagtgaacattatggaatgatttttacatacgtatgggcgtttaatgaaaagaaagattgggatgatgttgaaagtatatgtaatatttttcgttcccaaggggttgatatttattttgttgaattagaagctgatgtagaagaaagacttcaacgaaataaaacacctcatcgacttgaacataagccaacgaaaagaaagattgaacaatctgaacaaaatttattaagcacatttgaaaatttttagattaaattcaaaagaaggagaaattacagagaaaaattatataaggatcaatattacgaatttaatgc

SEQ ID NO: 2365 - DNA, 703 bp, Bacillus thuringiensis
attgcatatttcgtacttttaatttttgtatatgtattattctatttataaaaatataaattattaataagggtgatttatatgagcaagttccgaaagaagattattaaatatttgcaaacattttggggatgcttagcatttggagtattaatgtttgctatcttcttaattacggatttaacagatgcatctttaaatacattaggctggagagactggctaggttctgtagcaggcgcaaccattttatctgttgggatgtttactttaaataaattgaatttaaaataaatattcggtcaatactgaatttgggctgtatgccaacattcatttaaagtagtcttctctgtatctccttgtattgagcagttagcttttgctagccgctcttttattttgttccggttcttgcctcttaaagaactctttatctactttcccccaataaggacacatatctattctacattgctacaaaatgaaatctatattttgttatacgcgttgtttcttcaatcagccaagatacaatattaaaatcattagtttcaccctttaaagatgttccgttccaaaagcattctttcatcacttcaagtaatttttcaacagcttcaatcatctcatataattttccctttctcccaaatactattttgtttattaattactgataataaaacaaacaccttattaa

SEQ ID NO: 2366 - DNA, 491 bp, Bacillus thuringiensis
tggaagagcatggtatgttctattgcttctcatccccgttcgatatgcagcgcgagccgttgctaaactatgccaatgtgaattacgaacaaattccttttgttattttctttatgattcgatttattacagcaattgtaaggaaaaaggaaagtgacgatgaagagtgccactcaacttgtaatatagcgaatgttttttaagctaaatacatggaggagatttatatgtggtttcgatttcttatgattggtttcttttcattaacagcaatttctttaatgggatatcaagtgtctgaaatttttcaagcatatagcgatacattttttaacaaaaactaatcgcgttgctatttgaataataaagcgataaaatccttcttaagaagttttattaagaaggattttttctttgtcttatcttggtgggtcaaactattggcacatttacactgtgaatagtatggtaaaatagtgaggttacgtata

SEQ ID NO: 2367 - DNA, 191 bp, Bacillus thuringiensis
attgttcttaaagcgcgcgcaggtggattctgaagtctttttaaaaagcccgggggtcaaccacggagggtcattggaaactgggagacttgagtgcagacgaggaaagcggaattccatgtgtctcggcgaaatgcgtatagatatggacgaacaccagtggccaaagccactttctggcctgtaactga

SEQ ID NO: 2368 - DNA, 114 bp, Bacillus thuringiensis
ttgcttcccgctcggtgagtaggagttttgtggtttcgatttcgtcggcagcctgctggagttgctggttgagcttagcgatttcctgttggttttgttgtcgctgtttggggg

SEQ ID NO: 2369 - DNA, 269 bp, Bacillus thuringiensis
catctttccagatgaaagtactccccctttcgaaataaatgcaacgtggtcacaaagttgttcaactaatgccatgacgtgagctagaaaatactgcagaaccacctgaactaacaaatttctgtaaaatctttttaatagtagttgcagaaataggatctaccgcctcaaacggttcatcgagaacgagtaattttggcgcatgaagaagtgcaagtgcaaggccaagttttttacgcataccagtagaataataaataactaaagtc

SEQ ID NO: 2370 - DNA, 353 bp, Bacillus thuringiensis
tctcgatttggatttcttttgacgctcttcttctattgcgaaaagaagaaatgttttcgtgtcttcgatattttctaccgttatccccaatgcattttttatatgtggatcacttgatagctcgaaaatcacatttgtatagcataaatctagtggtaataaagtgacgtgctgcatggttgaaaccgctcctaaactgggagatcatacttatactcttgctgcaataaatagtgataatcacctacaattacaacctatacttgataatacacatttaccagctgggcaagcaaaaatacgctttgcacatttctctccagatacccctggtggtaatgtagatttaaaag

SEQ ID NO: 2371 - DNA, 665 bp, Bacillus thuringiensis
acctattttgtacctaattgatacatagaagactctgtgcgggtgtggtcttacaacaactgtggaatgtaaataggattatcatcagctgtttagaactaaatattttatctatgatggatgaacagaatgattattatagaaatatgaagtggtggtggggagtaaaagattacctataatctacctactagaatcactgctaatacagcagttgctggtttcctcctggccctttatccacgtgaacctaattgaaatcacattggctacctttcctactcaatattagaccagaaacatcttctcctatgctacttcatacgcttcaaagcttaggagaaaaatgcttctctcttccttgtacattttatatggtggagagagaatatgtgttccactcctagggacagacactgtgggagagattcttccagcattgctgatcgattcactccattacgaaaatcgagaaaaggacagaggcagagacctcctctttctggtccctttatctgggtgtcaaaaaaatcaagaagtaacaataaaatcttattattttagatagataaaaaaaaacaaatattcagcagaaggagttaaagactattgttgcgtctggagacaggtgaacaaaggaactgttgtttttcttaacaagcgtt

SEQ ID NO: 2372 - DNA, 566 bp, Bacillus thuringiensis
  unsure (1)...(566): unsure at all n locations
agatgaaaataatatttcaccaattattaatcgttatcaggaaattacggaagaaaatgaagtgttttctgtgaaaaaaggggaagttggaaatggaaatgtcttaattttaaatgaatctacagcacaagcattgattaaagaaaaactttttcgaaaacaagataatggctccaattatattatagatacgttaccgaaattccccaaagaaggggcgctattatttacaagtgaagacaataagactatgaaaagtattaaaataggagaggaagagattcctgttacatacgatagtgatgcttggataggtaacaatcgtaaatattcaacggaatggtatatgattgtagcaaaaaatagtgtttataaagaaataaaggcaaatgaaatgaaaatgcatcttcttcatttgaaaaaatcactaggtgacgaaaaacctaaaatgtcgacagataatacattggttaatgaaaatgtcaaagtaaaaaagttaatttgaggtttggaaggagaagtatcttttcactttgtaacgattggcganaaaccttaaaaaagag

SEQ ID NO: 2373 - DNA, 417 bp, Bacillus thuringiensis
actcgttccgtccataaccatcataattatatttttaggctggtgttctacttttttcaccttagcttttgccgaatgataattcatcatactttccgtacttaatacgcttactattatagctcccactaatagtaactttttcatcttcacaccataattcaacatgattgttcctccataaactttgcattcatttcaatacaccttatttccttttccataccaaaacctacatatgttttattagttcccaattctcataaagctaacaatagttactttctctttctttaattaaatatcgatatgtatcatttatcttataaaaaagatttaacatccttttcattaattacttgtttaacaataaatcctcgattaaaagaaataaaaatttattgttaaacaataaat

SEQ ID NO: 2374 - DNA, 160 bp, Bacillus thuringiensis
catgcctcggcctgccacgccgcagcgctccatgagcatgttgcatcacgtagggcatgcggcacccgtgagtgcggaccgtgccccgctgctacgacgcttgagcacggatcaacagtcgacagaaaagccgctgctgagggagttttccgtcgacgtt

SEQ ID NO: 2375 - DNA, 470 bp, Bacillus thuringiensis
aggtcacaaagggcttgaataggcttgcaaaagatatgacagtcggacagaacaatgtcgaggtactgtccacaatatacagataagcaaagtgaccagttgacttgattaagctaacattgttagagaacaaagttaagataaggagcctggacttccaccttctgataccatgtgcattctttctggagataccatttccctccttattaaactcacatcctaaatgaagataagcaataataaagtattgctaacattcactaccaatgatgctaaataaggaaatactgaaaatgcataagccattcaacggagatctaagatggaaaaacctggaaaagaaaaataataaggaaaactgaaaatcattgagggggatggaaatgagagacaaccttagatgacggttgtgtcaactgggcttataatgagagtaaagctttatcaagttaattagtaaaagacag

SEQ ID NO: 2376 - DNA, 416 bp, Bacillus thuringiensis
tgcgtaatgattgtaatcgtaaatgtaatgggcttagctctgttaaatggcagaaaacattcatatcattacgcaacccgtacggatatatagggcatctttgtcttataaaaagcgtacgttgcgtatatcgtaacgtacgctttttatgcattcctgtgcatatcgtcaagcggcggtatgcttttttttgtttattttcccttgtttggttccgataaaaaactttggaaggtggaaaaatgtgatgagattgtatgggttacgaaatgtaaaatgggatgggtctggatagcggataaagaaatgagaggtaaacgagatcgagaagggagaggctacattgttataagtattactaaagttaaaatggttttttagggagcactggaagagatatagcattgccattggag

SEQ ID NO: 2377 - DNA, 113 bp, Bacillus thuringiensis
ttattgccccagccgccccttcaggtcaggcaaaagcctcggggctccgcaggcctctggcaggatgtatattggggggagctgaggccaatttgttgccaggagcccccatc

SEQ ID NO: 2378 - DNA, 522 bp, Bacillus thuringiensis
tttaatgttgtaagtctactactctatataatcggtttacaatactttagtttatacgggggaggagagagagaaatttttgctggattattagttgatagaggatatccacggttaattggattgctagatgatcctaacatttttattttctataatacaatattttttatgtactatatgacgaatttgcaaaatatcacaaacatcttagggttaattttatgtgttacgacgagtctattaaccttttcaagagggggaatattagcgcttgtgcttgtcatttttgtatatatatgtatgtctagtttcgctaaaaaaataaaaataattatgagtttagtattgtttagtgtagttatttttagtttatcgaatagtgtaatggggggcccattacatgacatattaaataaacgaatttctgatttttcccatgataatggaagtggtagatctgcattatgggaagctgcttttaaatattatttatccaatccatatatcggaattggtgcg

SEQ ID NO: 2379 - DNA, 561 bp, Bacillus thuringiensis
ccataagatcaatattaactacaaaaaaagaaaatgagaaaactacatccgaaaactcaatccctatgcaattagatcttagtgttctcaataatttaatagcttctggtataaacaaaggttctaattcagttaatgaaaattcggaggcagataaaactaaataattgctatgtttgtaacaagaaaatatttatctcctattttatctattcttattaataactacctctgattaaaaaggagactacttatgtgtaaaaatccaatctctattattatccccatacagcatcaaacaagcgttttacccgaaattctaaaagcatgtcaacaactgaaacctttagaagttattcttattattaacggatgtattgatgattgtattgatattacacgatcttacagttgtaaagttattacactagaagaatcaacagaatataatatttgttatacaattggagcaaaaaaggcaagaggtaattgcctattatttttagatgaaaattacattatttcaatcttccacacttatacaatttctttaaccattac

SEQ ID NO: 2380 - DNA, 542 bp, Bacillus thuringiensis
catattttcttcttttgcttggtacactttaattttagccataattttaatctcctttataacgtaatcgtagaggctacacctcattataacgttttttttatgaaagatgaaattgttatatgtatttatagtaaaaattatgtgtccttactcaaaattggtgtgatttccatataaatgtacgagtaggtaacgataatgttacgttaaagttatattgtccaagcttttcttattttcttcctatatatatgtagtagcaattctatatagagaagggatggagtgtaagtgggtttgtgaaccgagagtttctagagattttgttcaagtacctgaactggtaggttttcgattacttttatcacatccagctggagaccctttaaactacggattattatttattaattttcctgatacgatttttatttttatattggcatcaagcggataccttgccatttcgaactgtttaaaaatagagggcggaactggtgatgcccaaatagaagagatgaacaaatgattgaggatga

SEQ ID NO: 2381 - DNA, 693 bp, Bacillus thuringiensis
tacaatatttaaaaaagataaggaaaaagtattggtcgcccaatttattcgaatggaatctaaatttggccagtggtatgctaaaatctttaattttgagacaaatggtgttcaaataattagatgtgaataaaattctttctattgaggaaacaagcaacacgaattcaaaaaatcttgaagaactattaagttatcttacaaactttcacagaaaacctgatgcaattgattttagcgtcattgttaatcaaaaaggaaaggacatttttgataaagagaattatccttccatgaggatacaaaaagaaaatgaaaattatagtataacaggctattttaacaagcaagaagttgagtttatttcaagttattttctaaattttggtgaaacgattatttcaattcagcctgtgatgctaaaagagttaatctataataaggtgttatctataaagcagcatttaacttctttaagataaagttagttttagtcattttttgatatgaaaaagcccttgcgatttaaatatccaaagggctttttgatgattttatttgttctttagaaaaattaccttttgtggaaccagaaagaccattagaagaacatcgtaacgatatcttttatatgtttttccaaactccttcagaagttgtgctccaaatcattacctaattttgaaacatttg

SEQ ID NO: 2382 - DNA, 536 bp, Bacillus thuringiensis
ataagtatatgattgaacaattaaatcgcacgcacgttgctgcacggtcgaccgaaattcaacttgaaacaacaaatgagctacctactataatcaaggaacgtaggtcttgtcgtcaatttgatatggaaaaacatattagtttttcggaattttcccgattcttatcaactctaaaacaggttagggaagaaaaaatatactatcattacgcaagtgcaggggggctctatcccattgatatctttgtttatgtaaaaccaaaacgtatagaggatatgaaagctggattttattattataacccatcaaaaaatagtcttgtgattgtaaacaacattgatcaagtaatcaaaagtgatcatgagttaattaatcaggatttatttactcaatctgccttctcagtttatttggtttataatgcgaacgctatcatcccgaaatacggttcagatggatatctattgcttgtattgagtcaggcattatcactgctaccttaatatgggggctgagacattaactataggggt

SEQ ID NO: 2383 - DNA, 345 bp, Bacillus thuringiensis
acgtacaagctactttggtgttacttgtcgagggctcggtacatcttccgaacgtcgtaccgcgtattgcaatcgaacggcgtgtaccgggcaatcatacgtatagtcatgcgagctctagcgagagtgactgatgctgacgatcgtaatcatattgctttaacggaagagatattagatcgctgggctggtccatgctccgtaagctatacatccgccatccggcgtaatactcgaagagcaactgacgggggcatcagagcacacccttatgattggacagtgcacagttgctacagaggccggaaaaagtgcaagcgctgctacaactacagacactgtctg

SEQ ID NO: 2384 - DNA, 235 bp, Bacillus thuringiensis
gtatgctcgtcattgccacgggcaacaatagcagctacccttgcatgcgaaccatttactgcatgtgctacttctcctgggaagcattcccaatacaaatcgatttcttcagggacactgtcatagagcgaaacctctgataccactccaggcgaggcttcgataaactttgaagcagcacactgggttatctcaggcaaaggatggagaggaagtccacacaaagaatcaatca

SEQ ID NO: 2385 - DNA, 531 bp, Bacillus thuringiensis
tgtaaacatttttgtatattagtaagttcatccttcgtagctgggtttttcaagcttaaatttgatgagatactgtgaatggtgtctttccacatcaccttttcctccttatgtgcaatcaagcatactcaaagaactccgctaaatttattgataccatctttctaacaattccttctccctctcgcctgaaatacctgcttttaattcccattcttccgtactctccatccactcatacacatctgtaactgtctcgtctattcttctaaaagtaagcccttcattaaccgcactttcgatacaaatagaaaacccgcctctccacggcttcgtctcaccatctaatgggaaagtttctggaatccacaaaggcatttctgtccaaggctgcacattgtgttcactcataaacgattcgtctacccaaacaaattcagcatcgctattcgtaacttttttacacgtatttaacagctcttccatcgtcaattcatcattcggacctgttatattgaatgtacctgcttt

SEQ ID NO: 2386 - DNA, 340 bp, Bacillus thuringiensis
ttcggcatttttcaggctgtcaagagggagaaggaaatcgaagaagctgctgggggggaaacgcaacgaatgaagaaacgttacttcaggaattaaataacttacagcctagcgatattgttgtagatgaatatagaactgatgagaatatagatagaacgaaaactgatcgtacaaaagaaactgtaaccaaaacaattttaatgaaacgtaagctatgaggttgtacaagaagagttacagggaagcgaagagactgtatatagtatgcttgccgaaaatcatcatgtgaaaaattggcagacaggctcattcatgacattaggggtaggcgttcttg

SEQ ID NO: 2387 - DNA, 291 bp, Bacillus thuringiensis
agtgcttgcagagccctgagcacaggcctggtgcctggcgcacagccattgctgaactttaggatccttccttgtgcctgggaggaccagccaccaggagggtctatggctggcctggtgtgtccaggtgaacagccagggtgcagttaccaccgaaggacactaggtggagccacaatctatccccagacccaggagaagctccaggttgggggccgcgacctattgggttccaattcaccttttgtgcttaggaggccaattcttcacaggacttcacatcctgcccat

SEQ ID NO: 2388 - DNA, 124 bp, Bacillus thuringiensis
ggcaaacgggcgtttccccccccttgaaagcgacacgacagatgagtgcattacgacccatcgtggcagctatcaactgtgcgacatgataaactcgaagagacttactcttaatagagctgtc

SEQ ID NO: 2389 - DNA, 534 bp, Bacillus thuringiensis
tgtttttatcaagaaagtaaggaatatgtaaaatactaaatgcaactgattatcatcaaagaagtaaattagaagaaagtgaattaaaagcaatgtctaagtgaaatgaaagaggaggaaataatagagtttttaaaatttgaaaagaattcattgatgagatggacttcaattagtattgcttgggatattattggaaatcgtggtgagatttctaaggacattgctgaagaatttactgaaattattttaagtagattagagagttattcttgggaaaattcgggggataagcattgttggaaaaattaaaaatatattaaaagaagatttttatgggatttggcggaatataatataaaaaatcttgatgacgatgacaattattatacttgtagctcgaatatggagtttctgttgcaatacgcaggagatttattatttatagatattgtgaaatatatgttcgatgaagagttgaaatgtcactatatgtggctaactggatgtggatatataagctaaaaatttgaa

SEQ ID NO: 2390 - DNA, 137 bp, Bacillus thuringiensis
ccaaaggcgacttttccacccctttaaggcgacacgacagacgatagaataacgctccatcttggcagctatcaactgtgctacatgatcgacatcaagtgacatactcttaagacggctgtctccatttacattaa

SEQ ID NO: 2391 - DNA, 121 bp, Bacillus thuringiensis
agactttacggaaacatatccctaaagtcatcaattagctcaatcgcctattttgaacagaaacgtgaatgtaaatatataaactgcagtgactggccgaagtatgtagaaatagcggtag

SEQ ID NO: 2392 - DNA, 682 bp, Bacillus thuringiensis
atatatcaaaatcttttcagcgttattatgaaaatttaaatactgttacagatgggtattgtaaattaattgaggcaaaaagtgtaagaaataatgaattagaaatagtgagaaactcacaaaatttgaacgtgtgtgaagaaagacgttttgatgtttcgaagttagatgctattacgaagtggttaaaagaaaatcgtgcataaagtaaaaacaacgagtgttgtagaacgccctcgttgttttttgtttctttataaatataaaggaaaaatttgtagaatattttcattatttaacagaataatctttcaattttaaagaaaaagaaatacaatatgaggaagtatatataaataatatgataggggatgggatgcgatattttgaatgaagtaacagtttttatataagaaataattagatagtcagaacggagatatttgggaggaaacaagcgagatgaaaacatttttgaaaataataggtgttatagctggtatggcggtaattggagtaggtttaacatatggtatgctgcattatttaaataatagtaaaccagctgcgaaaaaggcatcaccagctgctccagcagtagatgtattagctgatattatcgtaaaagcagaagatgcaaagcttttagaaaatggaaattattcattgccgaattgtggtt

SEQ ID NO: 2393 - DNA, 379 bp, Bacillus thuringiensis
gtaaagcaaagggaaatagaagtagaaaacgctcagcatcatgttagtaagaacaagaaagaatatattgaaacggtaatggaggaaaagccaaaagaagaaatagttaagataaaagagcctttgcaagaacgtcaggtaaaacaagtagatatatctgcttttaaaccagagccatttaatattattaagttttgtcaaacatggttaccgcgtgtatttgtcggtattatgttgcttggagtgatctggttatttaaagcaggggtagatgctggcttattaacaccagcgatacgaattgtgtttggtatcgtattatctatcggattgtattatgtagtccctattcaaataaaaagagagcggcaggcatcac

SEQ ID NO: 2394 - DNA, 166 bp, Bacillus thuringiensis
gtcgaaggcgacgccggccgcggccagcatcgcccgccgcgattcgctctgcgatgccaggatcagcctcacgccgccggcccgatcccgcgttcgccggccagcgcgatgatcgccgcggcggtctcctcgatcgaacggcgggtgacgtcgatcaccggccagc

SEQ ID NO: 2395 - DNA, 127 bp, Bacillus thuringiensis
gtgtaattccctttattgctgcttattttgtttacaataataagccgaaaaaaagtattatttattcccttatagcgttattcctagtttccggggtgtatcttaatacattgccaataaattataa

SEQ ID NO: 2396 - DNA, 496 bp, Bacillus thuringiensis
cgcgagacgcgtggacgacgaacacagagcgcagggggcgcacatatataccctactcgagccataaaaagcgaccggggggaaattttgggcatgacacacaaaacacacgaagagcgcgcgcacaaaagagaacaccacgaaaagcgcacacgagacccatatcgcgaaaaaaaaggggaagaccagagtgcgctgtggggagagagagacacagaagagcgtcaacactcccttacacgggaagacgcaccggcgcaaacggcccaagaaaagaatgtatcacaaacaagtgacagggaaaaaacatgcgagcgacaccaacttaaaaacgcgagcgcaacaatcaaaacgggaaagaaccggggaagaccaaaccgacccccacaaagaaaagaagggaaaacatggggaaaaagtaaaaaatcaaggcaggcaaccgaggacgatgggccaccaacatcaccgggggacaggacgggaccgggaaaaaacc

SEQ ID NO: 2397 - DNA, 406 bp, Bacillus thuringiensis
  unsure (1)...(406): unsure at all n locations
cccgagaagcgagacgacgaacacagagagcaggaggcgcccagagagaacaccccccgagccaaaaaaagcgccaggggggaaaaatgaggcangaaacccagaacagacgaagagcgcgagcacaaaagagaacaccacgaaaaacgcacacaagacccaaaagccgcaaaaaaaagggaagaccaaagcacgcagaagggagagaaagaaacagaagaacgncaacacggccanacacgggaagacgcaccggcgcaaacgnnccaagaaaggaagggaacacaaacacccgacagggaaaaaacaaccgacccccaccaacgaaaaaaacgaaggcaacaaccaaaccaggaaaaaaacgcggaagagcaaaccgaaccccaaagagaaaagaagggacaac

SEQ ID NO: 2398 - DNA, 179 bp, Bacillus thuringiensis
ttgaagttgaacgtttatattctccttactgaatcccccatggtaacaaactacagattcaatatgtaaatttaaatacttcttcaaagactgctttgcgtccttaatatttatagttgttggggcgggaattccttctaacatcccattcacactatacatagagtctcctgcaataa

SEQ ID NO: 2399 - DNA, 140 bp, Bacillus thuringiensis
gaactgaagaatatgggaaactgagcaactagtagagatcatcacattcaacttctgggtaagcaaaacaaaggaggaagcagcttgctgaacaccaggcacagggagtagctgagctgagttgaaagcccaagttacct

SEQ ID NO: 2400 - DNA, 463 bp, Bacillus thuringiensis
ttttgttctttggttttgtttgttataattaccttaaattgtaataaagggagcggtatgatgaatcaaaaagataaagaaagaaaagagcaagtggctcatattattaatattccagatgaatatagtcttgttgtagatgatcaagaagggggtgatgacccgtatcatctattatggtgggagcataaagaggatcaggagagaacgatacaaattacattgaatagacatactggtaatttaattgaatttaggatagatgatgaaaatcctttttcaagtggcaaggaagcgatagaggagaagaaggcaagagagattgcaaatgcgttcttgaaaaaatatacaaaagaaggatatgaattctatacatatgtaacggttaaggacgacaggcgcggttggaaagaagttaattattatgcacgaagtgaatagctatccattgccgaatacaggg

SEQ ID NO: 2401 - DNA, 100 bp, Bacillus thuringiensis
cgccgcgctgcagtgacggtagtgcgaaattacccgtggctgggtaactacacggtgccacccaagccggtgccggggcagctcgtatacgtcggggact

SEQ ID NO: 2402 - DNA, 557 bp, Bacillus thuringiensis
  unsure (1)...(557): unsure at all n locations
gatgatttctcaccaacccaatccaagattttttgggtgaacaatcgttgtatatatgatacaaaattgttctacaaaacaagtacacgtgtgacgtgtgaaaaaaaaaagtacacatgtgaaaacatacagacctaactggtttgctattccgtctattgttttatgttacttcctaaggtcaatgttgagttgtacgttaaagtaaatcaaataataataatattgaagcttttttgataaatataaagataatattgaagcttttctgcttgtataccaaaatagttgcatatatgtgatatcatgatatagtgttagcagaaatatccaaatttgcagaaaaaaacacatgattttcaggccatgccacattttaaaataaatgattatcatatggtcaaatttaaaatggacggatgggctatcaacctattaaatagtggacttgcccattactagcccataaataaaaggttacgtnccaaaaaatgttacttttaaaaataaactaacgcngatctagaatatgacatgactaaagcccaaacccatgt

SEQ ID NO: 2403 - DNA, 104 bp, Bacillus thuringiensis
gcactacctgtaactacaagtgcaggatctgtcactatgctaactcgtgagagacctatatgaccctcgacattgagagcaacaagtatattgctgctgaggcg

SEQ ID NO: 2404 - DNA, 590 bp, Bacillus thuringiensis
gattcggaataatcctttgatctaacaactctttacctccaatatttctttagccccacgactcggcatgcttatattgtataacactttttgtattgacctttgattggtccgttgaaagatttactccatttagaaataattctattgaatttttcaccactagccacaaaaacatcttataatctttatataataaactacagtattaggagtagataaaatgccagttacactcgaacttattcttttcattcttatagcaattagtgctgttggctatttaataaaagaatttcaaaaaactaggaaacgaacacttggaatttcactagaatttttagttcttttctggtcaatatggagaatatcaactctcataatctaatttataaaacatgaattccttcgaatgaagtgaaactctaatcagtgggggttttacgggataaatttaccagtattttcaccacaacattcatgttaaaatcccttgtgagtacgacataactcgaccttatgaagctccgcagcttttatcgcggagctttaattatttaaattaacgcttttgttcacttttttgatac

SEQ ID NO: 2405 - DNA, 289 bp, Bacillus thuringiensis
ataccaatcgaatggcataacgatgctcaccgaccgaaacagatctgggtctctgcaacatgtgttcatgccgaaagatagttactacgtggaaccaacgctttatatacaagcccatgtaagatcacaataacacactctcatttttcgaaaatataagaggcactatttaactgtttctgaagagatgacgcccgaaccgtatgaacaatcctgaatggcatcactttttccaaatttgaatcagacaaaacaaagcgcctgctgacctagtcgatatggaactata

SEQ ID NO: 2406 - DNA, 181 bp, Bacillus thuringiensis
attaaacaacctgggaagaagactcttaaccctcaaaacacctggtagctaagtaggaacccatgatgggccagagattggctgagcaggacagacagtgttgtggtgggaagtcagaggagggagaggtctctgtgcaagggctggtcggagacagttccctggagatgcatggtctgtg

SEQ ID NO: 2407 - DNA, 661 bp, Bacillus thuringiensis
caatgaaaaagaagcagcgagcttttctattctacttgtacgagtaccgtatgatattgaatggggtatcagactagcagaagaactcgaaatgccagaaattgaagaatacaaacaagaattacggactgctttatatcgagggtttaaggggaagtaagctaataatatatcaacgatttttcaaatatatctatcataacttaaaatatatcaacgattttttcgagatatcagcgattcgagaaaggatatcgatttaccgacaaatagtgacatgaattattacctataattatattatgtaaactaattataaagggagatatcatgaaccgaaaacaacgaatcaaagaaattgcagatcatattgtaaagctaaacttaacccatccaataagagttggagtaagcggtattacagcctcaggaaaaacaacatttgcaagcgaactagcggaagaaataaaaaaacgaggattaccagtaacacgcgccagcattgatgattttcataatccaagagtgattcgctatgcaaaaggaaaagaatctgcaagagggtattatgaagatgcacacgattatacagctttcaaagaaagattattaatgcctttaggacctaacggaaatttacagtatgaaacgatttctcata

SEQ ID NO: 2408 - DNA, 452 bp, Bacillus thuringiensis
ttcgtcaaatacttttttaaataaaacaaaaaacattatccgttttacggataatgttttcttacaaaatagcgctaattcaagcttttattctatcgcatagaaaaagttgaaacatttttccagcgcccatataaggcagcaaagaaacgtgctttttcacaaccattccaacaacattcactttcttatttacagaggaatcatatgtggcgacctggattttccctgtgtatttaccggacaaatcaatatcaaatgtgatggttcctttctttcttaccattggatgccttggctttatcaccactctatttcctttccttggttctaccaaacggattacattacgaggcggatctaggctatttggatgcacctggtttaacacttttaatacttttttattaggtattaatgaattggtacgccatggaataattcctttaatt

SEQ ID NO: 2409 - DNA, 208 bp, Bacillus thuringiensis
ggccaatctgcatcttatttcttgttttggctttcttcagccttttctgcctataagctcagcccttagctcagctcatgggagttcctttttattttgtagactggatactgcccagttcatgaattgctaataaaggcaaactagacctttacagctcaatttattgaaattttgttatttgatacgtcccacaatttaacaattg

SEQ ID NO: 2410 - DNA, 456 bp, Bacillus thuringiensis
ctttttttttactagtaaattcattgtaagagttaggtatttactaacttctatagacgaaaataagtatcctctaataatctcaaattaaaaaccttagcatagatatactaaggttttttgtatttttataatgaatgaattctttcatagtcttttttaaattgattatcattttttaaccaacttttaaaagttggttcctttatttctaaaatggaacaagttttagcgatacatttatttttcatatattccttaaggaaattttgttttctctgcttaacagcagattgggttctttttaggtttcgatcttttaattgatctagacttagactttctttctgaaattcttcatattttctatgcaaataaatatctttgtctttataaatccaatttgaaaatagttgtattgattttctcccggttaaaatgacgcgataatgttta

SEQ ID NO: 2411 - DNA, 142 bp, Bacillus thuringiensis
tgctgctcgaacttctccaacgcttgctggtggttcttttcagccttggccaaatcttcctgatgccgacgcgatgtgcccgggatcaacttggcccatcccgaaggagcaagcactttgaccttttccggcgcaacgcccg

SEQ ID NO: 2412 - DNA, 484 bp, Bacillus thuringiensis
tatctcttgtaaatggaaaaagtgatgtgcagctcccactgtctggggactgggaaaccttggaatggctcattaaagaggggctctggctggcaggccagttctcagctgcctcttcagagagtacgtgtttgccatcccagatgagggggatactgtttgttctctttccctccaagtagcaggtggggaggatgctggatgtatactggcaaaggaaaggactctctgtcctcatctccatgatctgtttttgggctggctgaatgattttccaaatgtaggataaacacatctgacacagtaactgaagcatgcccatagaatgaccctatatggcagatgcacatgaatgtgtttcgagctagagaatccagcagtggccaacctgcagattcattccttgtctctgaggaacaacaactgagcccccgtcccatcccatcctgtgggacctgggccatacaggggattcaggccctga

SEQ ID NO: 2413 - DNA, 489 bp, Bacillus thuringiensis
agcgagtgcaacaggtgagtttctagctaccgttgttaagcttagacagactgtatctttgtaagataaatgcgtcatgcgcccgataaattgtcctagtaaaaaattgatgatgaagagcaatagaacaggaacgagtaataataaaacaacattcatattttgtagtaaatatttaccttgtgatgcaaacatcgctactattgctaaacttaaaaatacaatttgagcagagctaaaaaacggaatgagtttattctcgagaggttcagcttttttcattttattcataatgaattttgtagcgtgtgcaagtataaatggtaagacgattacgataacaatactttctactaaaacagaaaccgctacagttttcatgacaccagcaaataaaaataaataaatgggaaggagcagtacttgcaaaattaaatttacaggtaaaattgcagtagaaagtgctacattacctttcgctatttcagt

SEQ ID NO: 2414 - DNA, 695 bp, Bacillus thuringiensis
tcggacccaccaattcgtgattccgaggttggtgtctacaccaagtattagttatttatattaataaggttaatggtaggctatcacttgataaaagattttcatatgtaaattcactaaatttagtagataaaattttgaaagacatcgcctcggaatttattgagagtgagaggtatgacattgtattagagcggcttgatgaagtaatagagaatgtagcaaagccatatactattgggtatcgagaaatacttttaggtttagcagaagaaaacattttatcaattaatgaaaggagttatggtgaaagcctagtttattttacttatgagagatttgcagatatatatatatccctagttttattagaaagatatcaacaagacaaaaacttatttgaaaatatattgtcatctgataactcattttattatggagtttatgagagtctatcaataattattccagaaaaattaaaagtagaatggctagatttaattgactttgagcgtataacttttaatatagcagaagcgttcgttcgagggatttcatggagagacgtacaaaatataaatgacaaaacctttgaatgggtaaatctatgtttaagacaaaaagatatagatttacaaagcttagtatacgaaaggttgttaaaacagtcttatattatagaatcaccgttaaac

SEQ ID NO: 2415 - DNA, 262 bp, Bacillus thuringiensis
tacttagagcacacaaaagataaaatggacagattcatcttggttggaatgggggttgggtcattctaatttgagtcttgaaggatgaatagatatcttacaggggtcaagcagttcattccttcccatttcaatttagctattctctcagtatgcccggacaagattattcatcccctaacctatctttagctgcatacttctttgtaagttactttactcttcacttgatattccttttcccaaaacaatgacacaaaat

SEQ ID NO: 2416 - DNA, 597 bp, Bacillus thuringiensis
atctgctgaaaatgcaaaacgttatatgggaaatcataaggttattttccattatccgaacggacgcgatgtgacaattaatgtttcaattgagtattgtaaatgcctacctgagggtgcttctgggacgtggggcattgtatacgatgaagaaggaaatgttgtgaaacataaaatagaatgtgagcaaaatcaagtttctgaaattgattttgtagataaaactttactctcttttgatattggcgcagggacgacagaagaagtcgtttcattaggggtgaatttccgtccgcaactaagtaaaggtttatcttatggtgtaaaagagacgttactacaaatcattacgagatggaaccggaagtatccaactaaaacgattgatagcattacagaattcaatcaaatttatttaaatgataagcatccgagaaatacattattagttgaggaatcacagccagcgctattaggtttagcagcgcgtgttgcaacagatattataaataaaattgatgatatgaaagacgatccatacgtgtttatttatggcgggggtgcagtaattattaaaaacagttaaaaatgatttta

SEQ ID NO: 2417 - DNA, 124 bp, Bacillus thuringiensis
accggagagctcccgtcaagggtcctgcctccaccaggcacagggcgcctggtctcagggacggagctgcccatcctcagggtcctggtttacacctgggcggccgcagactccatgtccctgt

SEQ ID NO: 2418 - DNA, 741 bp, Bacillus thuringiensis
ttacaactttgaaagaatccaattcttcaatgtaatattccatcatttcaactgaagagtaccctggcggttgaatgttataatcaatgacatcatcttggccgtatagccattgttttgcttctgcatcaaatgttcttttcattatttctgttaatttctcagcatctaaaattgtagctttttctatagatattctcgtcattttcgttttccccttcattattacaaaccaaccattttgtgaatgccataattatcaattcacttttatttttaatacttttcccattattacatatggaacatcatttttacttggatgaaatggctctaaaacatttacccaatctaatctttcatataacgaacgtgctttttcattgtttatttgtgttgttaaaacactcgttctatttgaaagcccttctagtaattcattatgtaatttcgttccaagacctttattttgatattgtgggtgaactgctaactctacaaattcaaaacaatcttgcaaccattcgtctacttgctctagatgtaacgcttctctcattaattgattatagtactgtccctcgattgagcgataaccataagtaaagccaactacttcattttcatcatttattgctactatacctttaaaacctgtatattctatatgcctattcattcgctcgatcatttcattgaaatttattttctcaaatactatacaatacaattttgccatat

SEQ ID NO: 2419 - DNA, 761 bp, Bacillus thuringiensis
atatcttcattatgtacctccttgcgtagaatgtatagtgtgtcatatttagtaataatgatagttatatagtaagaactcctaatcacctaggagtcattgtataagcatctcactctttacaatcaatcctaattataagatatctctctatacaaaacaaacgaactttatgtgaacaaacacccccattaaaatatgtagcacttttgttttacacagtccatactaattgttataactttttaaaggtggtgtaattattgatagttcttgaaactgaacgtcttaatcttcgctggtttgatataaaagacgctccttttattcttgagttagtaaacgatcctgcatggattcagtttatcggtgacaaaggagttagtaacttagaagatgcaaaaaattatattgtaaacggtcccatcgatatgtataacaaacttggattcggcctttacttagtagaacgaaaaaaagatctcactccacttggtatgtgtggccttattaaaagagattcattagaagacgttgatatcgggtttgcctttttagagacattccgttcaaaaggatatggctacgagtcagcttctgcgataatcgaatactgtgtacaaaagctcggcatgaaacgaattgtagcaattacttctgtagataacatcgccttaagaaagcttttaaaaaagtaggattacgatttgagaaaatcatttcagattcaggagaagatttaaaattatttgggtataacg

SEQ ID NO: 2420 - DNA, 668 bp, Bacillus thuringiensis
tgtcagccgcaagtacatactatgataaagaaacagcgacgaaagctgtaaaagatagcttgaagcaacatgacaaggaaattcaagattggttaaaaaattctaaagaggctcgtctcgtattaaatacaactcattcattccctgttggaaaaacggtaataaagaaaaatatgagtgtaaaagacaagttagtaaaaactgttactgttttagcaagagataagtcaggggaattagggtttaagattattacttcttatccatctgataaataagaagggggagtacattatgtatacgacattacaatactttcttaaatcgtactgtacgttaagtattcatgaggatgaaatagtaagcgtgatggaagagtttattgaacaagaagacgaagaaattgttttgaaattacgtgatgaattaataaatatgaagaaaaagaacgcgtgggaagaggcgtgtgtattagctgcgaagcaaggaaatcgtatgtggtctttagaagaaacgaaagaccatcttgaagacttttttactatttactgcaaaagaaaaaggcgtgatatattcacgaccttgtttttatactattcggttgataggaggtatttctttggagcgctttaatttacacttttggcggtttgatcatttagatattc

SEQ ID NO: 2421 - DNA, 460 bp, Bacillus thuringiensis
actcttatatgttctgtaagtaattctttccaaaatgactttgtaatcgtactcgcatttaaagctactttcatcttatgagatacgcttgcaatttcttttggcgcaatgccgtaatccattcttaaaccggtaataccccagtccaatagctcttccacattttcatatgttagccctaaatggtgtaacgattttggagaaacatcaaccattagctccatttcatgtgcaaaagcttgtttccctaatatttgaattaactctttatacgtatttggatcatcttctggaatgtgcagtgatgtaaaaatagatgtaaacccatgttccttcgctacttttagccactctttttgtttctctactcgttcttttgaaagaataatggaaactccgatcatataaatctccctctctattaatagaaaaagagaaaggaatccctttctctatatgg

SEQ ID NO: 2422 - DNA, 679 bp, Bacillus thuringiensis
tcactcaatattccccctactaacacactaatggcatagcggatcgtataaaaataaacgcactgaaaatacttgtcctatcatattatttgggacgatttgttggcatattgttgtgttatgaacattgaaaaatgcaatacaaatccctgctattacttcaattattattgcaatgataatactatgattgaaccctaatgaaatgtatgtgagcccccctataaacaatcctccaagcataagtatacgccggcttttatatgttacttttcccactaatactgagccaattacgtagccaagtggaaaacctgccataaaatagccgtactctgcatatcccgctaacagctcgtcttttatataaggaagatttgtgaccatcgttacccctactccaaactgcacgaaagtaagaaatataccgagccaaacgatgattggttttgtaaaaaaatatgtaaaaccttgaagaaattgttctagccacgtttttcgtatatctgttgtagtcctcttttcttttatataaagtaagaaagcaccactaacaaatagacaaatacatacgaaagataatgtaagttctgttccaatgaaatgaatgactactccgcccaatactggcgcaagatacatcatgagacgagtcattccatcaatatacgcatttgcg

SEQ ID NO: 2423 - DNA, 766 bp, Bacillus thuringiensis
atgattttgctgctgatttttttgggaaagtagctgctttatctgaaagagattctcgtaatattacagtgtacattctttctgtaaaagaatgggaaggattaaaagacacgttgcaagaaaaaaagttgggagtgttagtacaaaaattagagagtaccattgtaaaaacaattcggaagggcgatgttgttacaaagtgggatgaaaataagtacgttattgtagcaattgataatggccatgaaacatcaacaataacaaaacgattaatgaaaaatattgaaagtgaaatagaaggtgatttactcagtgtcactcttttatttggagcagctagctatccagtagaaggaaaaacgtttgaagaactgttgagaaagtcgcaaaatcaattgtaccagtatagaaatttgcaagaaaatgagtgaagctttgatttgaagatatatgataggaagatgttttatttgtaacatttttttgacttttattacaaaaaaacgccacgtttgtaataaaagtctttaaaaatatatgaaataagcatataattatgatggtagtgtcaatgcaatttgcacagtgtgttttattttaaaagtgtagaggaaagcaagctctacacttttcctttttaggaaatgaaaagaatatttgtaagttgttgcgagatatcgattgtactgtgtaaaatgaacaaagagattaattgatagaaagctggaaagggaatgatagaccggagagcggagcgatcaccttt

SEQ ID NO: 2424 - DNA, 618 bp, Bacillus thuringiensis
tcaggaaaattctaatattaaaaagcccaatttctcagttaaaatagagaaattgggcttttgtttattctattattaaattttatacataaaaagattttgcagtgtcacaaagtatagcgcttattcgttatatagagtgagaggaggaattatatgaaagttacaaacaacgattatgaaaagatggaagagctatatgagttgtatgaacaaaagatttattatgtagcgtattctattttaaataatattcaacaggctgaagatgcggttcaagagacgtttattactctttataagaacttggaaaagctccatagcttggctactcaagagcttaaacgctacattttgagggtcgcgaaaaacaaggcgattgatagttaccggaaaaacaaacgacatgaaacatttttagaagaatatgaaagagaatctgtagaagcagtagatgaaaatattgaagagtggtaaatacgtaaaatgtctgaggttcaaattgatgcattgctaaaagagctaaacgaatctaatagacaggtgctcaagttcaaagtcttctataacttaacgcatcaagatatttcaagtgccatggggataaccgaggcaaat

SEQ ID NO: 2425 - DNA, 325 bp, Bacillus thuringiensis
cgataccttggtgaccaccgtatgtaaatgaatttttatcagcgcgtgagcactgctcggagaccggcgttgatcgtactctatcatgcccaatgccttcgaactgtactgatgggtgagggtctattaaacgactttctgcagctctttttaggcgcccacttgtacgaccaacctcgtgatgctaatacttatagaggctataccggaacttgattcacaatcacaagctttagagcgttcatgaaactatttggtgctcacatgattggaataggggtggatacactagaacattcgccatcctatattgtaaaccgcttcc

SEQ ID NO: 2426 - DNA, 1111 bp, Bacillus thuringiensis
  unsure (1)...(1111): unsure at all n locations
tgaatattctatgtttaggtggttatatgtccttattacgctgacatatatgtaaatttataattggtattattgctatttttgccataagtcctattccagctctttttattacacacaattattcttatcaaaatgaatttattagcatttttcaaaacttcgcacagctttcttttatatcaattccaaaggttgattggatgcatgaatctatctttttctcagcaaaccaaatgatacatacttttaatcattcaacaccattattcccttacatatgggaaatatattttatatcgattgttcgttttacttttacccttgcgatcggatttttcataagtttgggtatcggccatttatttttcaaagtacctaattcgtttaaaaagtttactactgtattgaaatggattccttactctttttgcactgtagtattacaatgttcagtcttattactacttctatacatcgcacaatttataaaccttccttactactcatcatttatcatcgtatgtagtacttccatgattatcgttatgcaagcagtaaaaaaatggattcctttcttaaaaaacacaaatgaatatgaaataaaacatgattcttttcttgtggatacattgtttttggcgcttacttcgaatcataaatcaattttaggttccattattctttcattcgtttttatggaatgcgtttttcatgcaaatggactgttacaatttatcgttcaatttggcggaaattcacccataattgttacaatcggcttattactactctatatcccatatagcatactttctttccttcaaacactatggaccacaaactactccaaacaacagtcatacactttgacgagaagtgttccaaaaccttaatttaaaataaccctctataatctaaaagtagggggttattccttttgtatagcggacaaaataacagcaaattcaaaaactattacagaaacataccaatatttacccttttcctttgactattcttttcatttggatttatatnaaagtatacataatgcaggaggtgacatctttattcaaaccttggatggagacacgctggacatataaat

SEQ ID NO: 2427 - DNA, 537 bp, Bacillus thuringiensis
attcagtaggcccgttttttgcctgaattgctgcttgctcgtcccctctttaccgatatctattttgagcaaaatgtatcgtaacatactttcttaacctttgcactcattttagcctacatatttttattatgaagagagtgctattttatgataaaaacaaaaggataattatacataaaatattatgagatataaaattcgtttttctctgataatttagaaaagtgtaaaaaatattatttttaacactttagtatgaataatcagcaatatgaaacgtttacaaaggtatattttttaacggaaaattttaatgaaatagaaatataaatatacaaaaaatatatttgtgtgtataatatgaattattagaacatatatatatttctttttgtttgaaaatgaaagggttaacatttttttggagggtggaagtatgaaaaaaaaagataccagtttttgtagcatcaacagtagcgatgagcatgatgttaggggcatgtagctatcaaaagatgaatcgcagcaaacgct

SEQ ID NO: 2428 - DNA, 482 bp, Bacillus thuringiensis
atgtaacaattgcatctaggggtttttgaagtgcttctgcttcgtgatcagtaattgcacgacgtgctaaatgtgctacgtgctttacattctcaacggaaattcttgacacggctaggccacctccataatatatcggtcaatctacaatactattgatgataccaaattttcagtacttcaagcaagtcaacacagagtacttacgccatttttacataaaaaaagaaaggcaaatgcctttctttacaatttactctttatctaacggcttatttttcggaaatctctcgttatcttcttcattatcacgaattgttttttgtaatacaaaacaagacatcgttaaaaataatgttccaattaaatagtatccttttacactaagcgtttcatctaacgtataaatcccaattagcatacctgaaatcgcacaaacaaatgaagtccatgctaaaaacgtgaacgcttgcgtattacgt

SEQ ID NO: 2429 - DNA, 493 bp, Bacillus thuringiensis
tgcattctaaattttgttatgtacagtgtttattgtcatcagacaattgtttgtatacagaacgagagaattgtataagttgtccttttgctatttataatttttatgcgttatccgggattactgaacgcattctcaaacatatcagctttttcattagagatactgaaaagaatggatacaaaggagattttgaaagaaatgcaattctttttttaaaggatttaaagttgtttaaagaagctgaaataaagtttggatccgttatatatgagtttttttatatgagtaaaaaggaattttgaggtctctcttaatacaattaccttctattacacgatatattccacaaagaggtgaggtgagaaaacatgagtgaaataattgagattgaagaattaagtgatgaagcatttgaattagaacttagcatggaactttctatcgaaaacttagaaactattgaaaacaataagtttacagaaattaattt

SEQ ID NO: 2430 - DNA, 834 bp, Bacillus thuringiensis
agggttttcattttcaagtattccatatttacttgctctctatggtagcgcgacagtaattgggaatataataattggcaagttcgctgataaatttacaatgaaaatacttatgggtggattaattatattaatcatagcgttgtctttatttgctttaagtgcagagaataaatacattgcagttatttctacgatttttattggtttaactggtgtagcattgaatccagctatggttgcgagggtgatgaagacagctagtaatggaataatgataaataccgttcatagttcttttattacgctaggtattgttattggttcgtcactaggtggtcttgggatcagtaaaggatatggttttgtatctccgctatggattggagcttgtttagctatccttggggtaatttcgttattcccatatttacataaaggaaaggcagattaagatgtttaaaatttctttatatgaggtactgccacattaccatcaagctaatactttcatatccccctaaattaaatttttctttctctacagatagctattctgagaagccgctcattttttcgttttgggggcatttctttttcttaagttgatgggcatagggtaccgccccacaaccatcaacttaaggattaaaactatttttgtaattaaaagcatgttactattctcattaacataagagaatagtaacgtgctttttatgaatatgcaccaaaaacaagagttatatcaaattttttcattttggggtattttgtttttcttagatcgatggtgatggggcactactctatatgatcaaattaaatttaaat

SEQ ID NO: 2431 - DNA, 250 bp, Bacillus thuringiensis
atctttccaacgctttaacacgttactacagaggatagaacgacgccgtatctcggtagttatcaactgtgcgaaatgatcgacctgaagagacatcctcttaatggggctgtttgtatctatattacgtaatggacctccctactatgtcaacgcagtgcttctatcgtgcgagatagcgggaagaatcagccatatcccactcatattgtgcctagcgtatgtccacgtctccaagaggaaggcctcg

SEQ ID NO: 2432 - DNA, 438 bp, Bacillus thuringiensis
ctggaagggcaggcttatctttaaagttattatatataactgaagaaattggaccgtctactgcaaccatgcgcatgtttccagtgtttttaggatcacgataccaaacatcaaggtaaggcatagccccttcttgtgttaaaaaatttgtgctaaataaaatgagctgtaacttttctgtagatactaaaccgccacttgaactattaaacgttgcttttgcttctcgaggtgtacgtactttcgcttcatgtgtttcgtactttttttctacgtcttcattaaaaataggatttacgtggtacacaattaattttccttttgcttttgcatcaaagccgtaaattaatgaaatcgattgtttttctaagtcgagtcgatctccacagcctgttaaaaaggttatgagaaagtaaagtatagtgaaatgcataaagc

SEQ ID NO: 2433 - DNA, 963 bp, Bacillus thuringiensis
gcatctaatctaactaaatgatgacaaacttgtgcaatacttcatttatccttatctggtttcctattaaattgagcatcactcaacaaattaatttcctcaactaattgatctctcgttttataaaacttgtcatttacaaatgtatccatgtggattctcctttcattgcaacctacatacttaaattcctacgctagaaatattatcttcaaaaaaagtttttctttcactactattccaatttcattttaaagctacaaatgaaattatttgttttttatatctttttaattggcacaaataaattaacctttaactttccgtctagatcttcagcaacattatttaagcaaaactctaaattatctctatcataatctgcatcatactcactatttggtagccactctgcatacatgtattgatacgcttcacttaatttatgaggttcatcatagaactggtatagaccatatgtacctccatctaatcttttaaattgcacatcatgatgcttttctttatcgaagttttcaggaatcgtaacacatgcatcatgccggcacttatgacttgcaacaagttcaggattatctaatgatattccgataaatgattgctctggtggataaagtttattttcaattgaccaattcagtaactttccccagtgatcttgtggttcaaagtagctaccagttcgtcttatatatgctacttctaatggtggaaatttttttataaaaactttcatttacatcttctcccctataaatatgtacactgtttatttagctttctttaaatatttattccttcttaaataaaaagaatcctctaatcacatgaattttaattgaaatacaattgattactattactactactaaagtagtatgtactttcatacttttatttgattttaaattctttttaaatcgatatattaattgaaaaaaa

SEQ ID NO: 2434 - DNA, 615 bp, Bacillus thuringiensis
  unsure (1)...(615): unsure at all n locations
atgtctcataaaaaccttgtttcttatagtaacgagcacaaaaaaatgaggccgatttctcggccccccagcttattggcataaaacaggagatttggtttggacataaccagttcgtacttttattatattttattttttctgaattttaaatacattaaacacctatttatattgagaaagttttttgcttgcataaaattaaagattttaagaaatgatacaaatggaggtgtatacatatggaaccaatgctatgtccaagttgtaaaacaaaccgtacccgctttaatattcttgagcaacaagtaaaaccagtcaaattaaatccacaaactggtcaagtagaagaagaatacacaaatgaaacgatgaatgcttttcatatggcctatcaaggacctacttatcgcgtccaatgcgctgtatgtgggcttgttgaaaacccagaacaatttattaaacctgctcaaaatcagtctttctaataaaaacatgattatcccttatagaaatagatttttctattagggattttttcgtttaataaaagtaataanaatggatttcttccttattatatgttaaacttcgcactcttttggaatgttacat

SEQ ID NO: 2435 - DNA, 176 bp, Bacillus thuringiensis
actttctaacttactggtataactgtgtctcatacaaacaaaaaaaaacttcattggtcctttctcttagatggcccctgctcagctcagaagtttattatgtagctgaattatggaggactgagtactaaagacatgagtcatagtcaactcttgttcattaaaggtttatcctg

SEQ ID NO: 2436 - DNA, 899 bp, Bacillus thuringiensis
ttcctgcggttttatggggagataagagtgataaaatttttattgcagtacatggaaatatgtcaaataaggaagatacaattattcaaatattagctgaagaagccaaacaaaaaggttatcaagtattaagctttgatttacctgagcatggagaaagaaaagatgataatacgccttgcaaagtacagatttgtgttagtgaattatctataattatgaattatgcaaaagaacattggaaagaaataaacgtgtttgcatgtagtatgggagcgtattttagccttttagcttatcaaaatgatgtggtagaaaaggcattatttttatcaccagtagttaatatggaacgaattatcgaaaatatgatgaaatggtttaatgtaacaccagagcttttgcaaaaagaaatgactatagagacacctattgggcaaaagttatattgggattatttatgctatgtaaaagaacatccgattaatacatggaatatagatacatatattttgtacggagccaaggatgaactgtgtgaacttgaaactattaactattttacagaaaaacatcgttgtgaattataagttatggagacgggtgaacattacttttataccgaagaacagttaaagatatttgaacagtggttacacaagcatatcgattaacatattacaatttattttgaacctgttagagaagaatgagaaatatataaacttataggctatttgagagaatttataaatggtgaatgtctacactcaaacaaacacatgctttaattcgataagaattaaacaactttaaagagccttatcacacactagattgtagcaaggctcttatattttcataataaaattaatcaactgtattatcgattacatatg

SEQ ID NO: 2437 - DNA, 430 bp, Bacillus thuringiensis
ggccatctgcgactgcccgtctgagtaatgttctgttcatgagtcagtcgttgactgccgttggctagaccggctagacccagcgtgttctccgcaaatagggctgtatgcagcaaccgccccagttggtgaaaaacgctactttgggctataccgaactgaatcaagccgtgcagttgccgagtacgtatgctgcaatacctcggtacagagcaagacctgctctgtggacgcgaagccgcattgcgaaaccagcgagatcggccatcggagattgtacgctattccgtggttgatttctggaaacaggtgaaacgtgccgtacacatccaggtcgcctagtgcgtatcgcaccgaagagcagatggtgttgagcgactgttcaattcgacgatagatgtcgtagcggtagaagactgggaaatagagc

SEQ ID NO: 2438 - DNA, 446 bp, Bacillus thuringiensis
caattcctcctagttattgtccctgtttatttatgtttattctctataaatttatttttcagattaaaattttaatagtaatttccttcacgatattcatttttccataatctcttgtatttgaacagggccactacatgtgcatttttttcatctagcggtctgttactactttgcatgtcatacataatcaaggttataaaatcatatttagtaacaatagacgaaataaatttggaggctatatcgatgaatgaaaactatgataaacaggggcaatctttactagggaatgactttaatgaagatagagaacgtaatgaacaagctacactccactcacaaacagttggttcacgtggacctgttctagagcaagatagtgtacttcacgagacgtttcaagaatttattcatgaaaaaatttcataaagacctgttcatgt

SEQ ID NO: 2439 - DNA, 465 bp, Bacillus thuringiensis
agactctgacgatgaaatgacatctgacctactactaggcatctacacagaactagaaaaacacgcttggatgctacgtgcgttcttgaatcaataatagatttaaaagcggaagcggcttgctcaaaatcgcagggcattggagctctcgaccttgaagcgctttttgcttcgagcgagagagtgaaatgaccggagattctagccgctggagctggatatcacctaaaagcggaggtagcttgctcagaatgtgagggagatggagcttttgacgtagaggcgctctttgcctcgcaggaaaaagcgaagccaccgaacattctagctaccggagctgaatattactttaaagcggaagcggctcgttcagagtcgcttttttctatagattgatcgcgcatgctggtacatgaaatttatatcagcgatttttccaacatattggagattcttccaacattc

SEQ ID NO: 2440 - DNA, 395 bp, Bacillus thuringiensis
tactaagatttgtgttctgaaatgaatatggaattatgggcggggaggttttttgcgttttgccgcgttacttcatttttatattttttaccgtttttctcaggacgatccattccagcaatggcgaaggttacagttggacttgctctttcaattacagtggctgatcaagtggatgtctctcacatcaagacagtttgggacgttgcagcttatgcaggaacgcaaattgtaattggattatcactttcaaaaattgtagaaatgctgcggaacattccgaaaatggccgggcatattttagactttgatatcggtttatcacaagcaagtttgtttgatgtaaatgcgggctcacagtctactttactatcaaccatttttgatatattttt

SEQ ID NO: 2441 - DNA, 694 bp, Bacillus thuringiensis
gtaggcgttgtccactatagtaaagaaaagaagaagcagaaagtgtagtggataaattaaaaaagaggcgggttcggtatttgcgattcgtgcagacttaagtactttaatggcattaatatattgtattcaatgatggatcaatctctccaaaaatatataggtgatcctacatttgatatccttgtaaacaacgctggaattgggcaggtgttaacgttagaggaatctacgtttgaaatatatgtaatgtttagatacctaaaggagtctacgtttttttagtaggctctttctagctaatgataaggtaccagcaaataaactattttgtctaattgacaaaatagaaagtttacataacgtttttctggtaaacaattctgagtcaaatagtgtgatcaattaagttatttagtcctaaatcataagattttaatacaaaatactataatttgattaataatagtagtgaaaaaaatattaaatatatctaagttttaaagcgaatattagaagctggtgtaccgcattcttatttcaatagcacatatgcaagtattaaagtccagaactcatctggtagcgttatgtacaataaggaaattatgggaaatagacaacaaaatgctgaaacccaaacagtacctgtaaaagagggagattatatagaatttactcatatagaagggga

SEQ ID NO: 2442 - DNA, 685 bp, Bacillus thuringiensis
tacgatctcgaatttcatcaataacttgtttatattgtctttcttgttttaattcattttgagatattgtttctttttgaatcgtaatcgttaaaaagaataggtgaaacttcatatgtgaattcctcctttcgaattggaattacagatgactacagtaatgactttgtctttcttttacagaatccatagcctgattaatttgtcgttcatgaagcatttcagactcagaaaatttatttttttgaatggtaatggttaaaaagaatactttaaatttcataaaataattgcccctttataagtgatttagaaaaaacgagtgtaataagaaattacaggtgactacagtaatgactttgtctttcttttacagaatccatagcctgattaatttgtcgctcatgaagcatttcagactcggaaaatttatttttttgaatggtaatggttaaaaagaatactttaaatttcataaaataattacccctttataagtgatttagaaaagacgagtgtaataagaagattgaagctcttttacttcgtccataatattttgaatgtgttgttcacgtaaaatctctttctgtgagagcttacgttttttgatagtgattgttaaaaagaatgctttaaatttcatgaatatattacccctttaaaatatatttttaatacattt

SEQ ID NO: 2443 - DNA, 131 bp, Bacillus thuringiensis
ccccgcagacccccgctccacgcccgtcacccgataaccacgacgtctcccaatctgtgactgacgcctgcgcctataacccgcagcagccctgacgcctctcctggggccgcgcctgtgcggttcgtagg

SEQ ID NO: 2444 - DNA, 605 bp, Bacillus thuringiensis
gtgagtgatggaccaaatgcaatacataaaattcaattcatggatattttgaaaatcgaaacgcctagttaatttagctaggtgtttttttatatggccataaattctttatcgaagtagcacttgtccattaagttgtttacaatcccgttgaaataagcgaatttaccctttttcatttttactccggatttaattttcataacaaattctttaatagcttttaagccaatagctaactcttgttctttagtaaatgctgtatcacctgttgtatggttaacgattttattacactgtcttacgaccttccacagttcttgaattgttttagattcactgtaaaaagagccaactaaagaaataaaacgctctggtacccaatgagcaacaaagtcagcttgttccatattctcttttggattattgctattctcattactattacgtttggttatatcttttatattttgttttaaggaaacaggttttgttttaatggtaggacactttgtaggacgttcaccttgtgtcttgttggacacttcttccacaataggttgaataataatagcgttagaagtttgaagcatatcttttttacg

SEQ ID NO: 2445 - DNA, 290 bp, Bacillus thuringiensis
taaataaatgaaattaactgtaaattaatttcatttacttatatttaattacatggtaatgtatacttacttttttatatctctaccaatgtaaaaaggtagccttagtaaagtattgctcgttgaattttttttgaggttatcttcacttcatcaatatagaatgaaaaagtgatgaatccattacgggtatcatgtaaataaaaaatataatttatatttaaatttttgtgagggtgtgaaaatagaatgaaaccggtattgaaaaacatactcctttcctttatttt

SEQ ID NO: 2446 - DNA, 722 bp, Bacillus thuringiensis
tttcaaatataaataggttattcctatattcaacactaagactgaattcttgaatcccagcaggtaaacggattgatgatgaagaaactaatgtcatacatcatgtatttcaatgatacagtttgtataatcgtaatccattacattctgtagcagcggagttaacatgttaataaaaccaaagaggttacaagcaggagacaccgtgacaacagtaagtccttcatggggaggcgcaggtgattctgagataagataacgatatgacagggctcaaataaataaaaacactcctataagatatgactgtgaattagtactttttaaatgatatggagattacttatctaatgataaagggggatttacgtgtatggaagtaacatttacagtaagtaaatgggatgaaaaactaattgatgatactagaaaagatttccctattaatattgcccatgttgaatatgatattgatggagaattaaaaggaaaagcttttgttgaatacttattatattatctagactcaaatataaatgatggtcacttggcttcggctaaaatttctggatttttacgctttgaaggaatttataaggggcaacaagggacattcacagctatagagcaaggaatatttgataaaggaaatttagattccccaggaacaattattaaagcgtaccggtatacttagaatatatggtctggatttgtagtcg

SEQ ID NO: 2447 - DNA, 321 bp, Bacillus thuringiensis
accctttaccagtagaagtatacccgagtatatttaacgcaattcgtaaaggtacagataaaggtattattattgtagaagcagctggtaatggtgggattgatttagataaatttaaagaccgtaatggtaaacagattttaaatcgaaatagtccagactttaaagattcaggagctattatagttggagcatctactgcaagagttcctcataaacgtttaggtttctctaactatggtagtagaattgatgtatatggttggggagagtatgttgtttcattagatgcatttctgcactaggggggatgacgttgct

SEQ ID NO: 2448 - DNA, 681 bp, Bacillus thuringiensis
aagaaaacgtttcaaaggaagactatcctaataaagtgtataaattaggagtagagtttgataagttgtttgcggagcataacaatattacaagagaggtttttgacggtaagaaaaagaaatcagatatagtagatagtgtgaaagaattacacaaagtgttagataaatttgagtcaatagatccccctacagagtatgtaaaccaacaaaaagattttgaaaaagcaattagttattttagagagtctttttctttaataaatgaagtattcaccagaaaagaaaaaagagaaaaaggtgataagactgataaagagttaatagagaaatctgaaaagctagtgaaagaaggagatatttactggcttaaggcattcaaagatcttgaaggggatattaaaatcggtgacggtacagtatcaatgaaagatttgaaagagttagataagaaagctggaattaatacagataacgttatgaagaatgtgaaggatggtacggaattaatcggttattgtggattccaaggaacagacggtttcaatatgtcactcattttaaaaggtgataagacatttgaaacgtatggtaaaggtgagtattcaaataaaaagaattatattgaggaacttgggaatatgataaggaagcttttacaatctatttacatttcaataa

SEQ ID NO: 2449 - DNA, 476 bp, Bacillus thuringiensis
cagccgttttttctaggggcattctgccatcattccccagatgtgtacaagccaaatttctgaaatcactgtgtgatattgtgggcaaatgcagattgtattctaattcactgggaggcagttctcttttttgatctgcaaggatgaggattttcccagagagtgagccaaaggacatgcccatgagaaataaataatgctgcttctttcaactcaaacttgttcttgaaaagtaaaacaatgccaactctggagatggtttttcttactgtgagcatttttttgtgtgtgtggatctttaaaaaacaaagatctaaaaacacacacttcccagaacgctggcagccagccataaaaccacaaagaagtctttagaaaatttagataacaaatattaaataagaggtataatatgaagggtgaaaaataaagaccaacacctgcaatttaacagcgcctgagatggtgctttaaca

SEQ ID NO: 2450 - DNA, 1139 bp, Bacillus thuringiensis
cagataaaaaattttaaatgtatagttgattttaattccttttccataagtgcactgatatgccataaagaatattatagtcaaatttgactataaggcaaactttttcttccgtcaaaatattctttcgtatgagtagagaacgagtgagccatactgaatattgctataaaggaaatgaagtaaattgtaaaaaaatttcataaagaacaccttctgttaatagatgaaaaatggttttttcttcatattgtcgaataggataaaaggaagagaaatattaaacattgcttgtagcaagctttagtgatttggggaattcattgtgtgtatgttacatctgaaatgaggtgaatatatattatgaaaatatggggacgaatttcggatacaggaaagtattcaataccgctacaaccagtattgtggattgacggatcgaaaaaggaaaacgaatttcctcaagtagccgttacattacaaattggtagtatgtatacagaacagttttcgtatgaattgacctacgatgtaaacgacatacttattatgcgaattgaagtggaaaataaaggggtagaaatgatttcgagagttgttgtaagtcatatgattcgagattactttgcttatattcctaattctttaaaagttgataaggggataagtgagtttttattccagcttgttagatggcgaattgatgatttgttaccgaatgagaaggtggaactacgttgtaaaataaaagctaataaagataaagctcttaaacaaacattctttcaggctacatatacatttcaagataaagagatatcatatggcccactgcaaacaaatgaagttgttgtgcgtcaatgataaaaaggaacctgtacaaaaggttccttttttagtgaaggttgtgttttttgagtattttcttttgctccattcctttttttcctacatagttatttttgtagccaaagtatagaataaataaaaatgaaacaacattaacattagcgtcgatttgatcgtttgtataaagtgtatcccgaaagaggtaaataataattttaatgatcatagaaaaccagctagtaaacgcatagcatctgatagattctttttttgagcatatagattactcc

SEQ ID NO: 2451 - DNA, 1030 bp, Bacillus thuringiensis
attttgtgactgctacaagctatctataatggtaagaaggtcactgtaaggtaagtaagaatgaaaagtatgtatagtttttccagtgaatatttggtatgatggtgaatgggaaaaatatacaagttgttagtggttcataaaagggggattgaattgaaaagaacacctgaattcgtattaggtttaattggtggcattttgggaattattatttccataatattaatagttgtagcgtttaatattatggaaggggttgattacgaacttttagcttattactctattattttaacggttcaaatagggttgttcattttatcgtgtttagtaaacaaggttaataataaagtttatggagtttgtatgattgtgattcctatagttatgttgtttatgtcattattctttttacttattccgacaattttacaaattatatctggttcatttgcatttaggacattaaagttagaatcgaatgtaagctaaatataattattaacgtctgaatattcggttttttaaacattttcgtttgcagttcaaattaacataaagtacaaagttgtacgctttaggaggagaaatagatgattatttggtctggttggggttttttagtcgcaattattgtaattattaatactcttttgggtaaggctatctttggatctataacgggggacgctacatattttcatgaccatatttggccaatggcggtaatgtttattatatcaggggttatgtcttggtatttaggtaaatatattaataagccagatgggaaagtttatatagataccgaaactggtgaaaaagttatgtttaacaaaaaacactcgctattttttataaaaatggaatattggggaccaattttaggagttattgcgattgtaactttaattacaagataaaaaaagaggatgggtatagtaagagtaatctattcaagtagaaggagaaattagtcatgaatgcaaagaaactactaggggtagcagttcccggcatggtggta

SEQ ID NO: 2452 - DNA, 816 bp, Bacillus thuringiensis
cgtgatctgatgcaaacagagatagctggtttgctggatattctctcacaatacacaatggctgtttggaccggttacgaaaaagatggtccaaaaaattatgttagcgatcgctccactagaattgcacagcaaatgttccaagtaatgatgagcaaattcgctacagataaatcacgctttgaacgtccttcttctgtacaagaaataaacggagagttatacgtaaaaggtgcgaaaaaagatgcaattaaacaaattaaagtagatgctcctagtggtctgaatgtcacttttgatggcgctagcacagttacactaaactggtctggaccagcagaagttgatgcatatgcagccagctataaagcaactgacggttcaagtggtagcctatcaataagtggtacgacagctactcttggtggtattaaaccaggtgttacttacagcttctctgtagtagcgaaaaaaggcactggaacaagcccagcagttggtgcatccttcactgcgcctggcggaactccagatgcaaaaaaagctgaagaagaggctaagaaaaaggccgatgaagaagctaagaaaaaagctgatgaggaagcccagaaaaaggctaatgaagataaagtaaaacaagacgaagctaagaaaaaggctgaagaagaggctaagaaacaacaagaacagcaacagcaagaacaacaacgtaaacagcaagaagaagctcaaaagaaagctgatgaggaagctagaaggaaagctgaagaagaaaataagaaaaaagctgaagaagaagctaagaagaaagctgaa

SEQ ID NO: 2453 - DNA, 937 bp, Bacillus thuringiensis
gattgtgaaatcgtataccgtaccgtataattcacgttttgatcgcctgttttaatatgaaacgcggtaatctgcaaatctttttttgttacttccgttaaagggcttacctgcatctcatcttctttttgttctgagacatttggaaatatatccaaaagcttttccgtatctttttcattcaacatatacatagctttcttatattgcacccatcctcgtctatcttctccccttaaccatgcataataagtttcttttttcccatctctactaatttgtatttcatattcaggttcaccgaagcttcctgttatttcttgtttctcagctttattcaaaatgtctattactaacttcgcttctgattcctgcaactttttctctttatgttttttttgtaaaacggttacccctattgtttctttcacttcattcaccgtctcttctactttttttgtttcttttttcggttcaacttgaccacaagctgctagtaacataacaaacaacaacaccaatacatatttccctttcaaattaatcctcctcttacgataagaaatccttataatcttcatacataaaacaaaaacgtgacatcctattaaatacgctatactaatcattgaaaggaggtctttatcatgtccattaattttcatgatgaaaataataagtacacatatgcaacaagaaacgctcatatttcttgggctgaaatggtaaaaaacattacagaaatacaaaacaagcaaataattgatatcggctgtggtggtgggatttatacgaaagaattcgctcttatggcagccaataatgttgtggaactagcttgttgaaaaaacgtatttcatgctgcaagcgattattgagtcaattattctccctcctcattcataatgaaatacccatatcagttattgttttatag

SEQ ID NO: 2454 - DNA, 881 bp, Bacillus thuringiensis
aagaaagatctagtagttagcatttaaccattagatctttctttgaattagtatcttttacataataattattgaagagggaaaattctattaagaaatgctattaaatattagactaatttctaatggtcccagtatcttttattttgacgtgtgtctttacatttattttagcctctgctaacgcttgcgaccaatctccttttacttttttccactctttatattgaaatgctttagcatatagggataatccgattggatcaattttattctgctgtatttcatacaacatattttgtaaattattattaatttctttttgaatagcactttttaaattatttatattttttttattatcatagtaccccttaattaaattaggattggttttttctattaaagctacattagcatatatatcgagattaaatacaaactttccgttttgaaaagtaacatctaccttccttgtcgcgttctgtacgaagatagaagtatttgtttttttgttggaatttttaggaggaagtgcaaggtgtagtatcattcgcccgttactttttggcttatttataagattgaaaaatttaacatcttttttagggatataagtcaaatatttcccttttcgatttaaaaatgcaattcctactgtgtcgatttcattctttgtttttttgataattggaacagtttgcgtcattccatcttcattttgttctctcattaattgctgaattgtagaagagacggattggttattttgaattgaggattcgattacaccatttatataagatgatagtgatggcccactaggcttataaattttaaaaattttttctgcaggcccatctacaagtactactttagca

SEQ ID NO: 2455 - DNA, 719 bp, Bacillus thuringiensis
cacttatcgttttattaattgcgtttatcatattgttattttctcaaattatatggctaatggtggattttagaatgagtaaaaaaaataattatacgatttagtttttttgaattaacagatcaatatttttcataaaaaaagagaggaatctacatcaaaatagattcctccttttacatttggacttatactgcacttttactgcagcactactcctcttttttacgatgcatgttcatctttcttcttcattaacgctcttttcttcatcgccttcgttaaatatccacccttaaacgagcgaatttcatacgaagacataaacgctttcggtgcaatttcattaatgatttctaaaagctctttctctctagaacgctttgcgacgatatctaagcgataacgtatagaattaataccttcgccttcaaatactgtaacgccaaatccagagtgacgtaactcatctactaattcattacaacggtctagtaaactaacttgatacgtaatataaccaattgctaatttattctctatataaccgcctaataacagtcccgcactaaagccaatgacataggcaacgatgttcatccaatttgataaatcttgaaacacaatacctaaactgacaatgtaaatagctccttctaacaatccaacaccagaaacggatcttgtttgattctttacaagcaaaatcgtacggattg

SEQ ID NO: 2456 - DNA, 982 bp, Bacillus thuringiensis
tccttacatacagcttgttttccttttatcttttttatctcttcatgaatattagctaattgatatgaacctgggaaaatctcttccacataatgttgatgcgtcttttcatctttccaatacgttaacactatgtaacgatttttattttttaaagacttcccaactactccacctaacattccttttgctttttccattcctttattccaaattgtttcttgcttatgtaaaaaatgattttccttttccatctttacatcacatatagcaactcttacgaatgatccttctgtaacaacgtctttcaaatgcgtatcagttatatcatacaacgtttgaaataattcaatttcacatgaaagaaacgtatcctcttgattactatttaaataaattgtatcgtgagcaccattcataaatgattgatatgcacttctatcttcccataaagtaaatacacatgcctcatcttcataccatccaccaaattgtccatgaaacccatctaggtgccgtatatcacgccattttccttgcgcatttgaaaacaattcctttttctcttcttccaccttacagtagattgtttttagtagcattttttaattccccctttagcatataatttatcttcttctcacaataattagttcacataatatttttataatcaccctaatactctttatagacatatagaactaatcatatttatcactacatctatcgaatttaatttcaaatgattcagaataaaaaaagatgtaactcttaatgaattacatctttagctaatctcccttattcatctttttctcaaataaataatacgtaatgtctcctggataatgtactactgttaccttccgctccccttttttaaaactaacagtatgcccgttttcccctaagttctcccatccactcgcctttgtaatcggcattacacttatatattgatagtcctcttccttatcat

SEQ ID NO: 2457 - DNA, 694 bp, Bacillus thuringiensis
acgatctggtccgcccataaatccgtcaccacatgatgcataaaggcgatttggtgctttagggtgcataagtaattgatgagcatcgataggagcaccgaattttttatcaatccatgtatgccctttatcgttactttgaataacagcaccagcttcgattgaaacgtgtattgtattagggttatttgggtcaactgtaatccagcgtacgtgatgggtaaaaggtctaggcggaaatgcccacgtataagaagataataatgatttcatatttttaagttcagtccacgtttcaccaccattttcagagcgaaataaagcgctcggttctgtgccgacataaacgacaccatatccgttaacttgttcatttgagcttattgttatggaagtgatagaggagtgcaaaataccatcttctttagggaaatcaaagtaacgataagaatctggcaattggtctccatgaatccccactatcgtcacttaaccatagacctcgtccaaatgttccgcaatatacacgattcttttgaaatggatcacagcgatacaggaggttgcatattttgtagtgataagccgttcatagtaatcatgtgttcttcacttacacggttcacgtccatacagagaaataaacgttattaagaacctcttaaaatttttcattgtaacatatgaaaaaaaa

SEQ ID NO: 2458 - DNA, 519 bp, Bacillus thuringiensis
tacgtaagcttggatcctctagagcggccgccctttttttttttttttttttttttttttttttttttttttttttttttttttttttttttttttacagaaaccgtcacttgtaaacatcgaaaaacactggggtttctggaaccttaaaaatgtttttccataaatggttcatgggcataaaatgtaaaacatagtttcaggtttttttttgggtggataaaccaagccagggaagcacaaaaccccgtttagatggacaacttaaagggtcaattcacagttttgccgccaaaaacaaaggggcatttgggggccttttttccaacagccccaaaattcccccaaactttggggtttggccccaaaaaatgggaaattttttggggattgttttatcaaaggtttgcaagcaagccttcttgggggctttactcacggaagggtgtgcgtgaaattttcaagcaacggcctaactggatgctccatactggaaggggaccacaggttcttgggtta

SEQ ID NO: 2459 - DNA, 534 bp, Bacillus thuringiensis
aagggaatcgcttatattcttgggaaaaatgtaaatttaagaaatggtccatcaacttcttcctcagttattcgtcaattaaattctccagaatcttacgttgtatatcaggaaagtaacggatggctagatttggggaatgggcaatgggtgtataatgatccttcgtacattaattttgtaaagacaagcaatagtgatggaagcccgattggggttgcatatatacaagggatgaatgtaaatttaagaagtggtccatcaactacatctgcagttatccgccaattaaattctccagaatcttatttagtatatataaatgaaaatggttggttaaaccttggtggaaatcagtgggtatataatgacccagcgtatattaaatatactcaatattaggaattaaaatgataatgcaatatggatgcgtatccttgttatgtataacatggatacgcattttaattacatcattcatttccatacttatgcactatgtttcaaaaagaaacctttgaaaagcggatagaa

SEQ ID NO: 2460 - DNA, 832 bp, Bacillus thuringiensis
atttgttagttttggttataaggaataaaacagaaaagaggatcacatgttagatactttacagagaagtaaaaagttttttttagtatgtcttatttttttagtgcttttaaccgcttgtggtaatacagatgttaagacgtctaaagcttcattaccaccggctgaatccaatatagatacatcattaaaagcaccaaattgggtagagaaaagtcctatccaacagtctcctaattttacggaagataaaaaagtacaatcggttgtgaatttaatagctacgggtgataatttatatcatgacgcagtaattaaagatggcaaacaaaaagacggttcatatgattataattatatttatgaaaatatcaaaaaagctgttaaatcaagtgatcttgctatagtgaaccaggagactccgattgccggaaataatttaaaagtacagggatatccgactttcaatacacctgaagaagtaggccaatctttagtggacactggattcaatatagtgacgcaagcgacaaatcacgctatggatatgggtattaaaggtgttgcgaatacaagagaatactggaagaaatatccggatgttatcccggtaggtattaatgagagtaaaaacgagcgtaatgaaataaaaacgattacaaaaaatggtattcgttttgcgttactaaattatacatatggtacgaatggaattaaaattccagctgataagtcttgggctttaaatttaattgataaaaaagcgatacaaaatgatgtggaaaaggcaaagagtagctctgatatggtgattgttatggtgcattgggga

SEQ ID NO: 2461 - DNA, 512 bp, Bacillus thuringiensis
accaatttgcttcttgcgctaattttttcccaattaaaatgatttcagctttggaagctgtcagatatcccgttaacttcgtatctatcttactgaatccattatatacagttgatgcttgtgtccaatgctctatagtacttttttgctgcttatgatgaaagagtggtatgcttgttccaacttttatgtttccattagaggttctatccaagccaattaaaaggattaatgaaaccttctcaagaggaattctctgactacaaccaattatatacacacaacaaattacaatccatatccattttcgaatcaaagttgtttcctcctagtaatccaagtaaaaagaatactgtaagcgaaaaataagattggtaatagaataaagaaaatgacatttaagatatccataagagaatatataaacaaatattcatccacatcgggatttaggaaaataaatagcccaactataaataacataaaagcaagcagcgcccaatttcgggcgt

SEQ ID NO: 2462 - DNA, 1034 bp, Bacillus thuringiensis
  unsure (1)...(1034): unsure at all n locations
aaatcccctgcctaaacgaaaaaagttttaaattcttatcgtttattaccaatctataactgaaaacatatactatgatgaacgaactcacaaagcataagaaaagagagcatttacaacactctcttttcttacatactctatggaactttacaaaactgaatcaatgatttttattattatattttattacatatacttaggttgtactattatatgtaactctctctctgtatccgcttttttcggatgacgaaaataattaagttcgtactttaacactttatactcaaccatcccgattttaatccctttcgtttcttttaatatagctaataaatcacttacattttcatcatatgactcaaaaattttcgcgccgccctctccttgaaagattactttcatatattctccaccaccttaatttattgatgtggtaaatgacgcgtttaaaacgattcattctttatcctaaaattttcatatgaaaaagaacatcctttccaatcgaatgctcagctttttactaattatccatgttaaatatttattcaaaaacattatatgtattattttttaaattatgttcgatatccattattaaagagtaaatatatgtaataaacttgcataatgaaaaccgtagaatatccactttcgttgaaataattataatccataattttccattgtaattcttaatatttaaatgtaatattgtattgtcttactatctatttataactcacacactaattagaaaaagggaactctatatgagttcccttttctaattatgattacagtcattatttcttttctagaaatttaaatgtatctttaaattctttattattcactttaatatcagcatctttcaataaatcattgactacttgttgtttccatttacctgtcgtatcttggagnctttggtgttctatatctttacgaattttatcctttacttcatcnaatggctcaattctttttatccgcactttaatatatggtaaccgaagtgtttaacc

SEQ ID NO: 2463 - DNA, 727 bp, Bacillus thuringiensis
aaaaaaggtttattctgtgtgtattagtctcaaaaatcttaaggttgaccaacatgaattacttatgaaaaatgtcacataactaatggtaagcaattgtttctaattatatttcgattggtgaaatgtaaaggaggttattatatgatttggtctttaatcgtcggtggtatattagggtggcttgcgagcttaattactggaaaggacgtacctggtggtgtaataggtaatattattgctggtattatcggttcttgggttggttcgaaattacttggtagttttggtccagtcattggcggatatgcaattattccagctttaatcggtgcgatcattttaattttcatcgtaagcttcttattacgagcaatgcgaaaatgaatgtaaggactgtttacatttgtaagcagtcctttttatatgttatgctagtattatacaatcaggaggtgtcagcattgaaaacattcacagtaaatttccatcaagaagataatgctaaagcgacaacagtacataaattaagtgaagaggactttaacaaagcaacagaaaaaggcactcgtcatctatttgatttagatacaaacgttggattcttcgtattctttgacgcagaagatgcagaaggaaacgatcaatacttaatgttacaatacgaaggtgatcatgaagagccaactgcgtgctacggatttgatttaaaactatactatcaatt

SEQ ID NO: 2464 - DNA, 651 bp, Bacillus thuringiensis
atatagagtaataaaatttgactaatatgagaggggaattgtcatgaacaaattatcaacaaagttagtagtagcaatcggtattggagcagcattatacgggatattaggactttggggattttccattgcaccgaatacatttattaaaccagcattagctatattaactgtttttggagcattatttggtccagtggcaggactgttaatcggacttatcggtcataccgtaacagatacgattgctggctggggtatttggtggggctgggttattagttcaggtattattggtttttcaatggggcttattcaaaaaagagttggttttagtgtgaaaaacgggtcatttaacaagggggatatttcttatttagcaattactgggctagttggtattgtcattgctattatatttgctggggcattcgatattattgtgatgggagaaccatttgacaaaattgttatacaagtattaggagcaacaatttccgatgtcatcgttttcttagtacttggattgccacttacaattggtttggcgaaatccaataagaaacatacacatttaaaaattgaaaagtagggatgttaacatgcaaccaattatttcgtttgaacaattcacctttcaatatgggcatg

SEQ ID NO: 2465 - DNA, 714 bp, Bacillus thuringiensis
ctcatttttatccccctaataataaacagaattttcttttattttatcataaaatgtgcctcaatccattctctattatcaaatcctcaaaattacctcgctaaacttttacttttcattcatttatcggtgaccatctcttttcgcgacttgatatccataatacgcacatgttccatttctcgatagctctctaacttcaaatccacagcttctataaaaatcaaaattgttcgcagaagtatgtgcaaaccagtcaccatgtggtagcttttgcaagcaaagagcgacaagtttcttacctaatcccttccctctatattcacatttcacaactaaatttactatgttcgcgaccatgattccatcagaaacgactctaaccatggcaatcatctcttcttcatcccaaattgtgaatgcccatgttgaattttcaaatgctatcgtgaatttttcaatttgccaagaagggatattatcattgctacaaccggcatcttcaaataaagccttaattgcatatgcaggtacaccattcgttccctcacgaataataagtccatgatgataaatgtacatgtgatgccccctccatttgtatataccatacttcaaaaaatgcaaataaccctttttgatccaacgctcctaatgggataaaccagaacattctttccatggaatgaacttgctttgttataactacacccc

SEQ ID NO: 2466 - DNA, 822 bp, Bacillus thuringiensis
atagtccattgaaataatacttgtaatggaattgatatcacgctacttattcatataagaacaagtagcgtgttttttctatttaataatcccattttctaaaattttaatagttggtgccactttcacattagcttttgaaaaggcactcggccaatcaacttcgacttgtttccattctttatattgaaacgctctcgcataatcaccaaatccgaatggatcaagttgctgtttttgaatgttgtggattaaatcgttcaaatctttgtttagttgttttgtaataagagaagttaatttctttctatctttgtctatatccatattgaatgtaagttcagagacagcaattttcaaatccattttaacatgaaatttgaagtggttatcgctataatctgtatggatatcacgatccatgctaagaacatttattgttacgaaatcgccgccatcggtatcttttaaatcactattactttcaactgaagtagaagggattttcaatgtaagcgaaaccggtgtattcgctttcttttgtaacaaaagaagaagggcgctttcataacgatttaatgacattttataaattccgcgagaagttaatagcgcggaaccagtaacgataacatcctttttacctttttttatttctgaaatagcaggtgttatacctttattaaacgtttgcctgtgaaaatcatggaatgtcgtaaaaacggtccgattgtacagtttgttcgtattaattaaatctgtaaaaatcttcgggaagggcaggcctatcttttaaagtttttatatataactgaagaaatt

SEQ ID NO: 2467 - DNA, 545 bp, Bacillus thuringiensis
aattaattgcaggtgggggacagactaataaatagtatactaattaatgaaagagagtaattgcttattaggcaattactctttttctatgtacgtcttaatattttagtctcgttcaagtaaggaaaggaacgattgtaataccggggaaatccatctagatttatgatagattacataactttgaataactgttggagtttcgataggttgaaaacatagttgtcctttttggcaactttcttgtacaacgatataaggaagaattgaaatgcctaactcacacataacggattgtttaatgacttcaacattggaagtttcaaatgttttagctggaatatttccactttgacataaaaaacgatctaccattggcctatagccgcagctttgttctgtaaaaatgaactgggtgtcctgtaataactggaatggatttgtatgtgcagcggaatgatctggtaaaatccatccaaatatttcattactaaaagatctcgtaataaaatcattatgttctatacttactccaattatgaaga

SEQ ID NO: 2468 - DNA, 700 bp, Bacillus thuringiensis
aaaactcgaagtatagcttccaaaaaacaactgtttatcgtattggatacaaacaaaacagaagtcctaaaaaagacttctattttgtgacatataatgaatgataaggtggtaaacaaatcaagataatgtgattgagtggtaaaaatttattaatagctgttttagaatctcttataacaaggctgattacaaaaagcggatctctacactgctaataaaaattgaaaaattctactcattaaaacttagactaactacagttgcaattgattgagctgcatgttcccagcttccatctataactttaccaatctgctgaccaagtgcatttaaatcatttggattaactggaattccattatacgcagcaagaattgataaaagtggagcagcaaatggtgtccaaccacctctatcaatattaaatacaggtttatctagtacctttccatcttgtactgtaaactcataataaaattgatcatctggacgaaaacttaaatggtgagagatttgccccttaacatatttttttcctgcaccctagattactacttctatttcttttacatgaaattcatgttcaaatactttgatttttttgacttctggaccatataaggcagcttgaacggctgtttccaaattgttctgtgcaaaaggttgaatacttaattgtgcctcttttggttgaata

SEQ ID NO: 2469 - DNA, 716 bp, Bacillus thuringiensis
tttttataggctcctaattcactaaatatagaagattggaatgctttcattctagttgctaacgtgtaagtcatcaaaacccctcctaaaacagtgctttcattcttcatttttaattattctgaaaacacatgtttatattttatcatttttttatgaaaattaaaacgattgacaaatttagaggaaggattagcctattttgaaaagtaacgatgtaaatagcgtagatgtgttaattgaaatgtctattataggattcattttatataacttaagatattttctagtttttattaagtatatttctcatgttttgaatgaaaaagaatacgaaaacaagggctatttttgtggacgatttctaaagtgaaataacgcagaaaatattttctgcgtctcctctgaaatgtaatcatttctttttatatgtgcataatttttcggctgtcaaaaagtatacatttaatgtaccgtcggcaacttttaaagtttggtccgatgtaaatgaattaccataatcaatgtgatatatattagaatttttgacaaatgagcctttatataaatcgtctttattctttgttggttgcatttctactaaattttgcacaatttcctctttattttcttttttgataactgtttcaaatttataatatacagggcattcccctttttattgcaacgacttcccagaaccgatatatcgtatt

SEQ ID NO: 2470 - DNA, 898 bp, Bacillus thuringiensis
ggaatttcggctttaatgttatatgatactattagaacagaaccgggcatgttacatcaatggtagtgagtagaggattaggaaatagtatcattccgcaaagaattttgaataggccagagattgtagtcgtgcagttaaattaagctgtacgatttttttatacaaaagtgagtaaagagattttatgtattttgcaggagttaacattacaattttgttaaaaattttctacgttacataaagtaacaaaatttgaccctgattgtttgttatagtgtaaataatcaaaaaacttaaaatttgtcgagtgaaaattgtgataagtaattcatgtaaaaaacttaaaggggtgtacacatgcataaagaatatgaaattgaagaatacacggcgattgaggaacaaatacattattattgtaaatgtttattagtaagtcatcctgatcaaataataaagtatttagaaaaaaggttagaaaaatatgcagaaacattacaatatgcacatttatatcctgacacagttattttaccgttacagcaattagttattgaatattctttagatgttgctagaattcggaagtatatgaatttaaaaacgtaaagtgaaatttatagtttaaatgaaacagagtcgactttaggaaatgaaattctaatgtcgactctgtttcattgtttaatatcgttgattaaacatacatactaatcaatgaagtttgacatataattaagcaagggtaaaataaaagtgagtactcactcattttattggaaaaggaggatgaaatgtgcaacaaccttccattattttacggactgtatcaaaaagttttggaaaaaagaagtgttacacaatctttcattgcaagctgaaaaagcagaaattt

SEQ ID NO: 2471 - DNA, 878 bp, Bacillus thuringiensis
ttatggttccatacgtcattttatgtatttgcattactcccggcgccgatttttgttatgaccgcatcgcaaaagatttagctgctgcacaatcaatttggcaccccattacatttcaaattcaagaagtaattgtattaaatgaacttttccgtttttttgaccgtgaaatcagttataaaaattccatttaaagtcaagaaaagttggcatcctttttccaaacatgtgtaaatgaagctcctgaatgcgacctttatatttgttatattggcagtgattatttcaaagaaacagcagtaattgcctgcgcttattctttagcaaaacaacagcaacttactggctatatcgttttaacaaattcggctgcccctacgaaaaatatatatacgctcgctcacgaaatcggtcatattttatttacaagacgtattcatggaaaacttactcatgcagatcctcattctccaaccggctcggagcaccacccttctccaacaaatcttatgtatccgatagtccctcgtccagaaaacgttcatattcattccttattaacaacagaacaaaaagcgctctctttacaaagctctttactacaaagaaaaaaacagtaaccctcatgttactgtttaaaacaacttgttccaatcaacaaacaaaatcccggctgctagaaataaaaatagacaactaaatgtaaatgtaatccctctaaaaatccctatataatatttctttggaaataatttttggtatatccagagcagccgctttttattgaatttctagttcatactttttctttcttcaatttttaaagaccatttcattaatccatatatacttccatacataagtaagacctttgcaat

SEQ ID NO: 2472 - DNA, 560 bp, Bacillus thuringiensis
cgcccgtagctcaattggatagagcgtttgactacggatcaagaggttaggggttcgactcctctcgggcgcgccaattacgggaagtggctcagcttggtagagcacctggtttgggaccagggggtcgcaggttcaaatcctgtcttcccgaccacgcgggtgtagtttagtggtaaaacaagagccttccaagctctggtcgagagttcgattctcttcacccgcttttagttctttgaaaactgaacgaaacaaacaacgtgaaacgtcaatttttattttagatgctagacaaactaactttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgacattgaaaggcggcttctgctgtcacttatggatggacccgcgtcgcattag

SEQ ID NO: 2473 - DNA, 794 bp, Bacillus thuringiensis
tctctttgtacaagatgttacttttttcatgcaatccaaacgtcttttatgcatctattaatcactttatcccaaatataagaacattatgatacaataatctttaagtctttttatttttccgatgaaaatagagatactacttgttgttgcccttcaaaagagtgtaacgacatggtcaatttcttaataattgcgcatactacaagtatctattgatgaaatagctttaaggaggaaagttttgtgaaagacaaattctgttaaatcctttttatgtgggattttacaaaatgggatctattttactactgtacatgtgacgaaatatgagcatgcgctcatttttacaataatatacgtaatcgtaaatgtactattcttatttttagctgacaaaacagcatttgttttcttcatactaggaaccattatttccgtattttatttgttctatcaagcatggcttcacttatggagtacatcagatcaatggcaatatatgattatccacttcctgatggcagctaacttcttcattgtatatataacaactcacctattgaaaaaagtgattcatgaaaataaaactttaactgagcgtgtgagaacattagaacaatatattggagaatcaaaattactaacaagacaagaattcgagagacgccaagcgttattaacgactgcaatgaatcgtcgtaatgaaacaggcgttatcatttactttgatttcacttcctttagtaaatatacgaaggaaagtgttatgaaccgtgtagcttctttattag

SEQ ID NO: 2474 - DNA, 285 bp, Bacillus thuringiensis
ctgctcattgaccgcccccctctactctccttcttttttttcttcttggtggaaaacatacacgcgggtcttcgtggtaagtagcacctctatcgtctttgcagatgcatttaatcgtactacctgcataatctcttgatgatgtgctatgaagggcattccgagcgcatgtaactcaaatacatgcgcaccgagttcctgaagcccaagcatttcccccatacatacgactcctgtaccgtgttaacacatccccttcagcagataggacgaatgtactatctc

SEQ ID NO: 2475 - DNA, 840 bp, Bacillus thuringiensis
tattacctaacgctgatatcgctattgcaaattacagttatgaatcatatacagccactttcttcggattttatcaactatcactcgcatttggttttatcattggtaattataccggtacatcttttacatccaacttaagcggaatgtatacaccatggcttatttttggcggaataggacttattggttttatttcactacatattttgaatataaaaaaagtggcctctaaagaggatatacacctatgtaatacaagcgacctataacgaaaaagattcgaccatcatatgtgacagtcgaatctttttatttttcatattcaaggtgattatgtcttttacaacgaaataaatagcaagcccctatataatcagtttcaaactctaatcctggaacgtatccagatttgatacgttctaccattgttttataacaattattctcttctgtatattccttaattaactctttcttatcattttctgtccagttttcttctacttcttcactctgaacatcttctatttctgctgttttcgcttcgatagattcccgtataacttcatttatacgggagaaattattcgttttatatagagcatacacaaatctaccaatccaattaggacttttccagcattctttatatcccttttcgaaccattcaattgcttctttatagcaattcaattcaacatataaatctgctacattaatttcccctaaaaaattatcagattccctgttaaaagtatctaacttctcttttgcttctgtcgttcgttctaaatcaattaaacattttacatagctatacatgatatagtccgaatc

SEQ ID NO: 2476 - DNA, 580 bp, Bacillus thuringiensis
ttatactgggctgggtagaatgtatggggcttttcaaaggcctttggacctgaagactcatatcgtctaatccactcacgaagtacgctagggttaactcctatagatttagcaattgtttttccactttctgtaccatctaaatatcgtttcaccgcttggattttttcttttgaagaaaatttagccataaaaaatgcacctccaattgttagactgtgtctaacaattggggtgcacttcatattagatggcttttgtatgttacgtgtataaagttatttgaaaataacgatcgaataataggtgagattataacaatatttgtgtaagagaataaaaaatgtagataatttcgattttcaaaaaaatcaatttgaaaatatgtttttattttgcaactaaatatgttactatatgtgtgataaaaacaaagaggtctgacatctacactccacataataatactctaatgatttgaaaattcaaaaaaatcaaaatttaaaataataattgtattaatgattagagtaaaaaataagggaatggagaaattatggagaaagacactgctttgtag

SEQ ID NO: 2477 - DNA, 299 bp, Bacillus thuringiensis
ctactcagtgatcaccacgctctggtccccttttttgagcactaattggttgtaaactcataggcaattcttcgtcaaaactagcatctctatcgcctgtccggatggaatcaatcgtcctatctggaaacgctccagtgcctagtttaagagaggctttctgcacgcttctatctgcaagacatacgcgccgttatgctccaaccatttcttttaccatatacacaatacttctgttcggaggccacacattacctggcgcagagacgaagcctgtcctatctcattcacagcctgct

SEQ ID NO: 2478 - DNA, 1435 bp, Bacillus thuringiensis
  unsure (1)...(1435): unsure at all n locations
acaatgtatttatcgtcccagaagctaatattttttacaaaaaatctgagcaggacgctatgttacaatatgtaaaaaatggtggtagtatcttctttattgctgatcattacaatgcagatcgtaataaaaatcgctgggactcttctgaagtatttaatggatatagacgcggtgcttgggataatccagcaaaaggaatgtctaatgaagaagcaaattcacaagctatgcaaggagtagaaagctctgattggctctctgacaacttcggtattcgcttccgctacaatgcacttggtgatgtttcagcgaaaacaattgtatcacctgaacaatctttcggaattacaaaaggtgtttcgtctgtagcaatgcatgctggttctactctagcaattacaaacccaaaactagcaaaaggacttgtttaccttccagaaaatccatcaaaatggaataacgctgttgatagtggcgtttataatggcggtggtattgcagaaggcccatatgcttgcattgcanaagtaggacttggaaaagctgccttattggtgactcttcttctgttgaagatgctacgccaaagtacgttcgtgaagattctggccaaacaaagaaaacttacgatggttataaagaagaaaacgatgctatcttattagaaaacatcggagagtggttatcgaataaagagacatttacaagtttagatcaagtaaatggtttacaacttgattcacctacagctctacagacatttgaacagccaagcttatcaacagaaccacaacctgaaccttggggtgcaccaaatgcaggttatcaatggtttaatacaaatactttcaaaccaggttcatacggttataatggtgcggtaacaacaagcgactacgtcgttacacaccctagcattctaccaaacaatgaaattttccaaatgaagattcaagtaaacaacttactacctaatacaacttataacaactattctttaggtatcttcactactggaggaacacaagtggctaaagtacaaaatgcaaacggcacttggccatctacttttggatatagcagtgcattttctttcacaacaaacagcttaggctctgctgagaaagttgtaaatgtacagattgattcaaatacaattggacaagcaacgcttcgtctacgccaaaatacaacaacgaaatataatgaaactgtaacaattaataagaaataataaaaaaggcaatccatacatggattgccttcttctcacttctcttccttcgagaaaaacattcttgaaataacgatacctatactaccgacgattagggataacactgccctaatcatcatcgatacctctggtaagtcaagtaagaataactttccctaccgtacgactaaaacgactaaaccagcatataatatt

SEQ ID NO: 2479 - DNA, 551 bp, Bacillus thuringiensis
tgatgctaatccgccagttcctacttctgcaacgatagttaagaaattagatccgcctatgagcgaaatagcttcaaacatttctacaatggacccggctatttaataatattgtccagctttttctaatgtttctttacattgaaaaacatactatataacatcaattgaagcctatgtgcctgtgaaatgcgaggtacgaaagtgcattcgcttaaataataattttcaatttaaatcaacaaaagagacctcaaatgtgaagtctcttttgttgattattttccataagtaactcgccttttatttgtttattttaagacagataacatggttcattcaaatatatatcctaaagaaaaattttttcctgccgtcataatctagtagaatagattcaattaattcttattaattgcgataaactcactaggaatctcatctgctaaccaagctttttcatttcctaaataaaatttaacgccttcttctctagctttttcagtattaacttctaaaataataggatgcttatcttttcttttccccac

SEQ ID NO: 2480 - DNA, 279 bp, Bacillus thuringiensis
attgtgacagaagttaatttaaacagatcgtcatcgacgacattggctcctaccaaagcatcagatttgaagcataattttacaactcattacggtgggaaatattccgtcgtggtcaaaacaaccggtccgaaagctataccatctcagcctgaatattacgatgcgccggaaattcttcccccgcatcaagttcaagtccttccggaattgaatcatagttatgttgttttttggaaggagaatgatatgccgaaagctattcaagagtcatcgtaa

SEQ ID NO: 2481 - DNA, 608 bp, Bacillus thuringiensis
ataagcaaattaaacattgtgtatcatgagtaatgttaaaaaaactatttatacggaatttattgaattaagaggtaataatagtggtagtttgagaaatccaactgccactatttttgtgtttacgaatggttctgtaaagtaagtagtgtgtttaatgaattcaatcattcatccgtccagcaacaattacagcaccgccctccaattagcggctagcatcacagccggactcgctgaagtgcaaagcgggaaaggatttagtcctgtgagtgggacgtttagtacacaagggttgaatatggattgggtgagttcgattcaggggattatagaagaaacagctcgaaaaaacgagatgaaagaaattactttgcacaaacaagaaatgaacttacaagaacaggaagacaatagatcatggcatgaaaaaacagccatttatgcgcaaacatttttgcatggagttatcgaattttttcaaggtgctggtgatgcagcactagaaaacttttttggactacaaccacatgagaatgataaattagaaagtaagacaacttaccaagctggaaggttggctggaaatgttatatcaatagccgggt

SEQ ID NO: 2482 - DNA, 796 bp, Bacillus thuringiensis
tgaaaaatatggcgaaatcatatgaattatcttagacagacatttttcaaatgccttgattaaaaacgcttataaaaatggatatgtagaatttgaagaaaatggtgaattagacagagatttaataaataagtttaaaagtaatagagagtatggattgttagaaaagaagtgtttagagttaatactattatttgataaagtatatttgaatgatccatgtgaatttgctgtactagaaaaattaaaattcgaggggattgttaggcaatctaggtatttgaacgatgtggaaaatactgtggattataacgacattcagttaggagaaaacataaaacctttattaataaatcatttagttaaacactttcaaaaaagacagccacatttaaaggagcaaaggggattagccaaaaaatatgtagatggactatttgattttatcaatttatggaggatagggcttcatgaagaagctgttaattacacacatttaccattagaaagacttttggatacaggtaatcctgttgattatatatatagcctattaaaaagagaagaaagctatcctggttttgtggttgacatgcttgatatggagtttgaattatcatcaataatctctcttatgaaaatgtctgaagaatttaaggtaccatttatttcaaaaagagtatcatgtacatcgaacgaaacagaaggtgataatatgcatgaagtatataaactatgtttagttcaaatgaaggatgaaatacaatatattcctagaatagaatcaattgatgat

SEQ ID NO: 2483 - DNA, 873 bp, Bacillus thuringiensis
ttccactttatcgtagtgtctcaacattcgtatactaatggaagatagttttgaaaaatcccctattttaaacatgatttcctcctataagttacatctactttgaagctcaactttatcttaaacaatgacattgtgtgagagtcaactgtttataacgtttgaattatatttctttatttacttttatatcctcttccttctttaggttataaaaattcactaattgattcgatcgcgactagcaatcaattgatttaccttcatatgaacctctattcttatttctcattaaaaacatatttgcaatataataattacataatgaatattacctattatgcaattatcctctcacttcatgaatcttatccttgtatatttcaaaccactgttgccattcatctttagaaaattctttctcttctccttctaaaacgtaagaaaaaagatttaaacaaatatgccaaccaagctatatctctcggtgtatgatctgttaattcatgaatgtactctttaaggaataaaagagtaccattttcctctttatgtatttcaaatcggacacgatctttatcccaagtaaattcaagtactgagtttacttgacactctaaaatatcaatgtttatgaatgaaccgttcatcatgtcgaactttattattccacccgttttaaggctttcaatctgtaaattggacatccattttttcagcttactgttttctgttaatacagaccaaacttcttctgccgtatatggaaattggcgttcaaatttcacaatatatccatcatttagtttcccaatttcagctatcattttgattgcctccttatatagaatatatgttctcattttattttac

SEQ ID NO: 2484 - DNA, 456 bp, Bacillus thuringiensis
tcagaatttttttttgaggaagccgacccttatgagactgcgcgctctaatgagcataacttgggaaacaagcgttcaatactgctaacgaataatttaccagatgtgtttgatccaagagacgactcattctatcctagggaagacggtaatagcagcgcattcaacagtgcatatagcgcatgctataagaaacagtggtggcacaggtggatctgcacaccgtgctgcatactgctccaactagtatgcaaaccgacgcgtgacacgccaaaacaaccacgcgcgcgctttacattaagctatgagtaaacttgcgcaaggtggcctcctaccttatgctgtcgttcgctttgagtattgtgcagcttgtaaattcgaaagctgaatgagctcattatctgttgaagacgttcacgttggtttagcagtaccagattctgtcgttgtttctgc

SEQ ID NO: 2485 - DNA, 980 bp, Bacillus thuringiensis
aacaaatggagaagaaatcattccttctaaaacttacagcgtcgttgctaacgcatttttagcttcaggtggagatggatttgtatcttttaaaaacggtaaagatgctgaaacaggaccaactgattttgaagcattagtagattatataaaaaaatcaaaagaaccaattcagtctgttattgatggaagaattcaaaaaataaattaggtttttgttaatcttaaaaacaaatagattacctgtgcactatactttttcgtgtgcaggtaatctatttgtttgcgttttcgggcacagacgctacttcaatcctatcaatatagaaacaatttcgaatgtaaggaatttgtaaggaaaaagagattttcaattatatgtacatttatttaataaagtagcgtatctcattgaagatagtttgttaaaacgctcattgttacaagttacttacatgattaaatataaaccagtattaaacaaagaagtacaaaaagaattcccagagttgtatactcaatacattaagcagacaaataaaaaatctatgttgttagaaattgatgaagctaaagaaaaaggggagggaaagggttcccataaaaatactagaagaaattaggttacttatgcataaatagcataagtaggcacatgttatttataaatatattggaagtgcaattatcaatatttaaagatacgaaagtaatacaaatgaaattcttatttctactactacaagtactattgagcaaatgaagtatgaaattgcttttgaactaggagtaacactgtgacttgatacatcatcatctacaaatggttcggatcggtggagagattacaaaacgcttagttcgaatggttgaaaaacagttaacaggtcaatacagattacactaagaaaataatccgtatatatacggattatttttcctttaatttacaaaaaaataaaatttgaaatccaaaaaac

SEQ ID NO: 2486 - DNA, 837 bp, Bacillus thuringiensis
tgttaattatgttcagcacttaaaatagcatccgctgtattataaattccattatccctaatcggggatattacttttacatttgcttttggtgcaattccaatatttccaatttgattatcttcagatgaaacaattcctaatacagaagtaccatgagctctatgctggcttatattttgtcccgacataagcttaatatttttattgactaaatcctcatggttcaataaccatccatattccatatccacaaaagttgtatccttcccatcaccacctttaatgctccaagcatgcgaggcattaattccctttggtgccgcttcaagatatccttgatttttaaatctagggtcatcgtacggattaacagataaatttggtaactgtatttcaggaggggtcaaaatttgtttttcttgtatataagcctcctctacgagaggagatgtttcaaattttttcagtaataattctatttctatgttattaggagcttgtacaatataataatttaataaattattagctgattcattagcaactgatttagattgtactgataacttttcaatctctatcggatttacagatgagaacagacgattcaaagtaagttttgtattttcggaaaataactgctttaaattgttatcataatccccattttttattcgtttctcaataccatcttcataaggtaagtcaatttgatttttaaactttacaattaatctttcttcctgtgaatctctttctttgtatgtgacattattagattcagcgtaaacttcaccatgaatactatcattttgtaggataaaaactgttcct

SEQ ID NO: 2487 - DNA, 904 bp, Bacillus thuringiensis
ggcccaaccaatgaaagtaccgcagatatcattaagaagaaactaaaagaagtaatggataagaatagagctgtatccgtgaagttcgaaatatttaaccctaccatcccatccgcaatccatgtaagaccaaatccaattacaagtgtcgcaatagctcctgttacgatttggtttacttttaacagaaagttttcttttcttgagcttactggcattttactaatcgcaataaaaataatcgctgcactagctaaacttgcaatccataacggctggaacaatgatattggtgagttaccgttcgcactatttttgccgacctcattcatatttttcacgttctttacaataggtgttactaatttcgcagcttgatctgttgttaatgtacctcctttttccttatatccttctaatacttgcgcgcgaacagtattgttcatattatcaacaatcgcctgtaatatttgtcctgccatagttgatgcagccgtattcattccttgattaatatatatttctatctcaggtgaagatggctgtggtgttcgtaacgacgcttgttttgcgctaaattctttcgggatgactaatgccgcgtaatactctttattgtttaatcccttttgaacggcttctttattttttacttctacccacttcactgcgggttcttcctctgatttcgctgtttttttcatgttatcaacgatcgtttgccccatattcattttcggttgatttggaatttctacaccttgatcctcatttacaattgcaattggcaagtttttcggctttggctgaacagttggaaataacgttaatgaaaaaataaaacacaagtagtgcaataactggtgataacaataaagtttatttttaaacattttcttttctc

SEQ ID NO: 2488 - DNA, 805 bp, Bacillus thuringiensis
acatatttattcaagcgttaatgtacatatttaagttagcatttatatgcgatatggagtttggaaaaagaagaagcttttttaagaaaaatgcatcaaaaaggatgggctttacaaaagtataatgtaatgtatacgtttaagaaaactgaaccaaaagatgtagtatataaagcggattttagactggattataaagattcaaaagaaaaacaaaaagaatatattgaaatatatgaaatgtgtggatggaaacatgtaacgagttttgcgaagtggaattatttttgtaaagaagtagacgtggaaaatgagttacctgatatttattcagacaaagaaacgaagatacaaaaatttgttgaattgatacagttcgttgcaattatgtttgtaatgttaattccagtgctttacttatgttttcttggagtatcagaatcaggattatataaaggtatggttgggtttttagtttgtatatatttatatgcgtttattaatttatttaggaagattaaaaagttgaaaaaggaaatattttaacaaagagtgatattcttagagaagattattgatgggaatcaacttctctaatttctatatatatttattttggtcattcttttttatataataaaagaccaactttttaattcatagaactaacagttacaaagataatataccataataccagtaacaacacctaaaaaaatcataaatgaagaagaaataatcaataataacgaactagcaattaatattatttaatagattttaattttttaaatggtagtaaagt

SEQ ID NO: 2489 - DNA, 922 bp, Bacillus thuringiensis
tcgtgatatatatcaaaataagaatagttactgcgtatagtgtagcttatttcatcatctttccttttgttttactaaagaaagaagcagacctctcatccatactaaacgcaccttcacttgccaatttaaatgtatctattgttgttacgatatgaaaaattactgctcctaaaagcaataaacccgcatacagtattgtaatccaatcaattgaattattagccattttagtaacagtcaaagcaataggagctattgttgccaattggaatgaacataataatacgacaagggtttgtagtttttgaaatttaaattgagctatcggaaatgaataaatgacgaaaagaattatttgtataatatataagaatacttctaacttaacaattcctatattaaagagaagcatgcagtaatcccacccggctgataaaacaatagaaaaaatggttattgaactaaatagtattcctccaaacataaatcctgtagccccctcaggacttaaacgatcattacatgtcatcctaaacttatctaaatcttcttcttttatattccacaccttgacatttcaccttctatacagtttaaataatttccatttacttcaattctatttcactcttatttacttttcgatttggattttgtatttcgctttcgaattctccctcgcattctctcattctcttcccatgacatattaaatgacttgaatttaaatctacagtacaccaatagttggaattctgccgctccaatggctactgtatacagtaaaacaatacctaccgcataaagaactaaaacattcaatttccataaccattatgaaaatatattcaaaataaacaggattagcgcatatattgtagcccacttcatcacatctccttttcttttactaaaaaat

SEQ ID NO: 2490 - DNA, 504 bp, Bacillus thuringiensis
aattgggctggtttcgtacaaggaattcagtggtatgcaaatataaatgcgcagattgatacgcctttacaagataaaaatgactcatttaatccaaatgaaaataatccagctgaacctagcatggaactagtggtaaatggtagtggtatcaatgtacgtagtgatgcgggtattgaacatcgtgttgtacgtaaagcttcaaacggagatcgttacaaagtattagcggttaaaaatggttggtataaagtaggtaatggagaatggattttctatgacccaagttggattaaaattaactacaatgtaccaaaggaagaagtacaaaagccaaaggaagaagtacaaaaaccaaaagatgatattacaggtggctggtttgaagggcatattcgtaaattaaacagtctaggtattatgcaaggcgaaggtaatggtgtatttgcgccatatcgaaatgtaacgagagcggagtttgcgaaattaatctcgaatgctctt

SEQ ID NO: 2491 - DNA, 650 bp, Bacillus thuringiensis
cagtatatgtcgcgcatgtgtatacacgagtgttaagcattgtgttaatgtcaattcaagaaaatgtgtggggaaggttaaaagcatgtccacagtgtcgctgtgtattttatgaccattcgcgaaatggaagtaaaagatggtgcggtatgtatgctggagaagaaggaggaagagcatgcggtacgattgcgaaagtgaaaaactacagggcgaagagaaaagggcgatctggttatgatatgtaagtaatattagagaaagaaaaatggatgggggaatgaataatatgaaaggcacacaaatgctagctacaaataaaaagtgttgggatacagttgcaccttatttctttcaagtggattgtttacctaaatatggtccgtatacggcgtctgaagatgagattcgtttgttcgattcaatcagaaagaaaaaggttcttgatattggctgtggaagtgggcattcgttgcaatatatggcggaacaaggggcagaggaattatgggggcttgatctttcgagtacacaaattgaaatagcgaataagacgttaaaggattggaatccaaagttagtatgcggagcaatggaagaagaaggagatattccgaaaggatattttgatattgtatattccatttatg

SEQ ID NO: 2492 - DNA, 1247 bp, Bacillus thuringiensis
tttttatagtaataaaaataataaagtggatttaaataaaaaagggtacacatataagtgtgcatttagattaacaggattgaacgtatggactggattgccctatacaatatgcttgtctaattagaaggtgaagtttttttataatatcaacggaaaatcaacaaaaacgctatagtagtaaataaataaaaaaggacctgctgtgggagaacaggtccgttacaaaaatgcctatgaggaaaatcaatgtcaccaatatagtatcaataaacgagaattcatttcaggtgctaagtattgagaaataaaaaatatttggcgcaacaaagtggtcaactttattagctaaccacctgttacacaaaagaaaattaggccctgcaagttaggatgtgtaacttaaagttacagttatagtgtaagccagatttgaaatgttatacgaaagttattttgataaaaacctcattttgtagaaataaggaaaataaaaaaagtactatgcataagtgctctttaagaaaggaggtaactctttaagcggaacgttcaggttagaaatatatgatgtgaaaaggaaatgagaacaaaatttcattttagatttaatacaaaagagcagctagcaaaagctaaccgctcttcagaaaaacattaagaaggaagttcagaactcaagtgtatttatagtatggacataatttgaaggtctattcagaaaaaaattataaagagcaaccactcaggttgctctacagataggagataactcagtgaacaaaatgaacacgttaaaaatgtatgtaacaaatagaaaaataagaacaaaaaagcagctagcaaaagctaactgccctggtgaataagaagaacacaatggtcattcggattcaacctaggtgaacttatattggtaacactttttagaaatttattcaataaaagagcagctagcaagagctaactgctcgactctcgaccaagagagctagagtgggaagaatttaaagctgactttttaaagtcgtatatagtatcggtgaaatttagagatttattcgggtaaagcataaaaagagcagctagtaaaagctagctgctaagccttcgggtatgaaggggaatcagaaactgtatatacattattaacggaatgttgtgttttattcagtagtagcctaatttgctactacttgatcttgatctgcaacatcagaatcaaaagtattcgttgcactaacacc

SEQ ID NO: 2493 - DNA, 880 bp, Bacillus thuringiensis
tccatacacaactcaaccacaacaaccgcaataccaacaacaaatgtatcaaccaaactacgacgtacgtgtctcaccacctaaaccaccaacaatagatccaactcaaccacaaatcttaccacctggaccaattactgaaccaacacaacaacaaattcaacaagttgtcggtacacagtttttacctttcaagaaacccgtactagatttcgtaaaaccatgggtagattacggtttaaatgaagcaaaacatacatcacatgaacacgcattaacagaagttgctgcgattatgtttttagttggtaaaggcttcaatccgacgatcgcacattatatcgttgaatcttgggagaagaatgaacagttttagaattgtttatttgataaaatataaaaaacacaaaagtgccaaaccccttataccacaagggttttggcactttttaatatctaaaacaaattttattgaaataattatttttatagattttcatacttttttatatagtacgtgaacatatacagtacaaaattacacctttgtatacacatttttagaaacatcttacgtttatcaaacaataaccaaaagacgtacctgcaacctcatcatataaataatagatattaaaaagaggacactataagcgccctcttccttaggttttaaatatgttctccatgatccataaacacttcaattgcttcgttttgtggtatgtcttttacattagtaagaccaaaagtaaaaacagcggataacatcatcattaataagattgcttttttcattttagcgcccttctttctatgctctttttgtctgcatctaaagcgatgtgcaaatacttgcttgcttttttgtgattttctg

SEQ ID NO: 2494 - DNA, 1106 bp, Bacillus thuringiensis
cgtgatccgttcgcaggatttgatccagaattagctttattttcaattaaacgtttaaaagaagtggggagattagagaaaccaattgttttctttggtcatgatatagagcaggaaaagagttgtagagtgttcccggaatatatatagtgcaaaaagtcatgagttcgcgtgctcatgactttttcgtttaaataatttttttaaataaattataaactttttttgaactatcttcgtttaactgatagtacgtaaggtttacatcatcaggagtatcttgctgagcaatcatcacttcgctgctgtgatgatcaactacccatatgaaatattttttataagttccatcctcgaaagtaatccacatatcacaatctattaaatctgatccttcttcatccaatgttaatttgcctttttttgcggtattcatgctgataataaatgtttttaattcatctgtttttgtgagaaagatatccttttttggtttaattgattctacatgtatatcttttatttcctgctttcctaaaaaagcagggggctcatttggatctcacgagcttgaaataatagtagctttctttttcggtttgtttgcagtatagagatcttgaatagattttcccgagtttacaaaccatacaattccacaaataattaatacgctacctagcaataaaataatttttttaatagggttttctcctctctattatttcgtgtgaagagcttttctattaatatatgataggtaagcgtaaagtattatagttgaacttggttatgcttcacagtttttatcgggcgatctatgagtaaattgtaagtgagcccaattaatacgaaaatgccaccgataactttaccgattgagagttcatttgtcaggaagaaatcaataatagtccccgcaaataattgtccgataaagatgagtaatgttaaataaaaggctgatattttaggagtaatatagttggataatgaaataacgataacgcctactaatccgcctaagtacacagcaataggaatagattgtaacgtctgcattggaatatacaatgaatctgaactgaaaattaaaaataacatag

SEQ ID NO: 2495 - DNA, 380 bp, Bacillus thuringiensis
aacacaggcccatgaagagaagtccaccagaaaactgaacagcagctgcatccccacagtgctgtgccctcggcatgagaaagaactaacttcaaaacctgcctgccccacccagggaacagtgcccagtagaagagagaaataaatctcatttaagtgttgttcaccaaaatccggtcctcacgtgaacttgctgcccaactccccccacatcaggcagaaggaaggtgatccccgacagaagagctgagataaacaaaggaaggacaaaggaagtgggaaccacatggatgcatccagacaaacactgggagaacaaaataataatgtttataggtttaaaaaaaaaacagaaccaagcacatcaactcagagggatg

SEQ ID NO: 2496 - DNA, 1027 bp, Bacillus thuringiensis
aaatttgttttccaagcatatgaggaattgttttttcatacgccaagtttacaatttgcggtggaacagctcgctttaacgtgggaaggaaaacagcaccgtgctttagcagatgctgaaaatacagcaaatatacttcttaaagtgtatagcgagagagatattaataagcgatacaaaagacatggtgaacttgaacttgtaaaaaacggaaaaataacagaaaaagcgaaaaaaaagatgcgaaaatgggtgtttaaagaactaaagaaaaatacagaacgcccttttgaatggagtacatttgaaagtggtgacacgtgggaaagtataacggaaagatattatataagtgaaaatacagtagaactcctgaaaaaacattttcgtacagcagtgagaaaagcggaacgacagattaggtatttggctgagatggaggagaatacagaggttaaatgaattgctcctccatctctaactacatacatgtaataacagcgtattgatattaaataggcatcaacttgttgttgtgattgtacattataattgctttgggagtgttaagacgtaataagagttttaaactgtattaataaaataaaaatatatataaagaaaagagtgtagtttaatggaaacaatctttaacattttaactgttttagtttttgggataatatttaccacacaattagcattaactacactttctttcatagtaaagaagaattggaaaaaacttaatatctctttaagttgtggtgtattaaagtttaaaatagaagagtaagattgagttttgtacaagggaggtatgatagtggtagacttggatattaaagatgtcacagtaaagatggaattaaacggtgtcttttggaatgaggatcggattgctgaaatgaaggtgactacaaaagaagagcattccgttattcttcgtctagtagttgatttagaaagtaaaactattagggcgacgagtgcggaaatagtgaatggattctgccctctgtgcaaa

SEQ ID NO: 2497 - DNA, 627 bp, Bacillus thuringiensis
gaccctactactgtttggatgcagtctttctcctactgacctcaaaatataccttctacttccaaattaaaatctaacaaattactatagctccattgtaggatccaagcaaacaaagcaaatgtatagaggaggtaccctcccttatatctagttctgtagcatgccattctataatttttacttcagcatttttccaggtactattattttctcccaggatgtcataagcaatctctaaggatatcagttgcagctataactaatattatttagcacttagtaggttccaaatattgaattatttaatatttgtatgagacaggtgctgtccgtattctgtagaggaggaaattgagacaaaaagagtttaatgagtttgatttatgattaatcaaaccttaatcatggtcatatagctagttaatagcaaagtctagatttgaacccaatccagagcctagactcccaaccatattactgtacttgtaagttcaggaatggcagtgattctgaaatgggaatctcctaattgtgccagtatactggaagataccttcccaaaaagtcgcatgcaaggtttcttgagggactgcagtgaccaggatatccctttcactggtaact

SEQ ID NO: 2498 - DNA, 1077 bp, Bacillus thuringiensis
ttggatcaattttttctcgtccatcacaatttttcaatgcgattaatgctaatgtcgcatcactgcgctcgcccgcggtagcatagacagctttcgtaacatcatctacaagatttgttttatatttttggcaatattgcattttatatggattttgtaacaccttttcaatattgtatctcacaacctttaataacactggaaaatctgtattcaatacgtaagtattttcaccaactttagtcaaaataatttcactatcaagtaatgcttgttctatttccagcactatattttcagaccaaacctctaatgttaatgtctctaatccttttggtgcaaataaaggaaataattcatttttgttatttgttgctacctttttacattctggaagtattgtgaaataagagaatttacgctgaaattctttaaataaatactctctttcctttacttttatacccggttctattttagtaccttgaactttataaattctctcattgtatggaaataacacccttttattttcccctacaatataatctttcggatattggagaatatggtctaaatccacctctccccctatttgaaaatcatcttttaaatttctaaatattttaatccatttcataccggttgtagcttgttgtatttttagttttacaaaccgtatttttttattatttgacgcaaactctgaggtagaaatcaatatcatgcctcgtttccgtcttaaaagtaaaggaatatctggatgattatattcttgataaaatctccgaatccctattgaaatatttaataatggagcgttctcaccaccgcgggttatgcattgaaatcgatatacataggagaaaaaatcttgtgttttttcatcttttatcggctctgacatcgcctcacaaatattttgtgatctcagaggagaaaaatagaattcttcttcatttgtattttctaaatatataggacgctcacaaaaaatatgtgagattaaagcgggtatccacttagaatacgtttcattatcatgtagtactggcaaattagaaatcaaatcggatt

SEQ ID NO: 2499 - DNA, 865 bp, Bacillus thuringiensis
aattcgtgataaagataactatcctgttaataaggaaatattcgttccatgggagtcgtctttaaggaatattgatcccagtttattagatcacccaccagaaaaaaatacgcgtaatttaataaaatcttatttaccgtataagccaaataaaatttgggcccaaaatagagaggagtttaaatgtctcggtaatttcatatttattgagtataagggacatagatatatatctttagcacaattgattaatcaagaaagggataacggaaaaaacttcattgatagggatgagttttttataaagacaaaggcagttttcttgccgcttaaagataaagaaaattacatcgctttaaagtctatgaataaagaagatataagtgtttcctggaaaaatacgtatgatatatttgcatttgaacattattggcacccagctttttcgaatatgtattatgaaaatgaatttgaaaatataaagtgtgaagattcagtttgggaatattcctgggaggcaaatataaattctgtttctggagaaaaaacttcatgcagttatcttttaccaaatgttgatttagtgaagttttttgaactagttcaagtttctgagggggtatggaaagacaagactgaaaatatggttgtctttgatgcacagtatttagggtatgaaagaaacttgttatttagagcagattatttagaagagtatttagaattaaataaactagcaattgtatgggatctctatatggaaaagatatctgaacgtagtccgaaagaagaatggttcgagggctggataaatgaaaaactgaaataagtataagttttgacgaattaagatgaaaatgaagat

SEQ ID NO: 2500 - DNA, 225 bp, Bacillus thuringiensis
ggcaaaacttctttttccagaaaaaggccacgccgcagggaggggtttattaactaaacggcagtgacaagccaaacacctataaacgctcaagttactggcgctaaaccatacggtactatcatctgaccagcatttcacccatcgaagctccctcgtgagctgtccaatcccgaccgtactatttagataccacctgtccgcctctgtaagttccgtaaggct

SEQ ID NO: 2501 - DNA, 1017 bp, Bacillus thuringiensis
tcaatacgtgtaccgttctctatatgtttcatatactttgtttcctttcaacttagtaagctacattttatttttcccctttaaaatactaatcaaaacgaatccaccatatgtaacaaagcatgaaaagccaattatgcctggtacagagacatagcctacccttatgtaatttataactgcaaaacaagcgatagacaataaaatagatggccaaaatataacagctatttttcttcgctctcgtttcgatgtactttctttctcttcagaaacacgtgtgccaaaaagcaatacaatacaaataaggatcgctgcaaagtaaattgtatctaatgacaaattgtgatcatatagggcgattccaacttcaagagcaataatcgttaaaattaaaataatgattgttaaagtctttaagtttcttttcaatcgctcactcctagcatgctttcactatattctttgtatatgtactttaaaactactgcaaaagcttcatctacctctttattttcacggcgattcggtaaatcttttcccccaatcacataaagaagcggaaattcgttaaacattcctattataccaatatttattgtagctgtgagtaatccacctgtcatatgagttatatgataatatggaatttcttcatactctccttgctgtcttaccatgccgctaataattggttcccataattctggttctgatatataaccttgaaaggtttgtatgaaaagggcaagaacttcacttaattctccaacatttttctcatctctagcattctcttgtatatgaatttttgaaaagtacgtttgtgcgtacattttcacagcatcccatccaccacagtgcattacaactgactgtgcaacgtaactatcatgacaagcaatcattacctctaccgcttgactaagtgttaaagaagttcttccttgtaaatgcggatataactgcgcactatcttcatgtggattaaattaaatgtaatgaagtatatcattc

SEQ ID NO: 2502 - DNA, 765 bp, Bacillus thuringiensis
gtgggtattttacatggatgaaatagcgacacacgcgaaggataaaattagtagcttatattcaggaatgaaggaacttaaaaagtacggttatgtaaaaaggttccctgtaaaagatgaaaaaggaaaaattattaaatgggaaacaatcgtttatgaagtgccacaagaggaaaacccatatgtagaaaatccacaaatggacattccacatgtggagaatccatatatagaaaatcaaacactactaagtactaataatttactaagtactaataaacaaaatactaatatacaaagtagtagtagcatcttctctttttacgaaaataatttcggcattttaaattcattcatagccgaaagtatttcacaatgggtaaacgatacaagcgaagaacttgtacaagcagctatggagcgtgctttgaaacagcagaagaaatggaattatgctgagggcattttaaaacagtgggttaataaaaacattcgtactttagctgatgttaatgcagcagaaatagagtttaaaaacaaaggtaaaaaaggagagaaaaacaatgcaagcgttaggaaaaacagtagcttcatcgaaaaatacgattttgagtaaatttgctcaaagttatgtgttgtctcctaatagatgtacaaatgttttcttggtcgggaaagacaaaattaaagacgtttgtaataaacgcttacttatagatacaaaaacaaatgaagagttttgtccacaatgtagatcggtagagc

SEQ ID NO: 2503 - DNA, 1091 bp, Bacillus thuringiensis
acggagcatgacgtaaagcataagatacttattcatttttatttttaaatgattttgattattgtttttttcacttcgattgtaatctatcatttctttcatagcacattcaacccaatcccaaaagtcatcaaattcttttcttcgttcaaaaccttcacaagtaaaatcatgaataaattgaactttacttcctttgtcgatttcaaaacatgcagtatcatcattatcaaatcttttagcaaaaggaatcagcttacgattaggatatcttttcttcataccagagtatatgttagtagcctgttctgattccattaaaaaccatatatcaaaattaactaaatctaatttgactaataaggtaacagtttaaatgccacctattatttacacatttctctttcccatactctttttccgtcagttaaaaacactgcacttggcggatcatcatagagagaaatttcaaccaatgaacttttttcttgttttagccaattatatacagtaccttcgtttgtattaggtcgagataaaatattatttactctaaatacagctgcatcatattctgtataatttatatcatcctcatctagtccattgtctgtttcaaaaactgtatctagttctccaataatcctcaatccacttttccattctagtatcatgtcactatgttcataatttattaatgttccaattaaagaatcgtaccccattcgcatcctcttttcttatgatttttatggtctggatggtactatatgagcgccatcaagtccataatgaatcaaccctttagtagtctcatggtattcaccagtattgcggtcataatattttcctattggctcaccaaagtctactctttctctaccgttttttaatagttcaccttttcctgcagacttatcaagcaattcttgtgctattttattatcgccatagaaaatgctcttattttttccatttgctaattcttgtttatagttcggtgtatcaggaatatgcttctcttgagctcctgctttcacttttattggataaccatttacttcacggtatggacctttaggtacagaatc

SEQ ID NO: 2504 - DNA, 728 bp, Bacillus thuringiensis
gcctttgaaacccactttactttttaattctccgttttatcctgctgcaatcatgccagttaaataatcaataactgccatcgtcactaagattttcaatgttgtatcccatcctcccaagaaatacccgcaaaagccaccgaaagtggcaataaaggtttttaataatacatcaatacgatccatcttttcatctcctcgtatgataaagttaggttttttaggaaagggatttacctataaacccgtgagtatctagttatatgagatacttatatttgtagatagagtgttgccgaccacctccttgaatctttgtattcggttgaaagaatggtacctctgtctaataagtagtttacgaatgagttggatgttgatgaccattggtcattcttcgtatctcttacgaggtagtagcgcttattagttcagaggaggacaacactatctaacactgattaaaataggggtgtaagctatgttctatttaggtattgatatcgctaaacataaacattatgcgtccattatcgaccaaactggaaaacctattactaagccatttccctttcagaatcataaagaaggcggacaagcactgttaaattgaatgtaccaatatattgagtctccgacagaaatactgattggaatggaggcaacaggacattattggttagcccgttattcttttctacttgatcatggcttctcaagcgttgtat

SEQ ID NO: 2505 - DNA, 1057 bp, Bacillus thuringiensis
tctctacttttggcataagacgtacagaatggttttttgttaaatttgtaatgatttccccaattaccatagttttaaatgtattagtaaagtatccaataggatttttcataagagtcccgttatgctcagcttcatgagttttagagaataaagcaacagaagcattggcaataatgttgttaaatacatctttgtctgatagtaaattaaatttcttagcagcctttttaacgatattcacagcattgtggaaggattcattgataacttttgaatcaaatgcagttgctaatttcattcgcatagattgtggaactcgataatcgataaaatcattatcattgacattagattgagactcgttactcttacgtatatttatatctttaatcttttgttttaaagaaataggttttgttttaatggtaggacactttgtaggactttttgtatctaccttgttggacacttcctccacaattggctgaataataatagcattagaagtttggcgcatatcttttttacgcttcattgctatttgattaatcatgcctaactccacaagtttcttcattaaacgttgtacagttttataggatacttccatcatgtcagcaattgaatttttgcataggaaactaacgcctacatatttacaactgtgacgctttaaaatatccaataatgtaataagtctagcttgtacatcggcacgtttaacagacgttctaatgacgtctttgtatgttctaacgactttgtttagttcttccacatcaataaatacggataaattgtgataggattcttcttttgctattacgtctatacgtttcgttttcattataaatcttgtctcctttttggaaacaaaaaagcaacagaatgccaaatgtaagcaaactgttgctaggagcccttacgtactgtaaaatagtgcgtgagggtacagcaggtgtttgcctatcgtgagtaggcggacggtctatacagtgtgatcgcactgaatattcacgctgtgctctttgtttataatgtgggggtctaaaaa

SEQ ID NO: 2506 - DNA, 1372 bp, Bacillus thuringiensis
ttcgtgataaaaaatgaatttgatttcgatgttccagtcatgctaagtttacatgatgaatttataaatattattaagcgatgtccgtatgaagttcattcattgttagaaggagaaagtgttcatgttgcttttttagcgaatgtactttctgaagaagagagtagtcaattgcttatatttaaaagtgaacttgaagattgctatatagatgagaaagtcgtttatttgtttttcaaaaatagcattcgaaattctaaattaatgaaccagtttcagaagttacatacaccagctacagttaaggaatttggcggacttgtgaacaatattaaaagcaattgtagagggtatgtaaatataaaaagatgaggttttctacatgtagaaaaccctcatctttttatttatattgttttgcaactacgagttcgacaataggataaataaagaaggaagagcaaattgcgatgaacagagggaggttttttactccatctaaattagcccccatagaaaatccttcagagaagattaatataaggaacattacaattacaagcacaaaatatgcaattttaaagcttttatatgtaatttgttgtcccatttcatcttgactttcttctgatacaccgtggggatctccccaagtaatgtaattaattaaattactaagtattaacgaaatagcaaaaattgtaccgcccaaaatagaaccttcagttatgtatttatatgtgccatgtactagtattgcaattaatgctaaaacaatgattataaaaatagtttttttagtattcaataaataattgccccctcgattgtaaaaaactctttacaaatataagtataaaattggaaaagtatcatgtcaaatactttttacacgaaatatgtaagtatgtaatattttagttctatgataaataaaaaattacaatacatttgaatgtaaaagaatgggctcgcatatatttggaagggatgtcagattaatttagggggtagttatgtctatacttttaaaagctggtgcagatgcaggaaacaacggtttgaagttaatggtgaaagggcaagaccctatttttattccgagtatttattctttatatataggtgagcctacaggactcttagatgaggtagatgtttcattatctgaattagaaaaccacattgatgtgactataagttctccatcgttaatgctaaataatgtacgatacatcgttggagaaaaagtcattcaagatcaattaaaaggtactgaggtagagaagaaatcaaataagtcaacggatgagttaatggttattacaatactatcaggtttggcggtaagcgctatgcgtcaaagtccaac

SEQ ID NO: 2507 - DNA, 1286 bp, Bacillus thuringiensis
tccgataggttttatagttggtgcaatattagtaaaaaagagaactgattgtttttcttattcttatctattgaaaaaaataagttttatgttggcaatttttatgatagtttcaggaatacctgttttatttaaacctattgtagtaaataatttggtatatgttactacgtattgcatgattatgttctttttaggatttatgatagcacaaattgatattcctttaatgtatttcatgcaaaatgagattcctgaagaatatagaggaagagttcttagtattggattaagcttaggtaaaataatgcagccaatagcacttgcaatatcaggactgttattaaatttcattccagcctacacgcttcccattgcaggagggattgtattttttactttgaataaaattttagcaaataagttaaatttagaaattcattcaaaagattatagtgtttaacgtaacttaaaaagcgcaggatcagcatcctgcgcttttctatcgtaattcagctgtttttctaataacaatcttatcaatatcatcttcttcatcaccaataaataacccgcgctcttttaaatacgcttcaaaatataaatctgcttctgcacgttcatcatacggttttacagataaaacgaaacctaatttgttttgttcttctaaatgagaagtggagatgtaagccggtacattgtggcgtaaaaagagttctttaaccggaataatcatatctttcattaatttcgttaacatacccatttcaaactcgaaattaaagcgatctatactacataaatcagcgaatactacaccaataaaacctgtattaaatacttcttgatattctacttcttcatcattaccgtaaaaattcttttcgattaaataatttacaaaataagcaataccatcactttgttcaaatggtttcgttgaaagaacaaagccgattttcttttgtttatgtaaatacacacatgacatgtatgctgaaatgttatgttctttaaatagagaacttgttgccccagagaggccatcaagtacgtgatgaacaatttgaagttttttacgagcgaaataataggatttcttttgtaactccaatgtatcaataaagacagagccgataaagcctgtatttgaaatgataggcgtttgcttttttcttcctctgcgctttgcttgagccattgtaaaaattatcctttaatgtacatctaaaatataaagacacctatgccacttaatttatattttactattaaaacgcttt

SEQ ID NO: 2508 - DNA, 649 bp, Bacillus thuringiensis
aaagaaactagtacgtttagcagttccatttatgttgttagtcggatgcgaggtaggaaataaagattctactcataagactgagcaaactagtaaagcaataacgaaaacagtaatttctgaacaacagtatctgtactacatatgtgagcaagtggtagagttccaatttaagaaggatgaattgttactaaacttaggagaatccttaaaggacaaagaaaaagcaaaagctgttttaaaaacatcaaacgagatagataaaattttagacaatatggaacacataaaagtacctgatacatacaaagacattcacaaatccatacaagaaggggtaacagaggcaagaaaagcaacgaagttaattaaggatgctggtaaagaagataaacagaagattcaagaagctacaatgaaaggtactgaatttttatcaggtgtagacggagagcattggaaaaaagcaatttatgagttatcacaggaaaacaaagatgcttatagtaaggcacttgataagaaagtaaaggagcactcaaagtaaaacagtaacttgtaataatacatatccacctaaaatttacgcgaatgctatgctaggaagttaggtgggagattacctgtccttaaatgtggttgattaaag

SEQ ID NO: 2509 - DNA, 1052 bp, Bacillus thuringiensis
tacttccctctagttatattttttcgatacggaacaacttcatatagatgggaggaatttttcatgcttcgttattctcttttagttttattaggagcgtgtagttatggaattttagctatttttgttaagcttgcatatgcagaaggattttcacttggagaggtaattggcagccaatatttgttcggttggattattttgcttgctattacacttctattttctagacatcgcgttcctttaaagcaagcattacttttattcgttgcaggaacatctgcaagttttaccggaattttttattatgcttcattaaaaactgtaccagcttctattgcaattattcttttattccaattcgtttgggtcggaattatcattgaagcagtcgcaacaaaaacattaccttcaagagaaaaagttatttctgttattttcttacttgtagggacatttttatcaagtggtttacttgaacaatcagtaggtgctttcgatacgactggggtcattttaggtttattatctgctgttacattcgcaacatacattttcgtaagcggaaaagttgctgttgaagtaccttcattaccgcgcggtgttctcttaatgactggtgctttaactttagtcatgattgtattcccaccaacatttatttttaatggtgccatttctcaaggtctttggaaatacggtttaggattaggaacatttagtatcgttattccatctattgcctttacaatcgggattccaaaaatcggttctggcttagcgactattcttggtgcagcggaactaccagttacaacaattatgtcagtattcgttttaaaagaggcctgtactatcttcacaaaggttcggtgtatcactttatattaaatgggattgcaatcccgcaaattgcatactcaatgcgtggaccgtatcgtaaacatcatccccataaaaagttgcagctaaagtggaactttattagttgaaccattgggcttttatggtataaacgagagggattttcatttgagaattcttcttttatt

SEQ ID NO: 2510 - DNA, 302 bp, Bacillus thuringiensis
tacgcagagagtggaccactctactgtccttcgtttttttcttggtgctggaaaccatacattcgagtctgcgtggtaaacataacctctaccgtctttgcagatccattttatcgtactaccttcatatgctcttggtcatgtgctatgaagggcagtcccagcgcatgtaacccaaacacatgtgcgacgagtttctgatgcataagcatctctaacatacacacgactcctgtagcggcttaacacagccccctctactgttagtgcgaatgtactatctcacagtgaggctgaacagc

SEQ ID NO: 2511 - DNA, 1316 bp, Bacillus thuringiensis
gttggctctgttttaagtaagccattgtttcgcccgtaatgctgttctaaattatcagcaagctttacaacctctgaataatccgctttagagctgtaaaagatgaagtgatctgtttccttctgattcttataaaaagttgattgtaaggcagtcatgttcaaataaataaatataaaagaggtcatgataatgatagttagagtcgccaatttacctatttcgtgtggaaatacaggacttccatatgttttttttattaatcgataagatgcgaaaatgataaatggcatccaaattaaaccgaaaattgtcaaagctttataggaatccccgagccagtaaaatatgaaataagacatagtagtcaacaaacaagttacggtcccaaccaagctcgatccttgcgatttccagatccacaacgacaacaagccaggtattactaaattggcgacaattaaatcaattatcaacgtgtcatcctcccagaatgttatagagttagacggatagggtgacgctccggtttttctctcttctagtagccatacttctatcaactcaaaaataatagatacgactattaatatatgcagtgtggatggaataagacctcccatgacgacaatcgcgagacttttcgacatcagtcctccttcaggggtacagccgcatgtccatcaacttaagaattttagggtggcatttctttttaatcacttacaatccattaattcaccaggacttttctcttaaatccattcttttccgtgttcgcgaatgaattgaatctctcttccttattcatcgatgcctagaaactttggcacacgttttaaacctttgttttcaaggtgttttagcaatgtatgaattttaatactatcaggttttaattctcgtcgaaccgtatcccaaaaacaatatacactggagacatttcctcctgttagtgcttcttctttttcgtactgatttctcattaaatttctgattaaaatcccccaatttagggactctatgattgtgtgaatagagatgtatttttgcccataaataaaagcagatatacaaaggtatctgctcagcaatgggaatttaattgtccacaccatgtattttaagatagacaaataaacgcatccttaagaatcaaggaccactactgtctctatccaattaaataatcatttcaagatattccgcatgtgcaatatagattcccttttctttacatctctaaattaaatattaccaaagatcactagatgaataaagaaaattaaaatatttttcattattgtatcccatgc

SEQ ID NO: 2512 - DNA, 1054 bp, Bacillus thuringiensis
agaaagaattacgaatgacgtaaaagaaatgctgtgttttcaaatggtgcttcaaattgcagagggagaaatgcagtctgatgctgtgaaaaaaggcattgtaacgattgctgagaaggcgattgtttcaatcgatacagaaaaattagcggttattattgaaaaagaattaaagacgtatttacatacaattaatacaaataacattttacaagtgcttgttgatcaattagtagtgcaagaatatgatgaaaagacacttgattacatattagtgaaggtaaaagattggacagcgcaagatgaagctcgttaccagctcggtagcttaggtatgaaggcgatggaaaatataaaagtagatggattcttgcagtttactttgaaatcatttatgaatattgtagatgaagataagattggcggcattttgcagaagtttatcattagtaatattaacagcttacaagaggctgataatagcacaagacaacttatattagcgaagattcgtcaagaaattatcaatgtaaaagaaaatgaagccttattacaggaattagaaaattggaaagaaaagtggattgcgaattggaatgctactgacaaaataaaagagatgctagagcaagtacagcaaagagcagttgcttttgtaaataatgaagaatttgctgataaatatgttattccatttttacaaaaacaaatgaataaaataaaagaagatgaacaaactgttcaaaaaatagagaagtggttacaaaagcaagttgtcacacttgtggaaaagaaccattcgaaaatcggtaagcttgtacaagaaaatcttgataagttagatgataaaacgttaatcgaaatgattgaaaataatgtcggtaaagatttacagtggatccgagtgaacggggcggtttgcggatttatgactggattagtgttagaaggaattaaagcgattatatgagcaaaaacctttccgaattgcggtaaggtttttatttttcgagaacactcatattcaattataagcttttctaatatttaactt

SEQ ID NO: 2513 - DNA, 1434 bp, Bacillus thuringiensis
aaaataaagttttgattaaaaatatcgttttaacccggtattctatggtaaataaaaagaatcccttttgaaaaagattgatcaaaatggattcttatccagcaggtttatgttttggttttataaaaaagtttgatcattttctatcaatgaaacaaattaattgactatttttattatgaagaggtcggagcaggaaattcatcaattttgatacgaagtaaactataaggtttctgtcgtaagtcttttccataatgaaatctaggctgtcgatgtaattggttcacaatgacatacaaatattgatccggaccaattgaaaaagtatccggccacaaaattctcggatcatgtgcgatagcttccattatgccatttggcaatatcttacggatactgttgttttcataatctccagcataaacagctccctttgcatcggtgatcattccatcagacgcacctttttctccccaatactccacatgataaggtaaattcatgtccggtatcgttctgtctctcaaggcttctgttgagatcgagaacaaatgccgactggttagtggagcaaaaaataatatctttccatcgggagaaatcgcaagactatcagacgccaacctaaatggagaagttgaaccgtctttgtttcgattcattaaaatttgaccttctactttcggtaaaaaatagggatcgggtgaagttgaatttgctccatttaaccgtctaaacgcgtttccatttgataaatctacgacgataatagctcctggtcctcttgaagaagaatccgttatataggcataacctgcttttccaacacgaaaatcaaaacggacatcattcagataagttgtaggcaggacaacatcttctgtaaaggtatatacttttcttattgtattggtttctaaatcaacagcgactaattttgccccccctttaataggttcagaaaaattgggtgccgctgtatctaatatccaaagcgttccccttccatcagcaactacactttggacactgatgaaagtcattgggatattctcgggattaaccaaattggtttgtaaattaggataaggctgcaatttatcctcaaaaatttccgccaccgtaaatttaacatcgtctccccatttcggaaagcaaatgaaaatacgaccggtttctgaaacagtaacacctgtaggcatagccccataaaatgcataaactagttctaaattaccgaaatatttttcactaggtaacataggtttcataatatcctcctcaagcattcaaacgggatatctcctatatatgatttatattttttctagagcatgtttctaataagtttttctataccaaaagatgattgaattggattgttttcgaaatttaataagtctgtcagaagaaaggaaacattttaattaa

SEQ ID NO: 2514 - DNA, 982 bp, Bacillus thuringiensis
aaacgattataggctggtgatacgacattaaataagaggaatctgcgcgcagcaagagtcctagctcagatttctactagagaaaaatatttagttggagttgatatgttaataaaaaacggatggatgtggaaactaaatattcatgacattaaggataaaggtcaggaaatataatttggtattctgggaataaccggaggtccgtagttaaagttgcatagaatttgtattttgtttctaatttttcaattgttgttaagtgatgtgaacctagtccacgctgtacactatgttgagaaagagtcggcccaatttgtaattttcgttttttcattgcatcgttccatggactataaaaaaatttaaaaataaaagcaggttccatgtaaatgctataaggataatgcgaaccatgtctcccgactctatagttcccgtgcgaattattgtgaattaatctaccgttaagatatagttggtttggattaggttgagttattatgccgtgataacgttgtttaacaagcggagagctatatcttggattagtgtagccataacttggttcatcaatcatcataatcattcttattgaaaacatattgccacccatagtgctaagtaatttgaaaaattgttctttattataacagcacaggaattctgtcgtattcaataccattttccatcctgtaatttctctttcaatttccataacttcttgatcaactaaataagcatcaaattcgagtgattttgagtttcgtatttcccaattaggagcgaatgttttacagatttcaactgaacgatcagtggatccacgattaataagaatgccatgatcaaatagctttgtatggtgcattaaccaccatggaagtaaatattcttcattgtaaaaatgagaaattaaagtagtcttaatcaaaatcacctccgtatttaacctgcttcttatttaatatgatatggaagg

SEQ ID NO: 2515 - DNA, 1215 bp, Bacillus thuringiensis
aactcatttattagagcacacttaattgcaatcctctttgttttactaaaaaatgatgaggattcttctcccgtattaaatgcccctttacttgcctgtctaaaagtatcaatagtcgctaaaatatgtaatatgactgcacctaaaaataataacccaacatacattaatgtaatttgatcaattgaataatttgacattcccgggattatcaacattgtaaatgtaatagtacctagctgaaacgcatataacagtaccacaagtgtttgtagtttctgaaatttaaatggcatcttaggaaacagataaataattaaaaaaattacttgaagactataaagcactaactcaaggctaacaattattttatcaaagagagtcgggtaataactccaaccaaaccttattaaccctacaataagaaaaaacattattaatgaaataaaaaacatcgttccaaacataaaccctgtagcccagtcgggacttaagcggttcttacaagtacttttaaattcatttaaatcttcttcttttatattccacatataattacaccatcttttctaaaatcatgtaataactctatttttgtagacaaactgaaagtaaataaatgtttttagtatttcatattaaactagcttttttactttttttaacaaacacaaaatacagcgatagcattagtattaagcctattccacaaaccaatacacctacatattctttctggtataaaaaaataaacatagtaacaatatagctcggtattgacaaaataatgagccacttccccagaaactctgctattttatatagaattaaaaagataaacataatcccaaccataataggtgctattacaccttcaaaaaaacctttttctttttttacggctttagaatctttattcaagatcttacattcctccctttactagttaatttatgaataatgtattcattctatcttcaatataagtttacgagtatcatttacaactttcatttcagtttttgtttcgcttttgttctttctctcttattctttttctatttgctataaattcttggcgttccttttcatgttgttcccatgtaatattcaatgatggaaatttaaagcgacaatataccaataggacgaattttgctgatactacacccaatgtatataatattattgtttgtgtcccatgattgtcctata

SEQ ID NO: 2516 - DNA, 513 bp, Bacillus thuringiensis
gtatttgttttgggtgatcatccattttagaacgattgaccaatttcacttttactaaatcaccctttttcacttgaattgggtcaatatccggaaatacctttccgttaattgtatataccatttcattttcattcatttgcgtatttaagtccatattatatgtggcagtatactcttgatttaacgtgaaactacctaattttttagcaccatatttcgtcatatctaatttcgctaattttcccttttcatctgctttatctttcatctctttgctgccatcatactcaataacagctttcattccttttgcacctttattttttgaatggtcctcaacataccacttcccaggattattagcagtaaattcaatatcataacgttcacccggtgcgattgaaattactttatcctttataacttttggatcgtttattggttgaccatctgtcgcaattacttttatatcatgaccgtgaacatgtatatcatgtgatagataaccag

SEQ ID NO: 2517 - DNA, 1053 bp, Bacillus thuringiensis
acattatgcctattcatttcgctaaaacgaatagcaacatatactcaataataaatggaagacatatttgaaaagtgcttgcacctaacgctgatctaatagaaatatttttacgctccatataaagtgctgccattgatgttaatacaatagatagaaatgaaaaaaataagactgtaccgcttaataataaggggtatgacatattatcaataccttgtttttcgttttctaacaatttattcggatttgtaacataatacgaataacccttaccttctgttacctttaatactttcttttgaagttcatttatatttatcttatcatttgtttctataattaacccattgtataaaagttctacactatagaactctatttcttctgttccaattggtaaaatcgccatgtcatctaataatgtaatacgattatccgatatttcaccacttcgaggatatgtaaatggtgaatttttttctaaaaaaccaattacttttagcttcatttttaaagatggtataacatcaccaatagataccttttctatataattagcccctaatataacaggtctaatatcaaatactgatttatgaaattccgattcctcaaaatatcttccttgtgaaattcgtatacgaaagtacttattaatatctttatcaacaataagagtctttatcgttccattttctttttttaaactaagtgaatagttacggaacagataattagttttatttgttattggtatcatattagataacccttgcatgaaatgttgataatcatttttcgctttttcttcgctaaacaaggttatatcttgcgtcgcataaagttcatagaaatttttatgagtcgataaattatttgctaccgtcatcatttttcgatatcccgaaagattactaacaaattctattgctgaagaaaatgcaataattaaagaaattactataatcaaacttggtaacaaccgtttttttcacagaccgtatagaatcaaatattaaaacatgacgaccttctacgttcttaaatgtt

SEQ ID NO: 2518 - DNA, 867 bp, Bacillus thuringiensis
caaatgggtttgtggtggtagatccaagtggtattacagtgcagtttgaaatagaagcagtgtaaaataagcgagaaagtgtataatcactttctcgcttatttgtaattattcatagctcaatccaatatcttcttactatattcccatcttcctcagtgaaatcatcatcacgaatcccgccgttatgcaaaatcgttttttcagaagcggtattcacagcgtcgcaaacgacaagtactttcgtgatgtctaactccttcgttttttctaatgataatgctagtaacttcgtagcataaccttttcttctttcagaagggcgaatgccataaccaatgtgaccgccagcgttaaataaatgtttggttaaactatgacgtatattaacagctcccacaattttattttcatctgtaacaagccaatatgtagagtctggtacccaagtttcagggatatttattccgttatgcgcatcgagaagttcttgaaccatagctgggaagttggcaggattttttgagataacccacgggatcattgtttcaccgctatctttccattcgttatagaaatctaagtattcttcttgtaaatcagtagtaggtgtgagtaatgagacgttcattgttagtaagctcctttatttatatagtttttataaaaaattacgatacaaagtgaaagcgttttctataatttctcaacctaatttcatgtaatccatctttgtttttttagaaaattagtggaggtttaaaattacaagtgatctattttatgttaatatttaaaatattaacataaaacggtcggagtattaagaatattttagcggtatccctacatgtaacaaacaggatg

SEQ ID NO: 2519 - DNA, 759 bp, Bacillus thuringiensis
ttctccatcatattctgcaacaaattcaaattgatttggtgctaaatttcgaattctattttccatagcttctacacgcatgctaggtaagaaaaccatatacggtaaaacgtcatcctgtatacatatacgatgaattgctctagcatcttgtatttctactgctctaacgttgatccccatctttctctcctccatataaataacaatatatttgtttgtgtgtaattctagaaacgtgtatgaatgaccttctcactcgtatttctttatgtcatttttacataattatttcgatataatacttaatttccaaaaagattaacaactatatggatttggttaacttttcgcctcgttatataaattaagcaaattttcaattggaataccatttagtttcatgccgactatattacaattttctatttcaatatttttcagattactattacttatagtgctgccttccaaatcacatttatcgaatacaataggttccttctcatctccgagacttgtatttttaaattgcactccacctaaagtcaccaaattaaatttactgccagaaagatttaaatctgcatatgatgaccatctaaaatttatatttctaaactttgattgacttacattacaattactcatattcatatttattatattgctaccaacaaatgaactgttttttaaattcacttgataataccctgtattcgctaaattacagttttcgtattgactatttttcatatc

SEQ ID NO: 2520 - DNA, 1270 bp, Bacillus thuringiensis
  unsure (1)...(1270): unsure at all n locations
agatgtatgtattaagaaattaaagttaaggatctgatattcatatcagatcctttttctattgttctnttaagagcgactgagccaaaatattggaatgaatatagaaataaaacagcccaaggaatagtaaaacgagtcngggagcctactcgtacgcttcattgggattatccagaaatagttgtttatgaaataagaaagaactggtcttactctcaagcaaggatttaatacgaatgaattggataaaaggtaataataaaaaacactgcgcttggcagtgttttttattatttctgcacataaatacatagtcatattgattaaagtttcactttattgaagaaaaatgcgaaagccattcataaaatatggaaatgttaaaatccctttgataaaatagcaatatgtaaaaataattatttgttaattcttaatgtaatgaatattcatgtttaaatatacgaatttaactacatagttattgtgctaaagggggagaaagatgttagatgaattgtacaatgcttttttaaatgcgtctggttttacagaaagtgcgaggaaacgagatcggtatgatgatttacatgattatttaaaagataaagaaagagagttaaagcaattcattcaagatgctgaatcagcgaagagagattatgagagtaaaagtaatggtttagaagctaataaaattccggcagttgaatttgaacaaaaacgtcatgaaaaggatgaagaattacatacattagtatcctattttaaaagtgcattaagcgatgttggatctgcaaaaagtacagcttatgcaaagtatttggaatataaagcgaaagcagaatcggagaaagcgtcagcatacgctgcagcgaccaaggcttttgaagaaaagaaaaaggaatttgaaaaacttatccattaaccatacaaagaatggagggaaccaacatgagtggtaaagaggttgaaattataggaagtaacactgcaagtgccatttcttacgcacaaaacattgaaaatggtatgaaggattctttaaaccaagcgaaagacttaaaagcatatgtcacaggtgcgaaatggaatggaaaaacgagagatgcatttttaagttatcttgatttgatcattcaatataattcagaaatggtagaggcatttgaaggacatacgaaagctttgaaagagttagataaaagcattcaaacgtacggagataaatcggaagtaagggagataaaacaactgtgatggagaa

SEQ ID NO: 2521 - DNA, 1077 bp, Bacillus thuringiensis
aatcgaaaggatttagggatgggatccacatttgctgtgcctcatgcttttagtcgcaaatgtattgatacaattggttttgattcacttctttcacctacctcaagtcaagttaaaacaattttagcaggccttcatgtgaaaaatgcccattctgtcgatgttgataagatgaatcgtgttcgaccagaaaaacacttctctcaagaaggttttctttcattagcaacgcaacaaatcattggtgatcatatagaagcaatttcttacctcatcgaacaaaaaagaaacactgaatgcttttaattgtatattcttaccaccaaataatatatgaatttattttaaatatatagcaaaataaaaaagatggttgtaaccatcttttttatttttacattagatcaaaagaaaagtagcaggcaggcttttcatttctgtatctttcttaagaagtttgaaaatagaggcttgttaatgaagatgcaacacttaaatcatcgtttagcgagattgagaaacatgcaattaatggtaaagtaataacaattgatccactagaactaattacaattgtaggacttgtcccacatgtacccccacaatccactactgcatcaattccacttccaggggtaattgtaatcttaaggcacacatcaaaacaaacattattcgtagtacatgccataactctccctcctttctcttaacaatatatgcagttacttaaattcggatacaactctcttactaaatttaataaattaggtgcttctttaatattaattggatagttaattaacgttttattaaactatctaaataagataagaaactaaaatcatcctttactgaaatagctatacatgcaatgaatggtattacattgaaattagatggacattcatcattgcaccttacaaatatttctgccccaccatttggattaactatagattctaagcaaatgttaaaacaactcttgttgatgcaagacaagatattccctcctttcttacacataatatcaatttatgagaaaataataatatcggtacaactttattcaaccct

SEQ ID NO: 2522 - DNA, 1446 bp, Bacillus thuringiensis
  unsure (1)...(1446): unsure at all n locations
tcccaattcgtgatttaataacgttgttttactttcttatttacattggtttatgggtactgcttgggtaaatgatcttgaaaatccaacagtagcacaagttatggtaggaatttttacattttacgctggagacccaaatacgaaagaaacagaagagttattacgtaatattccagaaagaattttagttatcgtaaatagtgaagagtggaaacaacgcttagaaacattccatgaaagaaaaatagataagtttttacgttataaattcaaacgaaatccagaagtttttaatcgttcaaaattacaatcttttatatcagcacttccaaaagaatatgagttaagaagaatagatgagcatatcgcaaatagccccaaattacataagatatctgaagattttacaagtcaatttcattcgatagaagattatataaaccgtggtataggttaaagcattttatataatggagaagttgtatgcggtgcatcctcctatagtatttataatgatgggattgaaattgaagttgcgactgatcacaatcatagaagagagggcttggcaactgtagttagtgcagctattatattggattgcttagaaaatggaaagtatccaaactgggacgcagcgaatactacatctgctaaactagcagaaaagttaggatatgaatttgataaggcatatgatacttattttgtagataatagatgagtgaaggagttacatactaaaaaatacatgcgccctagtacgtaagtctagggcgcatgtattagttggtaaatatcttcataacaattttatcacattttatcttttgaatgtttggaattaaagatatttatgtgactttttgaaaaaataaaagagcagttagcaaaagctaactgctcttctccaagggggaatggagaaatacaatcatgttacctatagtattgacagaacattgagttttaatcagccatttataaaaggagagataaaatatctttgattaatctttagctcccattaggagtactgatagaaaaacgattgagaatatatttttttattacatttacaatttgaagagtagaacgtgtttatcgtaattctccaaacaccaattatatttttttagaatgattggatggactgcttctttcgtagtatcgacttcagtatatccatatttcttataaaagttttctaattcctcaaaaggaagacaatatacattttgtatttgtgatttttttgcagtttctactaaaaatgaaacaagctcaccagctaattgtagccctctaaattgaggcagaataaaaattccgcccatttctaaagtatcttcatctatttggactaatcggccaacgcctgcatactcgtntgtatatgtaataattgcaactntatctctctttaaatcactncgtacaaat

SEQ ID NO: 2523 - DNA, 992 bp, Bacillus thuringiensis
tgatgatgtaaccacctataatggaaatatacttttttcttaggaggtatctaatgtatatatcaaataaaattggcttatttagctggattgcaacttgtctatactttttaattgaacctttctttattttcacttctacagcaccttataactatttgcatcatgcaatgagtgatctaggtgtaacaacctgcggagaattcacctacgaaatagctccgtatgaaatatgctcccctaatcattttgggatgaatatactctttattgttaatggaataacattttgtattggagtactatatatttcacaacatctagaaaaaacaagaattaatagaatagcaacattttttatacttataataggaatctctactatagtttcaggattaattcctgcagatgtaaacctaattggacattccattctagtttggataggcatgcttacggtatttccaggactatttatttttgctaagaatcttaaaaaaactagaaaatggacatatttctgtttactaagcttaatagtaataactatccttatctcacttgtttttcttttccccttacctgcaggtctactacaaagacttttttacttggttcttttcgtttggggaactgtatcaacctataaattgataaaataaagattttattcagacttgcacataaactgaaaatatacataaaatttaattgccgatactttttaatatatcttggtcaaagagcgctttcccatgcggtctttttttctgttcaaataaggattttgttttaaacttgcacatacactcaaaacttaaataatatatatcgctgtcacattttcgttttttcgatatgagtcttgatcaagggccgctttgctgggcgttctttttctattcttttaactcgctttctattcaagtgattattttaatgagttttcaatcaaacttcatttcaaaatacaaacgtttcaaatgtaatca

SEQ ID NO: 2524 - DNA, 1223 bp, Bacillus thuringiensis
aaattatcccttctccgtactagttactactcgttaagtataatgttcgtattgccaaaggattgagaatcgtatgtgacaattatttttcctttactaataggttcgtaaggtaattcttcttcgtaattaccattattttcattgtggatagaaagtgtaatttcatcgatttttttatttgtatactgatctttaatcgtttcagcaatttgaagtaacgcttcggaactagaagctttcgtaataagcattcccgttataactttcttttcattttttgttgcattggaataagggatgttgctttgtttcgtatacaaaattttgtatggaacagtttttctatctgcttttgaaatagtggaatattttagagttaaaaaaaatcctacacataaaataatgcataccatacgagcaatccagatgcgtatcggtgacataactctcatttttcatccctctttcatatctttgacttcattatttatcatacaaaatgaggattaagatagagtaaatttgaggtaaagaaacgtaaagaaggagcacttatcctcccaaacaagtgctcctttttattaaaagagagatttaatagacaatcaaaatcacatctattacttataaatgtgcttagtcctcccaaaatattttcggaaattgtggttagtaaattcggaagacagatagtgtcgcagttgtatcgcccgcaggtccttgagcgccttgaggtccttgagcgccttgaggcccttgagcaccagtagtccccgtagttcctccgcctaggcaaccaaatccatattgaactagaatagcttgaccaagagcttgaagaagtctaacaaattctgtaagttctgacttagggatgttaatatggttacatgctcttacttcgcaacaatcattaccataaaatacttttcctttatttttattgttcatcttttcattcttttctttcatagaatcatcagtcattactatatattaaaatgaaatttatactaaattcgtgatggacaaattaccatttctaaaaaaaataagaaattggcccacctacgaaagaaataagtaagatatagagaaaggtttatataatgtaaagaagaaaagtgcaacataaaaaactacatgctaattgttgggagtgtttaacaattggcatgtagttcgtggaattagtcctttatttacattgatttaatttt

SEQ ID NO: 2525 - DNA, 960 bp, Bacillus thuringiensis
tttccacccgttaaagctggataaacgccggttacgcgcctgtcaagctttccattgttgcagaatggtacagccgttccatgatcagagattccaaaaacatcccgattcatgaactcagatgttttcgagttcatcaccatcgctgtatgagcaatcgttccttcctttatagaatccccagcgctaatcttagaatcaaatagataacttggccgatagtaaatatattctttcgtattcgaaacagcaattgaaatttcatctgaaaataattcaccaacaacatctagtaataaacctaatgttctatcttccattctattaacacctcattcactattatactactattatgaacgagcatctgttgctttataaaaagtttgattttaaattatttttaaaattagttttattcactattacttcgttactacaaaaagcctcacttcagaaaagtgaggtttcctctcatacaatatttctttattttttaacgactatagaataagatttattttttattaagtaaagtgaatttaagaatttattgcccgtatttctgtaaaataaataatcccaaactacaaacagtttgggattatctttctcatttattatgcgcatctaaccaagaaattaaatctttaaatacttcatccttatttacttcatgaaacatttcatgtctaccattttcatataaacgtagtgtcacgtctttcacaccacattttttatagttttcatatacttcttttacacctttccccatatcgccaacaggatcacgatcaccagaaaatatatgtattggaagattctttggcgtcttcttgtattcttctagtttatttacttctaatacaccagaaaataattctcggtaaaaactcgtcgtacaaatgaaaccacataacggatccgcaatatatttatcaacttgattattatctg

SEQ ID NO: 2526 - DNA, 1253 bp, Bacillus thuringiensis
  unsure (1)...(1253): unsure at all n locations
atttgtatagcttcttgtggtagaaataacataagtaagaaaggggttgccattatggaaaagccaaaacctgtacttgcttgcagaatagaagccactaatataatacatatgaaaaagaatgtgatacccaaaacagccctcctatttaatcaagtttaactagttaaagtctattatttaagtgcaatgtttcacaaacttatttgtattttaacataaatatctagttttttctcaaatagtgttgccatataaggctctttaactaaaaaatctgacttgtatttttaaacaattttattatggggaaacaaataatgaatgggatcaaaatgtattgattatcattaaattattcactgagatccccgcgataaaacaagaacagccatataaaacttacaaaaatacagcatgtagctaataaacagccaatcatttgaggagaaagaatttctaacagccctcctgtaaaaaacatcgataactgaataagagatccgtaaatggaataatggaatgaaaaaactttacctatcatattttcgtgtgtgtaagtttgaagtaatgtcgtatcaagtggaacgatgattcctcctgctatgcgcatacagaataaagtaatgataccgataataagttgatcggatagaatgaatccgagaaagaaagttccttgtaataagtaggcccaaccgaatacttttttcattttttctttattatgggatatataaagattaacgagaaggcttcctatcataagcccagccccttgaaccgtatataaaatcccaatgttcgtatggaaaattttttcggcatagatcgttagaagtagttgataagcacctccaataatcccccatgaaatgccgacaagaattaatgttaaaatgatttttgtttgtaatatgtatgtataaccaccttttatatcagtgaaaaatgctttcttcttgttacaagtatcatgagcaggaatactcatgttataaataaaataggctgaaataaagtatgataggctatttactaaaaaagcgaactcaatatgtaaagattgtgcaattactccgcccaaagaagcccccataatagacataaaaccattaattgtactagaaagagagttagcagttacgaaatgattttggtgtacgatattttttagggttgctgtttagccggttcaaataaacangaaagtacagataaacatatattnagcatgaaaataatctcaattt

SEQ ID NO: 2527 - DNA, 838 bp, Bacillus thuringiensis
taaaattatcgctatatctttcaagtaatacctatctatcgttccttgcccccaacctaaagaaatttcacctaaataagggttggatcattataaaaaattacagattcttcgaaatccttaatccaagtgtatctttgaaaaataggtggcgactgcttttcacttgcccccgaacccaaaataataagtttttttgattgtaatttcattctaataataaactcataatttattccttgccattctacacttagtaaaaacggttcttccatattaaaataaatgccttcaagttgctcatatgaaatatttatatttctcaattgattaatcgactgaatcacctcttaaaatagaaataaatctttaaaattcctatgcttcaataaatacgaaaggccttctaaatgatcaccagtaattcttaatacagctggcggatgccctattgtcgcgaagtgctcatgtggtcgaatacgatttggtttcattacatctacataatgaacacattctactttatatccttctaatattgcttttacttgtgcaatacatgatgtgtgaagagtatcccagccaattccctctaaacattttctactaatagcatgaggaaccgctacaagagatcccactcctaaatctttacggttacaagcaatattcaacatatatttatatatatttacaatatatagagggaatctaagatttaaatttaaatcgtttaaagcaatatcaacaccgtcagtaacagcttgcgttaatggatgtaaatcttttgctggaatagcaaaatcggcatctataaagagaagtatatctcctatgg

SEQ ID NO: 2528 - DNA, 1175 bp, Bacillus thuringiensis
acgcgtactatcagatcagcattcgtgtaaaaataacgtagattatagtgtatcattctattattgttctttaaagtcaaatccagattgctacagcaatctggattttcaacaaaagctctccttatatttttgaattgctaaatattttactttgaaaatctttgtatctaaatgtataattatataaaaacaaaaatataggagctatatttatggagaaagtacttactaattataaacattacttaaaaaattggagatttatatttatttgcatactacctgctattgccttattcgttactttctatgtcatcttcgaactactgtttcatcaaaatttctacttatctaacttaatttctgctatcatattatttttaatatttattaacgttaaagataaatttaacattaaagacttaagaacactatttcaaaatagccctttattattgcatcctactataaaataagactcgtagtagattttcataaaaaataagagcaccctgcaattggatgctcttatgtgattagaggttttttctgagtattaagtaggacacgaagatcttgtcctactatataatatatgcttgtacttattatttcgtgcatgtattaagaaccatgttcaggtacttaatatatgcatagtcattgctataaaatctactcaaatatttactgtacgattatcatatttataaattaaaaaacatccctaatggatgttttttatctaacattttaagcttccataaacttagccggtacaccaattttttcaactacagaagatatattagtaggattaatcattacattttcaatacatactaatttattttctaatatcccattctctgtagtaataagttctttaaaccgatctaaagtcattgagaatttatgttcacttccaccattcatactaacttttacatacttcatagtgtcaccgcctcgtatgataaagttaggttttttaggaaagggatttacctataaacccgtgagtatctagttatatgagatacttatatttgtagatagagtgttgccgaccacctccttgaatcattgtattcggttgaaagaatgctcctctgtctaataagtagtttacgaaagagttggatgttaatgaccattggtcattcatcacg

SEQ ID NO: 2529 - DNA, 608 bp, Bacillus thuringiensis
ttcttatttcaaagtatgttcgtattagcaaccgctactgattcacttgaactatcgtttgcaaaagaggtattactactaacagatagtgaatatggttttctagttagtatagctggtgcaggatttattttaggtgccataacaaatacaattttgtcaaagaaattagcaccttcacttctaattggaataggatcattattcattgcaattggttatttaatttatgctttttcaaatgtatttttaatagctgctattggattctttattttatctttttcaatggcatatgcaaatacaggattttatacattttaccaaaataatatccctgttcatatgatgggacggattgggagtatatatggacttgttattgcgatagtaacaatctttattacaatattatctggtgttgcgactcagttcatttctatacaacttgtagttattgtaggttcattgattatgttatttattactatcgtcttgtgtgtgtttactttattcccatcacaatctaagttgtattctactgaatcaataaagtgaaactttaatcagggggcatccccccactgattatcagccctcaccaatcg

SEQ ID NO: 2530 - DNA, 975 bp, Bacillus thuringiensis
tgtcaataatagcaaatttattaagtggatgtggttttgttgagacgaatatagagtatgagagattagtaaaggcattggatgaaggtgatatgaagacggttatgtctgcgagtgatgatgggtatgcttatgtgaaagaagaggttagggatagcacgttttgggcggaaaatgataatcgcattagcgttgtatatcaaacaacaggaggagtatacaatattaaagaaaaaaagttctatggaacaactttgcaagaaattgctagttcattaaatagtgagcaaaaaaaagaagagattgtatatagaactagtattaaatatgaagataatcaatcaaaaagtccagatcaaaatttggatgtttcgaatgttcgatttatatttaatagattaaagggaatagatagtttaagacccaaaaaagataaaaaaagatttagtgagtcatccaaggtaacatattacttaaccgaatcggaatttcaagaaataattaatgataagttaaaggtggactacgataaatttgatgaagcaatattattaatggaatttagttcggcgaaagattcaaaagaaaatccaatggaattcactacaataagcatcacaatgggatatgaaaaaaagaataaagaaggccgattaataaggcatgatcaaaaaatagcaatctatttaaatagtaaagaagataacgataaagcttctaaaacccgatatgagaagtatgaaaaacaatattcgaatagcaagtaatgtataaaataaggggaaaggcgtagttatggtatgagtaaaaggttagttgaaaaaatagttattgtaatgactgtaacgtttttactaagcgcgtgcagtttcggggaaacaaaaatagagtatgagagattagtaaaggcattggatgaaggtgatatgaagacggttatgtctgcgagtgatgatgggtatgcatatgtgaaag

SEQ ID NO: 2531 - DNA, 993 bp, Bacillus thuringiensis
acgacgacttggaggtgatacatttgtctataggcatgagaatacgtcatatacgtaaagaaaagaaaataactcaaggagaattagcaagaatgcttggctttagcggttcttcagctatttcttatatcgaaaatggtcagcgtaaactaaacgccgataaaatacccaaattagctgaaagtctaggcgtaactattgaagaaatttttttgaatgaaagtcgtcaaaatgacgacaaagagggagaggatgaagaatcatgagaaattcaacagttcaaatagcattatcacttacaaagttttcagcccaaaagggatggagggatgaagaattttgggaggctattgagttacttcgcttcaataaagaagatgaaagacaaacaactgtagaaaagttagatagcattccagtcactaatgatagcgcgaacgattatccgcttatgttaaacgtaaaacacgtagaagaaatattaggagtagcgaaaagaacagcttacggcattatggatcaaaagggttttcctttagtgaaaattgggagaaagaaagtagttcccagggatgcattctttaattggatagaaaagggggtgtcagcatgatggaagatacaacatcgctagctttattcgcaatgtttatcgcatgcagtgcgtggtcgctttacattacttacgagccgataaaacgttgggcttggagtgatgtagaacaaaataaaaagacccatagcagtgggtcctttaagaaaaacaagttgttataagtataccacggaaagtagggaaatagtatatgaattcaatcgaattcaagtgctattacctaataagttttgggacttagcagatagtcaagatcaattaaagaagatgattgatcagtattttaaggttggttatccgcattatgaaattcaacgaattataaaagtgggcagcatatgtggcagtttgtacaggaggtaaataaatgcaacgtt

SEQ ID NO: 2532 - DNA, 841 bp, Bacillus thuringiensis
caaaatgctacgaatattatttttggaggtagtgcaatatgaaagacatttatgaactattaaatgatattgatatagatgaaaaagaactagaagaaattgaggcttctgaaattgaaaaggaaaaagtaaaacgaaatgtaaaacaatcgatacgtacgaagaaaaagatgacaagtaggaagaagggtgtcgctgctgcatctattttagtaggattatcggttgcaactcttggtatcggttttcctacatatgctggaggattgccaattgtaggtgacatattccgatttttagataatggtagaacggggttatatgaaaattataaggaattttcgactgagttgaatatgacaaaagagagtaatggggttaaggttacaattaatgatgtaatttctgatggcagaacattatctataacgtattcactggaaagtgagcaggacttaggggaggatcctatcatattaggtggattggatataatggacgctcatggtagttcaggcagtggtaaaatgactaaagttactgaaaaaaagtatgtaggtatggtaacaacgacgcatcatgatagcaataaaaaggacaaagtaaactttagatggaatatagagagaatagagatgccagataggaaaaaatcaatacaaggtaattggaatttcgcgttaactgtaaaatcagtggatagtaaagagagaacaattggtgggagttcggaaaaagaaggtgtaaaagcaaatatggtaaaggtcgcactatcgccagtttcatttattctttattacaatcaagaagcctctaagggcgcgaggaaagaatgggatag

SEQ ID NO: 2533 - DNA, 1252 bp, Bacillus thuringiensis
ttcacctcctcatatactagtatatgaaaatagtgaagaattagcttggacaaatactggattatttaatagagtcaacaataattattgaaaagaagaaattcacataaaagcattaagaatatatcacaataagatgatatttttcttaatgctttttgtaattaagcagaatattcttctttacgtacttcaaaaaattcattacgtcgtaagtaattataaattttctctgaaacctcttcttcttcagacactaagaaacgatgatcaaaagcgtagaaagattgacctttaattaattttacgtaatacatattaaatgcctcctgacactaaattattacttgcttcatattatgatggcctatatgtctgctaaaaatacttggagtttcaaaggggataagtaaagggataaaagagcttacaattctgtaaggtttatgtcacctttttcgatagtttgtatttaccaatttcttctataatgcaaataggttacataaaataagggggtaaaaagatggatgaaatacttggagaagttgtagctggtatttgtgaatttgtagtggaagtaacagcggatgctataggaaatttagtttctggaaatgatgaggaaaaagaaacattataataatttgtaaaagaataaagttgatcaaattataaaggctgatttctaaagggaaatcagcttttttattttttacattatattaacttaatttgaatattcatttgttatcatatttaagaagcctatataaggaggtgaataaacaaatatgtcgaattcagggcctgatttatctgtttctcgtttgattgtggtaaatatagaagaaaaagaatatcattttattgttcgtgaacatccgattgtagggaaatttatatcgctatttgaaaatgggaaagaatacggtttaatagataaacaaatcgctaataaagataaatttattacatcggagcttactaagttagattattttaatatagatgttttatatcttacacctgggtggatatggattggtatggatcaatttggtttacatgctcgtgaggctacttataacgaagtagatgttattatgaagttgaaagaggatttatattatatagatatatacgaagaaataaaaatgtagtaaatatttattcaggttaggggggaagttcccatagccttttttttgtttaataataaaatgcaaaattatattattttaatgaaagg

SEQ ID NO: 2534 - DNA, 1257 bp, Bacillus thuringiensis
agagggaaataagtcatttgtagatattaatgaggcacatccatcacttcatgacggtattaaacgttgtgcaagtgtaggaattattaatggtcgtggtgaagggatttttgatcctaactcaccaattactcgtgaagaagtatctattatgattgacaaagcattacgatataaaggaattacaggtgagttagtagcattaccatttacagataagcatttaataacatacaaagaatcggttcaacgattatacagtctaaaggtagttaatggtattggaaataatgagtttgatccccgaggtacagcaactcgtggtcaggcagctgcctttattgtgaagatgttagattcaatgcaaaaataaaatgaaactttaatcagtgagggccactcgcattgcaatcgagcagtttattcaccgaattttgaaatgagagttgtactgtccgcaaatagcagaataaatggtatgtagaagctgacattggtagaagtaaaaaataagaagaatttgaaaggagctatccaaaataataatttggaatagctcctatttagtaggaagaacaaattgtatttcatagattgtaatgtagaatgcccttccaagccccttataagcccctaccaagtaataaatcactaagaaaaaacaaaaacaaaaacaaaaacagaaacaagaacaaaacaagcgccaaaaaattgaaaccggcgttgtagtagtaaaaaaattgtaattcgaatgccaaaaccattcccgtatgcctatctttataatgaagggttaaaattttcctatttactagcaaagagtggagggaaacatatggcggtataccgtaatgtgcaggtgaacttttggcaagatgaattcatattagatttaacgccagaggagcgttatttttacatatatttgttaactggtacgaaaacaaagcaatgtggtatttacatattaccgaagcgtgtggcagagcttgaaacaggttatagtatggagactgttgagaagttgctaaacaggtttgttgagtatggaaagattttatatgatacggaaacgaaagaggtattcataataaattggttacactataaccctatttcaaagaccaatgtggtagactagcgtattacgtgagattaagactataaaaagtagtgagtacatacatatatttttacttcaatgcctagaagaatagtccaagatttcataattattgccgcatttttggcatgcca

SEQ ID NO: 2535 - DNA, 1047 bp, Bacillus thuringiensis
ctgaattttttttaagcttataaccatatttttataatggggattattgcagattctagtgatgactactacgcttcgtattggggaattgatgtaaatgaaaaagtgacatcaaatacatgaagaggtatagatagaatagtttcgaggtactatagtttgttagattgtagtctgtatagtaaatatagactttaataataaagtagcatatacataaaggaattattaaggagtgaaagtatgagaacacatatcgaaataatggtaaatattgtaaatgaatcatattcaaatgctctaggtatttctagtactcatcatacagaacatgacgttaaaagttttttgaaagagattggatcaacaatagaattgtttcttaaagaagcagtatacaaaagtagaagaaatagggaaaatttctttgagttaattgatgggttagaggagttaggtgtttcttctaagtctatacatacacttcaccaacttcggacatcctataataaagcaaagcataacccaggaactcacataacaattatggaggctataaggatattaaccgacgtaaggctggtcttatctgaaattaaggatttagatataggtgtagttaatgagcgtaaacatgaagaatatgaaagggttgtttggattactggatgggatcattttacaactagtgacactgaaatttctataatagtaccatacgaacatgatggtactatggcgtacatccccactttagactttttcaatattcactgggagggatgggataagataattgagagattctctagtacaaataaactttttatggggcaaacatatttcccatctagtacctatgaatatatttcaggaatggaagattttattgaggccggagtatataccggagattacagagatttattaatagaaatatccaaacatgtagaccctataaaggaaggggctttattgactgatttacaaaggacaagaaatatttctgcttgatttatgctggatatatgcattttggatgctatt

SEQ ID NO: 2536 - DNA, 1064 bp, Bacillus thuringiensis
cgttggtgacacctggcgcataaaggattgacgtgcgtggccgccaattagcttggttgatagctattggtcctgtggcaattttaactacaataattttcactttttctagcggacttactttcgtttatccatgggtatttgcagtagtcccagctttacttggtggggcagtcggccttattgtcttattttctgtagttaatttaattccaattactgatccacattgccgtggaagaggaacgataatatctggtgacgatatgaatgcgagtaaaatgtttataaccacgtggctcatgctgttgatggtgctagtaacaacgataccttcgttactagttatatggttggggacatcattacatatacaattcatacaatggttaggtgtaccgactggggcttgtacgggagtgtttttagcatggctatttgggcgtatcgcttacaaaaaacttgaaagaaatggccctgagttgctatttgaaatgaaaagtgggatgaaaattaacagtgataattacaaaaagaaaattcgtaataaagaaatggaattaccgaagaaaaaacttgccgttgttattcttcttgtgtttatgggaatctttttcttggtgcaccaaagtatagtgccgattgtctttgaaatatttgatgtggatgaaagagtccgtctattttttcttccgcgctaccttcctcatattgcccgcattcctgtaagtatcattttcgctgtactaggtatagtgtttttgtataaagccatattaattaagaaacagcacgtaaaagaatcacaactaataaaagatgatatgtaaaacattaccaatcggtcaagtttttagcggatgttgttcaactatagttacgtagttaaacaacattcgctttacatatttattaaagaataattattttcaagttttaacctataaagatttattatccgtacttgttcctccgctaattcttctttatcccaatacatatgcattaagctatattcaaaaatctcctttaatttaataaataatggaaacttgtctatcatc

SEQ ID NO: 2537 - DNA, 970 bp, Bacillus thuringiensis
atagttttcaaatgcatacttatagccagccttttctactgccttttttgtagacttatagcctttttcatacgctgtttcatatgccttcacgtatacttctttctctctattttcaggattcttttcagctagttctttccctgtcttttcccctaattcagcttgctctttttcaattttttctgttctttctttattccctactttgaacccgtctgcaaagtttaccttaaactctggagcaacttgactatcgtccatcgtctcttgtgctaaaccttgttcttttcctttttcaaaatgcgttttcttctgctcttctaaagaccatgcggctgcataagtcgctttaaacgcttgtttatatgcatcagattttccagctacatgcacttctgcatcattttttcctgctttaaaatcagtttctccattcttttgaccttcaagttgacctttttccatatcagcttggcgctgcgcttcctcttgcttacgtgcctcttcagcttttctttgttcctcggctacacgttgtctctcttcttcagctttacgctgtgcttctgcagcacgttgtttttcagcctcagtattgcgctgtgcttctgcttgtctctcagcttctacagcactattattattctgactaggagctgggctcgttgcgccactactagaagctggtttattgtgataatgatattccccgtactgtaatccccacttctcacaatttgtacgacacgtatgtccgccattagcatctgtacgccctggatgcgcataagctgaaattggagctaccaataacgctatactcgttgttaaaagaagtttcttcacctgttgtctcactcttgttcctcccaaaatatagaattctaactttattatacataaatagaagaatacttaaatacgaaccgaaatattctattatttctcaacattagtaaaaaagaag

SEQ ID NO: 2538 - DNA, 1167 bp, Bacillus thuringiensis
actcctctggtatatatgaatattgttcataaaaagatcggaaaggaagacaacaagtgaagacagagaaaatttttacccatccgattggcgtatttattgctgcaatagtagcaacttttttatggggaagcgcatttccttttattaaattaagttatgttgaacttggaattcaaccacaagaagttggagagcaaatattatttgccggttatcgtttctttttatctggagtcatgctcttattattctttaaagtgttaggaaaagatatgagcttcaaaaaaggaacagggaaacagttaatacaaattggtttattccaaacgtttcttcaatatatctgtttttacattggaatgagttatagttcaggaattgaaggagctatcatttcaggaacatcatcattctttcaaattttactcgcccattttttatataaagatgatgctctcaatatgagaaaattaattggggtatctattggtttttgtggcgtcattttagtaaatgtgccgagtgatggtagcttatcatttcattttgggatcggaagcttattacttcttagtgcagcatgctgtattcatatggaaacatattagcaaaagaaggtagtaaaacattagatgttggctatatgacagcataccaaatgatttttggttctataggattattatgtataggggctttacaagttggagtcatgccatttacatttagtctacatgcactacttatgctaatttatttatctttcttatctgcagctggtttttgcatttggaatacaattatgaagtataacaaggttggaaaagtatctatgtatatgttctttatacccgtatttggtgtgttattatcgagcatgattttaggtgaagcaattcattcatttgtgctactcggtttagcatgtgtagccgcgggaatcattgtggtaaataggacaccagctaagcaaaaaatggagcaagaaaaacaagtagcataaaaagctgaaaagcgattacaatggaagaacagtactgttcttcttttttcataaaataaggataatagactcagtgtaacgaggaaagatacaaaatgcatttattgatgagaaaatattatgaatctactttacttggtgtataatgggcaaatatttct

SEQ ID NO: 2539 - DNA, 866 bp, Bacillus thuringiensis
agaaaacccacaagaagttattcatatcgagggtgtccattcaatcactcaatttatggggccgatagaataatgaaagaagaaactggaaggtggattaatcctctttcagtttttttatttaaaaggctattaatgtaaatgaagctttaaaagatacgattgagttaatgttataatatagaaatgtggtaacgagaaacttggattaaatttataagaagtaattttttatgaattaaggctaacataaattcctagtattatataattgaaattaaactagcaaaaggtgcggactccgtaaccccattcgttaaaggtgtagaaatactgccagatggaagtgtcgttagaactggaacgaactatagcgggaaattccaagaagcccatgatgcctaaaaagcgagtattcagagtaggatctcgaatttggagagtggtggggttaagggtacgggtaacgctgttcatagatctgaaattgacgaagtaattaaaaataattacgataaagacggaaacttgattaatagatcaattgttcctaagggatatgatagtgttgaagatttcttaaaacaagtagatgatactaccatcaaagaatttgggtatgatagtgttgaagagtttaaagaagttgtagaactaacagaaacatatttgaatactaaaacgaaaaataatatattaaataagcctttagcaggaggaacacatgtgaaaaaaggagtagattttgatattttaggattcccaatatttaaaggggatgatgttaagttttctttaaagttagagaaagatttctatgttatgaaagatacagatcaatttaaggaatgtactaaattggtaaa

SEQ ID NO: 2540 - DNA, 1022 bp, Bacillus thuringiensis
ctggtttaaagaatttactcctcgtatcaattgtgtatggaattgaaaatattgtgaccacacaggcaacaaaagaacaaggtaaccgttgcttggtaggtgtaaaaaagtatgtaatgtgggccattattgttgcggctatcacatcaattatatatgttattaactgaaaatataaaaatgtaaaaagtccttttcatttaaagggcttttttctttgtttagagaatatttactacataagatattcaggagggatgagaatggaagaaaaagaacagttgtctagaataattgatttagctagtgagttaaggaaagtattagtgcaagaatctttttttaatcatcatcctgaactaagaggagtcattgaaaatttagcaagttctgttgaaaatttggcggaattacaaataagtaaagatgaaaacgctgaagatcgattacgttacgtacttgcgaaaatgaaaattgctcataatgcaattttacaggagaaaaaagcatttccttctcattaatataagtttttattttgaacctggcggataacgtcaggttttttatttctagtttttcgtttctttcatacactaagaatagtatgaaaaaagaaggtgactaaggtgaaattacataaagctcttcagccaagttttataaaacgaatgtactatatgagatttttagggaaatttacaaaagctgagaaagagaagagtggagagaatttctttgtacaatgcttatcgccaataccattcactttacaggaacaatttacaaatgaaccatatgtatttgaagggttatgtagcaataaaaagaatgaaaaaatcttttcggaattaaagaagaggaaattagaaaagcaactagtaatgtttcgtctttattatgaaagaggaaatgtatacgtggagttaatatgtacagaagaaccgaaagaaatagcaagcagctataaaatgatttcggcacctaaagttacaaatataaaaaaagagaatctttagaac

SEQ ID NO: 2541 - DNA, 991 bp, Bacillus thuringiensis
actaacggcctttgtatattatcacagcaaatttttgctccccatacgagtaacggtacgccaataaaatcgatatggaaccttctagaaaacagcccaccgaaagtcattggtaaaggtacggttggtgatgtattagaaaaaataatcttttcatgactttgataatgtttttgcaagatttctcctaaatgcttcatcgctggtacaacaacttttgatgcgccgcatccaatcgtatatacaggatgaccatgttcatctatgccatgaaaaataatttttcccatatcttctgttttcaatttattaaagtaatctacattcaaaatttcttctttcgttaacttgcgatccgttggtaatttatttaaatgatacgctgcagctagtgaggtagtatgtgttccaccaaaatctgtgtaaatgtatatcatattatcatcccttgttgtaaaagttcaatgttaattagtattaccgttcttagcaatgttaaacaagggatgaatgtatttacgctttttgtgttaattcattatattttttccaaatataataacgtctactaatcacagtgcctaatgtaatacataaaaaggcatttgttacaaccattaatgtctggtgcgtactacccgaaaacatactttgtttaatcataatttttgctcctaaaataacaagaaggattattgtacttacccaatttccttttcgtagtacatgacctgtttcactatctaatcgaaatgttaaagctcttccccgtataatcccaagacataagccaattccaagcattacaacaaacagtagtccttgcagcaaagttatttgtcccatatgaataatggattgaactgttacaaaacacaacaaagccggaatgagccaaatacgggttattttcactttttcggtctttactttgcattcaaacaattattagaataacaaggtaaatatccatttagaatccttctataaa

SEQ ID NO: 2542 - DNA, 749 bp, Bacillus thuringiensis
acttagctaacttctcttagatacaatggaatacattaaaagaaaacttatcttttaatgagattcaagtcccgtcattagcaattagcttcggagaaaatggaataataggaactgaagctgaatgtgtaatagagagttttaaatatattactgataaagggttaaggttaggagctaacatagtaacagcccatattgggaaaatccctgatgatgaaaatagtgagtactatgataaaatgctacgtgtttgtaatgaaataggggacttagcgttcagatttggaggattcttcgccattgagacgggatctgaaaaagcaatagtattaaaacgatttttagaaactgcaaactcgaaaggactagctgttaactttgacccagcaaatttaataagtgatgtaaatgaaaatccgggagaaggtttattactattaaaagattatatagtacaaactcatattaaagattgtaaagaagtgaaaagtgatcgttcaactaagtatatagaagtcgcagcagggaatggtgaagtagatttcgatatattcttcaaagtattagataaaattggattcgacggatataacatgattgaaagaaatgattattttgatgaactggatgggatgagtcagtcgataaattttgcaaagaagtacataccaactcaaaaggaataacgatagtatttgtagaaagctacatagaatataaaaaccattagggggaaatgtatgatc

SEQ ID NO: 2543 - DNA, 1383 bp, Bacillus thuringiensis
cgtcccaactgatgatgcacgtgttctaaaacattgtgaatattttctttaagtgttttatcatttctgtgcatagcaatatgcaaatttaaaggtatttcatatcggcgctccccgcattctaatactccatctgtcaccattacaattcggttctttccagtacgtaattcacgaatacctgatgaatagcaaggaacaggtaaatcaaatgtgtttacatttccaatccattcgtaaaaatgacgttgatttaatgcatattgtcctaacttatgtaactcttcatgaaatacatacactaaacaatcaccgatagaaagccaccatatataattttctttccttacacatagtaagcaagctgtttcacctttaatttttttgcacttttccttaaatgaagatgactgaaaaattgtaagtatatgattttcaacagactgaaacactgtattaattggttcattcaaaattacttttatattttcatattctttttcgattgtatttactactaactcaacactttccgcactattatgtccatctagaatagctgcaaattcccattcaccatttgaccaaactaatgcaccatcttcattctttttcgctccagcacttatattcccaccatatttaccaagtacaatatcaccatattgtataactgaaatttctcctaaacacatttctatatttccaacccatgaatattgtgtattattttttgtatgcatactcatttaccatatactttcgtattctttcacatagtttttttattttctcttcgtcaccatatggtgcgccagtccatttcgctatctcggttggtgaccaaaactcttttggtgtattcggataacgcggaataatgtgcatatgcatatgtggtacaccatttcctgaaacaaaagtgtaaatatgctctgcaccttcgctttcttttaacgctttacttactctacttgttataagtccgaacgctttcgcttcttcatctgttagttcagcaaggccaggtacatgtctttttatatctatcattacataacccaggtatgtttcttcactatcccagtggacatgtccaacgtaaacgagttcatcttcgtaaatagctccacctggaactataatattccctatatgtgttccgcaaatgagacagatcgggtctatgtgattggttgttgacatatacatcacgttccttttcatatataatatcacacaagaaggagaaacaggtttagtattccgaattttgattctttcgatacaacaatgtttgaaatgaatttacatatcattatgtgttcaaaacgcagtgccaactataatcccaatcacacttgcgactactaaattatttgt

SEQ ID NO: 2544 - DNA, 767 bp, Bacillus thuringiensis
tgatagtggcacaactcctactaaatttaaatgtgtgctacctattatccatattatgacctttttaaaagatttctttctacatacaacagtcttgttaactttttgtagatgtttacaattattaatactgaggattctaaaaaggataagctgaaaaatgtagttttttaagtatttgcgcatcgtaaatttggcgggtacaacttatctactctttacatatgagatagaatctactcctctattggattatagttgctatctgtcacacttaaaaaggaatgaaaatatactatcattaaaatagaaattcaaattagtttacgaaaccaactgtaactattatagttacataaaaagttgatgtcaatttcatatcctccctttttaacggacaaaagacatgacctattgaacaaaaatgtgatgtttataaaaagggcggtaaagttttatctccttactcaaagaattataaatgatttagaattagatgaaattgaagctaatattgcatctccctaaaaagaatgttactctaaaaatagaattatgaaaggaatgatggatgaataatgattaactaatttatattttaagttgaattttataacttcaaactacaaaatatagggttagtctatccatttttaaaattcagttcatactttatttgtcatgattcaaatgattaataagtacttattaagtatagacgaaagactaatccttccgattacaaattgggggatttttttattccc

SEQ ID NO: 2545 - DNA, 1479 bp, Bacillus thuringiensis
gagcgcagtagctacagctaacaaaggacaccaaataatctaaatctttttttaaaccactctaatgtaccagaaatggcagcggcgataatgccaagacaggtaaatatatcgattaataacatggccttaatcccttcctcttaaagatgttccagagaaaaaatatacactaaagtattggaaataacaattacttttcgctacatgtagaaaaacggataaaattcataaagaaagcgtttgaaaatgtttggaaaatagccataaagtaatttgaaaaagatatgaaaagattaattttacattttttgatgttgtttatttggtaaaacattacaattataggtaggttatttatatttgtataaaatgataaaaaaatatttatatactgacaaaaataaggggatggttgttagatagattttataaaaataggggagtatagctaaaggacgataatttctattactgattaatacttgtcctggctagttttagctggaaaaatagttctcgatttgaatatgagttatgttataattgctaggtgtgtttgaatgataaaaaattatgattaaaagataatgttaagattttgtatggaggtcttggaatgttagcaaatcaagctagggttagatttgagcattttttgctcttttttattattttacagcctgttttagatttattaacgtctcttagcatcactttattaaagtcaaatgctaccgttggaattttagtaagattccttattatggctgttggtggtatttacattttaattcaggcaaaagagaaggaaaatagaaagtttttaatttatcttatattgttagccggagttttaggtataggatttattaataacaaactagttaaggatcctattgtacttagtgaagaggttaaattcgttgcgaaagcattatatatatatatcatgctgggatcatacattttagctttaaaatcattgaaaaagacagttaatattagtgataaggttcgaaatagtattgtatattctacattaatcattaacgcaattatggttatttctatttcaacatctactgactttggtagttatgaatggatgaaggttggttctcgaggttggttctatgcagggaatgaactaggttcaatcttagctattattttccctattgtagtactatattctatccaaaaaacaaagagctggaaacacattctatattggattccatcacttttaatgatttattcgctaattcaagttggtacaaaagtaggaatgggctcaattggtgctacgctagcggcagcaatcgggattattttactacaattattatttgatagaaaaaattcgaacaaaaaatcccttgcacttaatgcagtaattgctattgtcctattacctggggtaatcggaacgtttaaacaaacgccattagcacaaaatatgggtattcacaataa

SEQ ID NO: 2546 - DNA, 971 bp, Bacillus thuringiensis
gcagggcagttctatttattatgacaggattagttggtttgttgctagcaattggaactattctacttttttctttttatccaacagaacaaaatatatcaaaaagcattctatatgtaacattcgccatttggacagtaggatggattataggtccgatgcttactggaggagacgaaatattacgccctgaatattttgtgttgcttccgctcaattcttataaactagctaggatgcttctcggtgtaacttttataggagtaggaccactggttagttttttagcttttataggattattaatttatgcagctagaattagcatatatgcgattatagtagcagttccagcaattattttgcagttagtttttgtagtattgttatccaaagtaatagttagtattatgggtgaggcgatgaaatcaagagtcggtatggaaatgggagcgatgttcattggtttcatcattgcatttctaaatgtcggctggtatgcacttcctgtaatcaatagaatcatatttagtgatactacgctattttacatgattccatctagttggacgatacttgctgtagagtacgctagtcaatctaattggttattagcttttattttcttaggtacaataacaatattttgtgggtttcttttatttatatggactatattattgactagacgtaaagagatagattcaaaaaaagttcaagtgaagattattaataagcattatagaaaggcttttaaaatcttttttgaaactaaaataggagctgttataactaaggaacttaaaagttggagaagagatccacaacgaggccgtttcctgcgaatgggcatatggataggtgtattttatgggattttagttacgattgctaatataccttacttaatgccttgggcggggggaattatggttgtaaaaacaggtatgtttgcttgtaatttatatggt

SEQ ID NO: 2547 - DNA, 2053 bp, Bacillus thuringiensis
caaaaacaaatcattagagagggatttgcacgagcaacccgtatttcaacatttattaatttatttataggccaaagtgtatcgcgtaaaacaattgtaaatagtgtttttagtttattagagcaaaaaggatttttgaagcgtagttggaataagataaatttaccttgtatatatgttaatttatcaattgaacgaatatcgaaatttgatttcttacctattctttcaaaaataaaaggaaaagaaattttatataaattatatgggaatacagaatggcaaacgattgattacgtattattaaatataaataaacataatgcatttttaccacaaccatcaaagagaaatgatatgggagctctttttaaacaatatgtttccgaaacattaatggaaattgtacaatatgcaaaagaacaaaatgaacaagtttacttcattgtagatgcaaatttgagaaggtattggataaaaaagttacaaaataaagaaattaatacagatattttacctgatattgttccagaggtgttaaaggttccaaatttaaatattattagaataaatacaggttttgatgtaccaagttacggtgtaatagaatgtgatgatgctctagatagcattggcttatatgcagatcaaaaagggatgtattatagcactggtgaatattcacttaattgtagtgggatttttcagcgatatatacttgaaattctaccattaggtgtaaaacctgtagaaagggattatatcgctaaaatgatacattacatgtgctgtaattctagtatgctttcgaaaaagaatgtacacatgacatattccatgcatatggaaaaggtaataaagagttatattactgacatagatgcaagagagtttaaagaatttgatgatgaattggatgtagatgtagtaaaagtagaaaagaaagattcaattattctactttaaatactagtaaacaaatcctgctcgttatatcgatcaggatttgtcattttttcatgtaaataaggatatcctttgtcaagtatcttttcgtttacatatttactttatgtgcagacaggattaatatgttttttagaaatacaaaaactatttcatatggaaaaacgatttttattaattgaaaaaatttgaaaggaatggggaattgtgaagaaattagatgtgctcttaatgctactgagcggcctctttccaattgcaggacttacaaagcaaatccctctagaacaatctatatatattggagggcttttattttttactagtttcggtagttattttgctaaaaagatgtattcacgtatatgcagttggatagcgtatgcgccatttataacattactgttagttatttggcatcaagatatttcaacaagctcaatcatagcaaatgcgaaaattgctgcatgtgtcgcgttaattccatgtttattccgttttcgtacatatggacttactttgggcttattctcattatgggccgctttactatgggatataaaagaagtacagtcgttagtcatacttgaacgcataacgagtttaatgacaagccattatgtatatatattactattaattggaggacttgtaataggaggattacttgcgatgttcattcaccgcaaagagaaagataataataaagaaaatataaatctacttggaccaaaaaagaaacgcaaaagattatcatttaagattcgtcttccaagattaccgaaattaaagatgaaactatttaagtttggtgggaaagaatctaaaagtaaaatgccagaaaaaatccatgaatataagtacgaagaaccagttgcaacgtatgaaatgacagagaaaatagatccatacaaagaaaatgcagttcaaggtcaaacaaggatggaacgccgaagaaataggtataatgcatatgaagtttaataaccccgtaatgacttatcttaatattgataaatcatttacggtttttttatgtaataaaatgaaggttgctattgcggaggggaatagcatattttataga

SEQ ID NO: 2548 - DNA, 1484 bp, Bacillus thuringiensis
gtatagaaaactatgtaaaaagtttacataataaaattatagtgatctgttaaatttctacgcaaaaaagcacttgttgcctttaattgacaatcaagtgctttcagttcatatgtttttttagtagcataaattttgtaggtcttcgcttgattttatattacatctttctataaaaaactgcagtccaattatatctaacacttgggctacacttcatatcagacattttttcatataaatgttcttagtatattatttttgtaactttaaactagcaattaactcatctaaactatccgaaatctcttcaaatgaacctcgttcaaaatcctccaattcaaccttaccacttacattatctaaaacaactatcaaaccgttcccctctacacctattggagtcttatcaaccttattatgattgtttttatacccttctaaattactttcgaaggaatccaattcaatatttggtaatacaggttctagcctaatataatgattaccaataaatccatctaaatcagcaaaccaataagaattaaaataatcatcaattgaagtgtgcagtttaatttcaaatctttcctcaatcttcgttaaatcattcttattatttttttcaataggtttccatgaaatttcttcttcatcatccatttcaccctgatatataaatgaatcaacttcttcgttatatggcgttttaaataaaaaatctaaccctttatcaaaatattcttttcttaaattaaaatatttgctcatagcatccttcattaccaaaataatcacccttacttttctaagaatttttctaatagttcagcatatttttggtcatttccccaagctcatgcgcttttctcagcattatgaatccctcctaaacctggatgtagctttgagggtacagccacagcttgacctccaccaccaatgtgatgatgtattaaagtgtcattatataattcttttaaatcatattggggaaaatgttttctaaacgttggattgtttataggtgcgaatcctaattctattttttgtctatttgacctattaaacgcttctgggtacttctctaacatctctttccaataaaaatctttatcgcgtaaccaaccctctgcattggtgtttttttgccctttaccaacatagggcatctcaacagttaagcgaggatccgcagtatatttagcctctagcttacctaaatcagcaccacgatatgttctaataggatcattaatatcacctatcttcttaaccgtttcacccgtacccttactagcaagagaagcctctacacccttaatctcatcatctataatcttattacttgctgtatgatgcttattcacccagctttgttagacgttattaaaccttagtcgccactttcaaaacttttcgattgggctgtcatatcatctatgctttttgctggtttttttccaatcttatccccttatgaa

SEQ ID NO: 2549 - DNA, 1567 bp, Bacillus thuringiensis
aaataatcaagaaaggcaaaaattatagggggaaagttgtgaagaaaaataagagtttaataagttttttaggagtgtttattatgttgttttctttttgttttcaaggaaatgtacaggcagatgtaaatactgttcaatctggaaaaatcaaatcaggaaacgtaacagtatgggaagttggaaatgtagcgaaagtattagcggatgtggagcgcttaaatttaaatacagtaaatgtaccgattcaagtagatatcccaaatgtgacttctactaacatggtaattaatcaagcgcaaaagcaacaagctattattttaattcaagaattattaaagcgtaatattcaagttatagtggaaccgttcccatatattcagcaggggaatgttggagagacagaatggaacccaagtaacattaatgatttcttctggaattggaagacggttattctgcaagatatttttaattccattacaagtaaatacaatgtgtatggactaaagattgcttctaatttcgtgaatatggagtatgcagaaggatactggagcgatacaattgattttgttcgtaatcagtataaaggaaatgttttgtatcaaatgaactggtggttaacagcaagctgggatccttcttatgaagcgaagtttaaagagaaaatcaatcgcccgtatttaaaaaagatggatattgttagcatagacagttggtttgaagtttcaggaaaaagaaatccaacatatgaagaagtgaagcaaagtttatttgcgacaacagtatataatcgtgggcaaaatgttgttcagcaattggaacaattacataatgcaacaggaaagccagtttacttcggtggatttaacgttccagcacgtgaacttggattacaaaatccatggaatccagatgtttcaaatgtgttttcgaaagatgtacaattaaatggatggcgtgcttaccgagatgtattagaaccgaaaccatattttaaaggtttttcaatttggtttattggctctaatgatagtacacatgcgtatcaaatacatagtaaagaagcagagacagttattaacgggtggtaccgaaaataatttttataaaataggtaagttttaaagtttactacatatatttttagtgaaaggcctttcaccatcttatcacctagggggcaatcataatgaaatttttgtcttaccttacagtaattttggtgattcttggcggtttgaattggttattggtagcgttagattacaatgtatttgagaaatggtttggttctatgccggcgcttgtggacactatttattggctcattggtctttctgctatttatcaaatttttgatcggttctttacgaacgactagctattattctttcattattagagtgttaagtacgattatgtacttaacacttttttatatgtccataaaaaagtctgcacttgcaagcgattccatcgcgttttgcgccataattatttaaatacaattgaccgtatattatattttaggttataattcagaagtttaaaaatttccaat

SEQ ID NO: 2550 - DNA, 2060 bp, Bacillus thuringiensis
atacgttcttgcttttttatatgtatccttactttctattagctttaatcataaattttttacgttttgattcacttattacatcaattaacacatcaaatttttgacaaatcaaaaagattgaaatccaattatgaaacacgtaatatagactctgactctaaaaaagttcgtatgaaaataatgcataaataaggaggttttatatacgagtttttcattttaaaagacggagaggttttatgttatgtggcgtaataaaaacgtttggattgttctaattggggagtttattgcaggtctaggattatggcttggtattcttggcaaccttgaatttatgcaaaaatatgtcccttctgatttcatgaaatcagttatattatttatcggactattagccggtgttctagttggacctatggctggccgtgtcatcgatcagtatgaaaagaaaaaagttcttctttacgctgggtttggtcgagttttaagtgttattttcatgttttttgctattcaatttgaaagtatcgcatttatgatcgcatttatggttgctcttcaaatttcagcagcattttatttccctgcattacaatctgtaattccactcatcgtacgtgagcatgagttattacaaatgaacggtgtacatatgaatgttggtacaattgctcgtattgcaggcacttcactaggtggaattcttttagttgtgataagtttacagtacatgtatgccttctcaatggcagcatacgccttattattcctctcgactttcttcctacaattcgaagacaaaaaatcaacaacaccaagtaaacaagctgcaaaagataatagctttatggaagtatttcgtattttaaaaggaattcctattgcttttacagcacttatattaagtatcatccctctattatttatagctgggtttaatttaatggttattaacattagcgaaatgcaacatgatcctacgattaaagggttcatatatacaattgaaggtgtcgcatttatgttaggtgccttcgtaattaaacgtctatctgatcatttcaaacctgaaaaattactatatttcttcgcagtttgtactgcttttgaaaatctgtcattgttctttagcgatataaaatggatggctcttacatcatttggtttgtttgggtttagtgttggctgcttcttccctattatgtcgacgattttccaaacgaaagtggaaaaaagttatcacggtcgcctcttctcattccgtaatatgtttgagagggttatgttccaaatcgtcttacttggcacaggtttcttcttagatacaattgggttacaatatatggttctcatctttggagtcgtttcattattgattatttctatttccctttctaagcagaaacattatgaaaaacagcattcgcaatctgcaaatttataaaataaacaaagaagtatgggtctaatattgaatccatacttctttgttttataatacgcctatttattacgtttattgaaattacctaaaggagtatcccccttttatttcgaatagattataaaaagtactctttataaaaggagtggtaaaatgtctgatggcatcgaagtatttattgtcctgctctttgcaattgctctgtttagcatcctaaactttttagccatttccttatctggacatagttttaaaaaaagaatcgtggcaggtttcatatttttactactgactcccattatctttttgactatcgcaacatttgcttctatattcgataaagcaggatttggcgcaggtacgttagcctttatgaccgcaagcgtatatatattaaatggaatagtgattctgctttcctctttatttatcctcaaaaaagacataacataggctatagtactagcatgaatctgactttacactagattcatgcttatttaatttctcctaaatttttatatgaaattaaataattctttaaaaacatttaaactttatttattataatatcccaatcgtattcgcacgtttattaaaatttaaaaga

SEQ ID NO: 2551 - DNA, 938 bp, Bacillus thuringiensis
ttcgtgataaaagtcgatgagcagagtggatatcgattttttttatgcagaccaattaaaaaaagtaaatcaaattcaaacgttaaaagctatggggtttaatattgctaccatcaaagaaataatagaatgcgataatatagataccataaaagagcaatttttaaatcgtagtgctcaaattaaagaagacatgaataacctccaaaaacaattacgtctcctcgaagactcaatgaaaacgatgagagaggatgttgttgagatgaattatcatgtttcaataaaagaaattccagaaagaactgtagctagtgttagaaagattattccatcgtataattgcgaaggtgatttatggagtgtattaatgcaagaaattcaaatggaaaatattagcattgcccaaccgagttatagtattgcggttttccatgatcgtgaatacaaagaaaatgatgtagatatagaaatacagctaagtattctaggtaagcacgaaaatacaaaagacgttacatttaaaaatatggaatcgactaatgtagcttctataacagttaatggaagttatgaacagatgacagctgtaaatgaggctgcggcaaaatggattgagacagagggttacaaattagcaggcccgatgtttaatatttatcatgtgagcccagcgatggaatccgatcctaataagtgggttaccagaagtttgttatccagttaaatgaagataaagaaaaaaggcattatttatatgccttttttctttataaacttatccataaatatcaagataaattacttcttgatttgattcgtcaactactagcacaattttatttgcaaatgtacaaaatgagcggattataatggattcctttaatgaatcttctaaaaaccaacctgttgtaataaagaaatgcaccatttttgga

SEQ ID NO: 2552 - DNA, 821 bp, Bacillus thuringiensis
agctggatagcacctgccttacaagcagggggaccggggttcgatcccgacatcctccaccacatatgtcggaggggtagcgaagtgactaaacaccgaggactgtaaatccgctccttcgggatcggcagttcgaatctgcccccctacaccaatattaattaatgggctatagccaaacaaggaggtagaccactatgacctactcatgcgctggatagaattcagatagcccagacattaagagccggtagctccaaaggaccatcataggacttttaatcagagggtcgatggttcgagtccttcatggctcaccattttaattaatatgcgggtgtggcggaattggcagacgcactagacttaggatctagcgcctttggcgtgggggttcgactcccttcacccgcacttttaataaaataactcaaacatgtcttgcggaagtagttcagtggtagaatacaaccttgccaaggttggggtcgcgggttcgaatcccgtcttccgctccaattttcaatatgacatgccggggtggcggaacaggcagacgcacaggacttaaaatcctgcggtgggtgaccaccgtgcgggttcgacccccgccctcggcaccatatgcgcccgtagctcaattggatagagcgtttgactacggatcaagaggttaggggttcgactcctctcgggcgcgttttctttcgggaagtggctcagcttggtagagcacctggtttgggaccagggggtcgcaggttcaaatcctgtcttcccgatacttgtttggggcctaagcttagcttgggagagcgcct

SEQ ID NO: 2553 - DNA, 1977 bp, Bacillus thuringiensis
ctgaaaaagtacattatgagagatggaaacaaatatataataatttcacagtaaacctcgaaaaggtatctgaagaagataggcgggatttaacttatggactatataaaacaaatacaatgctctcaaaaatgttaaataacgactaaatatattgtttattactaaacggaggatgtttcatggctaaagaattagatttacaatccgtgcaaggtacgatgcttattcccttatggggaagagcatatggcagtgagaaaaataaggatattttagatgatatagaggctattcgaattattaaagaatgtaattttgacttctcaacaatagcaaatatatttggcgaatacggatgtatcacatacattacccgtgcacgaaaaattgacgatacgataaatcaatttataataaaacacccgaatgctactattgtaaacatcggttccggactagacactactttttcaagaatcgataacggtacaatacattggtacaaccttgatttgcccgatgcaatctcttttcgcaaacctttaattgaagatacgcctagaaatattagcattgctaaatcactatttgatacttcttggtttgacgatataaaatataatgcaaacggcggtattctttttatatcggcaggtgtgttttataactttaaagaagaagatttgaaaaagatcgtagtcgctatgtcaaaacgtttccctgtaggagaattatctattgacgctgaatcaaagttcgcactgaatctttcgaatgctactgtaaagaaatccggtaataatggtgctatgatgtatttttacgtaaacaatccaaaattaatagaaaaatggtcctctacaataaaagtattaagctgctcccctttctttaaagatatacctacaaataaagattgggacggtagtacgcgtataatgatgagaattgtaaacttaataaaaatgttgaagtttgttcatttacggttcaaaaaataataagtaaagaagagctcaatacatttatacttaggttataaatgttaatttcaataaaatcaaaggcagaaacataattgtgaagtgaaaatttaatcagtgggggctttgctcatcccccactgattattagccctcaccaatcgagcttttacggcagcccgaaccccacctaacttctttgctttcgctgaattttgaggtaggggtcttactgcccgacaaatagcgggataaaatcttgcatgcactttacgtaggagctaaaatgttgaatctcaccgatttccaaatcatgtacaccatttttgcaacattaactgattcatttatcctctttcctcatcgctcacttattactatctaaatgtataagttctgaccattcacacttttcccctttatatcctttagacactatcctcatttatatgaatagctttcttattcaaaaatagatttttaaaaattcctactcccacaattaataaacctataccaactaatttatttatttgtaatggaatgctctccattccaaataatccaaatgtatcaatgcataacgcaacaaccaattgagtaataagactaattagcaccgtatatgctggacctagactctttattgcacccattatacaaataattaacccgataccaaacagtccacttacataaaacaaataatttgcagtatacactttaatgctaatactgttttctgtaatgatataaaatagaatagagctaatgagacctatcccaaggacacatgtagttattaaccactgtcctacattttcatttacttttgcattaaaaacagattgtacgctaattaatattcctgctaatatagctaaactaaatccaatcaaaatcttcctctccctttcattgctcatatatattatctttagcgacttcctttcatctagaaaaatctttaattacaataactccattactc

SEQ ID NO: 2554 - DNA, 1339 bp, Bacillus thuringiensis
cgtgatcctttcaaagaatacaaaaatccgcccctatataatttggacggatttttttccgcggtaccaccgaaattgtcatactgaccatcttagccctgataacggtaggtaccgtttgcttttactaataatcacgttcaaagcaacactcacaggtgtctttccatcatgcggtatcgcaacctttccagcaactggctgctctctgtagacctttgcaccatgtacttttcctgatcatcactttttatatttacagagtattctaactccttatcttataaaacgcaagctttttttgaaacattctggttttataactcctaacttcttctaaagtgtgaaaagttaattttgtaatacatattcttatgtattacatccaaaattacacctttaatattttccaatttttacataaaaactaattcatttacgcatattaataaaaattttaaagcgaggtgtgtatatgcaaaaagcaattagtttctttctccttttgttttgcttaattgtagtaaacgaaacgtatgcctattcaccaaaatctttaccaatctctcaaaactctgatcaatggcaagtgaatattgataaaccgaaaaaaacaaacaagaatatgcttcaagctaaaaaagatgaatttcaaacatatcatttttcagtaaagaatgtcgggaatagtgaagtatataatgtaaacgtcgaagtattccgcaacgaaccaaataagaaaacgaaatatgaactcttttccctaaaggaaagtcgtttggcaagtggaaaaactggatttgaacacgctaatttacccgttgctacaaaagcagatgaagttgatgttattattacatggcaagaacacccattccgatcgatgcgaaatggtcaaaaagttgaatctagaaaatttaaagagcattttgtttttaaagaagctaaaaagtaaatgggatacggatatattcacactatcattgatatagctttatttactagtaccagttcttaagcaaattaaaaagtcgtggcttataatgaagtgcaccccaattgttagacacagtctaacaattggaggtgcattttttatggctaaattttcttcaaaagaaaaaatccaagcggtgaaacgatatttagatggtacagaaagtggaaaaacaattgctaaatctataggagttaaccctagcgtacttcgtgagtggattagacgatatgagtcttcaggtgaaaaggcctttgaaaagtgctatacattctacccagcccagtataaactagatgtactttattatatgaatgaacacgggacatctatcagagaaac

SEQ ID NO: 2555 - DNA, 1206 bp, Bacillus thuringiensis
ggttcctgggctttttttatttatataattcattttaaagaatgtactgggggcaaaaaataatagggctggtgtgtgtatagaaatggataagtgtaagtaaaataataaaacctctgtaggtccgtagtacattcatcttattagtaattaataattattagcccttctttctttaaaattgttcattgttcttttatctacataagaagaaactttttcacttctaacgctgaaaaataccactttccatctattttaaatttcgggaaacgttcatcattaaaagcaattttctctgatggaatttccactcatacatgtttgtctacacaattctttcatatcccaaaacatttttctatgttcaatatgatctagccgttttcgtaactcttctaagaaaagttcttcaatcttttgttcatctattttaatatcaagaatgttgttattcaccttctttcatactttcattttgcttatttcgttgttctactttcctttttataattagctcccgtacagctggtattaacggtgttaaaaatttcttccgctgttcctttgtaaggattactttcaccacatactcatattcatcacgaataatttgttcttcactcatcctctatcacatcttttctttttattccctttgtaagtgagtatcgtacacaattttccatcttccagaaaaacctttctgtcataatccgccagaatttcctcacgatttattctttctactttttcaccaacttcccaatatccagcacgaagcagaaactcagaatccccttctggaatcggtaattcataccatctaaagttattctagttacttcaataccttctctaataatcatttcatcaccctttcattatgaatatggataagttcgctttgagttttattaatacccttacaaaaataatcagttacgtaaacaacttctttgataaagagtttatgaaagcataaaaaagcccccaaacgctaaggaatttataaaggaattttttaaaagtatacggagtgggattctccacaaccgtaatacatgttttcatattgttaaaaccctcttaaggatgaaatatctatatatcttatttatgtaacttatgttatagtttcatatgttaattaattacaattctttttaaaaggagtataccccatgaaaggcaagaaacttatat

SEQ ID NO: 2556 - DNA, 1577 bp, Bacillus thuringiensis
taaatggttagattattggttgtacggaattgaaaatggttttatgaatgaaccaatggttgatgtgcaacgagaaaataaaacgtggcaaaagataaaaaattggccagatccagcggctgtaccttcaaaaatccgtatgtatttaagtaataaatcagtcaatttaccattaagtatgggagcggctaataaagttttctcattcttagatgatgcacaaatgaaatcaaaccaattagtagcaaacccagaattagaagtagcaaatcgattagtatatacaatgcctgtactgcaaaaagatacgcgtataagtggtacaccaaagatttcaattacaggaaatattgatcgatctgtatcaaatttaacagcattacttgttgactatggaggagcgaagccggaaatcgtaacgagaggctggatggatccacaaaacttaaagagtatagaaaattcaacagcgattcaaccgggcaaagattatacatttacatgggacatgcagccagatgattatgtatttaaagcggggcatcaaatcggagttgttttaattgcaagtgattatgattatacaattaggccgaaagctggcacgaaacttacagtgaaattaagtgaagtgacattgccgattgtgaaataaatattttttctaaagagcttactaaagtaagctctttaatttgtagtctgaatttttaatttttatatttcaaattggaaggttatgtaatacaatatcattatattctatggaaagtgagtgatatattatgacagtcagctctttcgaaatatcattaaaatcagaggtgcaggaagattagttgaattgaaatcttccgtacgtaaaaacggaggagaaaataaatgtttagcttttatagtacactttgtacagaactgtatgattacacaaaaccagtcggttattctttaaatggtgatattgagtattacaaaaaacggttaaaagattgtagaggaagaatcctcgaagccgcagtaggttcaggacgtgtcatcattccgcttctagaggctggttttaaagtggatgggatagattattcacctgaaatgctagattcttgccgtaagcgctgtaaagagagaggcttacatcctaatttatatgaaggaagcttgcaacaattttcacttccgcataaatatgacgcaattatcattcctactggatctttttgtttaattgaaaatcgtgtggattctataaatgcattgaaatgtttttatgaacatcttaatccagatggacgattaatcgtagatattatgcttccgtatgactggaagactggggaaattcatacatcgactttctctttgccgagtggagacggaatcacattagaaaataaatcaattgaaatagattggctgaaccaagttactgtatcatatttgaaatatgaaaagtggagtaaaggacagttagtgcaaacagaactacaacgctttgcgctgcgctggtatggaatagaagagtttaaacttcttttagaaaaaaaaggtttctctaatattacgtgctctgctgaaaa

SEQ ID NO: 2557 - DNA, 1046 bp, Bacillus thuringiensis
gtagccttcgttatattaacatggaatatatcaaattacatagtgaaattttagaaaaattttattagtacattttatctgaaatagaaatgctatttatttgagtattttggtacttactcgtataaaactttgttagaaaaagactttaaaatttacatgttttttatgaagtgtaatattgtagctttatctatggggctttctcaataactattaaggcgaaaagttaaaatatataggtttatagatatgaattattacataaaaacgcacttaaaaaaggatgtatgatggtaatagaatacaaacatcaagggggaacttaaaatgaagttaaataaactagtgcttagttgtggagtagtttcagcattaacacttggtgtgttagggaataatacttatgctgaagaagtacacaaaacgaatgatccaattcatgtagttgaacatgtttctgcagacttattattaacccaaacaatgaattatagtggcgaggctgaaacttctttcgtatatgatgggagtactgacttaagcttctctatgaaaaataatggtcaaaatacaatgggatatagtgtaaaaggtccaaatacagagctaattgttggtggttatataaaacctggagaacaacaaattaatgttacaaatgtacggaatgctttatctccattaccgaatggaacatataaaatttacgtttcaaatgatgatggttctaaggggcaattccaagtttcagtaagatctgtgaattaaatttaaaacgctttgtttttaagttaatttaatctttgcttattggaaagaagctaaaatgaattgagaattaccgataaaaatgaaaacgagcaccttatctaattgtgagagggtgttcgttttttgctattaaacagaaaataattataaatatattttgatattcccattgctaacctactagattgtgtcaacgagagaatgtctactataaaagatcttaaactaacgatgatgcatcatcccgctcattattatggggaaatagaaaa

SEQ ID NO: 2558 - DNA, 922 bp, Bacillus thuringiensis
aggtttactttacatttcaattcaaaagcccaatttcttctagtcattttcatctaaaacaaaatcatttaatagttcataatggtctttcaatattgcacaccctccaaaattaatattcgtagcattttggtgtagtttctttttcccccggtacactcgattatcaattgctgcccgagttattcctaacttgtcacctatttcctctgtcttcataccaagtaaatatttcataatgaacaccttttgatctagcggttctaattgattaatgagcttcaataattcttccctatcttccataacgattaattcgtcttctgctgatttttctgtactgatatgaaactcatctgaaatgatttctactgttttagtcgatttccggtaataatcaattgctttaaacttcgcaatcgctgcaatccactttttaaaatcactcggctctccatggaatttatttgcgttattccaaatggaaagaaatatatcgtttatacattcctctatgagtccatcattttgaatgggaagtagaactttatgcgtgatcccctttatgagtggtaagtatgtatcgacaacgaattctaacgcgtcttctttttgccgctgtaatctttttataaaatttttctcatttgatttcatgtagcgattccccttattgttttgtaaaagcttttacaccctatataacgtctgagaaaattttttctctcatcttttttattttttgtatgtaatggaatactttcccttagccattttctcacataactatgcattcaaagaaaactttctcaagtctgtaatttaattcatgtagtacactatttatatagtcactctttaatttagtgtacattttatttcattaatctattttaaaaattaagaaatgagatgtgtatgt

SEQ ID NO: 2559 - DNA, 1884 bp, Bacillus thuringiensis
gctaatgaccccaatataggtgaattagttaaattatgtagccttatttctccatcggttgctaaatcacctatttggctcggttgggttccaacgtatacaatgaaaatttcatgcgtgtttctatcctctaaagcatatgccccaaatccagttactgaattgaatatcatcagaagctataagattagcattaaagttgtcttgtaacttctgtttatttattattggatcagaattattatattttttttcttgggcattataatcataaatatcttttgccgataatcttaattttcctacatcactacttaatttataatctttctcattcaccatattctcccccttatatattaatggctttctttaaatttcttttcatattgtaagtaatctttttttgatttccgattattttcttctttattatgtaaatatgttgttatttcttgatcatgcctaatcatattattttcttcatttctttgtttatagcctatcgaaattgttatctctgttatttccatcggattttcctttgtatccttagcagaattaaattcaattagtagtgttgcataactaaacttctcatactctaatcctaaattcccattaaatatctctttaaattgaatttctgataaattatagcttatcgtagctggttggctgaagctttttttattcacatttggtttcaattcttttattccttgcactctattaagcattaattttatattagacatatctttccctcgatttgaagcttctagctgtccattttcgtatcttatatctgacttgaatacaacttcttctttatattgtgggttgtcactatgtttttcatcctcaactggagtattgactttcttttgtgcctcaccaaaaagaatattatctttaatactataaataccttgcgttgtttgataaactactcctatttgcttattattatcctcaataaaagtgctatccctaacctcttctttcacataagcatacccatcatcacttgcagacataacagtcttcatgtccccttcatccaatgcctttactaatctctcatactctatctttgtctccccaaaaccacatccacttaataaacttgccactattgacacgactatcatcaccttagctttcttctttaatttcatactgtcacctcgttagttactctaggcatttttagtttcattatgttccctttttgatagtaatacacttcatctttacctaatggcgcttcgttgcttatatattttatgttgaagatactttgatcatttaatggcattgcgataattgctgctgttagcttacttctcattttcataggtagagcttcacgatttcggtccatgtagtcgtggtgacctgctaatacaaagtaaatgcctactgtacgagatagatcaattaaagttgctgcatcctccatttctaaataaacaaatttactaaactcttcaacatttgtcatgataatgagttgttttgtgaatgcaggaatttctctaccttcttgtcttgcttgcgctaattcaagagctcgttcgcgaattacttccatccaatacttcgcatgcatattgatttcattttcgtctacaatgtagtgcgtcacattatctttatattgaacgaaactatactctgctgtatccactaacgtcacactttcaaaataatctttattcaattgagataggatgctagatacaatttgttttctcatactatcatctacactataaatcattaaatgatcattccctgcaatatcatgagctacaacttctacgtttgcaaaatcaagccccattggaattcttgctgcttgtaggggctttgtaacct

SEQ ID NO: 2560 - DNA, 1996 bp, Bacillus thuringiensis
aggcctgccctcctctctagcaaaacacaaggaaagatgagtgaagtgggctacactatacgcagtaactatccctattttgatatattttcataacgattatgggtttgatgatttatttatgtatgtagtagggacctttttaatgtatacgatagcaatcggtgcagctgaatttcagctattagcatattgcagatttaaatttccatcatttaataaaacgtgggagcaacataaaagagagactccaagatatcgaaagaaaaataaaaaaggtaaatcgaaacgtaaggcataaagaaagtgcgtattgtacgttttgatgatagaaaagtaattatttacaggagagtattttaacttctaaaagaaaatttaattatgtaaggtgattaaagtgattagaaggttatctgatcgaaaatgtagagtgggtagtgtgatgatgaaatgaacacaaaaaaggtttctaaaatgattactatcataataacaatcagcctactacaagcatgtagtttttttgaaaaaaagatagaatatgagccatttgtcaaagatttggatgaaggtgacatgaaaaaggttatgtctgcgagtgatgatggatatgcgtatgtggaacaaagaggtatatatagtacatatgagcaaaaggaagatggagagcatagaaaaacaatctatcaaacttcggaagggatatataatacgaaagataaaagtttatatggaaatacaacacaagaggttacttcagcagtagacagcaaagataataaagaagaagttgtttatcgtaccaatattatgtataaaaatggacaggtacaaagtccggaatcaaatctggatgtttcatatgtgaacttaattgtagatcgtttaaaagggatagggaaactaaagatgaagcccggggatgatataaaaaagtttgatcagcctagtactgttggatacaaactaactgaattagagtttcagagtatcattaatgataagttgaaaatacaatatgatgaatatgatggtggatcaatcgcattgcatattgattctaaaaatggttcaaagcagatattggaagtaagtattgtaataaattataagaaaagaaatgatgaaggcaagttagtaaaatacatatcacaaatacatacatcttttgatagtcaccaaggtaataaccaagatgcgaaacaggaatatattgattttaaagcaaagtataataagacgcagtaatatttagaagggcatttgtacggaaagataatagcgacataagtggaataaatgtttcataaatatagtgggaagaatttgaggataaacgccccaattgttggagtagatgcaacaattggggcgtttatctatctaaatttagcttgaatacataacatgttttagttagagtcattgctccgcaagtagcttctttatcttcataataacagtatgaaattgtgtataatctgcttttattgttaagttataactatttctgcttataaagtaccccttattatcgatacatcgtccacatcccaatgtctttaaatcctagtcgtttataaattcgtccagcagctggattgttataaaataaacaaagtgttcggccttctttcgtaaagtcttgaatcattttttgtaatatgagtgaagcgtagccatttccacgataattcgggtgtgtacatacaccaactaccatagcggataatgaattttcagcggaagtagaggtggatgcgatgatcacgccgtctttttcaatatagtatgtgcgtcctgtattcgtttcgatagcctgccttaatattttctctgattcattagtagtcggaaattcagcaatgtcacttcgtaatttcataattcgttctatatcatcgagtgacgcaagtttaatcgtttcatgaataggcgtgtcaggtaagttgttgtcatttagacattcactaaaatacatttcatttttgac

SEQ ID NO: 2561 - DNA, 1529 bp, Bacillus thuringiensis
tgataatgccaatagatcgttcgtatatagcattctatgccctccaataataatagtactaatcgttcagacggttttaatgcctcatcactttctagtataaagtctatatttttcatttctctaattattactccttatatcaaaaaatactttagacgcttatttaatataaaaataatacataacaaaattataaatatattaaaatagcaccatctaaaaacactattatactataacatagaagtagtgtttccccaaataggaaatgcttttttatatcgcttataagattcttgcaaacctacataatattttgtaccattacccaccaagttttcttctaatttcgctgctcatcctgatgtatttgtaatcaatgaagttcttctaaatttataaacaaataaaaaacggttcgtctatcatgccctaaacatgaatgacaaccgttttccagcttcttcttaattaacatgttctatcttaaatatttcttgcaatatgcggcttactgtaatgacttgttccaccgccaccaactactactttaccgcctttttcgaaaattaataatttacttgaaccatctgcaagaagcactattacttcagcattattacttgttgctacataaattacataaccactctttgatatacaagtttcccaattcgaatcaaattctgatcttactacacgatttgaatacacttgattttcaattctatcttgttctacgttttccaaattgattcctcccacttcactaaaatagcatttataggaaaataacagccctatataaaatagtagccgactttaacataaatagtatatgtaattagtaggagaatgcttggacaacgaaaacgaaatagacttcaaaaatttcacaattgaaacttctctttaatcatttccgctacttcttttgcactcaaatacgtgttattaatttttatatactcttctttttcaatttcaccatgaagagagtttaatctatgctttttcatcgtttctttcaaattattttcagaccactcaatatctctttttttcggtttatgttctaatctattcgggcttttatttcgttctaatctttcatctaattccgcttccagctctacaaaatgcactgtcccaccttttgattcaaaaatactttctacatgatgtatataatcccaatccgcttggaggtcaaatgcccatatatacgtaaaaatcattccagataaatcacttttagatacttcttcaaatatttcattacgaaataaacttactagtctttttgcttctttcgtactgtaatcaaaaattggacttactaaatcaattgtcatgtggttatgaaaaaagttttaaaccggttaatgttgctaattcttgccccactgtcatttttccaactgcttgtgggccaaatattaatataagttttcatttatttccctccaatctttctctataaaccattacataaaataaaaaataaggcagccgattttaaatcg

SEQ ID NO: 2562 - DNA, 1632 bp, Bacillus thuringiensis
  unsure (1)...(1632): unsure at all n locations
gtctcttcaggcatctaaaatgattgataatcaaattagtttatacattgaaaggtaagcaagaaggggtagattattggttaacggattttaatgcaaaaggtcaaagagagatatcattttccggttattttgaaaatccaaaactctattattttcttcaagattatttaaattggatagataaagagattgcgaattactatctattcttaggtagtatgtcgtcagatattaatcagaaagccgatagtcaaatttatgacttgcaacttgcgcataatgtaaatagaagcgggattgattataattcagaaaaatttcagcctgtccctaatatgaaatttacattggatcaagttaaaataatcgagttgttaatgggggtgggtctatataaggaccaatacttatgtttaagagaactatatcaaaatgcattagatgcatgccgctgtgcattggcaaataaggatattactgaaggtagaatcgaatttggaattaatgaaggtagagatggacgtaagtacttatattgcatggataacggtattggaatgacaaaagacattattgagaggtactttttaaaaataggaaattctttttacaagtcaaatgaatttcaacaaaaacaggctttatggaatactgattttaagcctacttctcaatttggaatcggtattttatcttgctttatgttaggaaatgagattgaggtttgtacaaaatcatcatattctaaacaggatgagtatataagttttatgataaacggtccccatgaattattctattatagatatatggaagatgcggatagagaagttataggaagtaatggaacgttaataaaaatttatcttcaagatgatcttgtattaaataacaagtatattgaaaatattgaagaaactatgtttctggctcagttagacaaagagaaatatagaaaggatatttctgataatctttattataagatatatgagatggtagctagtcctaacaagttaattcctatatatattaaatttgataataatgcaactgaaaaattaatgggaaataatcatcctgttgatttaagaaaaatagattttgaaaaggtaagtaaagctatttacgatggcagatataataaaggttatcttgaaaaattggttaaacttcaacaaatatacgaaaatgttaattttattaatgtagaagtggagtcaaagtatataaaatttgaaattccgctggcgttgccttcgcaaaatatccaagaaaatatatctgatttgttaaatgtttatcctgttttaagtagaagtacaggtataatggttgatggaatagtagttagtgataccaaaataatagagaatataagtaattatcgttatagtagggaatataataattcgagttcgatttatatagacttttttggggataaacgtcctttattatctgtagacagaaatgcaattaccacaatttcagatgagttagtgaaggatattcaaagccttgaaggaagagttgcaaaagatttgttagataaaattgatgaatantttgatactcataaaatggaaaatactcaaaaggataatattttaaattatgctttttcta

SEQ ID NO: 2563 - DNA, 1739 bp, Bacillus thuringiensis
ttagagtttgaattttagcaaaataccttacattttagcagaaaggacatttcttgtaatactcggaatgtcctttttgttgacgagcttattcaaattaaaaatgaacagagtatattatcaatatacagcaatgcatatcattttcgttatggtggaattaaaaacctaagcccgagtgacatggcccccacctattcattacttttcctactaactaaagaataatcccagaaaaactccccttcataacttccttttcaagttgattcctacatataaacatcgcagtaatatttgtacgatttttttcatcgggttcaaattgttctatggttaagtcacaacgaattgtgtcaccactaaacacaggacgtaaaaattcaaaatccatcttgcgagctagtacgttataatcaccgccaatttttgtaggtagtgttgatgttaaaagcccttgtacaacaaatctcccctgctcatctggtgtaacatgatgaacaccttcatctttcgatacttccgtaaataacgcaacatcttcttttgtaaacgttctttcaaaggtaattttttcgcctacttgcaatttcatcgatccccctcctcaaaaacacttgtaaaataagaaaaaccgaaactcaaatcatttcggtttttcaaaactatagaagtcaatatttactttaaagaatgaacaaacaacccactacgcagtttcggttcaaaccacgttgatttcggcggcatgacttctccggcatctgcgattgctaataaatcttccatagatgtcggatataatgcgaatgctgctttgtattcgccgctgttcacaaggcgttctagttcttctagcccccgtattccgccaacaaaatcaatgcgtgaatcagaacgcggatcatgtatttcaagtacttggcttaataaatgatcttgcaggatagatacatctaaacctctaacaagatcattcgcatcaaatgtttcttctttcacagtaagcttataccacttctcatttacatacattccaaatgcttttggttcatttggtttatacggagaaacaggtgcttcttctacatagaagtattgcttgatttgttttaaaaactgttcttctgataaaccgtttaaatctttcacaactcggttatagtcccaaatcgataattcatcatgagggaatagaaccgataagaagaaataaaattcctcttctactgtgtagagttggatattgttctcttctcataagtcctacttttgcagctgatgcagaacggtgatgcccatctgcaatataaagattaggaatatcttcaaatgcgtttactaaagtcgtaattacatcttcatctgcaatcttccacgcaacatgcttaacaccgtcttctgctgtaaatgtataaattggcgcatgctcttctttccagcttctaattaaatgctttacttcatcttttgtacggtaagttaaaaatatcggacctgtatttgcgtcacacacatctacgtggcgaatacgatctagttctttttcatgacgtgttctttcatgttttttaattgtatcatcttcatactcatcaatagatgtacaaacgacaaggcctgactgcgttcttccttgcatcgtcagttcataaatatatagcgctggctcttcatcttgtatgaacacttcttctcgtataaattgctttaaattgtcgcccgctttttcatacacg

SEQ ID NO: 2564 - DNA, 1251 bp, Bacillus thuringiensis
tcagctgatttgttgttagcaattcatacaacattagaacagcatgtatggatgctaagtgcattcttaaaataacgataaatatatagaaacccattgaaaaattatttcaatgggtttttttatgatttttcagttttcttttatgctataatatagtaaaaaggaggcgatgcgatgtttcgctttttcagaactggaaaagaagagcgggaaattacgaaagatgaattagaacaagcgatggctcagtttttagaaacgaatgctaatatcgtttatacagtattagtaaatgatgattatacagtaaattatgatttgttaaaaccatatttacctgcatttccaacaaatgtttttctcataacgaaggaaacgcttgaggtatttgaacatacagcagaaaatttaaacctagtgaaagaaattgatgtcgtacaaaaagcagtagatcaatacgtaacagaaaaagaaatgttcccaattgttgaaggtagcgaagatcgcctcatatgtggaatgaaattaggaccttacttaaatcgtagcttaaaaagagacttatatatttcagaaaaacattatttagtttcaagtaaaccagatagaaaaaaacaaaagagtgggtagacgtaatgaaaacaacaatacatatattgttgtctttttttgtttgttaaaatattgatttttcagtctattcttatttatactaaatgtattggacagggaagagcaactattaagcatcattttgagaataaggtattgttagcgtgggttatacaaagtggtataaagattcgcaaaataaatattataaaaagttgcgggggaattggtacatgaaaaatagtatgacttacattcaattattaaatgaaacgttacgttgttatgcaaataaaggaagttttgaagcgtacaattatataatggaaaacgctacaggtgtaatagggaatgaggcgcaaatatataattttaagtatgcactcgcaagtgcatcgggacttgaaaaagaagcattacatttaatgagagaggccattatagaaaagggattctggtatggaaatgagtatttaatttccgatgaagatttaaaatcactacataggtttgaagaatttcatacaatggtgcaattatgtaaagaaagagatgaattagcacataaaaaggaaagaccagatgtgaaatatatatacagttagaaagaaggaaatctactacttacattgcatg

SEQ ID NO: 2565 - DNA, 1310 bp, Bacillus thuringiensis
atttagcggcacaaaacttaatgttagctgcacatgtttagggacttggtacttgtccaatgacagggccagtattgctagctcaagatgaactgcgccaatatttacaaattgagcctgaaaaacaaataaatatggttatttcactcggatttccgaaagataaaccgaagaaacttccaagaaaagaagtagatgagattacaacgtttgttttttaattgctgcatagaaaagacattgaactaacaatgtctttttatttttgagggtatgtaattcatatgttgggctaaaatgatagataagagggaattactatttatttcataaaaaaaattaatgttctattaaggaaagtatgatacattaatcgtgagcaagattctatttgttcatgaaagtgttgaaagtagtctcaaaatttaaaagttatttttgtataataaattataatgaagttacaggggggatgaattttgaaaaaattcataatcactggattgtctgtattgttattagttggttgcggtgctccacaggaaaaagaggacgcgcaatcaaaacaggaagaacaagttgtaaacgcaagtgatgagaatatggttgtatttcctgaaggagcaatgtcaattggagaagggaaagtaaaagttattactccagatggtacttctgaaaacggcaatataccgactgtattcatcaaaaaggatacgttaattcagcaagttgaattagaactttctaattttcaaagtgataaagaaacattcgtatttgtagatcaaatgtatacagataaacatcaagtaactagtacaacgcagacaacagtgcagttaaaagaaaaaacgctggaaacaggtagtcatacaattactgcagttcagtatgaaaacaatgacccgaaaggaaaggttattagttttaatcaagcaacatttgagacaaaacctgcgtcttaacaagaataaaaagtacattactcaaaaagtagtgtgcttttttgtttggactagagtgtgcaagagtgaataacttatttcattttctaatacgattaaataggaagtaatcacttgttactactatgacagagaaagaggttgaagatgtgaatcggtgtattcgtatcgtcttgattagtatgatgatggcagtattttggtttacgatacaagagatgattcaagctacgctcaattatcaaattcatgacttattaataggagctatttattttaccattgtttatctattatatcccgcactaacgggcagtaagaccttaccttaaaactcggtat

SEQ ID NO: 2566 - DNA, 2105 bp, Bacillus thuringiensis
cgaccgataatataaagtagatcagcgcacttcccattaaatcaagttctgcagtcgttcccttcttcttcgtaaatctttcatacaattcttttaaatcattaataaacgggccaatactgcttaccttttgaatcttttcaagaaaccccttttcaatcgtttctttgccttcttctgtttgcgaatattgttcataattcgttaattgctgctctacattcgatatactaaacttttgatcatagagctgtgcggattcaagtaaatgttcaatgttattaatggaaacatgaatatccgattgctcctcctgtttcgtttcaatagaatagcctgctgccacaaacaaatcaccaactggaacaccaagactctccgcgaacttttgcaaatgcttcggatttgcctttcgcttaccatttacaatcattgaaatagtagccgtatcaatttcagtaagcaaactaagctttcgcatcgataaagacttttccttaagtaactttttcaacaacaatccaagattacttttttcattatcttgagacatatctcattcccctttattcacgagaataaccatagctattataagaaaaacaactataatctctatacaattcatattaacaaattttttcgactatttacaagatagaagtcctttatatgtctacattttgtaaacaaaaaagctatcttaaaaaattaagatagcttttcaactcattttaaccatttccgtaataataaaaatacactaccacaaattatgtaagaactcacgaatgtgacaattgctataaaaaatgaatgatgcatagaaaaggtcagtaccatcaataagaaagatacgaagattaaatccaataaaataaaataccccgaacttaaaacactttctactaattgaaactccgattctaattcagaatatttgagtcttttatacaggaatctcactttcactcaccttctatgaattaatcaaaaaatgcagcaaaggcaataactaataataatgttccactaatcaatgtaccaaactgacctaacgtgaatttaccgatgcgaacgtgagctatctttctttccaacacaactccgccccatactgtaataaaactaccaactgcagctgcaatacaaatagcaattggattcaaaccgaacaaacccgctcctaatccatttgtgagcgcattagcagataaaccaatcccaagaaaaatagactccacaaaaccgatttccccagatttaccgatatttttcgttaagccatttatttcagtgtcccccacttctccttcaatctcttgcaccgaaaccttccgaggaattgctagtaagatgattcggagaccgattataactaataagaacgaaccgattacaaccggcattatcccaggtaaaatttttgatagccataagccaaaatatattcctactacactaaataaaaagcaaattaccgaaataataaaatttgatagatgactaatttttatatttcgaatgccataagaaatccctacccctaagttgtcaatacttgatgaaaacgttagcgctaataccatcatccatgctgccatttcgttcaccccttcgtattgttgaacatcccggaaactaacgtgacatacatagcatggaatatgaatatagggagaaataactcctatattccttccacttaacagctctggccaaaaacggggtagagtgaaccacttcattatatacatgcgattcacttttcctttttcacgaacggatcgaaagaaatgtccccgaaaagaccccattttaggagcaatctttctttggatcgccctattttcagatgccggttttaccctcaagtctagcgcctgttcaaaatggactaacccttttttctaaatggcaatccacatcttggtcaaccagcttgattgctggaattaattactttcttacttttgcctaaccccttggaagctgcttacaatttcctcttggtcaatagaatggtcttctttaacataagaaaggtcttttcttgaaatgggtttggcttttctccatttcccgttcaacactattattttccc

SEQ ID NO: 2567 - DNA, 1007 bp, Bacillus thuringiensis
gggaggaatcaacatggtattaggggatttaaaacaagcgttttctcaaaaaaaggggtattgcacagagaatgcaaatgaattattagactttgcgagacattggtatctcgaaggaaaaatatgcatatcagattatcgaacattaataaaagaattagaaataaacggcgcaacaaaacctacaacaatgacagaagcataaaaataacaagagggctctccctcttgttatttacattgctcaactatattttgcaaagtatacgaaatggcttggtgtgtttcaaagaatcgtttacctttacctttatttacaaagcattgcaacacattcgtttgtaaattatcgtatacttgatcaatttgctgtacatgtatatactttggcttttcttctttaatccacgtataagctaattctttccacttctttaattcctcatctaccatatctacaaacggtttcatatccttataaaaatcgtattcagttagttctcttttttttacattcgcttcattactatactgcatgagtttttctgaagactgtattaatgcttcattcttcatttctttcccaccttattatgcactcactacgacgttttgaaatgtcttcacccaattccctttttcttcgtgatgcactaatttattttccatatgttcaatatgcatttctgttatttctatcttattacatattttttcactcgcatcctttaatgcatgattcattctaatccctatattcatttccagcaaatcgagagaacttaacatttgatccatttttttcattacatcttccttctgaaccatcgccatatacaaaacgcctccttctttgcttttcctttgtcatgtaatttcgccggatgattcaccactcctgcccacatgacaaaactagttgttattcgtcaaagaaatcatttcgtatgtcatttatagaaatggtaacaatacaaaaaggaggtgtattacaatggcaaagaaca

SEQ ID NO: 2568 - DNA, 1487 bp, Bacillus thuringiensis
aatacaacgtataattgagccattaaaaaatctcatttttaatatgatatttaataatcaaggctttcattgagtcagaatgaaaagagtataaacctttttctgtttgctcattgattaaagttttttttaagttgcaaaacggttctaaaaatatagaaggtaaaattcgataaaaatagaatatgttatatagcaaacaaggaggggataaaaatggaggtctatcatataacgagcagaaaaagggaaacatacaacgttcaggtgaaatattcgatacttttcgagtgtgcacttggcattgcagcgattactcataaaaggttaattgatactcttgaaaagactcaaagtgaatgggaagaaattaagaaatcattaacagaagaaatgagagaacacttacagtttgtagaagaacataatacgtggaaagcgttactccagttattgtatgaagaggattttcaagatttatcgcagtttaattttaaaattgattcactttcagaagaagatttgaaatttatatgtttaccgtttttaggagagaagtatgaagagaaaagacgtttagctgcaacgggagttgtatgtgcaatacacgaactaaaggaactaacagataatcatcagtttttttctacttatattagctttatatgtaatgtagatgtacaagtgctgaaatcgcatttaatcgctgttatgacaggttggtatgagagtgttattaaaagagaggaagaacaaatactttctatattaaaacgagattatgaagcaaaaaatgaaatgaataaaaagatgaaaccagaagagtttgttgagtgggctactggtggcattaactatatgccagaaccaagtgttcattacgtgcttcttatcccgcaaatgacgtacagaccgtggaatattgaagcggatattgaagatacgaaagtatttcattatccagttgcgaatgaaagcattcatcctgaagatccgtatgaaccgaattattttttagttcaaaaacataaggctcttggggatgaggcgagattgcgaattgtaaaaatgttgtttgaaaaagaacgtacattacaggaaataacggaaagattacagcttggtaaatcgacagtacaccatcatttgaaattgttacgtgcagcgaagttagttgatatacatgacggaaagtatgtattaagaaagaaagcagtacagtctttagcgaaagaattagatatgtttttgaatagataattaacaacgagaatgtacataaagggaggaatataaaagaaaagttggtgtgtgaaattgaaaaatatattgaaaaatcgttcgtacttttttatgtggattggtagtgcaatctctgaattaggaggggctttcggaacgttatgtaattcaattctagtatatgagttaacaggatcggaaatggctttaagtagtatgtggctattatatttcatcccatcact

SEQ ID NO: 2569 - DNA, 841 bp, Bacillus thuringiensis
gtaaaaaatagtctatttttttaaacagtaatatgaaaagctttagggataaggaatggatttagaaatttctttctaaagtattgtgttcactttacacataaatattgagaaaatttcacttaccctaaatggaaaggtaatagaagtgttcatagagaattactcgtagattcaatttttatccatccgttttgcggggaatgattgcctagtggtaatgggataaggttgagctactttattagggggagtggttctatgtttaataaaaaaatggtggcaatggcaatgaccgtgccgttagtaatggggacgatttctacggtttcggcattggaaaaacaacagcaagtaaagttagaagcttattcgccacagaaaaaagcaactgaatatttaaaagaaaatgctgcgcagtatggattgaaaacagatctttcagacttgcaatatatttctacaacagaaacatcagtagcttcatatgttaggttccaacaagttgttaatggtgcacctgtattttcaaaacaaataacagttacgcttaacggagagggaaagggagtactcgctgtttctgattatcagcctgttacaggtgtgaaggaagtaacgacaaaaattagtgaaaaagatgcaatacaaaaatcaatggcgtatgttggagaagcaagtgagcaaaatttatgggctcctacagataaagagttcggatatattgttgaagaaggaattgctcgtccagtatataaagttgtagtccattctaataatccatttggtgcatgggaaacatttattgatgcagaaaatggaaagttaattaaaaaggaaa

SEQ ID NO: 2570 - DNA, 1213 bp, Bacillus thuringiensis
agtgtcaatatcttttttatctgtgtttttaaaatattaaatggatttataatagatatatgggatgaaatgcatgatattgattataaataatatggaaaataaatatttttataaaaggggaatttgtaatggtaccacaaaattttattataaatattgagaatcaaaaatggttgtttaatgagcaggaagatttatgttctcatggagaaatatatttaaatatggctggaaccattattacgcaggcaggtatggatgaggaatggggaataagtgaatcagctttagctttgttacgaactttagataaagaatatatttgtgatattaaaaatgaagaggggcttattttgcacggatgtggcactatgctaatgttaggatgcccaatttcaattcattggactataaaccatataagtaaaaacgtgattttaaaggactttgtcaaagttatttctactgatcaaaaggctatatactatgaagggcttcatatagaattgaatgaaaatgaatatagaagacaaattgtttcttttgcattacaagcaaaagaattatttaataaatcaagtgacaagataattttagatgagtttgatcaaaggatgtatacaaacttttggacggaatatgacgatttactaaataagtataaataaaaaagcactgtaaccagtgcttttttatttatagattacgagattgtagggttttcaaaaataacaatctctgaactgtttgtagttgaaacacgttgggcgtaatatgttaaagctgaagaaatatatgctggtaacgtatcatttgtatgtgatgttgtatattcatggattaattcctttaaagttgtccattctaattgtgctgggtgatcagacacgaaagaacttacccagcgatcaaatgaagatgaaaaatcagtttgtaaacgaaatacttctttcataataaaacgctcccttaaaatgtagtataatcattttaccacaaaacacgaacgatggctaaattttttaagtataatgttcgtgttatatagttgtctagatgattggttatgtaaattcaatttgccatttgaaataacattccgtaagatgagagatagagtatatttagagctggaggaaagaaagtggaatttgtatttttaggaactggtgcaggtgttccttctaaaggaaggaacgtttcagcaatt

SEQ ID NO: 2571 - DNA, 2223 bp, Bacillus thuringiensis
ctttggttattgtgacttccatttcgttatctaatattttacgggatttctctctacatatttctaatttatcatcaaataaattcacataggccatacgttcattaaaatacatactaagccaatttcttataaatccatccttaatctctactaaatttttctctaccttatctaaatatggattcattgcccttatattaaaaatatcatgcatcgacaatgcatacagaatattaataactacttggcattctggatcattgggaaatacctttttattaatctcatccaataaaggctgtccacgttttttatcctgatttcttttattaaacaatttgtacgctttcaaatatttatttaacaacttacaattactatgtttattaactaaataatctattacttcatattctccagttccttggcaataacacaaagccttcctaacgtttagattctttttacatagtgtaataaattgtctgattatcttatttctttctttaacatctctgtatatttcagataccacacacaaaaaattctcgaatttcatttctgctgtttttccagtgatcgcatcatttatcactacacgatctactccggtttttctttctaagtcaggaaacgttaattcttctttttttattcgctcctttattagtttcattaaactcttcactagaaacacttccttttcccgaacacggacaccacctaacaattcaaaaaagttggaaacaaaatacgagaagagaatatttattttttatgttatacttagttgtgactcgtatgtagcaaagtgtttcctaagtactggttagggaacggttcaagagaacgtttagcagacacctcttgaacacgctcatatgggtcttttttcgttcatttttagttacttccatactatcacgaattttaaaaattttaataaaataattgttaatcaaatgttgagaaagtttttttatcgctataaatcaagatttagttacatatgcaatttttcatatcgttatttttatactttatagatataataccacaaaaagcgaacctttgttctgtttttttcacaataagagattgaattattatcaacaatgacaatttgagtaagaaagctatttattctcttttttatttgttcattcgacataatatgacaagttattaatattttgtttgctatgctaacttcagaaatcttacattttatatttttggaggattaagaatgaaaatttctaataaaatgtttattttaattagtatagggataataatcctactctttattagaggactctataatagcattaagcttggagactcagaatttggaataggatatgtttttggacaagctgtaggaggaactttagcctggttcagtattattgcgcttatagctgcattagtttttctaattataggattcattaataagaagaaaaacaatgagacaaaaccattattcgtaagatctgcaatatctttcggaacatctattgtttcttttgtagtgctattcgtaattatttttattacaatggggatcgaaaatgatcataaggccgttgctctggaacagaaaaaagaaagcgaatatctaatggcagccgcgaatttttataacgacatcgattcttttgaatggttctcaacaactgtgttatcaggctattcaactacatggtctgaggcaattaacaatagaaaagattttaatgtggagataatatcaaaaaaaacagagtctgataaaatgattaaacatgctgaactattgtactcagagatgggacaacaactgaaagttatctctaaagctgcaaaagaacaacctgaacaatataaggaactttacgatgaatataaaaagatatatagcatcgtaacggcacttaatgagcaagtgaactctccaactggtagtttaatctcatttaatcaaaatgttaattctttactacaggaatacaaaaaagcaaaagggaatattgatattgccattactgaagatataaaaaacaaatctgagcaaattaaagaagcgaacaatagtacatcaaatgataatgatttaacaaaatactgattttgtaccaataaaaaaagcccacaaattatgtgggctcagaagtatggatacatatattttaccacatagacactcgaatgggtgtctatttcctttttctaata

SEQ ID NO: 2572 - DNA, 1447 bp, Bacillus thuringiensis
  unsure (1)...(1447): unsure at all n locations
ctaatcatgataaaaaagatgcagaatatgatgataagcttattgcagacacaactaaagtcgtattagatactttaaaagttacgaataaaaactaataaattaatagttttccgtggttaggggacatattctctaataagagtaaccatacatgaacgtcaaatgatgctaaaaaaagaaaaaacacgcagttccatttggaattgcgtgtttttattttgctaatttattttggataaccgcttgtgtcatccagtgctgattagtttgcacatggtcttttcgaacaaatgcccctatggattttgaaaaatcattatagtgaaacgcatccgttaatctaagtacatacccctcctgaatccctccaaagagtgaagtaccgttgtagcacgaacgaattaccttttcattataggggccacgatataacactggaacgtgtgcaaggcctaactttttacaccatgcaactgctgcatcccacgataaacattcatttttctcattctatattgaaaagacataaaaataggacgtcagtgctgtgtagtgaatgccatgacaagcatacacattttcaccacatatcctccagccttctggaattctatccccccatacttccttgtaacttttttacccatgttctcgatgggttatgaccacttgataacgaccttgcatgaatagcatctttataaagagatgtattttcaccatctaacttcgtacgattaattacttcctgtagtagcctttctactgtatctattttatctcatttggttttctcaatattctttacttctattttttgattgttataactggcactttcttagtatcagaaatttcactgtaaccataataaagtagaaaaaacaataaaataattgtccaaataaatataaacactttataactatacttcatatgaaaaacctcattttccctatataagtgaatgtacatacaccttataaatcctgttacataaattattggatattgcagtagtagagaatcattaagtattagaaattgttattcataaacatatccaagaaatcttcaaaaaatatcatctagacattttaacatttcataaaaatgcacagataatatttttacgtttagctaagtaatgcttattatgtaataaatccttatctctatttcaccttaatatttatatgtacaagagtctgtgtagcaactaggctgtactttaaatatgtactaaattgtgtgtgggaaaggaagcacattttatttaaagttgttactttgaaccctttaattagttggtagtcttcttcattcagacagaaaggaaatttaaagtgtgcacgtattttcaactcagactctttactccacacactcctatacacatanaacatctatacaagaacgtaacaaaaaggaaacaaaaggaaat

SEQ ID NO: 2573 - DNA, 794 bp, Bacillus thuringiensis
aacaagtttccacgttttttgtacactttatcaaatatctttaaaacttcttcatgattagcaaacttatgtaagaaacgaagagcaatgataatctctgcttcatccgtaggctctacttcatttttacgtcttctagcaacaattttattcacacgttcgcaaattggtctcattgccatttcgtcgccatacgtataaatagctcgaacagcttcatatttcaccatcacatttctatcctgtaaagcttcaatataaactatttgtaagtccgatccccctatttttgctaacacctcaataacagttgaacgaacataggcactattactatataaaagctttgttaacggcagaatcgattgatttgttccaatctcaagcaaggtataacaaatatttgtaatctcatctttattttcttgagtatccagcaactttagtaaagcactctccgcttctaatgatttacataactttaaggaagaaactgcccaaaaacgaacactatcgtttttatggtaaatatacggaataattttatttgtatcacttacttctggcaatgtataaatattactaagcagttcacttaacaaagtcgggttttgttcacattccaaacaatctataagataatcagcaatactgatctctttcgtattaatagcaagtttcgtcattacataatacatatctttcttcattgctattttttttgctttggttaccttctgctgtaaatagggaactctagcaggacatctagctcctgtgttcatataagcacg

SEQ ID NO: 2574 - DNA, 374 bp, Bacillus thuringiensis
cgacttgtaggtctcgcatgcaagctgccttatgcctttgcactctacgaatgatttccaaccattctgagggaacctttgggcgcctccgttacactttaggaggcgaccgccccagtcaaactgcccacctgacactgtctcccgggtcgataagacccgtaggttagaatttcaatacagtcagggcggtatcccaccagcgcctccaccgaagctagcgctccggtttcaatggctcccgcctatcctgtacaaactgtaccaaaattcaatatcaggctacagtaaagctccacggggtctttccgtcctgtcgcgggtaacctgcatcttcacaggtactataaattcaccgagtctctggttgagac

SEQ ID NO: 2575 - DNA, 1748 bp, Bacillus thuringiensis
tgcgttgctatttatgttagtaatgattataccaagtttttcggttggtgcacgacgattacatgatattgggaaaacgggatggtggcaactattaaattttgtaccgtttggtagcattgttttacttgtattttttatcattgaaagtgaagaaaatgacaatcaatacggaccaaatccgcattcagatttaaaagaagcgatttaataaacttatttagtttgtagcattactagttcaattattttatctattattaaaatggtttgcgtgggctaatattattaggttgatctttaggtctagatgacttttgaaactgtaaaaatggaaagataaaggcagagagaatatagcatggaaagaaaaaaattctaaataaaaagcactgttttagctaatgtagctaaaacagtgcttttctctttgattgaacagttgcagcattttcatcatgtatacctgcatctttaataattcgttgttttgctttatttaatagatggtttactgcttcgccaaaatagttagcttcgctttttgtgcgggcttctcgtaaacatttatagttttctagcagttcctctttttcggagtttgttaagaaatcttctattttcttttttgtcatacgaaacaccctttctcctgacaaacgacgcaatagaaaatatttatttctcattataacaataattttaaaagaaagtatacactaacgtcgcaataatttgtcaatttcttgaatcttctcatcagctttcccaatttgcgtatttttagcctgttcgccaccaagagcttgatgtagtaaaaaagtttgaccggaaatagcagttacaatggatacttttataatttcttttattgcggtgacatcgaataaaacgagcccaagaagtgcggctaggctaccagtaaaaatatcagttaaaaatccaaaatgaaaaaatgttttcaaacggcgtggaagcaataacttaccttggttattgattagatgggaaacgaagccggtaatgccaccaacgagaacagcggttagccattgatacatttccatcgaatccactccttttagtgaataagattcgattatttcatattgattccttttaatatttcatataagcatattgagaaagtttgtttgggtatattttgtattcaaattaattataacagaaaatttagatagatttcagtctattatatgaatcatttttacaataatatgaatgcagaaaggggtgcgtgatatgaatatagattatcgaataagaagtgtagatggttatacaaaaaaataggggaattagtaagcctgcttgagcataccagagctgtaacattaggcgaagtaaaaaattatcagttgagcaattagatttaattatgcaaagcagcggaaattcaattggcgccttattaaagcatatagcagctattgaaaaagttcatcagcttatttcatttcaagatcgtgactttacaaaagaagaattagaaatatgggaagatgcactgtatttaggggaagcgggtagagcaatccgtggtcatgaaataaagtattatgtacaacttctacaaagtgttcgagaagaatctctgaagtatttaagtgaacaaggtgatgagtggctcatgtcagaaagaaagtggcctaacggtgtagcatatatccagcactatctatggtttcatatgatagaagatgatattagtcatcgaggacgaatta

SEQ ID NO: 2576 - DNA, 1599 bp, Bacillus thuringiensis
cggaattttggtcggattgatatgaatgtgagtaaggttagtttcaagtgttttctataacaaatcagactttgggccagattacacttagcgactgaacgaatgggcaaaatattttttaagactgctagactgctgggtaatctaagtgacgaacagcttctagatcttggctttccatccccgagtttatcattcattagaatgaaagggctttatcctgaatctgtaatttcgcgatttgattttgctgtaacagaggataacaaaatcaaaatgcttgagtttaatagtgatacaccaacttttattgtggaatgttttcaaatgaatgggaaagtatgtgaaaatctaggctatgatgatccaaactcggatcaagaacgattgctatcttctggtctaacgaaagcagtaatggaagcgacaaagggattagataatccaaatgttgtttttacagcacatcatgaacatatcgaggattggaataccactatgtatttaagtcagctatgccatgttgaaaataaagtagtgccaatgtcagaacttagaattacaaaagatgctctagttgataaagatggggcgaagattgatgttttatatcgccaaacatatccgatagaagatttaattgaggatcaagatcctgaaacaggagatttggtaggtgtggaactgctgcaacttgtaaaagccggaaagctttttataataaatcctttgtcagcatttttacttcagccaaaatcaattcagtgtcttatttgggggttagcagaagaagaggtcttttatacaaacgaggaacaacagtggattaaagaatatatgttacctacatatttagaaccagatttatttttaggaaaaggttctttcgttcaaaaaccttcatttggtagagaaggagatacaattacgattcgcgataaggatgaaaatattatgcttcaaaatgcacatcaaacgtataaaactgcactgccgatatttcaaaagtatacagaactgccagtcgtatccttggaaacagaaaaagggatggagaaactgtcctatgtgtttggttcttttttaattgctggaaaagcgagtagtatcggtattcgcgcgggagaaaagattacaggaaatgaatcgtactatttaccggtaggtataaaaaggagggggaaaaatgattaattttttattatatttagcagtaacacttggacttttatgtattggtctgttcttgatggaagtgacaacgaaagttaaggaatttaagttaatggctcaaggtaataaggcggtaagctatgtgcttggagggcgattacttgggttagctatcgttttatattcgacagcagctaattcaatttcacttcttgatatgatttcgtggggaggcgttgggattttggctcaaatatttgcttttttttagctgagtggcttacaccacgctttaatttaaacaaaagtttttataatttaattaagcagtcggctttttttttggtttaatcctttaaatggattgttaccctgctgctacttttaaaacttcctttaactaactctttttttatcctattttcg

SEQ ID NO: 2577 - DNA, 1024 bp, Bacillus thuringiensis
ttaatatattcttcaggaatgaatacttcaattttcaattcagtaaattgcatatttcatttcacacctttacttcataatagttaaacaaataaacgatatacttgctcaccatcatactcctgtcctaatgatatgaaaccatatcgttcatatagtttctttgcagagatattatctttatgtactgttaatctaatttctttacacgatttaaaagtattttttattatattaatactttcttgtaatgctgcttttccataaccattaccttgctgcgattgatcaataataaatccgttaatccaatacatatctgatgtctctcttacaacagcatgcataacaaaaccaaccataaggtcaccatcgtatatagcgagtggtatgtactctacattgtcaccatctggttttatatatactttagcaagcgaaactgctacggatggaacaaatttcaactgattttctttaacttgtagttttaatgcttcttcccaattttctctcgtaacaacctttaactggacattcaatattgtaagctcccttatatagaggatgtatgtttatattcaacgtagcgaaataattccctttttcgacaacgacttataacataatttttataaaatcttgaatgaatttttctgcatctatttctaaagctatacgggctccttcagatttagagttagggcgaaaatcagcaaatgtttgtcctttcgtatctccgtatgtatctacattcactgtacgatgcgcaaattcaaaaaaactttggttaactaatccacttatagcaaccacatcatgaagcaatggcccttcgatagatggattaagtttttggtatgcagaaaaatagtaatcatacattggtttcattatcgtatggaatggattctttgaattagcttgaatatagtcaaacacatttggtgttaacacagctttgtttgttacatttaaagggaatatgaataaattctttgcttgatggaaaacaattttactt

SEQ ID NO: 2578 - DNA, 2452 bp, Bacillus thuringiensis
agatgatgtaacattccgctaaattatatggggaaatagaaaaaccacccttatatgagtggtttttagtaattatttttaggttatacatttaaaattaggctaagttatagaaataataaacatttaatctgttgttattattttggttctggataatgattgtagtatgagattctaataaattcttggtagacatttgttaatttggcatctctaagagcatcgttgaatttttgcatacgtacactcccttgagcgtagcctccacctggagtataagggtttctagcttcaaagtcatccaaaaatacttttaattttttatagtcttgagattgatagaaagccacagcctcttcaggagtgacatcaaagtaagaggatgacgttgagttataagaagctgcttgagcagtaggtgcctctagcatagttgcagctccaccgaacatagtaagcgccatagaagatacaataatttttttaaacataataaaacctccatgtagaatattagattaatagtaatcctgtaatcattatagttacaatgaaaatgattatcaaatgcaatattgcataatatatctcgttatttttgggcagtaagactcccgcacaaaaattcaatgaaagtaaagaagttaggtgggaatcgggcggattaaagtttcactttattatttgaacgagaagtcacctttatatttaaatgaaggagtgtaatagattaaaagaggtgtataaattactcaggttaacaagaaaatgaaaaggctatttttaataggggaaagcttaataactggagtaaaggaattgctatttatatatttaacatacatatttgtcttttaaattgtaggcgtgttttagaatttgtatatagtaaattcgttaaaaaacttgataaataataaaatgtgtaaattttttgactattttattaaaattatttaatatttgtaatttattgttttataatgataattgggtcgatcgtgaatgttttagatattgcgatatatactcggattaatttattttagggaggttacaaaattgggtaagagagtcattataagagtttttacattattatcagtactggcattattccttaatgtatttttacctagggctagtgcagaggttatgacgcatgagaaatattcaatggactggagttatagtaatagtctaggtaagtacattcgcactgaaatgattaaaaattcaagtggtcaaattgcttattgcttaacccttggattaaaatcaccaaatggtgaagatcttcctgaaatggggaaaacagataatgtagtatatagagtcttattaaatggtttcccgcaaaaaagtgctgaacagctgggagtagctaataaaaatgaagcgcattatgcaacgcaacttgcggtttggaatgcattaggtcaactcgatgtaaatgaattaaaacatgagaataaaaatgttgaaaaagcagctaaggctattattagtaatgctaacaatagtgaagagactcaagatgtttttatgaatgtgattcctgctgaaaagcaaaaagcagaattaaagggtgaattcttcgaaacaaatctatattcagtacaaacaaatgctaagagtggttcttataaggtagtagcgaaaaatgcacctaatggagttagaattgttagtgaaaatggagaagtgaaagatcagctttcagttggagaaaaatttcgtatccaaattcctaagaatacaaaaacgggtgaatttaatttaagtgttgctgctaatttaactcaagttcaagcaattgcttatcgtggtacggatactgttcagaatgctacagtactattagagagaaatgaagaaaagcttagtagtgatcttgcagtaaattgggaagcagctggttctttaaaaattaaaaaggttggagaaaatggagaagttttagctggtgcagtatttgaggtctttaatgcaaataatgaatcagtcggaaaaatcacgactggtgctgatggtatggcagaattaaacaacttaccaattggtacttacacattaaaagaaattaaagcaccaacaggctatgtttcagatgataaaccacaaactattgaagttaagacaggggaaacaggagctgtccaaatagtaaataacaaagtaaaaggtaacatcgaaattaaaaagcttagtgattcaggaaagattttaccaaatgttgaattcacagtcttcactgaagatggaaaagaagtgaaaaaagtagtaacaaaagaaaatggaattgcaaacgttgaagatcttacgtatggtaaatattatttcttagagacaaaaacacctaatgcatatattggaaataaaacaaagtatcctttatgaaattaaagagcacaataaaacacttactttacagatccgaattcggatc

SEQ ID NO: 2579 - DNA, 2110 bp, Bacillus thuringiensis
gtcagtgtaaattgataatatatatacggaaaatttagtatagatagtttctactatgaatatagtgcaatttgtttctttaattgcgccaaccactttttatgaaataattgggaggttcttatcatgacagacttagtatttaataatgtttattagaaaaagaatgaatcatttttaaatcgattcgtataattgttagagaggcacctgttgaaccacctccaaccaaattaacgatgtataatacgtcgaataattgaagtgaaattgtagtatcggcaattaaattattgttataatttgaagttgatatagcgggagaaaaaatagaaccaggaagtggagtagaagcgtttaatagtagttttgttccagcgagtagagcagttgtcgtattaacttgataggttaaatgctatcttctggttacaggaattgtaaatatatcgtttgaggcgttaattgtaaaattaccgaggctttggttattagaaagaggaatattagttccgcctaatatcacagtgatgggatcacctaatgtattattagcgaacatagagtttgttgtaactattgacccagtatttctggtaggttcagtaagtctgtatggaagaataatttcaagagtcgttgatactagtttttctattcttttttcatttttatcttgagtataaattacctcatttttaaattagaatgcaataagtttcgtgtttttggaatggaactatcattttattatattaataggagttatagcaacggtaaaatgtttaatatatgtatgaatcatttggaaggaaaaaagaatagttatgaaagcatttcttaataatagactcatacttatgtaagttaattaaaaatatgtggaatgaggaattaaattgaagcggaatgataaattatcaataaataaaggtaagatagaacctgagaatattggacctacattttcagctcttccaccaatatatattccaacaggagcaacaggagcaacaggagcaacaggagaaacgggagcaacaggagcaacaggagcaacaggagaaacgggagcaacgggagtaacaggagcaacaggtccaacaggagcaacaggaataacaggaataacgggagaaacgggagaaacgggagcaacgggagaaacgggagcaacaggagaaacaggagcaacaggaccaacgggagtaacgggagaaacgggagcaacgggagcaacaggaccaacgggagtaacgggagcaacaggagcaacgggtgtaacaggagcaacaggtcctactggggggattggccctataacaacaactaatttgttattttacactttttcagatggagaagaaacttatatatacaagatgcagatggcatagctcaatatggtacaacgaatatactatcacctactgaggtttcgtatataaatttgtttatcaatggaattttgcaaccacaaccattctatgaagttagtactggtaaactaactttattggataaccaaccaccatcgcaaggtgcttcaattattttacaatttattattattaattaaaaaagacagattcttaatgaaaaggaatctgtcttttttgttctgaattacattcgttaacattaagtgacgataaattcaattgtaattggaattccgccgtctaatgcatccccaccaggaattgtaatagcaccagtaggaccagtagtaacactggagttcacgcttggttgaagaataccgttcacatataagttgtaatacgtgaaagtcggaaaagcggttgcagtagtacccgcatcgtttaaacaagctgtggcagcaattgcaaaagctgcacctgtacctgtgccggctcctagtgtggatgtaaatcttctagatgccataaatggttgaatgataggcaattaattttcactccttacaatattttattagaacgaagtataaaataacttgtccactatattgtatgagagttttttataatagaaacggcttcacctttataaggtgagcccaattttagtaaggaaatgttctttatttatatgaaaaaatgatgttgttacttgcggaatatat

SEQ ID NO: 2580 - DNA, 3079 bp, Bacillus thuringiensis
  unsure (1)...(3079): unsure at all n locations
tatttttccatcctcttcgtaaatatgctttaatttgtttggagtaattcatttcataataaactcgattttagtataaaactttttattaaatgttatttttagatagcagcctgcttaatttagaatgccaaaactttaatacctccatcattttaacatatatatccatatcaaaaagggggcaacggtgtatttttttataagcagtcaaatttttttcaaatggttaaattttattttaaatccatatattaaacaactattatattctaaaaggaattcgtgattcgtaaacatttgtatatacagactcttcacgccgaacataaatctctctaaacaactctatcgatatgcaaaaaatcccccttgttaaggattcttcattctctgatatatatcggtgctgcaaagtttttagagttactgtctatagaaacaccagcactatattaagaggtgcactagtgtactgatattatttcctaactcatccgtttgtctaaataacaatttctttatctatgtatgaaaatatcaagggactgatacttatcaatagtatcgcctttttcaaaagatactccctaatttgaacaagttttaaactaatcttagtttcatattctttcaattcttcttcaattttggccgtgtccaattcaaacaacctactaatctacacattagaatacatattagccattttaatttcactaaaatgtttccgtttttataacagtactgttcaatatctcacactaaaacacaacaaaccaacaaatagttttaaacactgaccaaacgaaaattatatctcattaattatttatacttaataaatgttctttaaatattttgaagctcttccactgtaataattcacttacgattatgccggcaaaattttttgggtttttctccccattttgaatctccgttactaatatacaatcatactttgcaggttccattatttttaattgtttaaagacattaatattatgcttttgtctgttagttaattctgtgcctactccacgtataatatcatcaagacccgattcataatgttcatattgatttctagcagccacaattaaatcaagtatacgtaattcttccactcctcgagctggattattccacatgatgtaattatcattatgcattataatcgtgccccttttatttttatccctttgaaaagatatgtcataaggattaccatgaacagtagatatagcttgtttagcaatgtgtagcaaagcaccagaaagaacattgattgaattctctttagccttaaattctaacttaagttttgctagtctacctagcattttttctttttcaatggatgccgatgtagacttatctttagcttcatatatctcgtaatcctctgttaatcctgcaatttctccccatgttaattgtgcttctttttccttctcttttattttcttttccaaaagttcaatattgtttttgtctttcgtaataatatttatgagttctgaaaccgcanattcaatagattttaaatatgtttccaatttaaacttctccttcactaattgagcttaacctaacatttccagcatccatagatgtctgtaaatacatttaatcactatggttataagtgtatccataccaagcaacatcttcttgctgaaaaacacatatttcatctgggtctaaataatgattatagcttcttagattcatagatctgtactcttgaccttcattatttaagttaaaagctggcgcattttcttgttgctatttttcatcagcccttcttttatacgtataataaccagcataagctcctatgcaaacaccgataagtcccgtcatagtaagctccgaataaaaaagattttatattatttatatagcctttttatcttttaaattctgtatacatcctattgaattatatcaaaatcaggaaattaattgtatatttgaaataaagtttgatcaaaaacacctctcaaaccagcatttcacaatagataaaaagcattcatttcgaaaaaagattaatcaaaatgaatgctttttaaatcacttcctaattttctttattattttatttccatttggaaagtagtaatttatttttgaattctcttcaaaaaacctttctttaatttgcgccaacatattatctttagaaacttttccaggacttaaaataaattcacctgaattccccattaaaagtatactccacccatcttttaccccctcataatattcagggtgctcgctcttaatttcttctagtttttcttcctcttccatagttaactcatctggatttacatatgcatgaatgaaataatccttttgttcttccctaactaatcttccatagtcatttatttcaaagagccaaaatttagatctagatgtttcaaaatttagtatccggtttacctctttagtaccaaatggtggttttctaactgaattaaacagtcctaaagtggaatgaacttgagtcgcctcttgagcacctaaaccagaaaatccatttcctgcactacctatccatttagttctttgatttagctcttttccttcgactctttctctcgtaatttcaaataaatcttgttttactagaggccagaggctactaactatatcatagtcttcatattcttgtggccatttgtcaacataaatcattatcggaattgaatcgtgtcgcaataaatcatgcacatcaaatgtattacataacttaaaacttttactttcaataataattgattcatgtgttacctcaatatgatcagctgacattagtttacttaaataaagaattctttctttagaacttaatcttttaaaactaatattgtttctaatttttaatgtgtaagaatttacaaaatcaaagagttggcgttggttcccccagatattcagacaaattaggtaacataaaattattgttttcattttccgataaaatggaattatcaacaaagtcagaattaacggtggccaatttaaacaagcttattttagaatattatccttttgagtt

SEQ ID NO: 2581 - DNA, 2009 bp, Bacillus thuringiensis
tttcatttctagtaaatgtaaacaatattctctacttcatactgaactaataattctttatttgtatgatttctttttcaaataaaacggcttcgtgacatgtttgtagtaaaataaaaaacacatttgcaaacatttctttatgcgctttcatactttcttttttatgaagcatttcaatcaataaccgcttcatttcctcacctgtacatttaccttgtacacttgaaaatgcacgagacataatacataatcctttttctaatatttcatccatgtataaaataatacgtaaaagcatcacatattctctcgcagttatctcacccatttttggtcgttctcgcaaaaatacactgagccaagctgtccaaaacttttgttgttcttttacacttaatgttttgacgtaatagcataaaaactgcataaacttaattttattttcttcattttctagtatgagtaacgggtataaccaatttgttttttgctcccaatatagtacacatttaataaatacaaagctaagccacttcaagaaagcttctctcgtatgcggatgtaatacttccaaatgttctatcgcatacttaataaatcgcttcatttctgtaaataaaggtaaatttatttgcgtgtaacataagccggcccatgcatattccgtaatctcattttgtttttttaaatctaagtatggtaacaaatattttcggcaccattgtttttcaatatgatatagaaatgtaatatctgctattaaacgagcaaacataaagtttgttcgttccgaattaactcttacttgttcttcaaataaaaataaatattcatatacattacgatcgtataaatgatcatatgataacaactttaataatacagccgtcatttttccaactggatgctgaattgattcattataaaaatcttgtttcccaagcttaaagtctgcatcactcttcataacttgagggaacactgaaaaagcaaatcgttttacaacacgtatactattctcttctaactcttctagtcgattactaatttcatatagaaaactactaattaaccaatgaaaagcagtatttctaacaaatttctgcaatagcggaataattttttggatttgctcattcgtcaatcctcgattatttcgccattctctaatacaaacaaaccatacttcattacttatttcttgcactcctactaattggtatgcaaatgaaatactccactctgtgtttaatttacatgcttttgataacatctctaaaaaatggcgttgttcaaaaacaccatcttgcgaaaattgctgaacttgcttcataatttcaacatctttcagctgcaataatccgtcagcagttacattacaagtaatgctttctgctgtatcttctttcttttgtacactgtatcgttcagaatgaaaatgaggatgcttttgcttcattaactcatacccatttgccgtagatgggctattcgaatcacacttgaataataagtctaatacgagacatgcatcaaataccctctcttctgtaagatgctttattacagttcgagtgacttcttcttttgttttttctaaacaatatgcataatgcctttttaaaagttgaaaaacttcgtgtttataagtgaaatctaaaagaagtccttcatgtaacaaccatttcattttgtcatctacacgaacaaaaatatttttattcatcgcatcaattgcaattcgctttttaagtacactatttgcttctatcatttctgtaatataataatccgcttttttttcattgttttcgcataaataagttagacactcttttacaattcgtattaaaaatgcaagatcattttgatgaaactctttctctacattttccttatttctttttttcagtgccgtttgtcttaacgacaacattctcaatttttctaatccaatcatcataattggaacagcataataagcgatatatggcctcatcttttcg

SEQ ID NO: 2582 - DNA, 1525 bp, Bacillus thuringiensis
tatttgaaattaatgttcaattttaaacgaataaagccattaatattaaatcttgatagctaccatccaattttacaccctttgcttttctaccctcttcaaagaagcctagattcttatataattggattgcacctagattatcttccattacctcaagacaaactttttcaatcttactgttatttttagcccaattgattaacgtttctagaagagctcttccaataccataatttcgatattcgggtagtatggtcatcgcaaaagccccttgatgactaattttttctttgtttccgttcttaaaatctattgcaccgactaacttaccatcaacttcagcaataaactgtacataatttggattttcatgataagcttttaacgttttttgaatagcatcgatacgcaccttttttacatcctcaaccgtacttagcatgtatggagcgtttattaaagcttttgaagcagaatctagtattctttctgcatcccgttctttagcttctctaattattattgtttttccatccttagatttataagtaaaaacattagttgataagatactacacacaccctttcggaatataattagttgaattttttaactatcatgcaattattaagtaagaaaaagtcgtatcacctttttctgcaatcgctctacttcaacttaatgacgattatttcaaatatttttaatttttacaaggatttattccgttatatagcccgattgttgaataacatgactggcgttttttaaacaactttattatctctgtacacgatgaattaacgacttgagctgttgtgtaaataatatacaatgaccttttctaattccttagtttgttctttttcccgtacacgaacggcatctactggaatttgtgtatgttttaaccaatctagaataaggtgtagttgttcttgtatttgcccaatgttttgctcctttatgttcttattctgaattctatcaattaattgaagcatatagggaagtttttctatacattcacttaaatctccgcaataacctgaagggaattcatgtgtaccaaattctaaagtattgatgtaattagaaactaggtatatcatggcttcttgttcggtatcaccacctaattcaatcgcttttcgaagggatttttctaaatcgtcttctttattgctagagtccatataaattcctatccatctaaaaggtcttgaatcaaatgggttgttttctgtccatctatatagaatgtcaattagaaaactatttagtgagaaagttaagacctcatctttttcgtttaatacatctaaaatagtaaacagcgaaatggcaaactcttcttgatcttttgattcccatttctttgcatttgtaataaatgtctctaaatgtttaaaagctaattttcgaagtcccgcttcgcgatgctgacagtaacaaataaaatcatgccaatgctcagttgtattcatatgtataataatagtttgtaatgcagtgagaggt

SEQ ID NO: 2583 - DNA, 3013 bp, Bacillus thuringiensis
  unsure (1)...(3013): unsure at all n locations
atcaaatgttaaaatgattaataatcatgcgaattcaaataattaattatacaaatggtagcatgatgttatactgctattctttattcatatgtagtatttaataatcgttgcattgtttataagaatcactaaaaaattctaacatgatataatgaatatataaagattattaaaatttcttagaaaacaggtgagggaatggttaaaaaacagcattatgtaccaaggttttatcttaagtattttgcaaatgaagataaggtagattattatgataaagttttggaaaaaaacttatctaatatgcatgttgataatgttgcacaacaaaaatatttttatgatttttctgaggagtttttggaaagtcaacagaaagttgctaacggatctgttgattctcgtttttttgacaagcaatttttagaagagcatttttctgtattagagtctcaatttgctagatgctttagggaaattaatgaaaaattaaacgatcaaacaaatttgttaaattgtagtctaagagaaatattagatgaagaggataggatagatttagtattcttcatagctttacaaagcattagagttcctgctttcagagaattaagtgaaaactttagcgatatgcttgcggaaaatatacctgattttgctgaagttaagatggatgataatgaaaaactattgatgcacttagcctctgggattttaaatagggtaggatattatcttctaagtgatagatttgattggtttcttggagttgtagaggaatttgaggaaatggaatccaaagttgtggtgatggatgaattggttatttcagataatccagtggtaaatattaaacacgccagcggaaaaacaatgcaatcgttcaatgaattttgtttgccaatttcacctaaacatctattgattcttagagagaaaaacttcccgtatgaaaatcctgataattctatttttaaacttagtaggaatgacttaagattctataatgaatatcagatgcgtttttcaacaagaaaagtaatttattgtaataagacaaatgctaagaaagtaaaaagtttttttaaaactcttccaagagaactttcacataatagtggctctattggtgtgaatgaatatgaaaaataatgtgagtagtgtggccttaaaataagttttgacagtttgcctctttcaattaaagaattctaagtgtgttttgatttaacttttttataaaaggggagtccatccaaaaagaaacgaattcattttgattaaactttttcaaaacgaattcgtctttttgtcgttaagtatgggtggcaaccgctttaaaggtacataaaaatataatttaaaaaggtgtgagtgaaaaaattgcttaagtttacatttattctaaaacctataataagtaaaataatagggttgctgactacttctttcatcgaaaaatggaagattaaatacaaactaaaaaagataaaatcatttcaaaagcaatttgaaaacacatttgttgattcaaatacatttcaaaagtttttgaatgaagaaaagaatgggcttttgatatttaattatgtatttggagctacatatagaacggttactaaagatgcttttgtagagcaattatcccaaatagcaatgaatgaaataaataattatagaaaatctgtgaagctagaagagatagaaactcatccgattgtaacacaatatcttaatgagttgattgtatatcttgaaggatatagggacaaaagttttaaagtaaatgaaatgagtattttggcaaatgttcaaaatagtattgttgaaagtaataacagtctaaaagaatactttgaaaaaaatttatatgaaattcaacaaagggcttacctagaaaaatatacggatgagtatttagaacaaatacttgatcgaaatatattagatttaggtaaaaggtataattcagaagcgaatgtagaaacggatctaaatgttgtatttgattcattagtaagtgacaagctaatttttgaaaagttcactgtgttaattaataagtttcaagatagtattatgaatttaaatgtggttttagatacgtataagnaagatatagaatttaagaatctttcttttattgaagagattttaaactatttaaagaatattaattataatgataaagggttttatttagaaaataatttgaagagctttaaagaagaaatcaatagctttatggaagaagttgaggaattaagatataagattaatgaagaaactaaaaaaaacattagaaatgaagtcattaatttaatcaatcaaataaccaaacatgaaagagcaatgaatgattatatgtatttgataaaacctcaattaattaacaatccgtatctattgatttatggagatgcaggaattgggaaatcacatttattggcagacaatgctaaaagattgcaagaagttgggcatagtgttttcttatttttaggtcaacatttaaatacacatgatcatccttataaacaactatttgatttgattgattacaaaggttctaaagagtccttttttaaagaatttaatgacagagcacagaagaaaaataaacaaactgtaattataatagatgctttaaatgaaggagaaggtaaacatttttggaaaagctatttgatgaattttttaaattttattaaagaatttgaaaatattgctgtcgtgttatcagttaggagtaattatctgagaagcatattacctgaaaatattgaagaagattttccgttgtataaattagagcataagggatttaataatctaagtttggaagcgttggacccattttttaatttttataagataaatccggtaatattcccttctttagaaaacgagtgttataatcccctattcttacaaatttattgtgaagcaattcaagaagagtatgttggattccgaagatggagtatagttcaagtattagaaaaatata

SEQ ID NO: 2584 - DNA, 2526 bp, Bacillus thuringiensis
acgattgtgctgggtaataaggttgtaaagaataatatgattgtgctggggtataaggttgtaaagaataatatgattgtgctggggtataaggttgtaaagaataatatgattgtgctggggtataactttgttgcgtgtgctgtgattgcagcgcttgttgttgtgcttgtatagcctgatgaactgcttgaatagtactttgtgcaggccccgatcctcctaaagggcgcatttgcgttttattataaaaaaaatcaaaaaacatcctatattcacctcatcctttaaatattttgtcttccatctttcatactatgaatatttaattacaatggataatacatgacgcttttcaccttataattcttgaatctctttctattcaaataactaactattttgtttcaagttttaacaacatatttatgaaaatcattcatatacttttataggtgttgtcattagcgacatggagtgctttggtcacgcactcctgtttttttatgcaaaataactattttgttaagctttatcaattcctacattctcttaataagtcccgtataataatcttttccaaatcattgtgtttctctctgcaatactacttttctaaagaatccaacaaaatttgacaaacatagtcaactatatttgttatgatgttctaggtatttcgcttctaagacttcgtacagtttaaattttgtttaacctatatcaaatattgataactggccttcgatttccactacttccatcacaggttcccccttttgatttgactgaaatgctattctttatccttatactccatctccaaaaattcagctaaattaatctctttcattatcaattcttctagaaagtaaaacgcttcttgttccccttcattttctcttatattttgaaactgtaatttttgttcttcatctaattcaaatttcacctttgcttctacaaccatcattcatcctcctcacctactaaaatgaagtttttattttcattaacttcgcttaaagtgaaatattcattttttcattcaccgaagttcataacatattcttttcctctggtataataatgattaggtgccccatgcgcattttatctactggaaataataccttttacgcacttaactaatagaaacttcatttctactacttctacaataacaattttgttcacttgtttgatacatttatgaaacattcacatgttatcttcaatatgttctattctttttgaaaaaccatgtgagaataccaaaacaagaagccctagagccctaactctagggcttcttgttttcaaataaggattttgttaaatattcaattgaaccttcttacactctccgtattactagcccataagatattcagaaaccgtatgaaattgtaatactaatgtaaggtttctcaatatgagccaatgtatttatgtagtaaactatttatcggcaatacatataaaaggagaaacatttatgacttttgaagacgatcgtaaattaggcattcaacaagggtgtatagtaataacagatcaatcgcaatatcttgtcgttaaaaagaatgaaaattattctttattaagcatcgcatctgcggaatgtataaactttgaagtttcacttgaacatcttgaagaaatggtccaagtagatttaaaagaaaaaattcaagatatcattccaccagagaatattaaaatcgtagctcaaaacagaatataaaatgtattttctaagagcactttcgatggtgctcttttttcatgaacagtttcaaataacgattttattatgtttccaaacttacagtaatgtccttaaaaaacattcatatatatttatcagatgcacttttaaatcccagagtatcaaatgcttttaaaagttaactgaccaacaatattcaacttctctttaaaaataacttagatacaaaaaagctacgttttatataggataaaaaattatcttacgcaaaggagcttgattatttgtgaattaccaaaatgataataaccctaacattcacaaaccttgcacttgtccatcccccacggctaacagtttaaatgttgttcaaactaccccatcaatagtctctgtaaattctgcgattccactagataccgtggtaaattctaatggtacggcaatctcattcacaccaccaacaactgttttacttgaaggtggaagaacctatttggcaatctatgaagtgcaagttatcattcaaccaggaggtaattcggcaggtatcactatgtatcttaataataatccaatcattggctctggtacttctctgggatatactgcaggattcacttctgtatcagcacccgctattttcactacacctttaggtataacaagtactcttactgttaatgtaggaccatattctaatacattaaatacattgggcttaactcttgctgttgtagcattaacataataaaatgtaaaactctctaaaatgattttatttatcccttaac

SEQ ID NO: 2585 - DNA, 1723 bp, Bacillus thuringiensis
tctttctcattaatagtggtacgcgtttctaaatttcgaatgtctctcataatttctttttgctccgccttgagattgtcaattttagcgtaaacatcttttccatatattcacaccctctgttcatcttaatagaaaaatctatatatattatgagacaaccctcttatctgtgaatacgttgcgtatatccgcgtaccaaattttttgtacaatctaattgaattactcacacgtttccattcttctatttataaattagcgttgagatacattaaaattagaaaaggaatcccttgtttatttaacaacaaacaaggtgcaatccaccattcgggagcacctacgataatttctattgttttcatatttacaactccatataatcagtatgattttctgaagaagccaatttttgaactgcttaaagtatactaatatgaatacgaaatagctgtattgataaactctctagaacaataaatatactggctgaaacggatctatatccaatattttttccagtaacatgaatggttatttctgataaatgcgtttgtacatcattgttttcaaaaatttcatcctcaacctttacaatatctgcttcacaatctacttctttaaaagttttcaataattttgtttccaataaactacaatcaaagctctcatcttttattacggcaaatttaaccttcatatcgatttccccatttttaacaaactaaaatcactaaatcaatataaatatatattattctattaaataattcaaaatatacgcttcttatatacattattaaaaataggttctaaagaattaaatgaaaaaagaaattacatatacaaatcccctctttcaaccaatcaatatagaattcccttatgcccaatgattaaaatcttttcatattaaagccgtagattctaaggactttttgtttttatattgataagtcatttcttgaattttgtatcatcggaattaataatatagtaaaacaaattaaatattaggcgttcaactaatctttcatataattcgtctcttaattattttgctcattgcgcttttttattttcctcactatttcaactaaactttgtgtaataatacatatttcaaatacattatttcctttcactcatacttttatcattgagtttttattcacaaattcgtaacacatatatatgagttatcatgctaaaattagtttattcacaaaaagaagttcttcttaataaatcaatcatttttaataccctgtttaaagccttgcccccctgcaaggttttttcctatttaaatagagtagtagttttcgttatgcttctctcccccttgttccttaccctacaaataatacttcatatttattttaatttttcagcatccgtactcgctctgttcgagagctctttaccaaatattcaatctaatgataagattgaccaaattaatattttcgtccataactgtatcaaaaagtacactaaagaaaaaatagcactctcacaattaagtaaacgcgagctttttcttctatctacttactatttaaggttaatagtgatataaccagatttaaaaattcgacttaaattcattgatgaatggagaggtttatatgaaattgaaagacaaagtagcaatcatatctggtggtgcaagtggaattgacgaatctctgttagtctattgattcaagtaatctag

SEQ ID NO: 2586 - DNA, 2174 bp, Bacillus thuringiensis
atcattaggatatctttgaataccatttttttcatctttttctaaacttttaatctcttctctattttcttcgataaactctttatgatattctattccccttttacatttttcttctatacataaatgatctctcattctttttaattcctcctcgcttctagattatggccactctccaacgatgttaccctttgcatctatcttaaatgttttaacctttccactactatcaacttttgataatactctttcaactttacctctttgcaaggctttcgtaatctgttcagctaatacttaatctccctcaacagcttttaatattctactttttccagtttcagaacctttcaaccaatcatttgacatttgtcgtccatctttagttttccccaattgtgaactaccaaacttagcttcatctataacgtatttgatctttgattctgcatttgcattttcgtataatccatcaattccttttactattttatcatttatgcctgatggtgcactttttccgactggctttaaatcaaatccagcttcttttaaactttgattattcaataaattgtcactagattttatttcaccataattccctttttttctttttttcataatatttttcttggcttctacaacttttaattgatgttcatttaagtttctagcaacataatgctctctgctactttatcaacttgaaccataccctaaataaaaagcacttgttgcctttagtcgacaatcaagtgctataagtacatatttctgttacaagcgtaattaaatattttttgattattttaacaataattatctctttgtactaatattattttttcgcatagagaatttattcatttttaaaatgaaccatgtcataaggataataagaaatatcttttaatatactatcatctaatcctaaaattttcataattgctccactttcaaaactccaataaccaaaatataatttttcttaatgtttatggcattcataccataccatattattatgcccaacataccattgccctaacaagtattttttcatgaattcacaagattttgtattatcattacacaaaataacattaatcagacttttaaatggcttttcaaataaccagctatattttcgaactgtaatcacttcttaacaactactaatctacctctattatttgtatcccttctttggtttctggacaatcattaatgcttctttttaatactcatcttcaaataaacaattatatatagtaacacctgtttcctttaactctaacgaaacatcctccacttcaatacttaacgtttctttatcaagattctttattccgttactatctaataattttaaaatactacttcctattttcttagattcatcattgtatggcgaggactcttcaactagctcgattgtaccattagtgtatctatatcttaaatatttaaccactgcatatggcgcgattgccgaaatcattagcattacacaattaatttctgattgcttccgaacatactcactgaattctacactaccaaaacgaaatttcacatctagtggtagaagaatgtaagaaaaacatgatgaataactaaaatcagtaatattatcaacgtttatatttgatattttattaatttctccatcccagaaatgtttatcaacaaatttccccaaacatattggaaatcaccttgtttatataatttattaacaacttttagtatctcatcactcataattattctcctttattgtacagggtatccatgtatatttcctttaccatccatatgaacctttaccctcgtttctccatttggacctattggttttccaaaatcatgtactctaacacttccatctggctttactggtgttcctttcacccatgcttcttgtgtctctactactccattcttccctgctccccactgcgatttggttgagacattattcccatgaccaggaacatgtttaccttgttttcctgcatcaacttttggagcccctgaaacgccagcatcaacatgtccttgacttgctagtttatcattttttccaatgttccctgctacactggctccctggccaccatcaccagtacccttacctccaccagaagactcgattctatgaagag

SEQ ID NO: 2587 - DNA, 2245 bp, Bacillus thuringiensis
  unsure (1)...(2245): unsure at all n locations
ataacaagtatttatatttaatagttaaaactattaattgaatcaaacattatcaaatcgactctgtttatttttaaaagtaattctcatatacagcacctcattatatttatattttaatacatttaaattatacaatttatataatgtattgtacttatcatttacaaaaaatttacaaaaaactaaaaaagaacaccttaaatcggcgctctctttacaaatattaagcgttatgtaattgaacatatagataacagtaatcctccaaatgaaattgttcctagtaaacctactacaaatcctgttaaacaaatacaatcagcaagacaaatagaagactgcgataatggaacgaatgacctacttgtacccgaaccatattgttttatcttctcataattcatatctaacattaaatgtagacatgttacaccatcctcaatagtatgtacagattctttttctaatcgctccaataatttactatcaaaagcaactgctagagggtactgcttatccgatttcatattttgataaattagttgcaaacgagataatatattatttttcttcttttcagatgttactgtacatttcatattattaaattcatttaataacagtgataattcatctctttttccgtataaatctttagctatttttctctttagtttatacgaatggaaaatagattttagttcaaccatattcatacacttcctaattacatagtatttaccctattattttgtagataaacagtactttttaatcttatttaaaatacacttaagcaacttattttactatcgattaacattacattaaccttacacggttgtaataaaatcattagctagaaggaatcaatgcccaaactagacagatatttaatgataaaaccataagaaaaaaacaatgattagattttaaatctagtcattgctttatccatcacatcttgattacatctatatatcttattgttactctttcacttgaatgattgaatatatccattaataatggctatattctttgtcggcacgtacatataactaatgttttttaattgataaagtgaaactttaatcagctctcaccaatcgggcttttatgggcagtccgccacctaacttctctttgctctcgctgaatttttttggggatgttactgccccgcaactagcaagatagatgttatcaatattcatacgttacaatagtaccggtagtatcagtaaaaccatcaaaacagttagagcaaccaccacagccgccacaaccgccacagcctccgcaaccaaaacaaccgaagcaaccaatacaacggaagccaccacaacggaagccgccacaacgaccaacaccacaaccgccacaacgaccacaaccgccacagcgacgagcagcatcttcaatatagtaatatggatattggttttgctggtcccaatagacaatatttccagaccggtaatcattaaggcttaacgcttgtagttcttgttgaaactgattcattttcataacctccgtttataaaatacaacctcatcgatacttccctatattcctgttcgttacatctaagtagaaatagcgctataaactaagttcaatacgtacaccaacaaagtatgacttatcactagatgatgcaccttgttcatatacctatttttactatgggctcatttttataaagtgaaactttaatcagtggggttttgttcatcccctacctaacttctttgcttccgctgaattttgaggtggggggcttactgcccggcaaatagcgggataaataaaaattaaaaaatatgaattctagcgtcatatcttcatacttactaagttcaattaatttctcaacaattatgatgccatatcctatatatttccgtctgctgcttagatttttctgtactgtaaatggctttcgctataacacctccaagtgaccggtttctatgacggttaagaaattccaacaaaaaaaagccctaattagggcttttcattctatttctccagcaaatctctatatgaaattgctaattgaaaaaagacacatttagattgatgcgtctttttttgatgcctcttttgtgaaatcatataaagcaattgcgcctaaaagaacaagtatcccttgaggaacatctagcaaaatagttttccaaatttctggaattacccatttaatatctgctgctgtttcaagatntgtttg

SEQ ID NO: 2588 - DNA, 430 bp, Bacillus thuringiensis
ctcaactcacttttaggccgccataaggccatacacagagggggggcctcacgcatgaccttgcgtgctaacggccggccagcggacgggcaccaaccaaaggccggcttgcttggctgttttccttaggttggctccgcttgcctgacttgcctcatataaaccctcactcaagatagagcgatccccacctgacatttctatattcatggcattcctttctgaatgttaccttgctggtgctctgttccgaccctaccctttaacctaccacttgcccgcctgtctttctctcttagggtggcggcttgcttatacataactctcactgtatgtatctcagctgtgtgtaggtcgctccatccaggcttgtgtgcacgaaccaacctttcagtcattccgatcgctgttatttgtaaattatctattg

SEQ ID NO: 2589 - DNA, 1058 bp, Bacillus thuringiensis
tctgcatttattgtataaaaatgataaggaatacgtatgattgggaaatgctgatgattacagagagttatttcaaatagtaggtaggttgaaaatagcaaatggaatagaattgagattacaagataagaaattaaagagaaagttaactttaaaacgaagtgtattcaatataatcatgtatttacttgttatatatattatgtacaaagcctatattaattttctgccataataggaaaagacggcttcacatatatgaagccgtcttttaattaactttcttcccacttttcctcatcaaccataagaaataaggtgttccaagtatagcaacttttttcgccggtttatctaattttgtttccccttcagtatgtttaattgttatagtttgctttttatcttctatcgttgttacctttttctcctcttttttgctgtccgcattcaacagcgaatagaagaacaaccatgaaaatactaagaattttcttcatcttctttcccaaaataagttttttattcgtaattatatttttaaaattttgctgaaaaataacgaattatacgaatatcgttatgtaagattaaaatccatatgtgtatgaagaatttagaaaaggaatttcatttaactagagaggcgaaagtacaagcaaaaggagatagtatcgcatgtaataattattagaatgtacgggataaatctatatttatctccactgaataaagctttcggtctgatttgataaatgttttttaatttcttacttgtacttataagattgaatttgaaggaaggaatcaacatgtcttcatggctcaataatacaaatggatattgtagttgtaataatcaaaatggtgtacatgttgattcgtgttgttttagttgtgatgggacagtccctaagcttggtccaacaggtccaacgggagcaacgggttcaacaggagcaacgggttcaacaggtccaaccggagcgacagggtcaacaggtccgacgggagcatcgggagcaacaggagcaacgggttcaacaggagcaacaggt

SEQ ID NO: 2590 - DNA, 2278 bp, Bacillus thuringiensis
gatttcacaatcactatacaataagttagtgaaggagcaagaatattatttgcaactcaattttccagaaaaagttcaaaaattaattggagcaaaagagagtgaaatgattttaggtgaaaaagtaaaggaagggtataagcaatatgaattacatgctactgttccgataaaaagcgcttcagaatcacaattaaaatcattagaaacatattacgaaagttatgatttgaaaatattaaacagtaaaaaagaaaaaataggtgtgtttcaaaatataattcagattgttaaagattatggtgaaaaaatgaattttcaaagataaagtgagactttaattagcccttacggattggaatgaatataaactcgtcaaatctatatgacctttcctaggaaatgataatagagaggggaaagcacccctctctattactttgcttttgcagatggctcattcattgattttcgtgtaataagaaaagaaatcataagagcggaaaggatgacaagggcaataaatacgtgattgggcaacaaatctaataataatacgtaactaacggtataaaaaataagagttgaagctaaaaacgatagagcacctattataagagattgtaaattcatttttgtacacctccttttatttatatttttggctgaaaatggattatataaacattatttctaacaatagaaaaaaatatgtcataatagagaaaagaacaagctttaatgaatgaatatgattcattaatgagagataaaggagaggaatatgaaaaataataaaaaaggattatggggaattattgttgcgataggtctatttttactgcctaagttaaagtgggtatttgcaatttttaaattagcaaagttttcaacggtatttagtatgtttctatcgcttggcgcatacgcagttctatatggttggaaatttggagtggcgctcatttatttgttgtttgttcatgaaatgggccatttatgggctgcgaaaagaaaggggatcccaacatcgccagcaatctttattccatttatgggggcccttattggaatgaaagagatgccgaaaaatgcgaaagatgaagcttacattgcctatatgggtccgcttttcggacttctgtcatttttaccagcgataccgctttatataatgacgaaagagccattttgggcgcttgttattttgcttggaagtatgattaatttctttaatttaattcccgtttcgccgctagatggtgggcgaattatttcagttgtcagtactaaaatttggggggcaggccttattttattacttggctattcaatttactttaaaagtattttgggaggatttattgttattatcggttgtatggagttatatagagtaataaagagagatgagccgattaaggaattagggcataaaattgatgggatgaaagaatatgttactaggcttgaagaggaattaaaagaaacgggtgctgtacatcggactatatacgtgatgcatcatgagatgaatgcattaagacaaagagaacgggaaaaagagttacaaataggtgaacttcaaaaaatggaagtgttagagtatcttttaccgaagttcgaaccgttagattatgttccatatgaagatgaaaaagatgagtatacaattcacataagggaagcatttgaagcgtcagaaagaaaattaaatgaatggaaaacagaaaaggaacaacaagaaaactattataaagtggatgcgaaaacgaaatggacagtatttgcttgttatatcggattaatggctatactcggttacacagcttatgaaggatatattgttttacaagaacatttgccaacgagaaatgtatagaaaaatattgtcgaaatgataggaagaatttatacaggaattatatttctacgagagaaagttacaagtatagtcatacattgtaatatttttagtagagaaggagttctgtatatgaagaaattgttaagtgtattcgggattattatcgtgatgatcattgcaagctatagtcttatgaaagtgctgttacattatgcgaataagcctgctgaggtaaatacaatagctcaaatagaagatgtgcaagaagagacaaaagtgctaaattttattcgaatgacacatgaaagctataataatttcttaaattacggtaaagcagagaattatacagacggggatttgaatcaatttaagcaatggtttcaacaacaagaatcatcgttaaaaaat

SEQ ID NO: 2591 - DNA, 1487 bp, Bacillus thuringiensis
ctttaagggctatatacaggcaagtaccgtttgggatatgggagatcatttcgcaacactatattccggaaccgttattcgatgttagacttttaatccattctcccctaatgcttaaaatggttaataactcactgccaatactgtaatatctattgttcataaaataaaccacaaaatctttcgatttcatggtttatcaaatataaagataatgctaaacgaatactctaacattaccttccccaaagttaattatagagtattttcaaaaaaaagacactcttgtagtgtcttttttatagtattttaaaaagaattccacctactaacacctttttgttgcgcctattcgtttatttcaatataatacttttccatctcgtatatgcaatagacaatgatagctaaactccaactgacactataataattatgtgtgtagaagtcatagcccgctttaatacctttctctattacaactaatgtaaatcctaaagccacccatctgttaattttcatctttataaacgttaaagagataattattaaaaataaaatatttgtaagatgatttatcattagctcatatttttgaatgtatactgccattatacaagcaacgatattagtcgcaatgccaaaggcaatcaccgctccccaaaccctgtccgaaagtcccactcctgagtcagtcccttcctaaacaaatatccctttctttaattcgttcctacaccctattcaagatatgctaaattatccttgtctgatgaatatctatttatcttttcatatagagcaaacaaaatttctacccataattttttctttattaaacaaactatgtctaagccgtttgaactagcggcttcactcttctggtaatgagatagcacaatttattgaattgactaactcattcaatccactggcaccggcaggcaacaaaatagttgtctgccattttcatgtatactttttctaatttcattacaaaccaaatgtgtgctgtactgatttcaaaaggacagcatttcattttttaaaatgtaaaaaagataagatcctgtctacttttggtataggactttttcttttcacacatactatttttgaacctgtttaccgatacgtgtcctaatggtgtcttgaattcctcctaaaaagggctgcagatacgactgcatgcccttttatttacgttgcttctctatattgagtaaaataattaaaaactaaaaatgtaatattacatattttttctgttcagattatgttaagatttacttcttagtcgaattatggtttcgtatctaattcagcaatatgtgaactgtttatctaaagaaaagacacccaaaaggtgtcttttcttcttttaatctaaaaaacatttctcctatttagtaagatccaattagccctctaacctaagcctcatatttaaaggtaatttaatcatacactcaagaattttcatctat

SEQ ID NO: 2592 - DNA, 1750 bp, Bacillus thuringiensis
cgttcttgcaaaaataagtattaggctgcggagaaaagtttctccgcagcttttttatattgctcattatgcgttactttttaaaaatgtatgaatgtttaagtgtttaaagagtttgtaaaacattgggattttttgttgaggagaatttatttaaaggatattatgatgatgtagcgctactaatctattaaatttatgaggtgattgttaatgaaaggaaaagttttttcaattacgactttagtattattagcaacatcaacctcaacaagtgcattctatccaactctaagcggtcacaaaagcggtaacctactatcttacagagctcaaactactacgaatcaaaatgcatctcgttgttcagtagcaatttcttttattaaatcaaatggaaataattcatatattgaaagcgcttcagacaaattaggatcccatgaatctggaagagcattaaacgcaactgtgagtaatggtgcatataacgcctttggtgcaaaaggactatactcggagcattatgcaaatgagaataatgactatcaagaagatacacacaaaggtacttttgatagtaatggtaacttatgattacagtggtaaaaagcattaaaccgctgtctttataaatatttagataaggagaaggggatgttcatcatctccttcttatttaaaaggagcacagacatgtacctagcttttaaaaatataaaaagcaataaactgtttttcttaattctccttatgtcattttttatttcttttctttctatatcaatagccgcacttttaacagagtctaaacgaaactttatatctgcttttcaaattggttttccagagaagaaccaagttttaactgttccgatagcgaatgcaactgaattggaagagataattcctttcatacaagatacttttgttaaaagtgatatttatgtagagcatttaaaagtattaaatagttcaggggcaacaaagatcatagctgtgaatttaaaagatgattattattggaagccatatatttctgaaggacaatattttcatcgtgaaaatgtaaacgatatggttgttggcgatcaaacgaatgtagaggagttatatgaatttgatgatacatataaaaaaataggaactatatcaagaaaagacagtgacgtaggtgtagcaggcatatacgttccacttcaaaacttacctactatatctaaaaaaggtattatcgagagtaaacaattacaattaacagttgttaatcctacatcatctattcataacgaaataaaaaagtttatgggtaggagtaaagaagtgctttcgggagatgttcaaatgctgaatgaacgagatcttcaagaactacatgtgacacatatagatccagcaaataagtattattataaatttattcttgttgcaattgtttctggcatttctgcggttttattttggatttataaaaaagaaagagagatttcattaaaaaaagcagtaggtgcttctaatatatctatctactgcgaactatatattcaaattttgtttatttctctagcagcgatgttcttagtttttattacgttagaaatattttcgggaacaattcatacttattttcagacatacttagtaaaaccgttaacactatatgtattgatatgcaatgttatttttataatttttcttacaatttttgttactgtaattccaatcaagcacattataaatatatatcccg

SEQ ID NO: 2593 - DNA, 1918 bp, Bacillus thuringiensis
ataaaaataagtaaatgaattaatttacattaatttcattaactaatataatggtcacgccttcccgtctcgctctatccatcgtacagtcttctctacatctaactccgtatacgtcttttctccatatcggacagactcatatatcggaataatatcttgcgttctacaaattctgcttaaccattgttgcatcgtttcatatgaccttctctgttcatgaaacggtaatgttctttcccattccactaacgtttgccttatcttatctttaagtaacggctgttcaaactgatgcttcactttcttgttcttttcggttctatccatattttcttttgttatcgattgtttatcctgttctatttctaatttcgttacctttctcctcgttaatttataaaaagcatagagaatgaccactgcaataattacataaaaaacgacactaatccatgcatttgaaagaacagaaaacacatcagtccatgaattttttcgtacaaaaagtggaattttcctatctatttttgttcttgtatctacaactcctgtttcttcatctataattctttcaggttcatcaaactgttcatctaaactagtaaaatcataatttctttccgatattgtctccgtcttactagaaaaaagcccttttactatgtcttgtacatgcacaacaccttgtgataacgttatcgcactaaccgtaaagaaaagtatcatgaaaactctaatactccaaaccttcaccttcatatgtcgctctttattagccataacataaaccccttcttattctttaattacgacccatttattcgttctactgtatttctttggggaagtaccaagaattaaaggaactgcatccaattcttttcgccgaaagcctgctgtgtaaaaataagtagacgatacaggagtatcttggtccgatattgaggcaagtacttttaatacattttgcaaatgttttcggttatgaccgttctttatatgtagcaaaccgttatcttttacgctattgatccatacttcaaatgaacagttttgcataagcagttgtttacatatgcctgccgttaattcaatgagttcctctgtatcatttcgcaaagaaataccgcttttattttgcaagttgagatatatcgcatatttatctgattgtgttcgctcgtactttttcgcggttatcgtccctgttttcgctgttgcactccagtggatagaacgaaaatcttcattttcatacgacttcactcccattactttcgtttcatcatataagggggatgacatcgcttttcgaaaccctcgtgaccattcttgcaattcaggaacttgcattttcggaacagctggtaaaactaaataagacggcgttccaacttgtttatacgttatatggttcgttatgaatccaaagggatccgtaatgacaatttcaacttcttcccatttcgcgatgcctctttttaacgctacagcttgcaaatcaaatgaaactgactcccttccttttaaattaaaattcatataataatttgaacctgtactataatttttgtttatttcatcatgattccaagttagcttattttcacatttaaatcgaaatacgatattaagaataggaaatatcgacttgtttgaaattttcattttgcacatattcgtttcacctataaaaacattcgaactcccttgactgtattcccattcaacacgagatactttacgtatatatacatgcatagcacctattaaaattacatataaaaatacgagagataaaaacagtagattgcttgaaaatacacttaaaataacggctacaactgacataacccccattacgaaaggctccgctaaaggtgtatacacaagctgttgattcatcgtacattct

SEQ ID NO: 2594 - DNA, 2736 bp, Bacillus thuringiensis
tatttttaaatactaactagaaataaaatgtttattcactaaaattttttcaagatttgtaatgctttatataaccaataatgatttaaaaaatatctggggtgtagcgaagttaacaattattgagaaacttttttgtcgtattctatcaaaaggaagaggtagaaacaaagagaataacgagagttaaggaagagggtatacaactagtaaccttctaaaaataaaagattagctattattaaggaagggaaaatataaaatattataaagaacaccttctttcaaaaaaatagggggagtaatatgcgactgatgagaagatgtgtggccttactaattgtattttttatcatggctccaacgattagcacaaatgtacaggcagaagttgtaaaagagcttggaaaggggtttcctgatacagaagtattcacacctggagaatggtttttaggccaaaaacctgctaattatgatgagaataaaccgccaattctctttgtacaaggaagaaatggtaatgctgatagttggtatggaaagacagtatatcatgatataaatgatatgtatgattatgctttaaaagcaggttatcaaacagtgtttatacaattgtatgatgctgcagggaaaggttcggctagtcagtgggataacggaaaattgttagcacaaaaacttgaagaaatatataattatttcggtaaaaaagttaatattgtagcgcatagtaaaggtggtattgatacacaagccgcattagttgaatatggtgcgaatcgatttgttggaaatgttattacacttgctacaccgcatcacggctcaaatttagcagatttgtcatatagttggtgggcaggttggcttgcttctatattaggtcaaaaagatgatggtacgtattcgttacaaataggtgaaatggcaaagtttcgttcaataatagataacaacccagcagctaaattaaaccgttactatacggctactggaactagctgggggccaacattttctgcattatctatgggcgggttatatttatcatcgtacggttcaaatgatggactagtaaatgaatggagtgcgaagctatcgtacggtacacatttatttacagattccagatttgatcatgacaatataagaaaaggatcagctgtttttgcacgaattgaaccatatttacgtacgacaaatgtgggattaccagctttagtagcatccagcactagttcaaatgaagatctagaacaattaaatacaacttcaaatcaaaatattttaggaggcgaattaccacaaaatcagtggatagagcaaagtatttctgttgataaaaaggctgaaggaatcgtttctgtactaactgcttcttctgatgtagaagtacaaatggtatctccaaaaggaaaaatctatgcaaataaagatagcgctataactactggtgaaggcgaatctttctttaatagggcgacaattagaacatttaagtttgataaattggaagtaggcgaatggaaaatcaaaatgatggcgaagcagtcgaaagatgcatatttagttgtaagcgattacaaggatgacgcaccatttgttcttcgaatgcctacaaaagttaaaataaataaacctgagtataaactgaaaaaatcacctgtagcacctgaaatgaaaggggatctttccataacagtaagagtcgttaataaagaaggtaagttagtctctgaatttaatgaattacaaaatgttaatacgaatacatttacaggtgctttgaaagatataaaacaaccgggagtatacaacgttacgatggatataaaagggatgaataaagaaggaaaaccatataatcgtacgattgttaagtcggtttatgtagagaaataaggaagaataaataagtataataaaaagtgcagaaatcttgtgttagaaagaattctgcacttttttatgtggggagagataataaaagttgaaaaaactgttattcaataaaaaaagatgctgaaatagcatctgaatgtgaagaaataattttaacttagttttgtaactgttaattcaactgaatttataccattgtcacaagttacaatactttgacgattaaaaccactattatttctaagttgaagagttgaattagcaggcactgtaacaattgtttcgccaacgagttgaagacattcgttatttgatgaagtattcatttgaatagcgaagtcaccttgactattagcaagtggattgttatttaaaaatatagttatgactgggatatgtggaaatacaggatttaaagtagtattaatactggaaatgaacgaaactctataatcaccagcttgtctaaagtgtatagtagtaggatttagtaaggaaacacctcctgctaaaggtccaacgtgattaaatggaaaaggatcgccataaggatcagttatatattcagtctgccaaaaagtcccgtatgcagaacagcgtcgtttatgtgaatggtcacatgaacattttttatttgaactgaaagaagatttgcatgagcatttcttatacgagtttgaagaatgatagtatgaacccaaaatattacctcctattctcaataaatttaaaccacatagtagtttatgaatatgcatctcaattggcgtgtatgcctgtactataaaaggcaatagatttggaatataaagtggtcaaatgatgaag

SEQ ID NO: 2595 - DNA, 3231 bp, Bacillus thuringiensis
actgtacaatgtctagttttagaatgcaacattcccatgtcaagttcattaataatacgacgaatttcctctccatcaaggtctttaataaggctttccacagcgcgttcatgctttgtaagatataataaagcatctgctatcccttctaattttaaatcttttccaaacttatcataaataatgttaatttgatgggttctttcatcaatattttgtgtggatccaaacaaaatgttagcaaatccatctgctataaatccaaaataatctctagtaaaaatttgagtactcagaaaatttatatcttgttgatttatatgaatgtatatatttgtggtttcaatcgacttatgattacgaaggaattttaaaagttctaattcatgcgcaggacctttttgacttttaattaaattataggcaagtgttataaaagttctattcatttttaatgatgaaaatttaaggttttcatctggaaatgtatcaaaaaaagccttataaggataactagtgagctgccgatttttagattgaaaatcaattaacgaatcacttaaaggattaagaattcttgctcttatttcacataaaactgctgcatatgcaataggaaggattaattgctccgaacaataaaaataacgatttgcaccagttttagaatgctttaaattcttaatttgaatcttccttattattttcttggcatcttcaatacttaactcatgattctgaatccactctatactgtcaacaatacctgttccctcaaaatttattctaggaatttgcatacagtcccaatgtctccaagcattatttaaatgtaccaatgtatacaaccaaactgattcatagcgattataaaaggcatttcttgaattattttgtaaagactttaataacacttcttttacgctacttacagctttttctttatgaatatctagattagaaatatatttaaaaaactccataaattcttctaccgtataaatttgcggcgctttcttcttcttactccttctcttatacggactatttatgttactaattgtaaacattttcttttgtaaagcatatccctccatttgatcaatttcccttaaaaatatataaagtatttttttcactttttctttggtattattattaaaaaacatcaaattaagctctttagaggagtacataaataactccttatcaataatcctctcagttaagaccctcgtaacagaaagatactctaacaaccttgcatttttcgaaacaaaattcgaccctgagtaagattctgatttaagccttataaatttaaaccacaatctctctgtttctttacaaaaaccagaaaattccacatcttccgcatttaatctgtacataaaattatcatatatagaccccctatcaagataaaggtttaaatttttattccgtcgctcatattctttaataatgtcctcttttaaatataaatatctaccattaaaatatctaggaattcccctcattaataaaggtatctccattgtctgtatacttatccgaataacatccacgtttatattaaattcattcaaaatttcctgtctagtatagtactttaaccttagctccttatccatttcctctttttccttttttaatgaaaaaatttcttcttttctaaaaaaaacatgtctccctattttctgactgatttttaacaatccttcttctagaagttttttataggtatacacgtttaaatccaataatttaagaacatcattcaatattattaaatccttgttcgatatatttaatcttattttctctcctaatgttttacttctatacttcaaaaaatttctaatatccttcttattgcaaaatgtgaactccctttttcttataaattgtatctttcttatattaaaactattgattacaaatatcgcttgagtatacccaatacctgccatcttcataaattcatttatcgtcacataatttttcaaaacatcaattatcttcacgctttctcacatagcgtttcgcatacctatattcctcttgattattcaaggtgaataatgggtatttcagtgttcttaagtatatttgaccttctttagaaagagaaacaaggtttttataatatgcatttaataaagatctgttgtcaaggttttttagtcctacgtacgcccaaaattgctttgtagtaaaatattctttgctaaattttctttcccattgcatatgtttgtttaaatcttctctatgaataaaaaccttttcattcttatattcaactctaataatatttttttctacaagaaaccttagactgttttctgttagcttgtatttcaaatgattcaactcaatatattcttgaaccactatttaatcccccccaattactaatataccgatcatatacctgtctcttattaaaagagtcctcataaaaaccaatatcatccataccctcaccatatacactagaaagaacatttacgtgttcttgtaccttactataagaagttctcttctcgatatattccaatgttgcagttaacgttctatccccccttagattagcaatctcctcaatactcagacctaaatcaataagaaaattggtaaaaacacctctacctatatgcgtggaccaaggaagacctgttaaaaattccaaatcctcgtaacggcgatttattctcagtttttccaaaaaacgttccttgattcttaaaaatcgcttagcatatccagtaccacttaaagctagtcccgtacttttagaaataaataacgccttactttcattacttttaaattgttttttcagcttttctaatcgttctatatgaatgtgataagcctgccatagtttctcatcatctaaaacaaatacttctctaggtctcttgacttgcacatcatacctagatgataagtgcttgaataaatgttcttgattatcttctattactaaccacatcccatcatttcccctaaatcctttttcgtagatagattctcttgtcaaattataaatgctaacttaaatatgtacattaacgcttgaataaatatgtacattttcaattggattctccatactgactctgaggtgttagtatgtatattaagctagatattcaaacagaattgagggtaaaagtcttcagacttacaaatttaaaaactaatgggaactaaaaatgagat

SEQ ID NO: 2596 - DNA, 2536 bp, Bacillus thuringiensis
ccacgtgtttcacagcaagacttagcgcttcttttgttgcattacgtacttgcttatgtttatatttaaatgctattgcatgaatagacataagtgcaagcttagatgaagacaaacctaaagcacgaacggcatccgctgctatctttcctctcatttgaagcacccattcatcaatttgctttataagtatgtcgaccattttgtcgtcactatacattccgtataacgaaagaattccacgtttcttcacatctgcgtcttgagaaatccatatttgatatattgtttgcacatattcttttaagtcctcttcatttaaagctctaccaattacttctgctgtttctttcttctcaataacagcatctaaaatatactgttgtaaataggctaacggaattgcagcatcagcaatgtcatcagagtcacgtaaacggatttgtggctcatccccaatcaattgcagaagtgaatttcttgtttgttcagttaaaatacgtgcacatagttcttctatcttttcttcctccggtttgaaataaaaacgagaattttcctgcgaaagattcatttttactttcttgcaaagcttcctgtacaaatttcgtatatttttcaagcttatactctataagtattttcatcacattttcacgaacaattttctttttattatgaagttcaactcccacatctgctgcagcttctacctcttttgaaagcagttcaactacagactcacgcatttttttagatgaatctcctaagcttttaattaaaattggacgcattttaatcatgttatcctttgctaactcttctaaaatatatgctttggccacagcagaatactcatcaaatcgttcaatgatgtacgcttgttcttttacaattacacaaacaagcgcttccttcgccttatttcgctcttcactgtagcatgcagcttcttcaactgcataagcgataagcttttccttacttaatccatacgaaagcagatcttctaatacttgtttcggttctactcctctgacagaacattcgtaaagaagttcgtataaattaacactatcttcatctccaaactgtagtgtaagtacagcttccctcttcgctatatcatctatatcccaaagaagcgcaacctctaacaccggcataccccaatacatacttctatatttcggatttttaaatatttgctccatatcctcaagtgacaacttccctagtaaataatcacgatatgtattccgcactgtagacaatttaatttgcaaagcagcaacaaaaaattcttctcgcattttccctctatttagctcatatcctttttcagctagcgttcgtgcgacgatgagataattcattctacttacatattgcaaagtacattgaataaattcaggattttcctccaacataaagcatagcaattcatattcatacgtcttacaaaaatcctcactattcaaatcatgttgccttagacgatgcgcaaaaaatcgttccttagaaatccaaaactgtgtacaaaaactttgaatttcttcatatgtttctctatttacactaccagtttttttgtagttttgagactgaccgagagtgtgacacatataacgtgttgcatagtttataaaaccccaaacatttttcttcgccaatatttcaatatatcgcctcgcaacattcgaatatttatgaacacaaaataatagccgccaaatatgttccggtaaattcccacctataaatacttcactatcatctttaccttttaaataccgtttaactgcttcaaccttttccttttcccctagcagtttcaatataaattctgtatgttcttctaacctctcattcaataaagaactatatgtacgaaacttttcataatctacatcaaacattacaagaagtaatgttacttgctggttagttggtaaagtatgtaattgtccctctatatagttcggattctctcttgttaactctctaagaaaaacatctgcttcattcacataacttgaaatactggataaatatttacatgcgattgctacaagtttgtccaaaggaagtgcacttttttctaaataaatcttcattttagaaaaactgacatgcgcaaaacggactacaagaacatttaataattgctcctcgagtatatggtaaaataatcgaaaaaaatccggatcttgtttatgcactttcctaaaatcgtttataaatcgctccgcaaaatcgcttcttttttgatcacgaattgtcgttagttgaatatcttttaaaatctcttcttcttttgtctgtaaatatcgttgtgataattgtttctgttcttctgtcatattaatatattgaaacaactcagatgtactagtagtcaaactttgtaccccccgcatctttttatctattataaaaatacccttatttaatggtagtatagcataaacctcacaaaaacgaacatacattctatgttaagttaatgtaaattaaaatacactactcaaaatac

SEQ ID NO: 2597 - DNA, 3115 bp, Bacillus thuringiensis
ttttataaaaccaaaagtgatagtcagagatatatatattattatccaatacgttttggtggcatttgacatcagtaattccaataagaatggagagtttcttctttaaagaggaattgtatatatataaaagatgatagatactttctcaaattacctagaataaaaaatagggggcaaggtggaaaaaaaagtaattgatgaattggaaatttcgaaaaagatttattccatggttaaagaatatgtagaaatgacagaggaattcggctattctgaaactctcttatcttatagagcacataaggggatattaaatgaaccgatattacgtagaaatcctgatatattcagatgtaatattttcagggatcttcttcatgagttttatgataaggtaattactgcaccaccatataattttacagttagaagcattggagaagactcggaaaaagaaataaggcagggcagaattaatggggtaaactttgattttgaacgccgagtaagacctaatgatactagacatcttgcatttttatccttaatgatacaagggttccatcctattgagatagctcgcttagggggacacgatacaatatactcacaacgtcactatcaacaacatgagttttttcttacagattcagggatatctaaacttattaaaatgtttagtcttacaggtcaaccgttaaaaaattcagttttttttaatgggagttcacgcaaggcagggcatattggaaaattatttagagaaagatttatattttcaccagcaaaaacttcgaaacaggagtgggacaagcttgagattggctattgtacagcactaataaaggattgtaaaacacagtgtttccggtgcttcgaatattggagaattgagtatgatgaatttttagaaaaaagggaatttatcgaaagatggatgaaagagagtcaagaggaagtgctcaccttatataaaacattgcttaatctacatctgaaattagttagcgatacttataataaaataaatcccaatctaacaagggaattagcaataaattcaaaacaattgagggatttattacagaatatcgataaattttataaaacttatgaaggttggttgtaacatgggaaaggtaggaagaaagaaaaaagaatatccagaggatgaaataagaaaaattatattgagttttgtaaaacagaaaggaattaaatctgaagttcccaagattgctttaagtaaatatgcgaaaatcctttatatggaaggggggcttccttggctaaatgaagagatatctgataattattgggttcgatcagaaagaaggggatttcaattaattgaggaatataatactgttgttcataaaacattagcgcaaaataatcagattcaagtaaatttaccaaggatagaggatattgtacaacagaatgttaaggattcaaaacaactattgaaacaacttcttccttaccaaagagaattaaagataagtcaacagaactatagtgtattacagaaagaattaagtgagttaaaggacaaattaattaaaaaaaatgcacttattgcaattcttgaaaagaaaataaagttacaacaagaaacaatttatcagatgtttataaatggttctgttacaaatccaaagcttagaaatttaatgaaagtgggagaagaagctgattctgtagttaaggaagctctacagaacatattcaatttgaaagcagatgaatttttggatttgaacagctctgttgttaatactaaatcggaaaagattgtggagattaataaacgccaacttaaagaatcacttttagatgatttccgtagcctgtaaatagtatttaaagtgcttacattttatcgagtaaactaaataaggaattcatatctctttttgattaataaacgtgtcacttttttaataaagcagttaatttgaatatacattttgtatattttaggaagatatttaaacaaaggtaagaaaaataaatttgaataaatagcataaggtaatgattgacggtacttatatataatacattttgtaccatcttttttttcaataaatggacatgaaagaggatgttttctaaaataaagataaggaaacaaatttttcctaaaatcgtggttatactcaataaaaatatattagaaagatttcaagaattttcaatttagtaaactaattataaagtggaggacaagatgaattttattgatattttaaaagatggaaaagataatggaaacgataatgaaaaattagctgttctatatgaaaagctgaaaccagatatagttaatcatttgaaaaatattactagtacattgcctgattttgatattcatgatggttcacattcagaaaaaatcttgcaaaatatgcttgttttaatagatgctcaaaataaagcaaaccagtttactggatatgaattctttttgttaggattatcggcatatatgcatgatactggtatggcaatgcctgaatgggaagtgaaattatttaaaatgattgaagggagtcatgaatttcctttatatgatgaagacttggatatgaatttgaatagtgatttaaagaaacctttttctatcattgaagctaaagattttattttagagaatactcaaactatttacggtgattttgcaaaaataaaaaattatatatttattgagaataacgaagaagattttatatcgaacttggctaaaaaggtgcgcaattatcaggtttttaggtctgggtacaaaagttcacttagagaaataagagatctcaaagaatataaaagagagagcctcaacttaagatatgaatttattcgaattaaccatcatattttttcggaaaagaattgcaagaatctaacttcgaaatttcaagattctttaggaggaacatggggcgggaagctcgcagaggatttagcaaaaatttgcttagggcatggattagattattcagaagtcaataattatgaagtgaaaagcagatacctaaatggaaaatatgctaatatcaaaattcttaaccagaatgttgagattggcggatgttatacattttagcta

SEQ ID NO: 2598 - DNA, 1733 bp, Bacillus thuringiensis
tgtgtgatagataaaattaaaaatgctgtagaggatatgtacgaagatgaggctaaagatttacttcaaagtattctcatacagttaaacttattagaagaaaactatagtgaagatacaattaaaaatttgatggatattccgaaacaattaacgagtaatcctacttataaagggaatgtaaaagaaagtacgcacgtacatattgcttttgatgattcaacggctggttgcttaaaatatatgttaagtcaagaagaattatttgaagagagtgttgttgctttttcggaattcttttcaattggaccgatatataggttgcatacgaatgaggggcaactagtaagacagaagtggttaataaataacttaactgcttatgatagttattttgaagaagaatatttatcaagatttatagcaactatagaagaactacatactattcctgttgaaacgcctattacaatttggaaggctgataatgcacatgaacatgtaggcctaagttttgtaatggcacaattaaaggataagaaaaacattcgagttattaatacgtctgaagcaagtagagaaatattaaaacaagagtatgatattcgtggaacgggagaattaccacctgaaagtttagctctattccaaaaaagttttataaagctaccttatttaactgaagagaagcgcatgaagtttgaaaatgagtgggatagattatcggaaagcatagaatgtttaagagtttggaaagaaaatgaagtgcattctgtacaggaagattattttgatcaatttataattgaatgcgcgaaaagtgtgggtgctgatcgagagttccttaaagctcctagagtaattggtgaagcacttggtcttgttgaacagttagttggagatactttcttagaatatcgcttgaaacaattaattaaacaagaagtatttgaatttgaaggttcgttagatgaaatgcgtttttatagtgtgaagttaaggaaataataaacacattctatttttgaaaggctcgtatttttaataatacgagctttttaagttgaatttgggctatacataagcttcccagagagggcatatcacatatgaatggtaaaggtaatgaatgaaaagaaggtgatttgttaatatgtataaccaacaaaattatccatatgatcaagcgatgtattataatccacatgactacgggtatgaacctacaaatgaagtgagagatattgaacaagaagattacagaccagatgatgcagaagatgctccaacgtcaccacctccgtcacaagcgccgtcgttaccgtctacatttgcttctccagcacaaccaggtaatatgaaatcatggatgtgtaactgtctaggaagatggggctatttacgcttacatcgtcctggtcctttcggaagagatttatggttcttcccgactgaagtgagaagaaatggagtgtcaggttacacgtggcaaggtggtcgtcgtcgtaaagtaagttatcgctatcaacaaattagtaattttatgtgcttcgcataaagagaagtgggagagtgaaacgattttactctctcacttttttatttttcaatatacgaagtaagattttgattaaaaatttacaattttcacgtttttattagagtataatgcatatgttgggttgattttcaaaaacaaatgagagtgagggaatacaatgacaatgaaaaac

SEQ ID NO: 2599 - DNA, 2842 bp, Bacillus thuringiensis
aacagctactggggcaagtcttttggacatggtggtttgtttgggataaatcgattcaaaatcttaaggatactattcaaaaaatccagtcttctggtggaggtgcggctaacggtaaacctagcagtagcaaaaatacaactgtagataattttgatgcaaaaacagctacaaataagcaaaaaggtaattatggtgaaataaaatctagtgacaatttattgaataatcaaagtttaaaaaaagctggatttgatttaaagccagtcggaaaaagtgcaccatcaggcataaatgataaaatagtaaaaggaattgatggattatacgaaaatgcaaatgcagaatcaaagatcaaatatgttattgatgaagcaaagtttggtagttcacaattggggaaaactaaagatggacgacaaatgtcaaatatggatagatggttctagacgtttggaatcaactgttggagaagaaatggcagataaaattcgagaagaaatgcttttgaatcctgaaaatgtacaaaatatactaattaatgttgacaaggatggtaatgtggttaaaaacattttggattcttctgggaagaaaataattgagtaaggagaatgaaatgagagatattttaaaaaatgaagattatttcgaggattatttaaatagacagaataatagaatagaaaaatataaagaattagcaataaaagtaaaaaatgaaagatcaaatgatttaggtagtattaaaagagcttatggatatattgaatcaatttgtattgataaatttaattgtttatattcaatgggaagacctatggaagtactaagagatttttaccccgaaataattgaggcgatgaaaaaggggtggagtggcaaatatagatatgtagatttattgtgggttctttctattgggataatgcttgatgtttcaaaagattatataattgaattagaaaagttggtagaaaaagagaaattgaatgattagttgattgattttttatttagttataaagatgaaaattgggaagggaataccacagaatttatctttgtagacccatataaatcgatttatcatgtgatcaatgcaaagaataaagaagaatcagtaaaggaattgaaagaatatttagaggggaaatggtataaggggcatagtgatacaggctggtatgactcacatgaaaataaaaatgatatctacaatggttattggagttacgaaagcggagcaatcgtaaagattttaaaattagatgattcaagtttaaaaaatactttatactacccttatgatatggtgcattatcaaggaaaataaatgtaagaatccacagtgttcaactttttacactgtggattttttagtttgtgttaaagtatctataagggtaatgttggtaagggatctagtgagctagaagtaagattgatgcagaactaattaggaattatcactgttttttttatctaaataatcataatatctataggaggaatcaaatagaatgagagattatttaattatagaagaaaaatgtagagaaggaattgaatataataaagagtttattcaagaaaataaagaggatattaaaagtttagaagaaggtgagaaaaagggaattcaaagatattctaaggataataatagtattatagaaggaacctacttatcaagctttaattatgagttagaggatattattgcaaaatattccctaggagaagctatccatacaatagaaggagattttgacaacgctcttattgatttgaggcatataggggaaaatgaagttggatatttaaatctaatttggatgatatctctagggattttattagagacggagaaaaagaatcttgtaagtttagctaagctagttgagaaagaaaatatgaacgatgcagtaatcgatttcctcttatgcgctagtgatattggatacacaaaaatgacgaatgtttattttaaagaaaatccatatgcaaaaacgagagagattatagaacttgcacaagcagataaaaaagaagcatctaaaagattacaaacgtacatggagaaagaatggtttaaaggccattatgattatgaatggaaaaatgcgcataaagaacctggatatgtagggtattggagctttgagacagctgcaatagtaaagatactcggacttgatgatacaagtttaaaagataataatcattatccatatgatttggcacattataaaaatgaaatgaaattcaagcatatagacctaagtgaatatcactatgaagatgagacagaagaaatcgaggatatagtagaaggaattgaacataatcctgcattggaaaatattattccgccaaaatggcattcattggtcaatgaattaatacatgactatgagaatatggatgatagtagtttttatgaaaaatacaaaaaaacgataggaataggtcaagtgtggttcttaccacaagagtatgaagaagaaaatgaacaaaaaaatctattaggaagtttaattgtgtttgccctgacggtaagagattatatattacaactggactataaagaagatttagaagactacattgataatcttaaaaatttctggaatgtttcagaaacaaagttaattcaatttattttagagaatgatcaaaattattatgcatgggtaccaaaagaagcaaacatcccaaatatgtatgaagtgaagattgagagtgtcgatgtagaggaagttctataataagcaaattaaaacattgtgcatcatgagtaatgtttgaaaaactattttatacggaatttaatgaatta

SEQ ID NO: 2600 - DNA, 3202 bp, Bacillus thuringiensis
gatttctccttccataaatagtacacattgcccctcaagtaatccttctttaatttcattccatgtatatactattttggtatgagtagcaataatattagaattaaatatttgactgtcttcattcactttttgtaataatggtgtaacaacattgctttttaatgcgacactatctgtaagtccttcaaaataatatagtaaaatatttgtgcttgtttttaattgcaaaggatgttcaattaaatctgcactaatatcaaagatattatctagtgtatttttaagttgttttaagttatttgtttggatcttttcaatgtttttatctgttttagtttctaaaatctcttcatttaaagacaaaattgacacctctttaatatataacgattagttgtatttattatttttataagatggaattttattcacaaattcaattaaattgggaacggaaattaataattgagagcaaaaaaagtagaggtgatttgtgggggaatctaagtatcaagatagaattgaaatttgaatgatcataacaaaaaagaacccttgataggctctttttcatagttgataaatatattgtcaacaatagatggcgtttaaggtagtaatttagatatctttaagttcatcagctgaattttgtaggaagaactcttttttcatatcttaatgctcaattaaaaagacagtacatttatttgggtgttctagtgtaattaaagtttgcgcgctaacaaattttgtttagggacaaaatgttttttctgaattaacagaaaaaacgcgcaaaattcctattaattattttggtaggtatcaaatatttctttggccttattttcttgatattaccgtacgtttatatgtttctaagggaaagaaatactttcatgttaccatctattgtttgattaagatggtaacatgaaagtgaaacgtttacaaccagaaaataaagaaaaaatattaaaatacgacttttttcgacaattattctatgtctatatttaattttattataggaaaaggcggagggaagcggaccttttcctataaactgttttgttggaattagaaataactaaaaaagtaataatagcttaaaattaaaatgaaattcaatgataaagttattattgaatttttgaagctcagatatcttgaaagtatggtcaaattttaatccactttgcgtttcttccttttgtaactagcttaatatggccaaacagttgcaaggaatttaaagccttactgattgtactctctgcaatgtctggataagtgttacgaatactttccttagtaaagggttgtttttgtttaagtataaaatcctgaattctctcaactttagtatgtttacatatagaatctagaactgtgttatgaagatctttgtaagcctctaatataatggttaaaaacgtttttaaccaaaagctattattatgttcctcgcagtaccaattcaccgaagatttataaagcgaattgtaataatcagattcatgtttcttaatatatttatccaaacatacatattttacaaatgtatgtccactcttaattaacagcaattgcattaacataaatgccagcctgttattaccttgattgaaagggactatgcaataaaaatttaatataaaacgagctattaataaaagtgaatgtagccccttactagtatttaatgagttgtattgatcacataattgctccataaactgtggaataagttcatgcggaagaatgcggtaactattcaagtgcattccatgttctggaattcctggaatgataaaaggtttttcacgccatttggcactgtcagaggtaatgtaatgtattagttgaaaatgtaattcctgtatagttgctggattgattaataaagtacaggagtttttatgtacaaaagaaagtgtttgataatagcaaaaaatagcatcttccgaaatattttgaggtacgatatcatctaaaataagttcttttaatcttttattaggaacttttatatcctcataaatagttgtgaaattttttatgtaatgtagtggtatagttttttctaagctattaaatatgtctgggttttgttcctgataagcagctaattttcctttgaattcgctaatttcacttattaaatttattaacctcctttttaattcaatatttttatacttatcatcaaaaaagtctctattttttgttccccctgtaagcccttaacacgttgttgcatatatctttccattctaaaggtattccacgaaattattgtaaaataccgacattttcgttctgattttaaatatatatcagaatctatatttttatttaacaattaaaacatggaaattataaagaagaatcgttaggattcaattttaataggcataatcctaacatcaaatgtacaaatgtacaataaaaaaataaaaaatataaaactagcgactcttttgaaagattatttaaaagggttttaagaaattgtaagtatagagtgctttagtttatcgataaatattgaagtggtaataaaattttcataggtaatcataaagtagataaactattaatttgtgacaattatgtgtctaatctattatatacttttatgagaattctaaaataaaatcctaaagagccgaattttctatatttatcataaagattagaagaggcgtgttgatgaaatgtatcattttatataaaaatatgtaacgtttaatactcgtattgtaaaatattttgacatccgttaatttaaatattaggtacaggaacatttaataaaaacccagtactaaaataccctttaaacgtttcaccctaagaaccttttctaaagcacactgaagttcatcttttgtttctgtgccttattagataaaaataacacaataaattattaaaatttgatagttaaaactagatttttaaatactttctcttttcttaaacgttaacaatttcttgataatctgtttaaagtaaggaaatacagaatagaaaatagctattaataaagaaaatacagttaagctagataccttaagttattttataagtaattaagcgttagtttgaattagtaggggtattatatgtgttttaacctaaagtgccccatctttaaggttaaaggatttgtgagaaataaaaaagtagc

SEQ ID NO: 2601 - DNA, 2535 bp, Bacillus thuringiensis
acaagtattaaaccatagacctaactatgtcttagtaaggctttattttttcttattattcccttaaaatcctttttataataatattaaaaaaccagtataatataaattactgttctctggcagggttataatgtctgataagtataaaattttcattcttattgttaccgcatctttttctttcttttccttaataaaagatttccgcaacacttcaaaaagtttcttttggggtagttttgtaattcttacaagcttcataatacttttaacactcgctttagatttaactcaaatactcctatattcagcgcaaattgcgcttgaaattattacaataccacataaactctttctaccatctgtcactgaagccgctattatttactaaaaaagtattttaattttcttatgcatgccaaaatatattttggtaaatttgacacacatttatatcaaacaagcatattttattgtatggtgactatctaataatacaaatttttaattttcataagatctttttatttttaattaaaaatttacaacattctaaaacagtatgcacataatatcctccattccctttttcaacatgacacttgtctcagagcgcctttaaaagcgctctttatctttaataaaggttttattaaaatttaggttaaaaattaataccctatagtcataatagctatttactgtttccaaaataagttgcattaataatatagaaatgaaatacctataaaaattattactttactatttctttaaacatgctagtgaggtgatttcgatagattatcaaaacaaagatatgttcattaacttttcacttttagatattaaccgtattattctcccacattctcctactggggctaccggctctactggagctactggagctaccggacctactggagctaccggttccactggacctactggacctaccggttccaccggacctactggctctactggttccactgggactaccggggctactggagctaccggggctaccggggctaccggggctaccggttccactgggactactggctctaccggggctactggagctactggagctaccggggctaccggttccactgggactaccggggctactggggctactggagctactggttccactgggaccactggagctaccggacctactggagctaccggttccattggacttactggctctactggttccactgggactactggagctaccggttccactggacctactggacctactggatctaccggatctactggctctactggagctaccggttccaccggacctactggctctactggagctaccggttccaccggacctactggctctactggttccactgggactaccggggctaccggttccactggacctactgggactaccggggctactggctctaccggacctactggacctaccggttccactgggactactgggactaccggggctactggagctaccggggctactggctctactggttccactggacctactggagctaccggttccactggacttactggctccactgggactaccgggactactgggactacccgggctaccggttccactggatctactgggactaccggttccactggacctaccggggctactggctctaccggacctgctggacctaccggggctactggctctactggttccactggacctactgggactaccggatccactggagctaccggggctactggctctaccggacctgctggacctaccggggctactggctctactggagctactggacctactggttccactgggactaccggggctactggagctactgggtccactggacttactggctccactgggactaccggggctactggggctactggttccactggagctaccggggctaccggatccactggacctactggacctaccggttccactggacctactggagctactgggcctaccggggctactggagctactggacctactggacctaccggggctactggctctaccggacctactggacctaccggggctactggctctactggttccactggacctactggatctaccggttccactggacttactggctccactgggactaccgggactactgggactactgggactaccggggctaccggttccactggacctactgggactaccggttccactggagctaccggggctactggagctaccggacctactggacctaccggttccactggagctaccggggctactggagctaccggacctactggacctaccggggctactggagctaccggggctaccggttccactggacctactgggacaaccggggctaccggttccactggacttactggctcgactggggctactggatatactgggactaccggggctactggagctaccggggctactggagctaccggggctactggagaaaccaaggctatctgaat

SEQ ID NO: 2602 - DNA, 4030 bp, Bacillus thuringiensis
ttttattatcacatggaaaatcaaagatttctttaaccaccatagccataaatggtaatgttgctaactgaaaagaataaaatacggtcacaatggtttggagtttctgtaatttaaaagcgagctttttaggcatgaataacattaaaaaaatgaactccaaaacatacaattccacttcagtttgtacaactatcttctcaaaaggagttaaagaaatcttatcaccatttagcaaaagaattaaaaacataataagtatgggtatagaagtatatgcaaaaactcccccataaaagattcttatataatccggacttaatcgatttctattttcaatttcaaaaagacccatatcttcttctcttatattccacattcagttttttcaccttctatatagtttaaataattctcatacacttaaattctatttcacccttatttacttttcgttttgaattttttattttgttttcgagttctcccacgcattctctcattttcttcccaagtcatattaaatgatttaaatttgaatctacagtacaccaatagctggaattctgctgcaccaacggctactgtatatagtaaaacagtacctattacatatccaataaaagtatcaaacgtataatcattatgaaaataaatcaaaataagtaggattaatgcgtatattgaagccactttcatcatagtctcttttgttttactaaaaaaggaagaggatctttcattcatactaaatgcaccttcacttgcctgtttaaacgtatcaatcgttgtcacaatatgaacaatcactgctcctaaaaataagaaacctacatatactaatgtaattccgtcgattgtataatcagacattccaggaagaatcagagctgtgaataatattgtacctaattgaaatgcatataataatacgacaatcgtttggaactcttgaaatttaaatcgagcttttggaaatgaatatagaattaaaaaaattatttgcaagctatatagcacaagttcaattttaacaattgttttctcaaataaactagtatagtagtcccaaccaaaggttactaaagtaccaataagaaaaaacatcataactgaaacgtacactattgttcctatcataaaacctaaagcaccctcaggacttaaacggctgctacatgttactcgaaatccatctaaatcttcttcttttatgttccacattcagtttttcaccttctatacagtttaaataattttcattcactaaaatcccattacattcctaatttttcaagtacattcatctttgtgtaactaaatttagataatcttttatgtatatcatcactacattaattaccgtacataatcagaatgcttttgatagttcaaatagccttctttctcctcaaaagctctaaatattcttctctctttcacttaagcatattcctcatactctatttttgtttcccccgaaactgcactcacttagtaaaaacgttactgtcatcacaattgtatcgagataatatagctttaattttatcttcagaaaggtgataacctcccatcaacaatatgctaggaggttattacagttatttaaaatttgttttttattttaatggattcgatttttgcaaataataatgttatttaatttgagagaagcgaatactaaaaacatactgcttaataactcgtaattaagtcttcaccctcatatctagggtctttctcaactttaccatcttttgttttgatgacttttagtctacctaaccactctgctccgttatatgtctcttcacttacccatacattatgctttttaccatctacctcaactactagtgtggggtgtgtaaatataaattcctcctatacgtgcctacctacaatttctgcatttaacgatgtaccttcttcaactagtttactattttgatacccttcgataataggtaatccaataaatacaaagaatatgagtccaaatacgattactttcttctttgtactccatttattcttttctttcaattccttctgtctcgcttctctttcttcgcgttcatccaaactctcatttaaagcatcttcccatgccttaatttccgcttcgatttctgcttcagctcttgctagtttttctaattgttcatcggttgctaccatctcatatgacttatctccaaccaaacgaatttcagcaccattttcttttacttttcgcaagtctttttctgtacaattaaactctcgaatgatttccccttgtgtgtttaccagtctaacgtaaatgctttttttctccttcttcttaaacatctgaactcccccttatttgtttcctatcatagataaccctattgcaattaagataaagaaaacgataataaggaaagtcttccctttgcttacttgcgttgtagaaccttccaagacagcccatctaaaatttggaaaagaagaatacctaggagaatataaaccaacttgttgctactcttctttagtggttattcttctactatcggttttatctgaactgcttcttttcttatttgtttcggtttctttttcttgcgtctatgattcattcaactgactccttttagaataactttttcctaactataaaaataccgaaatatcccattttcatcatataggataaaatgatttatttcttcacaaatagatttccaccataaaaaacagtctatgactattatttacaaatgttatttcaacttttattttattctttttctattcgctataaattcttgacgttctttttcatgttgttcccacgtaatactagatatttagattcttattcaatcaaaaatagactttcctctttccatgttggaagaggaaagtctatttatttctaaatatattatagcccttgttttattaataattgttacttattattttcagccttgttctttatcgtttttacaaattcatttcgccatattttaaaattatgagcaaattttccttcaatagaatttttatacccttcaaatttcacttctaaaatatcaaagtcattgaataatttatatgtctctgccgtcaaacctactgggtgtaataccccaccataatcatagaaagtgtcttcatcgagaagtattcctcttgtagtaattacatactctacatctttttcttcctcagtactcaacctcactacacttcctaaaggcaaaactttctccatataatctttcatattaattcaccgatccttttaatacgataattttctcttctattttttgtcgccttttttctaattggcggatacgatcaataaaagcatcacgtgttttaccttgcaaactattatcaatactactttctaatcttctaatatctcctgtcaaagatacagctgctttttcaagttgcataacaacgttaataatttgatctcgcccaccactgtccggaaatgtactatgaaccctcgacattatcatatgtaaatccatcctcatacccccttccttaacatttatcaataataagaaaccgaagctaactcttcatcttttgctatcatagaaattaccgcatctgttacatcttgacttaactcttttaaatcatttgaaagttcgttcacatctctggaaatctctactaataatgaacgatttaatcctctactaccatcattcataaaatagtttaataatgattggcgatggcttcttacataatctccagcaattgaagcaatatttgtatcaatttcaaagtcacctttaaatacatctaaaatatcttgaacaagagaagatgctacttcttttgcaattgctataatttcatcacgggataaataaagaatgatgcatcctactaaaaaatctacagctgcgttaaatactgattctaacacttcaagtaccttttccttacattttgctaatttattctctatccaatccacagccgcattcacctgatttctaacttcttgtataacttcctt

SEQ ID NO: 2603 - DNA, 1944 bp, Bacillus thuringiensis
tttcactatctatcatataagaacaaatcttcgtatgcaactaaaaatatttatgacttattatattctgcaaaatgaattagattccaatttaatcgacttttatcccgcgctcacattccttttaataacacatttgtagcacttttcaaatctaaattacattatgtttctttccatacagcatataattcttcttaatctaaagaaatcctttatgaaaaaggatttcttttacttcttaatgctttttaaccatttttcaaaaatttgtatcatcccatgttttccagctaatttctcttccccttgtttcgtcttatatggatataactgcaagaaaacaccgcatccagactcaatttttttactatgcatatggcttcctggatatacacaaatgacttcataaattgaccttcgataatagactcgctttccatcctgttcttctacatactttatagaccagtacttatacatttgctcagttgctttcgtatttccgacgtgctgaaaaatattgtacattggactatacttcacttcaataataatagaagatttatatacgtatttcccatcttcttttacataacagtctaagcgaatatctggcttcttcgtatcctcaccattgtaaaaattactacctttacttaatgcaataagaggatgtgtttcaattaagtcattaaatgcaacatgcacctttatatcatctcgttctaaaactactgtcgttccatcttgtaatccatctacataaaaatgttcttgtatttgttcacggatagagtttctagcttcaaaaccaatttgctctaaaattgaaataacgataaaaaaagcgtaatattcatacactaaaaacgttggcttataaacaaataataacgatggagattgatccgtatattgcgggagtacttctaaatgatgtagtaattgttgatgtggtatcggtaaatcatgtaagttcatgttacttgtttcagtaacttccctccaaaacgaagaatgcattaacatttgaaagtattgtacattttcatgcacaatatgcgccaatattttatattcttgtattttcattgagctctttcgtaaatcggcttcttttagtaaatgtatatttttatatttttgcttctctctatcagttaccgatccattacgctcaattgtttgtataatcgtttttacggcttgaaactcttctgattttttctttttttctctttctaagatttcaattgtttgacgtaaaaaactttttgcttcaattaaataatgataaaattgcatcgctttatatttaagaaatgcattttccttactatttttttgttccataaacttacgattataatatttggcataaggttttcgttctgctactatagttccttttcttgttggccttcgctcttttccttcccatttatattcatttataaattttgagcttgattctattttcttaaagatttgctttatcattttcattttttggggtaactttctaagtaacactaaataagaagaatcctcaatatcgctaagtgcagagaaggtctttttatagtaacctctatccaaaatcaactcatttaaaattgacttcacatagtcttgaatcatttcaaattgatcatcaaaaaagtttttcggtacgatttgaaatgcgccataatacgttgtatcttctatacgcacttcaaaatggtataaaccacagcgccatggataaaagaattctgttttcccatgttcatatattaatactctttgttttttttcatttatttcatattgagcctcttttatatttttctgtccctcatatactttattccatataaaagtaataattattgggaatttataattggactgcaatctattggttttaattcttgtactttataaatacattgaact

SEQ ID NO: 2604 - DNA, 746 bp, Bacillus thuringiensis
agagtgcgtaatagctcactagtcgagtgactctgcgccgaaaatgtaccggggctaaatacaccaccgaagctgcggattgataccaatggtatcagtggtaggggagcgttctaaggacagtgaagtcagaccgtaaggactggtggagtgcttagaagtgagaatgccggtatgagtagcgaaagacgggtgagaatcccgtccaccgaatgcctaaggtttcctgaggaaggctcgtccgctcagggttagtcaggacctaagccgaggccgacaggcgtaggcgatggacaacaggttgatattcctgtaccacctctttatcgtttgagcaatggagggacgcagaaggatagaagaagcgtgcgattggttgtgcacgtccaagcagttaggctgataagtaggcaaatccgcttatcataaaggctgagctgtgatggggaagctccttatggagcgaagtctttgattccccgctgccaagaaaagcttctagcgagataaaaggtgcctgtaccgcaaaccgacacaggtaggcgaggagagaatcctaaggtgtgcgagagaactctggttaaggaactcggcaaaatgaccccgtaacttcggaagaaggggtgctttcttaacggaaagccgcagtgaataggcccaagcgactgtttagcgtaaacgcggctctctgcgaagccgtaaggcggagtaaagaaagttcaacctgcccggtctggaaggttaag

SEQ ID NO: 2605 - DNA, 2489 bp, Bacillus thuringiensis
cgtttttcgttaaatcttctacttgttcccaaggtgtactttcatgggtttctttttgattcgttactgctgttaaagatacatcactttcttttgcaagatggacagacactcttgagctttcctgtacaaaccaattattttgcaattgacctggataaagagatagttcgttatttgaagcacggatttccacatttttattttgcggaagaacaagcgttggtttcacctgtggtgctgaattaaataacgtatgctgaacaggtaatgattttaaagtgatatacatcgtttctccagccgtttgaactgaaaggaaatcatctcgttttaaattgagtttttcatttgctttcgttgtcatttcataagttcccaaaagatgaatttgatttgtattatttccctctatcgttagaggctgatgtcctgcatctactacgatttttttgatagattcaggtatatcaaattgtccgtctggaatattactcgtttgcctcgttgtgttaatagaatgacgaacttcttctagtaatccagttgataataaacagtaaaaagcaattccgacacttcctaaaacgccgataaagaaaatactaaaaatatcatatttaataaaagattgctcttttttagagaatagaaggtatagtaaaacttcagctccaagtatgatgagtaaaactggccaccatgcagttagtgtatctaatacttgaattccttttacgactgaaaaaagtaaaaagcatcctaacgatataatagaaagccccattgagaatgttccaacacgccatgttctcattcttttgtaccacctttgttttctttatttccaagtaacaatttaaagccgccgccaattaagagaagtgcaacgatagatgtttggaaatagcgataatatagctcgctaagatgaatgttaaatatagttgcaaagtaatcattcaaaataggaaggactgtttgatctaataaataataaccaccgagtgtaattaacccgataccgatccatctttgatgattgataaaataatcgataatgggttcgtcttgaactcgttcttttccgtattttgctgtttgctgtaacgcatcaaaaaagctatagaaccaaatgattggtactaaaaataaaaacgcagaaagtcttaataagtcgagtaaataaatagatagtaagaaggccgccataagctgaagaccacggcgttgtaagcctaaatacatatgacctgctccagggaacatcgctaaaatagaagcaaatgttttacttttctttccctgctcgcggtgctcttcaaaatcttcgaaaatagtacgggcaattaattgctcgccacgttcttttttctgtagttgctgaacaacgtcaaagaaattataaatccataaaacaggtaacgtaataaggaagataagaaaactttcttgcgatgttaaaagtgcaacgaaaatgatcatacttccgattcctgtgcaagctactaaaaatgtaagtccgcgttgcataagtcctaattggaaatggccaagtccagggatgatggataagagaatgatataaaatcgttcgctctctttagaggaatttatcacttctccagcttcttgctttttcgtttggtttataatggtgataactaaatctagtaagttaattacccatagaacagctagtaaaaatagagaaagaaaagcaatatcacgttctcttactactatggtacaaaatactgcaaaggagaatagaaatagtgatcccccgctatataaaataaaccgtcctagcttttttaagtataaatgtccaagcccaggaattagccctaatacaagtgctaaaaagggatttttattcatgctttgaacctccgtcctttttcgatgtgtctaccgatttgtttacaatttgttgtgaaatagaagactcgttatgttttgaagatttctctaaatttgatgtcgctgtaaaaatatactgaaataaaccacttaccataaaaataattgtagccgcagtcgcaattatgtaatgaatgatcgtgcgctttagtgaggttgtttttatattttcattagactgtagtgtttcaaaattaatttgcgtcataacttcgttcgtaaatgaatcatcatttatcattggaaggttttcatgttgttcatcaatactttccatataaagtgctaaacaatgatcacattcataaagatgttcttccatagattcacgttcattactttctataaaatctaatgtataattgcgccaatcttcttttgaataatgcatcatagaaactcttcctccttccaatgttttttaatccattttcgtgctcgatacagtttcatttcgactgtttttacttcgatgttttcctgtaaagcaatttcttgatagctcttttcttctaagtaatgtgcgagaacaacgtcacggtaattttcgggaagatctcgca

SEQ ID NO: 2606 - DNA, 770 bp, Bacillus thuringiensis
cagccaccatttaaagagtgcgtaatagctcactagtcgagtgactctgcgccgaaaatgtaccggggctaaatacaccaccgaagctgcggattgataccaatggtatcagtggtaggggagcgttctaaggacagtgaagtcagaccgtaaggactggtggagtgcttagaagtgagaatgccggtatgagtagcgaaagacgggtgagaatcccgtccaccgaatgcctaaggtttcctgaggaaggctcgtccgctcagggttagtcaggacctaagccgaggccgacaggcgtaggcgatggacaacaggttgatattcctgtaccacctctttatcgtttgagcaatggagggacgcagaaggatagaagaagcgtgcgattggttgtgcacgtccaagcagttaggctgataagtaggcaaatccgcttatcgtgaaggctgagctgtgatggggaagctccttatggagcgaagtctttgattccccgctgccaagaaaagcttctagcgagataaaaggtgcctgtaccgcaaaccgacacaggtaggcgaggagagaatcctaaggtgtgcgagagaactctggttaaggaactcggcaaaatgaccccgtaacttcgggagaaggggtgcttttattaacggaaagccgcagtgaataggcccaagcgactgtttatgcaaaaacacaggctctctgtgaagccgcatggcgatgtattggtgggtgaccacctgcaccggtgctttgaaaggtttaag

SEQ ID NO: 2607 - DNA, 2007 bp, Bacillus thuringiensis
  unsure (1)...(2007): unsure at all n locations
tagctatccattgccgaatacagggtgcgttgtgcgagtgcactcttcaggtaatgttgtgcattttcattacaatggacaaaaagctatagagaaggaaccgttatggccaagtgaaattgttgaggagaatatcgttttagaaaatttgaaagctagacaagatatgagacttgtatttatagatttaacatactcttcatgtgagtatgaaaacggggaagaagtaaaagggtaccatcttgtatatgaaccagagcctagtcatgcgtttattgatgcaagtacaggtaaagatttatttggaccagatcattataaattgccttcggctgtagctgttgaaaaatcgaaaaaaggtaacgaacgaggtgaagtattcgaattatttgactggaataaagaaggttttacaaaagtagatgagacagaaaatgatgatgaaataaggatgaaatttgttccgaaagaggaattacaaaaacagaaagaagaaaagaatccatatttaatgaatgaattctttaaaaagcatttaccgatgttgaaatataataatttagttagcgttacaattgataaattaaccaatgaattaactggttttataaaactgacagatgataaagaagtaaagcaaatactgtctagagaggaatgtttacaaagagcacttcaatttttagaacgagttattccagatatcacacaatatctgcgtctttgggaggaacgtgaagaagcagaagatgggattgaaagatttatcttttctgtatatataaatgatattccggcagagtataaccaatttatgattaacatcaatgcagaaaatggtgctgttatgcactactcgggggagtctagcaactttataaaagaattgctcacatatgaaataacaccaaaagtaactaaagaaaaagcgttagaaatatacagagaggctatccgagttaaattagaatggtttttagatcatgatgcagaggaaacgaaatacaaactactttacaaacaaacgacagatgaaaaacataaagaaccttttaattgtaggcgggaaattcgttatattgatgcccaagcggggagaaagatttggagtaagtaaaataaaagagttatttttcaaagaaaataactctttttatttttatactttgcctgttcgtttttcaaaagtaaatgtgataggaagattggaataagaactatcacttttaaatattactttccattctttagtatgggctttaatttcaaaattaagaagattcatcgctctacgtttatctatttctaaaaacatattatgaatctctggttcttgctgtaaattaagagcctttagtgtgactgtaaatgtgaaaaaattctgtccttcatatactatttttgatatttttgttttttgtttatttaacagcacataaaaacggtctgatggagttaattgtacagagtcatcagtaatttcattttcgctattatgaagttcaactaagtaagatgtactatgggaagaatcttttttgcttgtaatctgtaattcagtaggaatcatcggtatttcataaaaatcatttcttattatgttgttgtaatcctctgaaaatttacgaacttcttttgggaaagagtcatcttgtgtacttaaaaaagttttgttttgctttggaatttttttactaaaatttaatgtttctttaaagtaataattggatccagttaaaaataaacaactacagattaataaaaaaattcgatacggattttgaaagtgaaagaataatagtatacatgtaataattccaattacatagaaaataaagataagtagttctagttttgagtgaaaggagaaaccatagttatgaaaaaattttattccagttataatttgagctccaaaaaataaagaaattccccattgaaaaaataatgaatcaggccaaattttattatcnaaagtaatgaacgaaatgaaaagtaaaaataccc

SEQ ID NO: 2608 - DNA, 5039 bp, Bacillus thuringiensis
  unsure (1)...(5039): unsure at all n locations
tgaagtactctgataatatttattttgctcaacattcttttaaaatgggaaaagatcagtatgtgaatggatttaaaaagtacggattttatgaaaaattaccaatcgaatacgaacttcctatttcaatcattgcaaaagatgggataaaaaacgatattcaactagcagacacgggctatggacaaggacaagtactaatgacaccacttcatttagcattaacatatgcaccgattgtgaatgaagggaatattccgtcgccacatcttttaaaagaagcaaaagtagcagggaattggaaagaaaatgtggtttctaaaaagaatcaagagatattaaagagcgcattaattaaagtcattaatgaccctgatggcgcaggaagaattgcaaaggttgatggtgtaacgcttgctggtaaaactggtacagcagaactgaaagagtcgaaagaagcagacggaaaagaactgggatggttcgcagctttcgatgcaaatgcgccagacatgattgttacaatgatgattgaagatgtaaaaggaagaggaggaagtaacgttccaggtgaaaaagtaaaacatgtatttcagaaataatacttaattatatggtgaattttttgactaaatttattacaggtttgcttaactcaaagatataaattggggaaaatatagaacaattaaatttcaaaaaagcattctcgattagaaagaatgcttttttgctgtgattctagaaaagttgacattgttaatggcaaatagaaggagatagcagcttgaaatggacaagtggagtgttacgttaaattcaaaaaacagagttttcatgagtagaattttatcattgtatgcttcacttgttttttagtagtattattctgcttgaaaaagataaccaatggaacaaatgaaacttgtatcttgtctatatattgaaaccataataaaagtgagggcagtttttatgtttattcaaataagtntgaggtgtggaaatggaacagacgtttattgaaaagtgtaatcatgatgagctggactatgttataaaagactattggcaagatgtatggaattattcatttattattacgaaagatccacacttatcagatgatatcacgcaagatgtatttataaagggtgttttaaaaattgggaattcatttcgaaaggagtcatctattaaaacgtggatattaaaaatcacaagaaatacggcaataaactatttgaaatcctcttattttaaaaggatatctttaataggattttttagtgacgataagcaatccctgtcagcagaacaagaattttttaagcaagaagaaatgaatgatgtgtggaaggttgtattagaactacctaaaaagcaccgtgaaataattatattggacgcaaaatatgaattatcttatgaaggaaatggctgaaacattaggagtatccattggaactgtaaaatcgagattaagtagagcgagaagtaaggtttcaaaattaataggggagggtagtagtgatgagcaataagcaaaatcctgactggtatagaaaaataaaaaaagggccaatggagaatcgtaaagatgaagaagaatttatttctaaaataaagcagtctatatatgaaaataatgaagtggattttgtaaaacataaaagaccatttcgtaaaaaagcattacctattgtagttgttttggtttgtacaatgttatttttcattgttcaacaaccttggcttgatgataataaatcgccggtacaaagtagtactcaaattaagcctaaaacaaaagatgagtctgctcaagatccatcattaaaacaatttatgaatgaactatatcaaagtacgaactcaaaaaatgaaaataacttgtacaaagcgttaaatgatgaagttctatttaaaggaaagagttataggaaggatgaactgaagtttgatgaagatatctttcatgagttgcaagtcgcccttacaatgggaggagagtttgcaaaagatacaaagcaagtatataaagtaccaagtggattgacagaaagtaaccaaccaaaccaagcgcattttatatatgcaactgttactggaaataaaacgaaaattttagctgaaccaaagagagaatcacaagttttatatgaaatatctaatgaaatggtaaaagcttggattccagaaaaagtgcaaaatgatggatatataaaaatttcgacaattaacggtaatactggatatgtacagaaagagtacgttttaactgatattaaatattcatttatgttcgaaaagaataatgaaggaacatggaaaataataaatatagattctatatggtaaaagaggaaggttcactttaatgaaccttcctctttgtttttattctctttttgaagagtattccagtactctaaaatttctgatgtaacgagagcggcaatgtttttttctgaattactaccaggaataacgacagaaacggcaatttgtggatcttcagtaggagcatatgcaatgaaaagagaatgatttatcattctttcttgctcattcggaaaacctgtaatacctgttttacctgcgacgtcaaagggcaactttttaatttcctctatattttgactcattccaccttgcacgacactccaaaagttcatcgggtaacgatttgaactttctaaaattggtttaaacttttttgtttccttaccgtccggactaataattgcacttacagtttgaggtttatatttatcacctttacttgccaaagttgctgcatattgagcgagttgaagaggggtatgcacttcatttcctccccaagaggcgtttaataaagcggagattccattttcaaacttattagatggatggaattcatattgtccgtcttcttcaaagggtaaatcaatcccggttttagaacgtaggccgaattgcattaaataatctgtccatatatgtgccactttttctatattcccattattttggttgaataggggcagagctacttttgctgtcataaatgtgttagatgaattaatgatagcctgcctcggtgtaatctcccctgttggtgttccaggcgcattcgtaatgttattttgattatcatactgaaaagtacctttatctaaataagtatcttcgggttggaaaagcttttcgtttaatccaattaaaatagtgagtggttttatagtagaagccatatttacataagattcaccatactttaatttttgaattgctttattttgcgaaagagagttaatgttttcttttctagaagatacacgtgtatttaatatatttggatcaaaaactgccgtgttggccatagttaaaattgcgccagtttttgcatcgcttactacagcataaccagctttagcatcaggtattttcttaatttgagatcttaatgcttcttctgctttttgctgcaactcagagtctaaagctagccgtacatctttacctatttgtactttttgaatgtcccataagaactttttattattcaatttaaaaataagagttttacctggttttccttttaaatcattttcatattgcagctcaatcccgctttttccaacagccatatgctttgaattaaggtcattttctacatacccaattacttgtgaaccaatttcgtgtttaggataatatcgaatccattcatctttaattattacattattgggtttgtttttgtttatgaatgcaagttcattctcagttatatgagagtataacggtatatcattcatagtctgctttttacaagattgttgtaattgagattttatgttctctgtagaaatatcatgttgaaactcgcttgaaaattgattaaaaaaagctaatgtgttcgatgtatcttgtttcgatagcttttcatcattagaagtgcaatatagagacttaactttcttatttgtagctagtattacaccattttgatcaaaaatctttcctctttcagctgaagaagttgcgatagtaattgaaatgaagttgatttttaataaaattagtaaaatcaaacctacaatagaaagaaccgcaaaaaatctccatctttttgtatgtaacatataaccctcccttatgtagcctatttcatcttatatttaattattttttttgtaaatgtggaacaactttattgtttaggttgtctattaagtattaaagcatgaagaaaggaataattagcatgaaaatttactagcaagtctatatgtaagtttaataagagtcattatacagtttagcacttctaatgcaagcggcaaaaaaatagagagaaaacaagaagggagagttattaatgccgtagctaaacgaaaaagaatggatgcttacaaggattaagcaaaaaattgaggcgatatttataaccgattagcggtatctaatatataagaaatgcttttagtatttgtagcaatttctgaaaggattaaatggaggatttatgaaagaacaaaaaggcaagaagcagaagacatatatatctattcgattaaatataatgttcctttgcatatttgtactattctcagctattattatgcagctaggaaaggtacaaatcgttgagggagaggcttataagaaccaagtggaaagtagtcaaaatgcaataactagtattccagttccacgtggacaaattttagatcgagaagggaaaacagttgttaataataaatctcttcgcacaattacgtatacaagggtgaagggaattacgagtgaagatattttaaaaacagcaaaagacttggcgaaagtacttgaaatgcctgaacaagatataaataaattaacagatatcgataaaaaagatttttggatgcagttgaattcgaaacgtgcggagacaaagattactaagaaagatatagaaaagtttaaagaaaagggtatagagggaaaagagttagataaaaaaatagaagacttaagacgaggtcgggttacagaggtagaattag

SEQ ID NO: 2609 - DNA, 2599 bp, Bacillus thuringiensis
cctttatattgtccagtccaacttttgctctcgctagaaaaagtaacatacgaaatggaacagcttcctaaaaagaaaatcctaatgaaaaagaataatgctctcttcataatgcccccctccattcaaaagcatttatttattgtctatttcttcctcttattatactattaaaatacagaattttctaaaataggtggtttatatgttacaacaacagttagaagaaattcgtaataatcattacgtaatggatacaattaacatggattctttaatttccaatatgcttaaacatatcggtgttaccgatagctatttaagggacaaacttatttgctctactttttaccatctcatcaaaaaggactacctttcacacacacaattacagaaactattattagaaagcatcagtgacaaatatttattgtataagattcattcggatgacgaagatgcggtatttacccgtgcatttacaacattattaattgcactcattattgatgccgatacaaatcataatttcttatcacaggctgatcttttacatgtaaaagatcgattagtgttatatatgaacaacgagcatgatttccgcggatatgtgcaagaccacggctgggcacatagtatcgctcacgcttctgatacatttgaggcgcttgttcgtagtcctaaactggaaactttatattacgaagaaatattacaaactttattaaacaaagtttgtgtccattctatttactacaaatatgaagaagacgaacgtctcgtttatccgattgtcgcaatgctacaaaatggtctaaaggaagaggtactcctattagcccttcatgaattagtagctcaattacccgtcaaaaaacagacattacatactgaatcgtacgagtacctatacggaaatataaaatctttcttacgtagtttgtttttccgactacgcacactgtctatatgtgaagaaaccgaatgcaaaattgaaaaattgctgcaagaccttccaaaatattattaaaaaaagaaggccacttagaaagtgccttcttctatttcactaatatttaattgaaatttcacgatccaaactgagaaaaggtggacaagaagcgcaaacgccatacatgctccgcttaaaaaagttagtataggatgcgaatacacgtgccccaatccataggatatcgccacgaaaaacattgttatgtaaatataaattgctccatgtatttgcctcatataaacctccttttcccatattataacataagttttctgattattcacattaattactcgtaatcaatatttctcaactgttacacctcttacagcagccttaatatacggtgacccttgtaaactttgtaaatcctctgttttcctgttacgactacaccgtatattggtaagtcttttgttttggtgttttttatttctttatcccgcattaacaggcagtaagacccccacatcaaaattcagcggaagcaaagaagttaggggggggcggactgctcgtaaaagcccgattggtgagggctgataatcagtaggggatgccccccccactgattaaagtttcactttatagtttatcctaaaatattctcgatatccctctttattttcacttaaagatatccaaatacagcttttataaatttttccataataaaaagcacatttattttgatgtgctcttcacatataatttagtaaaatatgaaccatttttttgaaacaaaaactcccactcatctctccccatactatcgttatgacttagttgccataataattgaacgaggataaaatcccagcttttcataaaatgatacagcttcatttccatacactactgttaattcaatttcatctatctttttcactttaaaccattccactgcactattcattaatttcaaaccaaatccgtttcttcggtatttttcatcaacaaataaaacttcaatctttccgcttacgcttttactatacgctatacaaaatcctaatatattatctgtttctgactcaatcaataattcaattctatattctccgtactttgagttctttttataattttcaatacgttcctcaaatgtcattcttgggtaatcgccagaaaaatattttgatttattattatgatattcatgcaatttatttaaggattctcttattatctctatttcatccagagtgatatatttattactaattctcatcctatagcatctccaataatatatatttcagcaaaaaaataagactgttttttgttcacaaaatattactctattactccatcgcttccctcacaacatcttgaatcataacaacttctgttttcatatcaatagacattgcttcttcatcaatacattcataccaaaacgctaagtgctttttatcgatttcataatgagaattttcgacaagagccccgccttctccttgcacagaataccaatataagtactcttctccatctcttatttcccggaaaattgtctcaacgtacactttttcgtcgtttaatgtcaaaaggacttctttcatattgtcattaagaaagctg

SEQ ID NO: 2610 - DNA, 2187 bp, Bacillus thuringiensis
acaaagcggttaacttgtaattggaacagaaggtacatacgcaccgttcacattccatgattcaagcaataaattaactggatttgacgttgaactatcagaagaagttgcaaaacgtttaggtgtaaaacctgtatttaaagaaacacaatgggatagcttacttgctggtttagatgcaaaacgtttcgatatggttgcaaacgaagttggtattcgtgaagaccgtcaaaagaaatatgatttctctaaaccgtacgtttcatcttcagcggcattagttattgcaaaagataaagataagcctgctacatttgctgatgtaaaaggtttaaaaggagcacaatctttaacgagtaactatgcagatattgctaagaaaaacggtgcggaaattattggtgtagaaggatttagccaagcggcagaattattagcttcaggacgcgttgattttacaattaatgataagttatcagtattaaattatttagaaacgaaaaaagatgcaaaaattaaaattgtagatactgaaaaagaagcttcagaaagtggattcttattccgtaaaggtagcactaagcttgtacaagaagtagataaagcgttagaagatatgaaaaaagacggtacgtatgacaaaataacgaaaaaatggttcggtgaaaatgtatctaagtagtgcattagtttcagatcgattgtctacttggatagatattatgcagacttccttcatgcctatgctgaaggaagctgtttttacaacaattccattaacgcttattacatttattatcgggattatacttgcaacgttaacagcgctcgcacgtatttctggtagtcgtattttacaatggattgctcgtatctatgtatctatcattcgcggaacgccacttcttgtacagctatttattattttctatggtcttccaactcttaatattgaagttgagccatatacagcagcagttgttggattttcattaaatgtcggtgcatatgcatctgaaattattcgtgcttctatcctttccattccgaaagggcagtgggaagctgcttatacaattgggatgacatacccacaagcgttaaaacgtgttattttaccgcaagcaacgcgcgtatcaatcccgccgctttcgaatacatttattagcttagtgaaagatacttcattagcatcgttaattttagtaacagaaatgttccgaaaagcgcaggaaattgcggcaatgaactacgaatttttaattgtttatttcgaagcaggtcttatttattgggttatttgtttcttattatcaatcgtacaacagatgttagaaaagcgttcagaacgctatacattaaaataatccttttacaaaaggagtttttgtttttatgatttcaattcagcatttacaaaaaagtttcggagataataccgtactaaagcatatagatttatcagttgagaagggggaagtggttgttattatcggtccatctggatctggtaaaacgacattcttacgttgtctcaatgtattagaaacaccaaacgctggtaatattcgaatcggtaataaagaactcgacttctctcaaaaagtaacgaagaaagatattgtcaatcttcgtacgcaaacaggtatggtattccagcaccataatttattcccgcatttaacagcacttcaaaatgtaatggaagggctcgttacagtgaaaaagatggggaaagaagaagcgaagaaaaaagcaaactatttccttgaaaaggttggtcttgcggataaagtagacttatatccgttccaattatcaggcggacaacaacagcgcgttggaattgcgcgcgcgcttgcgatggagccggaagtgttactatttgatgagccgacgtcagcgcttgatcctgaactcgttcaagaagttctgaaagtaatgaaagaacttgctaaagaaggcatgacgatggttattgtaacgcacgaaatgcgttttgcacatcaaattgcaaaccgcgttattttcatggatggcggtgttcgttgtcgaacaaggtacaccagaagaagtatttacaaatccaaaagaagaacgtacgaagaagtttttacaaatgttgcaataaaataggaaagggtctcaaggcatatgccttgagaaccttttgccatatatatttat

SEQ ID NO: 2611 - DNA, 17857 bp, Bacillus thuringiensis
caaaagggatattttttgagcatctattgtgttttaaaatgagaagcgaggtgatctaactcgtcaactgtttgtttcatttttctagcagtaactgtcatttcattcatatcgagaactttctgttcagcagattgtgccgatgcgacagtttcgctggatacttcagtagagatagaagcgatgttattaagtgaagcattcatttcttcagcacttgcagccatttcttcagcagttggtgatatatcttgcatttgagtagatgctttatttacttgttccacaattgttgtgaaaagaagtaccagcttcacgaataacattgataccttcaaaatgcttcagaacggccttgagacatcatagagctagcagtttctgtatcattttgaatttgatgtagtaattgattaatgtctgttgcagctgttttagattgttcagcaagttttcgaacttcgtcagctacgacagcaaatccttttccttgctcgccagcacgagcagcctcaatagaagcatttaaagcaagtaagtttgtttgctcagcaatattagaaatagattgtacagcagtatcaatatatttcgtatgagtgattagacgttcaaccacttctgacgtagcatttacagcttcgtgtattgttgtcatttgtgaaacagatttttggataaccgtacttccatcgctagcatgttcagatgtggcaacagcaagttccgctacagatgaagcagattcagcgatgcgctgaacacttactgccatatcatccattgcagttgaactttcttccatactagaagtttgtgattgaatacttgcatttaagttggacatcgagctttggactcttaatgtcgcctcacgtgatgtatttgttttttctagcatattttcagaagcggtttgcacttccactgatgttttttgaacacgattaatgatatgttgtaggttttctaacattttattaaatgatgttgcgatagcacctatttcatcgttgctatttacttgtagacgtgccgttaagtcaccttcttgagaggccaattcttttagtttcgtgtcaatttgttgaattggtttcaccagtttaccagagaaccaccatgcaagaataattgcaacgacaatacaaataacaagtgatagaaagactgcatattcaattcctagtgaagattgatcaatttgttcaatagattgttcacgtaatttagcttgttcattactgtactttgtgaagtcaccaattactttatagaccgttccgttttctgaagaagctacttgtaaagcttcttcccatttttgttcttttgcaagagtgaatactttttcttcaacgaactttctccaagtagaccctaattccattgtactttttacggacgaagaaagatttggattagaaagaagtttatcttttgaatcctcaagacgtttactcatctcattaaacttgtctaattcgacttgatcatgttgtagtaaataaccccttaaagcagatagctgtacttgataagcgtctccacgttctttcaattctgttgccagtggagaaatttctttttgtaatgtttcagctttacgagattggtcaatagcaaaaaataaaataaaagctaaggcgatgccaaataaagcgcaaatcgttcccatcatgaacataagtttttttctgatacttacaaaattcatatgattaaaagcctcctttgtgaaatcttagtattagaattaataaatgtaaaaaattgaaagaaagctttactccagttggaataaagctttcttatttcctttaggaattatagcagacggaatgagagatagaaagagatattttaaattgaaaaaagagagactgtaaaatattctttcctatacctttgggcttgtgtcattacaagcgaaaggttcactttaagcgtttgttttgaaatgagagacgagaacttcaagttcttgtacgattgttttcatttcagatgatttgttagccacgatactcattttgtttacttgatcaccagctgaatgtgctgtttgtaatgtttctgcagcaacttcatttgaaatagaggcgatattatttaaagctgcgttcatttcttcagagcttgcagccatctcttcagcagttgcagacatttcttgcatttgcgtagagactttgttaatgtggttaacaatttctgagaatgaagatccggcagtacgaataacagtaattccttcagaagcttctgcttgaccttgtgtcatcatgtcatttgctattttagtatcggcttgaatttgatgcagtaaatggttaatgtcagttgcggctagttgagattgttcagcaagttttcgaacttcatcagcaacaacagcgaatcctttgccatgttcaccagcacgagctgcttcaatagaagcatttaaagcgagtaaatttgtttgctcggcgatattcgaaatagattgaagtgcagtatcgatatgatttgtatgtgtaatgagtcgctcaactacttgtgatgtagcgttaacagcttcgttaattgtgtgcatttgtgtaatagatttctcaatgactttattcccatcatctgctttttctgaagttgtaacagctaaactagtaacagatgaggcggactcagcgatacgctgaacactcgctgccatgtcatccattgcagttgaactttcttcaatgctagaaacttgtgaacgaatattgtgttcaagagcattcatagtttcttgggtccttgcggtattttccatagaagcagtcgtttcgataaagacattttcggaagcttcttttacacttgttgatgtttgttgaacttgttttattataagctgtaagttagtgagcatttgattaaaggaatttgcaatgtcacctatttcatctttacttgttacgtgtaatctagccgttaaatctccatcttgagaagctaattcttttaacttctcatcaatttgtcgaattggtttaacgagtttaccagagaaccaccatgctaataaaatagacgttaatgtacatgtaatgagtgagaagaaaataatatattgaataagtgatgaagaagactcgacgtcagcaattaatgcgtcacgtttctcattctcttcatttgtatatttattaaaacgacctaaaagatcatttacataatctgtttgtgctaaagcaattttggatgcttcgtcccattttccttcacgagcaagaggtagtacctcattatctatgacgctacgccattttccccccattaaaatagcttctttcattccttctgggagcttcttgtcacttgttactttctctctagtatcagctaattttttcccttctcggttgaacttatctaatcctttttgatcatgtgatagtaaatattcttgtaaaccagcaacttgtgcttggaaccaatcgccacgttcttttaaaatcgtcgctctttttgatacatcattttttaacgtttcgatttcacttgcttgattcatggcgaatgaaagaataacaataagagcaatgctaaataaagaagaaatgcttaagagtgtgaacagtagtttttttcgaatactaacatatttcatcgttacccctaccctcgtttaaactgtttattatgatttatagatatttaaaacgaaattaataaaaacattattatgaagttattaatctgttcaatgaaaattatagcagataatggaaggagtcagattgatattagaaaaagttcttaaaatgtatacatttgcatatcataaaattcataaataaatattagaaatgctattgaaatttgaaatgacatcatgtatacttctaattagttgataacgattatcagtatcaactaaaacattactcttcgttatgttggtcatacccctttttgacgacgtaagtcagagacgaaatgttgaaatatcttgtgtcctattctacagaattatggtaatctccaacctcaacttatatgcgtgagcatgcaaaaaggatcctatccgtgaagggatccttttttgcatgctgtcgcaattattgtatatagaccagggatacgttcttcgattctttccggtgcagtagaagggaagagccatctttgatgaggtccgtgttcttcaactagtttttcaattttaaaatgttcttccgcgagtgttgtaatgatttctcctaacgtccagcgacggatggttgttttaggtagcgattctttctgtgcttctgtaagaaggatgctataagcaacatcatcttcaattaattcttcatcgaaataatttccacttgctcgaaatgatggatggtctactcctaatagctttgtgtatattggatggtaatcgcgaaggataagtattccaccgggctttagtagttgagagattgttgtgaaaagtggttttaaatctagaaagtaatgaagtacaccaagttccagtaatacgatatcaaatgatttggagagatttacatctagtacatcagaaacgatgtaatgaatagagacgcctgcggcatcagcaagttcatttgcatattttgcattacttgctgaaatatcaacaactgttacgtcagagcctaaaagggcgagtgcgacagctttatttccttttgagccgagtaaattaataatacattttccttttggggattttatgtaaggtaaataatgtgctacttcgcgcgtgggatctttcatgatttttttcgcataatcagctggtgccccgtggcgattcgtccaagcttcataagcagctgcattccagcttttttcatttatagtgcttagttgtttttgattcaatgttatcactccttttgtgaacgtatagttattcggcagggggatgggatttccttttctttctggataaaagtttgatttttccgtgattaagtcgtacaatactttttatacgtaaaagcgttgaaaaggaaaagtaggatgaacacattctttccagagagcttcggtagctgagaagaagcaagaatattcatttgaacaatggcctttgagcttcgtcctgaacttatcaaatgataatagtaggcggcgacgagagttggtactcgttatcaaaaccacagtataagagcatattgctccgtacttgttaaggctaattatgtgagtaattagcgaaataaggtggtaccgcgactgtttatacagccccgcccttatcttttttaagataagggcggggctttttatatttaaaaggaggaatgtaagatgagtatttttattggaggcgcttggccgtatgcaaatggttcgttacaccttggccatattgcgagtttgttacctggagatattttagcgcgttattacagggcaaaaggtgagaatgtgctgtatgtttcagggagtgattgtaatggaacaccgattgcaattagagcaaaacaagaaggtgtgacagcgaaagaaattgctgataagtatcatgaagagttccagcgatgttttcgtagccttggttttacttatgattgttatacacgtacagatagtgagcaccatcatgaaacggttcaaaatgtttttttacgtttattagaagaaggacatatttataaaaaaacagtggaacaagcgtattgtgaaacgtgtacacagtttttaccggatcgttatgtagaaggaatatgtccacattgccatgaagcagcaagaggagatcaatgcgatgcttgttctgctattttagatcctctcgatttgttagaaaagaaatgtaagttatgtggtagtacgccatctgtagaggaaacagagcatttctattttgcattgcatacatttcagcagcaaattaaaagagctgtagaaattgccaaacaaacagggacatggcgcgacaatgcgattcaactaacagagagatatgtaaaggaaggattaatagatagggccgtatcacgtgatttaccaattggggtaccaattccagtagaagggtatgaagataagaaaatttacgtatggattgaagcagtgacaggctattattcagcgagtaaacattgggctgaagaaacagggaaagatgatcaagagttttgggatagcgaagcgaaaacatattatgtgcacggaaaggataatattccgtttcattccgtcatttggccagcggtattacttggaataggggaggaagcaatcccgcgtcatatcgtttcgaatgaatatttaacagttgaaaaaagaaaattatctacaagtaaaaactgggcagtatgggtgcctgacatattagaacgctatgatccagattctattcgttactttttaaccgtcaacgcaccagaaaatcgcgatactgatttttcatggcgggaatttatttacagtcataatagtgaattattaggtgcatacgggaactttgtgaaccggacattaaagtttatcgaaaaatattatggtggtatcgtgacgaagggaagtattgaggtagagctgaaagataaagtagaaggattatataagcgtgtaggagaggcgattgagcaaactaaatttaaggtggcgctagaaacaatatttgatacagtacgttttgcaaataaatattttgatgaaaagcagccttggaaacaaagagaagatgatccagtttcatgtgaagaaacgatttataactgtgtgtatcttatcgctaattttgcccatctccttgaaccatttttaccattttcaagtgaaagagttcgaaacacattgtcgattgtgaaccgaaattgggaaccgcaaaatacgttgccaagtagaattgatagcgtacagccattatttgagcgaatcgatgtaaaacaaattgagcatgagatagagaagctgtatggagcggtaaaatgagatagagaaaaagacctttcaagtaaatgaaaggtcttttgttatgcagtatgattctctttcttatctttcaaaaagaaaagtacagcaaggattacaagaataatagctgcaatatcatacgttattttaaatgtagtattaaagtttaagtactctacgaaaggagttttcactgctcctgcatatatacaaacgggaacgagaagtaaatcgtaaaatttcttttctttcatatatcttattaggaagaagatacacataatagcaaaaaatacgatgcttaaaatagtcatttatacctccagataaatttacttattttaattgcagttatatcttttatataaattctgtattttttcaagcgctgtgcacgcgattgtgtttcctttctttcctagccgtaagcagctgaggagtgaagatcccaaccaatataaaaataattccaatccactgcatgaacgttacgacttcatgtacaagtgtaattgaagcaataatagcagttggtaattcagctgcacctaatatcgtactaagccctgttccaacctttggtacaccgattgaaaaacaaatgacaggtacgacaacaccgaacaagccgaggaagaaagtatatttccataggccagcttgcaaagcaccgtctgttaaaaaggttggcggaaagaataggcatacgataagagtagcacttgttgtcataagaaagcttttcgtataaggcggaacatccgtagcgacgcgcccgcttgcaaaaacatagaatgaaaaagagacagcagctaatagcccaaagataatccctttcgtagaaaaactttgtccgaggccttcaaatacaccacctgcaaacaatgtaccagcaaataaaataaggatagatatgatcttatcgtggcttggaaatgttcgatttgcaatggcttcgataatgacaccaatccaagtgaactgaaagagtaggacgacagcgatagatgcgggtagttcttctacagaaatagcgtaaaaaatcccagtcatactcattgttgttccgacggttagtaatgaaaaaaattgtttttttgttactttatgatgtgaaaagaaaagaacgagtagaaatagtccaatccatccgaagacatattgtccccctaggagttgatgtgctgaaaatccatttatgaatccgagtttgaaaatagttgaaagtatgccgtagctgcaagcaccgaataaaacgagcaatgaatatttaaacttttccataaaaaatcctccttttaagtaataaaaaacgcccgctatccaaataaggataacgggcgaacgaaacagagtaagacactctacaaaattccgccactcacacatgaagtatgagtttggggtatgtaattatagtgaatgttacattgcttttgggaatacaatggagcattttacaccttgagctgtgttttgtatcccgtaaggaaactgatgtttatctaatatttgtttcacgatatataatccaagaccactaccttgtactaacccgtgtttatcaggatttgcgcgatagaaaggctcaaataaatgagcaagtttatcttcatcaatttgtgaacctgtatttaatacttctaatgcgtaaccatttggtttttcataaagctttatatatacgtgctgatggtcaattgtataatgaattgcatttgaaataatgttaaaaatagcagtttgaataaatttaggatcagctaaaatttgtacgtcgtgtttaatattagattgtacatttaattgttttacagatacaaagtaatctactttcttcataacatcctcaataatattagataaagaaatgacttctaaattcggtttaaattgagggttttgtattttggataattccgacattttttccgttaatatgttaatgtcttgcatcatctcgtaggaacgtttcaaatacttatctctatctttataagctccaattccgtgaatcatgccatctagttgtcccatgacggctgcgattggtgtttttaattcatgggacaccatagacataaattctttacgagattgttctaattgttgttccttcttgagctcgtttcttaaatcttgattgcttgcatgtaaattctttacaatatttggtacttgcgaagcggctacttgcaaattaaaatctgtttgatctgcatttttgttaagtagctttttatcggagaaatcaagattcataatatcttttaaagcatcactcatatattgaaaaggtttggcaattagttttgtataaattaatgatccgagtagtgataatgcaagcattgtcgcgccaatatgtggagctaattgctgcaacgcatctgctaactttggattatcatttgtatcatttgttttacttgctgcattttgtgtatgtaaggcatcattattagcggctttcttttctgcttctgtaggcggattagaagtgctatttttccccgaaagattttgtgtatgttcttttgcctttgcagtttggctaggctgcaaaaggtgattgatagctgtagaaagagatttataatctataatagaagattggaaattagaaatactcccctttgacacagctttattttgcttcgttttacttccgtcgttttgcttatctgaatcggcctgttctgtagtcggcgttccattttctttcgcaaaacgttctttatcgtagtttgaagctagaaagtaaataatttgataaagacaaagtgataaaagaatacaaaataataaggttttgatgaaaatatttttggtgatgttgtctttgctacgattcgattttgtagccaatgcctttcaccgttttaatataaggaattcctaatttttttcttaagtttttaatatgtgtatctataactcttacatcaccataatgttcatagccccataccttattcaacaaatcacttcttgataatacttttcctcgattttgcagtaaagtataaataatttcaaattcttttgttgtcaattcaatttgattaccatgaacataagctgcatatgctgtagagtttaacatcaattcatggaattgtagtatagttgcagcttctgcttccttcgttgctgcccttcttaatacagcctctacacgcttaataaatacagtgtaatggaacggtttcgtaatatagtcatcaatacctaactcaaatcctttaatttcactttcttcattatgtaagcctgttaacataatgattggtacatcagattgtcctcgcataattttacaaatactatagccatctatatctggtaacattacatcgaggaggacaagatcgtatgaatttttttggaaaagaagaataccttctgttccggcaccaactacatcaacggtaaagttttgtgccattagaaattcacgaatcagttcttgtatatctgggttgtcttcaatcaccagtatatgcgtcatagtaacacctcctaaataacgctttttactgcaatattcgaattcatcatttttcgagtgactcagattgtttatacatataataagcccccgctataaaataatcatgaaggtagcaaggggaatagtttagtgttactgaataattcagaattacagtagttctattatagtatgtattataaaatttataaaatattataactgtataattttaatatctacgtttatcaatgtttagatattagctaatcaaatctattcctattatatatgtaaatacagttgttttgctactgtaaatgaataaataaaataagccaagacataaaattcttggctacacataaatcttgtttttaggctattttacagtgacagtagcttgctgctgaacgcgctcaaataaccagtgtatatcattgttatacatacgaatacaaccaagtgttgtccatttgccgattgcttgattattgttagttccgtgaatcgcataagttgttccgtaagttcctgccatatttaatccgagccaacggtcaccaagtggattacgtggatcgccgcctttaatttttcctgtataataagggcggtttttaattttatttacgatttgaaaagtgcctttaggtgtaggtgttgcagcttttccagtagcgacagtaaaactttttataaattttccatcctgataataatccattttatttaactgagtgtctacgattaattgatctttcgttgtagctgcctctgcactagcgaatggaagagttaaaaatcctaatgataatagtgcgcttaataataattttttcattgttattctccttttactatcgtaatagtcttacatacaatgaagttgtaatcctcgtaatgctttatttacattttcatctaatgtttcaaagaatgtagtgattttgctgttgtgtttgttgttatcaataagtaatctttcatttaataaaagctcaccacgtagtccaaaactttgaacttgaatatttagctcatcttcattttcagaaatgattggtaagaaatagtgaaaagcttttgttggaatgatgtagcttttgccaatcatgctttcttgatttgaattaatccattttttcgtgacaattttaatattcttttttgaaacgataaaagatagtgttgtagattttgttaaacttacgtcaaattcacttgtttcacatatttgtaaattaaaaacggtttcattttgatgagattcaacatttgtattaataaaatcgtgcattttatatgcttccatttcgtattcacccttttttcaatttcgaaaaacgacttatatttattcaaattaatgcttagtcatatattggttaaatttttcaacaaattccgatataatcttacaatacgtatatgaagctaatatgaagttagcatgagtttgtgatggttttttattgagaacaaaataagaaagcttttttagtgctaaaaaatggataaaatctgcatgttattaatgcgtcttttcgctatttcgacttggaaaataatttttactatttaataaagaacgaaaatcattagtgtgacccttacaaaaatgtaataaaaatgtaagctattgtgatagttatttcgacaatttttttatacaataatagtaagaagttgtacgtgattgaaaggagagatgacatggaatggattcatgaattatttcagcaatacgggtattatgttgtacttgtcggcttgctgttagaatatattgcacttccgtttccgggagagccaacattagcatatgcgggatttttagcacataagggtgatttaagtttaccgattttaattattctatcctttattgggacaagtgtaggaatgacgattcaatactttttaggaaataaattaggtatgcctttcattcaaaagtatgggaaatacgtatttttaacacaaagaaaaattgacttaacgagaatgtggtttgataagtatgggtacttcctaatttttattggtttctttattcctggtgtacgtcatttcacaggatactttgcaggaattattaatttaccattccgtcgttttgccattacaatttattcaggcgctctattttgggtatcattcttcttaatcggtggttactggttaggtggaaacttacatgatatctttggagtgctagaagatcatatcggtaaaatcatttttggagttattgtgattgtagcggttacgttgggtattcgtttccgtaagcagttaaaacgagtattactacaaaacgcaagttaatatgaaatccattctatgtcagaatttaggaaggcagtgcaaaagcactgccttttttattttatttttaagactatgtttaatgcacattttacattctttataggaatttgatacaggataagaaataagtattttgtcaattattatagtcgtaatgacaattataattgacaaatataaggatattatttacaattgtaattaaataaatgaaaaagagggaagacatgaagcttcaaaatcgagtgagggaattgcgagcaaagcatcgtttatcacaaggggatttagggaaagcgattggatcatcacggcaaacgattagtttaattgagcgtggggattatgcaccatctatcgtattgtcgttaaaaatcgcacaaattttcaatgtaccggtggaggaaatatttacgttagtagagggggaagaggacgatgaagagtaagagaaaaaaacaatttgattctgtggggaaaatagcattaagtatgataggaggatttttaacgtcttatatagctttaaatttactctcggatgaaccgagaaaattatcatccaatacatttataggtatatgtactatttttggaattttaatgatgtactatacttggaagaatacacgtatgttagcagaggcacgcgatgaagaagagagcgtacaaggcagaaaattaggcattataagtatatatttacgtgtaggtgatatagtgacgcaggcatggtttgtatatgcagttattacatgtagacgtgcactgttgcaggatacaaatgtttcatttgcggtgtggaatttagtagcttctattgtttgtttaactactgtagtaattatcggactcataacaaaaaatcgttataataagctatatcctgaacaaggtgtaacgtatatggaatctatgaaaatgtggacgaaaaacgcagatgaaggattaaagcacattgtgcatgaggctggatataaagcatatgaatttaagaatacaatattggcatatgtatggtgggctgccgttatatatacagctgctagtaatatcgattttgtattaattggcttaatctcatttatttggatattgcatcttgggaagttcatgtacgaaatgcaaaggaaaatgatttattaaggggagaaaaaggtggatattttaagaaggccagctggttcaatgacagtggcgttaatgctgtccattttatacggagtaatccgaactgggaaattagaagtaattttgaacctatgggcaatagttggaatttcattattagtgttagccattcatgagctaggacatgtagtatttggtgtaataggtggtttaacatttaaatttatgacagtaggacccattactattcaaaaagaaaagggaaaattacgcattcgagcaaataaattatgggcttactttggaggcgttgcaacactagtaccaccttctatagagacaccgaatctttcgaaaaaatgggcgtggctcactttaggtggaccaattacgagtttactgtttggtattacttccggttacatatacatggtgagttattatcaatatcttttatatttttcctttttccattttgcaatctttgcggttacaattgtgccgataaaaggaacgcttatgagtgatgggatgcaatttcttattttaattaaagatgatgaaagagctagaaatcatttatatgagattcaaatatcgagtgagttatttagttataaaagaccgaaagattgggatgaaagattagtagaattgagtgaggagaaaataaaagacaataaagggataagagagataatgagtagacttatgcttgtcttttttgctcgtgcagatcaagagggaatggaaagagcgataccgtatatagaaagaattgttcaactacctgtaacgaaagaaaataagtttttcgttagcagttttcatagttggtatcttttatataaagccctttatcagatggatagtctttctttgcaagaagcaaaggaacatgcaaaggctattacaaaaatggacttaaacggatattatcgtacacaaggaattatcaaatatttagagaatgatctagaagcttcccatacttatatgaagaaagctgataaagaattaaagagcgccgagaagagtgagatgggatatttacaattagaaagagaatggtttgagcagttgaaggtgagggtatcttacgatgggtgaggtatcctcttttttctatgtcatcttatgccgttccataaatagtccggggcgagtaaaatgagataagaagagcaaagcttggaggaagtaaatatggaaattttatcaattattttgatagtcttgctcatttatgttgtttttaaagtggcatatgtagcattaaagatactcgcgatcctattaattatctttttaatcgtagagttcggcagtaagttgcttgggggatagggtatgttgtgcgtttcgagtgtcgaaggttgtcgttaaatcgatatcttgtgttgaaccgttgatataatgaaaaaatcgttgatataagtggagaaatgatcgatatatttgaaaaatcgttgatatattttagtgaatacgaagtggggtatgtggaaaagaagttgccgttgggtagcttctttttattgtagtggcagggtatagagcataaataggttgccgaaaattgccggtaagtcgatagcctgtgtcgaacggtcgatataatgaaaaaatcgctgatataagtggagaaatcgccgatatatatggagaatcgctgatataatccggttggtactggatggggtatgtgagaaagaagttgccgtgagggcaacttctttttatcgtgatgcggggtatgcaaaccaacataaaaaagctggaagagtatcttccagcttaagagttactttcaatttgacgaccgctatcttcttcagtgtcttgtaataggttgaatacgtctgctaggcagaatgcaatgaaccaagtccatagaccgtggaagaaagctgagcttaattgaagtggtaatgtatagtttgtcattgagtaggaaatacatccaccaacgattccgatcattgttaataacattgttttttgagcattttcttctggattgaagaggaagtaaatgtatccgcctaaaattgaagcgcttacaagcgtttcgattccattaaagatgatattctctccaagctgagtgtttgtccagaagcagattgttccgccgataatagcaaacaggacagctattgtatatcgtatatattgattcatatgttcatctccctatgtaataagatgatttggaagtcaaaaaggtaggtatagtatattgaagtgagttttaattgtacgtatctttttataaaaagatcattgaagagtaactaagatgatcggttgtttaaaccgttacgtgtatggtgtctgaaatatacccgactgctcgtttctttttgcttgtaaaataagagaaacttccaagtctatatactcttttttttgtgagtctgctttcattataacacatttagggacataataatagaattatctgattttgtaataagtgtaaaaaataaaaagcgtaaggaaataccattaacggtgcagtttagtggaagaaggattttaatttattatgatgaaatatgtaatcaaggtgagatctaagaatgaggcttaaatactataaaaaatgttttatagcatgaatgtaagggaggagagctaacttggagttcacaacagaaagattaataattagaccttttaagagtactgatttacaggatgtatttgctatttataatagtgatgatacatgtaagttcctattacataataagtggactcatgaagacatgcagaaaagatttaataagaagctagcaaataatgtacttactaaagaaacaatattaagtttggcagttatatacaaaactaaagtagttggtgatttatccgtatggtacacaaatatgaaagacactgttgagattggttatagttttgcaaaggaagtagctgggagaggtttggcaacagaagcagtaagtagtttggtattgaaattatttaatgaatgtaatgtacatcgtatacaggctaatcttgatgcacgtaatacagcttcacaaaaattgtgtgaacgaataggcatgagaaaggaagcccatttcatacaagatttttggaataaagaggaatggacagatagtattgtatatggaatgctatcctccgatttgtagtaataaacttagtgattttattatgctaaaaggtacgttagttgaataacaaagggcataacatattatatatgactaatatgttatgccctttaatttattaacctgttttatatgcgtttgaaacggccgacaatttcaactgtttcagtaatgttcataaatgctttgttatccacttgacggataatacgtttcatttcgcctaactcatagcgagtcacgacagtgtaaatcatttttttcttatggtttgtatagccgccgacagcgtctaccattgtcaccccgcgtatgccgtgatgtagtagtgcgctttttatttcctcgcctttttctgtaatagtcattatcgttaatttaatatgtttcgtatgcacagcgtcgataactttgctgactacaaatcgactaattaacgtataaagtgtaatatcccatccgaaaataaaacctgctgctacaagtaagattaagttgaatacaaatatgattgctccaattgaaacatctcgatatttcgctacaatcaatccgacaacatcaaaaccacctgttgaagaagcaaatcggaatataattcctgaagctgctccgcagataacaccaccgaatacagaagaaagtaaaatatcgtctgaaacttggtgtaccgggataatgttcatcgctaacgatgacacagctacaaagtacgctgttaaaaaggttgtcttctttcctaagtaaaagtgacttaaaataagaagaggaatgtttagtaaaaagataagtgcaccgatattgtagtgcattaaataaccgataatca

SEQ ID NO: 2612 - DNA, 246 bp, Bacillus thuringiensis
cgaggcgccaccgtcaaacacaacgacgcgcgaaccagcaaaaaaaagcacatcagcaacgaaacaaagaaaggccaccaacacgaaacacgcagcacccccaaacccaaagcggcgaccccgcaaagcaccaccgccagcacaaaaaacaaccgatacagaaaagagagcaagcccacccggaacaagaagaaacacaccgccagcccgcgacacaagcgcaacgacagcacccaccaaacaaac

SEQ ID NO: 2613 - DNA, 212 bp, Bacillus thuringiensis
cagctacatagtaatctacccacagggaagcaccggcgcctcgccctgttcctggccccaacagggtgcgaccagctgaaccaactcacgcaacgacactagcaaccaagctgaaaacgaagactgcacacaacaggagaaaccctaacataaccccctcaaagcttaactacaaccagaaaacgaagtggaacaaggacaacatccctgcc

SEQ ID NO: 2614 - DNA, 317 bp, Bacillus thuringiensis
gcacgaccttccttctaattgcccgggcgcgcaaacaaaagagggggatttttcaggggcggagcggtataacccccactaccagtcagtatctaaacgaatatgcctgagatccacaagccattggccgaaccacttagaggcactatcttaaaaggagcctactttaaatgtcgtgaagaagagaagaacgcttagtggcagagtgccagggaacgggggactgtcatatggagagaagtgctacactcctaaccttgggggagtcagcaaatgcaaacagtagggcaggagcacccattgctgagaggaaaaaa

SEQ ID NO: 2615 - DNA, 556 bp, Bacillus thuringiensis
  unsure (1)...(556): unsure at all n locations
tgcctaggtcgagagctgtttcaattcaataagttttataaaccaagatgatttaaacggggatttattctttgcagatgagaaaggtcgcgcaggaacagatatgacattctttgatttcccaggtgttccgaaaggtgtacacggtacgaatgaaatttcaaaaacttcattccgtgttccgactgatgcagcactagcgtattgggtgaaacgctttgaccgtttggaagtagaacatacaggaattaaagagcaatttggtaagaaaactctttctttcgttgactttgatgaccaacaatatcaattaatttcagatgagcttgataacggtatagaatcaggtacaccatggcaaaacggaccagttccattagaatatgcaattactggtttaggccctgtattcatccgtattgcaaactttagtttcttaanagaagtgctagaaaaagttttattatttaaagaggttgcgcaagaaggagaattttatttatttgaagtgaataaagttggaaacggtgcttttgtcattgtagaacataataca

SEQ ID NO: 2616 - DNA, 147 bp, Bacillus thuringiensis
  unsure (1)...(147): unsure at all n locations
aggggggcaaacaaaaaaaaagcggggaacacaaaaaacacacggaaccagcagcaccaaagcaagacacaaacacaaacgaacngaccgccgacagcacaggcacaggagcaagagccccacccccaaggcacccacaaaaaccaa

SEQ ID NO: 2617 - DNA, 294 bp, Bacillus thuringiensis
aattccttttttaggccaaacaacataagaaggatgtggtgccatcgaataaagattgaatgagctgatatggacgcaaacctatcgtaactggtcaacgataatagaatgcgcattaagttgacgacacgagggtacgcctgcgcaggtccaagcatgagaggactgactgatgggctaacatcataacatagtggaaatagcaggacaatgggaaatgccacaacaagaactctgtttacaagagcgtgcatagatggataggagtggcgtgcggcttatcaggaagcgcat

SEQ ID NO: 2618 - DNA, 233 bp, Bacillus thuringiensis
aaacgtggcagagctaaacgaatgataaagaaaggggccaaagcaactactgaaaacattctaaaaaaaaaaagcacagacggttctacaacaaaagcaccaggaccaaagccagaataggttaataaaacataaaattgtgtaccaccagtacgcttttgtaatccagaaactaaagcgataaaaaggacagctacaccgggtaaagaatcaaaaatcgcacccatagaaaa

SEQ ID NO: 2619 - DNA, 239 bp, Bacillus thuringiensis
  unsure (1)...(239): unsure at all n locations
ccaaaacccacccgcaccnacgggagaaggggcgcgggggnaacggaaagccgaagccccagaggcccaagcgacggnnnagcaaaaacacagcnccncngcgaagccgnaaggcgaagnanagggggngacaccngcccggngcnggaaggnnaaggagaggggnnagcgnaagcgaangcccgaaccgaagccccagnaaacggcggccgnaaccanaacggnccnaaggaagcgaa

SEQ ID NO: 2620 - DNA, 268 bp, Bacillus thuringiensis
  unsure (1)...(268): unsure at all n locations
aatctgaaattgctgttttatagttgttatttnctaaaacaatgggaagcaaagtattagtttgataagtacacactggtcaatactgtctgggacagactgacttgggttatctgacgtgcggccttttctgactatcggaaacggcagttgcaaataaacgtgatatcatcgtaaatggaactctcgtataatcaacaaccttattatcgtacgatagattttaaaaggattacacatgttattttatcgttcccatgatagctaa

SEQ ID NO: 2621 - DNA, 256 bp, Bacillus thuringiensis
cgacaattagatccaacaacgtacttcgctaatgacactgcccatggggggctctgtgtggataggggcatatgctccctcactctagacgcacctaattcttgtgcttcctcgatttgagtccttaatccattcaaggttttatgaatcccgatctataacccttcgtatctagtttcaaataacttccttcccaaaccgcaccaaaagatgatcatcttccttaccaatcccattcaattctctaattaatttc

SEQ ID NO: 2622 - DNA, 271 bp, Bacillus thuringiensis
gatcattgatgatcgatcgcaagaaccatcggttacaggagactacttttaccatttccatggcgatgcaaagagcttgcatgtactgcaggaagatgacccaggcgtatatggcgacgacggtagtgaaacgagtcactactggacagaaaagatgaaagcaaaatcgcgacattagatccaaacaggttaatgggactaacgcagccgcatcgggagaactatcctacatgaagtgattacagggagggacgtacagttattcaagtgg

SEQ ID NO: 2623 - DNA, 205 bp, Bacillus thuringiensis
gactcatgactgataccacctgcagcaagactcccaagcaatactacattttatccacaaaaaaaaactcaactaaatacggcgatagtctacacccatatactgtatcaggttaaacctatcgagagaaatataacagaggcttatatagataatttagacgagtctctgtactaacctttgtctaaaaccaacactatatatg

SEQ ID NO: 2624 - DNA, 104 bp, Bacillus thuringiensis
atagagatgaactacaggaaagtacatgaggagctatacaagacgacatgctcgtagcaggcttatatacgttctgtttgcgaatccgatggttggacaataca

SEQ ID NO: 2625 - DNA, 252 bp, Bacillus thuringiensis
ccactaggaggcctttaaacggctgctcagccacttttgttacttgttgctgtactttccctacacctacgacgatagggcgatgttctgcttgatgaagcgctttccccgcttcagccatgactgtaccatttacatcacggaacagacaggtggaatgtgctttcatatgttgttttcagatgctgtaacatactattagtgcttacatctttaacatacctctataactattgtttctgactacatata

SEQ ID NO: 2626 - DNA, 213 bp, Bacillus thuringiensis
caacacagacagcccccggctaaacaccccagaccaggccaaacccggagagacactagggctaccaacgggaaccccccaaacaccaaccagcaaacgagcgagagaaagccccaaccaggaacgggataccccagaacggaaagccaaggaaccccgcgcgcacgagaaacatccagaaagccaaacgaccgccacagagcagcaagaaca

SEQ ID NO: 2627 - DNA, 198 bp, Bacillus thuringiensis
aaagcattttgtcgcaaacggcctggcacatttcaagggctcacatacatgcatttggatataccacaacgtgaacctgactggcataacaagaaccgcaggctcagggaaaaggagggtattccgcattgttgcttgagtagcccaagcgtttccccgtgcagcttcctttggtggtgtacagttaacaccccttcc

SEQ ID NO: 2628 - DNA, 325 bp, Bacillus thuringiensis
atgagagcttctgtccagcaaaaggggagcggccgtaccttggcccatttgctggcgtatttacgtaggctcctgcacgacgtccagcatgacatgaacaatggctcaccttataggtggcgaatccccacaggactgtaaggacaccaggtcggaagcagctgaaagctccctcgggcgctctcccgttacaaccctggctacatccggaaaccggcccgcctatgtgcctacggcaagtgcggcgctcattgagagataacgctgcacgcatctaatgcccgacgtatgcaatgcgcgcgagggagaaatgtgtgcacaaacc

SEQ ID NO: 2629 - DNA, 175 bp, Bacillus thuringiensis
acacacttgatcattcttcattacccattcaagcattggggggccgtacgtactacctgggactaaatccccaactaccagtaccatgtttcgcaacacgctctgtcagttctttttccttcgtaagacagttccggacagttgaaacttcttgatttaattttccttcataacc

SEQ ID NO: 2630 - DNA, 294 bp, Bacillus thuringiensis
aaaacccgacaggctgagaagcttgccactaattagattaccgatatattgaacaaaacccagcagctaacaaggggacttttaagggggcaccagaaccgaccgctaaaaggtctactgacattccaaaacaaaagttatgaagctacaatgctttaaatacaaagtcaggtccaaagcaacttacagcaagcataacaacgggagtggggctgacgggcaaagacggaaaaccatttatagaggaaagcctatcaagaacaaattgccttgcgaaggcttagagtacatggg

SEQ ID NO: 2631 - DNA, 302 bp, Bacillus thuringiensis
  unsure (1)...(302): unsure at all n locations
tcacaaaaatcgacgtctcaacccngagaaggcaaccccccgcaggactanacaaatgccatttttaagagaaaccccgctccccccaacgctagantaaaaaaaccctacaccttaccgaaaacctaaaacaatccaacccttcgggaaacgaaaccccacctaagagccaaagatagacgtgaccaaaatcagcgaaagcaaaacgctcaaaacgggaatatgagaacaaacccccagaaaaaccaaaccgaagcgccaaaacccgaaacaaatatctcgcaaacaacccgggacgacac

SEQ ID NO: 2632 - DNA, 354 bp, Bacillus thuringiensis
acactgcctttacgggcggggtgccgcgggcattacctacgctacatcgatccaaacaatactgaagcaccttgtagatcctcggaaagagaaacaaaggctatcagatgctatctatatagtaggtgcatcgcacacatgacaagacttactacataactaggtattcgcatcctagtgtaacctacttagtggaatttgtcgacatgatgaatgttccaacaaacatataaccatggaatgattctaggtgagatcagcatgagaatgaaacggcaaatggttgcgtaataggcgcactgtgtgataaagacaagggacgtgacgaaatccaagttcttatacatgaaagtg

SEQ ID NO: 2633 - DNA, 207 bp, Bacillus thuringiensis
ctgggatgccaaagaataaaatagggagtgcttatgaaacgggagttcgtttacagcgccagcttcagggaataaataacagccaaggtactgctttaaggtaaatgattcgctgagtcagattataaaacgaccactgtacgccattaccgtgatgagcatttgttaaaatatttaccactgggcaaaccgaattgcatgtgaata

SEQ ID NO: 2634 - DNA, 225 bp, Bacillus thuringiensis
  unsure (1)...(225): unsure at all n locations
ntggaattattagtttgtacnatgttctctgttatgaaccggggannnaaattagaagggtagtaacctcgtgattatgaatcgnncagctcacaatatatgtataagctgnngcgggaaagattcgttcattattgggtcaatctcgcggatgaggttatgatgccatggttttatcagactgggttcaatcatagcggtgggaatgatgggtccgcacatttt

SEQ ID NO: 2635 - DNA, 470 bp, Bacillus thuringiensis
caacgctctgtgcgaggcggcttgcgaacggagctcatgatcgatcacgaaccaactgactcgttgctctgggtcggatatcagcaaatagcggggtcacggcactcgatggcagttatactgcctttctgggaatcaagacatatcacccgttacaacgacttaacgattgccggctagggccctactccgtctaaaggccgtgctgcatgggtatctccatatgctgcatgatcatgccatgcatcacactttaataccctacagtcataggtggcaaagcccatcaggaccatggagaaagcatgcagagccgacctgaaagcatctcgcgcgctgttatgttacaaccctgatgccatccggctacctgaactggactataactaatggcagcgcggctctttataattgctcacgctcaacgtactaaacagtgcactatgattgaagctctactctgatccact

SEQ ID NO: 2636 - DNA, 317 bp, Bacillus thuringiensis
  unsure (1)...(317): unsure at all n locations
tggggatatcggcaatgatgtaccatatagccatcctaaatatataaaacccacttcgtttttaatgggggcattatccattttcgcttgctgtattatctcatancttatcnnattttcgtttattnntttgatgaaagggtggccnnntattatatgaatgaatacannagattccaannntcgttcaataaaagaacctggttataatacatcataaaaggggatatgcccaggagaaatttctggttcaataccccccttataacaatagtcgaggccaaggggaaatttaattattatttgctnnncaaaaa

SEQ ID NO: 2637 - DNA, 234 bp, Bacillus thuringiensis
gaaggaactatggggcactgaaaaacaaacacggcattctgggactacggggcggaataaccgcacagtaaaaaccggggaaacagaaatccaaaaaactggagaggaccaaaacggaagagtacgaaaacaggccgataaaaaagggcatggtgataacaacagaaaaaggatgacatcggttaacaccaaacgggaacacacggacctttaaatacacaatcaaaccctgaa

SEQ ID NO: 2638 - DNA, 319 bp, Bacillus thuringiensis
  unsure (1)...(319): unsure at all n locations
cagcaacagcccacaaaaaagtaacataaaggggngaccccaacaccacccgaagggaaataaaaaaaaaaaacttaatcgatgaaaccaatgcaatcaaaaaaggatacacatcccacgcaaactaccgaacaaacgaaggagcaaaactataaaggaaatgactgaagctataccaaaaaacaaaaggaaagccaccattgactcaacgaacacaaaatgaacccacacaaanctatctcaatacctcgtgaagatgcgccccaacacaaaccccacaataagaccaaaagctacaaaaaccccgaacacaacaaga

SEQ ID NO: 2639 - DNA, 150 bp, Bacillus thuringiensis
cacgcgacacatcggagccccagaacgcgagatctgcctatcaagacaacgatttttagcacaagtgtacaggcagcactgggggaactgccgggaaaggggttcccatattaccagcagtgcgccccagatggtccgtcattgggaccg

SEQ ID NO: 2640 - DNA, 320 bp, Bacillus thuringiensis
  unsure (1)...(320): unsure at all n locations
acaaaaaaacncgcannaagacagccagaacgaanaccacnggngcaaaccaaacacgggcccgngccgnangcacaganaaagcgccagcnaangcggcgacggagagaaggcgncaccacgccacaagaaacggacgcncanggcgngcngcaccaacgcnacaacgnggcacnanagcaacagaannncggcnacanccaaaagaacaaacggangcngacaaaacgcnagaagacanagccaanagaacagcgaccgaagaacacaanaaaaaagacacagaaccagaaagaagnacaagcacccaaaaagagggc

SEQ ID NO: 2641 - DNA, 341 bp, Bacillus thuringiensis
  unsure (1)...(341): unsure at all n locations
aaagaaaacccgaccangggaaaattttaagacgggggacggacgatacccnganacagcacaagnaaagaaaagngacagcacaaaaaacacngcaacncnagnaagccacncngaagnngaagacgaacaagaacacggaggggggaaagaagacgcannnaanccnaaaaagccaacanccaccggaaagccncaaaaagaggaaccnccagaccangnacgggaagaaanagaacanggagaaaggccgcacggnagaggaacaanggacangaaangcggccncgcaacacaaaaggcaacgaangaacaagcangcgaaggaagaaacgacggaa

SEQ ID NO: 2642 - DNA, 134 bp, Bacillus thuringiensis
  unsure (1)...(134): unsure at all n locations
tagaagaagccccannngcnaagacgggagcaaagggggcnncgggggggnacaaggcaaagaagagangcacccagnagaanaagagaaacagcgggacgacgggggngagcggganaacganaaggganaca

SEQ ID NO: 2643 - DNA, 124 bp, Bacillus thuringiensis
attacgatttcattgcccacctggacaagaataacaaacgtccatcccgttgctattacgattacggggcacatacccataacttgtatgccaagcattgatatcaaacgagaaaaattgaata

SEQ ID NO: 2644 - DNA, 213 bp, Bacillus thuringiensis
gctttgactaatggaggcaaaaaactgattggggctggtcacataagaggccgttggggttctacaacgactggacatactagagaaaccgatgctatacgcgcatgcgacatgcgtggacccggacttaaccttgattgtgtcgttacaccagatgatgttacaacgggccatagctgttcatggatgagctataaaaatgcatcggaactc

SEQ ID NO: 2645 - DNA, 134 bp, Bacillus thuringiensis
atcatatattttcgtctccttttctcactcctcctagagacgctgtctatcccatataaggactctttaaaatttgatgcgtttacccccgcccttctaaccgactgacctcccatttcttctctcattcttca

SEQ ID NO: 2646 - DNA, 142 bp, Bacillus thuringiensis
  unsure (1)...(142): unsure at all n locations
ttttnccattccttttatatctaaaatcttattctctactaatngnataaccaataagggggacttataaaaaaataagaggttttaaataaactaaacctcctccaaatattattagtataataaaccatattcctgcata

SEQ ID NO: 2647 - DNA, 124 bp, Bacillus thuringiensis
tgatttatcgcctacttctccttacatagacgggacactactaagaacttttaaaaaattgcagctggattaacagaaacaatcgaatctgcaaaatgaaaagacgtttctgctacgttattta

SEQ ID NO: 2648 - DNA, 294 bp, Bacillus thuringiensis
  unsure (1)...(294): unsure at all n locations
aaggaggggaaaaagaaaggaaccnngacagaaacgaaaagggcaaggagaacgaagaaggaaacagaaaaagcaggaaagccagaagcgacaaaggaaaacagagaagaaaaagaaaaagaaacaagaggggcggaacaagagggagaacacagagagaagggaacaaaagcaaaagaaaaagcagagaaggaccaaacaaaacaccaacaagagaacgacgggcgaaacggaaccgaaaaaagaagccagacacgaaaagacgcagaaaaaccaaacgaaaaagaggaccca

SEQ ID NO: 2649 - DNA, 244 bp, Bacillus thuringiensis
  unsure (1)...(244): unsure at all n locations
caccaggagaaaaagaannccagccactttaagagcgngcgacccggacacacgcaaaaggggaagggaanaaaanagaaacacaaacagnggnggncncaccgaccgcaaanagcaggggaagcaaacggnanngnaaaaacaaaacagcnaaaaaacaaaaaagcncagccgaaanggccagcaaacgagcaggcacgaagaaaagaccccaaaacaccancccaaccnggaagggaacaag

SEQ ID NO: 2650 - DNA, 164 bp, Bacillus thuringiensis
  unsure (1)...(164): unsure at all n locations
caaacgcaaaccaaaccagcnacgcgcgcgagacaagcngaaagcaaagaagagaaaccccaccaagaacaaagaagaaaagacgcagaccaagacannangaaccaagcacacgcgcccaaaagagagaaagcnaaagagcacgaacaaaagcaggggccacg

SEQ ID NO: 2651 - DNA, 252 bp, Bacillus thuringiensis
gcgactaccttgatacagaaggcgtcataaggcgtttcatccaatactcttacttgggcatgacacaccacttgccgcactagagactgttagactatatatgctctgactctattaaagaatgagacccatgtgtacagaccctgcattagaccgcgaccgagaaacagaacactgttctacgacgctctgtactgggggagcgctcaagcatatatgagcggcgcaaacggacatctctagttgaaatgc

SEQ ID NO: 2652 - DNA, 198 bp, Bacillus thuringiensis
cgttaaggggattttcatgctattcattaaaggcctaaccttttccatggctggccataaaaagcttttttaaaatggcggagtagcattgcctaaccaaaggagaccggctccctcggtgtgacaaaccggttttggtagcgtaatgaaagaaacctgccctgaggaattttactgccagtagctgaggtgaagaaa

SEQ ID NO: 2653 - DNA, 291 bp, Bacillus thuringiensis
  unsure (1)...(291): unsure at all n locations
ncggaatgcatttccacacagaaaggcaaaggcattgtgccttttaagatcatgcccgccttaaaacggcgcaagccgatttaagcaataaagctcaattgcacgtatagggccgcttgttgggcaccataaacaaagactttcacgacagatccaatctaacatacttcgactataccttttgagtgcgatagataaattccaccacctaaggaagtttaaccaatgccatcgtgcgcgcctgcatttaccagtataaataaagtttcactactgtaagggactaaccca

SEQ ID NO: 2654 - DNA, 104 bp, Bacillus thuringiensis
gtacgtatcggagccgcatatctgagtctaaaacaagcatctgtattgtttaagagcatgtcgactttgtgctcgttgcagaatcctatgatacatatatccaa

SEQ ID NO: 2655 - DNA, 316 bp, Bacillus thuringiensis
gccgccggactactcccatattttttcccgactcgttccacgtacagaacaggactatttcgggcaacatgagactgctagggggttagacagtataccttcttttccgctcgagtgactacatgcccacgcatcgactcagccccatcttctatgactatagggaaatagcagaaatgacctggcctctcattagccaaagcgaaaattgtattacaccggggccttacatgtaattcaattccctcagccgtgcacctcagatgggctgtgccagaatttaaaacactatggaagaagtatgactccggaaccc

SEQ ID NO: 2656 - DNA, 164 bp, Bacillus thuringiensis
gcggacctgacaaacaaattctattgctcaaatcgacgcactctcccggggggccacatgaggaccatggtgcccagaactactattcaacatagattctcaatttttaaaaaaccaggtaaatttgcacactctcatcaacaacgcaattgaacttcagcgag

SEQ ID NO: 2657 - DNA, 121 bp, Bacillus thuringiensis
tggcacatatggataccatgtatttactgtatcggactttcaaaacgcagtaaacattcttgcagaagaacacccagagtcagttttattagagcttaattgaccgtgattcgatgggtcc

SEQ ID NO: 2658 - DNA, 129 bp, Bacillus thuringiensis
tgacccatattacaatcaatttttatcagaattgtccataaatagctatggggacagatgttactaagattctccacattttgcattcattcctctaatagtcaactacacaatagtttggtaaccctg

SEQ ID NO: 2659 - DNA, 113 bp, Bacillus thuringiensis
aacgtctatcatcctttatctaaaaacatatgtaaatataataaaaagcgaatgattaatagaaatatcccctttttatcggacttctttttattgaacttttattttcttta

SEQ ID NO: 2660 - DNA, 324 bp, Bacillus thuringiensis
  unsure (1)...(324): unsure at all n locations
aaaaccgcgaaaacccaaaaaanggaaaacanacgcaacccccacgacgcacgccagaacaacagccacaacgcaaanagcccaggcaacaacaccaaaaagcgcanccagcaaaacaaaaaaaccaccgcangaagcaccganccgaaaangnaaacaaagccacccaagcggnggcccacaccacagagaccagagaaacacaaaaggaacaacccaaaaaccangacccaggcgcaacgcaccaacaaaggccagagcagcaagagaaccaccccgggagaccacaacgggaaaaggngcaaacacacgacccacaacacc

SEQ ID NO: 2661 - DNA, 120 bp, Bacillus thuringiensis
caaggaaactaaccacagcgaaccccgggaaaacagcacaccaggcaacagaagaaaaaccagaaccaggagaaaaaaacgcagaagcgcaggcagagaaccagcgccggacgcaaacga

SEQ ID NO: 2662 - DNA, 373 bp, Bacillus thuringiensis
aggatggagagaagaaaagattaagccacaataatagaaaaagcaatggaaaagaatgagaagcaaccaagacggacggagattaataagcatgctcttgagtaaaaaaaaccggagaatacaggggagcccaggaaccgaaacagaagcgcgcaacccgcactaataaaagaggaaataaaacaagcaaccgaaacatcttggcaagaatacaagaaagactgggcaaagataaaaacgatgaaaggtcaccaaaacactgaagctcaaaaagcacaagctacacgggattatcgataagagaaaacgaaagcaaccgacatcacacaagaaaggcgaatcaatatgaaaggccgaaacgaacatatgaacg

SEQ ID NO: 2663 - DNA, 369 bp, Bacillus thuringiensis
gatgaccacactaggataccttatttttcgggggaacagtccagctaaacgttgggactttcattcctggttggatgatcccgatccattataagctaacctctttgcaaaggggtacacttgatgttgataccctacattaatcgggagagactttcgtacgatgagtgatggccctttcatgcggaaccaacggatgactaagctcgacttaggtacctgcacgactttggaagtatggcagctaagtcaccttatggcatagaactctgcaaatgattttcacccatcatgagggaacctaagagagcctccgttacactataagaggcgacggtgcaatgcttgctgagaacctgacagctgaat

SEQ ID NO: 2664 - DNA, 277 bp, Bacillus thuringiensis
cgaaccggacagacaatcaacgaagacaacagaaagcaacggatacgcataaaacagcagacaacttgaaacagacccgccaatgtcaacagaaacagacgagccccgaagctaccacaacaaaaccgaagagctaacaacatgggagaccacaagaacccaacacgaacacacttgagacgccgaagatcccgagaagaaactgaaaaagaattatagcatcccgaacgggatacaccagctactacacacaaacgactgaccacacacactaaga

SEQ ID NO: 2665 - DNA, 307 bp, Bacillus thuringiensis
cgaacatatgatcggactgtatgacgactacacagctgctcaatacaccgaacaaactaactggggtaaagaatcagtcttgacattgtgttgtaaacaaggagcacctttatctcgttcttactttaacaatatacccattcactacatgataacaaattaatcacaatacatctgggaggcgatagacgtacaggaactgctcgtactaacaagcatgaacacttatggcgttaaagcaaagattacacactaggatctatttacgtgacactcgattcgaacataccggcatgccagtctagaa

SEQ ID NO: 2666 - DNA, 404 bp, Bacillus thuringiensis
  unsure (1)...(404): unsure at all n locations
aaatatnttttgacttcaaatgggttgtgtaaagaaggatatttaaatattttaagttaagaaatggtaattactaaggttttccagtataataggctccttactttttaaatatatgtcacattcaaggctgaaggtaaagaaagtaaaagtagacaacgcttgacaatgaaaattacgatagatacaatgagaatgtatattttttcttatatacgatatactttttctcaagaagagaagtaatattcggagtatggttttaatcttaccgaaataattatatgacattttaattgtgaaatgaaaaatgttctttaaaaaaggccgacgaccgtttttgtgtatgttgtaattaatgttcttgccacagttttttttatttatacacgggaggtgaaatt

SEQ ID NO: 2667 - DNA, 335 bp, Bacillus thuringiensis
  unsure (1)...(335): unsure at all n locations
aaaccccaaanacaaacggnaaaaagcgaactctgaaaaatccgagaaaacaagatcgaggaggaacaaggagcgcaaaaacccatatgagaagcaaaaaaagaagctgaaaancagaccaaacaacgaagggggccggacgaaacgcacaccacaacaagcatcggcagaagtacgacacagaagatggcgccgaaagaccaaaaaaaaagaggaagaaaagacacgccaccgagaaacaaaccgacacaacacaacaaaggagaaaaacgcgaaacgggaccaagacccacaaggaaagcaacccgaaaaacagggaaacaaagcaacaggaa

SEQ ID NO: 2668 - DNA, 233 bp, Bacillus thuringiensis
ccatcatcctggtttgccgagcatacaaattagattgacgaaagacattatttttataacaggcataaaaggaagtaggagtagtattacaacgaatgcaagagggctaacgaatgctccgaatatgaaagctgtttcgagtgaaaatcggccttgagggtatgacgtcatgtggtattacctacagcgaaaccaacagtaattaccatgactaactttgttactggttgacc

SEQ ID NO: 2669 - DNA, 153 bp, Bacillus thuringiensis
ttatcaaaccatctcgatttttttttagagaccgaaaataacaaacttgtggtcaacgcgtcctgacgcttgcctcccattggccatttggcaggcatggacagccccatgttcgctttcttattatgaataggaacgacggatgattcactg

SEQ ID NO: 2670 - DNA, 104 bp, Bacillus thuringiensis
atcgatcgcccttccccacttatgcttcacctgcatggcacaatggaacaggtgggaaaagctatattggggacgactccgaatgcttattgtactgtgatgga

SEQ ID NO: 2671 - DNA, 173 bp, Bacillus thuringiensis
cgagaaaaaccaaccttttctattttattagcccgaatcgcttcaactgactggtgatcaagctgtcctgacgcttccatctcatccgcatttaggaatgctctcagagcccaaatcatgactctttactaaagtaaccatcttcacgacctggttcataccctaagctctta

SEQ ID NO: 2672 - DNA, 273 bp, Bacillus thuringiensis
cccccaaaaatcatcgctaattggctcacctaacttttaagattgtggtatgaacatatttctacgaaataacactgatataagacaaatcggataacagccaactttcaacacaatgcgtattgattcgcgcaggctctaagcctggtagcttaacacacggggggccggctgggcgtgatttatagtgcactaatggcgacaataatggccgcgttacacgcgtactggaaacttgggtaccacttatcgcttgagacatcccttcgcagt

SEQ ID NO: 2673 - DNA, 157 bp, Bacillus thuringiensis
acaaactctgcattcccttgaaataattccgaactaaagcccgtaccaaaagacgtattaggcactgcccatactttaacgaactcaaccccaagaaacggaaaaacattcccttctacatcttttggttcagaaaaagttcgctctaccacgaaac

SEQ ID NO: 2674 - DNA, 131 bp, Bacillus thuringiensis
  unsure (1)...(131): unsure at all n locations
ggggggnantacattaccagatgaagacaggattgcatttgtaaacgaattgaacttgctggtgaggaatccgatggaaacattacacatgatctttttgtggtaccgaatgagggttaaactgtagtgga

SEQ ID NO: 2675 - DNA, 389 bp, Bacillus thuringiensis
agggaaaattttaggcacaaaagaaaaccgacgcttataaaaacccaggcgacccctaaaaggaaggggggcattttataaaaaaacaggggacgcatcaaagacactaaagaaaacaagggaaaaaaaaaaggaggcccccggcagggtccagaaaccacaataagggcggtgccaaactgaggcgaaaaggcccttcccaaggggaccagataaaaaggggacggcctaacaacccgaccccaaaaacacaaaggaaggcacaaccacaaggacatcccacatcggaaaacccggcctaacaaaagggcgacataagatcctgcaaacggaacccaaaccccaataggagaggcaaaccaaaaggtaacgccgaccaagaaaaagga

SEQ ID NO: 2676 - DNA, 244 bp, Bacillus thuringiensis
cgtcgacgacgaaagcagatcgcaggcggcgcacatttttatcctacgcgagcctcaaaagcgctcggggggaaattttcggcgagactgcccacacataacaagggctaccgcacaagagagaacaccacggaagaagcccacgagaaccatataccgagtaaacaatgcaagaccatagtacgctgaatggctagaaagaaaccgaagaccgtcatcactctcctttcacggaaagacacac

SEQ ID NO: 2677 - DNA, 139 bp, Bacillus thuringiensis
tgcaaatggcactcatgacgatacgtatacaaggccaaaaaagcgccccattcagtggggtattaagcaagaaacgaatggcatacagcacattagctcacaatctgaataactacgcgcactgcttacacgaccctta

SEQ ID NO: 2678 - DNA, 230 bp, Bacillus thuringiensis
ccgcacatgagtcaaagacagcgcatctgaacgaacaagctcatatccaacctggcgcgcaccttaaaatgttgaggcaagacatccggaaacagagcacggattaaccgcaaggtcgatatcaatggacggtaaaaaagaggactcctgctggagacagaaaccatcacctagaggtggcgtaacgctgctcagaaagagcgctacacagggggcacagatcacaaggg

SEQ ID NO: 2679 - DNA, 176 bp, Bacillus thuringiensis
  unsure (1)...(176): unsure at all n locations
gagaagcangacgacgaatgcagagggcaggaggcgcgcccgaagtatcaaaacgagcgaaaacaagcgccaaggggggaaaatataggaagnaacgggacgcacacgacgagcgagagcacaacagaaaaggccaccaaaaaggcgcacaagaaacagagagcggaaagaaacag

SEQ ID NO: 2680 - DNA, 354 bp, Bacillus thuringiensis
ggcaaaaggcgcgacggatgtttcacttggagcgtatacaagcctaattaacgaaatcttataccaagtaaggggtcgcgcacggcgaacgatagcacaacagaaaaggccacccagaaggctcgcaagaaactgagtgaggaagggaacagggcccccagaaaaggctgaaaggattgatagaacctgatcagacgagcagctgtcgtttacggcatgagacaccggctcgggcgtgagatggcaagaaccgaagcgaagcagttggatcggattgaacatacgacagtcaccaccgagtatatcgattgaatggggataatattgcagaaagcgtcggatacgaaccgatac

SEQ ID NO: 2681 - DNA, 298 bp, Bacillus thuringiensis
agatagttgaggcgccattttttcctatgaaagccttaataagcgctaggggggaaattgcaggcatagaagtcatatgatactatggggtaccccacaggagtgaatgctactgctggtgttaccgtgaacattattcagggagtaaactggtacaccataggacgctgtgtggcctgaaagaaaccatttatcgaaatgacttattttgacgggaagccgctcccaggcactcttaacgtgaaaggactgactatcaaaccattgatatggagagaacatccgatcttcaccaact

SEQ ID NO: 2682 - DNA, 306 bp, Bacillus thuringiensis
cgcatcaggcactacgagacatcttgttcgtaaagtgggtcctttaaccacgtgcctagcgagcatgtgcacctgcggctaaagcgagaacatcatccgaactgcacctaggagtgatcattattcttaccgtgctgattcatacaacgcgcatattagatatacccgcacttcttgtacggacatacacgatacagcatgacacgccgatacgagaatcagcttttgtctacaaacgcctttctgcgcgaggtattatacacggacctgtattactactactcggtttagccgaatgaccaaaag

SEQ ID NO: 2683 - DNA, 202 bp, Bacillus thuringiensis
agctcactcaaaggcggtagatcgggctctttcagtttcttgtctttacattggaaaatacattcgagtgcaaggcattctatggttcagtgcgcgtcatgttgccatgcaggctggtgctcatgcacccattctgccaagcggagcataataagctagttcgctttcaaggacattggtagctgacccttacagaactcta

SEQ ID NO: 2684 - DNA, 125 bp, Bacillus thuringiensis
ggatacacactccgcgattccgtgcgcgttccacctaggctcaggtaatcaagctctttttcctgttctaatacgaccataaccctgtagtggagcttatgtgtacgaacagaccccctcgcggg

SEQ ID NO: 2685 - DNA, 386 bp, Bacillus thuringiensis
gcagaggagaggtgtctgccaccattggcacaccttttgtcgtatgtaccctcgaaactaaaaaacatagcctcttacactgtgggcatggccctagcactatatatatagaggagctcggcatgtgaccgggcttgctcgtgaaacactatgcagctgagcatgtttcacggatctcactaggttacgctgttggcgatcacatcaatgggagagctacgtgcaaacatgcttacaacgatcatccgcaacgcacatgtcatcccatgctatgccattgacataacatgtggcactcctgcggcactgtcatccaggctgacgggcccgaaggacagaccctctcaaatgtactactatcacgacggatacgtaccgaactggat

SEQ ID NO: 2686 - DNA, 292 bp, Bacillus thuringiensis
gtcgtgattacgactacttttatgaaggaacggtgtaaattatcttttctttttaccaacataccatgatgtagcaggaggggtacctctgggtacaaacgcacccattaaatggatattacccacatcaaatatttctatagcgggtggaattacatcactccctagtgccttatgacgctgtgctcaaggatacacttccaacaacattttttcgaatttcatataacattaaaacgtggcggttcgagaggtaacactattttcgatctctttaacactccaagtacct

SEQ ID NO: 2687 - DNA, 262 bp, Bacillus thuringiensis
  unsure (1)...(262): unsure at all n locations
cccacaagaaaacaagcacggacaacagaaaaaccacgcacataaaaaaccaagcgagncccaaaaagaaagcgagcaagatataaagaaacaaccgacgtatcaaaaacaccaaagacaacaanggaaccaaaaaaagacgacacccgaaggagccagaaaccaccaccaagacggcgccaaaccgaaccacaaaacgaccagcacaaagggaacagaccacaaagggaccgccaaacaacccgcgccccaaaacacaaag

SEQ ID NO: 2688 - DNA, 362 bp, Bacillus thuringiensis
gcgcacatgacactggttctggtcactatgaaacgtgcttgctttatgacgcgctgcgcttgctcaacggcacgggagcatgaatttaaatcccagatgactgagtatcctcgatatggatattacacgacatccgcatcgaactcgactgtagcagacaggagcgctgcatatgttgttgcgtacggattttcagcatgttcacaactaacggttcagatacctacacgaacgcatgatgatacgccatccacgacggctaggcatacttcttcgccgtcactaataccatcagataatgctggctaatcacagagggatataccttctttaagcaagttgcataatctcattatgaacaa

SEQ ID NO: 2689 - DNA, 220 bp, Bacillus thuringiensis
ctccgcgatatgtttcttcgtgcatgtctcaaaatgcatggggattagtttcttctatcattctaacgggactgattgctacgggggtgtcatactttgtaccctccgctgtaaattttattgcctgcgaggagccagctgttgggaaagcttctttttgtcattgtgaccttatgttctccctttttaagcttttgcactctcatttttaaacgttgcc

SEQ ID NO: 2690 - DNA, 366 bp, Bacillus thuringiensis
tcccagacactggatgaatggcccattgaattttccacaacactaacaggaatgacaacaacggggggaacaaactatttaccaagctcagcacattctagaactacacagagcccctcgttgtggagacgcgaacataattcatgaacccgtaccgacacactcagacgttcgtgcagatacggtgatagcaagtccagtacagccgacgggaaccccgcatgctgcgataacagaaactctgctcggggcaagggcatgtcacacttcggctcgtataaatatctcccctattatggaagacaaagcgcactaggcgaggggaagcacgacaataacgaccacttcttggttgtggggaagcaa

SEQ ID NO: 2691 - DNA, 107 bp, Bacillus thuringiensis
gtcagcagtactctacaagcacaaacgagtactttgactttacgatccgcaccgatatagacatatcgcatcgccggagacgttttggcatcactatctagaccgcc

SEQ ID NO: 2692 - DNA, 190 bp, Bacillus thuringiensis
cagagtacaataacaaaaagcgccttgaacgctaaggatcagcatttttagggcgctgtttgttatgagattatagagtgcaattatcggtaggctgactaggaagccacactgtgattacgcatgccaacagctgctgttgcgacgtacgtatacgctgcttcagaaatatcggtcttatctacataaa

SEQ ID NO: 2693 - DNA, 442 bp, Bacillus thuringiensis
tttaccacttgaacagaatcttccttgatgatatcatgccttttttcggattactgtacgtctgccacttccagagaaaagaatggccatgccgagtattgattttgatcaaaaagcccataccgcttcactgtatatgatgcgccctactgactgcttcccactgggtgctcgtaaactacatgcataagctgttctctttctacgatggctttccactcatttaatgcaccattggatacgctctcaataaacgtaaatgcgatcaccccatcccgctgatttccacgataccatttccgcactaaggatgaaagcgaccctatagatgccgagccatctaatacaactaacttattggctaacgaccacattatctcaatccgcatttacgacactggcatcccatctaaacacataaagcctctcaccagaaacaaag

SEQ ID NO: 2694 - DNA, 378 bp, Bacillus thuringiensis
ttaatctcaggcatctcacagacggcataattattgatttatgtcaacatactatacggaaaccagacgccggggtaatggaggcccgtgcacatgcaaatatacctcaagctaagatgagaccactgcatgtgccagacatgatcatgctgggcacgcgcctcatataactcatgcggcatgtgtcaggacacattccagtctggctattcaacactactcagagattgtctgtgctatcgtgcctccacccacagtagtaattctcttaaaatttgctccctgaaaaaattgcacccactcatcctcagttaatagttcttccatgccatatacttgggcgaattttacttcctaaccctattcaatgtgcctatc

SEQ ID NO: 2695 - DNA, 239 bp, Bacillus thuringiensis
  unsure (1)...(239): unsure at all n locations
aaaaaccaagcggataaaaacccccgcgggaccnggaangaaggggaacaaataaagaagaaaaacccgacggataacaaccaccagagagaccaacggaancaaaaaaagacgacacccgcaggaaacagaaaccaaccacccgaagccgcccaacaacaaacaaaaaggccccnacaaagggcacagaacacaaagggacggccaccaaaacaggaacccaaaacacaaaaggcaac

SEQ ID NO: 2696 - DNA, 150 bp, Bacillus thuringiensis
tcgagaagcaggacgaagaataaagaaagcaggaggcgcaaaactatattcaatccgcgccacaaaaagcgccaaagagggaaatataggaaagaaacagacaacagacgaagagcacgagcacagaagaagaaacaacgaaaaaagcaa

SEQ ID NO: 2697 - DNA, 269 bp, Bacillus thuringiensis
  unsure (1)...(269): unsure at all n locations
gacgaancagaaggaggaggcgcccacgagatccaacccgagccncaaaaagcgccaccggggaggatataggcaggnnacccacaacagacgacgagcacgagcacaaaagagaatactacgaaaaaagctgacaacgagcccataacgccgagaaaatggaagaccacagtatgctgcagggagggaaggaaacagaagaacgtcgtcaccaccctccacgggaagatgcaccggtgcaaacgagccaagaaatgaatgtagcacaa

SEQ ID NO: 2698 - DNA, 250 bp, Bacillus thuringiensis
  unsure (1)...(250): unsure at all n locations
gagcaggaggcgcacaaatatgaacctacncgagccnnaaaaagcgccaggggggaaatagcaggcanganacggagaacagacgaagagcncgagcacaaaagagaanaccacgaaaaanngccacaagagccaaaanggcgaaaaaaaagggaagaccacagnacgcagnanggagggaaagaaacagaagaacgnccacaccnncccacacgggaagaagcaccggggcaaacgncccaagaaaaga

SEQ ID NO: 2699 - DNA, 404 bp, Bacillus thuringiensis
  unsure (1)...(404): unsure at all n locations
aacagaaggcaagaggcacccagggagaaaacacacgagccnaaaaaagcgccaggcgagaaataagaggcangacaccccaaaaaaacaangagcgcgagcacaaaagagaaaaccacgaaaaacgctcacaagaaccaaaagacggaaaaaaaaaggaagaccacagaaagccggaaggaacgaaagaaacagaagaaccgacacaccgcccaagacgggaagaagcaccggtgcaaacgagccaagaaaagaagggatcacaaacacacggaacggaaaaaacaccccgaaccacaccaacccgaaaaacggaagacaaaaacaaaaacaggaaaaaaaacggcggagaacaaaccggaccccaaaaagaaagaaagggaaacaacggggaaaaagaaaaa

SEQ ID NO: 2700 - DNA, 371 bp, Bacillus thuringiensis
cacaaggcagaaaacgcgccaaggggggcaaaataagcccgaaacagcgcacagacaaagagcgcgagcacgaaacagaaaacaaccaaagaggccgaccacaaacgaaaaaacgacaaaaaacgcaagaccgaaccatgcagcgcggagagaaagaaacacaagaacgtgctgacaggattgaacgagacgaaacaccggggcaaacgccccaagcagggagaggcacacaagcaaacgaaacgggaaaagcacgcgagccacaccaacgaaaaaaacgaaagcaccagaacccaaccagcgaaaaaagcggaggaaaaaaccgaaccccgaaagaaaaaaggggaacacaccgtgcgcaagagaaaaaa

SEQ ID NO: 2701 - DNA, 125 bp, Bacillus thuringiensis
cacagcgcgtcaagagcagggactaacggaaaagcccttctctcaacttcaggtacaacctcttctgggtcgtatggacactgaatagatttcttcacaacaaccaactatagggtgaatgagct

SEQ ID NO: 2702 - DNA, 272 bp, Bacillus thuringiensis
actcacactgatcgcgatgggtgagtctgcacaacagatatgcggctcgccgctagctcacctcgaagaggcattgccgttttatcaccatagacgaggagcggagtactactgcgcggctggtggtgatgattctcagccgcacagtattaccacatcagccggattcgtgctggcaagaggtgccatagcaggatcacatgatggctctcgagctgaccatttcatcaagtccagctgatttatgagcagaacctggatttgaagtcata

SEQ ID NO: 2703 - DNA, 195 bp, Bacillus thuringiensis
  unsure (1)...(195): unsure at all n locations
caaaggcaaaagaacaggggcaatttgagggggggacccgcgagcaccccaaaaccgacnacagaagcagaaaagaaagccgccaacaacgacgccncacacacacaaaangcagcaagaaaaacaaacgacacaaacgacaanccaaagcaagcagacgcgaagcagcaacaagccccacaaaagggcgcgaca

SEQ ID NO: 2704 - DNA, 193 bp, Bacillus thuringiensis
  unsure (1)...(193): unsure at all n locations
accagaaaaacgagcaacccggccaccaaagaaaggagcaaccaagccaccacaaaaacgagcaccgcaaacaccgggaaccggggcacaagctccaaaacaaaaacaaccgaggaggcaaacaagagcaccacaacagccaaaagacgnnccaccgaacagcccagacaaaacgccaaacccgcccgaaaaa

SEQ ID NO: 2705 - DNA, 221 bp, Bacillus thuringiensis
  unsure (1)...(221): unsure at all n locations
aacaacagtagacnctgaggtagcaataacgactacagaacgaataaatatcggtagagaagtgataaaatactctatacttcaaataaatactaagcatgaataaggcgaggaaacatcaaaagacataaataaactagttacacaaacacaacaggaaagatacatctctcacagcaattactaatattgccgaacaaacgaaacaaacagccttaaat

SEQ ID NO: 2706 - DNA, 305 bp, Bacillus thuringiensis
  unsure (1)...(305): unsure at all n locations
aaaacagcaaagnnccnncaaaaacngccacgaacgaccccncacggcaagccgaacaaaaccccggaacgaaggcaaccggacangacaacaagccnggaaaaacagngccaacccacgagagnggngaccacccgaacacanggaaccagcaccacggcaggcggcggaccgccagaaccggcaacgacngggaggcnnanaccncaaaaccccccccnggaacagaaaaagaagacgcagagcgcncngcacgaaggaccganaaagacaacaaacacaaggaaaaagcagcccaaacacag

SEQ ID NO: 2707 - DNA, 485 bp, Bacillus thuringiensis
taacagaaatatattttctcacagttctacagatcagaagcccaaaatgaaggtggcaggaccatgctctctagaaggctctaaggcagaatgtgttccatgcctttctcttactttctggtgttgaaggcaatcgtcagcattccttggcttacagctgcatcacaccaatctttccctgagtcatcacatgacattgtctctgtttctggttttacttggctgtcttcttaaaagagcaccagccatattagattataaacccaccctttaatgcagtgtgacttcattttaatttaactaattacatctgcagcaaccttatttccaaataaaatcatattctgaggtaaccaaggtaggacttcaataaatttttttgagggaacacaattcaacccaaagaatacccttgatggaataaatgaaagtgacacttaccctttcgattttcttccccaacccaaatcccatctatataaaac

SEQ ID NO: 2708 - DNA, 423 bp, Bacillus thuringiensis
gacagcgccgtgttgcaatggcctctttccagcacgctcgtttgctcgaaagggtgctccctgatcgcccgctgaacctgtcgcgactctctgaaggcgcttgtcgtactctttctttaatgatttgtcgaagttacagtcacattctggcgtaaccagatcttatagtgtccacttctccgcaaaacgcggtacccctctcgctttaccggattagtacgcgccagttatgcgtggtgttccctgtagcgacctgagttcaggatctaagaacacggtctactgcctcaaactgtcttttacttaccatggtgactatggtccagtccgtgtagctgaagccttgtcactcgttaacaggtcgatgggccgtttggcacttcctagaacccgttttggtagcctccagatttggtcttgtgt

SEQ ID NO: 2709 - DNA, 507 bp, Bacillus thuringiensis
agcgcgtctcgtctcggccccagaacgcgtgatgacgcggccgtcttgaactgtacttaccacagaaggctctcttgcctatcagcgtgctttttattactcagcactagctgtttccagtaactaaagcagctacgcgtcctctgtgtcagcatatctatagtactcactatccctatgcgacgtaaccataactacaacagctgatgctccaacaacggctggtcccacaacgtgattacgaaaaagatagatcgcacttactaactgcccctgctgtaagtaaccgggatacggattttaggctaactagtgcactcgtcccataaactgctttataaacgggatacttactatccacgctgtcatggtaacacctcctctacacgaaatagaccgaatggtactatgtcacgaccatgctaacgataatctaaagcccagcaaatttagagggccttcacataaagcaagactatattaccacgtacacatcggctgtgcttg

SEQ ID NO: 2710 - DNA, 110 bp, Bacillus thuringiensis
gatcgggggcgggaatatgatggcaaaattcacgacgctgtcgcgtcttatgagcatcacattttggccatattgccgcattggctggttacccttgctggtcataatac

SEQ ID NO: 2711 - DNA, 356 bp, Bacillus thuringiensis
ccgcgtgatcacacgctgactatatatagcatatgctcctaaggcttccttcttatggaaaatagctccagcctcctcagggggaggctgttatcacgtgaaacagcatctacccccactgactgggggaggccatgccccagtatcaggcccttgtgaggggtcatatcccataggcactctcatcgtgtatagcaacgctgatatcatgactaatacctaaggtggctaaaccacggagtaccttgtttataccaggcgctttgctaatgccgctgcctattgcgcaagcatgcttcctcacttccgcttgccggatgcctgaccatattacttcattcgggtagcgatgcgct

SEQ ID NO: 2712 - DNA, 518 bp, Bacillus thuringiensis
atcacgcgctgcctaacgagtggccgatgcaacacatcttttttttccgaagacaattgtcaccttcttctgtaggaacgctgtgagcgcctacccaggcacgatacctaataatgctgctctgattatttcacgaaacagacccttcgtggcatcgacaacaactgtagattccacttgttgacagaacgcatgacatttattgcatactgtgtccgtacataatgcaataggccccttgaaaacggtcttacgagcgtgaaaccagagtcttatacattgcaggaatgccacatgcatgactttgctttgacgatggccatttggttccgacgagtggtatgtatccatccgacgactacggcatgaataccacgttcgtgattcgatgatagcagatgctctcacttgagatgcagcaatctgttgtgtattcatgatacatacgtctgccccagaccgaaggatgtttcgaccgtcatgaagaaacacagctggattaatactattaccccatg

SEQ ID NO: 2713 - DNA, 140 bp, Bacillus thuringiensis
acgcgtcttttatgggaaccacacctcgtgataaaattaggaccttccatcccgttatctacaaaccaagctttttttaagcaaaaaccaacacaccccccccgggggaaccacaataaggccaaaaaaaacactccccc

SEQ ID NO: 2714 - DNA, 155 bp, Bacillus thuringiensis
  unsure (1)...(155): unsure at all n locations
aggcggggagaatacacctcgnacgaccttttttacgagagnaagccgcacagaaacggggggacaagaccagcagccccggaaagaacaacgggcacaacggaggagaaaacgcccaacanagagccggcacggaaacaagggggaggaaagcc

SEQ ID NO: 2715 - DNA, 128 bp, Bacillus thuringiensis
ccccacaaaatgccggcattaaaaagaacggcacggcggaaacgtgcaagcagcaaatatctcagctcacacggaacgcccggatacctaaagagacagaacacccccccctcacgcgaagaaaggcg

SEQ ID NO: 2716 - DNA, 278 bp, Bacillus thuringiensis
gagagaaaatgttacagaccggcgatcgacaggaacaccaggaaacgacctcaccacaaacgggataaaaaggggaaccaaggggaccaacaaagcggaaaccaccgcaaaacgacaggaaaccgagccaaaagacaaaaacactaagaaggcctaaacaaacccgcaccgcaacaaaagcaccgacaaaaacagcccgaaacacaccacccaccgcgccacaaaaaaaggcgaaaacaatcccaaagacagccaacgcaacccatacgagaaaaacc

SEQ ID NO: 2717 - DNA, 379 bp, Bacillus thuringiensis
  unsure (1)...(379): unsure at all n locations
aaaacagcaggcgcataaaacgaaaaaaaaaanttttgcaagcgaaaaagcagcgccaaaaagcgcagaagggaggggccgcgccggancccaccaccacaaacnaaggaanaaacggaggaacaaccaaacgccaaaagacaccacaaaaagcaaaaacaggcggaacagaccacggaacaacaaaaaacacacaaacgaagcagcgaacaccaaagcaacgaacgaacgaaaaccggcaaccaaaaaaaacggaacaggaacaaaagcaaacaacggcacaagcaaacgacccccacacgagaccaaccccaaacacgaacaggcgcaaccaccaacaagaaaggaaaaaacgcccggaaagaaacancaaaacgaa

SEQ ID NO: 2718 - DNA, 294 bp, Bacillus thuringiensis
  unsure (1)...(294): unsure at all n locations
cgaaaaccccagagaacgngagacaaagcgcaaagagcacggcaaacaccgtataaagcgcanaagaagggaagnaaaccagggggagccaccagggccagngagcaggcagcaacacacccggcgcaaaaagaaccggacgaaaaccaaaacaagcacacagcggagcaaaccaagcngccggcaaggccaacacccgaaaagaaccagcaaaaaanncaaacncgaagccagaacgcaccagaacaggaagcgggcaagaaagcgcaacacgcacaacacgaaagaaagacg

SEQ ID NO: 2719 - DNA, 128 bp, Bacillus thuringiensis
  unsure (1)...(128): unsure at all n locations
agaacagaaaaaagacaagaaaggccgaatacaccgaaagcgccgagaccaaancacaggcagnnaaaccaagngaaaaaacagaagggacgcaagcaggacaggggacaccagannacgcacaaggg

SEQ ID NO: 2720 - DNA, 106 bp, Bacillus thuringiensis
aagggtacccaaccacaaactgggcagactattacatttaagcgcaaatcgcttatacgtaccagatgcactcgacctacataccgcgtgtagaggcgcaccttac

SEQ ID NO: 2721 - DNA, 140 bp, Bacillus thuringiensis
cccccccccctcccctttgtacccctggagagggttcgcgctgttttcacccgaggggggaatttgacattgaggactccgggaagggtcttttcgcgcgtttgataccagaattgcgagggggcttgaaaggagcccca

SEQ ID NO: 2722 - DNA, 140 bp, Bacillus thuringiensis
taacgcctattggtggtgcatacgcatatataaaagctgcgaaaaaagcggcagctaggaaatgtataattcctgggggttatctccaaccatttttgtataccatcaagggcatctgcaattattcctgcccgtcagcc

SEQ ID NO: 2723 - DNA, 123 bp, Bacillus thuringiensis
aagctcgggagttcttgattggcttacatgcactcccatttaaagagtcttcataccccactagccgagcgactgggagcttttaaagaactggggtttaacacaccacctaagctgcggatt

SEQ ID NO: 2724 - DNA, 143 bp, Bacillus thuringiensis
attatatgttcttgataccaaataaggtgagtttgtacaacgcctggtgatacaaggtctattttatttctgtatacaacatatgtatcctttttgttgttatagcataaatgatgcgttcttttatgaaacttggacatatt

SEQ ID NO: 2725 - DNA, 109 bp, Bacillus thuringiensis
gaaggaaggacgctatatccaacaagccatatcctcaggaagacaattgatgctcgatgctgtgagaacatgcggattatccatgtcagaggaagcaaggggaatagaa

SEQ ID NO: 2726 - DNA, 157 bp, Bacillus thuringiensis
gaggggccggatttgtcgcgtcccccataggcgccgctccatatacgagtgtggcgagcgatcccttttatcccatagcaacgtgaatgcagtaaggaccaccttgttcacagcctttccccctggaatcgccctcttggggtgtttaccatcgcac

SEQ ID NO: 2727 - DNA, 260 bp, Bacillus thuringiensis
ggcctatagaacccgtgacgtatgctgtaaatcctataagggtagtaacacggatagcttgcccgtttatgaaactaatgtcagttgaaggctcaagctgcgtgtcttcaggcatggctcgatcgtaccatagtaacagcaccctgtttaaataacgagatccgtaggaatcaatcgaatgcagtactgaagttggcatcgttttagctacgagagaatacagtgcccgaataaggagctagggaaaacttttttcattg

SEQ ID NO: 2728 - DNA, 205 bp, Bacillus thuringiensis
aaaagggagggaaagagaacaagaaccggagggaaaggagaaaagaacaccagagggagagcaaaaaagaagcagaaaccgaggggcaagcaaaaaacagaaaccaaaaacgaacgaaggaaaaacacacggaaaaagaaccaaagaaaaaaaaagcaaaccaaggagaaccgaaaaaagaagaaccgaaacaaaagcaagcaca

SEQ ID NO: 2729 - DNA, 263 bp, Bacillus thuringiensis
aaagggatcgatacagaatgaagacgccaaccaaacttacttacaaggggaggaagaaaaaaacaccaagccaaaaacgagccaaggccaagatgaaccaagaagggacccaaaacaaacagtaacggattaacagaagagcggttcaaaccaaccggcccccacaagtaactggacagagatatgcacaggaagaacatccaacggaaaaagcaagacactgcacggaaaacggaaaacaagtccatccacccaaaaagaca

SEQ ID NO: 2730 - DNA, 254 bp, Bacillus thuringiensis
atattcaatctatacaatacggcatttgtaattgcttgaagagggggttattgctcatgtttggaaacgatcggaactgctaaaatcgaaacagtgccatactttccatatacagtcactgactacgggtaagggatcaccgtttagatccatatgaatatgatacaaacacgaaatgtatagcgagcatagtttaaatgaccttgtcatgcctgaattcaacatatgtttgcagacctggacattgtatgatc

SEQ ID NO: 2731 - DNA, 116 bp, Bacillus thuringiensis
tgctaagctaacgccggcgatcctgcctcggctttagctggtgatgattccgttcctgcatatactccatgtctacactgattcatgaacccctgcaattttgctcaagcagccga

SEQ ID NO: 2732 - DNA, 153 bp, Bacillus thuringiensis
tttttaccctcggtctatagcgtatttgactgaattggtagggatggatagtaatgcattcgtttgacaaccgagtcaagtagaaccactattacctccatttggtaaaaaacctgactaatttattgagtaaacgcggatctggatagatgc

SEQ ID NO: 2733 - DNA, 322 bp, Bacillus thuringiensis
ccccccccccccccccttttggcctctatagaggttttccgggctccccctctgacgcaggcgtttgcactaagtgaagcatcgggcaaacaaacaaaacaagcggccatgggatctaattacgggcaacagagatccgcacagttaattgaacatactgctcgactaccaaaattggggaacaatgccggggtaggccatacccacgtatggaaagccctattctacgaccctgtattccaaggacgcgtaagggataatcaaacagggcgtgagcttgatcatatgctggtgccaactatactgctatatttatcaccgg

SEQ ID NO: 2734 - DNA, 307 bp, Bacillus thuringiensis
taagaccataagaagatattcattcatgcttcaatcggacaggcctcaaccctactgtaggtctgtatacctaacacagtgacgtgacttcatgaggataggtattatcagccctggactattctcttatgcactcgctggcgatgtatcggttatcatcccaggacatgaaggctatattcacaatcgtggaagcatgtgatgaccacgagctgcgacgcctatcgtattcattctacgatggcacaccatatatacgcgctgacgaatgttacgacttcatgaacatggggatagctgacgctat

SEQ ID NO: 2735 - DNA, 208 bp, Bacillus thuringiensis
gttcaaaaataaataatgcaagatctttgtttcttacagtaaggaaaaaggattctagagtgcttaagacattaatagaagtaagagctccgggtatacctataaatacattacgtgtgaaacgttgtcataaaagcataaaaatgatgaatgtgcgttattggaggtatttaattttaagaaaaagtacttatagtgaatggggttc

SEQ ID NO: 2736 - DNA, 206 bp, Bacillus thuringiensis
caacggatgaagggcttagtgcatatgcaggcagccttattcgcagtccaatatcagggactggatgcagtgtcatcatgctgttatcttcatataccacaaagcaccgtgaagagaggttagctggcactcagggggcgagacaaatcaacgaaaacaggctacgcagcatccacagggtgaagcgatcctatttcacaaaggat

SEQ ID NO: 2737 - DNA, 318 bp, Bacillus thuringiensis
  unsure (1)...(318): unsure at all n locations
gacagaccgagagaagcaaaaacaggcagaaagagcggacaaggcaacaaaggaacgaacaaaacgcaaacgcaaaacgaaaaacccnnnaaagcgggaagacaacggcggannacaccaacnggcaanncggaaaaaaccacaaaacgggaaacaaaaccaccaaccgnnnaaacaaagacaaacncaacnncagagaaagcgaacngagaaggaacaaagaaagacaccaangcggacagcgnaaagcgaacacccacaacaacaaacaaaacggnaaacccaaccggaaccgcaacacaaaccggacgaacacaa

SEQ ID NO: 2738 - DNA, 332 bp, Bacillus thuringiensis
  unsure (1)...(332): unsure at all n locations
aacagaaacaaagnaaacnagcnggcaaacgaccaaagacgccananccaacaaccaagaaaagnngnnnccnccgccaaaccccaacgnaccaaagccaagcnngnncgcaacnacaaacacgnaccccncaagaagccgcaacccaggaaccggaccgacaacaccaaangcacggaacaaccgaaacccggcaaaaacacaaccngaagcgcggacacccccgaaaccaacaccaannacaccagcgccacaacccagccccagcgcccgaaacaccgcacgaagaaggcanccacgaaacccnaccaaaacacggcccagccgaccaa

SEQ ID NO: 2739 - DNA, 339 bp, Bacillus thuringiensis
  unsure (1)...(339): unsure at all n locations
agccagaacgacgcaaagaagaacgaacagcngaaaaaggaggccgacaaaagccagacgaagccaacganggagacggaaacgacggggcagaaaaaaaacggaacaaaccaggcaaggccacagnagcaacggaaaaaacggacaacacaaaaaaacgaaagcacaaaaaaagcaaaccggcgaaaacaggaaaaaaaacgacanaccgacaagaacagaacaaacaagcacccaacnaagagggagaagccgcncaaaaaaacaagggaacaaccccgancanaccagaacaaaccacagggagagaagaaaaangacaaaaacaaaaacggaaaa

SEQ ID NO: 2740 - DNA, 335 bp, Bacillus thuringiensis
  unsure (1)...(335): unsure at all n locations
cccgaagagaacgaaacccacggnaaggaacaaccaccaccaggcanncgcaaccgacaaagaaacgaccgacagaagacgagcccggcgcaaagagaaacaccnnacgcaccagcaaccnggcganggccacaaccagcaagcgcgaaagagaacngaaaaccacgagcgccaacgcccccaaagaaaaccgccgggaancacaacgccaaaccagacccgangnnaccgacaaaccaagccaccgnnngcggaacaacacaaaccgaacgncnagaaaccaggccgnaaacgacgaacgcccagaaaaggaaaggcgaacaacggcaaaaagc

SEQ ID NO: 2741 - DNA, 319 bp, Bacillus thuringiensis
  unsure (1)...(319): unsure at all n locations
ggtgtatctgtaaaacaatgggttggtttagtttagnttataatgcaaaagttaaaatatctttttgtttttggaattatacttgctgctgcattttttataggaaaagataaaatcatgcaaaaggcgcaagttctacgcttagagtttctatctgaaatgaaagaagcagctatgattgaagatgttccgtttattaaacaattaccagaattacctcgaggatgtgaagtgacaagtttagctatgttgctgcaatataaaggtgtacaagtagataagatgcaacttgctagcgaaattcatcgggttccatttg

SEQ ID NO: 2742 - DNA, 208 bp, Bacillus thuringiensis
ggtttttttgtgatagctccagatgctccaaccctattatatagacaaagatggctttcatgttattccacatatacatacgctggtgcaggcggtcttgcgatggtacctgcgggtgctccgccatgaaccgcgtgtgctagtagattacttataccactgactggctcttcactgtgtgctaaattaggatttccaattgcaagtg

SEQ ID NO: 2743 - DNA, 111 bp, Bacillus thuringiensis
tacttcaacgactgttcatggaaattctactccaaaattatcgcgcatagttatgttaaagaagatgtcttagacccgcaggcacctttaaccattctatatgtcagggaa

SEQ ID NO: 2744 - DNA, 220 bp, Bacillus thuringiensis
ttatttaactctgaacatttcgacatactcatattgtacttgataactacatcaagcaacatgatttaaacttgcttctattatctctcttttaccactcatgcttctgtaacatctcttaaaacaattttgttttcaaatctaaaaccttgctctttcataccctcaaataaaaaagtgtgaatcgcaaggctttttattcatctattcaattcaattt

SEQ ID NO: 2745 - DNA, 165 bp, Bacillus thuringiensis
aacgtgaaaacttacaatgaactctggactatacttatctaacatgaataatgctttatatcatacaggataagtactaatatacaagcccttaggagatgaactaaggatagtttgacagtcaatagtagcattttgtgtaaaccaaattagttaatgcgaaac

SEQ ID NO: 2746 - DNA, 117 bp, Bacillus thuringiensis
gaatatgtagcattattaattaaaatatgagggcacccaaactgtcagtaactatatttataagttcttttggtgcatccattcctgagttaacatctaacttccatatcttgatac

SEQ ID NO: 2747 - DNA, 212 bp, Bacillus thuringiensis
  unsure (1)...(212): unsure at all n locations
acaagcgggnaacaacacaggcagcaaaaagcccacaccaaaccagaaananagacangacacaaaacagacncaggaaaaggaccaacgcacgcacaacaggcnncgccaaaaacaaccncaaaaggaacgagcacgaaaagcgcgccaaagaaaaacacgcgaaaagcacaccgagcaaacacacacgcaccncaacaaaagaccgcgag

SEQ ID NO: 2748 - DNA, 435 bp, Bacillus thuringiensis
atacatatggatggtctcaacctctatttttcacatatatagcatcaagattgtgggggggatttataaaaaacctaggttaaaggtgatcaactacttcacatctcatatagcagcacggattacagagaatatctatacagatcatggcctatgtgagaactgattcacatagagagtaaagcgataggagtacgattggaatccaatccaagggaggcgtcgcgttaagagtgagaaaggctgtctgtgcattatgttatcagaaagtgggcatcttgaaccgaatcatagtttaactaaacaggaacaccaagaatatgagctatttgcaatcagtaatgtgcagaacccaaattatcttgaggaatggggggctcagaagacataccaaccggttacattattaatgtccactttatactatttggctct

SEQ ID NO: 2749 - DNA, 170 bp, Bacillus thuringiensis
tgattatggtcataccgcacaaaatactgcgttttttaccgcccatgcctgatgcgcagaggggggtttttaaaacccatgcgagtttgaaccagaaaacagctcaaaaaattgcttctaaaatgaagataacccctccttgtactacaccacctacgtatacacggaat

SEQ ID NO: 2750 - DNA, 163 bp, Bacillus thuringiensis
  unsure (1)...(163): unsure at all n locations
acgtatcggctggaaattcgtgatcatggtgcgaaaacagtaacgacagctgtgcgcggcgtgctcgaaaatcatcccgnagggctcatagagatattatggtttattaaaaccaagcaaagaaaagcggtaaactgcttttcttctttcttctagcaaataa

SEQ ID NO: 2751 - DNA, 301 bp, Bacillus thuringiensis
ttttttttcccatcacagtatttaagatttactgggggcttttttaacaacaaggtgggctctcaaataatcagacccttcctttctcttggtggattatctcatctgtgacagcacctcccttacacgcagaggatcatgatgttccatcccatcatcacttcaccattctgtaggacttagcatatattggtcgagcaatctctcttaaaaccactaggttgtggcatcaatctctctagggagcgccagagatcatgaaccatgactggaatggggtaacacacccaactgctattac

SEQ ID NO: 2752 - DNA, 115 bp, Bacillus thuringiensis
  unsure (1)...(115): unsure at all n locations
acgaaagaanaacgggggggcagaagagagnganggggcggacaaacgcaaaggcgggccaggagaacaagcccggaaagaaacgcaaaaactcttgccattcacaccggaaaaa

SEQ ID NO: 2753 - DNA, 348 bp, Bacillus thuringiensis
gattttccatctccacatacgagaacgccttttctagcaaagccgcactaataaatcggggggggacaaaaaaaaacggggcggataccaccctcggaccaaaaaccgcaaaaacccgaacgggcgataccggaaaacctacaaacgcgaagcccaaacacaccaagaaaggcaacggaaaacaaactgtcaaactccaacgaaaaacaaaaaatgcccaagcccaccgaactccctactgagagaaaggcggcttggccccaccgagcacattggaagaggaagcaaaaactaccacacacggttcccccaacgcgggaaggaaaacaggggaacggcccaaaaaaa

SEQ ID NO: 2754 - DNA, 376 bp, Bacillus thuringiensis
gcaaaagaaaacaaacaagagaggggtgaacaaacgaagagggacgggaaacaaacccgacgccaaagcaccgccagagcacggcgcaccaggaactcacacagcggcaccaccaacaccctcaccaggcgacaccctagaaaaaacaggcggaaaaaaaaccgctcctgaccacccagaaacgaaagaacatccgcaacatgcacagccaagcgcagaacgacctcccgcggcgaaaccagatgccacacacccaacaacacacagagacccaacaagcgagaaacacgcaccccacggccccacgacgaaaaatgaaccgagccaaaaccaacaggcagccaaacaacaccgcgaacaccccccgccacccgaa

SEQ ID NO: 2755 - DNA, 101 bp, Bacillus thuringiensis
cgccagccccctgccctcctggccattaatgtatgtataacaaggttatgaatttctagttatataggaaccataccccacggaaagtgacgaatcttttc

SEQ ID NO: 2756 - DNA, 222 bp, Bacillus thuringiensis
actactactttttgccgtccacaacgaacacccggtcgggttaaatgaatgaacggtgggtaatatagctacagaaaaggaaacccaattggcagatgaacttgacatgcagagctatgcacattctctattgccagacccaccaaatcagctagatcgtgccaactaatatgggatacttagcgttcttctggactacccactaaaagcaaagaggtacat

SEQ ID NO: 2757 - DNA, 269 bp, Bacillus thuringiensis
tgcatttgacgccgaagagcccaaaaaaggagtggtcgatctaacaacgggaggggaccaaacccacgctcccgcaaaagaaacacgaaaagaacgagaaggtgcacaagaggcaggaaacccatccggagtatcccaagaccaaaccatgactcatcaaggcgggaaagagcgcaaaccagttgctaacaaacaggaagccagaaacaaatcatgaggagcaacaggtggacgcgcgaatccatcaaagatactaccaggcgtacaat

SEQ ID NO: 2758 - DNA, 113 bp, Bacillus thuringiensis
acgcatcgttttttcaccacaccccccaccctgggttgggtttttttaaactcgggtgggtccaccccccctccaaatgtgcacgtttcccctatttgcttattattctaact

SEQ ID NO: 2759 - DNA, 154 bp, Bacillus thuringiensis
tattgagaacttagtgttcaactccattcaagtaaaactagcattaaagagcgagagtagagagcaatctccttgtcagagtgatcacgcacggacagctgattatataagcatgtgtgatacgatgtctttataagttctatacacactgccc

SEQ ID NO: 2760 - DNA, 117 bp, Bacillus thuringiensis
cagcaagcgcaaaacacataaagaaaccaacaatagaacatgcttggaattgaaaagggcggactgccatcccgagcctcagtaatttcttcactggcacaactatgtagctgaaca

SEQ ID NO: 2761 - DNA, 121 bp, Bacillus thuringiensis
ttatggtggacatgttttaggctcaaataacaacacgcatatctttgatggtggggtaccactttaagctgaaatggggtcaaaaaacagtgaacaacaaaagctgccaccatatgagggc

SEQ ID NO: 2762 - DNA, 128 bp, Bacillus thuringiensis
ttccataaacacaaaggcataccccaaagggggggttaacaaaaaaatgggggggagaaaaaaaaccaccccacgcgccaccaaaacaaacgagaaaacgaaccgccgacccatgaacggcaacagaa

SEQ ID NO: 2763 - DNA, 502 bp, Bacillus thuringiensis
aaagaagcagaaaatccattagtacaagaaacagtggtgaaactacaaaatggagaaggaatgctacaaatcgcgatccgaacagatgcaattgaggagctagcagttaactttaataagtacggcttacatacgatagggccatttgaagggaaacgtatgagaaaagatggccgacttttagaatggaaaatgttattcgttaagcaagaagagaacggaccgaaattacctttctttatacagtggaatgaaacggacgaagaaagaagaaacgatttacgtaacagtgggacgattactgaacataaaaacaaagtgcaacaaattgaaacgattcattacgcagtaaaaaatgttcgagaaacagtacggaaatggaaagaagtaatgggactatctacaagctcagttgtgaaaaatgaaaaatggaatgctgagtgtcaaagtgtatcgtttggtgacattcaagtacagttttgtgaactcgttggagaaggtc

SEQ ID NO: 2764 - DNA, 106 bp, Bacillus thuringiensis
gctccgatgaggtgcatgctatttttgaagaacatctataatgcggtgcgggggctgtccgttgttcaagaggtacagatacactctgaaccctgttgacactttg

SEQ ID NO: 2765 - DNA, 124 bp, Bacillus thuringiensis
ctgcccgacgggtcgtaacactagcagggacgacaacggactatttttgtgactgcgaaagccctggtgctagcaatcgttcgtgctttgctattagtacgagttgggcgagctggcgtagtta

SEQ ID NO: 2766 - DNA, 390 bp, Bacillus thuringiensis
cgtgtggctctagactcgcgctctgcgtctcgagaggctgtgcccacaaacacatattggcgccgaaagccgctagagatcacaacgccaccattactggaagctatccaccgaacgggatgttgtgattgattgccattctcgatcatgcaatgaggaatatgcatcacaggggccaagcagttaccccatactcacgcataagtacatgagtatgctagtcataaaatcagagacagtgcgaagcgatggcctcattctaccggtactacgagcactgccgacagaaatgcatgtcttaaatgaatgaaattgaccgagtgtactataagaggcgtgagacatacaaaaaccgctcctatgtctctgttagggcatgcaacttcttat

SEQ ID NO: 2767 - DNA, 385 bp, Bacillus thuringiensis
taaaaaaacatgtcatattatgtttgtaggtcatgcttctaaaaagattctttcgtatcatggattatgcaaatcctccatgccatttagataaatgaacttgataccaattattataatctaaagctcgtcctagactgctagataagtgtattgattaactgtgtcgttctacaatccacattaaagtgaatacggtgacaattgcctagtttacagcgtgacacgctcttttactccatcgctctatagcctattcgacgacctttggaatataatacagagaagctacccttacttgatctaaccagccgtgttgtatactaccgagcttacaattactaatatttacattatttttaatgatatcctttctcttatgaaa

SEQ ID NO: 2768 - DNA, 482 bp, Bacillus thuringiensis
ctcgcgcccccacacgtgtggggtctagcgctcctatgcgctagaggcgtcgtggacacgaacacatattaccggtggtattagacagatgaatatcggcgaggactcctgtagcaaaaacttcgaatggaagaagaatctcgatatccatttaggaccattcggaggagagtatactacactgttagtcagtggattacacgagggcacagaaagtcttgacgctgaggtgatatattagcgacaacagttatctaaggtaacagcctcccgattggcggagcacggcactacagctaaggactgctttaaagactgatatggacacagggtactttaaggagcacgagacgtacgaaacattgggagttaattttgaaggtacgtccaactctcatttgaggccggatgggaactagacaattgcggcgtttgaggaatgctaccacatggggaagctaaggttaaagtttgcgtctcaa

SEQ ID NO: 2769 - DNA, 324 bp, Bacillus thuringiensis
gtcaatctaatgtctatttgtggttttactggcatgcattttcaaaatatgtttacgaatctggataatattgatcccccgccataaattagaatgaacggcttcctattgtttacacaaagttttctgacttcggttatagtacccattcgattaaaccatcagcacattcgtatcatcatacaccccatttgatggacgcacctctgggacaccactgttcgttctcccaccagacgctgtttgtactgtcatactgtgcgattaccctaacttgatacatccttttcttaagtgttccaccgagcttacaattatgtatta

SEQ ID NO: 2770 - DNA, 261 bp, Bacillus thuringiensis
ctacaagggcgggattaattaaaataccgtggggataaaaaagctatccgtattttacaggcaaagattataccgagcaaaacacatacaaagttgccaaacgtgaaaatcacatatacagagcacgaaggaacattacaggtgaatgtcccaatacattatactgagatctcaataatagatgacttaaacctaccagcgggccggctgtacctctgtacacactgtccagagacactaccacctggctccacaccccat

SEQ ID NO: 2771 - DNA, 335 bp, Bacillus thuringiensis
cctgcattttgggtatgtatactatggtgccccagccttagaacaaagactgactgcagcaatcatatttacttttgtaggaactatgattttcattctacaaaggagaacagataagctgagttcgggtgtaattgcacctgctatcgcattgatgcttgaagcattaggtgcatgcattgtccactgtcttaggacttcattttcaaaagacgcgagggcttgaaactcggaatgaaggggcacacgctaacctacaagtggcaagatatgagtattaatggctgctcgtccacataactgtgctgatattgatgtctgctaatagaacgact

SEQ ID NO: 2772 - DNA, 121 bp, Bacillus thuringiensis
tatcctcgctgaagcacatatggatgctcggggttctagcatactatatagagagcctggtacgatccaaacacctatggtaggacctaggtatacctgcttattgcaaagaacagttaag

SEQ ID NO: 2773 - DNA, 154 bp, Bacillus thuringiensis
tactaattgttatgcaccattttcaaggatgcactgttactccttttgcgacaggcgatatgctgtttgaattcagtggcgcgcgtgtacccgaaaagtatttacccgattggccgcgcgcgccatcttgattcacactttgcgggagtgaccc

SEQ ID NO: 2774 - DNA, 202 bp, Bacillus thuringiensis
ccgctgctgcgcgtcggtactgcggatcctccagacttgatgacacgggatatcggcgatgctgttccgatacctagaatctcagcaacgagcattttgggatgtccagtaacagtgcacccgtctaagtctcgacgtatgactgtgcggatttccctacgatatcggtatttactgcacatgttatattcatctcatcacg

SEQ ID NO: 2775 - DNA, 159 bp, Bacillus thuringiensis
attcacgactatttttttgatctgtggctgaaagaaaaggccggtggtgtattacaacatttctaccaatgagggtcgagtaccacacaacggagatgcgtgtaaagcacattatgtaatttccatggcaacttacaggattgtagggactgttgtcta

SEQ ID NO: 2776 - DNA, 111 bp, Bacillus thuringiensis
ccacatttctacttctgccctcttattttcctaacaaaagggtgagccagcagcgggggggatccattatagttctgttgggggatacttaccctcttatctccaaaaaga

SEQ ID NO: 2777 - DNA, 205 bp, Bacillus thuringiensis
cctcccagactgtttttacaccaagtaaaccagcagcttcttggggagctgctgaagcagtactttgattgtttacaataactacttgaagtcctctttctgctaaaaaaagtgcaactgtactgtcaattacactacttccaataattcctacatcatacttctaacacatgtgtttccacccaatcacttagtgggtccatat

SEQ ID NO: 2778 - DNA, 331 bp, Bacillus thuringiensis
cggacgccggcgttttttcactgaagagtgcactgtcacaaacagcggatgctgtcgcgtatgatgatcggactgcgactcttataccgcagcgaaggacacagacgattcatattcttcacgctccttattcagaacagcttacaggattcccggaggacgactgtggagtcttacttccagcacaagtattgcgtcatgacgacactccagaaggcaaggcaaagccactctgtcaggcaggatcacctactgccgggacagtagcgcaagccagagctctcagtacactgcgtaactatgctcgaacgacacgctttacactgatcac

SEQ ID NO: 2779 - DNA, 340 bp, Bacillus thuringiensis
tagtcagacattatttttggagaggatgcggcggttgacatgaaaccgggacatgtaaatccaatatcgattgaccaatctccagccgtcgctttaactgaagctcagcatgagattctccgtatggctgagtggtcattacatggattaaaagacgcaaattacatactaaatacgcatgacaaaaaacacgcagacctggctgctcaccttgagggcgctattatcaatttagatagatagattaccgcgtatatagttgtactatcagaaaagccactgttacctacggagactgaaaaacattgtgacacagcaggcggtgacggagatattgacc

SEQ ID NO: 2780 - DNA, 294 bp, Bacillus thuringiensis
tacccataaaaggtgtatgatgtacattcatactaacaaacgagtacatatgactcggtaacatattagtactatgactgatcgctctataagagtgggtgcatggcgacggcacagttatgagctggccttaaaggacaaacaaaaggtaattggttgctggactcatatagaagcaagggaggctattgttcatgctgaaattgagacaggggtgtatgatctaggggctattgcctgtgcggatacccatatggatcacctaggagggtttgttgcaagtgcttcgcgaat

SEQ ID NO: 2781 - DNA, 276 bp, Bacillus thuringiensis
  unsure (1)...(276): unsure at all n locations
ttttgcagacgcaacgcataancaatcggctttttctgagaatgatacgtccacattctcgtatcggcatagcacagcccagacgcgcggcacgtataggcataagagcgtgtaaacgaggttgttgatctagccaggctgctacttggtcataataaactatccatatgtacaacaagagctaccatggatccgagggttacccgtcctggaataccctcataggctgataaagcagaaacaggaaacggccctgctaaggaatacgcttttgct

SEQ ID NO: 2782 - DNA, 304 bp, Bacillus thuringiensis
cgcgcaggcgctcgtgcatgcggcacgccgctgattatgtggataactgaattaccgcacatgtgcgggctaatactgttatgatgtaccgaatgatcaacccctgccagttctacagttaggtatcgggcgagcattatttcatttacagctgactgcataactgaaaggctcgacaggatcgccaaccctagcgaagaagtagaccacatgtcgaggggaaatggcaagcggtctatttttacaaaaatgaacgttaaatggccgatcaaataattgagttgctaatcagaacgtctaaact

SEQ ID NO: 2783 - DNA, 166 bp, Bacillus thuringiensis
tagctatgtctgaatcggactacgcatactgcctatttgaacatgacgtacatattcacactcggggtccgacattctgtgccatacgttcaacaagtcattccgaagattgacccacaaatgctgcctatgggaactgatgctttccttccggaacacccctcat

SEQ ID NO: 2784 - DNA, 296 bp, Bacillus thuringiensis
tggatttgctgttagaggaatactccctaaccctgttatcacctgatgtccgtaatactgtcaaagggaagaggaacatcgaatgaatgtatgactccatttgttgaaaccactataatggtatagaagtggatcatgtatttagacacatatcttgatcgggaaggtataaatggaaacttaataatgctacttccgggaaatgatagcctatgcgggagaaaagtcataatcatccgacggcagtatgtatgggagatggcacgccagaacaagatatatccaccctttgtatt

SEQ ID NO: 2785 - DNA, 142 bp, Bacillus thuringiensis
tggagctgcacaattcacatctctttacacacttgcttgcctacccgctataacaaaaacaagggcgggatttattgaaaaaggggtgcggtatgacacacccacacacttagaaggtaagttcttaaaaatgctaaaacaa

SEQ ID NO: 2786 - DNA, 167 bp, Bacillus thuringiensis
gatgctttcctcccaagcttcattgctaattctccgccctaaatatgcgacgatacacaaccaactgtaccagaaccaaataccgcaccgacatctggccgatgttgcctcgcttacacaaccactgctggatctactcatcttggcccatgtgatgtcctcgataa

SEQ ID NO: 2787 - DNA, 370 bp, Bacillus thuringiensis
atatcgcgatataggcatactattctttggtgcaaacactatggaccacagactacttcaaacaacagctatacactttgacgagaagcgttccaaaaccttaataagaatgaccctctataatctaaaagaagggggttattccttttgtagagcggacaaacataacagcaaaggcaaaagctattccagaaacataccaagatttacccttgtccttagactacactttgcattaggatatattataaaagcataacataaacgcaggaggtgacagctatattccaaaccatggaatggagaacacgcttggacagatacaatattttcatcatcttcgaacttattcttaccaatggcgctatgg

SEQ ID NO: 2788 - DNA, 239 bp, Bacillus thuringiensis
aataagctctctatgtttcgccggtggctattgattgaaccgctggatgggctgaaactacattttagtattaatcactgggacattcgttccaggtcttgatgagtaagcattttaacttaaattgcggtgggggtaaagacggtggactctctatactaaagaactaccatgctggtggagtaggtggcgactccactaacattcactgttacaattcactatatcacatgaaatga

SEQ ID NO: 2789 - DNA, 394 bp, Bacillus thuringiensis
caacacatgcagcaagagaaacacaggctacatatgatttcccagggaaaccagcgcctagactctatataaactattcattactaagggccacgacctcttatccccatgaacctaggtatacctacccataataccccgatattaacaaaaagtgctaagtacacaaaaatgcacccgagagctctatgcaccgagattagtcaataggagcggcatgacactaataactacgcaccactagcaacctccagtgggctctgtgtacacacttgtcgccactgacgactctatctaaaatatacgccaaacacacaaaatctgatcagaccccaggaatatccctagcatagaccggaaacgaaaccatccatggagcgaaaccatacttgag

SEQ ID NO: 2790 - DNA, 110 bp, Bacillus thuringiensis
gatgtggcatgcgaggaaccgagcttgctctattgtgagctgaaataaagctcggcgatgccatggccatagtgtgatcctgcgcgaaaattggatcggttgacatattg

SEQ ID NO: 2791 - DNA, 296 bp, Bacillus thuringiensis
ctgtttgagtgttgaacaatcatataccgccacggccggacccattaacgacggatggggcaaccaacaaggaatgccatatccagccgctactgccagcttcgccgggacataactatgcttataggtggaccccaacaaatggggacatatttccctttacaccaagtaacgctgggaccaattacattgagagtacgaacagaggccggatactttacgcgcagggaacgctgggctagcatacacatggctactagctatttcgtgccataagacgaaggtgaaacgcatgc

SEQ ID NO: 2792 - DNA, 407 bp, Bacillus thuringiensis
ttttggaaaatcgtttccataatatgaaccgttacgcttatagtgtgtggcagtatgttatgaagaaggaagataagattacacatctatatgaaaatgaaaagtttgcatgagaaactaaggcgaaatggtttgcgccttagtttttttacgtccattgagagaaaaaactagttttattgtgtatcgattggaaatgaaatatataaattaaaattaggatttgttatcagaagatttaccaaaaattaccgcatatttactatttttcaaactctctctccttttaaaaataggaggggtaatagtggggtcgcacatatttatatcacaaggaggaaacgcaaatgaacaaatgggttaaaatcattaactgctatggcacttgcaagctctttattaatggt

SEQ ID NO: 2793 - DNA, 227 bp, Bacillus thuringiensis
attgggtgctacatgtgattcatctcctgataaaccagcggtgctgcgcgcttcattatgagtcaagccactgggagtcatatgaggcagaaggggggctgtcccatctgacagtggagtacctacttgaatacagcattgttataaggcccactgactacgattctcgttcatcccatacctggtaattaccggcttctttagaagcccatgaatcgaaagagcta

SEQ ID NO: 2794 - DNA, 411 bp, Bacillus thuringiensis
cttcataccaagacatgtatttttcagggtttggctgaaatccttctgggcggcgttttaaggaaatttccgtttcgcccatcgttaatgcaacaatattccattataacaccctccaaatctctcctaatgtcccctgcttatatattgaaataagaattattgcaaaagcttagcttatgtgagctgtgtgtatgaacaatataacaccagtggcgcatactactaccggggttgtaacacgcatctcgtccaaaaggcagatcgattctagagtatgctcccgactctatttggattgttactagaaaaaaaccggcatgcaatttttcaagttcctttgcaacaaatagctcgtcgctttttccgcctgatgatcgagtcctggatttatcaaccccacaaaaacgg

SEQ ID NO: 2795 - DNA, 118 bp, Bacillus thuringiensis
  unsure (1)...(118): unsure at all n locations
cgaaaccacctacttattttggcggagaccgcgctgccntattaggacatggattcacagggaactgggggggatgccccaatgtaagggcggtttttaaaaaaaaaaaggttatact

SEQ ID NO: 2796 - DNA, 404 bp, Bacillus thuringiensis
atctacacattcttcaaaggatgcacttttgtaatgaactgattaataccctctgctaggggaacattttgttgttattcggcaccatgccctcatggagtgaatgagaaaatcctttatacttacctgtatcattatcccagtttgttttcttctaaaatatactctagaaatcctatcagctgtttagcgaatgcagcatgtgcctttatttattgatctgtagtattatgcacactagctctagcaacctacttttgctcttataccctttgctaacactatattaatatttattacctccccattatcgagacacccaatgatgcctatggtagactccatttctatgttatctcgactcttactagtaatatctgggctgtgcgtacttgaaacatgtc

SEQ ID NO: 2797 - DNA, 266 bp, Bacillus thuringiensis
tccccccccatctggagaaaaggcgttacactatataacaagcaagccaggagagcatcactaacctgggagagctgcacctagggggacgaccaggaagaaacgccaggaatctttaaagtgctgtcggaccacggccactttgactaggacctggaacacagtgacgctggtgggggggaaatgcacccattcacactcttttcaagcctagactaactgttgaccacaccactgggggacccacgctagagccagcattttca

SEQ ID NO: 2798 - DNA, 411 bp, Bacillus thuringiensis
cccggttgtttataaatcggccatgtttactaatggtgatggaatggtcacgggtgggcactcccaatcgcagtccttattactcatgacgtgaagcccattgacatatttttatagaagagcgttgtaccgatttgttttgtaccgatacctagttgcgaatataagggatcgttttttggactattgcgtgtacagaatgcgagcgtatatatcatgctcactgctcctacgatgatcggcatgacacttgaatcttgggacgctgcgttaacttattttggcgcttctgctggtttatccatatgtgaattatattgcagtgctttacattgtggactagtaacagatgctaattgtcctaggtgctacattccactagcgtctttaaagggcctatgcatgatgcgg

SEQ ID NO: 2799 - DNA, 367 bp, Bacillus thuringiensis
ggttttttttaaatgcacggatgaaggaacagctggttcaactgcaaagcatttggcagcagccctatctgaaaaagtggactggacagcggcagaaggttatgcgtacggaggaacatctgatggcgtaggacctataatggaaaatgaatttagtcgtggaggatcagaatgtgatgcttatgaaggatgagtgcatgcatatcatgcactaaacggaagagctgttaatatcgctgacggtaagtattctggagcatatgaagtaacaggaaaagaatgtgacgcagagtgggatcatgtgtggcaaccagagagcggagaaatagcgagaatgaagcgctatgtaaataggcataatggtggg

SEQ ID NO: 2800 - DNA, 313 bp, Bacillus thuringiensis
cgtttactcttcctatcacatcattttcttttattcaatctctacattaaacatggggggtttatttaaaaaacgcgtgggaataataatcaatcacaagatatattcacctctttattctatttctctacaccccttatcccacataatcccttttcttttaagtaattccaattaaatcctccttttcttctcactgaataacctctgaaactacaatgctacagcaaatcttaatcatcacctatcctactatcctcaccttttagaatctaaaatttagcccttcactttcatatactcctcttttaca

SEQ ID NO: 2801 - DNA, 385 bp, Bacillus thuringiensis
catgcttatagcgaacaactaagaactgctcaccgctgcgaacaacggagactagacaagactctgaaactcgaaactcccatgctcatgtacaggcttttctttgcacgaaataaatagacagatggtccagcaataataataccgaacatattagccaacgactacataccgacaacaaggcggcaaataagaggggtgccttcaaggctaagagcgaacgtactcataatacgtaactgggaaaaagtatgtaaaaacgccacgatcacgatcaagatcatcatacattccgagctatattcacctctactatgctataatggcatactggtaagctcacctggcatgaacttgaactaacagatgctgaaaaaagcacaaa

SEQ ID NO: 2802 - DNA, 165 bp, Bacillus thuringiensis
cagcattatgaatataacacatattattttttatggtgatgagggaattggtgttaccgggtattataatgatgcgcgcggttcttaaagtgttatgttagtatatacacccaggtttcactccacatatgatgcccatcatttcgcgtccgactgaacgctaca

SEQ ID NO: 2803 - DNA, 257 bp, Bacillus thuringiensis
tttctttttagaagttatacaatatgcggggggggttatttcacatgggggggtgaatcaaatcgagtgatagcgattatagttacaggtgttaccatctagttggtgatgcccgtaatctggagatacaagcatgccccttcaaaacgatagactgaagccagggcgcgaataatactttatctgaacgaggtaactactgaatcgttacatgcgactgttgcttaagtgatggacgatgtgtcttttgaagaaaa

SEQ ID NO: 2804 - DNA, 327 bp, Bacillus thuringiensis
gaattcgtgattcatcatactactgattcaaggggttcgttttatgtacacaaaagttactccttgctggtttttagaatgtgaggggtgtaacacatgagactaaaaacacactcacaaacaaaaataaatgcatgcttatataatatatataatcaatccgaacggcttcctaaataaatagcatattatcccaactgcccttagatacccacctgcttttcaaaactactctcccactaaactactattctacttaaacgtgacataatacattactatctttacagattcacatatcagtgacacagttaacatcgctgcgag

SEQ ID NO: 2805 - DNA, 162 bp, Bacillus thuringiensis
catatactttctcacagctttctactttctcatgacggctacatccacaaggggggggtacataaatcacttgttcccctccttactaatctccttaacaatccgaatcattccactaaaactctccactccacctaccatgctcttcccttgatctaaact

SEQ ID NO: 2806 - DNA, 300 bp, Bacillus thuringiensis
acattgagattcataaaggccagactatttacaacgtccagattgaatttcatggttggcttaaaaaatgcaggggtgcctaaaaccaacgacaataaaatgtatcatagaacgaaccctcttcacaagctttaattataaactacatgctcttattgcaaaatataccctagactatgcctcccatacaatatagagacatcatgacaacactcttattgatctgaagcatacatttgaaaatgccattgcgatatttaaaccaaaccttgaagatctctctcgggattttattagaga

SEQ ID NO: 2807 - DNA, 254 bp, Bacillus thuringiensis
ttcctttattagggattataccatttgctggaggggttattgcacaagggggggtgaatcattcgcgcgtggcaccatgttacgctgcaccattgtacttgctccgcctactagaaatccaggagtcctgttaatccagatgcagaggctcgagcttgaatcattgactaactggtcgaggtaaccactgaattggtacctccgactgttgctcacgtgaaggcctatgaaactgttgacgtgcattttctccc

SEQ ID NO: 2808 - DNA, 328 bp, Bacillus thuringiensis
aggaattcgtgattcctcttactactgactgcgcgggttctttttatgtacacaaaagactctcccgggtgggtaatttaataggactggaggtaccaaaagagagtaaatacgcactcacatacacaaactacgtatgcttatgacatatatctactctatccgtagggcttcataaaacaatagaattttatccgaactgaacttagatgctcacctgcgtttcaaagatcctctaccaaagaactactattataataacacgtgacaaactaccttacgttcgttacggattaacatatcatgacacaacaaaactcacagcgag

SEQ ID NO: 2809 - DNA, 163 bp, Bacillus thuringiensis
tttattgtagagtccgagacttatcgctggggtggatttgtacacgcgaggcggggtatatctacttgcatagcagcttaaggaattggcgcatcatgccgatgggggagagcaccgattacctcatcgccatctttacaaatatgttacaatccttcagctg

SEQ ID NO: 2810 - DNA, 129 bp, Bacillus thuringiensis
ataatatcatcccttttcttaattacttccgaggtggccctttatacaaccctatgggggaaacaactacttctttaaaccactttgcccaaactgctgcaatcgtgtccttatatcctcttccatcta

SEQ ID NO: 2811 - DNA, 254 bp, Bacillus thuringiensis
cccctcgtccactaattgagattgtgtgcgcttttttgttatattgctagaaagcgttgtcacttacatggaccggcccaaatctttcatggatgatatctgcgttcaaacattttgcaagaagaagattcaggtgcaaccgcaccgatgcacttggcggaagaacggcatgaacaccaaacaagctaccgaatgcttttgtgattactaccgatttgccatgtgagacatgccattgcagggttgcacacatg

SEQ ID NO: 2812 - DNA, 127 bp, Bacillus thuringiensis
tgtattggttgtagtatatgatccaaccacgttacaagcaactctgtatatacgattaacactgcggttcaattctaatacaagggggttggtccagactgcatgtataaattaaatctctacatca

SEQ ID NO: 2813 - DNA, 215 bp, Bacillus thuringiensis
ggcgggaaaccccccccaccccccttcgagaaccacatacagattttatggccactcctgacgccgaacaaagtggaggctaaggcggaggagtcattatggctcaaaccaagtcacccgcccacaaaatgagtcacgatggttgatccagcatacattgcaagcatatgctgcctttgcgctggtgcaatcggaaagggaacctgccaagtcgt

SEQ ID NO: 2814 - DNA, 127 bp, Bacillus thuringiensis
cccccaccgcaccccctagagagaacatgtatttattttaaccgtttttaaatgtgatatattactaataggtggaatgggggtactatatgagggcgaacaatatactggccgccgattataaaag

SEQ ID NO: 2815 - DNA, 102 bp, Bacillus thuringiensis
ccacacgcaacgaagtcttcttgctttttgataatattcacgctttttttcataagcgttaatatgaatagggttatggtgattattttaaatagttaattt

SEQ ID NO: 2816 - DNA, 184 bp, Bacillus thuringiensis
tacttgtgaccccccccgccccgtgaaactttccatcgggagagtttgatattttgacgaatcacctggagattactaggggaaagaccgtattaaaacacaacgtctctgatggaacactcaaatccttatttcacttatacgacggaatttctattgaaacggatattaatgcgacgcgaaa

SEQ ID NO: 2817 - DNA, 485 bp, Bacillus thuringiensis
cgaacgccactaccgaagtctgtacttcgacggtagcgaaattttggcaggctcttacagaactgtggtgcaccatctacataccatcttcactgaagactgataccagtgtctgctggcagcgacgttcggacatgacttatcgtcaacgacaaaagagctgcttcttatgaatagcttctttagccttagctagcactacaccactcctgtaggggaccgggctcagtgtcgctgtctcctacagtgttaccaaactggtcctacaagcatatacccaatgctctccaacgctgttcctgggtagacacgcctgtacgtcgactgggtcacttagcagcacaccctgttggcttccactggcctggcaagctaatggctggatacgggaagcactgcgcacggtggtgtagccccgttgccgtcagtgctttagttgccgcggtataatcctataatttacgatagacgtcgggcataaaatg

SEQ ID NO: 2818 - DNA, 211 bp, Bacillus thuringiensis
ttgggtatccacacgatcagcttgcaggtaagtctattttatatgtgacagcaggaatgctacttgaaggggtacttagtctgtcgttaattggacaaggtagagtaatcggtctagcagaacgacgtttaaatacttgccaagaattatgagcatctcttgacgcgaacaggatacatgcactaccagccgcggatgactatgaactaga

SEQ ID NO: 2819 - DNA, 495 bp, Bacillus thuringiensis
tattggcattatcaaatttatcatataaaacattaacagattcattaacggcgctagttttaaaatcgtatgtgttaaaggaaacgggtaagggaagaagacagaactgctatagattagtatgataaggcagctgttttagagacttttacatatgttttttcaatcgtaaggtggaagtgtgttttttgttttcaaacgaaaaaattactataagaggggttaagatagtagcgtttcatttttgtaaatgtaattatttcattattgaaaatacaaaaatgaagtaaacagtataaaaaagaaataataaaacgatccattttaaaaagggattgttattatattggaataatattatttgatatgctgaaagcctgaatagcagaatagacattacctgttctatattatgcaaatgaacaaatattatgaaaactatgtgtttagtttattgcttgcctttttcggaactctaatggaagtatgggcttt

SEQ ID NO: 2820 - DNA, 229 bp, Bacillus thuringiensis
taccgggattaaattgttcacacctgatttggaatggaggtatttatgactaacgacattttgcctcaaccataccaactttgaatttctatttacaccgggtctagataggctactcgtatatacctacctcgtatagaaaaggcggggattacttatctgcaccacgatacatagctccggctaaggcaactaagggggctaacagtacaaagaaattggaaaccgg

SEQ ID NO: 2821 - DNA, 131 bp, Bacillus thuringiensis
aaaaaatcaaatttgttttttttggaccgggcgtcgactactggccagaaatttgccggcccaaggtttatatacgctattaatccaaaagaaacattttttattttggctttgttccgggcttggaaaac

SEQ ID NO: 2822 - DNA, 113 bp, Bacillus thuringiensis
atacggaaacgagcgaggtattcataataaattggatacactctaaccatagcttggcgtcaacttggtacaaagtgcgtattacgtgagataaagactatcgcacgcaatga

SEQ ID NO: 2823 - DNA, 161 bp, Bacillus thuringiensis
ttcacgctcttccctgtatcacacgggatgaatcctctctcagcacccccagattacagagactgcatatcgtggtacattcgcacaccctcactgtcatcgacgtgggggcctaagtcccgctgcactagaagcaccgaatatggcatctgtgctctatt

SEQ ID NO: 2824 - DNA, 163 bp, Bacillus thuringiensis
tagggctgcccccccccccgcccggattttttgatactgatgtcattctcaaattgtccacgacatatgtattttttatgaagggcggtgcggactcacacacgttgaaaagagcggggatgaggagcggttaaagctgcagctgcagcccgctcctgggaga

SEQ ID NO: 2825 - DNA, 292 bp, Bacillus thuringiensis
catttttttgctactgtctttgcacatgcaggggggattttaaaaatcaggtgggtgtcccaacaacttgtaagtgcgggtgcaactgtaccacctgaaaggcttactaatacataccacacaatggatgaatgattgcctggaatatatgccggacctggctaacatacaatactatatggaggagacagtttacaaagaaatactaattgaatattcgaagttgatctgattgtacaactacatgcaaacaaaatttcagctatacaaggaactgctaaaggatgaggaa

SEQ ID NO: 2826 - DNA, 125 bp, Bacillus thuringiensis
  unsure (1)...(125): unsure at all n locations
ccccaaaataccaaacacagttctcttctcatatgnaggggtttttacaacccattgggggtttaacaacgctcaacatgccggattaaaacgccttgttactcataccggcatgatttcctctt

SEQ ID NO: 2827 - DNA, 147 bp, Bacillus thuringiensis
aaaaacaccacccccgaaccaccatatgctttaaattgatctgttttacaggttcaaacttatgcctgataacccttcggatcataagcaagtgtgcatcactaccttggcagctgcttttaatgctgataatgcaccaaaaactgc

SEQ ID NO: 2828 - DNA, 143 bp, Bacillus thuringiensis
agcggaactagaaggagcgatgataattgaacacccagcaggcccaagtatgttgatggaagtatattttgaagtttcatcaataggaaatttagtgcataatgatgaaggaatgaatagtaaattgcaccttggttaggatg

SEQ ID NO: 2829 - DNA, 388 bp, Bacillus thuringiensis
tactgcggataccagaaggatcgcagaagagctgagatcccacgacgagcccacatagagggggaggtgggccatcacgatgttggctcatcgaatactggggctgtaaaccgtcccaagggacgggctgggaatccattatagacatgcgcgagctgggctcagaacggcgggagacagttcggaccctatccgaagtgggcgtaggaaatttgagaggagcatgtcctgaagacgggaggacccgcatggacacaaccagtggtgtacgaaatgttctgccaagggcaataagtgggtagtttaagtgattaatggagacccagaggctgaaaggcatttaaggcatgaaagcaccccctcaaggatgagttctaaccaaaagatg

SEQ ID NO: 2830 - DNA, 174 bp, Bacillus thuringiensis
cacatgcagacggcttgaaataagggcagtgttctcaactgatttattagcgatagaggggacagagggagctcttatgcataaagatatatcgaacagagcggtactacaagtaagcagagccaaatctaaagatgcatttagatgattgtggaacaggctatgcatctttaa

SEQ ID NO: 2831 - DNA, 114 bp, Bacillus thuringiensis
gcttggctgttttggatagagaaagcaccgggtatcaaaagttcaaatagggaggtgggacttcaatgggtgacgcaaaaaccggatttttcatgaaggggaatctaaactcta

SEQ ID NO: 2832 - DNA, 437 bp, Bacillus thuringiensis
ggtcgacgactacagctgattgaactgcagctgtttttgactgaagaggccaatgacccaaacggggaatccttcagcttattaggatggggcccgagactaataccgagccgtggtaagagtggagtctttgttttcatgcacccgaagaggacagctcgcacgacagtgaaagccaacagtcgtgaactcattccagacgcaggagcgaggcctgcacaagacttcataaagcaaggcagtgccgcactgtctggaagggtgaactactgccgggtcgggacctctagtcgagctttcagtgtaggacgagactatgcggcgatgacaagtcgtacactgttcacgtgaaggaatcgacgacgaatgctttaaatcggctggcagatatggagtaacggatctctctagtggtgaacagtggctctactgtgact

SEQ ID NO: 2833 - DNA, 434 bp, Bacillus thuringiensis
tttatagaaagcaacccactaaaaagcggggagggtgtattatacagagcgcgggtataactcaagaaggaacagggccactaacagcacataaaaggatcaaaagcctagaaaagagccaagaaggtggcgtccattccataaggcacgcaccatgtgccaagcaatacaaagatataggctcaaatagctggtggcaacacccgccagaactataaagatgccaggccgaatcatctggaagcatcactagtgcactatccggctatgaccttgaggcttagcaactaccggatcgactttatcactgcatgaagtgtgatgccaaaaaataaatcacgcagtatgctgggaaggccggacctatggcgataggtcgaagctggacaggaaacacgatacccgcgtttaaagtgcccgatgtgcaataacca

SEQ ID NO: 2834 - DNA, 308 bp, Bacillus thuringiensis
acccttttgtcgcccgatgagaaattggacaccgggggtcacattaaaaaccggggatgctctcatatcgaagttgcaaattatcgaccaagttgctctctgacaactgatcgaaactgacaacgggtttcgtccatttgtatttcagctgcttgacaaactaactttattggcgagtatgatcctggctcaggatgcacgctggctgcttgcctaatacatgcaagactggcgcatgcactaagagctttctcttatgcaactagctgcagcccggagcgctacacgtggatctcctgccctatgac

SEQ ID NO: 2835 - DNA, 317 bp, Bacillus thuringiensis
  unsure (1)...(317): unsure at all n locations
aacctttttttaacacacgcagaccaaaccagatagatggggccctttgaaaaatnaacgggggtcttaacaaaactcaagagattatatagagctggtacatgaggaaagaggaacggaacaaaccattaccttagatgaaaaggacatagaacaaaagacgaatggaaatgtacgaaagcaaatcttaaagaacgatggacgtgcacaataatcaggaacgtacccaacgacgtaataagtggaatcgaagtttcatatatataaaccgatgtcagtagctgcttaaaattctcaagatacattatttgccaaaa

SEQ ID NO: 2836 - DNA, 346 bp, Bacillus thuringiensis
attgtttctggcaaaggtgcaggtaaagcaggtgctggtataggagatagttgcacttatacgattacagcttccaatgcagcatcaggctgagcggacgacgtgttattacaagatagattcgctacggaacattgatctattgcgtcggcatgtgactacggtatggtggacgtatcacatgcgagctcgaagacacctagctgaattattttaggacccatccctattattgctttgagaatctaatcattcctagtcaggcatacagtgatgacaacttagaccctgttttgactggtgctctggagaaattccaagatggtgcttttgatgctgggatctc

SEQ ID NO: 2837 - DNA, 105 bp, Bacillus thuringiensis
cgcaagttgctttcacaaagggcaaacacaagggggaggaaaaacacggaaaggggagggagaccaaaaaaacaggcctttaaaacaacaaaggaaaccacaaca

SEQ ID NO: 2838 - DNA, 134 bp, Bacillus thuringiensis
tgagcgtttgccaccttcacagctttaagattcatcgcaataggttcgccttttttagtgtaaaaacaggctctctacaagggtcattctatgactgaacaaaagctagtcaaatgcctttatgcattgcttct

SEQ ID NO: 2839 - DNA, 207 bp, Bacillus thuringiensis
actcgcaaggtggcaagacgcctttaattcacaccctgcatcgcacaccaaagggaggggtgtttgaaattgcggagcgatgaagccccaaagctacatcccctaagaagtgagaaccttcagctgactatactaaaaggtcaaaagctatcattaccacccccagctctatagtctactatacaaccgttctctacatgtcaactc

SEQ ID NO: 2840 - DNA, 188 bp, Bacillus thuringiensis
cacctttatcattccaatgataagacgaccaacgcggggtatctttttaaacagcgggggtaataagatcgtgggaagggtaccatcagacgttctaattgcaaactcataatggccgccactgtaatgaaaaggccaaatcccaaagatgtaggggcaagcaaaaaggggggtttatctatgacaag

SEQ ID NO: 2841 - DNA, 439 bp, Bacillus thuringiensis
aagctttataatctactgatgccttcgcgataggcgggttttttaaggacattcttacagtactgcaaaagcctaccttgtccaaacatttcggccattagcgcaaggaatcatatgcttatgtgaagaattaattcgccaaaacgaagcatttccaaacgagttccaagcgaaagttgcttcgacagatgtgatcgaacaagaaataagagaacaaatacggggaattaatcaatcgattacaagtatagaagcaatagaagcacttacaccgatgcccggagtaagtgcgattgtaacggccttaggtgcaatgagaaaaaaactggaagaaacactagagcgtttacaagaattcgaacattcatccagcaacaactacagcaccgccctccattagtggcttgcatcacagccggacttgctgaaatgcaaagcg

SEQ ID NO: 2842 - DNA, 180 bp, Bacillus thuringiensis
gattcggattcgctcagctgttcgcggttcatttcccgaaagcccaccgcgggggggttttaacatcgttcgagacacccggaagacactttcatcacactgcacaaccactgtaacaggacagccaagcgtggtcgaggttgcctacagagccttgttgtggtctctaaccacggctac

SEQ ID NO: 2843 - DNA, 163 bp, Bacillus thuringiensis
ggggacaaaaaggagagagggaaaacacacccagcagcaaaccaacaggaagaaagccagaactcaccagggagcaacagagcggacaagcgaatacaccaaagacactcacaggcgcagaaacagcacatacagcaccgaccaagcacgcaaacagaaagag

SEQ ID NO: 2844 - DNA, 164 bp, Bacillus thuringiensis
  unsure (1)...(164): unsure at all n locations
atcctactaatagttgaagagcttgactacctaccataaaatagctaaatgggttggttagtgtgtcttctttctaacataacgctgnatctatcatagcaaatagcatattacgatttccaggaagctggctaccatcccttatcctaagacgcgacaggcgc

SEQ ID NO: 2845 - DNA, 128 bp, Bacillus thuringiensis
tcggcgaagcaccgacagcagcatatcatagcaaaagcttacttcgatccaaaggcagaacttttaccgatgcatagctcaagcacgctccaatatgcaaaaacaaagctcctcccatacttggacgg

SEQ ID NO: 2846 - DNA, 390 bp, Bacillus thuringiensis
cataatttattttgaataaaattctttacctgtacttatttttggcatatatttttgttcgccgttttgaagccctaaaataatatcccgccttcggctactatcagtgtagtttcctcttgaatcttgcgctatatttatccaatgttcaatagcttcaagatgataacaagtgagttgttttgaagggaaggaggggatttgaggtatataaatttttagatgattgcaaatctgaaatttatatttaataattttcatttgtgccaatatcggatttgataaactttctggagtaattgcctctagaactttttttgttattgcatagggaggaaataataatgagttaacatttaaatctgaacgatgaaaaaaatgattcgtaac

SEQ ID NO: 2847 - DNA, 134 bp, Bacillus thuringiensis
aaattttttttctacagcaactgacttactcttggcggtctctatataagtcacgaggggctttcaaacaatcttatgaaatgtatccagcattctcaggcttaggcggaacacagggagatacattggaacaa

SEQ ID NO: 2848 - DNA, 360 bp, Bacillus thuringiensis
agctttttttcctactactgtggcttgtacaaaggtgactttatttgagtcagggacgctttgaatatctatacagaattgttcatctcgaaacgcaccagctgcgctctgatgtaaccgaagtctctatgccgtgactcgctgacgtgagtttactagcgtaatcacagcttcattgacagataatgtctgttgactacaaacagtcgtactgataccgcacataacctgcacctaaaactacgattatcggtgtctgcaccaaatcacaaacctttcgtttatctaataagggtcgaaagtattgcccagtactaaaaactccatcttgcaagagtgtggaataaatcacattctata

SEQ ID NO: 2849 - DNA, 104 bp, Bacillus thuringiensis
cgtgttcttactcccattaaacgcgtttaccggacgggcctaattacaggcaggaagcacttcgagccatacggatgaacccctaagacgcaacgacggaagag

SEQ ID NO: 2850 - DNA, 157 bp, Bacillus thuringiensis
aattgaactttcagtgccagctgcatgtcctccggtggcctatgaggtgatgcgtgggcaagacaaaaacgttgctcgaagcttttcttccaaacccgggaacacgtgccggctacgttaaacttggttactaccacaacaggctgacaagcactgt

SEQ ID NO: 2851 - DNA, 210 bp, Bacillus thuringiensis
ccctcgctacagcttgcttgccaactcatacccatttccttttcaccccctccacatccccccttgggggttttattaaccaggcgttcctaaaaccacatccaacctttcctaccacttccttcccttctcatagtctcaacccactctcccctgcttttcaatatcccctccatactctcccttatccccctatttcacattctttta

SEQ ID NO: 2852 - DNA, 410 bp, Bacillus thuringiensis
gattttctttactgtacagccaaatcatcctagcggtttaatattcaccagagctgggtaaaaacaaaatcaacatctccagccacttctaacctttctcaaacgacaaaccgtccacataattgttaatcgtatccgatcaaaccactttctgtactacgtatgtctcattccatatgacaatagaatgcccaattgctttacattacagctctcaactgtgcacagaaaccattcgttaactgttctactctccattatcatgagccaatagtgtagctaatcatctcttcctcgatcttcaccaatcatatagtcatgatgaacctattctattcctaaacctaaaattaaccacatgtaaacaccgaccaccgctattatgaccacttgttctccaacttgcgcat

SEQ ID NO: 2853 - DNA, 453 bp, Bacillus thuringiensis
gctcgataagcatgcttgccaactcatacaacacacatttctatctaataaacggaacttatctaggtggttgtaagaaaaacgctctgcttaccaagcttgcttttttagaaacgtttttaactgggatctcatacaagtctttcggaagtaacagttgtattaatgcccaactgaatggattatgggaacttactaatgaaggtaaaaaactatacctatatcgtcccacgtgtatggatacacaacttgagagactgaagaatgatcacccaaaagcgaaaatcaggacattgacccaagtggtggctaactttataatacacctcctcgagagtcttacctctcacacgtgtaaattaaaagtgaagtaaggagggtcacatatataggggctcctaaaagaacagaccgtttttattcattacgattacacggataaggtataataaa

SEQ ID NO: 2854 - DNA, 157 bp, Bacillus thuringiensis
ccccccaaggccctatatcttctccctcgccacggtgccctttccttcctacaccccctccttcccttgaatcatccttacccccgattgaaaaagcatccttgaaaaagggtgctctttcttttgcgctccgaaataggcccagagcgcccccccc

SEQ ID NO: 2855 - DNA, 233 bp, Bacillus thuringiensis
cgatatcctcgttctgaacaggaggcgggatagggatcgcgctcttattcgagctagtagacgactagtgaggcaactagctttacactttctgaggaacataaacactgctgccaggctacgcttgcatttcgttccacgcagccatcgcatcaacttctgcccttccttactgagctggatctttgaaaacgacccgcgccaagcgatagtatccaaaatgggcgcttatc

SEQ ID NO: 2856 - DNA, 215 bp, Bacillus thuringiensis
tcggggacaatgacagtggcggctttagatgcggctcgtgatcttgccttggaaccacaatttgtacgtgttgcacttgctttatcaataggctttggtgcgcattcgtctctcttttgggagggacgcgtaaagcatgattacggcagaagaattattgatgtgggcgttgttgaagctgatgcttcctttaacgatccattccgattagatga

SEQ ID NO: 2857 - DNA, 491 bp, Bacillus thuringiensis
tgtgttgtttctcagaaaattatatcctaaaacgtgggacgctgaacactttagaagtaaaggaagctggaaggccttagaagctgcctcaaaatcaatgaccttctcttgtctctccctgcctcccaaatacagggaggagctctttctggaatttccatatctgaatgatgaaacttttttccaaaagaaatgcaattgttttaaaccctttccctaggaaagactgaccactgaataagagaaggaaataggagaaaagagactaataatggtcatcatgcccagacagacatttcatctattcttctgcgggcagctccaagagattacataagagactatatctgcataataagagaaccattgttcatagtgcagttctgcccctttcattcttgtaacttgtggatccctatcagtttccaagaggatcctttacaaaccattctctgtctactgggctgattcacttcccctagaaaacattt

SEQ ID NO: 2858 - DNA, 157 bp, Bacillus thuringiensis
attaatcctctaccagcctacactgttaacccgggggggccttttgagtgagcgggctcacaaaacaggcggatagcttactgtccgctttccagaccataaaccttgccagccagatgcagtaatgaatcggacaacgtgtcaggagaggcccttt

SEQ ID NO: 2859 - DNA, 301 bp, Bacillus thuringiensis
gcttttttttaggccgaaatagggggattcaaagatggtccttaagacgaacgcacgaaccttagcccatagtgtcatagctagggcttaaagcttgcactgggcatgttgttgacggcattaaataggcatggcccctatgacaaccgtaactgaaagctacactactgacaacggtatttaaaaacgacaagactatctggattacttgcttatatccctgttaactcactatggcgcgctgctgaaccgaccctgccaccatgcacagacctgaacctattgctgtccagcagaagct

SEQ ID NO: 2860 - DNA, 191 bp, Bacillus thuringiensis
atcctggcgtcatcttaggccattttttatttcctttaaggacgcctatctttgcgggtttttgggcaccgagcgggtctccaaatacacagcggcagccgaatcacatgccctatggaacaatctgagacggcgcgccgagaacggatgggttgtagtgcaccatccgtgtacacgaggcaatggggata

SEQ ID NO: 2861 - DNA, 146 bp, Bacillus thuringiensis
taattatcctagtgacgccgggaataatgtccttcagcccacctcgctgcggggttgccgtcaacttggtgttcggattcacatcctgcggggtcggtttaggtccggaggattgactcaccgacggcacggaagctgtaggcgca

SEQ ID NO: 2862 - DNA, 198 bp, Bacillus thuringiensis
ggggggtttaataacaggcgggtcgtctaacccgcgggaggaacctacttgcccgctcatccaggggacatgcacacataatctggggaagcgaacggacgatataacgctccaatgcataacaccgatggaccacgcaaggtacccagcatagcctgtaatgggaaccaatacacctctgctgggtaatggctataa

SEQ ID NO: 2863 - DNA, 118 bp, Bacillus thuringiensis
gggggggttttaataaaagctgggcggctaaaaacaagggcgaccagagcgggcctatccgctattaccccagacctcaagtcgcatataaagaagaacaccctttccttcacgctca

SEQ ID NO: 2864 - DNA, 236 bp, Bacillus thuringiensis
tgatggtgacgcaagtacaaaatgcagctggtggggtttttgatatggtgggagcttacaaacaacccatgctatacctactaataccatggatgatcgagactctcgttcctctcaattggcaaacttaggctcaaggtgctcccagacaaaaggaacgaaaaaggagcacactccctctgtgatgaaaagacatattccttaactcagaaaacacgcaccctaattcattacgg

SEQ ID NO: 2865 - DNA, 265 bp, Bacillus thuringiensis
tattacatctacaagtaccttcttttgataagaatgcattataaaatgtatcaggagggttcctgactgcggaacggcatcattaaaacttatcaggtgagaaagagaagataccagagtaggaacactaccttttgcaatttgtgagtttacatgcacatgaggcgatacagatgttacttgagagatgatttgttgaatattctcctacatattatttaattctactgccgtacgaatcaacatctctgattgataatgcgga

SEQ ID NO: 2866 - DNA, 157 bp, Bacillus thuringiensis
tggtgatcagccttacacaaataatcagcggggggaattaagagcactatcgtacatcccacctatccaaaactacaacatgaagccgaaattgtaaacaagaactacgcagctaaaaacaaaagcttgctatcattaggtgatggtgacaacttaa

SEQ ID NO: 2867 - DNA, 127 bp, Bacillus thuringiensis
cattaataatttcttctaccaatttttttttcacccaccgcacaccccgccaggggggcataattggatcgccttttgctacaaccgtcataataccataaggacgtaccctgctctattagaaaaa

SEQ ID NO: 2868 - DNA, 164 bp, Bacillus thuringiensis
gtgatccatgtttaaaaattttattcccagcttttgtttttacaccccatcgaccacaacaagggggggttttttaaaggatctgcgctatcaaccccactttttaacagaacctttcttgcgtttgggaagatctatagtgtacatatactattatatcattc

SEQ ID NO: 2869 - DNA, 334 bp, Bacillus thuringiensis
tacttttcgactcattcgacattactacgggggggagtagagatgatagaggttcccagacttgaccaaaggccaaggagctatatgtactactcgctagagctcatagagctaggcaggcgatcgacaccgtacaaggctgaatccctaggactgcatatagaaccaatgtttaaggtactgagcacgcgcttgaaggaacgtagaacagacaaggtgctcgagccggtaataaagggacaagacatgaatgttatggcaacgacggtaggggcatacgcacgattctggaagatgggcttattagaggtattggccctcatagatcatagag

SEQ ID NO: 2870 - DNA, 163 bp, Bacillus thuringiensis
cgtgatgctattgtacacgggcaggacaaaatctttgctatgactgaagggtatgacaaataggggcggtttcttatattcacagagattggctctcatgcaccgggagtgaatgaccaactagatgtaacatccggactgggtgatattgtgccgaaaggcc

SEQ ID NO: 2871 - DNA, 307 bp, Bacillus thuringiensis
aagcctgccaacgaatacacaatctgttttagcgacctacgggggcaccacggggggttaaaatacaaagcatctgtaacccaaattaaccgcaggagcactcgctgcagcataaaagaaatgcatgcaacaacctgacggaacgaacatctgaaacccaagccgtacagcaaaccattgtcgctagcgcgattggcatcactcttactaacttattaatacaggtattcaaccgtttaccaggacttgcaaccgctataatgggaggcttaaacatttctaaaacatgcctagaccccaactggac

SEQ ID NO: 2872 - DNA, 185 bp, Bacillus thuringiensis
ggggggtggtgatgggtgccactaaattgatccactgtttttttatcgagcggctaaagtactaggggggctttatactgacaatggtgttgtaaagatacctgtccgtattgcacatgatatgagttacaactactttgttagctactacagctccaggctggattgctcctgctctgaatggg

SEQ ID NO: 2873 - DNA, 176 bp, Bacillus thuringiensis
  unsure (1)...(176): unsure at all n locations
ccacttcttttccccccacaaaacccccaaccggcggggttaaaaaaaaaaaccctcccctaacaaacangacagaaaggacccccccacccacgcacaaaaaaaaatcccccacacacgccaagacaaccgaaaaaataccaaccccaccaggaaacacccactcccccccccaa

SEQ ID NO: 2874 - DNA, 255 bp, Bacillus thuringiensis
cggggggatttaataaaaaagggtgtctgcccaaagcataagcaactttatccaaacttggtcaagccgcaactattcacgcaagcggactatgcaactcatataaaccagacaactcattatcatcaatagatccaaaacgagaaaacactcttattgcctgctgagggaagctaaaaccattcttatcacctcgaacatgggacgataactgccctctgttgttaaactctatgaacgcctaagataaaggca

SEQ ID NO: 2875 - DNA, 198 bp, Bacillus thuringiensis
ccattttgttttctccatcggagggggaaactgggggggtttaatttaaaatcctctttcatctacagggaatgcaggtgcactgcctgcagcattaaaggaaatgtatccaacatctcgtggagcgaacactggacaacacgctgtagggcaaacgatcgtcgctagcgcgaatggcaacactcttacttacttatt

SEQ ID NO: 2876 - DNA, 173 bp, Bacillus thuringiensis
catttttattgtctgtaaccatgcttgatccggcgcgccttttaaatgctagtgcgtctacacaaccagaatcttccaaaaccaacatccccagtccattacatgtgacacatgactgaccacgcctcctatgtaatcccttaggaatcacaatttctggatcctacacctta

SEQ ID NO: 2877 - DNA, 244 bp, Bacillus thuringiensis
aattttttattcaccaactccacatacaacggcaggggaattttacacactcatgggtgaaccctcccagcgagcgaagctcgattggaaccgaggacaatcccagtttgcaacagttgaccaagatgcgcaaatgcacgaattaatcgaagaaatgcctgcgcactaaagtcaagaacgactagaacccaacttacaattacatgcatgaacactttaccgaacaactgatggtgaaaaaagg

SEQ ID NO: 2878 - DNA, 197 bp, Bacillus thuringiensis
ttttttttggagaaacgcgccagaagacgggcgggtttaataaacacgggggtgttcaaacacgtcgaagataataccgcgtccgccgtggggctcacttagtgatgcaccacgcaccacacgcagcttttgacagaaagaagaaatgttgtagacgcaattcagaagtttatgcggcgataagtgggggtggacgc

SEQ ID NO: 2879 - DNA, 118 bp, Bacillus thuringiensis
aattcggatttaactgttttgacatagccatttcgtcaagtccaaattccttctgccggggcgggatttactaccaaactggctgggcactccgaagaaggaatcaatgaagcagagg

SEQ ID NO: 2880 - DNA, 210 bp, Bacillus thuringiensis
agggggggttaaaaaaaaatacggtacgaaaacaccccaaaacaacagaatcttaaaccaaagaaagcctcgcgatacaagcaaaacccacggcaagcacaagacgaaagccccaaactgaaacacggcaagggaaaccccgaaaaaaacccaaaaaaccaacaggcaacaaaccccccaaaaaacccgcccaaagcaaaacacccgccc

SEQ ID NO: 2881 - DNA, 229 bp, Bacillus thuringiensis
cactcgaattttactcagcccgctactttgctcccaacactaagccacccggggggggttaaacaaacattcgggaccaaaagacaaccaaaccacacatgcatgcccaccacatggaggtgctcataatagtaaggggctaaccatccgtagaaacaaaaaaagtgatattcttttaaaatgtgtgctttaaagaacacttgggggggcaaaaaaatttatattaatg

SEQ ID NO: 2882 - DNA, 187 bp, Bacillus thuringiensis
aattcgtgatccttggggttgtctttcaaacatttggtggttacaacggaacaaagataacggggggaggcttataaagaatcggtgcagagggcaacaccctatgccatcgaaacgacgaaccctctggaatagctgcctgagttacggcggaacacggtgaaagtactcgactgaattcagggta

SEQ ID NO: 2883 - DNA, 362 bp, Bacillus thuringiensis
gcttgccaactaatacaaatttttttctcatactgcgacgataagcatagctgggctatttaaagaattggtgggtcacaacaccatcagaaacaccagaccattgctaagctcatcataactacaatacgaacaacacaaatatgaaacggatcctattaaacaaattcatggacttcactatcccacttgtctcaccatgcgaatgttaacagcacatttgctcttactttaccattttgaaaaatcacatagcgtgtatatacatgattatctcgctctaataacgtcagtgaaaagaatgacacatcaacattgcctataacagctcataccatagggacggctgcagagcattctat

SEQ ID NO: 2884 - DNA, 127 bp, Bacillus thuringiensis
gctggtcggtgattttttttacccgacgctcgatcgaggagaccgtgggggggatcaatacgctggccggcgaacgcgggatcgggccggcggtgagaggctgatcctggcattgatagcgaatcga

SEQ ID NO: 2885 - DNA, 323 bp, Bacillus thuringiensis
tctgtgacgaaggcatgtatggcattgggagtgtgtgacatgtttgctttgtatacgtgtttagcaggaaagtcctctttgactgctattgatgaaatttgtgtttatgacgctttatatttgagcgtcgtgaagtcgatatatcagaggatcaataacgactggctgcatgcatgttcgaacgagtgtaatgggcagcacccgcgctcatctatgcgaggcaccatctcttctgagacttacggataagccatgatggaacgtgagctacgatgaaaatagttgactatctcacccaagaaccgatcacatgatcttatgtg

SEQ ID NO: 2886 - DNA, 273 bp, Bacillus thuringiensis
tgctggtcgccgggggtggagctggtcgacgactacataaggtgtccttattatgttccttccactggcattgccctgcctgggagaggggatgtgaccttggtgcctgcgctgagagagctcttgagtctacacctcctgctccaccagttcattgcgttgcatcttgcccccggtgacctgggcttgctttttgaggtaacttgggcgatcactatactgtggatcgaaacagacgcgtgtgcagtacgcgtggcaccgcgctatctctat

SEQ ID NO: 2887 - DNA, 185 bp, Bacillus thuringiensis
agtattggcttcttttttgcacctcgcattaatgcggctgggcgatgagaacatactgcgccgggtggcagtcctgactttcaaatgacacatgctatgacgatgactttctcatcaagctgggtataacgagcatgcacctgcagtgcagcttcacggacatttacatctgagagctatctact

SEQ ID NO: 2888 - DNA, 405 bp, Bacillus thuringiensis
taacatttggtgcttttaataatgaaaatcgttcagttggggacgttactgtattaacagaagaaaaagacgcatatgagcataaaggacatatcgttgcaatgcatgtagatactgaaatactaataggcgggcctgcacgtgatgtaatacgtcaagcaactgaaggggctaaagagacgaaactcgagccattgcatgtatgggtagtgtcagcgagcgagccagccaaacgagtacatgaatgaaagggagataaaacatacggcattgaaaaaaggtctatcaacctgtagggcgcgtatagggacacagaacatatggagcggacctatgcagagctacagcagtggggcctaatgtgaacgctgacacagaaagacggcgattatcacacatagcagt

SEQ ID NO: 2889 - DNA, 331 bp, Bacillus thuringiensis
ggggtggatacaccccaaggacacccctatttaacagagacattttatatacacagtctcccccagactacagagtttcacaagttgtgccaggagctcagtgacacactccggcgcgaccattgcgcggatgtgctcgaccttgtgcaccaaggtataaagggtatatatcggacacacatctcctatttataggagaagagtgtgtcacaaactcgtgggggcacattgtatagagtacacgcctacacatttaggcggaatactctttgcaccacaccgaattgagtattgagcatatcccccaatgtgttgtgcctaataacacttg

SEQ ID NO: 2890 - DNA, 171 bp, Bacillus thuringiensis
tgatgcttgacatgatgatgggagtggaacatttacatcgtggggagctggttttaacatatatatagacaagggacggattctggattcgaatcactacgcgggtgcgtatgcatggaccgagcttgacctatggagagtagaattagagctgggcgtgatcatgggcgt

SEQ ID NO: 2891 - DNA, 418 bp, Bacillus thuringiensis
cccgctactcttaacactggcgacttatgtgttacttttaaaatacatcaggaacagctcccccaacgggaacgtgtggagaatcttcactcataaaactatgggatactctggctactaatatatataatgctcctgcatattacggtcatctatctgcatagagacagcatgattgtctacaccgaggagtggatagccacacgcttttatcaagacactgtacatgacatggcgatcttggactatatcttattgacatgaactgattacttgcctagagtttcgctacatgctcaaacagtgataacagacgttgaacaccaatagggcttgggcacgcattacctaataaatacgcattacctgcaccttatacacttacaactgtgccgactccccatttttggtaggaagc

SEQ ID NO: 2892 - DNA, 134 bp, Bacillus thuringiensis
aaacagtccatacttgttacgagctgcctcacaaaacgatggatgggaaaaatactctcatgaacccatgcgggatttccctagataatgcacgtgtacaagacgatccacccgaactatgcttactggacctg

SEQ ID NO: 2893 - DNA, 145 bp, Bacillus thuringiensis
ctatcttaaatgcgtataaaagtataaagcagatctattttttcatattattaataaggaaatacttaaagtatgggaatgtcttctaaacgtgaattatactgtaaaatgctgagggatacattttagcattttctgcaaaata

SEQ ID NO: 2894 - DNA, 153 bp, Bacillus thuringiensis
acacacgtgtggtaagatgtctctgctctgaagctggtggacgacattcagatatcacgggcgatagatgtttttttcggatttttcccatgataagggaagggggggatttaccatatgggaaggtgcttttaaatattatttatccaaatt

SEQ ID NO: 2895 - DNA, 313 bp, Bacillus thuringiensis
ttacactggcggaagatgaaatgttttacggccattgcctttacgacgagccaggaatgaagcgcgaaaaaatggttgagcagatgcactagcgaaccgtatgacaaccgaccttatacaagatccaggagcaataggtggcgtggccactgcactcttagtaaacaggatcggcggaactcccctgcaagaacttatctcacttaacacagcaaagtctcgagaattagctgttaggcacagtacttattatagagcgctcgctggcaactatatcatgagtataccactggctggtaaagctttaactgca

SEQ ID NO: 2896 - DNA, 303 bp, Bacillus thuringiensis
tcacccaggccggacatcacattggattgcccccagactgagacggactaccctatccctgattgacggacaaccacgaacacggatcctgtgcctccacgacaggaactgtgacagcgcataatctacgcaataaccggactgagggtagtctgctgattccgggaatgctgtactccaccagatcgattgggtgcgtaaccatctatcatgatgaggacagatcaacggcctgatggcagcaagcggcatggactagcgctagccagttcatgactgaccatgtcatatgtaacagaattg

SEQ ID NO: 2897 - DNA, 135 bp, Bacillus thuringiensis
gtgctacagaccctattgtcacaactcacagactataataatctctgacctcctataaagagattattggtggaccactatcaaacactttgatagttccccactcacagctcctaaccccctaaccctaaaaac

SEQ ID NO: 2898 - DNA, 353 bp, Bacillus thuringiensis
cgaagatcacctttctataatagtggggtaactgcaatagaccgtggggtatctcttgaaacgactgcggcctctttgggtcgaaatagaagggctgtttatctggatcttatagcagggcccagctggtagatctatgttggacaggtagcgatacaccaaggtgaccatgcgcaaccgacccaagagggcgatcgatgactctgggactgggacacggtccaaactcgtacgggaggcagcagtagggcacactccatattggacgaaagtctgacagggcaacgcctcgagagtgatgaaggcttacaggtcgtatagcaccgccggtagtgacgaacaagggctagtat

SEQ ID NO: 2899 - DNA, 119 bp, Bacillus thuringiensis
cgacgggactaatttcttcggttagcgcacgaaatagacggaccgcggtgagaggagcctgaccgaacacgcataagtgactgccagaccaagtctgctcatatctacctaagatagag

SEQ ID NO: 2900 - DNA, 476 bp, Bacillus thuringiensis
gttgacgacaacagcagatttctgctcatgttttttttcccactagctaacgctttcatatcaacgtggctaacatctaagggctctatacctttcatgcctactaagtctcccccccataaatctaatgctcgctcacagactctattcaataacgctcctgtatcaaacacagttctcggtcctcttaaatcaccaaagtacgagggcactttcttagagctactatttgtagttagcgacttattgcttaagacaacagatggatgcttgccagataacagcaacttcgtggtcattcttggagctggttgttaaccgtactcaccatctgagtgttcaagcctatgtgactcgtgaaaggcatgctgatacatgacggcgattgccggtgtagcaaacgcaggctccaatgcagcactgcaaaagcccttgaaatgatgtaccttactcaccggcactcttagtagcaccga

SEQ ID NO: 2901 - DNA, 399 bp, Bacillus thuringiensis
cgacctatctggtttttttgcgcaattccttataagtgctgaaatcgggtgcttaaaggctgcctgatgacggttacctagctcatgaactgcttttatatttttacacaccaataatctgtgtacagcagccatgccaggagttgctactgcatagcgtagctctgctaatgaataatttatcccttcatctcgcgacgagctctgtaacgaatattagactgttatacgcgcatctaacgtcgctccgacgtatcgaatatatttactttaatgatagcgtcccgctttacttcactgcagtgaatagctcaattccatgttctttcactgctgtttctaaattgccgtggataccatcactccggatacatagatctattgattctagtgacagtg

SEQ ID NO: 2902 - DNA, 194 bp, Bacillus thuringiensis
  unsure (1)...(194): unsure at all n locations
cacacgtgtgtttagaggtngcctctgcgtgaagctggttgacgacaaaatcacagcgcgtacaaacgtttctttacactgcgggatcataaagggaccggggcttatctgtgaatacagtgtgcgccattagcaccagactgcaacgggggcttcggttgtcactgtttgacagacccacgcgctatcaacta

SEQ ID NO: 2903 - DNA, 287 bp, Bacillus thuringiensis
aatggagagagcaggacatcatttattgatttgcgaagtatggtctcgctacggacacgatggcgaatgcatcctgcgataacaggcatcgcttattccataaaggcgcgatggatgctgagggctcagtatctgacttatgctaggaagtgccatattttaataagcgatcatatgatgcaggatcttggtgaatctcaagcaatgacaacgttaccagcatatgtagtgtattgtacagaaacggtattggctttagtactggaacctacattcgcaggtaacga

SEQ ID NO: 2904 - DNA, 126 bp, Bacillus thuringiensis
ctctgcacacgatgagataatgccgcgacggctctgagagatgtagagggggacttgtaggggcagctggcggaatgaccgcatgccctagctcaagttgacaagcaccccgttggccgtatcaaa

SEQ ID NO: 2905 - DNA, 488 bp, Bacillus thuringiensis
tataatacaagtgcttgtattcactacttcagtgggactaaaggaaaaaatagataaaggatcctgcaaacgtgcattcgtatgtaacacatcaagaactatccaacctgtaacccactgactacacttttgaatctgtagcacaagggatgcatacatacagtaaggacgaaccattgctctaattatatgaaccgcgcgaaccaggtagactcgaagatgatagtcatgaagccttgtagctattgtttattgattactatacaatctatcacattagatattaagaataagcggaaaaccacaatgaccagttacaacagggacaaaggcgaatgcactatttagcatgttcataacatgatgatcactactaacactacattgtgcagctattgcggtgaccgaggatgatatgagttggcatatgtacggccagtacgaagcatatgctccatacaagcatagcatcacgcactaaatgcaca

SEQ ID NO: 2906 - DNA, 427 bp, Bacillus thuringiensis
attattccacattgcttttttagattcagggacagcataatgagctggccagggagaaaatgttgcaaactggcgattgcaataattgacaacaacaacattcttactcgaacatatgagcaactaacttggttcagcctctgtgtatctgaacattctagatgaccactaggacgccaacgcttactgggtccttcactatgcgtcccgccttgtctaagcaataagagaagcactgtggatactgactatcggagctgaaaaacccactattatatgctattatgataaaatcaatccactctagaacagccagtacaataacatgcatttgagcatgattttgcacactctgctgactagaatcactaataggatcatgtatctgaactactgtaggtttactgagcgtcatcagccgagttgc

SEQ ID NO: 2907 - DNA, 326 bp, Bacillus thuringiensis
ccggaaaaaggcctttttgatggggttaagccatacgatccgccctgaagactgagcataacaaaacacggcgcttctgtcaaagagctactaagccgggggggtatacagatgccagacaagttcgcaagtacgctcactcgtgcggtaaccggtcgcgcccatgaccatcacgggacacctgaacgtctatgtccctaaaagaagaatgtaactgtatcataggtaaagactcctgctattcatggcatgatcaacagagcgtttcaccctgggactggagcacaagcccaaggatcactcattcctatacggaggagcctggg

SEQ ID NO: 2908 - DNA, 140 bp, Bacillus thuringiensis
ggtgcgtgcttggggtgtgctatgccactctgttatttacggatggttaacacgcactatttcggggagccctattatgccctgtaggggagagtattcattttctgcctttacaaagggcagatgactacctttgtgac

SEQ ID NO: 2909 - DNA, 327 bp, Bacillus thuringiensis
gtggatgattccctaccaggacttacccaaggcaccttttatatgcggatgactggatcgtctggagctcacatgtgtctagcataaatctagcggtaatacagtgacgcgctgtatgttctaaacgcgtgttactctaatagaactatcgcataccgtgaaataatatgaatattgagattgtcatcaagactggctagaagcactatgcctttacttatgacaatacacagcctctgcatatggatgtacaaatatagtgtctactcgaatacgacactagtaactgctactggagaaggcccatgaaacaagcagtagctagcg

SEQ ID NO: 2910 - DNA, 390 bp, Bacillus thuringiensis
ctaaccacaccctgtgttaagcacaactgctgataataaaacacctgtgcttttcataaacgcgtgcatgcgccacatgtacaaaaacagacccattaggatacacaagagaagagggcacacaaacataatacatatgataacttggagcgccttcagtttgagtgattagattctaatgttttctatacgataagacttcatcctaattctgaggtgcgcatgtggcagcggggaatttgaattctcttaaaaaaccaaaagattggaatacgccgtgctcaacgatttttcaaggcaacaaaatcttttggtagctaactattttcattccattctaataaatctgcatttactaacaccgttttcattgattgacaaaacactact

SEQ ID NO: 2911 - DNA, 193 bp, Bacillus thuringiensis
gctattacaagacaacttggggtgaagtacgactatgcaccacggtatcacgtgcaggagatgcgagcgctactacagataatgctgactgggaggaccgagcgcacgcaaacagacgcatcacacatgcatttgagtgcctacaatgctcatgccataaagtggtgggacagggataatcacctgatgtcca

SEQ ID NO: 2912 - DNA, 142 bp, Bacillus thuringiensis
ccaacgcgcggggggttgtatgcagaggatcgggggctcttctcattggggagatactgagttgaagagctgggtccataccagtgcagtgcgcggccaaaccttactataaggtgtgattgcgagtgatcaccagactgac

SEQ ID NO: 2913 - DNA, 379 bp, Bacillus thuringiensis
aactattatctaaattcttttctgcctcatgatccgtagccattgtatctggcgctttttgtagtttaagatatgccttcgtacgtatgtatcctttgcacgagctgaactcaaaagccataagtatagtgagttgcccctccgcacatgccatcgataggacggcattgcactatgcacatataacagccaatcgcaagcctatattttgagaaaaaggagggaaatatctatatagaatcacagcagttacttcaacatgtgctcgcgccgactctgactactgcactgctctcatgagtatcttgctaagggaactcaaacgcgggtaccggttagaaccgatcggcttgactccacacagagcgagtgcgacaat

SEQ ID NO: 2914 - DNA, 425 bp, Bacillus thuringiensis
ttggggatggtctgtgttcatcaacttaacactataatagtcaggtgttacccctggccttgctgtagatattggaattagtggatctcctccaaatatctggaagctctctgaaccttctgctggcaagggagcaattattgcagcactaattgaaccagttaccactgccagcgcgataattgcacccagaagctgactgtcatgtaccgtggtacgagcccttgcatgtacttgtgtcgactaactaaaagcatatgcaatataataattcactgcattgccaccagtggatacacgaccctcaccactaacgcctaactgtggaccaatattactattggctggatacggtgcaatcacaccacctcattgaacgacactagctgtttctgatgcacgatttccaaacgcagcttttaccc

SEQ ID NO: 2915 - DNA, 430 bp, Bacillus thuringiensis
cctcgggagacatggaccatttgtcgagtaacaattgtagataacaactgtctcaggcgagaaagacggaacaacccactggagcaactttgtgtagaaagaacaatgtacaacatccgaaaaaaccgaagaagctgaccagtaggaagggggctccactagcgaacaccagaagtaaaagacagccactcaaaggcaaattacataggtacacctctatctagaaagatggtgacatcatgggtacacagcccaatgacaggccgggactacgtggaatacactcacaaacaaacggatatgagatcacatatccaaactggagagagtgcacatacaggagacttccacgaaggacccccattataacataccgactgactcatacgaggaaaacaccatgttctgtaggattgtaacctcctcggac

SEQ ID NO: 2916 - DNA, 292 bp, Bacillus thuringiensis
cgggagatcctgatgctccttgagctccagttgctcaccgttatcgccattctacaccattgcatacacctgaattacttgtggaccttgtctaccagtagctcctaccgaatcctgaaagccatggatccccagtggaccctatggacccgttgatacaactagccctgggacacattgtatttcttgagggcccagaagtacataaaggccgagcggacctgatggctctatgacttcaagaatgcctaggatctcaattggacctagcgacccagtgcgacctaacaaa

SEQ ID NO: 2917 - DNA, 222 bp, Bacillus thuringiensis
gatccatactaaacccaccttctctcgccaaagctagcgcttctgttgttgttgctataggagaaattcctgctcctgaacggaatcgacccgcatacagtatcggcatccaatgacttgaattattagccattctagtatcagtctaggcactaggagctattgctgccaaatgtggtgaacataatgctactacaaggagacgaagtttttgtaacatac

SEQ ID NO: 2918 - DNA, 329 bp, Bacillus thuringiensis
acatgaatgggtgagaaaacttgatagttaccataacagttatttacataacgaggtattgttaacatactcccgaataaccctgacaatgcatgtgcagcttgatgagattcaataagagtcccaaaaagacctattagcttcaacgtgaccataaaaaaaagcaaagagtttcccgtctgcttcttgatttatatcacagcgaggagacgttccgagctcttatccgttccgtattaatgcgcccaaaaataagcagtacaaattactgaggcgctgggaacaaatactggaccgggaacacccttggtgtgcccaacataatcctt

SEQ ID NO: 2919 - DNA, 417 bp, Bacillus thuringiensis
caactacataaaatttttttttatcggataaaaaaacacaacctggggtttttaataaaatgtgggggacaaacacaaatacttttcattgcacaccatatataaatatacaaagtttcttttacaatgttcatcacacattacttcttatacaaatgcgaaatattctaatttaaaacatgccaaggggctaacttatctataaaaatctaaaagcaccaataaatgtattttccattccaaagatagaaacaccaccatgtctaatactctcaccaagctatccaaacaacttttatatcatataaaccaaagtaatccacgccaatgattctattttaaaacaacatatccatatacaagaatggcaaatcacctgcgctcgatgctaaggtccaaatataaacaaggattata

SEQ ID NO: 2920 - DNA, 328 bp, Bacillus thuringiensis
taagcttgcttaccaattcatataaattttttttaaaactcatgtcacattaattatagtggtggtttttaaaaaaaattaaccatgcgccaactatctactacaaatattcaataagacaactaatacacatattaaacccaatttggttatctattacaacaatacatcatatacccttgttataaacaaacagacaccggataaacacttatcaactatctaatctacataataccacctgtttaccctactatatcaaataatcccgtaaatcctaactatattacacataactatcttcaatattatccgtcatgactataaa

SEQ ID NO: 2921 - DNA, 458 bp, Bacillus thuringiensis
cagacgcggactgatgggaaccaccattcgtgatatcagatccgattgcgtcatatgacatcacacgcgagccgtttgtattgcagcttctgatgcagactgaggaagggcatttaaacgattgacataggcaccatctccatatactctaaaacatactgtatacaatatataaggaactttaaaaatgattcaacattgagcctgcatgaagaattaggacacaccaatgagaaccgctgaatcaacataaggacgaaagccaacccctttttataacagaccaaccctataacaactgattatacacacaactggaagatcgcgttacctctgctaacaagaactcggacttgaagaatataaacaggaggcactagatcactctctgagatccattactcatctgacccgatcgagtaataaaaatagttagccggaatggcacattgtcctag

SEQ ID NO: 2922 - DNA, 246 bp, Bacillus thuringiensis
atagtggcgcacatgcagtcgcccgcgcggtcaatattggtggcgattatacaaaaagccccgcgtgaaacaggtgttaaaacggtagccgcggacgcacaatgggggcaccgacgtttacgcgcggagacccattccaggagaccaacgaccgatccgtgtgatgcaaacggctattaagggccaccacaatgcggcgccaagtgatcatagggtttatacttaagaccaatgtgaaaaaagaat

SEQ ID NO: 2923 - DNA, 337 bp, Bacillus thuringiensis
aacatggtatgttacaattaactaaatatgtagttaacatactatgagaagcccgtaacaattgcacgcatcatacacgtttatctctataatgcagacccataaaacaacaactttgctgcatatttgtaccataaccaaagcgcttatgagaacgccctttgcttgttcattgtaatatggatgagacttcttctttattatctcaaccggcatgtgccaccaaaataacttagtggtacgatctgctggccttggctcagaccccggatcaaaagcttcatgtgcctgatcaacagaatgctttgacgctgctactgcaggctttggtacaagt

SEQ ID NO: 2924 - DNA, 286 bp, Bacillus thuringiensis
tcgggagttgcgtcaaatcggggtgcgccgtgagttactaacgaaattttttatcaagagctattcttagcattgttattgccagcaattagaggtatcatatcacgtatctaggtgctataaaaccaacaggctctattccagtcgagccgcactatcgatttaaccatccacacgagctccctgtagagaattccaccaaacaccactacatgacaccttaacctgaccaagcaatagtgcaaacgactgtccttgatccttctacatcagcgctgcaagctct

SEQ ID NO: 2925 - DNA, 258 bp, Bacillus thuringiensis
ggtgcgacaaacgaaattgttacgagaccgcagtagcaacctaattagatgtggtgggagatcgatgccgggcttctggtcagcactacgattagcatacttattctgtataaaatggaacctaccttcgagcatgggaatgcgcacacgacgtaaagattctgtttggaatactgagcaacacggcattttaccctgtatggagctagcgtatcaaaacggatcggattatatgagaaatattcgttcaagctcgac

SEQ ID NO: 2926 - DNA, 365 bp, Bacillus thuringiensis
gcaatcaagagatttcatcttattatcataccagggaagataataatcaaggttccaaaaaagaatatgtaaatgatgaaaaagagtatataaatcaaaaataatatattttaattgaattttgagaacgatcaatgttgcgaagatatgagtaaaagggtcgtaaaaaatagctattgtgataacaggtatgctttactgagcgcgtatagttttggccaatcaaactagagtatgagagtctaataaaggcattggatgaaggtgacaagaagacggttatacttaattgaaagcagaatatttggaacttttgaggcaaaagaacactacttgaaccatgaaaaggcattctgattagatga

SEQ ID NO: 2927 - DNA, 109 bp, Bacillus thuringiensis
aggcccgcaccctgctaattgccacaaaccgagaaacggccaggtggggggctactttgcatacgcttcgccctcctgacaagcatcacataaaaagacgttcaactga

SEQ ID NO: 2928 - DNA, 358 bp, Bacillus thuringiensis
aaagaagataaagcgatggaagtttttttagatagagatttagcgtgtgatctaaagggagtttgtgacatacgaaaagccgcttctcggtcatatgataagggcatgtagctgattatttgagcaagctgcggaactaaatgaatgtaacgggattggtttactaccaggggaacaatcggaagacgaaagtgtacattaaaattgcttatatgggatggaaggaagcatggacggaaagagaatttgtgctttggaatgcattagaggagggttactatgggcattatgttcactgcatattacgcggattggctaaatgaatttgattgcggagtacgggatcatgggatgcaaa

SEQ ID NO: 2929 - DNA, 343 bp, Bacillus thuringiensis
agctgatattctttttcactcctgttttttaacgctctatatgagcatagtgagccatgggataaataagtaggcgcgaatgggactaccaactgcccaaaagaacatttcatcatatgcgcaaaggagatgccgctcgtgcgcttcttttagaagaagatggtgcaaaaccgcgtattatatatgccgtacgagctcatttacatactcatagggagctatcgctgaaacagctgtactctctaaatgcatcgccacatataatacttcttcttttgcaaatgaaagagtgaactcttttttataaaattgtaaaatctgcttcgcaagtgcatattctttc

SEQ ID NO: 2930 - DNA, 328 bp, Bacillus thuringiensis
cactgcttaagaagcggagatgtattaaaaaaagtattctggcttatcccaccaaaaccttctctactactgccgctatagtaaagaacatccatatcaactccccatcttgatcggtctgcaacaggcatcaccaattcgacccataccgataataccaaccgtgctatggcgcacatcctagccccaagagattttttccgatatcagagccccattcagtatttctcacgcaagaactcgactactcacacgccgtgcccaaattacagcataagggctgaaaaccagatcatccactgcatcactcaatacctgtggagcatct

SEQ ID NO: 2931 - DNA, 362 bp, Bacillus thuringiensis
ctaatatcagtatttctctactaccagctaacgcagcgttcccaggggggaatggtgacgggcattgcacgcgggataacgatattgcatgctgtgtggacggtggtttacaaaatactcgtggtggaccgggatgtgtctggtgaggtatgggaggactttatacttcaggttgggatggaggagtcattcactgtaaagtgcctgatgctaacatgatgctacacgagcgcacctgcagggtttaatgaaggatcgatacttttacagctggagaggcctacaatttctctggatacgcaaaacagacatctggctgcagcgtgaaaagcgactgggggcttaggaactgtagcgaggcc

SEQ ID NO: 2932 - DNA, 322 bp, Bacillus thuringiensis
ttccctgctctatctaaaattccgcatggggccttcttgaatcaattggagggtgaaaactacaccctgtttccaccagaattagaacgatctttctcagaaactttctcaaggctagaaaaacatgcactcttattccactgcatatgaagacccaccttgtacttatactaaatcaccacttccaacaacataccgcactaactgttttaggatactctatatacctcgtatagtctcgccagctgtcatgaacacaccaatcattcaaacaatcgacccttctagaagacagcgtgacgataacgtcaccgtctgcata

SEQ ID NO: 2933 - DNA, 434 bp, Bacillus thuringiensis
ataagctgattctgcttgctggggaggtatcttgacagagaacccgagttgcatgtttcacattcagttataacctgagccagacgtgatgcagcatgcataacgactgctaatctcttgcttgcctttgacttggtatgagacatcttgatccaatgcttcatactaaataaggattgtgagcgtatacaaacgtaaacatgccagttaggagtcagatatatattcacttcatagaccactaaggattcaatgacacatcattatcaactatccattgcatatctatcactaggtaatgtcactagcaccatttgctgatataaacgtaccattactaagcgcttgtaattcatatatagaatagagtccaccattatttgtgagaaaactggccattgcgccagagatggtcgatctgctactacttcacc

SEQ ID NO: 2934 - DNA, 105 bp, Bacillus thuringiensis
acgaaacaccgggttctctgaaagccatgactctatgcagagctggacacgctatcaacgaaagaaacgaatttgaacgggaactagactcgaggattgcctacg

SEQ ID NO: 2935 - DNA, 151 bp, Bacillus thuringiensis
cgctcacaccttgctggtaacgcaagggaggtggacacctgggatccaccctcaacacaccttcactagccaactaaaatgtatctatggtcgaaacaacgtgaaaaaccactgcttctgactggatgactcctgcactcaggatggaaat

SEQ ID NO: 2936 - DNA, 277 bp, Bacillus thuringiensis
tttatagggatcaccaccgttgcaatctaaactaatatactgctagaatgattatggcaagtatacatatgttaacaggatacattactacaatacatttgaactaatgaaggttaatggtgagaagagcataaaacgggataggatggtgagaccattgggtgacctatacgaaaaccgacgaaatgagttcctgtgcaccacataactgtgtcaaaaatgcttatctgctaactcaggatactcgcagtcaacacaaaatgcctcctattcacca

SEQ ID NO: 2937 - DNA, 366 bp, Bacillus thuringiensis
tgatataacgagtatgaggtagaaaacatgtgtcactacgagatctaaagtaatggggacaataagggctagtacgatagacggaaacatggtcacagcgggcactggcatccattgccctggacgtaactgaagtatgcgcggcgtaacaataggagctcgcaaccttgcaccgatggcatcgctaaagacaacagcgagtgcgcttatgatgcttaaaccataacatgcgatgcagtgtcacccgggattgatcgcggaaacacgcacccagcgtgataatatcggggggatacattacgaaagggaggagcgatgcgacaagaggcatgaaaatgaacatggcacattcaccggttgtaactg

SEQ ID NO: 2938 - DNA, 317 bp, Bacillus thuringiensis
cgcggtgatcgtgtttttgatgccgtgcctagaacagctaacggagcgaggatttgttggaaagccgctagcgtacggatcgcggactgaccatcgtatcaccagataggtggactattagctgcacacttgcgtgattccgatatgaccttcgatgtcggcaattatgagggacggggaacgttctcattgttcccacaatcccatattatggatcactgtaaatagggatgcgagacgctctttgggctcgacgattaatacaaggttactaggtacagcggctcattcagccgcgtgcccggttgcgagacccc

SEQ ID NO: 2939 - DNA, 123 bp, Bacillus thuringiensis
tatgggggccgcttttttattcttcttgcatgaagcgttacaagcgaaggggatttttcgtcaaacagaaggggtggttcactttcttggacatgcataattaatgctacttctgtaagttgg

SEQ ID NO: 2940 - DNA, 127 bp, Bacillus thuringiensis
gggatcacctcccagacgtcacattaagaatgcataaccactattttggaaccattccttctttgtggcgagcaattgggtgccctggtgacccttacgtggagaagaggaccaaacggtcaccatc

SEQ ID NO: 2941 - DNA, 290 bp, Bacillus thuringiensis
ggcagcatactcatactacgctatgtggactcggtggacttgcacacaacaatcaagcgatgcgggatcgaacttagatgacagatcggataaacatagttagcacatggggcttgccacgatgaccgactagatactgatcccggaccaacacttgtctttcaatacagaaggagcgcttcattatacgaggtagaggttacgacaccggagacgctgctagaaatcgggaactaggaaaatggatggatggcatatatggcacgccatactctcctattgacttattt

SEQ ID NO: 2942 - DNA, 179 bp, Bacillus thuringiensis
acgcagaaaacgtccccataacgaagagtccgaacagacgcctgcaaaataagcgacagagaggaaacaggaagaaaagaacgccatgaaacaggcaaggaacgaaactaaacgcaaataaattagaagacgaaagagcaatgacaacggctacctattgcggaaactcccgagcaaca

SEQ ID NO: 2943 - DNA, 493 bp, Bacillus thuringiensis
tgggccagcgtcacctgctacagcaggtcctacatttttttaacgtgctgctacaatctggacaacaccgggtggtatacagagtactgcgtcacgcgtaactatttctgctgcaaccaccatgccagatcgtactatcttgtagttcaccatgtatctagacgaccgcttgacgtggcgtgatctctcctatagcctctcaagctgggtcagctttatataatagcacaacaccagctgcagctgtcaacactacttgatgcgcaaatacactgaggtacgcccatcgacctacataggcgacaatgaggtcaccactgatacgggcatctacaaggacactattgaattgacgctaaaatacactgccatatagtgcgttgggcgtacaagcagataatcatttgaatccgatggctataaacgaacacttactgttacatgagctgaacctgggtgaacactagtgtctagggcaataaatgaacgaaac

SEQ ID NO: 2944 - DNA, 620 bp, Bacillus thuringiensis
aacacgagtacatacaccacgttttcaaggagcagagatatcttttgacaatgactataaagaggcaaaaccggggtgaaacgcacgtgataaagacggccatactcaatcagaacgaccaggggggcactaacctggcccaacagtaggcaatttggataatacctcccttacgcaatgctcgtaagaaccacaatatccagggaggactaatcaaatagcacgaaaacaaaagttttccgcaagggaagaagcaacacgcttctgctccatcacaaaacaacaagactcgaaccaaataatatcccgatctgcatgaaagcatatccaccttagaatcccccagaaagctattacccaagcctttaacgaacatgaaaacaaactatctgaatacagggacaccgctaaaatatgtcatctggcaacacggaatggaataagcaaggggtaaaaccccgcatgacaagacatcacctctgcgaaagaacaaacctttcctgaaacctgaacccatatctctgacttgccccccaaggaagcgttaaaagacccaacgacctacataatttcagaagccgaaacctctttcgaaaggacaatataaaatatccccccaa

SEQ ID NO: 2945 - DNA, 369 bp, Bacillus thuringiensis
atggggtatgcccatcactacagcctatattttttgtacatgaaagaaatacttccggtacgagggttttgaaatgttgagcgggcaactacttgactaagactatcatacgttctcaacgctctttaaagaatatatgtatcgttagatgatatgcttatgagattcacttaaagagtgcgttgactttcactctcttgcatagcactattcataaaaagagagaacgatcatgaacctctgttttatacggatacttaatagacaaccttgataacacgcttgtagcattaatatcgctggtcgcttttacacctctaactaagtgcatctagaaaatctaaatggactttttcactcatatagtcc

SEQ ID NO: 2946 - DNA, 262 bp, Bacillus thuringiensis
tgcgcgtttttaatagtgctaataactgctttagcctttctttttttctattctgaaacatctctgctggggacttttaaagatgtgggccggcctaacaataccaagctctttcctttgtctgcaaaccaaaataccttagaacccccttctggcaaatgcaatttcagttacagcttttccatttttttcaaaagatgctttccctcagcgggccaaacaaactactaattgccatgtcctttctgggaaaaacgatttt

SEQ ID NO: 2947 - DNA, 282 bp, Bacillus thuringiensis
tgatagatgctgggcgaatagaaactgtatcttttttttttgactgtccatatgacgacagggctcggggtgcttaaattgggtaacagtgcgccatcattagaccaactgttaagtgctcatatcgatcactcatggttatgtgacgagacagcagcgcttattataggaggtaatgagggtgttatcacagaagcacctaccgacgagggtcatgctttctgatgaaggaagagatgccatttggtgcagccaggattgacttaacgaccacgactagac

SEQ ID NO: 2948 - DNA, 327 bp, Bacillus thuringiensis
cgatgtttttggtgcgagttgcgccaaaatcagaggcggtatcgtttaattaacacggatgctcaatgagaatgcactatgatgacagaatattagaataaaaacgactctacatagggcatatagtctgatattaaacgcggcttacatcatcgcttgatttggtggatgtgtcacgatactggcacgcgggacaactgctagaacggcattatattcacgcatcacttgaccaccgaatgcgtgtatgattgtaagggttgatgaattgcacactgtagcgtgaaaatataccgatccataggcgggcatgctgtaaccttactg

SEQ ID NO: 2949 - DNA, 490 bp, Bacillus thuringiensis
ggaaactgaccttttgtttcgatcaaacattatgacaatcaaggatgcgaatcgtacatagtgcacagagagcgaaaggacacatcacacctgttaatgaaaacgcctgtaggaacatacgcgagaagtgacgtactcgtcagagcgctgatgatgaaaaggtcctcatgtatgactggagtggagctatgatatgcactgcaattactcgcgcgtatgatgatactggcagtgagatctactagagcgctgcggtgctgttcattacaccgatggcgagtatctgcattgtttaacgaagaagaaatggcatcctctttaactgaggcatacatttagaacgcctctgttgagtgaaggcgatcgcctgtgataggacatgatcatttacagacggaaaacctaccgcagcagatgtatgtgatcgagacaatatgacatgacaagatgtgctttttattacagagaacgtatgatgttactgtacaca

SEQ ID NO: 2950 - DNA, 137 bp, Bacillus thuringiensis
  unsure (1)...(137): unsure at all n locations
gaaaaaaangaaagaaaaccaaaaaacgagaaagacatttttttggagggaagaaaaaaaaggagnaaggggggacagagaaggagacacgaaaggcgcgaaaaaaataacaagaagcgcgaaagcgacaaaaacaa

SEQ ID NO: 2951 - DNA, 341 bp, Bacillus thuringiensis
gcgaacgagtgactccgatggagtaacgcatcaaacttttctaaaatgacatctcgtgtgtgttacgttgcattattcattaatacccctgcacagatcgatagtccgaacagtatcatatctcgattggaacttgcaaacagagaagcaacttctacatgtcaataggagatgttccctttaaggtccacgagttgctaacctttctaacaggtcgtattctcctactttcaaatgagcttgatcctatatacccatacgggtgttgctagcaggttcttcgcgtgccagaacaagaactctcttctgttgtaaccgctacctttacagcttgagccacc

SEQ ID NO: 2952 - DNA, 345 bp, Bacillus thuringiensis
aagataaccccgcaattgtctcacacaacgagcgagcggcaaaggggggtcccgaagctcacagcggaacctacccaaagaagatcaaagacagagaaaccattttgaaaaaaatcttcaaaaaatttttctagggggaaaaagaattggcgcataagagctgcacgaacaatcggcttacctgagtcaaacgctaaagaagcagcgatgagctgaatatcttcaacaaaaagggcctgccctagaatcgcattaaaaccgaagcccataatgacagcatgaagtacaacaggaaccgctggcaaatcagccaaaaaacctacaggcttgaaaccccgaaagaaa

SEQ ID NO: 2953 - DNA, 173 bp, Bacillus thuringiensis
ccggaagaacaagcagatgctcacactaatattttggcacgcggaggaccaaagattggaaatgacgctggtttagccgctgccaatagaaaccgaggggctggatccctggaagggccgacatatctaggagcgcacgaccgcttcttatgcccttaatgtgaattcgaacc

SEQ ID NO: 2954 - DNA, 152 bp, Bacillus thuringiensis
ccgaattcggatcatttaaatctgattttgcaccacctgatgagtggggtaccgagcgcttacggggccgggcatggcaacagcgcacagaggacccgcagcatgtttaacctctagcttacctaaaaacaccaggatatgtgctagcagga

SEQ ID NO: 2955 - DNA, 233 bp, Bacillus thuringiensis
tgatcgtgctgattattgagtgtaccaaacgggtgcatcaaggggcggaccgcgatgatcgggggggcgactggaatggaaggtggattaacaggctagaagatgaatgagccagatggttggcactggttgctcaatactagaaacacgcccctagacatacacgggaagccgtgaagtttcgagaaagaaacgattctttcttatcgatacattacgaccatgtatatatc

SEQ ID NO: 2956 - DNA, 335 bp, Bacillus thuringiensis
  unsure (1)...(335): unsure at all n locations
cgtgatcnacgcccggcgaatagacactgaatctattttttttatccggccctaagacagaagcttttgggggattcataatagctatcactgcaacctcattagatgctgtaggaattgcgccggcagtgcagtcagccatatcctatgtgtatgcactcattcttgcaaagaatcattgctgctgtactcaactgaacctctaccttacactgtgcatgtttattggtgatggaaggctctccttcttatcaacatattcagactgaatgacatcgctttgacattctatgtgcggagcaccgtctctaatctatcaaacatcatccagagcc

SEQ ID NO: 2957 - DNA, 121 bp, Bacillus thuringiensis
tgatcaaccgacttgatcatacacggtcttgcgcgcttttttatccaccacggtgtacaagccccactggggatttttaaggatgggcgcgcgttcaccaattaattcgctctgcattgga

SEQ ID NO: 2958 - DNA, 479 bp, Bacillus thuringiensis
gtccttaatatataccactatctgttttcccactagcactacaacattcatagggggccttttaaacaccaggcggggcataaaccaacgaaagaccgcattatttgcctagataaccaggaaactccaaccttacccaaacaccaccaattctcttcatacatcatccacctaaaacgaataaatcctcactatcaaatagcaacatcatgtcctattgccaaaccaccaaagaccatgtcttcattcataaacgccaacactccgggtatctgtaacatcgggcactgttccctcaattagcatactcttcgaaacacatttcatagcgctaagaaccgtcaccagctgccaaaaccaacatgccatctgcagccgaatcgactaatgccttttaatgcacttgaccaaccgggttaacagtgggggcacctttaacacagccagtaaaaaacctttaaagatcacactaccgtaac

SEQ ID NO: 2959 - DNA, 198 bp, Bacillus thuringiensis
cgtgatgaattctggcgaccaagataattcacaaccgcttttttactcaaaacggacacaaatcaaccggggggaaacttaaagatcttcggcacttataaacaaacttaagccaaaacccgaaaaaaacagaaccctaattgagaaaagatttttcttatcaacaagactctattcaaaaactccattcttctctat

SEQ ID NO: 2960 - DNA, 424 bp, Bacillus thuringiensis
gtgataaaccatgatgccactcgcctcttacaggttatccatcacaaacaaataatattaaattcggggggcttctaagaatgagggggctgttcccaacaatctcgcgagcattcaataccttactttcttcttgaagaaccttgtagatgagcaatatgctatcgctcgctggtctattatgccagagacaaatcacatagggaggtaggcatgttacgctcattaaaatctaatggtttaccctcgatcattaaatatcctgctactgacatagacgattcaatatatctgcttaatgctagctctcttgtgatgtcggaaggttgtccctctggttctattttctgaacgctttctccaccaactacttctacataaaccttgatagatatatcttcatactctgctgcgaccatcgccc

SEQ ID NO: 2961 - DNA, 288 bp, Bacillus thuringiensis
cgctttgtgtgttcagagctatggattcttaaaggaggtggatttaaaagtcattgcggctcttacatagctagcactttatggtgcatcggatattgaagtggatcaggactagatagatatgcacacggggtaaccagcagatgattcttgaagacgctgacaatagctcatggatacaagcaggacttctaaaaaacattgaaagcactctgagcatatgatgatgtcgatagtttcaatttatcagttaacaacagtgactagagcgagatgagatatacagat

SEQ ID NO: 2962 - DNA, 422 bp, Bacillus thuringiensis
gtcaccgggtgcatcaattgcaacgctttttgtttttgtctcgatactccttgttccataggtggggttattatagcttggcgagtgctaaagccagtcatctctatattattcacttaactcacccggtggcccataggtcacgctcatctaccaccgattcacgagattcacgtcccacatgtgactaaaatatcggcactatcacatagctcgttactgcctattcggaatccgattgagacctagctttcattcatatgccaccacctgatctcatatgcatcatgaatgaaattctctacatgaatccaaaccccaaactaaccataacgcatttcacgatcagctgggccctttgccaactaggcatctgcaaccaagtcctttgttgctgtttaaagtccgatacctacaacatt

SEQ ID NO: 2963 - DNA, 510 bp, Bacillus thuringiensis
tgcgtgcgtgattcatttggccccatcgcaaatgcatacgcttttttttgtacttctgcgccgacacgtttcggtgggaggcctattaaagtcatgtgggggcactcccatcacctctaattgtgcaaaacagtacgccgtttcattattagccaaggatagacttaattccctctgagtgaggcgaagcgtctaatcgtcgcattacctcatgtgccagaccctgaaacactatactcgcgtgataacaccccggcgcttgcaccggccgagaatacctaatttgtagtcatccccaagctctacgaacacttcactgctgccgtgctctagctaagggcatacgctctgccctgggactaacacattctcacctaaatggcgaacaaggttactcgcttcattcaagccagaatctgtgccaactagaagataccgaactcgattagcacggtcaccagatggtacctaataccgagcgacttgcttgtcacgaatatcattactatc

SEQ ID NO: 2964 - DNA, 267 bp, Bacillus thuringiensis
cgattggtgggagaccagtcagaaatactataaggagggcgatttccaagtctgggaggtgctatcctaactagcactgcttgagctatgtcaggtgcgaatgggcacggactatcacgaaatgcgctcgctcatacaagtgatataggatgaaacgctggcgcgggcttaacagaacaagcatgacattactaaaacatcgggagcgctcggacctgaacatgagtatctggattcaatctatcatcctaagcactgagaggagcg

SEQ ID NO: 2965 - DNA, 298 bp, Bacillus thuringiensis
cttggtttatgaagaattttttttgctcggaacgacttattgcttgaggggggttttctaaaaagaagggggcccttttttaggtagttataacggcggcatggttgttccaaaagatgatacggcgcagagtttatatgctatgacatgtgaaggctatacacactgacaaacagacgcttcctttgaaggacgcggacgaattaataatgaccttactctacacggtgaatgcgcggctagctgaaaagttccgtctgatgatgctgatatacctggtgctgtactcatgaagacg

SEQ ID NO: 2966 - DNA, 223 bp, Bacillus thuringiensis
ctgtgcaatttccataccttcacctaattttattttcaacttactttaattttacccttaggggggttttttaatactaggcgcgggacaccacaattaggttttgtcctaattcacgaactaataacctaaatggtcacctttacatactccctacagatacttccctcaacaatcattaaactttcatacaaatctatcatttactaacccacactataat

SEQ ID NO: 2967 - DNA, 134 bp, Bacillus thuringiensis
cgatattcttgcacttattatgcacacaccttttgatattgcccatagataaaaaacatatgcggggggtgtttaataaacggggggggctaacaccacctaatgtacgccaaaggattgcaatacgtacagcc

SEQ ID NO: 2968 - DNA, 184 bp, Bacillus thuringiensis
cgattgtttcacctcactcagatatactactcggagggttttttacaagtttgggcggtgctaacctccccagcactgcttgcggcatctatgattcgcactttctacggtctatcacgaaatccgctcgcgcttccaaatgttattgcttgaaccgctggcaaaggctaatcgaaccatacat

SEQ ID NO: 2969 - DNA, 416 bp, Bacillus thuringiensis
ctcaattgtgtccccttcttgcacgaaatttatttttaacttgggaagggcttttcacgagggtggcattaatcagatgcggaaaggtaagagcacatctttcagtctcctcgtgcgacgtacatctgaattccttcgttcttttctgctcatttggcgtaattctactattgaaatcggatacgccgaacagacaacatggcgacgctgtaacttgctccgctggacgatccacagatgcaagtccttctattttcactgatactaattcctgctctttcctttcctctaaacggaacggagcaaatgcgaaatcatcccactgatctgattccttatatgcaggcccttatacatgcggcgccggtatattatcatgctcgtgcgctcaatcttcttgtaactcagcatacacg

SEQ ID NO: 2970 - DNA, 375 bp, Bacillus thuringiensis
ctgagtcagtgcatcaaatataccactttttgtatcctcctaggtccccttcattcttagggggtattcttcaggcttggcgggacagtaaagaaacgaatgactgtattatttccctccatcaccggaggattgaccgtttaccccaaacaaaccgaaaccctttatacaggattcacctaaaactaatcacatcagctactatctaagggcacatatttgccttgtgtcaagtcccactggtccccgtcttcattcatcagcgcaaccaccacgcaatatgtaactgggagcatgaagtcacaccatggttctattcgctacctattaaaccgcatacaaccttcaccacttacatttaccaagatggtatct

SEQ ID NO: 2971 - DNA, 154 bp, Bacillus thuringiensis
cgcgattatcttgatcaaggcctacacacagcttgcgaaatccaatcatacatagtacatccgaaaattaatgcgggggcggctacctatgggagagcgatcacctatcaattaccttcaacaaaatcgcttcaacaccaaacaatctcctcta

SEQ ID NO: 2972 - DNA, 418 bp, Bacillus thuringiensis
caagatttttttagcgtattcgcttgaactttgccattttccgctctaatagcagagtcgcttacataacttgctcgattgtacatggcgtactttggaaggtacctgcattaaggacgcacggaaaaacaaaagaaagctgttgctggtatcgttaccggagcactaaccgtaacaacaagtactgatgaagaaaacatcgctgcttacatcctagaaaggggtcaaatccaacatgctatgggcggaaaaggctttagtgacagaacatttcaagcttgtttataagaagccaccattagctgtttcttaggttcttccttctgacaactcaatcattttctctaaatattgtccttttgatgcatcaccatatattaaagcatgccgatgagattaacccctcttccggtttttt

SEQ ID NO: 2973 - DNA, 237 bp, Bacillus thuringiensis
gggcaacactatctaacactgttctaaataggagtgctagctccgtttctatttaggcattgatatcgctaaacatcaacagtatgcgttcattaatgcccaaactggagggcctactcctgagacatcatcctttcaaaaaggcaacaaaagggcacgaacccttaaaaagcccatgtgccggcgttttttcataagctcagaaatactgattggaatggaggcaacaggacctta

SEQ ID NO: 2974 - DNA, 154 bp, Bacillus thuringiensis
ccccgctactttctgagaaatggttccgagggtcgcaaacttgcgaagaacgcgcgtactggtcaagcatctgaagaagacgctcgcataatgcggaatgacgaaatctactctggcacaacgcttggatacatggacatagcacacggagtag

SEQ ID NO: 2975 - DNA, 544 bp, Bacillus thuringiensis
ttgaaattcttgtaaacatatataaaaatttaatactggaaacaatatcattgtatgacgggggcgtttacatgactgccactagctataaccccatctctatgccaaacataattgcctcaagcttaattcgggtattacctaatcaaaataactgtcagttcagaccttttatgccggtttattaaccggattaacatataaacatatccactaatagaaagaaaaacaatttgtgcctcggtagcaatcttattttatagtttgtcggctttattcccttgggatacattttaacataataattaaatctattgggtcccaataaaaaaaggggggtgaagacacatcataccttggattatatacccccggttatttattggaaaaaaaaatttcaccaaaaagggaattgttaaaaggaaagaaaaaaacctctattttttcaataaggcccccttttacccggaatggcccttttctttatttgtaaataacgttaatacccccacttcaatttggtattcttcctggggttttaccc

SEQ ID NO: 2976 - DNA, 184 bp, Bacillus thuringiensis
cgaacaaacgttcttctaatacacagactttttttggtgtaaatggaaggatgggaggaagtgttcctattggaacattggctaaaaggtgcaaagcatttcggttttccaaacggctattccttcaatttctaagaccgtacacttgacccattacttggattggcagaaggggaagaaaggg

SEQ ID NO: 2977 - DNA, 530 bp, Bacillus thuringiensis
gcatactgagaacatgatcaaccgcgatcgcttgtgcgatactgccataacactcgttttgacgataagattaggtacagatccatagataaagagctgcggtcactccattatatgaatcgatttttcatgttggattgcctgtcccttatggtgaaagagcatccacatacttgatctatgcgtacgcacgactccacagtccaatatttatggctaatcgacaccaatccatgatcatgtcaaggtcacatcccatatagactttgggggtgtaaggactttatcctagacctgttgaaggtgagcttatatacatactacccacctcagagtctgtatggacaatccccttgtatacgcgcatctttatccatgcgtgcatgcacatatctaacggagggggtataatactatttaggagtcataggagcgggtgcacctcattggctaagtgctgcttttttcagattggctcatttactgaagcaccgaaatacaatgactttatccatcactatgacatctgg

SEQ ID NO: 2978 - DNA, 306 bp, Bacillus thuringiensis
tccatatgccctcaaagtatgtaactaaccgtgatttaaatgctctcgtgtgttcgggaggctccgatgactacgctgcccctggaccgaatatctggacaaggatcaagggggcgtgagacttcgcgaatctctcacgtgagtaaagagatgctgcttcaaaatccaagataggtgcaatgcgacagagctatctgttattgcacaactaaatacatggacagaagtgctagcctttgattcatcgagtgatgcgacagagcgatttgcgacgtcagcgtaagactgagatactccatctctcgc

SEQ ID NO: 2979 - DNA, 348 bp, Bacillus thuringiensis
acgcgttttttgtcggaaccatccttcgtgattgatataccctgctgtatcatcgcaaatgaaaagagttttttatatgcgaatatggccgggaatagaagaggagctttcatgtaacctatcgaatacacatgatctattatcttggtaagcgtcgcgataaataacaatgtgctccttacgctcatatctttatagccaaatggagaagacacaatatacgttattagcgaccctcccatgatgttgacgctggcttattggaacccttactgacaacacgggaagcgagggttttttagctataaagactaaataaagggtgagtacaataggttttcttttctt

SEQ ID NO: 2980 - DNA, 194 bp, Bacillus thuringiensis
ctaccgtcgaggcaaaggactacgcactttcgcgctttaccgtccatcatgtacctttccccgggaaaaacgattacgacctcattcatcattttgaccataccgtgaagcttatttagcattgtgaaaaaagtccaatgaactttccttggaaacctccgaccaattctgcatggcgaggaatttattatgcc

SEQ ID NO: 2981 - DNA, 128 bp, Bacillus thuringiensis
aattcgtgatgcggtcatttgtgttatttaaaacattggatgattcccgaaaggagttgatttctctggggggaaccaaatagcgccgtttgcattcttaaccaaacttagcaccgtcagatccagaa

SEQ ID NO: 2982 - DNA, 129 bp, Bacillus thuringiensis
gcgatcctttaatcgatcttgaaatggccagagactcaacgcgcgtcttattttcaactactgtagggatagctagtacgacccccatgacagtattgtatgtaatgctattattgcggttcatgacct

SEQ ID NO: 2983 - DNA, 185 bp, Bacillus thuringiensis
caaactcatcgcatatcttgtttatgcctcaaattcaacgttcgtcttattttcaacaaatgtatgagaaatagtatgactatcatgacagttctgtatataatgatgtaaatgtggtacaggatcttcactatgagaaacgctggctgctttatgcagatgccaaagcgattcactcattacaa

SEQ ID NO: 2984 - DNA, 539 bp, Bacillus thuringiensis
aatccgggatggaaaatcccaccggtacgcttaacactcactggcattcaaatttttttaaacatgcagtccggctgacgcataaagaatcacagcccatttagtgctgaattatccagcggtacacggtcgagcactgtcatccgatggtgtgatctcatgtattacctgtgaccggctgctatcttatatacatgatagcaactcgctagtgatcgactatgattatcggatcgactccaccagcgcggctctggaactatcattgccgacaagcgaactgcaaatgctgagtagagctatatgacttatggtggatggttaagttgactgagagcccgcatagacctataacctagttgcttgagatctaccgctctcttactcatatgtctgccgagtcgattccggcatggtccacagcacgtttacactgtttgacggtgcagctcctggttctatcagcgagactgcataggctgcatcgttcatagctggctgggtgtgagagacatgctcttgaacatacactgtaattg

SEQ ID NO: 2985 - DNA, 119 bp, Bacillus thuringiensis
tgatgaactaaccccagacaccccggtcgcttcagcggctccttcgtcgtatgcaccagaatatacagacggggctggggaaccggtcgattccgtatcccatgtccagaaacaaattt

SEQ ID NO: 2986 - DNA, 169 bp, Bacillus thuringiensis
ctatttaccaagggactaactctccaaatggggaagcttgatcttataacgctttattacatttcgcactaggacgtacaatccgtgaattataatcgcgacttaatacttgctaagacagatcgtacactctacaataatatcaaatacgttgactcattttcccctt

SEQ ID NO: 2987 - DNA, 210 bp, Bacillus thuringiensis
ttgaataagatggaatcaattgggggtggagatacattaattctcttttctgctgccggttatgcatatgctgagggagcacttattacagacgtacattcgaaaacggccgtaatagaaaaagatgaaaacgactaaaatggtgattagactgagcatacactagaccacacgcaagggggccagagctagcggacgctgaaaacaatg

SEQ ID NO: 2988 - DNA, 133 bp, Bacillus thuringiensis
tacattggcaccaccttgaacgaccaaaattaccgacgagcgctattacttcgcaaattaattgcatttatacatgaccagaattccatcctcattcaagaacatgatctgatggtgggggacaaggctttta

SEQ ID NO: 2989 - DNA, 257 bp, Bacillus thuringiensis
tcgaatgatacgcatgaaggcgtcggggggtttttttggactacgtcaccggctgatttctcactcatacctcactaaatattcattctttggcataacaaccgttcctatcatagtttttcttgccaactgaaaggagtcgatgaagtgagagaatcgagaggcccaggcatggttcccatactttcgaagaaaattgcggaacctttctgctttcgcttatcctatttaactcatctggagagcacgatatgaat

SEQ ID NO: 2990 - DNA, 118 bp, Bacillus thuringiensis
cctggctcagaagcttgtttactaattagaccgcctaattatcccaccaaccatgccacaccgggggcatcttttgagcttataacgctctcaatatattattgactcctagaaaaat

SEQ ID NO: 2991 - DNA, 168 bp, Bacillus thuringiensis
ccaaacgcaacaatgaccccatcacaaaattttttaacaggctccactggcaacagacgaccgaggaaagcacgcgcgcgatggaatcgaccaccacgggggaaacgacggaaaacaacaactacaaaacagggcgcccatcgcggcccaacaccccatcaaaacgag

SEQ ID NO: 2992 - DNA, 243 bp, Bacillus thuringiensis
gctctttaatagctgatcacacaccaaacaacccaggcggggtagccataaatcttcaaaggcctctcgagagaatatgacttaaattaaagtccaaactcgtaacggcgactttccagtagcgagacagagaaagctcacctacctaatgaaataaacactttttcgcaataagacgcccgacatcttgccgattgttgtcatagttcccacaccggcgttaccattatcattaggtccctt

SEQ ID NO: 2993 - DNA, 168 bp, Bacillus thuringiensis
cggttaaacgatatctattttcctgaacaataggaagacggtatggcttgaattgatagcatgctatccctctctcagcacccagaagatgaaactctactctactatgcggcgtaaaccagagatccgaccattctccaagtgctttacgatctgttgctgggactg

SEQ ID NO: 2994 - DNA, 192 bp, Bacillus thuringiensis
atagaaggaggcaaatattgatgtgaccccatgcccatcaacttaaggtttagaaacctctcacggtttttcatttaatttgaaatgttcaaactttttaaacacgcctaatcctttttaaaacttgagcatactcaaataaaaccctaaccgggtgattattttaaatagttattgcaagcttttctttta

SEQ ID NO: 2995 - DNA, 376 bp, Bacillus thuringiensis
cgagattacgcgttctaagtgcactatactgaaataagggccgtttatatacgccccagcaatcagcatctaagccacgggcacttattactggcgctggtttttcatacattctctacaaccaatagccacatcggctccaccatgggtagactactttaaatgtacttccatatgcgttgcttctttgataacttatacacctctacattgttactctttctagcctagtggaaacggtgatctaagccatgcactgtaagtacatcgtttactacctcgtattcaagcaacaatgcgagccattaatccaacacgtccactaccactgaccagaacagcgatagctggctatacgcctgcagatattacgctc

SEQ ID NO: 2996 - DNA, 116 bp, Bacillus thuringiensis
ctgccgatttgctgtttgaggtttctctataatatgcgaattctcgctcgcttggaaaaggcggtctttgttataatttcgtctgcgagaggctgaacggacactgtcaacacaaa

SEQ ID NO: 2997 - DNA, 308 bp, Bacillus thuringiensis
agtgcgtgatattatggtgtgctgctgcaaaagacagcgtattttcatgtatatgaacaatacaaactagcggtggtcactttacaatacgcgcagtaaagatcccaatgacagtactcaccctaaatagtggatgcacggtaatttgcgctaaaacgtccctattgttcaagtaaagtagattatctacctgtgatcgagatcaataaaacatttctattgcttttttattagtgaaataaaacttatcgttaatatcaatgggcttatttctaaccgaaccaagtatttgtatatatgaaacgtgg

SEQ ID NO: 2998 - DNA, 229 bp, Bacillus thuringiensis
caaggcagaccaggcgacatacattctaaaaaagtaaggccgacctgtagaaacagaacggggaccccagcaagtaataccaccgacaactgaaatagcttcaaacccagctgctaaatggggaacaaaaagcagacaaacatgccaccgggactccataccataactcctactcaatcgtaatcaactatcccttgaacaacgagacttatcaactcgctgatataac

SEQ ID NO: 2999 - DNA, 214 bp, Bacillus thuringiensis
taccttctttttttccgaaggttacagactgcaggggggctcattgacatcgtagcggggcttcaagaatggctcggcgcacacgctgggcttggatctctcagtcacagactgatgaccctgctagaaggcagctcccgtgtatggacctattgcattggcaaaatccgtagctttccctgttgaatggattgttcccatataccaaaagaag

SEQ ID NO: 3000 - DNA, 231 bp, Bacillus thuringiensis
aacagaaccagaagttatttaccacacgcaagaacccggcgagggggggctccacagggagcagggggagaaaaaagggaacgcgaaccgtacgaagggcggcaataacgcttcggaacaaaacacagcggtgagccccacaaagaaagaagaacgccaataagaaatcttcggcgagaagccagatggattaccgccaaaaaaaaaagataagcctaacgggaaaggaaa

SEQ ID NO: 3001 - DNA, 186 bp, Bacillus thuringiensis
cagagttttattacccgcgcacccatctgatcaacgggggggcttcttggactcatcgtgggtcccctacacctcctctacactaattcaatactgtactgcaaaccacgcggcccgacaccctactaagataccaaaatgccccatctccccttgtctcagcatgcacacccaatcaaacctccc

SEQ ID NO: 3002 - DNA, 135 bp, Bacillus thuringiensis
gtgattttcctggattcatgctgtttcctcacttaattgatggtgccataccatactctaacatggatggggggctttttcatccactggggcgagaaaccacacgattatcataccagtttgtgatctaaaacc

SEQ ID NO: 3003 - DNA, 184 bp, Bacillus thuringiensis
  unsure (1)...(184): unsure at all n locations
cagaagggaacacaccgacagccaancggacaccacgcacacnncggaaagagaagcccccgaagaagaagggcacaacgccacacagagaagcacnacagcaaacagaaaaagaaccaacagaccaagcgccgaccgaaacggaagggaacacaccacaagcccgcaaaaaagacgggcaccc

SEQ ID NO: 3004 - DNA, 231 bp, Bacillus thuringiensis
gaaatatcttctagcaaaggagcagcatctttcgtgtatcgatttcaataattctaaaccaacaagttaataaatacgagcatcagctgtgaccgaaaccatataaccaggagaccctaacacataacgataagtgcgaactatatgtttagggatgcctggattattccagacaccccacggattataggcagcctccatcatataacccccccaaaaaggatcgtatat

SEQ ID NO: 3005 - DNA, 201 bp, Bacillus thuringiensis
cgggaaaccaaaaacagatgcagaagaacaaaagaatagcctccaaacacaaagaaaactgccaaacaacacatagcactaacgcgcaagaaacgtagataagaaaataagcaaaaggaatacctactgacaaccctacagataaaaaacccgcaaagagaaaaacagccacaaaagaaataccaacaaaaaacgcaacaa

SEQ ID NO: 3006 - DNA, 110 bp, Bacillus thuringiensis
agagaagcgaagcagaaactaacagccgaagaggtcttctttgataaacgagtcgctgtaagaaacgggggggtctaatacctaaaagggcactcaaagtcatcgccaac

SEQ ID NO: 3007 - DNA, 117 bp, Bacillus thuringiensis
tagatttaagctaatccgctctgtactattgggttaccagatgttaaaataccacaaatgtatttctttcataacacggacgcagttttagaatgttagagtgtagtcccatctctc

SEQ ID NO: 3008 - DNA, 217 bp, Bacillus thuringiensis
cgtgatcgaagcgaatatgaatctacatgtagcactctatatttttatagaatatgctctttaagaaatgggggggacttattccaaaggggggtgttaccggcattgctatcggaagagatatcttctgtagaatcaaaggaacactttaatataccttttactgagcaaacacaaattgatgttctacacactgttttcaacgacgaacgctgat

SEQ ID NO: 3009 - DNA, 113 bp, Bacillus thuringiensis
aaaaagggggcgttaatatggacaacctattccaatacgagtgtcactttgtattattaacggggtatgatacccctgcagcgctattaactattcgccgtatcatcccaaag

SEQ ID NO: 3010 - DNA, 358 bp, Bacillus thuringiensis
gttggcttcggactacactatagcggtgctctttttacagtggaccaaggaatgtcagatgcggataatcaagcatctgatcagttatacaaataaggctcaaaggaccggggcgattatacgatcacctggaatccagcagcacgtacagatctttctgatttcgaagatattcataaaaaagaactaggtgcattctgccatatgagctcttcgctaacataaggacctggctacattatacttggaacagctttgtcagagacaaagctggttgggacggccacttcactccatgcaagagacgatcgtaacagacgtctatgcggacaaacagatccacttccaagcggatgcc

SEQ ID NO: 3011 - DNA, 235 bp, Bacillus thuringiensis
gaactcttatttcggggcgaaaactcatcacaaaggggggttccaaagcgccacgcgggtgcaacacgcgtggtacctgatctttttctattgatgagccgtactagagctgggcgcaaacatggacatagctgtctccctgtgtgaaacggttatctgctcacacatccccacaacatacgatgtcggaagcatatagcgccaagaccctggggggcctaaccgagtgcgcttt

SEQ ID NO: 3012 - DNA, 428 bp, Bacillus thuringiensis
attacaacgttatacaattttttttgaatatagaaggaaagaggttgtccctggatagttaacaacctttttgttattaccatattacagctttaaattatcggaaagccaagtctaaaatgttctttagagattactatagggggtgcgatactaataacggtttttcaatgtgtttctttacatcagtattaccagcatgtctttcagttattctacagaatgagacgatgctgggtttcgatttaatcttcgattacacgtacgcagataaactcttttactcggagtatacttttagttgaatcatttggggttattaaattctcctttttaaattgccccaacctttatgtttccatctaaattggaaaaagaaccgcctcctgtttaaatttttgtattcctttcttaatcacctttcaagg

SEQ ID NO: 3013 - DNA, 212 bp, Bacillus thuringiensis
gctgtaactctaacggggggctgctactttgtagtaacacatcaacatcaccaacacagggggatctgttgaaatgcgctctttaattaaactcctcgcattgatttgagatttacagctcaatcagcaacatagagttagctaacatgaatacgggcgattccatttctattagcacaaacgaacgttgacatttttgctactgataaaaa

SEQ ID NO: 3014 - DNA, 227 bp, Bacillus thuringiensis
ggtagtgatctcttctaaccaacaaggaagacttacgggttttattttataagttgctgggtctttacttctaactggaagcctgcacgcatcaattaaaaaagacttccacgcttgaatctaactttaatcgatcagtctggtgtctagcttacaaattgatccattattctttggcataccatataaggcatagtactatatgctctctatacctttcctttaaa

SEQ ID NO: 3015 - DNA, 157 bp, Bacillus thuringiensis
cgtgattttcttaatctcaaaaattagatgatttgcctactcgccagctcaatatcgcactttgggggggcgtttttaaactatcctatcttgaacccaagctctctatagcgatattaacaaaccaatcattatttagcaactaattattagcggc

SEQ ID NO: 3016 - DNA, 172 bp, Bacillus thuringiensis
ataactacttggcttgttttacggaaatgtatcttttaaagcgtgagatatgtatttgatacggggctactagatgatgcacgacattaacatattaacggaaaaaatgttttgaattatcctcaaaaactaatcccttaatttaaaccgaatttagaaggcaatttcttta

SEQ ID NO: 3017 - DNA, 221 bp, Bacillus thuringiensis
ccacggttatgttccacacgttagaacctgctgaggaatattgcctcagagggccggctgagtaatatctgaatgctacctttcagagcgatgggatcatgagcaccgatcctatgacagtggtgacctcgcctggttacaaaatacatgaaggtgcccgagtcttcgtgaacgtgcctgaacacctggcatggttttatgtacgactaagcagcttggtt

SEQ ID NO: 3018 - DNA, 266 bp, Bacillus thuringiensis
acagccgggcggcgaagcaggccgacgaagaagaagagcggttatttcaccgcccgcaaaacagaacaccaggggggaaagcaagaagccggaaggaacggacaacgcgcgggaaaaagaccaaaaagcaaacgggcgcacacacgcagccaggccaaggcgcaaacaatgagtgctcaaagcaagagggaaggcgacctcaaacgccgcaaacaacgcaaaaagcacacccacagaagaggccggacccaaggaagaaacccaaa

SEQ ID NO: 3019 - DNA, 225 bp, Bacillus thuringiensis
acgactcttgacgcggaccccccaggcgtgatgaggactagtacgcgcaccacaacgtcccacatgttacattcggatacatgagacaagcgcaacggagcctaggatagctacaggccacacctgtgggggccacagctcgcagccgctaacatcaatagtgtcaccaaaagggaccggcaattcactgagccgaagacggacaacaggggcgactgggaaaac

SEQ ID NO: 3020 - DNA, 479 bp, Bacillus thuringiensis
aacgcgtacgataggtccagattcggatgatagtgttggaacggatttataactatagtttttatcacacgcacgtttggaagcgcaagacgcttaaattttgacgcgacgtgtacaaaacgtcttaacgtatgaagatcctgacttctttaatgcagttgcacaagatgggtgatataaggatggttcatgtgttccttattctacacaggaacgagtatttgatgattgaatttctgaccatccattacttgtgggttttggcatgcacgatttctgaaccttatggtttagcatttatagtgactcaacataagcgtacggatggctagaatgattcagctatattagatggcactgaaatgcatgctccagagaataacagatgggtctactcaggttaactggattgagtgctaccagacacgacatgcttgaattagggtcagtatgcgatgagcgttgtgtgctcacattct

SEQ ID NO: 3021 - DNA, 364 bp, Bacillus thuringiensis
gatagccacacagctttttaaaaggcggttttttgacccaatgacccaactgaaccccacggagacctgtgtaggagctactctgtactagctgctgtcgaacttagaacccttgctaccctcaggacaccccctacaagctcatatcttaccgtgaaaataccttctgccattaacacataatccataacacacggtgatacttccatcaagatcagacctcttcagatcagacccagtgtgactgttaacaactatctagagttaatcatacttcccacttatttgaacacctaccggtgaaacctacgagccgaagccagctatctgcacccccgcgagaccacacgatacgactcgcttc

SEQ ID NO: 3022 - DNA, 367 bp, Bacillus thuringiensis
gcctgggatgcccggtgcgccagagtagtctttgtaacggggaataagctgcgctgacgaggatgctacctaggagaaggcgagaccaacctgggtgccggtacttatgcgtggtagaaccgtgatgcattcaatgcgtgctagtgctgatgcatggatactaaccactgaggacccacgaatatcgggtttactgggtttaaaagaaactgcagaaccaggtgaagatgttgctgaggctacaggtagtgtttctgcctccagaagcatgcgaaatctgtttgccactgttcttataacagggtacgcaaccttataatgggtcaggcacaatgacgcatgaagaaccgtcaggttgaagctaggg

SEQ ID NO: 3023 - DNA, 105 bp, Bacillus thuringiensis
gaaggctttggttttaatgttcaagatatgatcttcgggttgattgttgtattaagggttagcttattccccataaaattcatgggcgatggactgcaacaagca

SEQ ID NO: 3024 - DNA, 742 bp, Bacillus thuringiensis
tattaatataaaattttttttttttttataaaaaaaaaatatatattataaaatatataaataatattttatattataaaaaaattaaaaatattatatattttttatatattattatatactaatattaataaaaatataataattaaatatatatatataataaatattaaattaataataaatattatttaattaataatttaacattatcaaattataaaaatataataatattaaaataataaattaaatttaaattaaattatataataatacattaaaatatttattaataaaaatttaatatatataatatataattataataatatataattaatgtatataaatttataaataattaataattataaaataataaatataataaaaaataatatatttaatattaatatatataataaaatatataattaatatattataataaaataaataattataatctatataatatacaaatgtatatattaattatataaatttaaaatatttaatataatattatatatatatatttatataattaataaatataatataataaatatttaaaataaatattaaaaatattataatatatatattaataaaaaaataatttttctcaattatttattattataaaatattaaaattattaatatattttaaataaaatataaataaatttatatatattatatataatataaataataatattaattattaaatt

SEQ ID NO: 3025 - DNA, 197 bp, Bacillus thuringiensis
atgcctccgaagccggactctttacgggctacttccgcatatatagcgtggtgctaccggcgcgttctacttgcagctgaaatgactctagaagaatctaaacgggttaatcgtgtaccaaggattgcacttccctcattccaccgggcacgactaacgcccgctgatttcttgtaaacgcacggtcgctaccagga

SEQ ID NO: 3026 - DNA, 222 bp, Bacillus thuringiensis
ggttggagatcagtgatgatacttggtgatccccactgatattgatgggaaccaatcgggcatttacggacgggatatatcccaccgcgcttcggtgcaacacatatagaatgagggaagggttgacaaaagaataatgcgggacagactattacgagcggtaaagaagcccccataataaaaaagacagatgcattttgcacatttatcttacaggagctg

SEQ ID NO: 3027 - DNA, 118 bp, Bacillus thuringiensis
gacgttttacgtataggccccagggtgcgggatagatatggaaactttaataaatacatctcttttttgaggatctaccattgcctctctcataggagcaatgatacaccagatcggg

SEQ ID NO: 3028 - DNA, 217 bp, Bacillus thuringiensis
atctatgggctctcgattttatgattaccatgaaccatgaaggttgcggcgacattttctcctttatgtatggcacgaccatgcctataccttgtcagttgctatccatattatgcgtggcatagaaagtgagcctacattctaactggtactgacaatcttttctatacagcaccaccgccacggaagggaccttactttctacaatagttgcgat

SEQ ID NO: 3029 - DNA, 250 bp, Bacillus thuringiensis
tcgtgattttggataaaatccttattcaacccctacctctaagcgaccatatcccccaggtccgggggacttacaggctgggggttaaacacaaaacagcgaaaaaccgtctgtaccttcttgaaataagacacttgtacactgtctttgctaattgtaaagtgaaaatatacaacgaaaatggacggtaattcattgatccttatcgagcgaccattgtatttgtatcatctataatgggaccccctaa

SEQ ID NO: 3030 - DNA, 353 bp, Bacillus thuringiensis
gacgcgtttcgcgtaggatcccgcaggtcgcgtggttcgaactacttcttgctaggcatcggattttatattacggagccgaagagaggcaggtatttgatccacatatcggcctctcacatttggggaactacatgagtttagagagatgtccatcactaagggtgattctctttcatatgtgcacggggaagggaaagttgaactggcattccttacccctatcccatttgctgcaagtgaatgcatggtcaacatgaacgagaaacggacagatctgcctaatcatcgtcataggatactgcttgatccttctagaaatagggctcatggaagaaaaaaaaagtgtgatt

SEQ ID NO: 3031 - DNA, 266 bp, Bacillus thuringiensis
gaactacgagcgtatacccacctactcctttttctacaacacctactcccgaaacggtaaatgcggtttgaccgactccatcgtgacatgtcaatccattcacttctactggagtgtccgcttacagtgatatctatatcggtgttgaaactgaaattggtaacaggtattccattgacataagctgttctacggaggttggaatcaaatgtacgacacacgatattgatgtacatgtccctggatgggggggaaccatgcacctc

SEQ ID NO: 3032 - DNA, 229 bp, Bacillus thuringiensis
atgagttaaatacattttttcgagcgggagaccagtattatgtcttgtgccacaacagatgacattccggactcagctagcgtggatcggaagtgaggatggaagagggtatatatcgccacatgtcaataggatttgacgatgagcgtgactggttctaccagatgttgtaggatctaagaagttgtcatataagaagagcctgtcttacatagggaactgcgaaaaa

SEQ ID NO: 3033 - DNA, 267 bp, Bacillus thuringiensis
cttgaattttactttttgtatacagtgagataatagagcgacatgtacgtaatccatgctgcggtgagcagtgcttgttgatgtgtccatccgccggtagatgcacggttggtcagtattggaaggccatcatcaatcctgtgttgaggaggaagaggtactgctactgagagggcagtctcctacgcgatgcaagaaacatggtcgttaacaaggagcggtactagcggtggaattattagagctgaccttattaatataaatacg

SEQ ID NO: 3034 - DNA, 124 bp, Bacillus thuringiensis
aacaaacaaccgaaacgccaaacagaaaacccagacgaatacacgacatcaacgagaaaaaaatgtagctcagaaaacatcccaacaaaccagaaaaaaaaaaggaaagcaaccagacaccccc

SEQ ID NO: 3035 - DNA, 236 bp, Bacillus thuringiensis
  unsure (1)...(236): unsure at all n locations
cacacagatgaaaccncaangacaagnacggaaggagggagcaaagagaggngagaaaccggcaccacaatnacaacgcattgtngaagaagaagcacaagcaaaagcagcacaagaagccaccgcaaaaaaacaagcagagcaagcagccaaagcagaccaagcacaaccagaacaagcaccaaaccgagcaagccgaaccaacaaaaaaaaggaagacaaaggcaaaaagaaaa

SEQ ID NO: 3036 - DNA, 284 bp, Bacillus thuringiensis
  unsure (1)...(284): unsure at all n locations
gaaaaanagaacaaaaaaaagaatggganttataaggngngaaaccgcgnaccaaagncggacaaacngggcaacgnannaaggcnggcacgcnnncnacacacacgnnnncaccngaaagaanagaagaacggaaccggaaaaccaaaaaaacggaaggccccaaccaaaaaaacgaaagccccncagagcaagcaaaagaaaaagaacgcgccacngacgagacgcaacaagaagaacgcaaaaagcccgcgaaagcacaagaaaagccggaagaaaaaaag

SEQ ID NO: 3037 - DNA, 114 bp, Bacillus thuringiensis
  unsure (1)...(114): unsure at all n locations
ccacacgtttgggcaagagcccgcgcaggctcgagaagcccggcgacganaccagaacacnnnaatgaaaanccncaagaaaannnggcacgccgaggnttagaaaaacacccc

SEQ ID NO: 3038 - DNA, 173 bp, Bacillus thuringiensis
tgcggcccgcgggaccaagaaaagacctgactaggatgtcaggtccctaccccaaaaacatcacacctactgcagcataagctgccgatacagcttgtacagctttagagattttaccgaataaaaccgccaacggaccgaagcgccgcttgacgcatcactttgaagacaga

SEQ ID NO: 3039 - DNA, 314 bp, Bacillus thuringiensis
  unsure (1)...(314): unsure at all n locations
gggcttttaattcagatgcgngaattaatgaaccanaagaaaaaagncggggacgcagnattagagangaaagaccgnagaaacgcnggaagggggacagnnggcgnnaacccgggcagnagcgagcncggnnaaacggaagaggaagnggagaacacggacccggcagaacnncgcgaaaaaacagaagcagcccgcaaccggcccggagaaaacggggcgcaccacacgagagaaacgacgcaggaacccgaaagcgnaaaggaacaaaacgagaaacaagaacacaccaccccacaaaaggggaacaggaa

SEQ ID NO: 3040 - DNA, 253 bp, Bacillus thuringiensis
acggatcacatgctatcactgcggagcttgtttgacgcataccgagagaagtacgtgcggggtgtttactaaatctggctcagtacgcgtaccgtatacgtgacaatcctatggtcaacgtgaaaggcaaaaattccctatagcatcgtttttatatgcgtcacaaccactgtgttgacaaaatgccgtgtggatttaaggacgagtgtttgaagcatatacatccactggcctggttgttaacatctcggaa

SEQ ID NO: 3041 - DNA, 183 bp, Bacillus thuringiensis
acaaaaagaacaggttaaaagagattacttcagaaaggccaaaaccaccagcacagctagcaaacataactaccataaaaaaccaaaaacggctacaaatcacagcgtacaaaccaaggacacctaacggagctctacaagcaaataacacgcaatctacaaaggaaactcacacgaggaaac

SEQ ID NO: 3042 - DNA, 178 bp, Bacillus thuringiensis
cacgtgtggagatagctagcctacgtcgtctagaagctcgtcaccgaatgcatacagaatatgcgatttatgtttgtaactgaccgtggtttatatgttctctgctagtccgaaggctcacgtgccaccgctagcctcggcacgaatctctggacaagtaacaggtgcgcgtgaacct

SEQ ID NO: 3043 - DNA, 360 bp, Bacillus thuringiensis
tccttctatgcattctttcatgataacagcagaatgagacttactcacgcgcacaatacaacatttcactccacgtaaggggttgcattacatataccatgagtccaacgggatactaataggagaaatagtgttatctagtccaactgttgtaaaatggagagatgctctaatgaagtgacatgtctggacaatatacgctctaattcgaaagacgctggagctcgtcctgtctatgatgagtgcagctaaactcgtacgcaagccgcggtgcacttggtctagcactactctaggcgatgccgcattgactgtcgcacatggaattgttcgatgctgccctgttgttgatatgtggaa

SEQ ID NO: 3044 - DNA, 169 bp, Bacillus thuringiensis
ctttgcgcacataggttgtaagtctgaacgcatcagctacgattagggcctggatatatacgttagctgctatcccgtctactcagaatacagatcgaagtggagtttccggaccaacggtgttcggagcatctacaaaacgcaccacgcgtcgagttatgcacgatga

SEQ ID NO: 3045 - DNA, 328 bp, Bacillus thuringiensis
cgtcacatgggcccttctactatactacgctcagacggatgttcttcaaattcacctctcgccgttgaggcacttgcaaatcacagttctgcggatatgattaaacggcctgctcttttcaacgatgatacacctgctgtgccgtatggtcgggtacccgatgaacataaaaatggttctgcgcttggacagcataacatgaaacatcgtgttgcaagaggcatcacagcaggacttgcctctgatacaccttcgcctccctgtcttgatcatggaccggtattaacccatgtataagctcatgaccgccgtacattatgggataaac

SEQ ID NO: 3046 - DNA, 283 bp, Bacillus thuringiensis
gtgcgcgttcactatacagaaggtactgaacacgctattttagcatgagaggttgatctgttaccaacggggattataaatatatgagctgcagcgctctgcattcatatctaaatgcataacaatcaccattcagctacattgtaggatgtttttcttacaagggggcgctcacacagaaggatgtaccattaagcagcgtgtggctagacaaaaggactgttaatcttggctcaggcgcttaattccttggggactacatacatataccactgtttatata

SEQ ID NO: 3047 - DNA, 205 bp, Bacillus thuringiensis
ttttttttttttaggagtctagcccaccctgcgttctatagctagcctacgctagctaaacaagcttgccaacgaatacagatttaagctactatttctccataaattatcattgagtgtatgggactcgcaaaaggtacccctacggggttaggtcgatcaacatatacacttaacatactcgaccctaattgggtccctcacc

SEQ ID NO: 3048 - DNA, 111 bp, Bacillus thuringiensis
gttgggaggcagctttttcgagataggccggctattcgtgggggaggaatgatccagcgagcgatcgcgattcacgtcagctgcatgagtacgctttcggccgactttact

SEQ ID NO: 3049 - DNA, 140 bp, Bacillus thuringiensis
tgagtgattcgggattctttactcatcgcttgtggggcatgcatagaacctagcttgacctatattgtggggaatataagctccacagtatcaatgacacagcggcttgctgtgtgaatactaccttggctgacattagg

SEQ ID NO: 3050 - DNA, 207 bp, Bacillus thuringiensis
atatattttcaaatcacatataatcttagtggtaagaatctctaaagttgagggtgtgtataatagactcaaaagcagaatattaatttaaacaactaatggaggatctaaaattgactttttgagaaagtgaacttccgggtattggttataagttacacattctttacaaagggaaatgaaatgatggtaaaagtcattcatgaa

SEQ ID NO: 3051 - DNA, 174 bp, Bacillus thuringiensis
  unsure (1)...(174): unsure at all n locations
ctttgctcncccatcctcatgtctttcacaagctcttatcttccgaacgcatgtcgtaactgcgaaccaggacctattggcattccatggcgcgcgatcattctcgtcagcaatagatattaaggctaatcaattctatgacgctcgtgtgtcatggggaattccaatattacg

SEQ ID NO: 3052 - DNA, 143 bp, Bacillus thuringiensis
ttgatctccataattcaatataatatctaaaagccatggttggaaccccggttacaagacgtgcactaaaacccatcattgctacattatttgatgctctatgtggaaactatccacactggtacaactgggctatggctact

SEQ ID NO: 3053 - DNA, 101 bp, Bacillus thuringiensis
caatgcatgacgatggcaagactattttaaaggatttttttaactcgtatactgcttggagctatcattcgcttagtggttagagagagacatgtacaata

SEQ ID NO: 3054 - DNA, 549 bp, Bacillus thuringiensis
atgaaactatgtaaatttcacgatatttccttacataatgaaatttggaaagaggaacgtgtaacgaaagtagccagttctattcaacgtgaattgctattggataaccgtaaatataaaatgagtatattaaaaatggcttatacattcgctgtacaaacagttgatggctactttgaagatcaagatgcgattgatatctctaccattctctcaaatgcagatttcgtggaactaaaagaaaaaagcattgtacgtgatttaagcaaaagttctttatggaatacgcttaatacaagtcgtgaaaatcattactttattgtacttaacgataaagacggcctgttttgcttcattcgtttgtttgacatttttgaagttgtcgttcatttatcataaaaaagatttgaccttccatcacccattgtcggtgttaattatgggaattcaccaaaaatctatgtcccaagtttaaacggatatgggtgggttggtaaagaaaagcccctctttttaactgagaccaaacataccgtttctttttatgaa

SEQ ID NO: 3055 - DNA, 525 bp, Bacillus thuringiensis
tccctcgcggcgatctttttccctgctttacaaaaatgtataaatgctcgggtcatcgttcctaagactccgattcaggcccaataggcttgatacaacatatactgtgatataacaaatgataattgaatatgttcggatatagctttagggtaatgctcatccagctcgatgaaagcggtaccataatacatccactaatcatactgtaagtgaatccagttcgtaataatacttatatgtacctgccgcataacgcatcctaactgtatgatattatcgcgatatctatctattacacccacttctgtattattgaactgctcgaccataaactctagataggacaatatattcaattggagagttacgctgtacacacatatatataagcgtgtggatataagcaggttaaaactttactattcctcatatgcattattacatgcgatacgtcctaatttttttgatacactatgcatgcggatttgtcatccgaaaggcacacaacgcatatgtatgtat

SEQ ID NO: 3056 - DNA, 199 bp, Bacillus thuringiensis
ctacatcaagaggtgcatatcttgcccaggcttaggatgctgtccgaccactcaagatgacgcaccctcgaccggaccataacaccattgtggcggccctatcaccgagctgtcgctttagagagtcgaatcaaagcgggcactcagaatactcatcgctgacccaagtgagaatgtgtgatacactcccgactttacc

SEQ ID NO: 3057 - DNA, 125 bp, Bacillus thuringiensis
gcacaaccgacgtatttactacatctcctggatgaagcagggctggtaccgctctaatcctattcagagaactctcaaaaatcggatttcacatgtttaaatctccaatctaaatgacaatggta

SEQ ID NO: 3058 - DNA, 328 bp, Bacillus thuringiensis
tcacaacttctgtttttcattccatctcgtggatgcatcagggctggtaccgcactacccctattcggagatcttttaaaactcggctttctcatggtcttatctgcgatctgaccgaagatgatatccgcgcacattccctcatcgtatacgggccggttgcctaaagcggaacgcctgaggtgccgatcgggtgacccaactcccattgaatgctgagcactcgctgtcttctctccgcccagtgctccaactcggaccggctgcataagtgaatcgtccttcgcgaggggagaggcagtttggggattgagcgctattacctttc

SEQ ID NO: 3059 - DNA, 132 bp, Bacillus thuringiensis
aatctccccaaggcaccatttttttcaccatatcagagctactcttggccggggccacatcattaggaatcgctttttttaacaatcaacttaaaagcccaagactaattcagcgggaatttaaaattccat

SEQ ID NO: 3060 - DNA, 104 bp, Bacillus thuringiensis
ctgtaactcgaaatatatatttgattattgaaatatatctatccgaacgcggaatatatgagcgattattaaaagatacttgacttacccgccaaaaactgaca

SEQ ID NO: 3061 - DNA, 227 bp, Bacillus thuringiensis
agcatgtatctgtgttcttgttaagatggtttaaccagtctttgaaatattttattgtaacttatttattgtgaatctacatagtttgaaacttttattagttattggagtatttttttttttttgttatattatatttatttgatatatgttgttttttttcatatattgatctattataatgtttattataatttcctttgttatttctctttttttttttttta

SEQ ID NO: 3062 - DNA, 260 bp, Bacillus thuringiensis
cgctctgcagtgcgcggtctgtggactatcgcggatcacctgagttgcgctatctgtcctttctccagatcataaaccctgcatacgaactgcgtgacggaccgggacttggcccgatgtgaggcgaggttgatattgctgactgtctcactgtctaagtctacgtctagtttgcctagtgcgtgaaagtgcagggagcagattcaattgactgaaaggctggcgcacgggtacccacacatattgatgagtacgctgga

SEQ ID NO: 3063 - DNA, 398 bp, Bacillus thuringiensis
ccgagcgcatattcaactccttgaacagatggcaacaaactgcgttgaaccgatacgcaccaacgggcatgactcacctaccgactcacttgatactgatagacgaaaattctaaaaccactgagcctacttcggagctgttgttacaaaccgctcctaaatgcccatcttcaaaattgaacacatctattcgagtcccaatcttataaagcgtccaagtacattaagcggcacagaccggtatttctttttcgggtgcaacttcaccaattattttagaatgcatgcgggtcctacctagtggctgatgttattcactcatagatcttgtttcgacaagttatgacattcatactcgagtaattcacgagattctgagtaacgaccatccattgatt

SEQ ID NO: 3064 - DNA, 231 bp, Bacillus thuringiensis
tcttccttctgaaaatcgataggtgtttatgacggggtcttcccgtttcgagttatacatgttacatagggttattcgtcgagtgatccctatagcatttacatatatactgcacacagctgagcagaccggttagtttcacccagataaagagagaccatagtttgcacgatttttaacggaattacgatttgaagaactcccgctataacatacttactaacatacctt

SEQ ID NO: 3065 - DNA, 105 bp, Bacillus thuringiensis
gctttcggcgcgatatttattttgtgcaactgttgtccgcggacccgttcacatcttctcgggaagggctcgaacacggggttttaatgcctactcaataaggct

SEQ ID NO: 3066 - DNA, 154 bp, Bacillus thuringiensis
cattggcattctttgccgcgggctagaggcgtacgccctttgaaatgcgaccgcgacgaccgcacagatcatgcgagaaggacctaagagaccagcgtaagcctagtgttgccagccactctctacgagcggcttctgcagcttgcactactgc

SEQ ID NO: 3067 - DNA, 113 bp, Bacillus thuringiensis
  unsure (1)...(113): unsure at all n locations
tcagtgcaacagtttctttctgcgacaaattgtgctggccaatgacaagtttgtatacgtcatgnnncatgcacattgttatagtccaccaacaattatttggtgccccacat

SEQ ID NO: 3068 - DNA, 440 bp, Bacillus thuringiensis
tatcgggcgctttttttgctactagatcactgacactgtgtgcttggaatgctggctagagtgagtggcattagcgcactaacgggcgattatccggtgatacacagatataggggataacaaaggatcgaacaggggagccatgggatagcatgaggtccacaaccggagcaaggccgcattccaggacgagctacatatgcagcttctggaaggcgagcgtcacaacagtaggcgctcgattcagatggcatcgaaacaccccaggactatgatgaaaccatgagtagccccccggagcgctctctagatgcgctgtgctgtaaataccctctcgcttacatgagacaaggtcgcctgttcaaccttatggaatcttgggactggattataggaagcccttatggcttctgagctctgggtaagacatgctgtcaatg

SEQ ID NO: 3069 - DNA, 180 bp, Bacillus thuringiensis
  unsure (1)...(180): unsure at all n locations
tgacgtagcattncacaaagaatcggaacgcttcaagtcaggagggtgnngcgaaanncccgacaagggacctatataaagataccccagggccgttttcgcctccttggaaaggcttcccttcgttgccgccttcttccctggtttcccgaccccttgtcccgctttacccgggaataa

SEQ ID NO: 3070 - DNA, 120 bp, Bacillus thuringiensis
cacccccgctcgactgaattcagcataacatgctgagcaattatgccagtctttaaggccaggcaacccgataaaaagggccgtcgtgtgctggcggtttattccaataggactccagcc

SEQ ID NO: 3071 - DNA, 250 bp, Bacillus thuringiensis
gttgaaaaacaggtacactccgtgtcctccaggctcattttttaacacctaggccgaactctgaaacctcctttataaaccttaatagttgtcggtgataaggttgagcggtggtgaaaaccgtagcatgagtccgctgtatcagcagggcgactctaacgtaagagggctacactccgtgtattacggggaagggcgcctacaccagctatgatctttaaatcctcctttggagtcctggagtgatatg

SEQ ID NO: 3072 - DNA, 144 bp, Bacillus thuringiensis
cataccgcatgcagaccaattctacgtcagtaacatttggtttcttttcaacaaacggcctcattattattaaatggagatctacccaaatgacctgaaatgctaacgatggatcacgaagccatgcatgtttctagggcacat

SEQ ID NO: 3073 - DNA, 224 bp, Bacillus thuringiensis
tgcttaaaaaggaaacctgccataggttgggctcaaccaattttttattttgataggtcagctaactcactgcaaggatggcctgaatttgtacgtgaacactctctatctgctttaatacggaaagggtactgtgagacaggatcttcctactcttattggcggttgacccatcgtggaatagcaaaagggcaggctgttcctgagcgctttacatatgatga

SEQ ID NO: 3074 - DNA, 109 bp, Bacillus thuringiensis
gtaagacgacgaaaagaatcttgttttttatatctctgcttcgaggcaatccagttcatggtaatatagggcggataacactccacggcaatcttttcaatatgctgca

SEQ ID NO: 3075 - DNA, 274 bp, Bacillus thuringiensis
ctgatttataacgggcgttattttatacgcaactacaagtggatcaaccactgaaaaacacgtccatatcatgcttcctgtttcacgattaacagcatttgccgtcgttaaccacgtgccatatgatgatataacgaacataaatgcataacctgataaggctgtataatgtactgacattacattaacaagcacattttctttaactgcgtaactgattgccattgtagaaacaacaccttacttggcttaaaatgctgtttaaagggatgct

SEQ ID NO: 3076 - DNA, 150 bp, Bacillus thuringiensis
tgcctaagcttgccccccccccccacatctttgaccgtttcggtcggatatttttaaacttttgagcgcatatcctgttgctcaagaggcataggagctcacggaaacctttaacctgagtgcatagttaaagctttactatttgacggg

SEQ ID NO: 3077 - DNA, 167 bp, Bacillus thuringiensis
cacgctggatcataagctagccaaggatggatatgatattttacaatgacaactataggtgtgtttgagtgctatgcatttacgaatagaccgaatcagggatatccaccaagtatgggattagaagcagaaggtacatgggatgaagaggtgagcattagggctga

SEQ ID NO: 3078 - DNA, 128 bp, Bacillus thuringiensis
atcgcttcatcctttttgaaacttttttcttaaccttcatataaaccttggggtcgcctaattgcatctacatattcacattcatcaatcatttttaaacctttcatcccgaaatacatatactctaa

SEQ ID NO: 3079 - DNA, 217 bp, Bacillus thuringiensis
cacccccgccccacgaattcagatttgaaaaggatttaaattttaattatagatttgagtcctttttgtatattataatccctatgtttgcatataattataatatattgaaaatgatttaaaagcaagaatattagtaggggtaccgctacattgccatcaacttaagaaattaaatgttcctcaaaacgaaaatagtagccgtcggctacctatt

SEQ ID NO: 3080 - DNA, 394 bp, Bacillus thuringiensis
cataataaaggcctaacttactataaaagggtgagttgtcatgctcgcctctggatatatctccctcttccctacggtgactgctggggctcttaacctctggaggaagggtgaaacgactctttataccttgataatctttatgcatgaataaacgatctacgtaccgatcatcgccataatccccaaactccacaatgacaccattatgaaccgatccataactaataatgttatctaaagactgcaaccaaatttcactatctaattgatccggtgaccacgcctgttgcatgaagctcatcatgaatcaccagcattaaccgtacaaactgttacctacatcaattgtgatactagaactaaaacatctttttggaatgatctaattgta

SEQ ID NO: 3081 - DNA, 121 bp, Bacillus thuringiensis
gatacctaaagcgcccgcccctttatgctttttttttttcaaaggctgctcctttggccgggtgcgcacggaactacccaaggcgcctgcttcacatggagccaggagtttctaacggatg

SEQ ID NO: 3082 - DNA, 116 bp, Bacillus thuringiensis
cccccccccccccgaagggagatcatgacgtcaaagttttcactcttaacgacagctcgcaagcacagaacaggggatgaggggcggaaaccgagcaaagagaggcaagcaaaaaa

SEQ ID NO: 3083 - DNA, 159 bp, Bacillus thuringiensis
tgatatattgctgaaagcatttcccactcgtataattaactgcacacgcggagcctgagaggcgccactgactgaaagcgacatggcgaagccctgtgacatcacatacccaaggcgtgggggcgaatctccgagaatgcgtggataactctcgtaaac

SEQ ID NO: 3084 - DNA, 363 bp, Bacillus thuringiensis
ttttatgtattgcatttttttcatcactcactacaattctatgcaggtggtgttccagtttaataattttaccttggataacatctggttctttatattttcgatactcagtgaatactaattctgtatcatcacgcactgccaattgaattatttcaccaagcttttgttgttcgaattcattcatgtatggtctaggttcttttttaatagcctttttttttggtggttctggaattgctggtgacatatgatctttaccttcattatttatgttttaacccatttgataggctttttttaactttatcttccagtgaggtttttagctttctttgagccttctaaacttggttttttttt

SEQ ID NO: 3085 - DNA, 508 bp, Bacillus thuringiensis
cccccccccgggggttaaaactaccctcggcctgaaaagcttggcccccaattcaaaaaaaacgggctaaccctattaaaaaaaaaatatcggaattaggccccccggccccaaaatccaaatggtccccaaggggccaaaaacttgggccccgggggtcattggttctccccgagccgaaaacttaacctaattttatccattccaccaaatttcccccgtttagggcctctttggggtcctccccccccaaggggaccggggggtttacctttcccccgggggcggattcgcccccttttattacaagccttttttttcccccttttggaaaatttttccgcgctttaaaatttttttcggggtgggttttggctgaaaccacaccccctccccggttttttaacccccattggccttggggggaaaccaaaggggccttttttttccccgaacttgaaaaaattttggttgggggcaacccttttaccgtttttttaatccccag

SEQ ID NO: 3086 - DNA, 151 bp, Bacillus thuringiensis
caacaattatatcgaaaccgactaactaactagctactgtaatcacaactttaaatccaggggtaatgtattcccctaaaactgcatagaaagactatatctcttactcttgaactacataacatatactttttccttagtaacttcatac

SEQ ID NO: 3087 - DNA, 302 bp, Bacillus thuringiensis
aatctataccctgtgtgtgatttcatcaaacaatgattctaaaactggggttttattacttgcgcacttggagttgctttcgattgccaagaaaaaatggtgcaagttacgattagccgcaccatctacatttgcataacacgtatctaaaacaattaacacgtatgcctatacagttttatctctatcaagacttgtatcatcaaaactaagtcagcactggctgtaattacaacagatttcaagtaagctttattttttctcgccatgattttaaatatatccattagtttcacaccctt

SEQ ID NO: 3088 - DNA, 195 bp, Bacillus thuringiensis
caccctattactaaatttttttgcgagcgagatatagtaacacgtgctgagtatcttgaacggctaggttttgcagcattcatagtgcaattcttacttagtcctattccctatgtatctgccggagatgcggtgggatctactaaagagacatacgcttttatcgtgaatggataattggctgcacatgatggg

SEQ ID NO: 3089 - DNA, 149 bp, Bacillus thuringiensis
gtatactgtcgtgcaatctttcatcgcaaaaatgcagaaggcacactgcgcgtttacggttggagtgaacatgtggccgatcgttaacacgcttgttaattggcgggcatccggcaaatgattagtgcagtggttcctggggagaaagc

SEQ ID NO: 3090 - DNA, 390 bp, Bacillus thuringiensis
ggatttttataaaggagtatctaatcgtaccctcggtgcgtataaaccatctcgtgttgcccttgggcctattatttgaaatgaattcccttgtccttgatttgagagcaagcaaactatttattcactcgctttatgcgcagccatatctatagcgaaaaatagaacgtctaaataatctgttgcaaccttattattgatgcgagatatgacttgtcagcagtgtatactgcacgtgtaaaaccaatgatgcaccccaacggaggacataaccaaaggcggactctgtcggattacgtacatcctgagcccttacaccaaataggctttgagcaacaagtttttttactgccgcgaacagcctgttttttaaatgactgaacacccgat

SEQ ID NO: 3091 - DNA, 112 bp, Bacillus thuringiensis
agatgcgatgttaatatgttttttggcattatactgtgacaaagaatgggattgagcccactagggatctagtctaatgtgaatcggattttcatttaccgcagatttctgt

SEQ ID NO: 3092 - DNA, 243 bp, Bacillus thuringiensis
ctagtccgtctgatgctgactcaccgctcaaatcccgagaggacttttatacatatcgctgcatcgcgctcattcacttttacaataaatgctccccctatcgctctatagaacgcatgcagcatatataaatcatcgcgtgcaatgattagcgatacccacacttaatcgcgcctctgtctaccgacctttgattcgcgtccatcatcgagcgtagcctgtacataaccatgacccatggta

SEQ ID NO: 3093 - DNA, 129 bp, Bacillus thuringiensis
gatttaaacgaagtgggatagctttaatgggttttcaaacttgcggagtatcctcacctgttaccctattaccatatctagccccttgaatgaaacgtgcttttacatgatgaatcgccactgtcagcc

SEQ ID NO: 3094 - DNA, 147 bp, Bacillus thuringiensis
agggaatacacatgcaagtactacagtcgatatccgcttttttttgatggaacaacagtcgcatattgtctcggtacaccaatcacaccaatcgaggcacaagtcgtaacataagttatggagacaatcctagcctcatctggattt

SEQ ID NO: 3095 - DNA, 114 bp, Bacillus thuringiensis
cgacaaacgcggcgcgtcttatccactataacgaatatattggtaccggatagactttaccaattagcgggctgatgtactgccgaaacaaagaagtgagaaccaaaggtatgg

SEQ ID NO: 3096 - DNA, 243 bp, Bacillus thuringiensis
gagcacggactggcattagggatatatgaaaccaatctttttttgaaccctatgatcgcttatgattgctcagaaggtgcatgccattctcctactgctgttagtagcggcaagcattcctatgcgatccaatcatagcgtgacaagggctctgtatgatctttaatacagagaacgtatacgacgacaaccgattaagacccgtataagaacattgatcttgcattgtgtactccacttatg

SEQ ID NO: 3097 - DNA, 183 bp, Bacillus thuringiensis
gtgggtgcgactacaatacactgatcttcgcttatgccttttgaaaaatgcgacacgctattgagcgcggggcgcatcaacctcttcttacgagctaataacatttcataacgaagatcggttaggttaatatggtcccgataagtcgacaccaatcacttgattataggtaaactataacac

SEQ ID NO: 3098 - DNA, 163 bp, Bacillus thuringiensis
ccgggctggttgagatcctcttaacatattggcacattcacgcgcatcacgaccattgattcctaatgggcgatctgcctcaaccggtaactcattaccgaccactgacgatcgattgtgagctccaactaatgtgcttacgtggttacttgcaccctggctg

SEQ ID NO: 3099 - DNA, 117 bp, Bacillus thuringiensis
gattagtaacttatccccatgcatacacacaattttctgttaacttttccacagatgggaagtgcatgtatcttttttttttttttttttttgagacggagtctcgctgtcgcccag

SEQ ID NO: 3100 - DNA, 226 bp, Bacillus thuringiensis
ctaataggagacgaaacttttttgcttatacaagtgctttgataacgtgtgatatacgctcacagataggaaattctccctcatcgcatgtcggaatgagagaaagaaacaacttaaattaaacgatactcggatactatataacaagcacactaacgatgcacacctcagctttaattccgagatacgattttagaaacatttaaataccacccgtgttaaaaag

SEQ ID NO: 3101 - DNA, 109 bp, Bacillus thuringiensis
cgcattgcgcgcaactttttcttcctatcgagcaattcactgataaagcttcaagttacgagggtgagatcgagtcaggtccataatctttcatgccgtttgcgaatga

SEQ ID NO: 3102 - DNA, 109 bp, Bacillus thuringiensis
atcactcgcatcattcttaccgcaatgaattcctgatcgcgcccgagcgggagcaaatacccgaatcatgttactaagacgcggtcaaacaggaatccactgaaaccgg

SEQ ID NO: 3103 - DNA, 261 bp, Bacillus thuringiensis
agagcgtgcaaagcctttttcacaggccattggattgacgcacagacgatgctgtacgttatgaacgtttctagggcctgtgaggaccagaccaccatcgggtcgagatcagggctggtgtggacaaggcaacagcctatgtgcatcataccagctggggacacttagtggagccacaatatctgcccagacccacaagatgctccaggtgggggagcgccagttattgggtgccaatttaactgtgatgcttatgaggcc

SEQ ID NO: 3104 - DNA, 173 bp, Bacillus thuringiensis
aattatatacttatctcacggatattgcaggcactttgaaataggaatgagaaagggcctctgtctcatgacggagggaccttcctgctggttcccataataatcatatgtgagctcttgtctctccctaaaccagctcttctttttccatcccacaaaggctccacccctat

SEQ ID NO: 3105 - DNA, 184 bp, Bacillus thuringiensis
gactgctcacatcttaccctgcatggatggaacatccatatttgttaccattggctggagctggaggcatacttcctaagtatgatctgtaacctgatgcgcatcaacgcccatcaaatttcaacctttccagacgtcttatgatattggaaagcacgttgaactgcggcatacttttgggaac

SEQ ID NO: 3106 - DNA, 115 bp, Bacillus thuringiensis
ttgcactctacgaatgattttcaaccattctgaaggaacctttgggcgccttcgttacactttaagaggcgaccggcccagttcaaactgcccaccctgacactgggctccccgg

SEQ ID NO: 3107 - DNA, 137 bp, Bacillus thuringiensis
cgacgactacttctgatgagtaactcatgcttttttttgcacactagtttatgttatacttttcgccgaatggaagagcatgtatcctttttttgttttttgtttttcggaagaccggagttttgcttcccccagta

SEQ ID NO: 3108 - DNA, 184 bp, Bacillus thuringiensis
tatcagggcgtcatttttttccttgttcaatcaccatagctcctgagcgggacgaaatactccatcgctgcacaaaggacaatcactaacaggaacctattgctatcagcttaagaatcctggcacttcaatcatatttatatccgcatgaatgatgattttcttgtactaccctttaatgctt

SEQ ID NO: 3109 - DNA, 354 bp, Bacillus thuringiensis
agcaaactctatatgttaatgtcttttaaatgaaagaatctatctcaaagaaagaacatctacgtttgaaaacttgattcttcggtgcactcgtagaactttcctacaacgggatcttcatgaacaatctcttttatgaagtagcgttgcatgtgagaacaaccttgcttctctagtgaagcgtctgcaacaccattgtgatacttcaaccgcgattagctgtactgctgtcacgctggcttcttcattcaatgatagatctaccgtgactacttgaatcacataatagaactattggtgcacaagaggaaagcaagcatattcacttgctgtagaaagttgaactatggatgt

SEQ ID NO: 3110 - DNA, 194 bp, Bacillus thuringiensis
accactaccactatgctattcagtctaaagtggacaagcattacaaaaaggctgtgcttttcacgctttgagcccttaaatgtctgcgccatctttaacctttactgggataatgaggtcctcaacgagtcctgacactaagtatcgttgcctgtgatattaaacgttcttcggtcgtgacgcgactatgagac

SEQ ID NO: 3111 - DNA, 219 bp, Bacillus thuringiensis
ggcagtgacacttcgtgatacagcctaaggtggtcttgctgcatcaccaactggccagcccctgcgagaggacattctcgggaagagcactgcctctgtgtccatcatcgtaaaaggtgctcatagatgccggaaccactaattctgtatccctttcgttacgcgttctgatgatgcgtcgagaccatgctgatcctatcgtgagctgtgttatacact

SEQ ID NO: 3112 - DNA, 390 bp, Bacillus thuringiensis
ccgtgtttgatctaatgtatacacagggggacatgatgctggtacgacacatactattgtccgtaaatcctgctggagaccatatgcgggaccaattgtcgaacagactttcgagagttcagttgaaccattgttataatgaagtaatagacgctcctctaatgcttatgctcgctttatagcacaagcggggtgggctgaaaacccggtggctgttttaaatccggtattatggttggctttagaatcgattggccagccgggcccttcatcataatggggataacacagacggccgccaatatttttggggtttcatagaaagctatgtcgatatcacaattatttgagccgtggacttcttttggacttggaaattacccttgcgca

SEQ ID NO: 3113 - DNA, 304 bp, Bacillus thuringiensis
agagtgggctccgcctgtgctacactcaggggctatagatacatgatcaaggtaccagactaccgatcagaccgagctcgataaaaggattgacaatctatccgattgcatacagtctattgattgctgtcgagatgacaactactgagtacgatgccttacaggtacggaacatggctggtacctagcttcgcctatactggattaatttacaactgggacttagcatggttataggtgagaaactgtgtgataagctgatggtgtcagaagtccgcaccctatacgaccctgaaacatggaa

SEQ ID NO: 3114 - DNA, 161 bp, Bacillus thuringiensis
cccggcaccgaacattatagtggaggggtgcggattatgttgctggaccactgatgcgctgggtccgtacggaacggctggtcaatcgctggtcagtccggagcggacaagcgtgggtaatgccggaaacattcgccattgaagccgctaagatggccgtt

SEQ ID NO: 3115 - DNA, 354 bp, Bacillus thuringiensis
tatatgatacacccgaagttttttgggtaacctttttggagccagccccctaacgtggtacagataatggaggcgaactcccaacaaggctaccgtctcaaaaggtgcggctggaccacctgctctctatcgataatccttacgctcatcatgtctacgctctaacccgcttacctattggcccatacaaagagcgtgcattacacatatcatatatctcatgtgggaatcatctctgtatagcactctctaaactaagccaaatcgactcactggaactaatcttgctcctcatcgcttataagtcctccatacaagggcagttatccccacccaccttcctatacggttacc

SEQ ID NO: 3116 - DNA, 454 bp, Bacillus thuringiensis
ccttcattatctagttcactggtaaactgatgaataacttctcgcgcttcggaatgcttcacactgatcatatctatgccgtgctcacatgaatcaacgtccatcaaccgctcatgattaagcaccaccatatgctgcgaatcgccatatacaacgaaacaagattcgaataaactgattaggccctatgtacaatggatccacatgtaaatagactgacgatgcatgatacacagaacagccggcaatgttaccattcacggctattgttcatatctctactgcctcagacactttactataactagcttttgctagactaatcgttccttcaaaagctgataagactggatatttacctccttcgttcatataagcacccctctgtatggtaataaattgcagttattgatactctacgtaacacactcctagaacacgcttaaagagaaca

SEQ ID NO: 3117 - DNA, 267 bp, Bacillus thuringiensis
gcgtactatcggatacgacttcgtgaactcatacgaaatttctatatggcgcagtaaacaatttattatacgggctaagcccacaacaagcaagcgacgtcatcactattaataccgaaggggaaagtgacaacaccggcgatgaaaaatatatatcctaatttgaatggaaccataggtggatatcctttcaaaatagatctgctccgaaaggacataccgtggaaagcatgccaggttaagggatatgctcttgtgacaagggga

SEQ ID NO: 3118 - DNA, 280 bp, Bacillus thuringiensis
aacatgaacctttaaaccctgcttttattcttccttttcctacagaggagatggcagcaaataccttctaatgtgaagtccaattcctaatccttttagccactcccaattcaactataattgactgatgcaactaggcttggattctgttctgtgacacagataagagattatctatagcttctcctggacagaggaatgtcagccactccttttagaattaccccctttctctgtgcagagtgcctaaaaagcaccccatttttgctgtctcccatca

SEQ ID NO: 3119 - DNA, 186 bp, Bacillus thuringiensis
ttcgtgatctccaggtcttccaagactattctgcatcacgcgaattttttgttgtgcgacggagagtcctgcgcgggggggctcgacttctgtttgtgctagacctttgaacagtgaacgcgtattatcgtgtcgctcaagcacattcactaatgaataacggaaaggttgacgcgagtcgatttt

SEQ ID NO: 3120 - DNA, 135 bp, Bacillus thuringiensis
agaagcagccgcgatcgtcctcaccttggccatgagcttgtgcagccgcgtcggtgaaggactcctcatcagtgattctcggacggtcgtgggtgctcatcgcgttgatcatcgaggacatgatcgccatcgggt

SEQ ID NO: 3121 - DNA, 224 bp, Bacillus thuringiensis
acggggtgtgagaagaccggctggagaagcaggtggacgactaaatataaacgattgacggaaaatttgttaatctacatcatgcagaaaaagatcgcggggaaatatcaacaagatcatacgaccgagacatgcggggcaaacaaaccggctctatctaccgaccagaggtatggcgtaagcacaaggagagagaaagcatgggtcacacaaaagccacaggc

SEQ ID NO: 3122 - DNA, 250 bp, Bacillus thuringiensis
tattgtggattaagcgcaggtcctcctcattgggcactttaatcaagtaacagggtgcctttaaagagttactagaactatttctgatgtacaaagagatcacggtgaaaccgattgaatagtaaccacgaccatccaatgatctcttagaattaaaacttgtattgaaacatgatcgaaaaaaagctgtgactctactggcgaagaactcaaccttggcataatgatgtggaacggcaataaaaacagt

SEQ ID NO: 3123 - DNA, 193 bp, Bacillus thuringiensis
tcgtattacgtagcctcttttaatacactatgtgtttcattcacttgttgaatcagacgacatgataatactcgaaggggtgatgtgacagaccatatgtggaaatcaagaacttctaaggcatcatgaaatattataccttatactttttaaagaactttccaatatccagcacgaagcaccttcctttaat

SEQ ID NO: 3124 - DNA, 176 bp, Bacillus thuringiensis
cttgctcgcatcacatgatttttcctctgtgccctttactcaggtagcagaccggcttcgccaagttgctagatctatctgtgatgtacacgaggagagtggcggggatgcgtgatagagcgctctcccgctttgtacatgactgatctgggagtgatagctcgtattgatgcatt

SEQ ID NO: 3125 - DNA, 307 bp, Bacillus thuringiensis
ttcggttcctatggtattccagaatacgactattcatagctctgttgaacgtgcaacgcttcatacttaaacgtagctattattgtgatggacactcaaaattcgccctctgaaagaatcaataacatgcactattactatagggtcacatattgtcctcttgctctgatggataccatatctctttttttcgccgtacaaaagcctcctttatatgtgaacatctgatacatattcccctttccctcggtacctaccccttgaaaaactacaacccttccgatcgcacgcgtttgctcctctggca

SEQ ID NO: 3126 - DNA, 123 bp, Bacillus thuringiensis
catatcgaggtggcagtctgtgatccggaagtggggaatatttatgatcgagggcctacatgcaacactgaggctaatcgctactcatgacgagccttgcgaaaacatgggcaccagctgttc

SEQ ID NO: 3127 - DNA, 273 bp, Bacillus thuringiensis
tacccaccatccacaaccacacatgctacatatgacgacagattttgtccaactcataggagagaagatcgagaagactcgggcccaatccctgaacttgcactcctatcaccttggtgtggggcgaatccggacacgggagagacatttgaatagcgtgcgcgaagtaggccgagaatatcacggtgcatacgctgcaactatacctcgtaaactcccagaggctgtaccggggacacctgttgagcggcaaacagagttatcgccagatga

SEQ ID NO: 3128 - DNA, 221 bp, Bacillus thuringiensis
aattcgtgattgaaacagaacattcagataacgtagcctgatagttatgcagccttttagcatgggggacatggatataattcatgctctaagtggcaaaatagatagacgaatggcataccacaacacctctatacagaggaaggagagaaggcacaggcaatgtggacaccgcgacatgaaccaaggcaatgacgctccatagctattgatgaaggccc

SEQ ID NO: 3129 - DNA, 191 bp, Bacillus thuringiensis
tatcggatccccaaatcgcgagatctactcgcaccgattgtaacgatggctacggaccttttattactgtacatggaaactgtcttgctcgagcgtgcatcctgtcatacctcacacatgtaaacacacattacgtgtattgattgtacacaaaaatgtatgaaacggcctacccactactttaagaatat

SEQ ID NO: 3130 - DNA, 222 bp, Bacillus thuringiensis
gggatgggaataaacacaatatttgcaaaagaatcagtattatgagccgtgtcggcaatccagaaagctttatcagaagcattattttatatgcaaacaccattcctatctcacagcatatacacctacaaagaatagtgcgtatggagcagaatgcctttatcttgtaactataacacacttgcatggagaagaaaaaacattcttatcagggagcgaatt

SEQ ID NO: 3131 - DNA, 163 bp, Bacillus thuringiensis
atgcgagatctgcatcttcaacaaaaggatcgccctctgccaagactgatagcaatagcaagcgtcacaccgatagcggggagcaccataactatttactgcagggccttttaaagccgatcattcgacaaagatcataccgacatcagatgtatctatgcaa

SEQ ID NO: 3132 - DNA, 157 bp, Bacillus thuringiensis
aattcgagatcacaataaccgctataaacgcttcatatagatcaaacatgtttaactctgaggcgaaagcatgctctaggggaccttatacatgcacttgacgagccacgcgctcctgtactagctcacactgaagaacaggacgctgcgaaccttg

SEQ ID NO: 3133 - DNA, 247 bp, Bacillus thuringiensis
tttgaggacttatcctttactcacatatctaccgaaatatgcccttgtgataacatctggtacaccaactgagcggacaggccggtcctctaatactaaggactgctactatcgtatgacctacgcccaccacggatagggaccggactgtctcacgacattccgaaccgagctcgaatgccgcttatacgggcgaacagcctatccgttgagaccgacttcagtccgcagatgcgatgagccgaca

SEQ ID NO: 3134 - DNA, 243 bp, Bacillus thuringiensis
cgactttctggcctgtaactgacactgcggcgcgaaagcttggggcgctaacaggattatataccctggtggtccactccgaactcgaggagtgctatgtgttggacggtcatccggcctttagagcatgaatctaacgcatcaagcactccgcctgctgagtgcagacgaacggatgaatctgaatggactggacgggggcccatacaaccagtggagcatgtggttctgttccaagcagca

SEQ ID NO: 3135 - DNA, 153 bp, Bacillus thuringiensis
ctgcataatgatccagcctttctctcgtgttctaggcaataaagagcagcaggggcactacctgcatgtgccgttgcgcgtaacggcctatgccaagctgatccaccccacatataagaggcgtggaggttggttggtgattcgaccaatagc

SEQ ID NO: 3136 - DNA, 239 bp, Bacillus thuringiensis
aggaaaaaaaaattatttttttttcccccggggggcaaatgggggataccccccttttttttaaaaaaaaaaaacttttcccggtttgttttttattgttcccccccttttttgggggggggggaaattttttttttttttttttttttttaaccacccaccccccttgtggggggggcacaacacccccggggggttttttataaaaaaaaaaactcccttttttttttttttttttt

SEQ ID NO: 3137 - DNA, 226 bp, Bacillus thuringiensis
gagctgatacttgcgcctatatagtgtcaggctcaaagactattcatacgatcaatatgcgtctcaaatggggtctataaaaaaagaggacgctcatggcgtcctctatggtgcttccacactatctcttgcgcccataagctttatcacaggatttcccttgccttcgtgatccttaacggctttatgagtcgcttgttcttcttacctgccaggaatagctgca

SEQ ID NO: 3138 - DNA, 176 bp, Bacillus thuringiensis
aatgttagagaggcaaaaagcctatccgcttaatgtttatcttcccatgccgagactaatgaaaactgtgggagaggattgtatgaactccaaggtgtatataattcacaaggggtcccacaaggcggtccgttatccgtgccaattgatccagcccgccgccatttcggtgatct

SEQ ID NO: 3139 - DNA, 413 bp, Bacillus thuringiensis
tatacatgaggaatcgacgcagtaagcgacatttgagtgataccgtttgcatgtatcatatacgatggagggacatgaagtacttaataaactgaggctacgactatgttcttgtccactagactgagaaaaggtgtaaccattattgtagcactactgcttacctatgcttaccgcacaccatcaggggagaggtgctgcatgaccgttacagatgagcgtcgctcgatgatctatatagaaaggactgatgtgagggatttgcttgctgacatggcgcgcaccacagagcccagaagtttgcagtacattattgacttgaaaactacgatgactttacggttgacccatcttacttcgctgatggacagtccagggccctctttcctaaaacaaaaccattcctggcgatg

SEQ ID NO: 3140 - DNA, 178 bp, Bacillus thuringiensis
cacacacgtggtgtacagatacgaccactgcgctacgaagctcgtggacgaaaacacatacggatcatatccaaagcttttttcactgaggcgctgcgctaagacaaacggttgacatgagcggtatacgatgacaggcaggcgatcaccctgagggacagcgactgaggatgcacca

SEQ ID NO: 3141 - DNA, 332 bp, Bacillus thuringiensis
agcgtaaaccaagcagctttccataaagccacagaacgagagaaataccaagagcatacagtccatatacactaatgcgagggacaagggggaaatatatagccttctcaggtgccaagcgagctccatgctcaatatacacaaaggcacgggacgaatatagctcgttcgatattatacctgagcacttgtgcgacatcactaagttgaaggggagaacaacgaatgtgcgatgacaacaagcccgtacgattgaacatttgaacatggataaatgcgacaccggttaactgcataaaaatataaagaaaatgtatgatgggtactggggt

SEQ ID NO: 3142 - DNA, 168 bp, Bacillus thuringiensis
ggaggatactgcggatcaacgaccactgcaacagcaaatggcgttaaacctactatgctggacagtgtccactgcacgggcgatgtaggggcaattaatatatgagcacctcgctgcaaatgccgctgattaagatctatcatcggggctgctcatggcgggaggaac

SEQ ID NO: 3143 - DNA, 215 bp, Bacillus thuringiensis
ctacctttgcaatttctattttacctttgataagatgattgactgccaagagctcaataacctttccatgttcctttatttcgaacataatcggttcttgaacaggaacgtatccatttggagaagccttttctacgaatgaatatttaccgtacgctcaatcttggacgttacgctgaccattcttatctgtgacatattgcccaactactgaa

SEQ ID NO: 3144 - DNA, 119 bp, Bacillus thuringiensis
ggcacttcaaggggaaacgtacaaggcgtaaatccactgactaaccagctgactctactcactagggatctaattccttctgaatttcatttaccattggtggctccactttgtgcctc

SEQ ID NO: 3145 - DNA, 190 bp, Bacillus thuringiensis
tgcaagttattttatttctcttctattcccggtcgtatttctcttatacatgacactttatcagcattggaaaaggagcatagtttaaatgaggcgctttattcatttcactatactttacttttttataacctttttaacatgctgtggagattgactttacttataaatacaatcctatttcattaat

SEQ ID NO: 3146 - DNA, 219 bp, Bacillus thuringiensis
gataagagcgagggcactgaatgctacacatgaagcatacgaactgttggtgatcagtggccgtcaagcgttgcaactgaacacgacagcacacgatccaggtagctagaaaacacctgctattagacatggataagattacgctgaatcactcccaaaactgtgttcgcgtgctacttgaagcatactgaagggatcagtcagaactgtattatgaga

SEQ ID NO: 3147 - DNA, 413 bp, Bacillus thuringiensis
tgattcttattataattctttaactaaaacctatgacagtggcagattaagcgaacagcccaacctatttgtgagggcgcaagaagcattcttactccctaactaacatgatagtatcaatgtcttgaacatgcctaaaaccatacgtagaaaaaggggaatggctcgttataaaaacgaaaaagaagaaaggcaatatagcgagatctaagccacagcgatgtgaaagagattctctgaaaaagagaattgaatacacaaaatacttaatcatgctattttatatcaaccatatcttgctgctgctatgacataacgaaggtaaactaacatattaaccctgtggaggccgtatgattacctatgtgcgataagatttaaaaacgggatgctgaaagttgaccttatccact

SEQ ID NO: 3148 - DNA, 261 bp, Bacillus thuringiensis
tgcgccgctctagactcattacctacaccagctgaatagcgaaccggaataccccaccttgtaatgccggtggtatcagccgacgcgcttcaggcgatccggaactatgctcagggagagcatgcagcagatataaacgactcaggagccgagacttctatcgctaaatgagatgcgcgcaggccggaccgctctgcactatatgcagagacacctgcactatgggcccaaccaaatgctaatttggtaagtacataccct

SEQ ID NO: 3149 - DNA, 170 bp, Bacillus thuringiensis
  unsure (1)...(170): unsure at all n locations
aaaaaaaacaaaagcgaggaaccgacacngaatgtttgagaaattcgacaaagaaaacaaacacagggggctctaactaaataacaatagcacgtcttcaatcacctggaaaaaacaagatgaaagaaaaccgaagcaaatgtacccaagagaaaaaaggaaaacggccg

SEQ ID NO: 3150 - DNA, 345 bp, Bacillus thuringiensis
ccccggatgcccgaatgacagtgaccccagccacttagcactctgccacgtaatagtggaaattaccgacatatgacgaatcaatcgaagaagtggcgcaaggttacagaggtaaattgtcactttgtcccaaccgatcaaataagtagaacaattcactactggcatactgtctattacactcttatgtaaatacgcctgaatatgctgtgatgcaactgaagagaagccggcacatacgatgcctaatcaatgaaagtcattacaaactgtcatcatacacaggtacatatcgggactttggatatccggtagaccaaatgagtagaatatcaacgataacgg

SEQ ID NO: 3151 - DNA, 317 bp, Bacillus thuringiensis
gctttgcatgcatatattttgaccactatagaaagtacagctccctgttcataaacttaaactatgcaagaaattatcgcacaggctgggcctggaagcccggacatacatactagcattgcatactcctgcatctgccctgctccagagtaaccaaatgccatggggtctactctagcatagtagaggataaccattcaatcctgtgcaagatcacaccgtattggagggaacagtgcgaaagatagaataacttctctagatgtacgatatgcgagtagagagtgtcttgtgatcatactacacgggctctctgg

SEQ ID NO: 3152 - DNA, 108 bp, Bacillus thuringiensis
agcaacagtaaaccaagtatctaaccaatctttatttatctatcgtaagtggaaacttcacagtggatagtgcgaaacaactatcatctctattaaatgcaggagcac

SEQ ID NO: 3153 - DNA, 441 bp, Bacillus thuringiensis
actattgttttcatgacactctagtacatccagggggggttgcataggactacatggagctcatactcattctatagaaaagttcagccactcctcatataagcagccactacagtacgcctagggtacctaaatgtagttcactcatgatcatatgcaaagaagcatagatactactcgaattataacagtggaatactgtacacctcatattgatccaccaaattaccaaacatcacgtacataccagaaactaaactcattaaacaattaactagtgaaatgacatcctactactgatactctattgataacttgtgcaccatctaaactactcataagtctaataggaatgtctcttggacaaagtaacgtgtttgctaatgacacactgtgcagcgcgctcatacatgcacaccctgttatacacggacataacat

SEQ ID NO: 3154 - DNA, 348 bp, Bacillus thuringiensis
ggctaaacatgcttgccaactaattcaaatcactttgttcttcttacttctctcatccaccaggggggggaaaaatataacgggggggttgcacaacacaatttcatccagtattccactgtacgtttagaaccgcggtctcagtgactccataccattctacaagtgaatacacattatatctgttacactggacagcatcgattcgcaaacatctaaaccgactaacaaccatgcattcactttccgttaccatttaatgctctgtatgcagtcgaacacaaattctggaccccatacgcacccggcccatgcgactcgctggaccatagctgatctatattgagc

SEQ ID NO: 3155 - DNA, 435 bp, Bacillus thuringiensis
tatgttttttacactcactgcccggtttaccgggggggatcgtttgataccaaaagagttaaggacccagaccacacgctgggagagatgcatgggttatcgggcgctctatccactgcggctctgcctggctaagacatctcggtatttggagtgggaaagagcgacaccaggtcacacaaatgcgagtgtagcggtatacacagcatcacgggctaccgctgaaaaggtcatgggagcaaacattcatataggggccgagaacgaacaaagggcctcagggctagcgtatctccttacgctactcccgcctgccgattataagatagatcgactcccttgtgacaaagggcatccccatgcaggacaagaaagtccccacacgatgcccgatgtaacctaactaaagcggcttgctgaaccgaccgcgacagt

SEQ ID NO: 3156 - DNA, 399 bp, Bacillus thuringiensis
gctggctaagctagccgaccaattcatataaaccctttccttttaaaatggaacacattgtctcaagggggggttcatttacatagagggtgtcctacatataacagtttccaatactgggttcgaccgcagcccctagaccaaagaccccatcccagcccagaacgcacttaatgtataccctagaaaataccgccaccagaattgctgcactaaacaaatgacaaaccaaaatcacatctgtccttatctacctttacatacacaaagggtcgcgaacgataaaaacaggaatctccctaccatattcaaacgcatcccctttgaacacaaaattaaggttttacacattgatgacaaacatctacctatccccgttatagtatgaactgcttacta

SEQ ID NO: 3157 - DNA, 279 bp, Bacillus thuringiensis
gatcatacacccatttacagtgccgaaaaacgtctcatttatttggactactgcacctatctgggggggatggtaacataataggtaccttgcccaaagctttccaacgaaagactgcggggtaaatgggacaagacactccactggtggcttgggccgattattaagaaagacctccgaatacattatgaatacgttttccgctttgaccgatctttatacgttgcactccaagatcattcacgctattgaggcatacctgaaatgaacagacttgga

SEQ ID NO: 3158 - DNA, 101 bp, Bacillus thuringiensis
aggtccgtcgtcagcatcaggtccaactgaatcaacggggggaactttttaaacgggtggagccttaccaacgggagcaacagggcagactgactcaacag

SEQ ID NO: 3159 - DNA, 265 bp, Bacillus thuringiensis
gtgatgcttgtcactacgctcacatacctcttgctatgttttgtgcgacactacacggggtaccagggtccaaatttgctatctacgttgcacactcttactacatggcttgtgagttctctaactactactacaaaatgcgtgaacaacttcaattggtacgacaaaacaccactggatggactatctgcgagtcgcattgctaaaggatccctagcacattaaaagaggccttttgctgagccaatggcaaagacctgcattc

SEQ ID NO: 3160 - DNA, 237 bp, Bacillus thuringiensis
acctggttctgttggcgcctaagacggatgtttttatggcgaacatggctctggggaggggaatacaaatgcatcgtgtacgtgtgacactgggactacatggtgcgtttgatgtctcagttctactaaaaattggccaaaaacagcccggggacgaactttccagttgttcccaatatttgcgaagcgatatgtgaatggatgcctagcacatgataataggatttttgttaagaa

SEQ ID NO: 3161 - DNA, 198 bp, Bacillus thuringiensis
acgcttttcgtctcggctcctgcagacgtgatgaatacgaccgcttcatttcatgaacattatttttgcggacgctgaacgtccaaaagtatggacacattgattcgaccgcgcatgcttgcaaaaactttgagtattgccaccgggcatacgatgttggctcacacgccatatcatgatcacagaatgcatttattg

SEQ ID NO: 3162 - DNA, 427 bp, Bacillus thuringiensis
gcctggctcggagcgtgcacaattcagataatgtttcttggccatctggatctgcggcatgggtggcattaatagaccctacaagactaacattgccacctacacgatctgtcacttgtcgatcaacagatccaactccagcactttgtgcttatgaagtaagaatcagatcgtcgaaagacagcgatgccagcaccaatggccttggactcagcgcacacgctaataacccacaggatggaaacaacggcttacatcatgacataaataaattagaccttaaatagatttgatagagggctatttgctgagcatgatgaatagaagagtaggagggaaccctactttttttaacgttcatcagaactgtcaaagagataccttattattttagcatgtataatcttcagtatcacacctgatacct

SEQ ID NO: 3163 - DNA, 166 bp, Bacillus thuringiensis
accactgttttcaactggcgctgcaatgacactaccgacagcaatgattgtctttcacacaactgcaccctataaatggcgcgtaggtggttgatctttcactatcgggaagatcggagctcatgtgttaactgatggcttcgaaaagctggaagcataatctcta

SEQ ID NO: 3164 - DNA, 121 bp, Bacillus thuringiensis
ggtgatgttttgacatacattttctcttcatcaggggggccttttctttgctaataactcaaccataccaagagcagctctaacctcttttcaacgaatacctcttgcatatgcaacaact

SEQ ID NO: 3165 - DNA, 106 bp, Bacillus thuringiensis
  unsure (1)...(106): unsure at all n locations
attaactcggaatatatcagcgatnattaaaatacattcgactcaccgacagaaaacgacaanaaganctttcattaaaanaaaaggaggctaaacaaaaacgagc

SEQ ID NO: 3166 - DNA, 139 bp, Bacillus thuringiensis
  unsure (1)...(139): unsure at all n locations
acccagaaactcagtggaaagngaaganaaataatcgggggggttatgaaagaggggggggggtaaaaaacaaccgaagagcggaaacagccaggagagatgtcaccccggagagggaaaacccaagaagagcacaaga

SEQ ID NO: 3167 - DNA, 100 bp, Bacillus thuringiensis
  unsure (1)...(100): unsure at all n locations
ggaacatactgacatgccatccgaaagaagccaaccctccaccgcagagnacacaaccaanccagggggctaataaaaaacgcggcggccgaaacccccc

SEQ ID NO: 3168 - DNA, 172 bp, Bacillus thuringiensis
tctataagcgcaccaaaggagcataacccacagcaagaacggaaaaacagccacaaaacgaaacaacgagcaggcgtgaaaataaaaaaaagaggcgaaaacgaacaaaaaaacgggaaaaaacgaacaaaaccaggccaagcaaggaaaaaaaaacgccccgaaaaaacgc

SEQ ID NO: 3169 - DNA, 365 bp, Bacillus thuringiensis
  unsure (1)...(365): unsure at all n locations
ccaaagacaaaaaaaaaacctcccaccccccgagaaaaaccaacagcnggggccctaaaaaaaacacccgcggcaaccaccaaacacaacacntaataaacaccacgaggcctaacgaaagaacacagcaaggacacggtccaaacataacgagcaacgaagacagcccccgacacacgagccaaaaacaacaaaaaaccacccgagaacaaaaacacaaaccaaacaagcgaaagcaacaaaggaaaaaacaccatcacacccccaacagaacgcaaagtcaagccataaccccccacccaaggccaaaagagcggcgcccaaagaaacaacacaagcgcgaaaaaaaacccaaaaaaacgaaa

SEQ ID NO: 3170 - DNA, 176 bp, Bacillus thuringiensis
  unsure (1)...(176): unsure at all n locations
tgaagactcaatgggcgcacgagagggnnacaaggggggggatctgaagggcgggggggggcaaaaccaggaagcgcccagaagaacggtaaaccaaggaaggagcaacgcgaaaagcgcctggaaaggcggccgcgggaataagccccgaaagcgaaccccggggcaagagcaaa

SEQ ID NO: 3171 - DNA, 104 bp, Bacillus thuringiensis
  unsure (1)...(104): unsure at all n locations
gtgatacatggtggattttttacccggcttatgatgtttttttctaaaaaaatggcgttgnatcaaaagggtgtgtattatagaaaagtggctggaacttgctt

SEQ ID NO: 3172 - DNA, 478 bp, Bacillus thuringiensis
cgtttgaatagcatcactacccccctttttttcatcctcaaccctacttagcatgcatggagcgtttatcaaagctggaggagcataacactaaaataaattcctgcatccggatcgattaccctacctacatattatcgatcttccatccctagatttataagtgaaaacattagttcatccgatgctccacccacccttaaggaatatcatgagtagaatgttacaactactatgcacgtattaagatagacaaaggcccatcaccttcttttgcatgcgctctacttactcttaaggacagcaatttcaaatacttttatttcgtacccggctatatcatcgtctatagcccgacggttgaattgcaagactggccatatgtaaacaactgtataatctgtgtacacgatcaaggaacgactatgagctgtagagccaataatacacaatgacctcagctaatcacttagtgagg

SEQ ID NO: 3173 - DNA, 524 bp, Bacillus thuringiensis
cagcaggacgcagaccacgtgcggaccgaccgtatgcacattcatttaacatacgcacttcatataaagcggataatacataatatacaccgatcctaggttcggtagctagaaccacatattgtagcactattaccgctataatagaacgcatcatcattttacgaatacgcaagaaaactgcttcaatgtctaattcatcgaacagtctactaaggaaggaatcttttgccaatttgatatagccttatccaagatacgggttgccaagacatgaaccgagaaagccaaccctttccttgcacatcaaataaagacattgaagcccatggggttaccccatccgtataaaatcgagcgtgaaaaaaattgaccacgctctgcaggttcaatcgtttgtctcgctaagaataaattttctttataagactaagcctttcgacccacaaaagggaagaccgctggaaccaccattaacttatatagaacgaggctggcgtgtaagacgcggtatttcaacatac

SEQ ID NO: 3174 - DNA, 282 bp, Bacillus thuringiensis
gtgatcaacttcttactgacctagtgcacccacctttgtttcttccacaacccacatttcaatgggtgggtccaaaataaacacgcggtgcaagcctagctagcctcagcctcttctccaatgtctatcagagctccaagaatagcggttgtcgctcccttaaattggatcctagcaacatacgcgggactatacccgaaccgcgtaatgacgggctaatcatttgattataaaggacgttcagccaatacttaggcttaacacctgccatcaccgggtgat

SEQ ID NO: 3175 - DNA, 277 bp, Bacillus thuringiensis
gatcattttctaccttagatagtgctacttctttctcttcttcactttccactcaaggttcaatttggaggatcttcataaaagccattgggtgcattcatgaggaaaaattgactcttttcaatctgcttgtcacgaccaggaatatatcctttcgcttacttatattgctctcttgccatataaacttgcgtatgacccgaagcgagaataaacatactcgtcattttcttctaaagcacagcttatacaacacttatgctatcttccacgctat

SEQ ID NO: 3176 - DNA, 180 bp, Bacillus thuringiensis
gatgctcaactagtgatactagacgcctatcttttttaccaccaacagaaccgttagaggggggggttttatgagcttcggggggtacaccatactaacgggcagtgtatgtatttcattcgggctaattgatgaaccactgcttccaaaccgcgttattaacgtgagccattataccat

SEQ ID NO: 3177 - DNA, 229 bp, Bacillus thuringiensis
aaatcgttgatttaacacaatcagatactgctgactgggaagttggtggcaaatttggatttacagcatacagattagaagcactggcatgattaatgacaggattccgcatcatcatatggatgccctggacttagcatgagagcgaaaaggcatgccccggccggaatcgcgccgatgggcaaagcgacgagagattctcctttgcgcagaactcctgacaaggata

SEQ ID NO: 3178 - DNA, 109 bp, Bacillus thuringiensis
cagaatgcgagatgatctgtctatttcgctgacccaacatttttttgacgccccgccggggaaataactagacggcgtgggggctaccatcggggcccaaccctttagg

SEQ ID NO: 3179 - DNA, 223 bp, Bacillus thuringiensis
ttaaatgaacgcattttttagccaccctgtattatgtcgacgaaactccctaaccgtttgttggactgacttcgattggtaagtgtggtgaaccagtttgggacatgtgaacactagtaaccatctcatgctcgaacgtagaacgctgtaaaactgtcatttagaggcgacgctccactacaggcacgatggcctttatcaagacgctgggcttcgaggtgcc

SEQ ID NO: 3180 - DNA, 291 bp, Bacillus thuringiensis
tattatcccgaatagatattgcataagaccactgaggactgaatccctggtgtgaattgacacagactagggcacgatcgccccttcgagagcaatatccgccgggtgagccaatggcaccatatacagctactcctgaacggtctccacctgatccgagacctgcatagccgtttccaccagagtcattgacaccagatcggacaccatctacaccgcctaaagcggaaccatccccgtcaggaccaccgtcagtgtaaccattacctccggaaccgttggcgccagaca

SEQ ID NO: 3181 - DNA, 170 bp, Bacillus thuringiensis
  unsure (1)...(170): unsure at all n locations
atgatgcggacacacttgttngagagaccataccacatgctacacgtggggatcaagagacggaaccaggttgcctataagactagaacgatggtagaatctgcagaagttcaaattgacgatggtagcgataacgtaaaacaactagcatgagcgactggagagaacaa

SEQ ID NO: 3182 - DNA, 299 bp, Bacillus thuringiensis
ggtgagacagaaaacgagttatgagaacgcttttggaacgctaataggatcattagagtctgtagctttataaggaacgggaaagaatacattgctaacagattaaaaacctggagaggagaggatgtttgaacatgttatacgatgaccatgaattttgaaagactttgacttagaacaactctgttggaataaactttatggatgtacgggcataccgaatctaacgcgggactcgcttactggagaagcacccaccaccattgaggcgttgttggcgaactttatctcatctatta

SEQ ID NO: 3183 - DNA, 334 bp, Bacillus thuringiensis
ggtgaataacgaaatgaatactaagaggtgggaagactgagtcatacttggtcactcgacattcacaacgagcgaggagccttattacggataagtggaatggtagctcggacaggctgttatacttctactgtgcgtaaaatcgaaagagatgccagtggtgaaggtgaaaagcaagatacggccgttagatctgtataagcatcgctatgacttgtaagtcagatgaaaccaataagccgtgagctgctgcggaagccaagattatgtgatggaggggaagagaaatttcacgtgaaaaaaatacatggaacgattactaaaagggattgcc

SEQ ID NO: 3184 - DNA, 317 bp, Bacillus thuringiensis
acttcagaacgcgacctttctgttactaccagggccgctagtacgagtgggggagccttcagagcataatggtggagatatgcttcacgttaatttgaactcgaacggactagctcgaacattctatgattttcatacttgccaccagactttaactttaagcgcatacctacatagtacatctattttagtacatttatcggttataggtgcgaggaaccgccgcgcagaatgtgagcaccacatattacgcaccgcattgggaactaatgaccgacgagttccataacataacgctacgcgatgtttacaaagac

SEQ ID NO: 3185 - DNA, 310 bp, Bacillus thuringiensis
ggattcttgatgtgctaacgcgaggcacattgcagacggcactatgctcatacggtgtgtcgcatggatcagaagcattaagtgactcgaaacacattacacaccgtatgacgcatcaacattctactaggctctgaattgcacctatctaagttctgaacggtgcaccaagctatgcaactgacacaggcgagagggatatggtaactaatcatgagaccgctgaacaagccaatttgcaagcccctgatataattgttatacagctggtccccgtacacgaaagacttatgccctggtggttaacaaa

SEQ ID NO: 3186 - DNA, 491 bp, Bacillus thuringiensis
caaattaaaagagagcggcaggcgttagggtttgtattagctggaggaagtattaccgggattgttctaacaacgtttgcagcacattatttatatggatttattccggcaagtgtcgcgtttctctgtaatattgcatgggttattttaggtatttatttagcgaaaagatatcaatcggaatatctcactattttcgtagcggtcggagcgttcttcgtaccattcttgttaaatagtacgactcctaatccttatattttctttggatatgagacagtattgacacttagtttattatggtatgcgttgaaaaatcgttataaatacttatatatgatttcttacgctgttgctgccattgtccttttcgttttctttgctgttatgtcaatgttagtagagaacttgcaaatacagttaacgattgtatatggtttgattcatttactattaatttgcatatgtttacggagagaagtttatactag

SEQ ID NO: 3187 - DNA, 162 bp, Bacillus thuringiensis
agggatagaggcataaccaagaggaacaggagatcttagtgacgcaaaagggggctgaacaccgaaaccggagaaaccaatcgagcgcatcaccagacaccgatgaagggataggaaacatcgtcattacgaaaataggaaccattacggttggaataaaaa

SEQ ID NO: 3188 - DNA, 377 bp, Bacillus thuringiensis
caactacatgtgaataagcggctggtttctcaaaaggggctgcacagagctctatccagatcgtagaggacaagctcatattctgtataggctcaggctgagatcttttcaaataagttatgcactcgacgtgcataaaggtgatggcctcttcgtgtatatcgcacgtggctatactcacacacgggagaatacttaggatattggcagccacgtatcacgcatgcgggtgcagaattctaacaatgtgaattggattggctgtaggaggactgacgggccgtattttagtacgaagtatgcctatctacttagcctgaacctttccttacgtggaggcaaaggaaaaaatgtcccagataaaattccgggacctt

SEQ ID NO: 3189 - DNA, 334 bp, Bacillus thuringiensis
taactgtcggactaacgttctaccgggggttttgcgaataatgcaccatttatacaactgggagacctatcataactgacactgacaagcactgcgtacgtagactagcttgactcagtatatgttatggcatagatggtacattgatttgttacacgtgttgattagaggagcatctcttatatgtgcggagaatatccactcataaaacctgtatgaatcaggagcgtacttattacgtacgctatatttttatataacactgcccattgctacacggaccaacaatatattaaagttcttgatatactcaaggcgcgataatatgtggagg

SEQ ID NO: 3190 - DNA, 119 bp, Bacillus thuringiensis
cgacgcttggtggcatcatgcccattatgaggcgaatacgaggagctatgggaagtgtctgagaatctgagaggaacactgcatgtgagaaggaaaaacgggagatatatcgcggggac

SEQ ID NO: 3191 - DNA, 293 bp, Bacillus thuringiensis
ttccggatgaatgtctgctatacgctctttcattattatacttcagaacgtactacttgaattcttaatggagcggaacacggatgacgaaggacttgaactcatccattttatgatgggactcgaagacatctattatgtgctgcctgaacaccttgcgcatacgattgcgacttcaagtggctctgcattcacgtatgtagtgagtacagtatgcatagagaatccgtacacatagttgaagatatacggtgaaaaagcacctatgtggtgcctttaatgtttttttaaac

SEQ ID NO: 3192 - DNA, 256 bp, Bacillus thuringiensis
aacatgctgcaaatgcctttggttcaaaggcggtcaatacacgagctgtgggtctaccgcaaggaggaacagttgtgaccacttcccttaacatagacaactacagctattatgacgggggtcattgcaaggcgcttattttccgattcattgaggaggctgcgatcgtgtatgaagtagcaccggctccatcacttgaaccaataattggacatacatggtgttactacaactattcataaaggctctcctgata

SEQ ID NO: 3193 - DNA, 432 bp, Bacillus thuringiensis
ccactatatagagaacgaaaataccattcacatacacatttctgactccattatactaaccgagaccttgattgtgcttatctaaatgggaatatgccccaaaatttagctatactggctgctgtggctggactactgcagtctatctagctagacttaacatatatgcaatttcttagaggcctatatgtcaacgtatcgcaatggtgtatgatgctacttgatagcgatgttaacatatgctctctatcaatcaggaatagaaatactctcttatcgagagaactaccattccctaatacattgtttattacaaccttgttataccacgactattgagactaagtcacatagacatttgctgctctaataatgaatacaaacctttacaaggtcactctcatatgctaatttagtgctggccacctgacc

SEQ ID NO: 3194 - DNA, 325 bp, Bacillus thuringiensis
aatccaaatatataccaaccagactttttttttgtgtactgacgagttacttgtcgtcgctcttttgtaggagggtctgtgaaattacctgaacagaaccataacgtccccaaacgggatacccgagctactttacacaatggactgaccattttcttgaagtgggacatgatgatgaccgcccgcatgaatatgaagaactgactaggcggtgaagggatttacttctgatcctggctctcataagatacacacactttagggaacagatgtcccactttaggaactatagttcggattctgaacgggcatactttgctcctaa

SEQ ID NO: 3195 - DNA, 323 bp, Bacillus thuringiensis
aaaacgaatatgtccccattgttggaatacaccgccacctataaacatactctgccttgctggtgtaatcctatggagctacacttcattcctggtgcatagctcagacaattgatcataactggatggagatatattattattgacaccacctactgttgcgcgttaaacggctcaaaacgatttgtaaaccttgtacataaaccggctcaccgacacaaagctgtacttgcgccactgtgtaaccccacaccagtgcagcgatgagcagctcctcgtctcatgtcagcatttccagaacaaactgtatataatgcatgctt

SEQ ID NO: 3196 - DNA, 100 bp, Bacillus thuringiensis
caagggggggggatacaaggagcgaaaaggccaccaaaatgccaggaacaaagaaaagcccttgaaaaaggcgaagtttcactagactccgtcgcctaat

SEQ ID NO: 3197 - DNA, 180 bp, Bacillus thuringiensis
ctacgacattatcgaatttatttttggctgaatgaaagactgatataatcggagctgctttgaaaacaacaccatgcagtgtaccactaggaggacgcacatcagatgataccgacggtacacccgcgacgtctctaaagcggaaggattgaaatcctgagaatgggtacgtcaatggat

SEQ ID NO: 3198 - DNA, 105 bp, Bacillus thuringiensis
aaagcgtggtgtaaacctcgccccggcacctttaggaataacccaccccccttttatcttctggaagctcccttcctcaaaattcaggagcgaaaattataacct

SEQ ID NO: 3199 - DNA, 102 bp, Bacillus thuringiensis
tatactagatgcgatattacactcatctatggacaattatattaaatggggatgtattaccaaacgattcgcgggaaacatagcgctagaggataatagctt

SEQ ID NO: 3200 - DNA, 302 bp, Bacillus thuringiensis
ttgagattatttctgttattcacacgaaagagtgttgggatgataaactctgatgggaaatgaaagacaacatagctccgtaagaatagaagactaatgatgggactagacatgcaatggacttacaacatcagatcaaacgattaaaggaagtgcgagaaggacacatggatcccgttgtgagaaattatgaagtgaaaaaacaatctcacgaatggaacattactgtacatatctttcgcgcttggcgcaataagaggctcgttgggttacgaaaaccacatccgatacagagcgaaaca

SEQ ID NO: 3201 - DNA, 177 bp, Bacillus thuringiensis
caaaggccggccgacggttatccccaggcgccgggcaaaccgcgcggaccgaccatggaggccaaaggtcacgaacaggcctacggaccgcgtccgatgagaggaacagaccacgcccgtactagaggcatggccgtgatgcgcagaaaaactctacattacgcggtagagatgggt

SEQ ID NO: 3202 - DNA, 141 bp, Bacillus thuringiensis
ataccaatccccctggaagattcataaggcgctcacaggatgcgaccctgccgataaccctattcatgaactgactatatacttcaggaagcgtggttcttactgagaaatgacactgtcggtacgaaatgtacgtgctgg

SEQ ID NO: 3203 - DNA, 205 bp, Bacillus thuringiensis
cccccttgtttcggcccaccccacacgccgcctctggggggcttataacatctatggggggctacccccatcctcttacttcacccttctccacttcctccctcccccaaaccgacctcactactgccctccaactactctaccttaccaccattccaccatctctaccttctctcatatccgatactgcgtccccaacttttat

SEQ ID NO: 3204 - DNA, 223 bp, Bacillus thuringiensis
aaccattcaaagggacccccagagcaccacccgcccaccccacgaagcgaccaccccacccaaacaccccacctgacccccacacccagcccaacaacaccccaacgacacaacccccacacagccaaggcccaaccccaccaacgcccacaccgaaacaagcgctccgaccacaacggcacccgccaaacccaaccaaaccgccccaaccaccaaccaacac

SEQ ID NO: 3205 - DNA, 350 bp, Bacillus thuringiensis
tatttaaccttattcgttgaactatagataggattatatgagtgaaaaaggccatttagaaatgctaagtggactttcacagattgctagcaacgaccactgacaaaaacggaacaaactggtcattgaggtcgcctatcaagtatacggataaaacaagggcacatgacagggcacgccagcttacgaaaagggagatgcaagagagcgatgtccgatacactccctaactggtagcgatctgtgtaccatccaaaaaacacataggccagaaagaggccgaaaccgccccaaaccgaaaaccctcacgtcttgtatccccaccccctcagacacaccctattcccccc

SEQ ID NO: 3206 - DNA, 286 bp, Bacillus thuringiensis
gaatagtaaagcacatctagctctaccgcgcctgcctataacgagaaaagggagaattttagctaaatatattgcaagcacaccatctattatggctggcttgagcgcaacttttatagccgtaataccaggaaatattctattgaacagagatatagccctgcctggatatgccatattttcagcaatagcagcaactttgatctattgtgcagcaacgacaccgactaacttcattgggggatacaaaagctattacccgcctgaatctgatcccgccttcccc

SEQ ID NO: 3207 - DNA, 311 bp, Bacillus thuringiensis
ctagaacatggagacgtgtcttttaataaaaaataaccatgaaatacggtacggtagggtcttctacttttgatttagtggcatctatagtcgccttacacttatattgaacatcttgatggcattgttgagaaagtgcgtgaaactgtaaaaacagacgggacctctacctttagcgttcagcacctcgaggtggctcattcgcttgaacgctcacaaacaagtggggaaatattgagttggctcgtagctgattactctaaactagggaatcggggggaaccatggattgcccatacagccatttaata

SEQ ID NO: 3208 - DNA, 259 bp, Bacillus thuringiensis
tataagtcccttagggataatatagaaaaaagaatgcataacaaaggtgaaagaataagaaaatgatgagaaaaaagggctacaaatatatcaaaacctcccaatgaataaaacacagcgaaaaatacacccaaaaacgacaatttacaaaaacaagctaaaatacctattttattgacatcagggactctttcctaacaaaaacaaaactctaggaacctcatatcaggaacaactataaactaaacatcaaacatat

SEQ ID NO: 3209 - DNA, 410 bp, Bacillus thuringiensis
ggtgccaggtacatctggaattgtgacatcatccgttttttcggcgtattcaacgtggagtaacacacgctggccttgaacaaagacagcacgaatagagtttccgtcaattgaatgggcccatgcctacttgtgaggatggacgaaacgccctctaatgcttaacacatatgctgtaaaaacgcaagaagagagagtgggatcagagcgtctccctcgttctgccttaggttgcttatttaatggagatccgaagtgctttaggagagctgtaagatgctatgcaggctgcgctgctagaggggcctgctgaggaatggtaccatgatggtagcataaccgtgcttcctcacagtaccatagaagaccatgcactatatgcagaagatgctggacattcgacctagctg

SEQ ID NO: 3210 - DNA, 235 bp, Bacillus thuringiensis
cgttgatggcgttttgtgagggttcttctatggacaacatcggcaggagggatttgtagattattggacggtctataacccatgaggtgaaacatgctattgaacgaaagaggacctttccagatcaattggacggatattttgcgcagaaaacggcaggacttccaatctttctagcagttacgatttttatcatgtaggatacgtttacacggctccggtacacctccattct

SEQ ID NO: 3211 - DNA, 411 bp, Bacillus thuringiensis
aagacggaagagacatatgggcgtgacattcacattttctctctagggtttcacgcgctaccattgatgaagggaatagctacctgggggcgatttgtgctcttccactggccctagtgacatgcacactggctcgcatacggccgaaataacgacacggcaacctaactgaacctcgcctttaatcaactaactaccacaccagtgaggtaggtaaaaatcccaatgcgtatgactcatgcagataacaacctgctatgagacacctaatatatcaaacacactactcgcaaaacagaaatatcgcccttaacgggatagaatagacacagatacagcctaagggaatacgagatcagagcaaataaggactgacatgttattatcaatatacatacattataataagac

SEQ ID NO: 3212 - DNA, 284 bp, Bacillus thuringiensis
gcttgaacagcctattagcgtgtcctcacactttataacaagcgcttctcgctctccaaacgatggagtgaatttttaaacacgcgcgaccggagctgctacactagacccaccgtcatgcacacccggtcgcataccgcggaaatatcgatccggcaacctaactggatctcccgctctctcaattaacgaacacccatttgacatcagtcaacctcccaacggctaaaatacagacatctaaatacccgcagcgagacacctcatatctcaaactcactact

SEQ ID NO: 3213 - DNA, 126 bp, Bacillus thuringiensis
gctacgttgctagcggttgtttttcttacaaagcttttacagaacacagggggggaacctttagagaactaccgtcattatgaggcaaactcaactacgcttcacaaatcgccataaattcatata

SEQ ID NO: 3214 - DNA, 170 bp, Bacillus thuringiensis
aaggctaaagactccctagtgttcgatagggtactgaaccgcgagggacaggcgaaaagcaccggtgagggggagtagaaagagatccggagaccaaccgccaacagacagacacagcccggaaacgggcgacggtgagccataggaagaaagacccgacaagcaccgac

SEQ ID NO: 3215 - DNA, 393 bp, Bacillus thuringiensis
ggcttacttatgttatcataccataaatgcattccttatattatagaaattaccaatatgtgacagatgtcagagacgggtggttagaccattaagggaaaatcaaacgaggaagccactcgcataaagttgcttcctttcctattcaaattacgctgacattgttccagccctatatcgattatgaggatcgaggcgtgacacatctccactgattgatttatgggagagcctaaaacctcattgtgctgttccaatatacagctgacatatcgcaatgcctactgcttgaccccaacttatttagtagcacatacagtacggataaacatactcttcacagacaaagctaccataccgcctaaccatacgggggtcttgatcggtaataaa

SEQ ID NO: 3216 - DNA, 422 bp, Bacillus thuringiensis
tacaggggacttttttttcgttcaaatgctctttccaatttcgacggtaggatcaactaccgactgggtgaagaagacgaatgttcgcctggccacccaataaaatcgcggtcttatcgtgagggccaaccatgattcacaggaagtacaacgtgactactctcttccattgaaggaactacatggatatgcatatactgtccctttcggaagtgttcacttaatgattacggctgcaccgatgctctgtaaaccactagtctgtgttctcagtctgaatggtgtcctagtacaccctgtagcgattgctgtctagcgttgggtaaaccgctctctgctgttcctatctttctcttagcatgacctttttgtttatcctataggagccactagatgtctctacggttcctaaagtgaccacg

SEQ ID NO: 3217 - DNA, 189 bp, Bacillus thuringiensis
aaacggcgagaaaacaatcgaacaaaaagcacaaaaatggacatcacacttcttataaaaccaaaaaagattaaatccaaggaatcaatgccaattatgaaagaccggataaaggaaagaaaggccgcacaaaaaccaagctaaaggagaagtgaaaacaaggtcaaaaataaccaagaaaaaaaaaac

SEQ ID NO: 3218 - DNA, 307 bp, Bacillus thuringiensis
aaggcaatacacagagaaagacataaaggaaaacatgcatcaacaacggaagaaacagacagcaaaacaaaagacccaaaaaagtaaaccatataagggtagccaaaacgagaaagcccaaaaaaaaacgacaggaaggaaaacaaaaaccaatataaaacaacaatcacaagattccaaaagaaagaaaccaaagcaacaacaaaagaaacgtaacacaactcaaaaaaagcacaaacaaagaacaaacaaaataaaaagaacaacacaaacaaaaagcagaagaaaccaaaaaaagacagaaaag

SEQ ID NO: 3219 - DNA, 188 bp, Bacillus thuringiensis
  unsure (1)...(188): unsure at all n locations
cacagnnnancaccacaacnngcagnagggacncccaaggaaacacgccgacacacaggacnaacnnccacccnnacnnacangaagcaaaagcgagcagaacacaaaagcggacccaccccaaccaacggaagcggcccnggcggaaaaaacggaccaagggcaaacaaacnccaaaaccaagacac

SEQ ID NO: 3220 - DNA, 349 bp, Bacillus thuringiensis
  unsure (1)...(349): unsure at all n locations
acgaaaagcacaaaacacgacccagagcaaggaacacaacacagaaccgcaaacggccaaacagaaaagagagaagcacccacacaagcaggcccccgaagaaacgggccgaacacacaacgcacaaaacggggcaacgcacacgaccacaaaaaaaagcgaaaacccaaacaacccacaccaaacgagcgaacaccggcaaaccaaccaaacagcgcaccaaacaccaaaaacagagacaagggaccaaccacccgacaaaaaacgggaaaaacaaacccacaaaaaagaagacngccccaaaaaaacggaacagaccacaacaaaacccaaaaacaacaacaaaacg

SEQ ID NO: 3221 - DNA, 497 bp, Bacillus thuringiensis
  unsure (1)...(497): unsure at all n locations
aactgcgaacaaacaggnctttacctgcggatggncgttgtaacggcaancgggtanaaatacantnggtcgtacttgcgtgtgtaatgggccannatgattctacctgtaaaaagctgggatntcatggggatcaccgcacaagttgaaaaagaatctttacgtattcaagaaacaagctgaaaaactaacgtgttcncgttattttattttagtcgacttctgctggagncgcgtattacnagatcaaagtaggaaatggttcccaggggcgccgccggtgcaaggaagaatcttcctattaatcaagtggaagttatcaagggtaaaggttcctcaaagtatgctttgtttatttggacctttctgcagcctggtggtggcgtatatttccagcctttttgtgacgtttgtaatgatgggtagaggggaaatgcatttatgtatttagggatctccttgtatggctgagaaggctatcggtgagaaggtaactt

SEQ ID NO: 3222 - DNA, 261 bp, Bacillus thuringiensis
caattaccccagcacccgccaataaaccagatgcattaatatcaaacacacccaaaaacgcaaccagcaaaaagaacataaacaacctaccctaacaaaaaaaacaaagaaacaacactacagcaaccgcaccaacctctcaaaaccgaaaaggaaaacgacttcccaagcgaaacgcatatagcacaaccgcactagcaaatcacacaacaaccgcaccaattattaaaaaaacgcataaactcaaaagacccaacccca

SEQ ID NO: 3223 - DNA, 397 bp, Bacillus thuringiensis
  unsure (1)...(397): unsure at all n locations
cagnnaaaaggacngggacacacncgcccagaagcannccacggaagggngccacccgccngcgcggcccggaccggcgccaccggcaaaaccacacangcaacggccacaggcacacaaggcacggcacggacggccgccccgaaggacaccacgaaacagcacaccgccacgcacccaggcaaacacccaccgaaccaccannanggaggaccacagccgangcacgaggccgcagaggcagcgaaaccgggaaacaaaccnncaccngaagaaggaaagagcaacccccggcccggcaccaccaccaaacaaacggcccccggcccaaaaaagcggccacaaacaaacgcaacagccnccccggcaaaaaaagaaaaagcaacccgaaaaaaag

SEQ ID NO: 3224 - DNA, 318 bp, Bacillus thuringiensis
acggaacccaaccagaaagccacagaaaaccacaagccaacagccgcggaacaacgcacgcggcaagcgcaaaccggacacaagggacgcaaagcgcgcacaaccgaacaccaaagcccgacgcaaaaacccacggaccaaccgcgaagggaccaacgaaaaccggcagacacgagcgcagaagaagaaagcggcacaccaagcaaagcggcagaaacgcgaagagacacggaggaacaccacaggcgaaagcgacaccccggcccgaaaccgacaccgacgcgcgaaagcgcgaggagcaacacaagaaaagaaacc

SEQ ID NO: 3225 - DNA, 282 bp, Bacillus thuringiensis
  unsure (1)...(282): unsure at all n locations
aagcaagcaaacgcggcctattaaaaactaacccggggctacccccaacatacagtgaaataaaaagcaccgaaaagcatcgagcttttaatagaactgccgaagaatacgacgggcaagccgccaagaccagcaacgaccgagaaagccacgcaagcgcaaaaacgaggcaaccatctctggaggcgngcgccacaaccttttggaacgaacaagccggggagccatatatccaaacccgaatacgaccaacaaggaggggacaaacgtagaacagaagaa

SEQ ID NO: 3226 - DNA, 298 bp, Bacillus thuringiensis
tgccacatcattgcaatacaaagccgtggctcctcataaaaaaaaaaaaccaaactatagaaaaccacaccagcagacccggccagaaaaggctgaagaaacagcataagcgagcaagaaagaacaaagaacaaaccagccaaaaaaaacaagcaaacaccccatgcccaacacgccccaaacggataacaaacaccacatcccgccgaccctcctagcggaaaaactatacaactgaaagatcgggcaataacaaaacaaacaacaaaacatccgttaaaaataagaacaaccccca

SEQ ID NO: 3227 - DNA, 128 bp, Bacillus thuringiensis
atgttcttgtaaaaagcctcgcttttatgtaaacgaagacaaacaaaactccaaaactaatatacgttgaaaaaataatgcaaacaatataaaaaaaaggataaaaaggaagttcatccaagaaaaaa

SEQ ID NO: 3228 - DNA, 322 bp, Bacillus thuringiensis
atccgtatgagcaagagggggtcgttttgacggcagcttggtaaggagcacccggagaccacaaggaccaggtgagtgctcttgatgaagcataagatgacccaacgccaggggcatttgaagaagaagagaaaaagaaataatcagaacagagggcgaacaagccggaaccgacccagccgtacaatagatggcggccagcaagatagtacgagcgaaataactaaagccatttatcatgcaggagaacggttaatctggtctacaattcctgcatcttccatcatgtatactgacactatatatatgcatcacccagagg

SEQ ID NO: 3229 - DNA, 302 bp, Bacillus thuringiensis
  unsure (1)...(302): unsure at all n locations
ccagaaccgaccaggggcggcaaaaaaaaaangaggggggcaaaaacaccatcgaacaagcaaatcatgcccccacagatgatagaaccccagctaaaccaagcaaggaaaaagaacaaacattacaggtagaaaaagaattactacatgcacagtcgggaaagacaccgctaaccaatgcaacaaagggacggactcatcatagaaagcaaagcacctccgctcctcatcgctggcgaaaagcaaaaactaaatcaaggggtaacaaaaaacccaaaaaaacgcaccgaggccaagccaaa

SEQ ID NO: 3230 - DNA, 141 bp, Bacillus thuringiensis
cccccccccggccccgggtcggtttaggcccgttcccccctttccccggtaaggatatcgaacactagagttaaggccttaaatggaatgcgtctcaatgttcgattaataggtaggattatgtcgttgacagtcaacata

SEQ ID NO: 3231 - DNA, 162 bp, Bacillus thuringiensis
aaaaggggaaacaccaccatatgctacaaacctgtttgaaagggtatttgtaaaagcaagccctgccgaattgtgaaggagcgaatactgatagtcgaggtacaacggaactgggcgaaacaaattatcgatatgtacagcttgatcaggattaatcctgag

SEQ ID NO: 3232 - DNA, 256 bp, Bacillus thuringiensis
ttcccggatgcggacattaagctgtctatgctggcaaagaccttttacgagcgtcttcttaagagagcctagtgacctacgggtaactcagtatgtgccatccgggtgcgtcagccttgcgcggtacatgacagggatgtgtggtgtttggtgctgaacgttcgtaggcgggaaagggccgacgagtgggatatcgattccgccagataattggggcggtgtcgctacactgccaccggatgttgtttggaggcca

SEQ ID NO: 3233 - DNA, 106 bp, Bacillus thuringiensis
ttcccgaaaccggggagttaaagaaaagtgagagattggacggaaatactgttgaaataggcgaggaaagtacgcggaagacaattttttaccaacagactgggtc

SEQ ID NO: 3234 - DNA, 325 bp, Bacillus thuringiensis
  unsure (1)...(325): unsure at all n locations
tttttaacacccgaacgtgaanattattctctagataatacttaacacactttttatagtaagaatgtaaaaaatatgacctgtccttatgtcagaatgctccaccttacacttgattttcccgaacataactattttcataaacacatagaacaacctgactacctcttaatggacattgttacatacaccaaacaccgaattttgtacgcacttaaaaatagcccactgcatatatggttatcaaaatttacatagatgttaatacaagaagacatcaatgcacacttgctaaatactaaaaaaaaaaatccgagtattgata

SEQ ID NO: 3235 - DNA, 311 bp, Bacillus thuringiensis
  unsure (1)...(311): unsure at all n locations
aaaacgaggcatccacaaaaaaaaaaaaaccctcaaacacnggnaaaaaacaaacaagggggggactaaaagaggaaaacggcgctaacaaccccaaacagggatgaaaccagaaacaaaggacagacaaaagagacaaccaaagggacatccacaaaaacaacgcgagccacaaagacaggcacttcaggcaacaaaacaaaaaacaccgccggcggcccaacacaacacggagaaaaacagaacgcaaaatccaatggcacaaaccacgaacaacaatccgcagaaaagagaaacccaccagcggcaac

SEQ ID NO: 3236 - DNA, 344 bp, Bacillus thuringiensis
aacaggagagcccaccagggagcccccagggggcaacccccggaaacccaaaagccccgccgacggcccccaccccagacccgagcgaaaaccaccagcgacgcccgccaggaggccgaagcctacagaaaaaccccaaccacccggccaaaaaccagaacacgcccacaagcaaaacgagcccaagccagcacaagaccacacccgagggggccccagcccccggccgccgaacaccacagagccaccaaaacggccgcacaaaacacaggccgcccgaaaacaaccacgtgaccgcaaaaaccccgacgaaacccaacaaaacccccccgcaacacaacccc

SEQ ID NO: 3237 - DNA, 218 bp, Bacillus thuringiensis
  unsure (1)...(218): unsure at all n locations
gcggaacaacagcaacacccaaganagccccacacacgccacgaaacagngcaaaaacacgangggggaccacccgacgcaaaggnacancagaacagaaacacacaccaaaaacagaccggacagcncacccaacaccanccacggacgaagacaaaacaccaccacgaaaagcaacagcgcgaacccaaccacgacacgcagccacaccagaaacc

SEQ ID NO: 3238 - DNA, 226 bp, Bacillus thuringiensis
ggcaggggaaacaacggcgataaacttaccgtacgcaaataataagaaacgagtagcaaaagcaaccgacacttcaaaaaaacgcgaccccaaaaaaaccgatcgccccacactagctaacaaggcgaaccgaaagcccaaaacgacacaacgagacccaatagccaaaccgaccgacggccccacctaaaaagaacaaatcccggaaaacccgcaagtgcaagcg

SEQ ID NO: 3239 - DNA, 379 bp, Bacillus thuringiensis
  unsure (1)...(379): unsure at all n locations
acccccacaccaaaggcacaagaacccacttcaaacgcgaagccaaaaccgccacaggggcattataaaaaaaagggccggccacacacgacccgaacncacgacccnccgaaaaaaagacagangcccaaccaacggagccaagggcgcncacaaaaaaaaccggcgccgacgagaggacacgaacccccaacccaccgaggacaaggcacaagccccaccaagcgaaccaagacggccaaagggaggaggaagacgggaccaaaccgccgacccccngcacgcaaggcaggngcacacccaacngagcgaaaccaccgaaaagcccggcaacgacccacgcncacagggacaaggccccaaccaccaccggcgcaag

SEQ ID NO: 3240 - DNA, 127 bp, Bacillus thuringiensis
tgattagtagacacgtgggtttacgttgacccagttacgccgatagaattagtgcacttactcgggaggtgtttcagaaaagggatggaaatgatacacacgtaggaatgttaaggtggaaacagtc

SEQ ID NO: 3241 - DNA, 396 bp, Bacillus thuringiensis
aaatgatacattgcattgtgtggttaaaaaccgtaacctcctttatttaaaaatgtaattgaataagtatcttatgctttacgtcatgctccgtgggaatacgaattggagttagatgagaatggctgggtgtctgttgagcaacttttacacgcacttcaccaatccattgaatggagagaagtgaagatagaagaatttaaaaataatgaatgagaaatttgtgaaaaaaggcatgagctaaaagaaaataaaatttgagcgttgtctgaacattctattcccatgaaaatagtaaaggaagaaggcgtttcaactaaattactttatccagggacatttcctcgctttttaaattctattgaattaaaagggctatctcctatgtatagacaa

SEQ ID NO: 3242 - DNA, 465 bp, Bacillus thuringiensis
agtatacgtactttctttttatgtacacggcgtgacaggatcgagcgtatttgcggcttataagccttatccccttcattttgtattagagtatgtcagaacggacaagatggagtggccatgatgggccgctatagtagtgattagcatgaacgtgagtgtgcgtacgactgtacctcgtgtggtgttcgtcttttacatgacccacttgattgagctacgtctgcatgtggatggggctggggtgttgcatttttaggtgcgcataacagtggatcagtcgcgagtacacgtccctctagtatatacacaaactcggtggacccttttgaagcgtgtgctccatgtctaagccttactagatgacgatctcgtatattgcgcgtagaaagaatagatgaggaggactgcgctgtattgcgtgtattaactggagcatcaggagatggaaccggtgtaccacct

SEQ ID NO: 3243 - DNA, 376 bp, Bacillus thuringiensis
cagcaactgctggatgctttcctttacgaaacactagctggcaatgggccgctcgttgcttatctgaaggcgcttcccatcctgtcatattgcctaaaatggctggttcctgcttggatcggatagccacaaccacctccaccgatcattctatattgaaacatatagctgctagcctgtgcgccttgcgtgggtatctctaacacataccatgttgggatggcttcccgctttaccaaaagggaagcggataaagccacatgaatctatgcgatataacaacaagactatgagagggggttcacgttatgacagatctgccggcctgcttgggcatgacttcaagtggaagtatgaccatctgttggcagcattg

SEQ ID NO: 3244 - DNA, 171 bp, Bacillus thuringiensis
ctgaggtgactaacacgttcttgtggtgtaccctggttatttttatcacatgtggacagcctaaatcggaggggttgcggtttcttgcacacaatcgccaagagaaaaagggactgaaggctagatgacaacaaagagcctgataaacgcacgaggcttcccctcacaatg

SEQ ID NO: 3245 - DNA, 306 bp, Bacillus thuringiensis
caacatctccccccacgcacatagggggggtgttataagtcctcgtacacacgactcgtaaatacctaacctatccaggagaaaataaaaaagacaataccccccagtgtattgtccattgacttccctaccaattccatctacccagctcaattaaatgtagtaagcgccctccgcaccatattctgcccttctccacctgggcaggagctcgcttttcttttggatactggccgagttctctctactttttaaaaaaaagggcccccaatcttccgatgaatgttctaacaggtatatgcacac

SEQ ID NO: 3246 - DNA, 141 bp, Bacillus thuringiensis
agactcgaaacatggctttcaaagaagagaggaatatctgacgcgaccgaccgcataccttttgttagaaacattcgctttagcctattcattcgctatctctctgaaagatgagcaatatattctaactactaccagatt

SEQ ID NO: 3247 - DNA, 134 bp, Bacillus thuringiensis
  unsure (1)...(134): unsure at all n locations
gtcgtgatctactctaaattgaatattttngctatttaactcatgaacagtatgatatgtatgccncggatttctttagtttatagggggctaatatgttacaatcacatcaattccgtgcttttttttcacat

SEQ ID NO: 3248 - DNA, 145 bp, Bacillus thuringiensis
  unsure (1)...(145): unsure at all n locations
cacaagacggagagcgggctccaccccccaaggcggctttagcaacgaaagccgcaactagaggcgccacacgcgcgtcaaatgtgcgccggaatgatatagtaccgcaccctaacttcatnctcctgcctacaagcctncagca

SEQ ID NO: 3249 - DNA, 240 bp, Bacillus thuringiensis
ccccctgtaccggtggcttgagaaccatggactaatgacccgatcgagacaggcttaagggggaaagctctaaggtcaaacctgatataacgactgattacttaatgctactacaaaagagcattgattatgggagcggctacagtggccggaagaatacggacggttcgtactacttgaatagcggagagacagattgaatctataccgaagaagggtactgatgcatcaacgcgcacg

SEQ ID NO: 3250 - DNA, 134 bp, Bacillus thuringiensis
  unsure (1)...(134): unsure at all n locations
cgaaggccgctacancaancgnccctattactaacgccncnncggccncnnncgggggggaataaccaacccggggcggccgaaccaccccaagagggggcttactaggtgaagaaaatttctttccggcagca

SEQ ID NO: 3251 - DNA, 171 bp, Bacillus thuringiensis
atcattctattttgttgtggggaattttaaactgtgcctgagtttataaattcaactttatcataggtatgtatgtataggaaaaaatatatagaaataattggcactttctgcggatctaagtattcactaggggtctcagaacatattcctggcagataattggaggct

SEQ ID NO: 3252 - DNA, 379 bp, Bacillus thuringiensis
accgcaggttttttagacaacgatctagacccaacgggccgtactgcaccaaatatgctatcgagcgcagataagtcacctaaagagcgatcgggaggcttgccttgcataaggaccgtgagacgctctataagacgcggagggcctaatggatcatatactacccagatttgaccgtcaattggcaccgggaacaatagatacactggtttcggctttaaccaaaagggaccttcctgcagtcattcatatatgaaaggatttcattcatgcgctctattatctccctctgtgaaaagctcacacacatcatccttttaatccagggtgatgcccaagtagcagttgtgtatctgaaaatggagcgcgatgaacggcc

SEQ ID NO: 3253 - DNA, 267 bp, Bacillus thuringiensis
ctaggaaactcccctaaacaggctgctaaacaaacgccgtaactaacaagtcatgaatagcctggcgtgacttcatctagaagggcattccgatatatgacattgatttagccatctccttctccataccacatcgctacattcgattatttacgagcttcagatcaagacgactgccattcatcgtcactgccctgcatgaagacgcaccttgcttgcaccttcatttgaccattcacacgggtcgccctgtcatcatggtattgc

SEQ ID NO: 3254 - DNA, 245 bp, Bacillus thuringiensis
gcatacgttacttacactggaaacgatctacaaaccgaaccaacaaacactgggggctaatatattaggcataataccatcctaaatgacaatttgccctctataacatagggaggagggttggaacaaacacggatcaattggttaattgtaaaccaaaccataaagttagccagaatggctataggacataccgatgcgactgtatggactggaaccgagacaaacacctgcatgctctgcac

SEQ ID NO: 3255 - DNA, 171 bp, Bacillus thuringiensis
cggattaataatcagctcaacatgaagcgaaccaccggggggtttcatacaggtgctgtgggggttacattccacctatactgatgcacttcaaaccatgtccactggccctattccatgaacttgcacaccaaaatcccatttctacggcggtttttcgattgacaatat

SEQ ID NO: 3256 - DNA, 401 bp, Bacillus thuringiensis
agcacggctttattaggggaaatctagtgcggtatgaaaggttgtttatatgaactaaaagaagcagtagcagggcctactctgggtccgccctatgagcaagagcatatagctgcacaatgcttttgtggtggtaaagaagctcaacctatggtggattggcggaaagcgcattaatactttagctgataggtgataaaaaggacacggggctgcctaatcaaacgcagtccaaggtcctcgtgagctgtaggaagcactgcatgtagtccctacaccgaagcatgctgctctgaaaccacgcttttacgacgaatgaactgaagcactaccattaaggggtaatgtaagacccattgtaacgactgtatgggaatgcgaagcggacttcccacatttat

SEQ ID NO: 3257 - DNA, 217 bp, Bacillus thuringiensis
gaaatatcctcaattcattaaaattccaatgtcgcacggttatcaattcctcccctgtgttatcctaatttatctgaagatttatcaacattagtcttaatattcggccccgacgacattgatttttcagaaagataaaaactggcgcggacggacacaaatgaaggaatataacttcttttaaaattatattcccacccctcgctcctcttcaaaa

SEQ ID NO: 3258 - DNA, 260 bp, Bacillus thuringiensis
gcgcgactacatcaaataagccacctttctttgtgcggaaactaactaagaataaagcggggccaaccacggataggcgcgatttgagatgaccaagctactttcgggttacgatcgacaagatgtgcactggattaggtgccttcaggatgaattccaagaacgcgctatgcataatgacccgacacgatagctataagatcttggcctagcattcatctaaaatgcaactaggcctgcccagattcggcggcaaccca

SEQ ID NO: 3259 - DNA, 100 bp, Bacillus thuringiensis
gagtgactttgttgttcaccctattggaaaaacatgtgtgggccatatagacggagcgattgcaaactcatatggaaactcaacgccttcttgtgatgga

SEQ ID NO: 3260 - DNA, 265 bp, Bacillus thuringiensis
cgtgcgtgatcacatagtagcattgaaatgcacccgtctgtttagatgataaaaatcaaggacaaggctcggagtaagttgccgcctgtggcaagggacctaaaaaaaacaggccccaagccagcttacccaccacccgcaccgaaacacaagacgtcaggggtagagcgagcttcagcagaattgttatagtaaaaagagaaccatatgctcatatcgtaacaccagtaaacgacacaaccaatgcaccttccaatgaaagtac

SEQ ID NO: 3261 - DNA, 149 bp, Bacillus thuringiensis
aaggaggatcattggacgacaagactggatactcactatgcgatccgtgtaatctccgtgggggtttagctgaatacaggggagattaccccatatttcggatacagagcgtgtgccattggaagatatccgattaacacggatacatt

SEQ ID NO: 3262 - DNA, 348 bp, Bacillus thuringiensis
taggagcttcaaggggccctcaatcagcactctctcttttcgcgcattcaaccattaaacgcgcaaaatagccttgctggccagaatgcacctgattttctctgcaaactctgaaacattctatgctttccgaccatctatcccactcctttacaaacttcaagcgctgctcttcagttaaaaaagggtgcttcctaaaactaatatggaataacgccaaacttctgaggcggcaattcttccgtaccacgaatatcatactctagtgctaatagtttctctacttgctccagacgtgtcaatgcctacgctgatattctcatcccctaattgcaccatcacaaaact

SEQ ID NO: 3263 - DNA, 228 bp, Bacillus thuringiensis
acagcagactatacttaaaaaaacgatcttgattacaggcgaacacaaaacaaaggagggtggtattgaccacattgcgggcgacgcaaaacacataacaccaggtgagatcccaactactaccaaatactatatgcacctactgcacaaagcaggggataccacttaacaagcccatgaacgaaacccgcgttcgcaggaacttagagaacaaccacaaaatcaaat

SEQ ID NO: 3264 - DNA, 112 bp, Bacillus thuringiensis
aactaaattccattaataatattgctccatcatatttatcgcaggccacctttaaccaatgggtcattttctaatactttggggattcccctcttacatatgttacctttga

SEQ ID NO: 3265 - DNA, 319 bp, Bacillus thuringiensis
ccagtaaaaataatgacaccgaacggccacggcaaaacaggggaggattacaagctatagagggatccaccaaatgccgatgcacacaatgagggtcggaaataacatgcagacaagcctaaccgagggcaaacttcagatgggcaattagactgccgcgaactcgcagggaacccgctaatggcatttatcaggagaagcgagcctgcttggagaatggacttatgaccatgccttaaccataagggaatgagttaggaaacaggaaaagagggtactccggaccaagtcagagtcggtacaagtacaaccataagcc

SEQ ID NO: 3266 - DNA, 391 bp, Bacillus thuringiensis
ccatgaattagaagcaaggcatcaatgctattattttccgcccccacctaaggtaaaagagtgccatgacacaccgctttggggacgtatatcaacttcaacagctgccgctaagatcgggcggcaatcacatgtgaccgttattgcttgaagagtgaagtctgtccactgctcccagaatcacatgactgatgtaaaaaagcttccacaagtactaaagatcgtgcggtacctacagaaggcatacgttggcactaaagaaccatttcttacactaaccgaaaactacagagtgcgctcttgggccactctctgaaagtacaggggacacctatcccatcagatgaactgtttgctgtctggaagaggccaactgtcctgatatgtaaga

SEQ ID NO: 3267 - DNA, 168 bp, Bacillus thuringiensis
ggcgcgttatttccatgaccgacgcatgatcgaagatgagggggatttttaattaaaccggggtacaataacacttcatttagatagtgtggtagattctttacttacaatcgcaactattgttcaaaaactggctattaaaggataaacgactgccgatcatcaatt

SEQ ID NO: 3268 - DNA, 329 bp, Bacillus thuringiensis
ccctgttacgatctatactattatgcatttttttccctgaatgtaaattggggtattgggggataactatatttccatcgcgtgcctaattttgtatcggtggactaataaaacaatacactgcttcaagacgttcgaaagaacccatttgattacataaaagatttatactacaaccgactggaactgcccaaacataaacagctctacagagataatagtgttatgctaacactactatagagagaagctgtactgtcaatcaatctgacagattctccttataaacctatctaaaaagcgcaacaccatgtatttgccagctaact

SEQ ID NO: 3269 - DNA, 181 bp, Bacillus thuringiensis
agaattcgcgattaatcacataaatcgcactcgctgcgctcattatgccaccaccaccccttgctagtacgggggactttttgagccacttgtggtttacaaataaataccatatgaattggtgctaaacctgtgatagcattcaccatctataacaaagagggaaacactgtttccgcaa

SEQ ID NO: 3270 - DNA, 442 bp, Bacillus thuringiensis
acgaaagaggtattcataataaattggttactttttaaccctatttcaaatacgaatgtggaggagtgcgtattacgtgagttaaagactataaaaagtaatgagttcatacatatatttttacgtaaatgccttgaagaagaatacaagattccattattattgcagcattttggtatgccaaaagaagaggataatagtagttcacaagtagttattgaagagaaagaagaagcggaagagatagaggtggaaactatagaagaggacgttccaaatagtgaagtttataagttttatgaacaaaatattagtagtttatccccatatattgtgaaggaattgaagaattggatacaaagactttctggagagaaagtgttagaggtacttaaaattgcgtttgaaaataataagaaaacgttagcttatgtggggggat

SEQ ID NO: 3271 - DNA, 220 bp, Bacillus thuringiensis
tatcgagttttttgataatgctcaaatagctcaagcaggggggttaattaaagatgctctgctatgatctacgcaagatctacgatatttaggtagcgtagctattgaatcatttacacttgtgctgcatgcactactagactgaattaaacagtgcttggttgcaatgtaacactgcatctgaaacataagagggaataacacttcaattgcggtggat

SEQ ID NO: 3272 - DNA, 408 bp, Bacillus thuringiensis
atattaattcttttattgcgacaaaagctataaaattaaagatggattaagaatttttgcttgtcgcacggggcgttagtcgaagaaggctcttaaaatagaaaaggatggtactttccatccttttccttatgtattttgagtgtcgaaactattctcaaaacaagttttacactactagttgtataattaggttatgcttttatattaagaattttgctgaccgaatcttttcccgagtttagctaacaattcaggttgatcgctttggctcattataacttcaataaagataagttgattcttattaaaaattatatttactaaggtttctgctaattctgcttcattttctactttaaatgttagacttttttcttctgatccaaatatcattgatagtttatt

SEQ ID NO: 3273 - DNA, 216 bp, Bacillus thuringiensis
attgagtgacgaaggtgtaatacagatacactataatagcagtgtaaaggcatgtgtgatatgagatggaggattcttgagtgaagtggaagatgacatgctatcgagtccgaagaacataccacacgctgacatacgaggggttttagattgtcagaggaagcacaagggcttattataggtggacaaggatatactggtgcttcagatgggatt

SEQ ID NO: 3274 - DNA, 169 bp, Bacillus thuringiensis
cataacacgtattgaatgtgaaaaggatatggtgaattcgggggcagattaaccgaaatatgtgcattatctacagcaccttctaaaatttgaagcatcatatttttcaaacagggcactctgcctcacttgacgtctcgtactgtataattcgattattagaattgaa

SEQ ID NO: 3275 - DNA, 335 bp, Bacillus thuringiensis
ctacatatgacatgatgttgttgttatggataatgtggggcagcaacacggtgatttgttagaaatgctgcaggaggcacatgttgtaaattccattgatctcaatactgagtatgagacgtaaacaatctcttaatgatccgttacaattcattgctggacacgctgggatacatctgagcttcatgtatcatatgaccgaatagtgatgctagtgtatcgatatgcctacaggtgcctgaatgtgacatgtgaagtactaggcatacttttgtatctagatttagataggaaggctggtgcagcgggatcccagatctggatgaacatggcta

SEQ ID NO: 3276 - DNA, 306 bp, Bacillus thuringiensis
ggccttgataattccgaacggcacaccaagtgagtatgggggacttttagataaaggggggtgcttttacggaaccggtcggctaaggtggaacagatgattcgggcgaggtaataacacaggtgtacgtctcggacgagacgccttggtcacccgcactaatttggagagatgatgcacgctcgagaccaacaaaggaaaaggctctcagtgaggacaaagacgagagaactatttaagatatataaatggataatgtttgacatctagataccatcagtggacagatagttgaatttctagctc

SEQ ID NO: 3277 - DNA, 206 bp, Bacillus thuringiensis
ctctattttttatactgagcgtacctggttgcgaattaggggatatttacaatgatagagggcttattaactacagaatgacatacggatgcgggcagatttgtttactaactccagagtggacatgactgttgccagacactcaccgggtaccacctgtaagaacatgtcaaccatagcctatcacaagggcgtaacccgggaaa

SEQ ID NO: 3278 - DNA, 187 bp, Bacillus thuringiensis
tcatattgcaaatgataggggggtattttaaacattccagcgggttatccaatattccatacgaaaacagcttacggacgaactttggtgaataaaaaagaagaatcaacttcaaatatcagacaacaagctaaagccgataactccgaaattgtatatggcattagtgatctactggcctttccac

SEQ ID NO: 3279 - DNA, 343 bp, Bacillus thuringiensis
tctatggaacgttggtggacgctctcgatcttttactatttgagagattacggagacgaggtgtgtgagctgtatcacgaagatatgaacaactatacgctgacaacttaatatcactgagcaacatatcatatactgtcgagtacgatcatgagagaatgggcgcgccgttgatgcctggtccccatgagtgtcaatgggcatacagattgcgccgatatgctaaagaggcgcagaattcaagctccgagacgaagacttacgtgtggaccagcacattccacttaaggtgctggggtcctaatgtgggtgcaaaaggtagggctggcattcccatgggact

SEQ ID NO: 3280 - DNA, 172 bp, Bacillus thuringiensis
aataaaacagaaaagggggttatatgggaactgttcttaaatgcctacaagtgataagatataactgcagacaacgatgttgttagtgaagccacagataccgttgaaccaatggaatgatgttgacatagccaaccggctggcattataagcatcgttgaaccttggataa

SEQ ID NO: 3281 - DNA, 114 bp, Bacillus thuringiensis
ggcaaacgcgtgacaaaagggggcgtgaccgtcattctgaagggaggccgacgtaaacagaacatttgtgttcgaatcgtcggctgcgatatcagtatattatacgcgataatg

SEQ ID NO: 3282 - DNA, 142 bp, Bacillus thuringiensis
tgctaacctgtccttggccatgcgccccacttaacctataaagcttagattcagatgaactgcaccgtgtcgggatttttgtcatgctagaagcaccgtgcttcctttgttgaacgcacctgttctaaacgatttttttctt

SEQ ID NO: 3283 - DNA, 104 bp, Bacillus thuringiensis
cgccaccaccgctcatccacacgaatcacggccataccccacagcccagaaccatgtgacgcccaaaggtccaacaccaggcccagaacccgtaaaacggcccc

SEQ ID NO: 3284 - DNA, 294 bp, Bacillus thuringiensis
tgattgaattctacttttgaacgatctacaggagaatcataagcgtgaatccgacggctgacgcggggggatttttacaacgtttgtggtaactaagacgagacggcctactgcagaacgcgctatccgcttcatgtgaaacagaacacgcgccgccaatgcctaaattaccgactgtgctatgtatgggaatttcacgttcttctctaccagaaggctaaggcattgcgtgaaaattgtagttacattcagctgtaccacttctattacaaaaatgggttaccacgcttttta

SEQ ID NO: 3285 - DNA, 172 bp, Bacillus thuringiensis
ctacttcttggccccactgctgcatgtggtactagagttggaagtggtcatctggtcaacttctggccctatgcaggactcctccacaagcttgctcccttctctgtcttcctaagctctttacacatgggctcttatattacctgtcaccattcattgtggccatctgtgt

SEQ ID NO: 3286 - DNA, 125 bp, Bacillus thuringiensis
cagaagtggtgataaccgttggcaagtaaagggatatcttagtctccaaactgactaccaaatacataggacaggcttttgcggcagacttctttatacatttccgctcatctcaccgctatcat

SEQ ID NO: 3287 - DNA, 134 bp, Bacillus thuringiensis
taaacaaactatcggggttttgtttcgcgtccgaggcgagaacccccatctgaaaaagccttcttcaacgacatataacactgttcactttgtgatcgggatactaaattctaaagaaaaataatgtagcagtg

SEQ ID NO: 3288 - DNA, 360 bp, Bacillus thuringiensis
cacatttcttgaaaatttaacactcgtgataatcgaagaacgatcacagcctatgcagtggggcctatactatgaacaagagcgcgcaggcccaaacaagccagtagcacctacatactcgaacataaacaggagtcccccactatcgcatagcgagattacaggagatatcagacaaagacgtaactagtggaccgtattacatatgtactacactgagacgacaaaaatatcaaatatgtaccaaatgtaaaagggggagcacatttcactgagagagaaacctaatgaagactatcaacatctatgaggcgaaccctatgtgtaaagagaagaagactgaacaatcccatgaatatt

SEQ ID NO: 3289 - DNA, 447 bp, Bacillus thuringiensis
gttgacaggtcaagctagctaactgattttttagatggtgttccagcaccaaaccatacatgttatgagaaaggacgtatactgtaaaccttggaatgggctgtttgttgtcctgcttatgcatattgaacatgagcagtgtttatactaattataccgaatggcatctcactttctgtttggaggcttgaaaaacctatgaccatgagacgtgggccagacctctatataacttgaactactaactaatgaataatactactaaatctaacgaaaaggactaattatacaaggagaccactacatgtaaacagaatagtagtatgaggcacgacctgttacatcgcattcaaagagaactatggagatgtcgcaacgcactgtgttaactctagacgcagcaccaagaccagcaatagctatattgggagctagatcattatgaat

SEQ ID NO: 3290 - DNA, 170 bp, Bacillus thuringiensis
ttataccacggtataagtctctcctccatcctgattaaacgggagattttaaagtaacttggggtttattaatagtaaaacaattttattgcgtaactgaatatgtctattcaagtcaactgctcatacgcatgaaagttcatcaaaaccctttagcagttatggcatac

SEQ ID NO: 3291 - DNA, 325 bp, Bacillus thuringiensis
aaacaaaccgaattggggaccttttaaaccaatagggggttaactaaacttgccatggttaataaccgaccggcctatattcgtaacacgcaatctcctacctaccacttattctacacacctgtgactcaatgagacctcgacatgcacaagcgccattacagcatctcctaccatgggcacaacatgcttattatcgcactacctgtcctccctcgcgaactgaaggtactttactcatccttgttctgaatacaactcgagtttcctcatcccttgcacgtcctatgacagcttttttcatcaagagactccccctctacgc

SEQ ID NO: 3292 - DNA, 394 bp, Bacillus thuringiensis
cttgtcttgtgcaatctcatgacctggtgcttttttttctgtattcatatagacaggagttgtggggtgatgcacagataggggggcaactaaacttaacatggttactaaccgacctgcttgttttattaacgctctattttctacttaacactgattcggcgcatctgtgactcaatggacccccacatcatgcagctcattcagagcgtaccctaccatgggtgcaactggcttattatcgactcccttggctccacctggaactgcaggtgctttaatctacgatgttcgaaatacaactcgagttgctttatccctttcacgtgttatgacagctttttcatgaagagacgcggtctctactggtatgttaccgcttgtccgacttgtt

SEQ ID NO: 3293 - DNA, 346 bp, Bacillus thuringiensis
aagctgtccatctacgaaaattaacattcttttcctctcgcactgctttcacctatgacatattgacccaactatttcccatgggacgtactaactgacgccggagggaatcgcacaccctggatcgctaaaggcttatgaccaagcgccacaaattcttcttgctcagagcaacatggttcctctaaggaatcgacaaacggttctctattaacactaagcgtaatgatagcgcggcactatggacagattatgaatatccgcctacgacgccgacggatcgtgacgcatctgcgtcacgacgcgatgcattaatcgttcggcccggtctaacggtcgaccaaac

SEQ ID NO: 3294 - DNA, 324 bp, Bacillus thuringiensis
ccactggccatacacgggaaaacacatggtgctcacgtcatactgcctacacctatgagatggtctcctaaccttcccggacgtgacatactaatttacgccagatgaaatctcacaccctatatcgctatctgcttatgaccaggtgactcttctcctttatgcgcatagctacaagcttactctcttcaatcgactcacggcaccgtcctaacgcaaacaccttgattgctcgatccatctgacagataagctaaaccggaatacatacgctgtgcattgtgacacatatgtcgcatgcaatcatgcaataatcataccgct

SEQ ID NO: 3295 - DNA, 330 bp, Bacillus thuringiensis
ctgattagtgtagaacactgatcaataaaattttttaaagatgtgtcaacacaccgactatgagaggtcgtgtagtatgacgccggagaactagcaagccagggttaagtagacagcctgatacgaatgctcagtgtgatcactagcatgaagtgggatcactgacagccttcataggaaagtatgcatagacatgatccacgccgctacgagactgacctgcatcgagctattttatcggcgaattgaataagtgagcaacgctctgctgctaaatggggcggtaccaacgctaccacagcctttagcgctagtttttagagaaagaag

SEQ ID NO: 3296 - DNA, 170 bp, Bacillus thuringiensis
aattgagcatataggaacatacacatagtctatggatatgcaatagcccatgtagacatattagtagcggcaagcatcttacaattagaacgggtgaaccaaagtggggacgagcttggatacaattgtagaacaacagaactaggacgttgcggagacatatgaaatat

SEQ ID NO: 3297 - DNA, 586 bp, Bacillus thuringiensis
taactttactcgcttacaaaacaaaatttatttattttttgtatagatttttttggtaattgtacaaaaattcgaatacaacaatcattttaacttttctatttcttctttcaacattgaaatccaataaaattcattattttttattgctgctaatatccatttcgtagtgtaccaagctaactcatactcttccttcgtgacatcgacacttttataagcatcctctagctcctcttcatctaatacatacaccttaccgctaggtaataatactacatctaaatataaatcatcaaaatacggtaaaccacgatcgtctattttatattctttcgccacatcgatataatattgcactaattttttctgatcatctaacatagcggtaatcgcaaagtttttcccttctataaaatattgaacccacgtatactgatccgctgcaatacaaagttcttcaccatcatattctttacaactaggctctctcacctttttatatccagtattccgagcattcctcttccacttgctaaccgaaaactctttttatagcctcttcacgaagaccgcaccatattac

SEQ ID NO: 3298 - DNA, 268 bp, Bacillus thuringiensis
aattgggtgtcctgcaaccggcgaagaagaaataacaactgctgcagctgcaaaactttttgttaagggggggggaccaggtgaaatacatgaacttactgacgtcggcacaccttgactacctgtacataaaagaacaactatacaagatgggaagcctcctaaaggggacgcaccctataacaagtatcttttcgggcaacgactataaccaccggcttttgtactattgttaccgctgcttccatactttcgaccaaacacaagc

SEQ ID NO: 3299 - DNA, 166 bp, Bacillus thuringiensis
atttgcaggcccttccgtttatatagctccttttttttttcatcaaccagcagcacatagcaatgtggattgatttgatggccatctggttaccacccgcttcatttcacgagactgacgaatagaaatgcagtactcatcatattgctttgcctattcctcctgg

SEQ ID NO: 3300 - DNA, 119 bp, Bacillus thuringiensis
cagaacacgagatgaccactcccatagactttcccaaattttttttagcaaccaccaacgtaccaaaaagggcgggtgccttcggacaaaagggggcacaaacaaacacggcggaaaaa

SEQ ID NO: 3301 - DNA, 345 bp, Bacillus thuringiensis
ccacacgtttggggttagcccccgggggctctagaggctctgtgacacattttcatatcggaactctcgtcccaggcgatagagcaagtctcaaggggtgcatttatacaaacgtgaggtgttgaacaaggagccacattggcagaagacgttacagaatgattccatcgcgttgcccacaggtccacattagtatctactggctctatgtattctgagcttcttgcttcatatgatgggcagtttgttgaactaactgtcaatcaattgcaattattccatgagcctgtctcacacccttcctaacacattgcaccgttagactatcaggagtatcttatcgga

SEQ ID NO: 3302 - DNA, 301 bp, Bacillus thuringiensis
gtgactctgcgcccaaaatgtaccgaggctaagtgcaccacccaggctggggattgataccaatggtataacggggtagggggagctgttctaaagggcaagggctgatacgacctgattggactcggtggcagcgctgactagatgataatgcggaaaggagtagcgaaagactgctgagactcctgaccaccgaatgactgaggattgctgaggaaggctcgcacgctcatggtatgtcaggacctaaggtgaagccgacaggcgtaagcaaaggaccacatgatgatgttcctgtacg

SEQ ID NO: 3303 - DNA, 286 bp, Bacillus thuringiensis
gggatattccgattctacttgtttcagactaaatttttgattttgacaacaccaactggactcgggggaggggcggacgattaaaagacgaaacctctttcttccggagacgtaatctgcggagaacaggcgactactgttccatcttgtaactttcaggttctactggaacccggcttagcacctttccgctcgtaaaccattttttcaccatacctctaatcccaatttgggaaaattggctttctactttttaccctctgcctagcttttccgttcttctacc

SEQ ID NO: 3304 - DNA, 261 bp, Bacillus thuringiensis
cagtttgggttgagcgctatgtctgtccatttttagaaacaagcgattctgctggcatagagaccggcttcgaaacaggagggggaacacatactgataagcctgtatgcataatgaacgatgtgaatgcgactacaggtgccgaaagctgatcaaaagagaacgggtacactgacattggcttccttgtgaaatggggagagaacatgcgggagagctttatgaactggaagcaatttcatttgttgaggggaaaggcaa

SEQ ID NO: 3305 - DNA, 326 bp, Bacillus thuringiensis
ggagttgcgcctaacgtctacactcacgctttccaccacaggaaccgaatgggggccaggggagatgggaaaagaagccgcctatagacacaacgggagcacccaatggcaaaacgaccgaaaagggccacgaaacctgcaaataaaaaattaaagccgatatatacagtgatgcaagggaggggagatccagcatataagttggcaaacaccccaatatcactaataatgcctgaaccagccggcggtgcaccgtctggaagggtaaaattgcaaaaaaataacgaggagaagaacgggaatgtataaagaaagccgccccaaaa

SEQ ID NO: 3306 - DNA, 200 bp, Bacillus thuringiensis
ttgctgaaacggttctttttcacgtcagagttcgaagtctaaaaaaaatgcattcgagggagtaggggaacagttaaaacggacatcggcatctagaggacttcccgtgaatgctgtatgcacgctcatagctatgaacaagtcacttcaactagctaaaaaaccatcgtaaagaaaaaaatgcgtagctgtatgcgggt

SEQ ID NO: 3307 - DNA, 111 bp, Bacillus thuringiensis
ccaacattaacccccccagccagcccaccacaacagggggaccacacaacgtgcaaacgcacccatccagaacaacgtactctaattgggaaatcattgggggaacccaac

SEQ ID NO: 3308 - DNA, 128 bp, Bacillus thuringiensis
gctcgagaagtttgtatacttattcagacctacaatacatgtcctcaagcccaagattccccgtgcccgcatttgaaattcccgctatatacaccgaaacttccattagccatcaccaatggggcttt

SEQ ID NO: 3309 - DNA, 219 bp, Bacillus thuringiensis
cacgccataaaacttatgggatggtgcaggataagaactgtataacgatgaaacaaacaggtgctaaaccctaaagggttcatcaaaagagctagcatggcttgtaagaatgcttcgtataaccgaatgcgagcgtcattcctaatgcagaagcgaaaactttaatattatttacccatcatagatgccctgaggggaactcatgttcactggctttaa

SEQ ID NO: 3310 - DNA, 229 bp, Bacillus thuringiensis
gaatgtacctaattagtgcactaggctcagttcggttttctactagggttgccattgtggacactcccttcatgcctaggctgatcgatgctctttttactacgcgtgcattttcgcttattacagtgattatcacgaacattctagaagcggtgacattgctcgcacacacatttggtggccgaatacctccacgtgctgatcgagtccatatataacacctagacca

SEQ ID NO: 3311 - DNA, 262 bp, Bacillus thuringiensis
agggaaccgtctcctgtgggttctatgggggattacggccggtaacacacagagagtcgtctggctactaaatgatgacttacgtataggaggatataagaggatggattatgctactgacgtggaagggaggttttatataatgagcatagcggaagaaccacactaagacttaataacatgacagaaggaacttatgtgacaatgggagctgaatgccaatcgtattatttattagggcaaggctataaaaaaacagagg

SEQ ID NO: 3312 - DNA, 230 bp, Bacillus thuringiensis
ggtgtgcgacactcaacttaagcagatggcacgcgtataaaacaggcagggcgatatcatgttatcgcatgcactgccattggtatgcacaactgattgctctgattgtaagatctaccaaatctagaagggaccttgcggaaggttgcgatattacgatcgttcacgtgaatgctcacgatccggaggctatgactcgcacctgctgaccttgcgattcaatatcgcat

SEQ ID NO: 3313 - DNA, 592 bp, Bacillus thuringiensis
gaggatgtgacttcgccggagagttctgacctttggagactattaagaacgcgagccctgtaaacttaatacccatggcatgcccgaggcggtggaatttatcttgattcgttctgtcttcttgaattacatcttattgtttatgttcagtcatttgttttaagttgctgttgtatcccgttcgttatactataattacttttcagttttatcttttgaacatctgtatcatatgtgtgatcgatatgaaatctttattgataccatattaaaagcacttttatttagaattagattcatgggggctcgtctgattttgacgacattgtcggttcagtttcatgttgtctactttttaatgcgtattcctttttatttttaggaatttcgggttttttttgtcttttctcaaagtgaattcttttttttttttctttattgttccattaaacttttttgttttaccattgaatttttttgtgatttttaacatttttccatggatttcacttttttctgttttatcttttttttttaggtctatttatttgtccttttttcttcatttttgctgttcctttttatttttttt

SEQ ID NO: 3314 - DNA, 101 bp, Bacillus thuringiensis
cccagaaaccgagacaatcaacccctgcagcaccaacatctcgcctctcaagcaacaaaagcaaacccaggaacgggaggcaccgaagaaagacccccccc

SEQ ID NO: 3315 - DNA, 111 bp, Bacillus thuringiensis
catcacatcttgcgatcatagtgtctgccatgcaatgaggtgacgtaacgaccgattccgatcagcattcacaaggggcggccataaatggcgagagctgacttatcatct

SEQ ID NO: 3316 - DNA, 192 bp, Bacillus thuringiensis
cacgtcctcttactaaacgaagacatccaagttccgggggccgatttacaaggagaacgggtctcacctatccaattgacaagcgagggagctacgttcaataacggtgaaaccaaacggaatccgcctggcgacaaggtggaccacattgactcaaatcctgaccacatcagcgcaaggtctaacggacca

SEQ ID NO: 3317 - DNA, 152 bp, Bacillus thuringiensis
attcggatttatgggcgcatttatgacagctgtcctaatctatgtattaccccatagcaaagggaactggactttatgcaatccgactaacattaactggtattggactcgtatttgcactatctggaccgaccattgacctaattggatcc

SEQ ID NO: 3318 - DNA, 221 bp, Bacillus thuringiensis
ctctatattaaccgaagacacgattgatggatcgtggttctggcatggatgaaagtggaccatgagtgaatggacgaccatgttgaaaaacaaccacgcggctgtcatcgaattggccagatagtacatacggcatgcgatctactttgcccagattgtgcaattctctttctatggcatcgagagaggaattactatggggcactgggctaatttgggct

SEQ ID NO: 3319 - DNA, 210 bp, Bacillus thuringiensis
cggaagatttagttttgcaaccgtcgcttcaaatgaaaaatcgtttcgtaattatcgtggaaaactcagctagggttatcttcggcctatttttcatccggctctgctttgcctgcccgtgtcgtaatggaggatgtgccgagtgtaacatacgtgagaggaagaagccagggcaggaacaataaaaggtcgtcatttatggaaagcctt

SEQ ID NO: 3320 - DNA, 159 bp, Bacillus thuringiensis
gacaaaaagcaacgtaattataaagagctacttatatatagcttgctaacgaacgacaggagggacaaaacgaacaaggcaaagcaaaccaacacaacgaaacgttagtgagggacaaagatgaacgcaccctaaaaattcaataaaaaataaaagcgg

SEQ ID NO: 3321 - DNA, 146 bp, Bacillus thuringiensis
  unsure (1)...(146): unsure at all n locations
aaaggacccacacagagtgagaggaaggggaatgcgcaaggaaagatgaatttattaacgaaggaagacacaaattggttagagagggcacggagnttaaagccggtcatataaaaaagaatgtaaaacacaccccagggcatacg

SEQ ID NO: 3322 - DNA, 104 bp, Bacillus thuringiensis
aactggggacaacggctcgctatacacacgctaaccgaacagaatcaaccgccccccgcggggggacccagcaaagcaaatcagcggctagaaacacagaaggc

SEQ ID NO: 3323 - DNA, 256 bp, Bacillus thuringiensis
atgattggtttgattattataagaccttgttcgtatcaaggatggcactttctgaactgggggggtgctgttggaccaagctcaggtacaaggttaattgcttcaaccttcttacttaagttttctaaaataatcaatcttattgagccccttatttcgcgtgtatgggtcgatattgatgagaacaatgacaggaaacaataaccttttttttttttttaaggtcaaacacttcaataatcccaaagggtttttt

SEQ ID NO: 3324 - DNA, 441 bp, Bacillus thuringiensis
cgtgatatttgcgagcgcacgacacagtatggcctaggtttttttgcgctgttagacagaagacatgggtgtctacgagcattgaagatgttagtactcggtcaagcatcacatattaattaatgtgtaaaagaatgggtaggaagacgcgcatcgaaggactttgttgagcgctctgtgttaccagaaccaatactaggtatgcttacacgcacgatttcactgctgtgtgtccaatgaaatggatcgtaggattgactactatcgagaacatgtgtttggggggtgcgtatatggatgggaagaagaggggtcctaaaacaggagcggggattaaggttactgttacttttctcatcacacaataccctttttactgtccggagcaacagttggggtttgctacatgaaacatgagggagtttgcgatgccttatggcc

SEQ ID NO: 3325 - DNA, 216 bp, Bacillus thuringiensis
cgcacaggtaaacgtgtgccatggtggcttgcttgtactaaccatctcatcatctcagtattaagcccagcatttcttcctgatgttcttcccccacacccctatcaccccccaacagacaggccccagtgagtattgttccccccaatgtgtcctcgtgttttcgtcattcagctcccacttataagtgaaagcatgcggtatttggttttctct

SEQ ID NO: 3326 - DNA, 328 bp, Bacillus thuringiensis
tatcctcgagtgttgtgggcatttcagtgctcacaaatgaggaaacgatgagaatgatataaacagatcggctacgaatacgccgcgggttgtggtaacgatgaaacaaactcatgatttttactcgatccgctggcacatcgatacgtccagataaggacacattatgtagttggtgaaagtcctatctctagactagacttcactcacgtagcctgagaggcaccatgatgtgaaagccacatggcgaatccctctgacctcacatgcataaggcatgtgggcaaagcttcaggttgtaacgttcaaacgacgtagatgtagactc

SEQ ID NO: 3327 - DNA, 336 bp, Bacillus thuringiensis
ctgttccagcggctagaatgttcggttttttttcttattcctacgtggcaagaagcgccgggcatgatgaagatttcatgacgcaccacaatatgaacgagcgcgttgcactttccattttaaatcacatccgtagccatacagcggaggagtaagcctttgaaccggtgcgaacagggccgttttatcccagcgttacaggagttctattgggttgattaaatccattccctactgaacgggcctcagatccgtccccttgtcacatgctggagagggtccacttcagtcccatacgaaggctcctgcttgggctactgatcaggtgtcaaaccg

SEQ ID NO: 3328 - DNA, 256 bp, Bacillus thuringiensis
gaggtaattgttagaggaaagtgttggtgctatccggtccaggactaggtgcatgccttagaacctagcgggttacttgaaaacgacttggacagcctgtaacaggtggtagagaatcatatgatacaagcgcaagctcaactggaaactatccatatggataagcaattctgcggcggatgatatgagcgggcgttgcaagaccagagctggcacgatcaatgcaccgcagtgatttagatgcatggtaatgatc

SEQ ID NO: 3329 - DNA, 222 bp, Bacillus thuringiensis
cgacagcatgcctgaagtgggtcaccgaacataggactggcttagggtttaatcggcaacctgattggctcgcacagggtcgaagggtcgctcttagggggcccttgttactagaagatggagacacacgacgggtcctagtgcgttatctacaagaggtttgcgcgtaccacggcacagtgaggggcaggccattcatgatcgtaaggcaaggtggatacg

SEQ ID NO: 3330 - DNA, 293 bp, Bacillus thuringiensis
tactgaatactttaaccgggtttattacagaaagggtgctgctgtgtaaggtgctcactgtgaataacatggtgaattgaaacatatcgatctggagccatacacagactggttatgagggacagttgaactacatttgcggtgaaacgcatatgctttcggcgcagagccatccaaaagcccatattatatgctgaaatggaatgaacatgcaatccgacctatcaattaataaacactatgcaaacaggtgcactcgctatacatggtggcatgggaccataagaccgatc

SEQ ID NO: 3331 - DNA, 325 bp, Bacillus thuringiensis
ggaaaaatgctgacacaaaagtataatctacagcatttatttttaccaaacctaaaaacaagaacaaacgggggaaaaaaaaacaaagaaggggcaacacaacaaatattatcaaaagcaacaagaaaagaaaaattaaggcaaatcaaaagatcaattaaaagaggataagggaacaacaaaaaaagcaaacgggctcaaaaggaaacaaaaatcaacacgcacaaataagaaaaaaaatcaagaaaagcataataaaaccaccaagaaaaaaaatagaatgaaaagatagaaacacggcaaagacaaaatctcagggaaacca

SEQ ID NO: 3332 - DNA, 402 bp, Bacillus thuringiensis
cacaggcctacgcgacctgcaaagggaggaatgcttgacccacttagtcatacaccaaaaagctctagcccataacaaaaaaccgcctgcaagcaggaacgtttgtcctgtacaaggaccaaacccaaagaatacatcagaaacagacgagcatgcatacatacgaatgaggtatcaagaccattgcaaaccatagaaaaacagatgagaaaaggaaggatccaggacgcttcatgaacgatcacataaactattaccgagacatgcaatactctcaaaccacaccgcaactagcacataaggagcaacgagagcgtgtctagcaacaaacccctcaattgagtcaacaaatgcaaccggaagtgaactatgagagcatgcataccctcaggcaggcacaac

SEQ ID NO: 3333 - DNA, 226 bp, Bacillus thuringiensis
agatgtaacgccagcaaaccaataaaaagcgacaggttttttataaaagggcacgggacacataaaacagggggatgggggcgtaattgaaaagggatagaaatgacttatcacagcaaagaaccggtaagaaagcacaacaaaaaagggagcgaaaggggaaatacaccaaaaagctttaaccagagatccctcgccaaacgaacgaaactgtacgcgcctacct

SEQ ID NO: 3334 - DNA, 283 bp, Bacillus thuringiensis
ccacacgtttgatcaacagccgggggtggctcaacaagcttgccaactaatacacagtgcttttccttttaaagctgctactagatgaatccccggggggcactcttaaaacatgcgtcgggtaaacaacaacttttacatactccgccttcgctactggaacaacggctttcgcaaggagcagcggcggacctggtacttctccaacaacctaagctttatgacctacttgttccacatctacacctagagcaacatctgcaccaagagcttctcttgcaac

SEQ ID NO: 3335 - DNA, 295 bp, Bacillus thuringiensis
tgcttacgccctctgacgcaccatatgccattattttgtgtgcacccaatagtcatacaaccgcgggttcttttgctaaacctggcgcgtttgcaacacgaagaattattttgcctgctgcaatttaaggtccaccgtcgctgttactgacaactgtcgggagtagaaaacagagttgaatacaccaacttgctcggcgccgaataccctatgtaataaagggtatacgcggtggataccgatgcagccagcatcacagtacaagaatcaccgcaattgctatatttgctttgac

SEQ ID NO: 3336 - DNA, 253 bp, Bacillus thuringiensis
accgagaagaaaaaaacaacgggggggaaaaaaaagggacagggcagacgacaagctcaatagcgcaacaggtgctagtggagagaaaaaacccgaggaagggaaagcaccaaaccggggaaacaaggagaaaggaaaaccaacaagccccacaaaagaggaaagcaaaccggcaaaagaaaaagaaaaaaagggccgccagacaagagagggggcggggaaacccagggaaaaagaagcccggcaaggaggg

SEQ ID NO: 3337 - DNA, 352 bp, Bacillus thuringiensis
catactgaaggtgaatacgcagcggggagttactataatggatatgtgctggcactagctctcgacatgatttagacgcatctcgcagtaagaatacatgagaatagatgatcagaaaaaggacggtaacggtaaatagctcctactggggggagaaaccatatgtgactcccatgtgacaagcaacgctgacatgaaccctggaatattaccacgtgaatctctaccggcaccctaacttacctggcgattgataccaaaaactgattatggcgtgataatggggcgacgcgcatcagtgacatatagacctgaagatcttcctttacgactgaggaaaacaccttggtga

SEQ ID NO: 3338 - DNA, 383 bp, Bacillus thuringiensis
gtagttgttctaacaatcggcggatggcgcatcgatgggaaattatcggtggccaggagtaggtttaggctattggtaaagagtttgatgcatcgtttggtggacggattacattagagagcgatgtagcagaaggtagtactatagcaggttatattactaaccgtaccaaggtatggctagatatacagtttttcaattttgaagtgatatgcatcatggacgatgctaatagctggtgcacctcataaacagactatgccacctgatgcaccaaggtggcgtttttcaagcggaatccaaataaaatgtgtaagatgatcatacaattatcgacgggtttccatgcggataaaagaaacaaattgccaacattgttactg

SEQ ID NO: 3339 - DNA, 241 bp, Bacillus thuringiensis
taccttgacccgaaaggattattttacagggcctaaaggcctatttaaggggggactatatatatggtccgtggccttcacaacctggaggccttagaataacaaagcaaaatggtttgttccatttctgaccaatttaagttaaaacacagattacacagaataatgcattgcagcacgatatttagaggacagctcacacaggattggcgacagacccacataaacaagagttacatca

SEQ ID NO: 3340 - DNA, 374 bp, Bacillus thuringiensis
cccagccccaccggtaacgggagtgttaattaagaacccgggggtaaaaaaaacccagaatgacccagcataccctactgacctgagcgcacacatatgccgctaaataccctccctcccaaagcgaccgaaagcgcaaaagacgcgcccatccccgccctgcccactgacaaaggctgacaccgaaactcaagagtgcccaccctacaatactgaaagctgccataccaaataaaccatgggctccacacgcatctgctggtcgagagactccaacaacacctggaaaaaagtaagcaaacataactggcacaaatactgataatccgatcaatagaaaagcccgtagaggaccgcaaagttcaattccgaac

SEQ ID NO: 3341 - DNA, 498 bp, Bacillus thuringiensis
attaaattctttttatggcggggttgaccacttcacctaagaggagactgtatacgctccttgtgggtgcccgcctaaagcccaaaggatgcaaaaaacctggtataacatagccacggattcacagccaattggaccagaccctagcacacctggtacgagcaaaccatcattaccattgaaaatggactcagctttggctatcattggcactatagacacaggaaccatgaaaatgtacgaaaagtattcaatacatataaagcccgtacaacaccaataccgagacatgatgaacatctttagtatactatagccttgcatatggacctactacattagcgcccttaaaataatattggacagaggccggtagaatacttgaatcttcccaacaagctgtaacacgtttatatgccgcggaatttatattctgagcctcgtgagaaacttcctgcaaagcacctacatagtctcgcccatattcattatacctat

SEQ ID NO: 3342 - DNA, 410 bp, Bacillus thuringiensis
tatataatgcatttttattccttggtgggggatatcaaaggcggagtcgcttatgctattaagagccgtttaccgcagctcccttaccactcaatacaaacgttttatatatagcggctgggtctgacaaggatgctcgtacatagctaaataagaccgcctataatatcgagcgaggtcagacggccactggcgctgaccttgaatatgataaagaacacgctgctgtatcaaatgcggctaccgattagcgatacattattgctttaaaacaaccaaggggctgcactagctctgcttggactagatctaatccgattccttacacgcgctacgccatctgaagaccaagtccaatatctagcacatgttctccaccatatcagtgagcatctcttccaccatctaaa

SEQ ID NO: 3343 - DNA, 212 bp, Bacillus thuringiensis
  unsure (1)...(212): unsure at all n locations
cccacggccaacggccaaanaaaggcagnccgccacagggaaaaaacgggcgnaagcccccagtacccctccggaagcaatcgcaacagaagaaggcggaaagacaaaccgagcctccccaacagaagcaaaagaggaggaaagagtacgaacaacaatcaacgaaaaccagaggagggccaacatttaacagaagaggaaaaggaaaaagc

SEQ ID NO: 3344 - DNA, 354 bp, Bacillus thuringiensis
  unsure (1)...(354): unsure at all n locations
aaagcaagaaacaacaacagaccaaaacaggcccaacgaaagagaaagaaccgacagagcgnacagcgaaacaccgaagggaaagcgcgaaaagagaagaaggcagcacgaacggcgaagaaacgcacgaaggggaaacgaaaaaagcgcaagagcgagaacaagagaagaagcgggcagaaaaagcggccgcaaagacagagaaaacgaaaacgaagcaccancagcaagaaggacaacacccacgcacgacacaaaaaccagaagagccaaccggccaacaaacaggcggacgcgaaagcaaaagaacgacaacggcagaggcagaaccgacaaacggagaacgcaacgaag

SEQ ID NO: 3345 - DNA, 114 bp, Bacillus thuringiensis
  unsure (1)...(114): unsure at all n locations
gcaaaagcccgcncacagggcggaaaaggagncaaaccccaagaaacccaaaaaaccacaacgtaaacaaaagctaacgaacgctgaacgcaacaaaagccacccggaaccaaa

SEQ ID NO: 3346 - DNA, 210 bp, Bacillus thuringiensis
cccaaaagaagaacaaggaacaacgaaagaagaagcaaaagaacgcacagctaaaaaaaacgaaacggcagaagcacgtgaacaaaccccaagagatgcagccacatcaaacgcagcaaaagcagcaaagcaacagaagcttgcagccaaagcaactggtagggatactagggccaaaggcggcaacaacccacaagcactgacagacga

SEQ ID NO: 3347 - DNA, 420 bp, Bacillus thuringiensis
  unsure (1)...(420): unsure at all n locations
gattcgtgtaaaattctagcaccataaggttangcctcttggacagataaactcaacggggaatttttatgcctgagaatccctttcttcgcatgtgacattattagattcagcgcaaactttattatgaatactatcattttgccggattaaatcggttcctacaactgtggtcattgcactagatgaaagtagaaaccctcagaatatgttcatactatacccgccactctatatactcttgagaactctctaatgcggataaaggctaagatctgtatataatatatatacgcataaaataacttttgcagcgaaatctatgactttattaatactaccatagagggaaccatgaatagtcgtcattttaccacagactcctgtacactatacagaagaatagtaagtgtggcgcgt

SEQ ID NO: 3348 - DNA, 111 bp, Bacillus thuringiensis
gtgataggaagatgcttttcttacatcccactgagcactcaactccttcccctccgtttccccttggtgtttaagggggacgttttcaatgcaacccccaaaccaataaga

SEQ ID NO: 3349 - DNA, 342 bp, Bacillus thuringiensis
  unsure (1)...(342): unsure at all n locations
aaacagggcaataccgccggcaacggngaaaagacccaggggaccaaccaacgcgacaaacgcggaaaaacggnagaacgaaccgcagaacgagggaccaaaagcaaagcaaaacggacggaaccaaaaaacaaccaagnagcagganncaaaccgcaagaaccaacacgaaccccagcacaaaaaggaggcacgccaccatnagncaaggaacacacggcccggacgcacaagaccccaaacgtgcagaaccaatagagaacgccaaagcccgcgaatacgaaaaaaaaagcagccacgggaactggccaaattacgccggtccacaagcccgggaaagac

SEQ ID NO: 3350 - DNA, 298 bp, Bacillus thuringiensis
  unsure (1)...(298): unsure at all n locations
cccgnaacagaaacccngnaaaggaagaagaaggtgggacaaaaaaagangcggccccgccacaccccgcaaaaggtatattacaggcggccgagaaaataggaaaaccaatcactaaaaatgtatcaacacatgcgcatgatgaccacaccggcgcaacagatgcaccaaaggaagcacctccccacgacccagaccataaccccaagcgggacgcaaagcccgaaagaaggagaaaacgaccctacaaaaggacgaacccaacacacccgaaccaaaggccggccgcacccaaaaa

SEQ ID NO: 3351 - DNA, 366 bp, Bacillus thuringiensis
gaatacactgagcaccctctcgttcgggacgcattctatctgtgctgccagaaatgaatccacggggggggtaataataatgcatcgcaacacgggccctattacgcctaaagcattgtagtggacccagatacttgtgatatctgaacggctaactatggtatgagcagtttctatatttaccatgcaaatgactgtgtgttatataataaacatttcattcaaacaggtaaaaatacagatggtgacactctatggaatgcttacgtactctgatatagcgacgtaaacccgccttatcttatcaaacgaggaaaggaatggagagggacaacatgtggtatcttcttatggggaagacagtga

SEQ ID NO: 3352 - DNA, 423 bp, Bacillus thuringiensis
accggtccggccattgactctatggctcctaacttatctgtctgaactgctgggtttgctactggagctcctgaaattgtgcgaaacgcttcaccaaatactggaaactcagataaacctcgaaaaaatgaaacaaccactaaatccacatgaatgctcgctactactaccatattggtcaacacttttataatccaacggtcacacattttggtatataagttgaataaccatacaaaaaagtcatagtcacaaagaaattccttacacgagctataacaccatctatgttgagagatataccatgttatatcatagctgcgcacccgaagagatagacggatacaacaaactcgttcaagagacggcatgaaatccaataaataggcaattattatgaatgaccatccccccacgaagtgc

SEQ ID NO: 3353 - DNA, 200 bp, Bacillus thuringiensis
  unsure (1)...(200): unsure at all n locations
acaaatttcagaccccnnnagtaangaccccccaagaggaggagaannngagcgggaaaaggagagatatacccggaacaaccaaaaaacaaggaagcgaaatttaggcaaaaacacgccacggaagtaccaacggcaacgggaaagaccctccccaaagtcccagctagcctacacattggctacccctactcacaaat

SEQ ID NO: 3354 - DNA, 180 bp, Bacillus thuringiensis
  unsure (1)...(180): unsure at all n locations
cancaactacccaccnancaacacgaaacaccgcatggccaaaaaaaggaaccgacccaattcccaaaagaaaccccaagccaaacaaaaagaaggccaagaaaaaaagagcacgacgacaagaaaggcgcacaagaatcatcaagaagcacgctggaaaaaaaacaagaagggggaacc

SEQ ID NO: 3355 - DNA, 184 bp, Bacillus thuringiensis
tacaccgacaggtcccgtgaacactattatgccttcacgaggatacttcgagaataaatcccaaccgacgatatccaagcctgttataatatgtacaaatatagttcaagagacaaagaatataaatgaagtgcagtttgcttgaatacacaaaaacggacacaggttcttcaaactgccaaat

SEQ ID NO: 3356 - DNA, 242 bp, Bacillus thuringiensis
  unsure (1)...(242): unsure at all n locations
cccacagcaaacaccggggagaacacgagcaacggagagcaaagagagcacgagccccccggacacacaccaaggggagaaaaaacacgaacaacacagccgaaaggagaccgaccanccgcaaagccaagaagaagaaaacccaggcggaagcggaaaggaacggcccaggaagagaaccaaccgaagaagcgccagaaaaagggcccagagacccagggaggaaccacgaccgaaccgac

SEQ ID NO: 3357 - DNA, 311 bp, Bacillus thuringiensis
  unsure (1)...(311): unsure at all n locations
gtgacactatataattttnggccccggggattaacccaanggaaaaagnacaanaaattgtggttttaaaaggaaaagccccttttaaaccccnncccggcaaagnntcgcataccaagaaacgctattttcttatcaataaaattttttctaccccgtaataaaaacaaaccgatataattccatttcctattgtataacttctttaaatattagataattttgtaaacgtcagcctataaatggaatgtgaattctccaaaacaagtcgcaaacaataacaatcttcaaattcctttattggcagaaaa

SEQ ID NO: 3358 - DNA, 422 bp, Bacillus thuringiensis
  unsure (1)...(422): unsure at all n locations
cacaaaaaggcgaggatttgcggggagaaagaccttactccaanagagaagggnnnagcancaacaaagcgaaagcgcagcaaaaaaaacaaccaagaaccagccgcgcaaagaaaaggccnggctaagaatatgtccgcagatatcacttgaagctgtaacactttcgtaacactagattgagaaacaagagtattagctaatccacgtgaacttgctaaatcaatgtgacacgttacagaagtttcgagtacaaacatgccactacctcgcactaggaaaaaatgacctctatacacatgctgactaataactgtacgtatcgtattacggcctactagcgaatgagcaatcgacgctgggtctgcaagaagttttttcgcaacagtaacaaggccatccaggatgggtagattaacaca

SEQ ID NO: 3359 - DNA, 388 bp, Bacillus thuringiensis
cgtgattaattagagttaatgttcctctttcacaaaccttttttccaattgcctcatgaatagcaccgggggcgtttgttccgaatttgtctgccaaccctagtcttgcactaataaaaatggctcttacaaactacatgttgccagatgcgtggctgtttatcttcacggggtaacacatgctcttacaccacgattaatacttatccgtcaaatcaaaagcgactcagcaaattcgcaaagaccaatcggtttataaaaatgacacgacatcgttggaatcatccatcacagaaggacatgcagcgtcaacaagctgctcattatacaagaacgacgcgttcaatatatctttcttacacatagggcaatactaaggctcatacat

SEQ ID NO: 3360 - DNA, 157 bp, Bacillus thuringiensis
ccgacgacagcagagcaaaacccggagagggccagccttacgcagcagggaacacagcgggcgcccggggggagacgcccaagggcgaacaagcgcacccacagcggaaagaaagcgacggcaggcagccagaggaggggaaaacgaaaaggaacgc

SEQ ID NO: 3361 - DNA, 169 bp, Bacillus thuringiensis
tatatgctgtgttcaaatgtcctctcagaattaagagaactaaatgaacacgtgggacccttcaaagaacttattgcaaatactgaagctctaggaatggtaagacagtggctagatgaatttaacaatcaaagtatatttcacatttctttatttaccatgcccaacc

SEQ ID NO: 3362 - DNA, 384 bp, Bacillus thuringiensis
cgcgagcgcttgcgtttgtttagtgtgttgcaactaggtctagtccttaaaggggtttagatgctttgaaaaaaggtgttgttttattgaagtttaccattgtacaacttttccttagactcatgccaggcgcggttgtgatttgcatattgaagctgtatgcacaggcgattcatttccaaactaaacacgaaagtgttgcatcattggtaatgtatacagacttattattaaagaatgtgaacctgttttttccattgcatgttttaaagctttgtgctgtaatgatactttgtaagggagattatgatcgcacgccacctgatgcatcgggaaggtgccttagagtacttttagttgtcatacgtatgagagcgctttata

SEQ ID NO: 3363 - DNA, 193 bp, Bacillus thuringiensis
taaatcttcactaaaggtttactctgccgaacgatacctcacagcaaaaaaagtgtgtgatactagcagacgaggggccggtagcaagcaataagacatatccactaatatggtacctcttctaattattatactcacacctcaaaccacgaatatgctaaacaaatcattacgcattattccgttttattca

SEQ ID NO: 3364 - DNA, 231 bp, Bacillus thuringiensis
aacgccccgcacccagagagagccgagaaagacaattgatctttcttccgctttgtcgatcactgactcactgacctctgtcgcgctgctaccatatgttgtataaacgttctctaagggaagttctgccatggcatatccccctagaaataaattatgccaacgttttctgttgaggtccattatataacgagataggattcaaaaaaattaaattggataaatattata

SEQ ID NO: 3365 - DNA, 378 bp, Bacillus thuringiensis
aactggataaaaattcactataataaatcctgataccatttttatataaagaactggcatatgagaaagggtgtccgacataagggctagttgaacacacttatttgacaaatactacaaacgataaattaatttgggtacttacagcgttacttacatatcttgctacagatggagaaccgcccggattgagactagcactatactgtgtgctatataaactgtcgttggacattgtgttggaaaagaggtgacaactacttgattggagacaggcttgagatccactagcagcattataaggtattagcagacacctagactcaggatctgtagtattttggggcacaccattaattattaaagcgtctggtataa

SEQ ID NO: 3366 - DNA, 167 bp, Bacillus thuringiensis
gctatatactagaaaaaaaactcgatatttgttacacaacgattggttgcatggaagaaactcgccctcacccaggtgtggaacacatgcttttttaggagaggacactccctatcccggtttcatcacacaatatgacagcagtatttctagcttgtagctcttgc

SEQ ID NO: 3367 - DNA, 352 bp, Bacillus thuringiensis
gaagagcgataatccctttataaacttgtgcaggcttctcttctaggttgtaaacagaccttgtatgttacgtgaagaaataagtgttgttgaattgtgggaagatctattgctgtagactacagaccttacatcggacaggagacgacgcggtcctttttcacccccaaatgagttaggataggtgttttcgatttgtttgtaagttcaattgaagataagtcagccttcacggtttttgtatcatagcgagtataaagcggcaaatattactgccgtcataaagaaggagccggagatacacttttgttcatttcatgcgtcaattaatgatgtgagtcatgaacgacac

SEQ ID NO: 3368 - DNA, 102 bp, Bacillus thuringiensis
gcgagaagcgcgacgacgaactcagatcaaagataggacaaacaccctctcccagcgaaagacaaaaaacccgcccagggggcacccaacacgacaaaagac

SEQ ID NO: 3369 - DNA, 415 bp, Bacillus thuringiensis
ccgtcgggcccgccgcaatattttacgggccaccgccgggagaggcgttggggagggcgctctccgtcctgctactgaccgtgcgccgacgtcggcgcgggagcggacagccaccaaggggaaacggtatccacaaacaggaaacgcagaaaacaggagcaaggcacaaaggcagaccgaaaaaggcgcgtgcgggtctccataggcccgccccgacgagcacacaaaacgacccaagcagagggggaaaccgcaggacaaaagaaccggcgttcccccggaagcccccggcgcctccgtccgacccgcgctaccggaacctgacgccttctccctcggaagcggggcttcccaagctacgctgaagatccagccgggaggcgtcgcccaagcgggcgaggcacaaccccgtcag

SEQ ID NO: 3370 - DNA, 245 bp, Bacillus thuringiensis
aataacatctatattgttgctcttccaaacgaatttgctattagcaagataatgatccgactagtgcgttgggatttcttcaataatgactaaaaacgctcgcacttgcttcaactggcttgccgagtcacttgtccacaaccatgagtctctaggcagctgaacaggggtgttatacatagcgtccaagtacctcctttagaacagccttaacgcaaaagggcataacctataaccattcaaaa

SEQ ID NO: 3371 - DNA, 128 bp, Bacillus thuringiensis
atggaagccaagatagggggtgtactaacaccgaacttatcaggaataccgccaatgccaagcatagatagcccataggctgtcgaaagatgtgcacaatgtgccgtaatcatattggataataaagc

SEQ ID NO: 3372 - DNA, 108 bp, Bacillus thuringiensis
ccagaggtgctttctgcgcgaaactgttattcagtcacaccgctacgcaacatacgagccctatggataatgggccaagcctggggggcacgacgagtgagctctggc

SEQ ID NO: 3373 - DNA, 300 bp, Bacillus thuringiensis
gcactgttagttatcgttactttattttcagcgcttaatatgatgacggattttgttgataatacacagaaggtgaaagtacagccgattttatataaaacggtgacgtatttacctactcttgttacacatggcgtaccacgatttattttatctgctgacggctcgatgtctggcttaaaatatgggatatgaaacggaggtgataccgcagaaacaagcacttaagtttattacaggagagctgaaggagacaacgctgggacatggtgggtattacacgttgcttgctgaagacgc

SEQ ID NO: 3374 - DNA, 233 bp, Bacillus thuringiensis
gaaccttgacttctacattacctacgagtgcttagcaatttttgatattcaccagctggcagaccgaatgagggggcgggtgttaattgaacagctccacctgctgcacgatcgactaataacactttatagccttgttcttgtaatgagctgtcaatactcgcacccgattcacgttgagcataagatactatatctactggtatttcatgcacaatggtgcgttgctaccg

SEQ ID NO: 3375 - DNA, 298 bp, Bacillus thuringiensis
gcatggtcacatgagatttatttgttatagcacgaggtgcatggagcacgaatttactaggatagaagcaccgggaaagggggccatatccatatttaaggagaagaggtcgctgccatatggacaatgatcactggcgacacaaaaactcgctcgatagagattatgtaacagaaacgagcgtgggactaatcggagtggcacactctgcctatgaatatacagtgaatgagacagtgcagcctgataggttcactgaaaaattagagggggctattacattgctgccagatgagaa

SEQ ID NO: 3376 - DNA, 395 bp, Bacillus thuringiensis
aacggcatccgcactcattcctttttttcgaaccgtccgaatgcgttgagatgcttggcccgcgatcctagcggcagtgctcactgacactatttgcggcgtgcttactgtgatacgaacattctggatacctgcggacacttgtatcatattggcctgtacgactctctgcgagaggctatattgttgcatggcgctgttgcgttcttcaattccacgactcgaatgctaattcggatacttgatgtgcgcgtgtcttatttctaaacaaccgctgtgcatcagacatccaccatctcgtgtgatgagcgcccgcttgatctacagagcggaagtcagcgataagccagctcggtcggcagagcttaagactaccccagcactacctgctaagc

SEQ ID NO: 3377 - DNA, 201 bp, Bacillus thuringiensis
aattaccttgcataagaacggttcggaaagtaacgtcttttttataccccaactagccctaattcgaatggacttgccacatgttggactaaacgctctggcatatacgtataacctacttagctcggatgagaatgaacagagtctaatacatctttggcggggttttggacacaaatcaaacggtggtgtaatatatac

SEQ ID NO: 3378 - DNA, 350 bp, Bacillus thuringiensis
atcacacaatctgggggtttttctgtataaaagcacgcattacaatgcctgatacggggcttatacgaataccaggcccggttagcgattaccactgtgggctctgcttatctagcccaggtccaaaacgctgaccataactcctttgtgtctcaaccctacaggaccgtatgctactggatgttttctaactgcagacttgatcgggctcatttctgttgcaaccctggactctgactggtacatttccgacagggttatttcatgacgcgagatatttcacccgagctcctctgaagggaaacatttacttgcgagtcgtttagtccacgctcttgtatggagaaccc

SEQ ID NO: 3379 - DNA, 210 bp, Bacillus thuringiensis
ctcgctaaaacaattacaggagagaatgctagctatcctactgtttcctttaagtaaagaggaatatctacaattttcaaagatcggtaaagatgacaccatcggctttgtatcgctaaaaaatcgaattactgctaaacggaagactgccaccagcaataggagacagtctttattataacggatcataggtattaggacaagtaccat

SEQ ID NO: 3380 - DNA, 185 bp, Bacillus thuringiensis
ctgcacaattcagatttgtgttaaggacagaatctcctcaccaaacaaacgaacgacgcgagacgtctttgttcaacggattatcgcggcctatgacaaagcggactgagcctattagccaggatcatctgttttagcatgctaaggggggccaacgccgtatttctcactatcatgagagatca

SEQ ID NO: 3381 - DNA, 163 bp, Bacillus thuringiensis
ttcgccccgaagaacgtttagtattgaggggctgtttggaagtactgcaaggcggaggggaatgacgcaacacggactacgaccggggacgcttattatttagaatcccccggtgactggaaagagttggtacaactattggccggattacaccaagagaaac

SEQ ID NO: 3382 - DNA, 271 bp, Bacillus thuringiensis
atacattactagaaatgaccttccatgaagaagcaaacatagggcgtgtgagtactaaaacgagccgttctagaaatacaagatgcggcaacatacacaagatggatgctgtcaatacttcataagaccgcgccccatatgacaactgtaaacgacattgatcaagaaaaaagtcgtcctgacacattaaaacttagacaagataaatgagccaatgcccgctcgaaacaacattagttttccatcaacctaaaggacgttcatttacaca

SEQ ID NO: 3383 - DNA, 107 bp, Bacillus thuringiensis
gaatgagtatgcgcatttttttattgatgaccaggggcaggagaagatgcgtatatgagcttaaaccgcgaggtgtgagagaaagcatctcgcctggaaaagcgctg

SEQ ID NO: 3384 - DNA, 203 bp, Bacillus thuringiensis
tcccatcctgcaagggggggggtgcttttgagaaaacataaacctgggtcctgtgccaacaaaggtggaccctaaaatagccccacatattctaatatggcgcttacgccccataacgacaatgggaccatatgcaagaattattgcgttgggccagtaataaaatgcggttttggacccgattccttggttataaggaccag

SEQ ID NO: 3385 - DNA, 304 bp, Bacillus thuringiensis
cagagtgattgattaatgcagccgatcgacaagctcgttttttacaaacatgacccctcttctctgggcaatacagagactcggacgctgctaacccagaggctttcctgttcctgtacccggtacacttacggtattacgagactcgcttagccccgaatatatctcccccatcatcactagaggacgttctctactatgaaactatggcatatgcggttcccacttttccatcagtttgttcaagcaagcatctaactctgatggccacggaaatactaaggcgaggggagggatccgatct

SEQ ID NO: 3386 - DNA, 118 bp, Bacillus thuringiensis
ctaaggtctggaagctagttcacaattacattttgggcttttttatggatctacatggctagggagtatgggacttgcaccgggggttcaaaggtttaacactaatatcatttatagc

SEQ ID NO: 3387 - DNA, 144 bp, Bacillus thuringiensis
catgttcattttcacttttcagacggcaccgatacagaaaatgtgcggggagcctacacacttgggcgccgcttccggagaggcgacgcatttccacaatggtgaataaaaattcactgcaaatttgggaggttatttattcta

SEQ ID NO: 3388 - DNA, 199 bp, Bacillus thuringiensis
aattcggattatctctattgatcttgacttgcttttatctcgcaatctacttcataggctgggggtattttagaatacccgggagcccccaacagttcgatggcagtcttatgaaaagaacaacttttgcttgcaaatttaaaagcctcttctgcccagcagagaaccaattaacccgtactcaccactaatcaggaaa

SEQ ID NO: 3389 - DNA, 401 bp, Bacillus thuringiensis
cagtatttgcggattatcgtctcatggaaggatcaactcgtgggctgcgggccgtcagtcgtatatgattcgacgtcgcgcagaacttgggcctcaagccatgctcgctgtcacgaaaaatatccagcaaggccagttctggacaacgcaacccgtagatgcctcagaaaaggctgagctggatcgaaaattactggagctcagagacgagtttgcagagctgaaggatcggtattaagcagccaatgcaaaggtggaggccattcttgaacagaagagggagatcggggctgagatcgtaagtgatggcgcccatacgatgaacgaagtctggagctaacaattgcataggatcggcttaaatctgaaaaggatgcgcctccaagaggagcttacaaatt

SEQ ID NO: 3390 - DNA, 344 bp, Bacillus thuringiensis
taatgcccatgctagaaaacctagttttttacccacatgatactaggggcgctgcgcatactgcatgaacatgttatctatacctaaacgatgtatgcgcgaactgtggccatacttgatctcgagcgaatgcagccggactgtcctgtgtagatccatgcatgctgagcccgcatcctacgcacaaagatacgactctcgcactgctacaacagtcctctcctatgcatatactcacacctgctcagctgatggcttggatgatggattctcgcatgtacctgcgtgatgttactgtgatgacaatcatgtacaataatagctagtccacgcttgacgatgtc

SEQ ID NO: 3391 - DNA, 421 bp, Bacillus thuringiensis
  unsure (1)...(421): unsure at all n locations
gatggacttctagtgtacccgctgcaaggattcctcttgaagatctcagatgaccgactacatacacggatatgataatccggtccagtgcctgtgacacgggataagaaacgtattaccgaatgggactgaagacgatagctacgggataaggagcatcatccgaactgaacgatgggaggatgatcacatgcctaatatcgaatcagtacagaactagacgcggcatggcatacctaccgcgtgtgctatgtagagcgaaccctcgctatccgaaaggagaaaggggcacaggacttgcggtaaggggcgtggtacaaaacaagtgaagaacatcaggggcaatcacacatgttacagcggattaaataaaggtacagttnggtgatattgagctaccactttattcatctcatcttgg

SEQ ID NO: 3392 - DNA, 155 bp, Bacillus thuringiensis
cgagattatactcaaagaagaaatgaaccgagtttgtctagagacgaaaaaaacgatacagggaagcctactaaaaactgaggcgggaacaacacggcaaacaagactgcaacggcactaaatcacatagcgcagaaacataaatacttcctaca

SEQ ID NO: 3393 - DNA, 113 bp, Bacillus thuringiensis
aaccagcacccgaaccagaaccccacacaagaacccgcgccacaaaggctaggccccccactgaccccgcaaccccctataaaaaagccgctgcaccccccgaaacccccacc

SEQ ID NO: 3394 - DNA, 238 bp, Bacillus thuringiensis
aaaaaagagacagactccgagaggtggatccctgtaacaaataggaggatcacatgggcattatactctaagacgagtgcaaagcgatacgtgacaaagaggacaatattactagggattgctctcatattggcaacgacgaggaagaagactgaatatggatcataacgaagcatagaattataagagaagatacgttcttcactacagaaagcgaggatacaacgcatgggaaaac

SEQ ID NO: 3395 - DNA, 174 bp, Bacillus thuringiensis
tcgtgatgggagaactgcctgcaccatccaagctttgctgttgataagacatgacctttaatggagggggttttatatggagggggccgaaaacgatcgtccttcaataatagtgatcaaacagcagggcccgtgggcagtagaccgcataaggcttctacccggtttgggcca

SEQ ID NO: 3396 - DNA, 455 bp, Bacillus thuringiensis
taacgaccgacttcggagagcttagggttctttggccaagtgttcattggcaccttttagcattattagccaacccgcgctcatcttacgtgtagaagcaatggagctcaccttgtaaactttctgctgaatctctgtaaacccagcctcctccagccccttcttctgcacatcatccgatatgaccaagaaggtcttcccaagctttcgcccggcctccccccagatcttattccatagcgtcttcacagctgagccttccgtcactgttccatcgtcgctacacatgagcacctccgcctcgcctgtctgtacccaacctcccggcttgcaacaacggtaggcttccttgaacagggcggtccagtcggcgatggcgccgaagagaaaacgaagatggatgaagccgaaggaggactcggcgaaggtccacgcttttgacaatcggcgatctc

SEQ ID NO: 3397 - DNA, 367 bp, Bacillus thuringiensis
aaccttttcggcactgatgtcccacccctagttttttttgtgttacgttttgtgttctacgccatttgtggtggatttcaacaccattctgcgggtgactctgtttacttttgggcacagaagatggggacggacgattccgtttttgacgtagctcacgcatcctaaccatccgctgaatgcactgtgcggtacactacaacagatcgagtggcgaaacagtgaagataccgatctgactcttcattgacgcacagcctgcattggcaaagatagcgtattagcccggagcaccgtacggaacaggcgtttgaactgtagtgcagccagaaggggaagcggatactgcaagggcaccatctttgac

SEQ ID NO: 3398 - DNA, 254 bp, Bacillus thuringiensis
gcccttagggggtttatttactggctgcggctggtgaaagccccctgtaattgggtcaaaatcctctaccattaatacccacggatataaataggcattccattccaccaccactaacggggggggtgctaaaaccaggttatgcatataggcccttgattttggtattacaacaaacttggcttttacattatttgtctctaaatttagcgggcccccaacatctcttttacacaaccggctatgctctaacc

SEQ ID NO: 3399 - DNA, 230 bp, Bacillus thuringiensis
cgatccgaagctgatgctaaagaagtaaacacctctaccgccgtttctgatcaaaaaagccgtacaaacaattaacgtgccgggttttcgtacaggaaaaatgcggctgccatacatacgaacaactcttgggtacagaataagaacgccacgatgctgtagatatcattttaccaaaagcatacggtgaagcgaaagcagcagctgggctcttaccagctgatgcatcc

SEQ ID NO: 3400 - DNA, 333 bp, Bacillus thuringiensis
cagcactagggctgttatacacgggggagcgccggaacatctgatgctcagttaactcctacccatgcaagagaacgtactaaataatacgaatacgtacaactacaactaccggaggtacataagcaggcgcagaccgcacgctgactgatacatctgagacagataccagattacctgcggcaatctcggacgttgtcacaactagcacgcacgcaccaacctggggacgtaattcttcagtacaacacatatataagattccttcattacgcttctttaactgacatgatacttgaagcagcgaacaaagctactggacctatgccttct

SEQ ID NO: 3401 - DNA, 167 bp, Bacillus thuringiensis
tgattggaagctagtgggggaaacacctgtatgtgcaccaccagtaattatcacgcttctacgaacaaaagcggttgtggtggcaatcgaaccgtatagtcatggacagccaaatgaaacattcccatacaaagtgatagcgatagagtaagttgatacataaacaa

SEQ ID NO: 3402 - DNA, 131 bp, Bacillus thuringiensis
atcctcagaggacctatgacatcgcggggtggctcaaacatagagggctgacaggacatctgtggcacctggtgcaatggcggcgatagtgacatatacctcatggacaggggaatgctctaacataaaag

SEQ ID NO: 3403 - DNA, 600 bp, Bacillus thuringiensis
  unsure (1)...(600): unsure at all n locations
nngatagagtttactttnnttaaatgtctttttaggtagtaatcagtatagctttcctcttgcatttaccagtgcgcatcannactgcatgcttnntatcttcgatagaacctnntagatttacctttttcaactnntcttctcctggggtatatcccaagnnccattgtngnnagaataanannttaaacccccagttcttttcgtccattannttttctcgnncatcaaatggtanntgaatgggccttgtcnccttcgtttaccccatcannaacaagnnttgaattgggtccctgtnntttcnngtatcttggagggcaatnnttcaaatggaattgttctatgcnnacctaatacnnttccgtaacccannaatccccagtaatggttattctaccaagcgnnttatatttcttcaaataaccatttccaatttcgtttgcattcaaccannaaataatggcccaatatcnnnctggaggcttggtttttggaaaattcgattgcccttaaacttaaagtattgcaaagggtaagtaatttacccggtccctttttcatataacaaaacaaaatcttttttttcacaccggtcat

SEQ ID NO: 3404 - DNA, 254 bp, Bacillus thuringiensis
tttattttgggttctcaatgcattaaacgcattgacagcgcttacaatatctaagagagaaagcttctcatatcaagagggttttatctcataaagcgttcgtatgaccaacaggtggaaagaatcctttgttaatatgcagaagtgtttgtgactctgttgatataacaaggaacggagcaggacgctcctaccatacgttatatgttcggttatcaactgtttgtacaccaggaacggaagatggcacatct

SEQ ID NO: 3405 - DNA, 485 bp, Bacillus thuringiensis
ggagcatggcgaaagctttatttttttttgtcctaaaggcgagggaagggcccattggaccacttatattgtcttagcgaagcatcataagaaagctaagactgatacaacataaagatatggtgtattctgcaacagattgcaagccgcgtgtgacatttgttgatactgttgttttaggaactctaccttatgctcatgactagttattggctgagctgtgtactttcctatcgaatcaactggtgcaaacagattctgttggtatagggccatgttatatagaaggtagactaccatagggcccgcctgtagctagtattatgcttgatacagctgctgacatgggcatatatttgtccttgtcttccttggtacagtcagacattgtgacgcagcaggaaaccctgcaagtgctttctaaaggtattggtactatgctactttggactgaggaagatgttgatcatgctactgcaggtact

SEQ ID NO: 3406 - DNA, 232 bp, Bacillus thuringiensis
  unsure (1)...(232): unsure at all n locations
tttggtctnncaccgccccncctaactacagggggccggtttaaatttaatgggcggtggcgctcaagagtctatggatatcctctgttccttttgaaaggtgaccaacagcctaaagtacacatacctcgatcagaatacaggcacccaatagaattgtatacgtataacacggaatattgttccctatttttttgtagcaaatcaattgcacaatgcagatattcctttt

SEQ ID NO: 3407 - DNA, 100 bp, Bacillus thuringiensis
ttgaatgaattatgtgctactgtatttttatattcattagattctaaaaataaaggtgatatctttaacatttctgaccttcaaaataatttaattggtt

SEQ ID NO: 3408 - DNA, 202 bp, Bacillus thuringiensis
ggatctacatgctattatttaatgtcctaaaacatagtcacttaaacggacccacacttgtggatattatttcaggacagggggtattcccaatgccagatgaactatcatatgcagcaatctaaggtgctattgaagcatctacaaagtcagtagtaccagttgcaatgtataaggggattacagcgagtgctttagatcc

SEQ ID NO: 3409 - DNA, 120 bp, Bacillus thuringiensis
gaaaaaggaaaagcttcgtatggcccaaaactacacgacgacgcattaaaaacactcgcggggggctattaaaccagatgggggtaaaccctccacctgatcacgcacggaaaacaacag

SEQ ID NO: 3410 - DNA, 429 bp, Bacillus thuringiensis
atccgagattgaaaacgaaacatccttaccatataaaggaagcgtctttatcttttatgacagagagctaccacggacctgagttaggtgaagatgcataagatgctcgaagtgttgaaaaaacagttcaaaactggccactaactgttgtaaaaggagaggacgaaattgcagctggctcagaataccgacaggatagggttatgcctgaggggccggaacccaatccagaagaacctaaagtggagaatggaacaggcacagcaaagcatccagaaattacggctaccaaagagagaagcatcatctttaaggcgaaagctcatgaaacgtgacactgagggacggacaatttactcgccgcggttgtgcgacatcataattcggcaaatccacccggttgacccaacttattccaacttgcacctc

SEQ ID NO: 3411 - DNA, 188 bp, Bacillus thuringiensis
cacgccgtatgttcgcagccgcgtccgtgatggaccccggttctaaattacaaaaactagcaactttcggtttattattccggacagatgcctatgcctccgcggcaggcacaactgcatactacgcgtgtcccagcactgacactgagctgattactgaagtaaccactcctgcctccaacacgcca

SEQ ID NO: 3412 - DNA, 115 bp, Bacillus thuringiensis
agaaaaaagacactgcctggaccatagtgtcaccccccgttttattattaaaccgcttgaactatagtgcctccgggggtgaaacaagaaaccgtatgggccagacccccaccac

SEQ ID NO: 3413 - DNA, 187 bp, Bacillus thuringiensis
ggattcataatcggatttcctgctattccaaccccaccgacatatcatttcacagcggataccgaaaaaatacaaggaagcttcacctaatatacatagccgtcctgagcatgaaggaggcgcctgaaagttttaatatgagagagtaaacattctaagttaacttttaatgcggctcgttcgatcg

SEQ ID NO: 3414 - DNA, 127 bp, Bacillus thuringiensis
agttccaacccaccattttttttttactgtgtttcaacaagcaccaatttgggaggctcatatagcaggcggatgcacccacttcgattagccgttcctatacacatcgcttttgcccaattcccgg

SEQ ID NO: 3415 - DNA, 556 bp, Bacillus thuringiensis
cggaaatcgggagacccgccctggtgctcccactacaccacggtttttttgtgcaccgcacaaactagataacatctcggacagaacggccacagcgtatctgcttggactgtaaggactccctactactttttcataaaacgctaccagttcgaaattttccaacgcagttacagacaacggaaggatcactcactatgactacttcacattaccgtacacgctgatctatgatcaaatgagagttgagtccgttgaagccgatgaataaatagagggataacagctgcatgaatgttgaacacctggaacttaccttgcaggaataggagcgctccgtatactacacgctaacccatgcttcctcagtcaataaaggacatctgtcaatgaatttcaggttccgatattacctgtgagcttgcatcggggtgtaggcttacatgcagactttgacttacacattcatgaaacgctgacccgaggactggatcagctctactgaatctatgccgggaccttttgcctacagactattttctacatactctaaacc

SEQ ID NO: 3416 - DNA, 374 bp, Bacillus thuringiensis
tgattctctgccatcatcaccaaattattttgggctctgcctccacaactagaaaccatgcgctacatctcacctggtcaggtcctgcatctattgatatactttagcatcacatggcaccatgctaccgccttacacctattcacccagatcagcattaccggatctgactaggtttcgctatgggaaaacgaaggttggggcgtgctacatgctgccatgctattaacagttatacgtgacgatcttcgatccgcaattatgcccttagcgaagcctcttggacaccaaacggcgcgttcatacgggtactagggagctgctgtcacttacatgtaccctttctactagcccctcggataaggaccatactg

SEQ ID NO: 3417 - DNA, 296 bp, Bacillus thuringiensis
acacatcctaactaaaaatatatcattataacagaattcatgatgtatgcaaatgagattgtgaatgctcaagtgaatgaacatgttcgaggtgatgacgatgcggaaaagattccggattgaagtgtgcagatacatgatggagattcaacgttatgactggggcattgagataggtcactaagctataagaaacgtatgtacagcacttaaagtgattgaccgttatgtgatagcagagacatccggacaccctgagaagactggatgagtggcattaggcgattagctgccat

SEQ ID NO: 3418 - DNA, 301 bp, Bacillus thuringiensis
gatacgcgtcatcaagcgtatactgcatatgacgccttgtcgtaatgcactggcgatcgccatggatatacatgtgtgacgtatgagacgtgaaaagaggcgggcattcacaatcatatggtaacacgcacaggaaatgcacaagctgacgcgtctaacacaaagatcattgaaaacaaatggtgccaccgagagactacatttgatgatccaggcccagataacgccgggaaggcatccgagtaagatagtaatatgtatgacgagcggagaagtttcgatcatgcatgggatcgtggca

SEQ ID NO: 3419 - DNA, 102 bp, Bacillus thuringiensis
cacatacacagaccgactggaagggctcgccatttttgatggggcgagcggaatcgtctcactctctggcagtaaatgaggagaacactgcatgatcagaca

SEQ ID NO: 3420 - DNA, 300 bp, Bacillus thuringiensis
attagaatacttctaaggtcgtgtggcttgctcttatttgttgagcctcaaatacacggtgccaacagggcgtgtggtctcagcatctgaatggagccctgaaccaaagcccccatggtgtccaatcgacgcaaaaccatgatgggcacttctgaaaacccgtgtcgcatgaagtgcattctctccgcttgagccatactgacgtagactggaagacgaagcctcacaagtaacgagccgcagcttagggtccgtcatcatctagtaaaagaggagctctatatagcccaggacgttttc

SEQ ID NO: 3421 - DNA, 395 bp, Bacillus thuringiensis
ttacagcttctacctatggcggacaccgggtaccttgcacacctttcttacttctggtaagaatacgacactctattacgagcaaaaagcataatcagtatcagcagaagtggtgtcctgttcctatgtttggactgaatttgtctgcttgaaaaaggatatttgataccgcttgcaacaccctttattgtttaaaacaggaccataccttgaaaacgatatttaatttggctcattagcaggatgacggtccttttgcatacaagtttacgttgcagcttgtttcgaaaaccaaatatcacttttactgggctatttacaaaagtgcacttttaagctgatagcatatgccttgttctaacataaatggtgtttccattcagctactgaaacat

SEQ ID NO: 3422 - DNA, 182 bp, Bacillus thuringiensis
caaaggcgtccatttatatgatactcttgctctaatactttcttttcaaactccataggcctcaatatgatggcgctcttacaacttgaataccttgactctcaaattcctgaacagtttctctacttggcaccaggagcctcatattaaggacaatttcttttagagactatgggcgaaaa

SEQ ID NO: 3423 - DNA, 364 bp, Bacillus thuringiensis
tggcgatgctctcgctggttgctctagaaaagatacgcctttgattttgtatcgccaaccccgtgtccgaatcgctggtggtcatctcaagtcatggatggagagcgctacagcctgcatactaccccttttgccgtcacacgatatggagcaaacatgatgatgcgacgacttcctgttggaggacacgaacacttcttgcaatatcgtgcgtatgatctgcagatgggaactccacatcagactgtgttaaacgcttgtttttctatagcacagcgcatcgtggccgactaggtactggcccagcattcccaagtctaagcggaacaacggcactcgtctgatagccaacacgcgcacatca

SEQ ID NO: 3424 - DNA, 180 bp, Bacillus thuringiensis
gaggtaacggggccataagaaatgcacgaacgagcttctcatgatatattaacgactggttgaaaaaatgtcactcgttttatctcatatgaccttttcgcaatggcggcttttacttatgtaacgagatgctccgccacttataaggagatccactcctggtctcgtgttatagtacca

SEQ ID NO: 3425 - DNA, 202 bp, Bacillus thuringiensis
agcacagctggggaagacggttatgaggctcaagaggatagcgttgctggaataacactaaatatactaagagaccacttatgcttgcatagaccaattgcatttgcggtctggacattactcgattagccggaacgtctgctagtggacatacgcatctgaatattagggctagcaagccccatacgaattcagcgtagga

SEQ ID NO: 3426 - DNA, 135 bp, Bacillus thuringiensis
aacaaaacagagcaaaaggaatatgatatacgaaccaggaggtaacggcgccaaaagaagggaacgaaggggcaaccaaagagtcatcaacgacaagtggaaaaaaagtaaccaagaacaaacacaaacgacacc

SEQ ID NO: 3427 - DNA, 222 bp, Bacillus thuringiensis
aagcaggtcgacgactaaagaatatgacgcgtaaaggccatattatctaaagtatcaagcgctggcacacagatgcatgcagacaacgcaaggcaaatagaaatagtgccaaacacatacaagcgaaaatacgctggtgtgatagtgaaaacaattcaataacgaatggtccggactaaaagtctgctaacaaatggaataatgcatggaaacaaatcaccc

SEQ ID NO: 3428 - DNA, 155 bp, Bacillus thuringiensis
ttgaaggccatgctacaccatgtgatcctgtcacaccgcttgatgaagcgtttccattggtcgctattattgccagtagataaggtgggtgttagccaattcgattggtgatgttaccactataaaacggagaccgagtgaggtctatatcgtat

SEQ ID NO: 3429 - DNA, 188 bp, Bacillus thuringiensis
ggctactccagtaccgaatattttttgtacaaatgtaccaataaatacagcgatgggtgtccataacagaagttgacctgctatcaatgcgcatgaaacgaaatataacataagcgtcagtttaaagagcccacagaaacacttacactggaaagcgcgagaaaacggggacaataaaaaaaagagat

SEQ ID NO: 3430 - DNA, 212 bp, Bacillus thuringiensis
gttgtagggttcgattgcaatttttttactcccatcaaagaatcttccccattcatctgggcacttgctatgatgaggggatagaaattgattgatcaaacaaccatgggctggatcgatttgaacaccaggagagccaagcctttctggtattacaagacgtagtggctgctcagaagattaactgccggcatggatctggagcatattct

SEQ ID NO: 3431 - DNA, 202 bp, Bacillus thuringiensis
acacataaaaatgttctaaattttttttactgctaatcgttccctaaacaaattatattttgcttaccgtcttcccaataacctgctaagactaaatatggaatctttatgagagagcgcaccttgctactagtggatctcatgcggttatcatatccaatacattccatagccatcatgatatttccaaactgcaatacca

SEQ ID NO: 3432 - DNA, 375 bp, Bacillus thuringiensis
cgcggacgtttcggagccgaatccgcgatttgcgctgtccagcccatttggcagctaatcgcgcctccgtttgttacggaacctacatctaaacctaatatccgcagaaactactgctcaccatgatgttttaagtaagactctacccgctctcaaatccactcattatgggcaatgcttgcgaatgatgctacgctgcatctttattgccaggaatgcatgccgggacaccactgaaccacacgcctgatacgaggcgcactatacactagcctaagctacgctgagcctaatacacggtgaggagctcgtcttttacacggacactgtgattcacatgaacgctgcttaacttcatagctttgtccaagcggt

SEQ ID NO: 3433 - DNA, 366 bp, Bacillus thuringiensis
acgccaagcgattgtccacagcggttcttgtctaactcggttcatggaagataacagtgcaaccattaaacaaccgctgaatcccaccctttgaaggaaggataaactgatgacgaacaaccatctggtactgacgcctactaaactcatcgaactatcgaatccatgtgaatctgctgtatcaaaaacagcaatccctggctgactcagcgccttttactaaccgcttgccttgtgcatcattcacatcagcataaaaattatgatcccctactgaatcagggcctcaacccaccttaggaaatctttaatgctgccttaggcgctgctaatacacgagggggactgcccctatattgctattgt

SEQ ID NO: 3434 - DNA, 103 bp, Bacillus thuringiensis
aaagactgacccagggaactgtattttctaagtacctgcaggaagagaaagcgagggcgatttcctgagcagcgtcgagcgaaacgaaccatagcccaaacca

SEQ ID NO: 3435 - DNA, 212 bp, Bacillus thuringiensis
cgtgatcgaagaagtccgagaccggatgacatcatcttaaacacgtccaatattttttgcgccggtaatcgacttttgaataggtggcacgagctgaaagaacacaaaggcttacatttccactgcattttaatctgttgtaagtactggacgcgcatttgtaatgccatcatggaatgttattgctgccttttgtctctgctgtgacctta

SEQ ID NO: 3436 - DNA, 552 bp, Bacillus thuringiensis
cacaatataatacaattgacacatcttcctcttgcaatgatcctcaaattttaatgtatatatgaatcacttatgggtcttgttatttgtggattctcaatcattagggcttagggcctaagattctgtatttataagatcccaaatggcgttattacatcataaaccacacttctgagtacaagggtcaaagtaccttcctctctatctgtccctatctttctctctgtttctgtcccctctctatacctcctctctgtctctgtctgtctattcatctattccttcctctctccctccctctctctctacatgtatgtagcaaatgtcatctttctcccataaccagaaattccattaagcacattcagattgtttatatccttaggctagaaagcagggcccggagagagttagaagtctctctcctggttatctaagcactgatttctaagctttctggtcttacagattctcttcctgtgataattagcagcatatggagatatagccttaaccatacaccactgtgatgatattagaatagaacat

SEQ ID NO: 3437 - DNA, 141 bp, Bacillus thuringiensis
cccgcgacactataatcaagtatctcattcgtatctaaaaacaaatcctttatttgcaataaatctcctttctgaatcggtgtatacaaacctttcctattaaacaccttcttattaacacgctctcttaatctcctatct

SEQ ID NO: 3438 - DNA, 102 bp, Bacillus thuringiensis
cttccttcaaatttgtacacaagcacatgcgtcggtgtctttttatgcaccaacacacagaatattacccgtgtgggctccgaactatagacgttcggggct

SEQ ID NO: 3439 - DNA, 235 bp, Bacillus thuringiensis
gttgaacagtacgatgggtctgctgcatgggataaccacgatattgcatgccaacacatgcagccgtgcaaagtataaaaagcatgtcggtatactccgtcacaagccgctcccaggccactaaacatacttaaccgagtgcgcccgccatcggtacagccccgcttagaacacgcacaggttcctgaacatactcacggcggaaaacatgtcgtgctcgcaaagtgccaacgaa

SEQ ID NO: 3440 - DNA, 108 bp, Bacillus thuringiensis
gaaaccgccatgttctgaagattattcatctatttatcaatttctaagcatttcttcttttaaaaccccttactatatttcaaatttgttattaactggaacacaaat

SEQ ID NO: 3441 - DNA, 322 bp, Bacillus thuringiensis
tcacccggagagaggcggttttattattgcgcgctcctacgactgcctgactactgggagcatgttccacatggcaagattgcaacgagccagctcgcattaaacctagcgataaaaaccgtcattcccataataagtgtaacgcactaggaaagctaccaatcgatgcacccccaggcattatcaacagtctccgaaaaaaactcgcgaacattaaaagtatgcgaaatctacttactcccactatccgatacacaaacagccgctatatccaaagacacgcaaacccaaacaccctacaatcaaactggccgaaggcacg

SEQ ID NO: 3442 - DNA, 335 bp, Bacillus thuringiensis
ggtcactcctatggagtttgttttatacaagatcagctattcctgggtttaacgcatccttatggttcttctacgggtggaggatgctattgagcctccatatcgtaagagacggatggagctgcgagcaatatgacccctccattttcactgagccgaaaactacaaactgtatacgccctaagcatcactaggtggcctaacatattgacctagggggagcgtaattgccactgagtggctatggaggaatgacgggacattggcatggtatggataacgattcacgcatgatttgcagcggttcgcaatgctgtatcagcaggcttgctagc

SEQ ID NO: 3443 - DNA, 157 bp, Bacillus thuringiensis
tactgtcgcactgacttgtctcattattggcacaaggggtgtttcttaaacgttgccaggataacttatgagcgctcattcaccaactaccataatggctcacgtctcttcatctaacgcctgggtggatgcaactgtcacaccgtttttgtcactt

SEQ ID NO: 3444 - DNA, 180 bp, Bacillus thuringiensis
atatagattgttaccaatcgaataagtgcaaattcttaggaccttaacaagaagtcttccatatgtatataaacacttactttcacatgatttatcaaattatatctcaatattcgcctcaggactttttaacagtgaaatttaatggttcataaatagctactgagcttttcatatacc

SEQ ID NO: 3445 - DNA, 290 bp, Bacillus thuringiensis
tcttatctttaacttctttttctaaaatggtaattgctggaaatagtttgcatataattccttgggcgcttaccaggtatgtgtcaacacttaaaaccggaagctctgcactgataaatcaatttcttctgtcttaattcacggctatggtgtgtctaaaagttcaacaagcggtccgtttgaagcacccaccacacgcatggtttaatatttatgtttgccgacacaagcagcgtacccaaaaaatggaggtggaaaaagcgtcgcaaggaacaaactttcatttaaaa

SEQ ID NO: 3446 - DNA, 126 bp, Bacillus thuringiensis
ggcttcgaaacgaattcagatagcggcaagacagagatccttttgaaacgttatgggacatggaccgagctctaattccagtgaaatatcgggagaagccaacaggagtggatttaataacggacg

SEQ ID NO: 3447 - DNA, 385 bp, Bacillus thuringiensis
gatatgagacaacttggaattcgaattactctatcaaactattttattgtcatacgtcgcgcccactgatttttcagaagagggaaacacttttggtcacttactatttatattccattctaatacatatgcattcactagcacactagccattgcttcacagaccactaccccatttagattaaaaccaccgaccttattactttaagagctcacacacaaataaacaaatgagatcttgcacccgaacgcagcgtaaagctctactggcctacgtatgtaccctacattgtggacaaatacaggcttaaatatatggcaccacagctctatcaattccaaaaaaaagaggcaaccaccttggacgccggcggactcatttaca

SEQ ID NO: 3448 - DNA, 145 bp, Bacillus thuringiensis
aatgacctttatgtgtagtgaagcgtaaggcacaggatcctgcatgaattgataggggcacaataagcgataacagaattggttccacgagaaccaaatcttgtatcgcattagactcgtgctctgcttcggtataatacacgac

SEQ ID NO: 3449 - DNA, 330 bp, Bacillus thuringiensis
cacaccatacagtatgtattcaactaacaactgtcataatttattttattaaatcagattattcaaattcataacagcagatagttaaaatgatcgtgctccatccgtattttgcgtaaatatatggaataagcgaacatgcggagttaatcttgtagaagctgaaatgtagtacataaaaatatatccgcgaaggtgaaattatatatatcgagcctgaacatagatcatcgattaattgccaaggagcgtctgaacggcagtaaacgaccagccggagacatcataccttttaacaaattatgtgaccaaatactatctgcatattgg

SEQ ID NO: 3450 - DNA, 158 bp, Bacillus thuringiensis
gaactagacatttgttcttccatgcgtacaataaataaaaacgcggtgatatcaaaagacttagcacattgagcaggctggcttatacctatcatgactaacgaaggggttgaaccatacaacgatgccttatcatacgagtatcaagatgcgaaatt

SEQ ID NO: 3451 - DNA, 165 bp, Bacillus thuringiensis
ttgcacactcaacactttcgtagagacgaatgaaatctgttttgtctttttacgagcacacgatgttttgacgaaagtgggtgtaaaacacgtcaagctggtacttccaccttgcggcgaatctagcaatgccacccttaagatcatagaatcactcggatacac

SEQ ID NO: 3452 - DNA, 121 bp, Bacillus thuringiensis
ttttctaagaattaattcatgttctttatgctaaagcctgtttaggcgcgaaagggggtgtctatcttggggacaatgacgggcctaatgcgccaaacacgctgggcatagaaaaacgttc

SEQ ID NO: 3453 - DNA, 458 bp, Bacillus thuringiensis
tgataaatggcctgctgagacgctaacttatcatacacacgaattttttttccactcattattttgtagcttcttataccaagtttatcttctaaaatataagctgcacgtttcacatcaggaacagtgattccaatgtactctgcttgttttccgttaatacttcttcattgaaactttcttttaattagttttccattgtgaaatcacaccaaattgtattcggccatcagtttccattttcacctaaaatatggactagaaatctatataatgtaattgcccatattcctttgcaaatgcaattttaaattaagttctcagtaactttttttaatacccaaattggattctaaaaccggttaacttgggtttattcctaaaattgtagccaattcttggcttttgttcacgatttgcttctttgcaatctatccgaattacgttggtttctattt

SEQ ID NO: 3454 - DNA, 398 bp, Bacillus thuringiensis
cttgaccggagattaaccccaaacacggcggagcagtagattttttacacatgaaacagccgatgcttatttgtggggaaagatgagaactattgttggactcttgatcatttaaggatataatcttgagcgggggacaccgaagctaatatttactatatagatattgtgactgaggagtaaaacaccatacatcttattgtttaaaccggctccagattgaccgtagaaacgagctactaaaatagtctggaatccgaagatctctgtaacaccggaagatactatgacctacgaacctgctgccactaatgagccgactatatgtagacaatactgatgactattttgaacgtacagaacgtcttcaatctgaccaacaccaaccctatatggat

SEQ ID NO: 3455 - DNA, 179 bp, Bacillus thuringiensis
gatgaggtgtctggaatgttaatgactacagccacaaccggaatatttttatgtggctcatggactggatcagtgtctgtgtcatttgtgaggatcgaaccgagagttaccccggcgacaggaatagcgccagccatcattacattatttattgctaaactcacttcaataaatattgt

SEQ ID NO: 3456 - DNA, 140 bp, Bacillus thuringiensis
tgattgctgtagcagaccaagtggatcacgtcacgtatccccggattttttttgaccgaagctcgccttgtgcacggagatgcagttgctatccgccgacaacgagcagccatctctgctgtaattgcgagcctctctaa

SEQ ID NO: 3457 - DNA, 201 bp, Bacillus thuringiensis
aatgatattgcacctgcacaatacggaactttactggacttaatattgaagcgtccaactaaactactgcatttttgaaaccgaatagaaagtcaatttctagcatttttactgcaactcgacgcagatctcgcacccttcgttgattgtttgaagctcgacccatgaccgataacaacttttgattaaagttacttaacc

SEQ ID NO: 3458 - DNA, 207 bp, Bacillus thuringiensis
tcagggggccgcttcttttgcggcatgatcgcagcgctttttttattccccagcgtgaagtgatcagccagttgttggtgaacctgatttaaagacctaaacgaatgctccaccgtaattaccgctggcgcatttatctattgatgactgctggtcatattcttcttcgttagacacgacgcaccttaaaataagcggtgaacaccc

SEQ ID NO: 3459 - DNA, 470 bp, Bacillus thuringiensis
acagctcgtttgttgcctactttttatcgcgactacacagtaaaaatcatatgcatgggttaactccccgatcttatttaatgccgaaatccacgtattattctctctcaaaaagaagcgctctagtttctgaatttcttatgaatttcctgcataattcaaagcattcttatcacaagactttaaatctcactttaatatcctccacttgtcgattcggatactattggttaaaaaatatcggctgtccaatgcacatcgtcgctaaaatcaagatacataacgctgacgtatgagtcaataattctaggacaagctcttccttcattcatacctcacgcatttataaccagatcgcactacaggtggaatatactcagctttcttttctaactcattgcgtaaattacgtctatggctattcaccgatcgatcattgcccgcaagatatatccccaaatttttgaatc

SEQ ID NO: 3460 - DNA, 364 bp, Bacillus thuringiensis
gagttcgggtgaaccatcctaatgcccggaaccatgacgggtgaacggccctttttttttaaactctataaacgcctcatataaaggggtacgattgtgatccatcgacagcccttccttaatatacattctctatctattatgcagagcacataagcttatctgcacatgcctagataagaatctgatagcttctaacacccgatgctgcattgaataaagaggctattacgggacacgctgtctctggattcaccatattctctgcacactcatagcatattaaacaatgaagaacactattactttcaactctttgtgcctacacgcacgactctctttagacaagaaaaatgactatctt

SEQ ID NO: 3461 - DNA, 375 bp, Bacillus thuringiensis
tgaatgagggtatgacgttacttaaagtctctatgataaatttttttacatgatggacacgatagaggtacaggtgactgctttaagttgacgagccgtgtgcataaaaatagtgagatattttataacgagtctaaagcggatgccgtacatgatttgttgaatgagaagagattacccgccatcatggtacataagactacacgctggccaggacatatcatcacgatgtcctatatttagcgaatagccgcccgcgctgccccagctgtatgcatctgtgcaaataacgcctttcgagtgccctggcgtccccgaccactagataatcgacatgggtccttctaaagagcattctagttgtatggaggctta

SEQ ID NO: 3462 - DNA, 191 bp, Bacillus thuringiensis
ttgatgttggtgtttactcatttgttctgttactttttacatagatttacagaaattctaagattattgagtttttttttttcattatttgacttataaattatctttttcggttttcttttttaatgatttcattataccttacataatttaaaaaaaaacttggtcttgaaagtatggctctttttttc

SEQ ID NO: 3463 - DNA, 304 bp, Bacillus thuringiensis
caccgatatgtctgacgctttttttgcggagttacaaagcaagatctaatttgcaatccgcttcatgaacaccatgctgcaaagtataggatgtaaccctagcggaaaaagaccatgcgcatactacagccgtttaccatcggttgaaagccgacaccattcttccttctaattgagtgcgaaaaatgctgttctcgcacgatatgaaagagggatcctaatataatgaatacacttgccgtgctcttataacgctggattacaagcgttcaggttaggtgtagcatcaaaacaaaccactttt

SEQ ID NO: 3464 - DNA, 275 bp, Bacillus thuringiensis
tgaaatcttgtttacttacttgatccaacacaaacatgtgctccagcttcggacgattcgtaaccataagtgtcagcttatgactaaacagcgccccgcgcattatctgccgtatgattgggccaatgcgagcttcttcaattacacactttgattctaaaaacatacaggcgccgcggcatataaacgttggctctgttgatgtacccgagccggaaatagcgatgattgagaagtaccttctctaacacacgcacacttaaacagtcatgcaa

SEQ ID NO: 3465 - DNA, 291 bp, Bacillus thuringiensis
aagacggaccaaaaaagggacccccacaaagctttctttcgaaaaaaccaggaagaccgacggggcgcgcccacaaactaacggcgggaaccacaaccaccgaaaacaggcaggaaagacgcgtaccaccagaacgggacctcaaacgaaagaccaaaagaaggggacccaccgtccaaacggacccacggaagaaaacccccaacccaaaacggaacagaccaatacaaaaccggaccgcaaaaaacaccaaccaaaggcatcaggcaaacacaacgcaagccccaaggc

SEQ ID NO: 3466 - DNA, 130 bp, Bacillus thuringiensis
ttctttaaccacaatatccaaaccatcaagggtgggttttattaagcgggggggggcatataaataactaacaaggtagcagttcactaactaattatatctaacctcagcactcgttaattcaccatta

SEQ ID NO: 3467 - DNA, 257 bp, Bacillus thuringiensis
agaaatcgtgatattacatcttctataccaaatcatagatcaccctcatccctccaaggtactaggggggcatactgcaagagtgggggggctaatgcctattgcctttggatctaacacctggtcaatgttttctataacaagcgcgtcaaagaacgaattctaaaaatgtaccaattaaagtgctacttttttttgcataagttagaccatcttctctgactttatacccacttataattatctgatgaattgac

SEQ ID NO: 3468 - DNA, 203 bp, Bacillus thuringiensis
gtccattacgcgatttactgggctagtctttcccaacatagcatacaacacttcgggtgccataccgaacaagaggggggacatactccacgctaaatataacgattcgtaccagcgttggtaactgccactgaatatgagatgatttgaccgatacgtttactctactctccaagcggagtataattgcactaacatttgcc

SEQ ID NO: 3469 - DNA, 321 bp, Bacillus thuringiensis
ttttggcatacccatcctctatcgcagccgtgggccatatcaaccatacaggggtttgtaccaagaatatcccaaatcagtttacaatttccaagtcaagcaattgcggctttttctcaaattgctcattacactacgcttgtcacgaattaccgaagatataaacttatatcaaagaatgtagcagcgtgtttacgccacgaaatgccattcatgccggttgatattttaaggccaatcccatgagaacccacaggccccattattcgtcgttctcgtatatacacataaccacactcaccgagaacctcaccatgaata

SEQ ID NO: 3470 - DNA, 226 bp, Bacillus thuringiensis
cgacctaggactttgccgctctttttttgctgagcacaggaaaaaactgttgtggcaccctacaagagatagcgcgctttaacagtcattatcacgaacctgggatcttgtgaatacgttctgccgctgcctatagtgccacgaacacctgcaagctcacccgtgatgtcagtgaatgatatattttcgactgcgagaccacacatatcatgcagttggtgaaatt

SEQ ID NO: 3471 - DNA, 289 bp, Bacillus thuringiensis
tttgaaggcatttggttaatttcaaatttaaatccattaaatctttttgggtttgaaccaccaagtcctaaatttttcccgcaggaggcaaaggctaaagcggtttaataaccaattccggacctggcacacaaaataacagggtatttaatataaaatccccctaaatacaaatatatttatggagagagtgtatttgttagagtacactctaagacaaatgttttatataaatgagacgcgcacataaaatatatagggatacgcgtgtggggggagtatagtgtgt

SEQ ID NO: 3472 - DNA, 147 bp, Bacillus thuringiensis
tatcttcttgtcccgcaaatgggagacctagggggggatactctgatgctggatggcctcacaatagaaccttataatataacactttctttcacatgcttacaattagaaaagactccctaaaaaatcaagcgttcctttgcctac

SEQ ID NO: 3473 - DNA, 136 bp, Bacillus thuringiensis
actttttaggattacagaattgaacggtactaggaaataggatgaaacttatggggaactaaaactgggaaagaaatcgctgtaagaaacttacctattcaagatgcatagagatcccatttatgacgcggagggg

SEQ ID NO: 3474 - DNA, 214 bp, Bacillus thuringiensis
tttatttttacttacatcgatattaaagtttgctggactttgtttaactggtgaaagacctttagtattttcgtccacatcactatttaaggtcgtgattgctattcggagcttcacttctataattacgataatggtatagtagacagttgaaattccttaagattcctgcgtaacccgggatactttgttatcaatttcaccttgccttttt

SEQ ID NO: 3475 - DNA, 327 bp, Bacillus thuringiensis
  unsure (1)...(327): unsure at all n locations
gcacgtatcatnagtacgcgtggcataccaccaaaaattcttctcttaaacaaacaactcgtcaattatccctctggatgctcaccgaatcacactgatagtaaggaaagagacatttccacagtctatacattttcgatcccacaaatagggggtggaacaagactcaatttttatacctctttagctggcataattgttcaaaaatacgcaactgtggtttctttccaatctctttctgtggtggtacggaaaaagatacaggtccacaacacggtagaagcgaggatgaaatcttattcatttttgagtctatattagcgaaag

SEQ ID NO: 3476 - DNA, 263 bp, Bacillus thuringiensis
gctgcttcgactaatgcaagaccactatgcttcccatggggattaacagactcggatggagtacaataaccctcttgccgtagatctctcacgagatttcctgctcactcatctgctacacgctggtagtgcctttcacaggtactatttagacgctacccgatgctagcgggcgctgtaccggatggctttctattagcgttttataatagcacctcttagacgccataacactcgttactattttgtacccatcctggcca

SEQ ID NO: 3477 - DNA, 196 bp, Bacillus thuringiensis
tttttccttaaaaacactttatcgataccgggggattttccaacattccaggggcttttccaagtacaactactatttcattaacaaactccacatctccctatgccggccttatttttaacagcacctaccattatgcttgcctcggattcaccaccttactaactgacattaacaaatgatatcgctttataac

SEQ ID NO: 3478 - DNA, 126 bp, Bacillus thuringiensis
ggttccaagctgttgtacgggcgaatgcttgaacttgagggcaggaaacatagcttaatatcccaaacacggataaagtcggaggtggcgtgttcaaaaaataacggagtatcctacgttaaacca

SEQ ID NO: 3479 - DNA, 125 bp, Bacillus thuringiensis
tttgttctctttccatcagaaacaaaaatagggggttacaatggtgcgcaggggattactctgactatctctaagcagattctgtgggcatttctctcattttctttttaataagcccttcaatt

SEQ ID NO: 3480 - DNA, 295 bp, Bacillus thuringiensis
atcccctttttacacctccttttttacccccctttttttaaaccccaacacctcaccccccccaagcggattttaaaaactttttgggtcaaccccctacaaatgaatttaaacctaccacttaaaatcatgaaaaatcaaccaattctattattaccaatcctaacaattttaaaaagactcaatcaattatatacaataaatccccccttaacccctaaaaacataaccaaacataaaattcttccaaacaaatctatatccattacaaacaaattctaacagcaattcttat

SEQ ID NO: 3481 - DNA, 185 bp, Bacillus thuringiensis
gctagtaagcttgccgttaatacagattttgtttcaaacaaaggattagaacttacggggggttttataaaggttatggcgggaatacggcgacatgttctttacaactgtataccacttaacgcaagcaaataacggtgtgaaccgatggcttggagggcaagcaccgtaagacttcaatgatg

SEQ ID NO: 3482 - DNA, 176 bp, Bacillus thuringiensis
  unsure (1)...(176): unsure at all n locations
atctaaattctttcgggatgactaattccgcgcaatttttttaaccgccnaatcccttttgaacggggtggtttatttaatacttcgacgccacttcactgcgggtntcttcccctgattatcgctggtttttttcatggttatcaaaccgatcgttttgccccccatatttcatt

SEQ ID NO: 3483 - DNA, 149 bp, Bacillus thuringiensis
cgtgatgattgctaaacacgctttgcgccatttatctactatgcacgcgcccataagccaccggggggtatttaaacaattatggggataccaccactcccgtatccattccacaccagcgtacaaaaaactgctcgaaccactcacat

SEQ ID NO: 3484 - DNA, 200 bp, Bacillus thuringiensis
gtaactactccttccgttattttattctgctaagaacacgtgtcaatacactggccagccaatatgatatacgcggtgtccatattactcataataaacatcggttcttctaataccgttctgcccgagcctataatgcctgaacccactacgatgttgcccacatgaacagtgaatgatatctaatcaattgggtgaac

SEQ ID NO: 3485 - DNA, 332 bp, Bacillus thuringiensis
ataccaggcgagagaagaggttttttgaatcaggcgcaaataaaaaacaaccctgtctcttacaggatacctgaccgcctaactcacttacctaagcgttcagctatattcataactcacactacagctaactgatatacgtgtcagaacatcactccaaatgtgaattcacacgataggccatttctgccttggctctctctactctactcgttacaggatcaccccttcctgatctctgtattacaaactgtcaccttatatgccacacaaccttctgaccgtacggatacatccaccgaagtgtccaactcttgacgatcctcacgtta

SEQ ID NO: 3486 - DNA, 187 bp, Bacillus thuringiensis
ggtacgacactatttggctcaatttttttgtataatcgtgatcgactccaacctgggggtgattactagggtatggagaacatgccaatgattgaccaagttctatgttactgtcgccgaattgtctgtggtggtacgacttgttcaccctttggtggagcaggagtgtattcccgcagacgcaatg

SEQ ID NO: 3487 - DNA, 104 bp, Bacillus thuringiensis
ctgctatcgcgtatttcgtattgctcaagggggggctcttatgaataacggggggctccaaacaagtgattttcataactagcgtaatggctgttctgtctaac

SEQ ID NO: 3488 - DNA, 182 bp, Bacillus thuringiensis
tccgaattcgtgattccattttcgtcatatttgtttcttctggacacctatttattatgtatttattggcatataaaaaagaagacgggcggctcccttccctcgccctctttctcctgcttttccgcacttatttgcctttgcttttgctgccctatcctcgtgtgcgcaggtcctttctt

SEQ ID NO: 3489 - DNA, 398 bp, Bacillus thuringiensis
ttatgccgctggcttattggaagtttttatatgcccgccactcagtatgcctctgggggcctaactcctgggacggggagaactagcctgggcggtaaatagaccacatacagatggtccatatttaagcgtcagcgtagctttctgctgcataactaaattcatgtttgaataatctgatttgcacttaacaaaaaaaagtgtgggtacccacaattgctgaccctggttcgtgagcttactttgcttacataattactaatgtggcttattcatatacatgttctctagctttatttttgcaatctgctggcttagctgcacgacgttttgattgtgtttttcgcaagattgcttagacttcaactagatacttataatgagtaagcactgtgtcc

SEQ ID NO: 3490 - DNA, 291 bp, Bacillus thuringiensis
atatcgattgttagtaaccggagacaggtagtatgattcgtatggtcataactgggacactcgcgcatatagatggtgtacgaagtgacatgacattcactctaagaaggagttagatgcgcattcgtgacatacgaatgaagattacgcttaacttaatataaaagatcttaagaattgtggcggactatatgtacacggcccttctcatacagtatggttaagagtggagaatgaccctatatgatatggacatgcatgaatataactacggaggagattatataaata

SEQ ID NO: 3491 - DNA, 883 bp, Bacillus thuringiensis
aaaaaaaaaaaccaaaacgaaaaaaaaaaaaaaaacaaaaaaaaaacaaaccctgaaaatcaacaactaagccgaaaagccaaagaacccaaaaagcaaaccccccacaaaaacacaccaaaaaaacacccaaaccccgcaaaaaaaaagacaaccaaaacaaaacaaaaaaaacccaacacaaaaacaaacacccccgggaaaaaatagcaaaaaaaccaaaaaaaaaaaaccaaaaaggaaaaatagcaaaacccaaaaaaaggaaaggaaaaaaaaataaaacaccaaaaaaaaaaggggaaaaaacaaaaacccccccaaggagaaaaaaacaaattggaaaaacaaacaaaaaaaccaaatgtgtaaaaaaaaaccaaccaaaaatagaaaagatataccggcacgaaaaaaaacaaagggggggaaaaaaaaaaaaaaaaagaaaacaaaaaaccgacaacacacaaacaccccaaggaaaaaaaaaaaaagaaaaatgagcccaaaaggaaaagacaccaaccaaaaaaaaaaaacgagcaaacccggcgaaaaaaacaaaacaaacaccccaaagaaacacaaaaacgaaccacccacccacaccaaaaaaaagaacacgagaaaaaaccccaagacatataaacaaaaccacaaaaaacccaaaaaaaaaaaagaaaagaaaaaaaaaacctaataaaaccacccaaaaaaagggaaaaaaacacacaaaagaaagacagacaacgaccacatccaaaacaacaccccaaaaggaaagaaaaaaccacagaaaaaaaacccaaaacaaaacccaacaaacccgaaaaagaaacccaaacaaaggaaaaaaacctgaaaaccaaaaaacacaaag

SEQ ID NO: 3492 - DNA, 381 bp, Bacillus thuringiensis
taaggcttgttcgacttaattctgtatctttgtattttcagctgccgagtaaattgtcgttttctgtcaataatatttacgatagagtgcctgtaacaaacgtttgcatctttgttaataaaagattgcttgacaattctttaatgaggagagtgcctaaacactacacacatctttctagttacttcatacggaccttagtaaatatttctctacttcctattaatacctaatattcccgataaaaagatggttgcttgaataaaaattaattatatgtaaacctttcccgttttttatgacctcatatatattttcttgcttttcccagagaattaaagtaaatagagatatagggagagcaatttccttcgcctacat

SEQ ID NO: 3493 - DNA, 322 bp, Bacillus thuringiensis
  unsure (1)...(322): unsure at all n locations
aagcgggccgacgaattaagaagaggcttcatacaggngaaagcaacganccaggnnggaacccacagaaaggcaccgccgcaaccccagcaaacaggaanagaaacccngccagcccacgccgaaaacaaagagagccaagcgacagagggaaaccgaccgaaacngccgaagagaacgcaaaaagcaccccgacgggggaggacggccgcaaggcngaaacacaaaggaaccgacgggagcccgcacaagcagcggagcacgaggccgaaaacgaagcaacgcgaagacaccaaccagggcacgacacccccgaaaaacc

SEQ ID NO: 3494 - DNA, 223 bp, Bacillus thuringiensis
aaaaagaacaaggcatagtggcattttgaaaggaagccggcggacccatcaaagagggacgatttccgcggatcaacacctgcgacgaacaactgaaccggctctagctgtctcaggagtgctctgacaagctggtatgaaaaacccactcgctgaagctggggcaaccggcataacgtcaggaacaagatttaggacactcggaacgatcacaaggaccccg

SEQ ID NO: 3495 - DNA, 475 bp, Bacillus thuringiensis
  unsure (1)...(475): unsure at all n locations
aaaganggggcnnnaagcnnaancanaaacaaanagagangaanagggcgaaagggggnccggcggggacnncnnnagcnnananagngccngaancacaannagcgaaagcaagagcnanagnnganccnganannnccgaaaacnccaacnncgaaanagnnacgaancagcaaanggcnccactggggctaaaagggaatttgcatatccatttaaatacaaatgaaatagatacattaaaaggaggaaaaattaaattaaaagaagggaatacagttattcaagagaaaacaattgaaacaacagatatcaatttacatgacgtaccaaatggagtgtatacggttgaaatttcaggtgggaaaacgaatagtatgtaccatttcagttcgtattatgcctatgttaaagaaaagattatagtctaaagatgatattacgaaatgaaagtgagtagttggtaaatgaacga

SEQ ID NO: 3496 - DNA, 136 bp, Bacillus thuringiensis
  unsure (1)...(136): unsure at all n locations
aggcgcaagaagccggccaacgaagacagagaaacttctctccggacacaggaaaaannangacggacggaccaagaggagganacggcgcgcgccccgacacaggaaagagcnnccaaggngcagnnannacacc

SEQ ID NO: 3497 - DNA, 342 bp, Bacillus thuringiensis
  unsure (1)...(342): unsure at all n locations
acaggcaaaaaaanaacaaaggagggaacaagagaggaacccggcggaacacccanaccggaaggagcaccaggggaaaaccaaagcaacgaaacaaaagcccccgaacaaaacaaaggagacaaaacaccaacaaaggccacaacaaaaaaaggcagaaaggaagagccacccaacccaggaccaggaaaaaaaaggccaccgacaggcggcgncacaagaacaaaaggggaagaagccgacggcaccaccccagaaggagcaaaagccaaaaaccaagacgcccacgaaaccaaaaaggcaacccgaaaaggacaaacgacccgaaaaaaacggcaaaaa

SEQ ID NO: 3498 - DNA, 129 bp, Bacillus thuringiensis
  unsure (1)...(129): unsure at all n locations
aacgccngcaagcccgcccancgggggggagnagggacaaangcggcgggcaaccccgcaancagagcnaccaaaancncaaagannaaagaacgagcnncngcaaagaaaagnacangaacgcaaacg

SEQ ID NO: 3499 - DNA, 124 bp, Bacillus thuringiensis
caccaacgggtggaacaagagcgcctgcaggcgggaccagccgcacggccggatcagagaaagaaagttctaattcacgagatggaacatgttcaacgaaaacatcgacatctatacccggagc

SEQ ID NO: 3500 - DNA, 243 bp, Bacillus thuringiensis
ctagaacacacgtgtggcggcaaaagctggcggccgttgtaagctatactgtgaccgaagtggcccgtcaaaagactggccgggataatacaccaaaggagactgggctaacccgctcgctacccaagttaataggctggcaaaacctaccacattcgccagctgtcgtaagaacgtacaggccgcgacagatggcactttccaacaaatgtgcagcctgaatagcaaatggatattgtaagc

SEQ ID NO: 3501 - DNA, 126 bp, Bacillus thuringiensis
  unsure (1)...(126): unsure at all n locations
aaacaccagagggaccaaacaacgggaggaagaaacaaacaaccacanccgcgaaaggaaaagagaaaggccccaccgaaacaccaaaccngagagnngacccacaaacaggacaggcaacagggc

SEQ ID NO: 3502 - DNA, 191 bp, Bacillus thuringiensis
  unsure (1)...(191): unsure at all n locations
tcgttttcataacataattatctatttttatactctttnacagcattactgtgtgtgtgtacaaggtgattcgcgccttaaatagtaagattcttctaactactacaagaggggggatcgacggatgctccatgagaacaatacgccgacaccgggtctatatccagattatggacatgcagaacacgatg

SEQ ID NO: 3503 - DNA, 117 bp, Bacillus thuringiensis
gataatttttacattgtttttctgacaactatatgtttgctggcgaaatcatcccacatgggaaggcaggaattgtcgatggtacatcaccacatgcaattgaccccaacatgccac

SEQ ID NO: 3504 - DNA, 178 bp, Bacillus thuringiensis
ttttgtcttctcaacaccttgcataagataatgggatttcatgactagcgtgcgccattaacttttgtacatcacgaatcttcattctattcttaaccagatttgacccccatatctatcttcaatagcatggattttaaacagatatatccccccattctcatacaggatttcatat

SEQ ID NO: 3505 - DNA, 366 bp, Bacillus thuringiensis
tcattgttatctattttattcagttgattgactttcacgacagcttctattttacaaggattgaggcacccgttgaagccaggattacttgttgtattagccggtggcttagagtatgcgcaaaatcatatttatatgccaaatcatgttgagacaggcgcaccatttcaaactgtattggccataataatcagatttcgactacaagcttttgcgagcctcgagtggtgttagaccacaactgtggaggacggagcacatggtcggtgtagtctatagagctaccctgaatgggctgacaatacactggccgttgtttgacaacgtacttgactgggagaagcccttgctggtacctaaacttaa

SEQ ID NO: 3506 - DNA, 113 bp, Bacillus thuringiensis
gagaatttatcgcacacgtcaaaaccaggactgaggtgggaaataaaagagtcggatgtggtcaagaataaacaattatttacaatgagcaatgatcaagccgattaacagag

SEQ ID NO: 3507 - DNA, 199 bp, Bacillus thuringiensis
taactctttttttttccgcacgccaaacaaacagcacgggggagggcaacatggaactacggcagctctaacagtatactctttccaactagtatctccaaaaactttcgttccaactgattatgttgttatgtgcaattgtaggaactagttatcgatagtgcatttaacaactgcttgcaactgttaggacattgcc

SEQ ID NO: 3508 - DNA, 211 bp, Bacillus thuringiensis
  unsure (1)...(211): unsure at all n locations
atacacgcggannatgttgtgttgttgaggaaatcgccgggcgctgctgaagtccaggaggaagcctttcaggtttacagattacggcactgagctcactagcatgtaacgcattgcactctggaccagcgctctggaacacactgctgctgagactttctgcattatggtccagaactaatattcttctatactgccatataggggaata

SEQ ID NO: 3509 - DNA, 332 bp, Bacillus thuringiensis
  unsure (1)...(332): unsure at all n locations
aggcagggagaagcaagggcggcgaacgaagacaanaagtatcattgaaagaccgaaaacacggagcagggcgggaacacaaaaaagaaggcgacccactacgagaaaaaaaaacgcgaggcaaaaatacgccgcacctacaagcatagccaataaagaacgggaaagaaacccgaacgtgccaccaacaatacatcgaaaacgagtatcgcaacattatctgatgggacaagcggactgagagacagagcaagcagagccgcaggacaatccgcagtaacagcagctacagaaggggagcgcgcgaatgagaaacatggcaggacacaacc

SEQ ID NO: 3510 - DNA, 331 bp, Bacillus thuringiensis
  unsure (1)...(331): unsure at all n locations
aacaaacttgntggaagaaaaccgagaacaaagggaggtttttgggaggcaaccggcgccggcccccncagcggaaagcnaacnaaaaccaacgcgcnnccaacaaccacgangaagagaggaaaaagcagaacaagcngcaaccnnccaaaaagaagaaaaaacccaaaggacgagcccacagcaaaagagggaagcaganccaaaagaccgnccgagggacgggacaacggaaagcgcacgganggaagcannccagccaacgaagcacngaaaagaaaagccagaaggannaacgccannccnncngggacgcggcggaacacaagac

SEQ ID NO: 3511 - DNA, 310 bp, Bacillus thuringiensis
  unsure (1)...(310): unsure at all n locations
atttggagangccgccccgacatcccgccgcgaggcgccaggcggaggcggcaaaanggcaccccaaccaaacnannnaancncacaaagngcagacaaaggcgnaccnncgaaccnagaaggggnnancacgacgnanccagagccagagagcnacacaccaggaagagcggaaggacaccccaaagagancnacccgaaccacgaagaaaaacgnncagangnnggnaccgcaggnccaacgagcgacaagaaannnaaccccgnaccagacgacnaacagcgnangaaccgnncgaaagaccacgaa

SEQ ID NO: 3512 - DNA, 195 bp, Bacillus thuringiensis
ggagaacaagcctcggaaagcggggggctattaaaccggcacgctccgtatcaagaggaggcgctgtacctgcaagatatatggaagggccacataatatcccggatccatcacgaaaagaagttgtaactgtgagaacatggaaaccgatgaaatcccacacgacgtacgagccggacaacatccgcggcaaga

SEQ ID NO: 3513 - DNA, 392 bp, Bacillus thuringiensis
gcgtgatcgttcgaataagctttggtgagaccaattgatgccgcactggaaaaccaagggatgggggggcttgagaacgaacaggcgggacacgattacgggcaacccctcaacaattagaaaaatacttatgacgcgtgtatatcctatcgagcaataagctgaatcgatgccgagcgcagcctacgatggacaaggataacgcacgagcctggaaaaggaggatgcattaaataacatacggatacaggcacaggcaagggactggccctcgcgcagatactactggacgtagtacacaagaggtcgcacgctagacccacataccaaagagccaggcccacagaaggcatgggatgagaacatagtgatcattttacgatgccagacaa

SEQ ID NO: 3514 - DNA, 359 bp, Bacillus thuringiensis
acagagcaaaaaaggatgtttttttaagaaacgctagggccaaaaactcaaaccataaatgtcgaatcctttctaccaaaaaccttatacattgcaccaaaaaaaacctacacgcacttagtgaacctcctgctcataacacaaccctgaatgcataccatcatattatcgtctgcattatacgagtatgaatactttgtttactcgcgaaatagaaataaacaaatctgttgctgtctaatcattaaacacatcacctttgccttacatgagccactcatgtattttatgtaccaactgcgaattgttataaacatctacctggatcattatatatgataaagattttactttaaatt

SEQ ID NO: 3515 - DNA, 176 bp, Bacillus thuringiensis
  unsure (1)...(176): unsure at all n locations
aaactaattgtttaagaaaatncatacggaacggctgggggggggacgtggagtaacaggggggcgtaaaacaaaggatattgtaaagaaaaaaggctgaaggtagttaccccctaacaagaaggagtaggaacctgataaaacaagtaaaagaaaaaaaactagatcaaatataa

SEQ ID NO: 3516 - DNA, 115 bp, Bacillus thuringiensis
cggagatctacctaaagagtgaggagtggtcttataatacgaagacatcacaaccgtgtagcgttatacgaccatgtaagggggcaagctctactaagagtgcaatccctgctac

SEQ ID NO: 3517 - DNA, 175 bp, Bacillus thuringiensis
atcccaattcgtgatccgtattttagaagcggcgaaagaaaaaggcgctactcataccattgatatggcagactattggggctgtggtaaaacaattgggatctttaaacactcctgatcctgatgcgataatatagacactcgcattcaagattacctatagcgaacggaaaac

SEQ ID NO: 3518 - DNA, 268 bp, Bacillus thuringiensis
acgatcggatcagaatcggatagaacatattggcaatacaacggtgctatatatacaactaaagagccatatccaggggcccctactagaacacggggagacttccgacaatgacattcaaaacgtgagtcaaactatgctgatacgaatgaaagacatcttgggaacgtgacttctgaatgtatagacacagcaaccatgtaggcatcgggcagaaacaccggggcccatctgttcaacaagcgaaccccattggccacaccatgga

SEQ ID NO: 3519 - DNA, 180 bp, Bacillus thuringiensis
tggcccattagcatatcctccacgctagacttgttgtaaccttcgctttactcaacttcagcgtccaatacatcaaactcgcggggagacaaataaagctttatcacaatgttgacaacaatccccacttgaatgcttccccactacatagcaacctgggctgaaacctcgatcaattaa

SEQ ID NO: 3520 - DNA, 438 bp, Bacillus thuringiensis
  unsure (1)...(438): unsure at all n locations
ccttgattctacagatcgaataacatcacgagttttatctagtctatttgtatgcacttgctctaccacttttaatacttctttatcagttataaatgatttgtaacgcaatggaataatccctctacttgcactagctacttcttgcatactttctaaacttgcgcttatatctccaatcaatactttatcaacaccacaatcttgtacaagttctaagtacgcttcaagcgggcgcatattgcgatgtttttctaacgttggtaacccttcatataacggaccaacgttttccgcatcttcttgaataaaatgccattgtctttattccgcacttctgtaaatattgattttggtttttgtaagaaggacnttgctagtcctgtctctggcgccggtaaaaaatatgccatgcttcaacattctctactcttatat

SEQ ID NO: 3521 - DNA, 216 bp, Bacillus thuringiensis
gtgctggcaacgctctatatgcatggtctttttttccaagcacgcttctttaccgacggatgggcgataatcttaacaaaggccgcaacgcgccggaggatatcctagccactggacgggatctgtatcgcagagcaagtctactgcgtaatcacctgttgccaattacatgacggatagtaactcacatggcggcctcggttattaaattaacgg

SEQ ID NO: 3522 - DNA, 379 bp, Bacillus thuringiensis
gagcgatggggtcaggggatctctgtcgatatgctggttgtcaacggactatcagacgcatcagtcgggaataagacgggtatgcggctgttaacgtaaaaaaaccacttatgccctatgacacgccggttgattggtctaatgaatgagaaacgctatactgcttaaaaagggtctctataagtgatagaaacctgttggcagaaggttaactctattatttccttgtttaatacacaatgtacagctatgcatacttggttgaccgaaacttacatagcacagagaaagtagccaccgtgccttaggaaaggcaactggaagacctagagttcgcttttcaacataagactgaaaggaaactacagagataataact

SEQ ID NO: 3523 - DNA, 247 bp, Bacillus thuringiensis
ttcgtgatctgtcggtcctgaaacgtttataacatcagctcctttattcgctgccacttccgcaatcgggtgcgttatagttgcagatggggggtttgtcataaaaagacctcttatttcctatgacacgcctgttgattggtctaatgaatgtgaaacgctatatcgttgagagggggtctctataagttgatcgaaaacctggctagcagatggttagagttattatattcttgctttctacaca

SEQ ID NO: 3524 - DNA, 301 bp, Bacillus thuringiensis
attagcgctcgtgcttgacatttttgtatatatatgtatgactagtgtcgctaagaaactaaacataattatgagcttagtattgtttagtgtagctattgctagtttatcgaatagtgcaatggggggccaattagatgacatattaaacacacgaatttctgagtttctccatgagaatggaagtggtcgatctacattgtgggacgctggttttaaatattacttatccaatccatgtatctgaattggagcagttaacttctcgaatgattatgacgatgaaggtactgaataatta

SEQ ID NO: 3525 - DNA, 290 bp, Bacillus thuringiensis
tagtgatgattgagggaccttctggcttcttctaacacactattggagaagaccctttgctgtgcactgagcccaagaactctgacgagtattttcagcacttactaatgattgacctctgtaatgcgcagaaggcgctctatggggcgtcgaatgaattccggtgagcgtgcattacctaatatacctgcacagcactagcttacagagctcgatacttcacgactgcttatgataaagcttttcaaagctgcatatgccaacgataccacacatacctgcattaccta

SEQ ID NO: 3526 - DNA, 122 bp, Bacillus thuringiensis
  unsure (1)...(122): unsure at all n locations
ccagagaaannaaaagcaaaactcataaaaaacaaccatataaaaaccaagcgcaacaaagagaagggggaggaaaaaaaaaaaaggcgaaagaaaagcacgaaagtgcaaaacccagaaac

SEQ ID NO: 3527 - DNA, 216 bp, Bacillus thuringiensis
aatgaacaaatattaaagactgtactaaatcgtattgggggtaaatttattgatttctgggagtaaaatcatatccttctcccacttttacaacttgctatcaacctcacagtatcactattttggagcttactaatgaaacatcttcacttcacttacatgaacggatattaattggaaaaagattgcactccacttattatttcgtagatacac

SEQ ID NO: 3528 - DNA, 165 bp, Bacillus thuringiensis
agatgttatattataaaataccaattgaaccgagaaggggggctttattttgtcgcttgaaggtaacaacatgtacgatgttcgaatatgtaaatggaatactggctatttaatctctaaactttccccgaaaactgaaaagtggcatgcattaacagaaaaaat

SEQ ID NO: 3529 - DNA, 159 bp, Bacillus thuringiensis
ttcagatttctgctttttttttgttcttcacgaactctaatccaggtggaattttatcttctactgggacctctactagttttccgttatttacctggcttttaaaccaattcggcattctacttcttctcctaattaccggttttattatctgtctac

SEQ ID NO: 3530 - DNA, 166 bp, Bacillus thuringiensis
gtatttcatatttcacaagcggaataagccgaagcaggggcttcattagatacaggtccaaaaacaacaacctttcaaaaggaccccgaacttctttaacttgctattgcaccattgtactgtctctatacattgtacatataaaccagcctccatcttgagagca

SEQ ID NO: 3531 - DNA, 443 bp, Bacillus thuringiensis
acgtattatattggctaattggcaggggaaactgtgtggcatctaaactgcatgaggctttacaaacctgagtgcttgcgttagtattgtaccttcgaattaaagcagcatgggcgttttgaatatgctgaccggaatgtatgagaatgttatactccatattcgtacgtgagtagtgcgataattaatgcatcatgtcgtatttgcacataccgtgaataaccgatgtctccctcctctaccgacttcattaaccactgtagagcataatctattatcgcccaatatgcatataagcttggcctaatgaataaaactcgtgcacgtgacatagttgttactgcttacatcataatttgagaacattatgctgagaacattatgctaacgaggaaacgcgacaatttatgtcctggttagaatgtagaatggtgatacatttg

SEQ ID NO: 3532 - DNA, 429 bp, Bacillus thuringiensis
attggcgattttagctcagctttaatggcattaactagtggtcgatcagatgctactaacggggtacctctgctactagcactagggttgagatggggatgagattgtgattggaggactttccagagcacgaggacctttatcaaaagcaaatgacaacaacctaagatgcttacaaagacaccaggcattacagctggaacaccgttcaagacaatgcttgacgttgaggtgcggaagcaccaggaaagctgaagtatcgccaggaaccatagagctaactgaacgatggataagccattcgtacaaagaatgcactatgatcaacgcctgaatgctctagaggaatttaaagaaacgtaccttgcggctgcattttgggaagtagattttaagatgaaagcacaaacattaaagcctggactaaac

SEQ ID NO: 3533 - DNA, 268 bp, Bacillus thuringiensis
tgtcattatttgcattatgccaaaagcggtgtaacggtgcttgcgaaaggatagagagcgaccatgtatacttaccatatggtttagaactaataccatttttaccgctttttagaaaaggcgctgcatgctttagagggtacggatctagacttacaatatgcgggggcatctagatttaccttaaggaaccgttaaatgacgtgagatatttatggccagattgcgagagcgtatacagacgctattgtatgaagagcttgaccac

SEQ ID NO: 3534 - DNA, 407 bp, Bacillus thuringiensis
ccatctatctacttacctcctaatgaacggtctatttgttcgaatgattgaacgttaacccacacatggtaatgaacagggacatttaagacttttttcaccgactcacgtgtgctatctacggcaccatgtgcgcgggcttgagatatacggtctagtaaattattagcagggatgtacctcaccagcatcacgcggtattcttactagcatagcagaacgaacatctttgtctatagcagctaattaatgtgcatgtggcttgactgacttgccctataggcttgttataatttgactagcatgctacacccatgattaacaactgctagatacatctttaaaggatcagcaaagttataacgctccgatgactgatcaatgttagcatgcgcataatctacaac

SEQ ID NO: 3535 - DNA, 155 bp, Bacillus thuringiensis
tccaaagggaagggtagctaaagcttcagggctggacaatacacttacatttatcttagaggatattggtttaaagatcagaaaaacgcgcgaagatactttaaaaaaccgttttgcagaacttccaagtcccggaaacgtgtttctggatgaac

SEQ ID NO: 3536 - DNA, 131 bp, Bacillus thuringiensis
acttctgcacacacatttaacataagtgcttattttttgccacccaagcaggcaacctaggatggtgctatatcatcctaccgtgactctctaaagatcaattacatcgatcgtcccaacagaattccaac

SEQ ID NO: 3537 - DNA, 281 bp, Bacillus thuringiensis
tttacagatgtttactcttatccatttctaagttatgcgaagaggcaggaccttcaataattcaagtgcctcccgccggatttaagtgcctagcatcatatatctctctatgaatcaacgcctcgctcaccaccttgagggcccgtgcatctatctaacatcgcactctataatatatgcgatgcgagtcgatacccgacatctcaaattcgtctaaaaatcaacaaacacactgacactcctaaataacgccaccataatagccactagaacacacctga

SEQ ID NO: 3538 - DNA, 199 bp, Bacillus thuringiensis
gacagaagcagtgcgtagaagctagtttttatacatgcagtagacaaagaatattgggaatatcgccatataaaagaacaacggccaaaatgagaagagttcccttgaataaagaaaggaaaggaccagactcgggatcgccatggggagagaaagatacaacaggttatttaaagatgcaccatgatcaaaatcgact

SEQ ID NO: 3539 - DNA, 228 bp, Bacillus thuringiensis
gattttctctacgaaagagtagacaactaaatggcaaattagtttcactcaagggtctatgtcggcttttatagcctttttgacattattcagtttacaagtagggaaacgtttattctctttcacgtagcttattacaaagaaaagaaaattttactcattcatacttgacatggattacaaatacattgcatcattgttacatacttgatttggtctttccttaaa

SEQ ID NO: 3540 - DNA, 152 bp, Bacillus thuringiensis
ctttattctccaacaggcgcgcatacatgcggaggggctcctgtaataacggtgggagaactacaacctcatcttgttgacaacattcttattagagcacccattgcatcccgagcctcacttaaaataacagacgaatcatcaagcgtaca

SEQ ID NO: 3541 - DNA, 105 bp, Bacillus thuringiensis
agctcactcaaaggattttttcccccactttttaacccctcatttcctggactccaaggggaatttacaggcatgatgtggtttaatcgataaccttccagagcc

SEQ ID NO: 3542 - DNA, 200 bp, Bacillus thuringiensis
tgagtcataagggagaccgttttgtttatgctcacaacttatggaactgggtatgatgacggctattatggctaggggtgcacatataaaaagtgggaaagatgttgtatgttatatagtactctgaagcacagttgatacatgatagatcataatttgaggcatgttcatggacacagtggtttttacgtttaacagag

SEQ ID NO: 3543 - DNA, 278 bp, Bacillus thuringiensis
cgcagcagtattatccccacatgctcaatttgctatgggggtcgtataggattcagacggtattctaccggaaacggccacaacatcattagatgttactactcttgatgaggtgctagagttattagtcagacttaatgtaacaggtctatatacaatgctaagggcatatacaccgtgtgaacactgaagggctgattgtagataacaaagcaaccattgctgataaacatatgtacccgcaggataaacctgatgacagtagccaagcgagaaac

SEQ ID NO: 3544 - DNA, 180 bp, Bacillus thuringiensis
attcgtgatctggcctagcaggtactgtccttgatggctttactgtgtcatggcactacctgcgtgaatttatatagcacagctgtcagcacctgtttgaccagctggatctactgaatgatacaccgtatgcatctgcgaggggatactaaagggcaacctacattgttctgccacgaa

SEQ ID NO: 3545 - DNA, 375 bp, Bacillus thuringiensis
tagttagtaccattttttcatactcgaaagggggatgcagagggtgggtgtattacatcagtaggagtacattaagtgacattgagataaagtactatgaacattgcggagagccgttacaatgggggaatagttacagctgaggagcggcgatgtgttgttaaacggatgagacgctttaatatgttaagttactgaaggtatgaggcgacagatgcgaatgaacgtataaagaaaatcgcagggttgagagcaaaggtcggggccaaggctgctcgagaaaaggatcgaatgtgatgaccgactataaaagaaattgagagtattagcggcaagaaaattgctgcattaggaaactttcaaactgatggaaca

SEQ ID NO: 3546 - DNA, 402 bp, Bacillus thuringiensis
ttcggattgcgtgtaaatcgtattctgtttttttgtcccactacttgcatagatgcaggtgggttgatcgagacagggccgatgtgaacgaatgtaagcagtgggggaactacggtattatccattgtaaacgtcgggatgagtttacaaatcgacgctgtgatttgctctggcatgaagaccatcgatgttatgtctaaacgggtatgtatgcactcgcacactcggaacagttaacatacacgagagggaggtttgactagcagtagtagtaaacataaggtgagtgaccactggttccaatgaccacatggagcttgtagggtgattaaacacccgaaacgaaatttgtgcttcaatatcagtggaacacgctacgggaggagctgctagagaaattat

SEQ ID NO: 3547 - DNA, 268 bp, Bacillus thuringiensis
aggaaaagctgtggaggttgaattgatatatactggaggaaccaccagtttaccgatcgtttatttaggtatacataataatgactgtataaaggatacacaagaacaggttgcaatgtgtttctatttaatagagtacagatcggatcagggtattaatattgatcctgtttaggtaggatcagaatactattaagctattgctttatgagggcagaagaaagcttctgcctagaaaggaatatgtgaaaagatcctatatagttcc

SEQ ID NO: 3548 - DNA, 187 bp, Bacillus thuringiensis
caccttgttttcctacccgctcaccaaacctcaggggggtacttaaaaactatgggcggaaaaaaaacccaacatgccaagctcgaaaccgggactacttatgaccaccaatgtccacaaactaattggacccttacccttaaacatcacaaaacaagaccgtcctttagggatacctaacatcatg

SEQ ID NO: 3549 - DNA, 116 bp, Bacillus thuringiensis
cctacatcaacacgcttaattttttacaacgttttttttcacccttacacaccatttccactgggggatacatgtaaacacaggcgaagaaacacaaacttaaacacccaaaacag

SEQ ID NO: 3550 - DNA, 385 bp, Bacillus thuringiensis
tacctatggcaacaggtgatgaatatgtgcggtgtgagattgctgcaattcatagggaccgctatgagcgcccaacgaagactatactggggccaagaaagggcactaactgcatacagctacacaatgggaacaatcttgtgtaagaggatggatgcatgtaagagggacaaaccaggaagaacacgcatctagaatcgagcggtgagggaggaaaagaacggaaccaaaaaggaagttccaaatcaccgagaatggtaggaacgcaagagaatgcctaaataggccggtctttaagggacaagcgaagcaatgctaccagggatggagccaaaggaagagatgatccatgttccaatacaagctggtccactagcacttatac

SEQ ID NO: 3551 - DNA, 167 bp, Bacillus thuringiensis
acttgctaggtctataaagatgcattcttcacagaagactcatctctgctgcgggcgcgagaagactctacactgaatgaacatgactacatactctgaatgacagaatagactcagtacgtattcctctggacgtttcaaagcgcacacaaccgatatcgataaga

SEQ ID NO: 3552 - DNA, 161 bp, Bacillus thuringiensis
  unsure (1)...(161): unsure at all n locations
gaaaaggcaantagaaacaccagtgccataaacaccaaccaagctaccaagacacaataacccggcaggctgccgaatcaacaagtcctgcaaaaagctcagcacgggtcaccagttcaaacagacaagcgaagcccccatcgaacaaacaaagagcaaac

SEQ ID NO: 3553 - DNA, 109 bp, Bacillus thuringiensis
tgaaattgtaagacccgagtatacaacattccgggggggtcaataatcccttgggggggacaactagcctttctgatatagctaacccagaaaccttggaataatctta

SEQ ID NO: 3554 - DNA, 131 bp, Bacillus thuringiensis
tcacaattcggatagcgtttttttgtgagcaaatttctttaccggcatttttttcacccacaagggaataagcggcgacacggggaattgttgaatacctcatacgtctctccttttttcaatacttgaat

SEQ ID NO: 3555 - DNA, 187 bp, Bacillus thuringiensis
atagatgtgaaacctgcatatattgccccgctatattttaccacgcccgaaccatgaacaaggggggccgctacaggaacagggggggacatatctccgataaaagctgaaaccatagcaacaacagaaaggaaaccagtccataggacgagccagcgaccctcaggaaacaccctagggaagacag

SEQ ID NO: 3556 - DNA, 173 bp, Bacillus thuringiensis
ttactgttctcactaaattctcaattttctctctatgctccgaagtaatggtctgtgttatacataaacaagggaggtccaggtggatacggaattactattatagacgctatcattctaacagtctcaactatagatactatttttgtttcatatccgtctagttgtttata

SEQ ID NO: 3557 - DNA, 116 bp, Bacillus thuringiensis
gatgcttttctgcaatggagccaacctgcggggtcgattaagaaaactgggggacaccgatacacaccgggctcgaagcaaacatagcagcaagttaaaccggacgtgcactctat

SEQ ID NO: 3558 - DNA, 316 bp, Bacillus thuringiensis
tgaggtgatggactcaatactgacattatctgtttttgcatcacgtatggcaagaaaagggggggatttcaagatgattcaggtgatctaagccctgaatgaggatgtattccaggagaagagacataagccttgcgcgaaggaactgaacagctcttagcgaagagcgatgcccacattattgatgcgctccaaacgttaatcaacagggggggatctttgatgaatatcgtagcagactggtatcgaatgaacctaattagtgctcgaatatgaatatgattaaaggaaggtgcacgctgatgtttgaaaaaag

SEQ ID NO: 3559 - DNA, 127 bp, Bacillus thuringiensis
cacgtagtgagctgagtggcataccgccagtcaataatccagcggagccaagtgcattaatgccaggaactaccaccggagcgaggaggattggaacgagcgtggtgattacgtataaaagtcccta

SEQ ID NO: 3560 - DNA, 207 bp, Bacillus thuringiensis
aattcgtgattgagacatacaatacgtctttctggacgtttttgtaaacgaggaatgaaccacaagatggggggtttttgctcctgtgcacagatatcaaaaacaagcggttctagcagatattaggctacctcaatgctacgcacaagcgactattagaacagatagcttggtgtgacaagaggaccgaatctgtattaactacct

SEQ ID NO: 3561 - DNA, 301 bp, Bacillus thuringiensis
tgtcataggaaatgggaggaaaaagaagtaaaggttcaaacactggagcatagcggctaaggtaggcatattatgtatccataaactgcttgacgcgcttccgatatggagcgcggctgacagtaatctcgacgatgataagcgaagatataagattaagagaggattcgagtttgtcgaaaggctacgccagaatacaaatcccgcggcacattaggggactgcagtggttactgcatcgattgagacatgtaacagagatatacaggctgaaatggaggaaaagaaaaagaaagaacaa

SEQ ID NO: 3562 - DNA, 273 bp, Bacillus thuringiensis
agataagatacagccaactagcattaggaagaaaggaaaaactaaagaacaatatggcacagacctggcaggactatagagatgcgaagcgtatatccctattagggaactacgcagatatgctgaaccgaccctgccggttcatgcatgccggtacgcctttctctatgctgtaagcgtgagacttgataacatctgacgctggatgtgtcacaagccagagtatggcgatcggtccaagctgacctgagggcacgaccctaccactaaaac

SEQ ID NO: 3563 - DNA, 219 bp, Bacillus thuringiensis
gtgatcacacgtgccgcactttcttttgtgaccggaatgcttaagcgccaataggccggtacccttcggggtatatcactgttagatcagctgattgatgaaccgatatggcaagcgctgataatgtgctaaaaacagcaaagaatagaccgagatgggggcgtgcgatgcccccgattgcgcacaagagtccattgctttttatcttatgcttcaccg

SEQ ID NO: 3564 - DNA, 379 bp, Bacillus thuringiensis
acgaagatggctgctcggatttgttgccacaagcagacggtctggtgttaggggagatatcgatcaccaattcacggaattgctgtgctgtatatgctatgtagcgtatttttgaccgacttaatccgacggctcgatgacaattgggatcaataatacacaacttggttgatgctaaagcagagttctttaataaagataaacttggaacaaaagccatgcctggagctagctttatgatgtgtgtaatgacagccggtccatctacttcagaagcagtatgcggggttgaaccagctactttgcaaaaaacatccgttaagtgtcgaaaaccatagacagtggtcatactagtaaacggatcgatctttacttcatg

SEQ ID NO: 3565 - DNA, 313 bp, Bacillus thuringiensis
cttaccaactcatttagcacttttttatactacgcacacgatcttattagccgggggtaattattcatatataacgggggacaaaacgcgtggctctctcgtatgaggttcccactccctcatgaaaatattagcggaggctgcaacaaagcctgaaaatcgcattcttgctattaaccaacagcagtacatatcacaaaaactggtgcttttggtacttgaaagacccgttttagaagaaacgattttggcatgacagtggaacagacttgtgcaatcacatgcgaattactcttaccaatatagagttttc

SEQ ID NO: 3566 - DNA, 183 bp, Bacillus thuringiensis
aagttcgtgagttttctatttcagaatagtacatatatatttcaacaattacatgagtctaatctaatcgtcttgtaatggttagtattttaagtagcgatgaatgcatcattatttcataagcttggcaatcaagcgttatggattatatgagcctaatgatcattttttttattatttatc

SEQ ID NO: 3567 - DNA, 158 bp, Bacillus thuringiensis
tcggattgtgaacttgggatataatttttttatcttttattccttctacaatcgcttctgtttgtggtatgttcagaatgggtttctgctgcccctactaatctaagcaggtcattttcattgaatccatctgctacaattacatctgttaacaccgg

SEQ ID NO: 3568 - DNA, 148 bp, Bacillus thuringiensis
tcgtgatcggaaaagtgttatgtgcaaatggtttagtttttaaagaggaagctgaaaacagggtattgtagaaaataaaacggggtgcaccacctatacatgcatttgaacgtggagaggttaccggtggatttgaaacagggattaa

SEQ ID NO: 3569 - DNA, 123 bp, Bacillus thuringiensis
gctctctactttgtactaatattgttttacgagcagcaccgtagctacgggtatggttcaattgtgttagggcttgccttaacgccaatttcattcaccttatggtcatacggtccaaacttc

SEQ ID NO: 3570 - DNA, 177 bp, Bacillus thuringiensis
  unsure (1)...(177): unsure at all n locations
ttgagtccaacccggngagttacgttttcatgggagagggaagcaaccagggttgggttgccaagcagagggggggttgtggtcacacaacgaacacaactaagcgtggaaaaagcatcatttagggccaacgttcattttctaggaagagaaggtgaatttctcaaaaatgctaaa

SEQ ID NO: 3571 - DNA, 417 bp, Bacillus thuringiensis
catatatggcgccctgtgtaaatacggcttcttttccttgcctgccgctaacaacaccaggggtatatcgctggtcatcacggctgacaacagaaagcattcggccatctgaatacgctgacacgattgtctagccaagggtcactctttgccacacgtgtggccaacctgggcctgttgacgctgccattgatagggttgcccaaatcggcgcacttatcactgaccgaacgttcacaacgacccgcctggcaagcctccatattttcataacatattggcctagtaaagcttgcccctaacgtcagatggcgttcaaacgtacaggatcgcagccatacatcctatcagctgcagtgcacctagtacgagcaatgtaaaacgctggaacatctaattcgagcatagccacggacg

SEQ ID NO: 3572 - DNA, 147 bp, Bacillus thuringiensis
tgatttgtacggagccgtttttcccatttcaggcgacaggacaaattttgtttatcaaaccatcaagtagttctttttaagagatgctttgtataaatattttgcgggaatatttttaccttccctattgaaaaggatgtttcacaa

SEQ ID NO: 3573 - DNA, 105 bp, Bacillus thuringiensis
ctgttccgtccttttctctcctttcgtggaaggcgtggctgcttttctcataagctcacgtctgtagtgtatcttcagttccggtgttaggtcggttcgcttcca

SEQ ID NO: 3574 - DNA, 128 bp, Bacillus thuringiensis
gaacggttcatcaaaggatgcccaactggaaccagaatgatgaccagccgaggatattcagcgacaactgtgcgatggcatatagagtacggccagtgaaaaagatatgcgctccaacacttgcctaa

SEQ ID NO: 3575 - DNA, 110 bp, Bacillus thuringiensis
tgatcaacatcatctacaaagcttacttgtttaatccctcgagctttttccacataacatccgcttgctcaagctcgcgatagcgaatcatcagcgaatgcatctaacgg

SEQ ID NO: 3576 - DNA, 199 bp, Bacillus thuringiensis
tgcttcgtccctccctgtcgatgcatttacaaataaatccgacgtcttcaagttcaagaggttggcgtaaaccctgtcagggactattaaaggattaccagtgctgttttccccctctggataggcttcccttcgttgcgcttctctcttgttccagacccttgcacgtctttacccgtgaataccctggtcgcgtctt

SEQ ID NO: 3577 - DNA, 100 bp, Bacillus thuringiensis
tgtactaacgaaagactctatcccgttcataccattaagaggcgatctcgtatatacaacgcaggtattgaatcgggatcctagacttgataataaactt

SEQ ID NO: 3578 - DNA, 114 bp, Bacillus thuringiensis
atgatgcttttcatacaggacttatcttacagattctgccacttacaaggcacatggggcgctctccgaccttagctataacgtgacgaatatattcaatttcttaccaatcga

SEQ ID NO: 3579 - DNA, 433 bp, Bacillus thuringiensis
aatgcgggatcatgctgcgctgaaggattttttttcacgaacgcttcgaatagtccttgctcactatgggccgtaccatccgcttttacttgccgttctgaagccattcacttacgatcacccaatcattggtaccatcacttaatagactaactactgattgacacggtattgcaccgtgtgctgataactccataccaatatgaagtggtggcgctcgtagactcagatgaactgctccccccgctaaggtagaatgggtagacgcaagctcgccacttacatcattcaatgcagatgaaccgatacttaaacgaacgacaccattcagaggctggaatcgctcattttttagcataaggtcgatcttcatgcaacttctcagcaacattacttggatgactgaacccttgtgccaaagcttgaaactttg

SEQ ID NO: 3580 - DNA, 355 bp, Bacillus thuringiensis
aaggagacagaaaacgggaggacgaaaagaagaaaaagccaagaaacagaaaaaaaaaaaggcggtttaaaagcagaaccgaaaaacgaacaaacagggggagaaaaaaaggggaaagaaggggaaaaaggaaaggacaaaaaagaagaagaagaaacaaccagcaacaagaagagaaaaacaagagagaaggcgcagaaaaaagaaacaaaaaaaaagaaaaaaaacaaaccggaggaaaaaaagaaaacgaaaaaaaggaacagaaggaaagaaaaagagggggaacaaccacagagaaaaggaaaaaaagaaaacagacaaaagcaaaaggaacaagaaacgcagaaaaaag

SEQ ID NO: 3581 - DNA, 367 bp, Bacillus thuringiensis
tctgctggagctttattttttttataaccgcactagcaccgtaatttatagtgagcacattatgatcatggtagtaagctagatttcataaaatgtggattccttccctaacgaatgggaaacttagatgaaaccgggctattgctatataggggagcaattgttgtctgaaaccgagatgtgaacagatgtatactgtttgagaaggaaatgcgcaggaaattccaatcaacgaaccagcttacagctttgaatgggagaaatgactggtgtatcgagtgagcgaccgcgcgcttatagaaatggcctccctgaccagttgacagacaagaaagctgactggccaactgggacagggaatcagctc

SEQ ID NO: 3582 - DNA, 310 bp, Bacillus thuringiensis
gcacatgtggctggcgcttcacatagcggagcgcaagaacttgtataagcggcgcacggtgtatggcctgactctgaaagcgacacgaggagatatcgaagatgcataaaaccaccgcgtcacagatacagcatatacaaaccacgcgagctttcgaaaagacgctttggttactctgaagcaatgatttgtattggacccggttttttaatcccggactgtcaaaagtgcggacctgtctattgtatcgagcatggttatcaaacggaagacaaggtcgaattataaataaaggatctattatcacaaa

SEQ ID NO: 3583 - DNA, 357 bp, Bacillus thuringiensis
aaaaaatgggggaatgggatttttttccaaagtcatgtcaacaaactacgtggcgagtgtatcagctgctagctaaagataaattgaatgtattgaacgcacatatgaaaggcggtctacaatttgatgtagcgcaggcgaataccggtgttgccagtgtaacgccactagcatagtgctagtttttactgaatacacgttagagtcttgtacctgacttacagcaaagagcgcagggcgcgagaattgcagttgcgtggcgcaattatgccaaagatgagggtgaatcgattgcggtgtggcctcacttaggagttgcataaaattccacgttgatattcgtttggagacatatgg

SEQ ID NO: 3584 - DNA, 135 bp, Bacillus thuringiensis
cggaggctaagagacgtatattgctgtaaaatcacactcaggcaacctgggggctattcccacaaataaggggacatcctctataaatgaagaggtctttttaccgcttaatggtccaacaaccgtaaaaaggcc

SEQ ID NO: 3585 - DNA, 307 bp, Bacillus thuringiensis
cgcgggactggtaagcgtttttgctactctcgtcaacaccgtgtctgctgtagtgcccttacgactggtacaaggggcaatcaacctcctatcagaagctgatgtggcggtctggggcggcggacgtgaccatgattcttactatggacgttatgctagcattgcggacgctgagcctcacggaactgcacgatacggttggaattacactggttgcccgaccggtttcgatcactcggatatcgccaccggtagggtgaatcaccataggaaccgatctggaaagctttggagtgccagccacggg

SEQ ID NO: 3586 - DNA, 406 bp, Bacillus thuringiensis
aactgaacgcgagcttttttttattacatcactcaattctcttcagttggtgctactgccatcttttcataaacccaaactaccatatgttcaccagccgtgtacgttggaggtaacgtttggattaaatatcgcggatctagatcgattctgattgcatgctgccaaattactgtgatatctgcaatgacacttgcaagacctatgtcatttacatatacactaatgccaaatgcaacttaatgtgagcgaccgagtaagcttatacagtttgccttcatagacaggtaaatggtgtgctgcctcaaatgtcaattccttgctgaccgttactatctgatgatggaatccgagtggtatacgctcaatatacttgctcattatccgcatattctctgcgatgcga

SEQ ID NO: 3587 - DNA, 132 bp, Bacillus thuringiensis
ttacgattttgatagatttccatgcattctaagtcttattaactaatagaaggggacacaaaacccgcggccgggggcataccgaatgtattgctccgggaacccattgctttagatgcatccgcttaaaaa

SEQ ID NO: 3588 - DNA, 299 bp, Bacillus thuringiensis
gtactgccagcggtacatttttggatctagcataatgagagcactgcctgctgtcgagcagactcccagctcgacgaacgggcggtcccagaacaaggctcttagatatggctgccaagtcgcgggaagtacaatagcacagcggtacattaaaaacgtgaccgcgcggaccatgaagccgaggagccgaaggacccatagaggtccttgttgaatataccccacaagcaatattcactaataaaggggggaatgagagtgagatgcgagtggcacgctacaagcgggctattatatgg

SEQ ID NO: 3589 - DNA, 248 bp, Bacillus thuringiensis
gtgatagcttaatgaacttggcctatgatatattaagcaagaataattgttatagaccagacgggaaaaatactatcatacaggcgagatgaatataaatcagggaatggttaataatcaatggatacattagtagatttgaaattaggtaatgctaaatttgtctacttaacatacaacatgtgaaaaataattaggcaaaaatgtcgcacagaaagaaaatctatcatgctattcaacacataaaa

SEQ ID NO: 3590 - DNA, 140 bp, Bacillus thuringiensis
tgattatcatattctttctcagagattggactatgggctgtacatcatggattcataaaaaaactgccatgtctacaagggagatctttaccttgtcgaaatgattattatcgattacttaaccatcttacgtgctgttt

SEQ ID NO: 3591 - DNA, 126 bp, Bacillus thuringiensis
gtcatccctgagaagtttaacactcacttaatctgggcggccgtatcatcaccgctaggggggaatagcattcgggtgttgtatgtatagcgtccggtctttcgaaataaaatttaccgaaaggta

SEQ ID NO: 3592 - DNA, 300 bp, Bacillus thuringiensis
ctgtctagaccaaaggcggactacatttattttaatacaatttaaagttggatacatattcggagacagtcagcaagctatgctattaccagagggtttgtaaatgaaggtgcgcgcgcacacatagctggctgtggttcagcgggtgttacgctggtttgaatgtttacataaagggacttgtttgaaaagagtgtcacggcgctttacgcattattaaatgattggagcaatgtagaagttgtatgcgaatgatgcgcgacttgcatgacgctaaaggtttgtatagccctttgctgc

SEQ ID NO: 3593 - DNA, 334 bp, Bacillus thuringiensis
ctcttatggagcaaagttttttgttccctgctgtctacacgcgctgcttgtgagataataggtgcctgtaccgtcaaccgtctcatgtaggcgcggtgcgcgtactatggtgtgcgagagatctttgactatggaactcggcattatataccgaacacttcggtatatgggagtgcttaggaaaccgagtgcactagtgcttaggcccaggcgtttgtttatcaaagtctcatttctatgcgaaaggcgtaggcgaagtttagggagtgacacctgccccttgctgtaaggtataggacatgagtttgcggaagctactctttgtactgaatca

SEQ ID NO: 3594 - DNA, 138 bp, Bacillus thuringiensis
gatcacaccgggcacattttgcggaggagcaactggcacattaacacttgctggggcagttaatgctgcactctgacacactttctgcacacgtgatgctagatatattgactgagggacttagttaatatactggtg

SEQ ID NO: 3595 - DNA, 253 bp, Bacillus thuringiensis
aaccggggctaatgtaatgccaacctgccatcacgaagtaagtaccattgccatacccacgtttgctgctctaaaatcttcaggaatatcgggggaaaaagctttgtagaatttgtaattaatacatcctacaccaccaagattcttcaaggacttatctgaagtaaaagatggttggattggatcaatccaagctttatcaatgaggcggagagaagatactccgccttgtactggataaaatacattttgc

SEQ ID NO: 3596 - DNA, 415 bp, Bacillus thuringiensis
tacggtattccacaaatgtatttaggcccgcaaccctgaactattaaacgatatgccaatgacagggcagactccggacattggccagaaaaaaacaagaaagctcattggctgcgatatatggactagactctgaacaatagactaccaagacaactgtggcgatacacaaccggactgtcatgactcaaaacaaacgatgcatcaagcattcattggcccaaatagaatgcatcactgcctatacatggctacctgatcgaagaatatggtaatatctgtgcaaccagaccgcacacttcacaccgaagatatcatatcacctgatgaagaagacaggccaaagtgtatatgtgacgtacatacgaaggactcagacaaaaacaactgcctgagcgcgcatcattaatggatg

SEQ ID NO: 3597 - DNA, 151 bp, Bacillus thuringiensis
ccccttgcattactgtttatgcacgcagacagcttcattgctcattttattaccaaaaaggaccctcacccagaccctttgaaattaaaaagggcgttttaaactgatttacagtatatatgcgccaccttggtctgagcagcaccaatgc

SEQ ID NO: 3598 - DNA, 172 bp, Bacillus thuringiensis
tattgaagggcaaacaatatcaataggagcaagcgtcacatatgggattcacggttgtattatgataatggatgagtggcgcattatatgggattacattatacggttatacaaatggatctttacagatcagtctacgagatgatgctaaagtcgaatttcttatttgaag

SEQ ID NO: 3599 - DNA, 454 bp, Bacillus thuringiensis
aatatagagccgattcatacgatgctaccagtgaaaaagaggactttaatcgatgaccaaaatccataaacgtgagactctgaacacactgcgtcggcatgacaccagctagaaagagagcgacaggactcatcattgagatacctacagttctgcacagtagatcgtgcatgctcagcaagacaccaagaaccaccagctaccacctgtgacaccgagagccggaacaagagctaccacactctatactcgaaggacgctgggtacagcagaccgctgataccatatactgaggttcttgagtcatcatagctaggccagcacgttaagaagtttgatgcaacgcttacatacctatctctgctcctactgctgcccgtgcttgctgtcgagggtgataagtaccgtctcacccgaatgcactcaagactatagcgacctgatctggctcaat

SEQ ID NO: 3600 - DNA, 136 bp, Bacillus thuringiensis
ggctctgttaactacagggctttggtaattcgcccggaagggcagtagaacaacaggttgggccaatggcaggaaccgctcaatctctgccctccgagcggctagccttagaagcctcaccgctcacgacacatac

SEQ ID NO: 3601 - DNA, 539 bp, Bacillus thuringiensis
cgagatcagtacttagtaggtataactttttatatttcaaatgacttttttttctaaaattatttttcatacaaattctcagattctaaaaaatctataaatttcttataatgtgtcactgatctttctaaagcaatcattaaaacaaatataaaataaattgcttgaattccattcatataattaaagagtgattcaaatatatatacaatacttgcaatcatagaacaaaaccataaataaaatttcattttcagttttttaattttttgcttagttgtcttacaaggctggccatgaactcttataaacaaataaattgctgtatgcaaaataataattgaaaattggaaacttcgattgtcctccgaactaaattcagagaaacctatttctaatgaatgtaatactatccaaatagaaaacaaagatagcacgaagacatattaaaaaccaaataataattcaaaaataaataacccaggtttatttaatattgagtaaaatggatttaaatattttatgttaaataaaaattc

SEQ ID NO: 3602 - DNA, 135 bp, Bacillus thuringiensis
ttgctgtgcaaggtcaatgagcaggttacgcttatccttgtatttgaactggtacacttcctcagtgcagagggggcatacttgatgccagaggcaccggcggcgaccgggtttaatccaattatacacagcgtt

SEQ ID NO: 3603 - DNA, 260 bp, Bacillus thuringiensis
gctactgctttgacgcggttattacgaatttgagattctacttttttctcaactgctgactcatttacatcacttagtgctcaaccaaagctgtggtttaacgccgcacattgtgtaccaatcaaaccttcctcaaggatgtcttacccggttaatacagggtagtgcgtacaaggaattccaggtccgattactctgcacgccgctagaatacggaggctcacacagagccttcgctcttgccacgatgctttatcaaa

SEQ ID NO: 3604 - DNA, 156 bp, Bacillus thuringiensis
gttcggtatataaagaagtgttttcggctttggatcaaaactagatggaagggtgtctgcttttggcacaccccaacacgatggactcatgacaaaggtacgagacggttgcactattgactttagacgaccgtatattatgactataatgatgtt

SEQ ID NO: 3605 - DNA, 194 bp, Bacillus thuringiensis
  unsure (1)...(194): unsure at all n locations
aagaaaggaaaagaaagagagcaaaaaagaaaggaaaaaaagaaaagaagaggatatcctatggaaaacnagggataaagaaggaaaggaacgagaggcaaggaagaagaaanaagaaaaaaggaggaaaaaaggaaaaaattattaagaaggggagaaggaaagagagaaaaggggagaaaaagagaaagaaa

SEQ ID NO: 3606 - DNA, 537 bp, Bacillus thuringiensis
cgaagacagaagcaggggagaagacgaatgtttatatgaaagaggaagagacaggcaaaaaggggggggagaccaaaaaaagggaaacaggagaggaaataaccagaaggagatgggcaaggggccagaagaaaagaagagaaaagggcgacagagggacacaaaagccaagagaagaagcaaaaaagcagacaaaaacgcgaaaggacgcagaacgctcctacgcgcaagcgacaaaagcaaaaacgggagatccaggggggaggaaaaaaagaaaagatgaaccaaagcggtcacaacgcgagagaacaaacaatggagaaaaaagaacaacgaatggcggagagagacaaaaaacagggcaaggaaaaaaaacgacgcgagaagaagaagcacagaagaataaggcagaagcaacatgggaaaagacgagaaaccaaaagaggggaggaaaggaagaaagaacggagaaaggggccaaaacgggcaaaaaacgaaagaaacgaaaaaagggggggaacggaaaagcaaaggggg

SEQ ID NO: 3607 - DNA, 123 bp, Bacillus thuringiensis
tttatgcaatatataaaacataaataaataaaaaagcaatacaaacactgcttattatgtataaaataatgcataaaataacataactattatctcatgaattttaataataaataaaaaagg

SEQ ID NO: 3608 - DNA, 101 bp, Bacillus thuringiensis
gtgaagttctaaaagcttgctcataatgctttaatttttttgcgcctgaaccatcctatattttgatttaaatggtttgccttattctcccagttgaatcc

SEQ ID NO: 3609 - DNA, 523 bp, Bacillus thuringiensis
taatatcttctggagaattcacttcagaatatgagatgaagtttgtttgcgcctaagactgaattaaagtttaatttgaatcgagtcggaacgcgtacttcgagaccttaaacttgtaagctgactcgctaccgcttgtaaaatcgaacggtggaagctctgtggatacgggcgcgcataaacgattacatgtcctattttgcttactcctattcgtgcatatgagaagagccatctgcgtatctgacgctattatggacactgacattgcagaagtcaagatatccatatgcgtgtacagagagacgcccgctaatacacctacctatcccgcgctcatacactagcacaacgaacacttatagaatcgagacaatgaccgatgccgacactatatacgagagggccttcgatatatgtacactccttgattgaaagaaccaagtactcttgagaagagagctattccatgtggaaacgactgtataactgtgctaaagtgagacacgcgtgcaatgattga

SEQ ID NO: 3610 - DNA, 408 bp, Bacillus thuringiensis
cacgcatactgggcgatgttttatttcaggatatggaccaccgcacattgattcttttggccatgatgcaggaacaactgttatcagcgaatgcattggtaagcgagctctttgtttgggtacgggtgaatcaatgtctatgccaacgacaattgctgctgaaaagggggaaactcttgtatggcgatttacaacaagagggcttatccattctgttgcaagtgatgcgaactgcgccattcataatcatttctgatatataagtcctgaagattttacgattacaagatcctttaataacattcgaccgaatgattccagagaagtatttgtgtagatagggcgtgagttcagggaagaagcccgatttcgtctcctacagtagggactaacagttatgcgggttat

SEQ ID NO: 3611 - DNA, 110 bp, Bacillus thuringiensis
aagcataaaagtaggagaacttttttttatatatgttgtgagatacagcttctcggatggattttagccggagggctaattttatgacattatggcaaattgaatctaaa

SEQ ID NO: 3612 - DNA, 206 bp, Bacillus thuringiensis
cggtacaactacgcaagcgcatagtgtagagtccgaggagcactatggggagggcaaccttcattcgttcacccgcgcttagagcatgcacaggagtatgaacatcctgacggccgattgaagacggcttgactaggcgaacgaaggcttctgtatagtatggtgcttccagaacattccttaaaaagggactagctgttataaac

SEQ ID NO: 3613 - DNA, 169 bp, Bacillus thuringiensis
aaagaaaagagacaggaaggagaaacacacaagagaaaactttttaaagacggagaccgaggagaaaaaggaagggggacagaaaagacgacgaagggggaccaagaagcaaaacgcaacggcgcccacggaaaagaaccagaagaccacagaacaaaagagggggaaa

SEQ ID NO: 3614 - DNA, 394 bp, Bacillus thuringiensis
ttgatctatcgtaatacagtcagattcataaagggtgatactattatcacgatcacgaacatatacttgcatgctaaaatcctgaagtacttaaacatgagcacctgtacgccgagacactacgggagctaactcttgaacatatgtgcgttcaagatgttcttagatcacgggatagcatgagctctagtgatagagatgcatattcaatcgaatgattaggacaaactggcgtactatttcgcgcagataatgtgcgtacttaatcatagatgaacgtgaccggcacgactgatgaacgtggatgacaactcgcatatttaagaggaagtgcaatagatgaagcctacgcttcatgtgagtcaacatacgggtgattcacaagcgctaataa

SEQ ID NO: 3615 - DNA, 361 bp, Bacillus thuringiensis
cgatgcatgttattgcataactacaatcgtatttcgatgttaattgtgaagaactctaaacactctgagaaatggcgtattccttttgttcttgttctttctctcttttcttcttctctgggtcttccctttccttttcttcttctgttttacccttgcccttttttcttgtttcttcttcctctcttctcctccttttttttttcttttttctttttccttctcctttctcttttcgcctttcttttttttcttccttctctctcttccttttcctctttggccctttttctttttcctcctcttcttttctttctctctctttttctccttttcttttttttttctcgcaacccttttt

SEQ ID NO: 3616 - DNA, 152 bp, Bacillus thuringiensis
tatttcaatacctcacgcggtttatagccccatatacattctgctgctcatgggcggtattttgccatgaaggcgttacactataaacatatgttttaaactaaacaattattgttagacttatttggctctaattaagatctggaacaata

SEQ ID NO: 3617 - DNA, 376 bp, Bacillus thuringiensis
tgtatgaggcacatgttctgcttatgcgaataaaacatttcctgtttggtgctccagtaatacagcattgggagcacggacattgctgaacaactttgcatatgtatgaatcgctatatcgcttgcatacatgattagaagctgaaagagatcatcaaattcgtcctatattttctcccacgtgcttacggtacttattgtacaagtgaatgcatggccttgtaaaaattgaacgaaatctttacttctacttccctaaaaaaagacacatagaatttgcgtctaatagggtgatcattcaatttggttagcagttacacacctttttttatacatcaggccaatttacaatcataacacctagctttttaagaat

SEQ ID NO: 3618 - DNA, 139 bp, Bacillus thuringiensis
cagattattggcacctcgtgagaaatgactaatctcagactggctataactgagtttctccatttcaatcattactatgtcagacgttgtcatttcatggaggtcagcaccgagacgcatttccaactagtggcacaaa

SEQ ID NO: 3619 - DNA, 412 bp, Bacillus thuringiensis
ggatatcccgacagtttttatttttattgttagactgaatcgaatgacccacactcagatccgaatatagacccagatgggcacaagcatggtgctattgactagtctggcaactggtccacatgagaaagatccggacgggacgatgaattcatctgaagccagtgtaatgtgaaatgtggatattgctatgcagaagataccgtgcgctagctgattcggtgagagtaggtacggaaaaagcacgtgctgaagagcgaactgcacgtgaagatgaccagtgagcacgccatgatattgcgcttgcgcgaggaacggacgctgcactcggaccggctttagagatcgtgaagacatatcttgatgagcatagcattcgagttccgtaagttacagatgcaaagccagcgga

SEQ ID NO: 3620 - DNA, 226 bp, Bacillus thuringiensis
ctgctggactatgaggcttttttgatgtcattcgacgacaatcactaaaggggtacgtcagcacggagatgacgatgcgccacaggatggtcttgagaccaatggtaacaccctctaagctaaaacgtgcgcccgtctgggttggctcatacgtgcagctgatctgatgaaatggcgatctcttttggaagggcggttctacatggataataactctctgctgatc

SEQ ID NO: 3621 - DNA, 443 bp, Bacillus thuringiensis
cgtgatgatttcatatgatcgaccctgtaaaacgcggtttcttatcgaagattcaccgacagccaacgggggtgtcgtttgaacttccagtggttgcaacgttgttacccacgccaatatcactaagagcctagcaaccataatttttggatccctggtcaatgggacgactcttccttttgaaaaatttttaaacccgatcccatccaagacacagcgaatattatgtgaaggattattattaacaaaggggatactcatttgcacctttccatctaagttgtttgacaagccagcgcctccaaattctactacccttgtattagctttccctgttccaacctaacccgttgcgtgtacaaaaggaccactcctttctgctccgaaacttttaataaaaggactatttttcaccttaaatgaaacatatcgatttcccattt

SEQ ID NO: 3622 - DNA, 137 bp, Bacillus thuringiensis
aagcgggctttttttggaatagcccaagcacaaatctggggggttagactacaatagcggttaggcaaaacactccaagtgagtactgaatctatgtgccactgacaatgagactctagcgtcaactcacgcgggtt

SEQ ID NO: 3623 - DNA, 222 bp, Bacillus thuringiensis
cccttgtattatacactgaaaacattgcgggtgaggtgggatggttattaaaacctgacttaactaatcaagggatctaatggggcccggattcattatttttcgtaccaacatccctattttcatatgggatttgttttctaagctgaatcatagatatggggcttttggcgcgaatgctggtatcgatttaccaaatcgattcatttaaatacgctatat

SEQ ID NO: 3624 - DNA, 226 bp, Bacillus thuringiensis
cgtgatgacctattttatactccccagtgggtcaaggtcttttaacagggggaccacgcctgtctagcacggtctactgaacagctggatacttcacacacccatgtgctgctatatggattctaggtgtccatttacctgttaaacgctacccccagtcagtgttttttatgttttctacgcataaagtaatacgatatgtgaagcttgcatcaacacagcacat

SEQ ID NO: 3625 - DNA, 138 bp, Bacillus thuringiensis
tattaagcatttttaggtatcgcccatgctcaaaccggggggggttgattaaaagagcggtcggtcattgataaacccaccgtctattaaatgtattaccaaattacaagtagcctcaaccggacacccatacaggaa

SEQ ID NO: 3626 - DNA, 376 bp, Bacillus thuringiensis
gtgatgccactcagagtgattgatcaatagcacagtttctttactaaatgtggaaaaggtggccaaggggccgttgaatccagtgccgatgcctgtgatcacctctcaagggaagatgtcttgcacgaagcgaggtaggtagtttgtcaggcttcgagccacagcaggacacgttaagtcgcatgttgaaaagtcgccaatggcagctgcaagaaggcgcaatgtgcttatcttatgacgcacattatggcgaccatgggctcttaatatccccctttcgcccacgttcatctgacaagatagcatcacctatttttactactggagtattataagagactgctccccgtgccccgtctgtgatcacacattggcc

SEQ ID NO: 3627 - DNA, 115 bp, Bacillus thuringiensis
aatcaagctttttttcctatcgcgcatgctgatctctgctggggaatcttcaaatggaccccatttatcgaatccccgcttccaataaaaactatctaccccaacaaaaggtgcc

SEQ ID NO: 3628 - DNA, 183 bp, Bacillus thuringiensis
ctcaatagtttttattttataacagaaatatatagtgagggatagagagggatctattaacaggtaagttcggacagaccgaacttgatctgcaatttttgtatgatccttgttttttcataggaaataggaatttggatcacattgttttgaaatttaattataaataggaatatttcaaac

SEQ ID NO: 3629 - DNA, 397 bp, Bacillus thuringiensis
ggtgatttctttagctaggccttccatcaaaatatttatctgaacaactgcccaaacagataagggggggtatattaaaacgctccgttcaacaaacacctgccagataaagggacggccaagaaatccgctcctaataattcacaacggaaatttttcgcgtgccatcccaacatgaaacgggcgacccttttgaacccggctccacttactgggggaagaactacatccatcccccattgtggacttctaaaacggacaaattctctcttacaaaatagttcctcaacctggccatccccccgtgctttaaacttccccccttggatttctatgcccctcggataaagaaactcccattttacaccctgagcaagcttttcaataacaaatgccg

SEQ ID NO: 3630 - DNA, 297 bp, Bacillus thuringiensis
tacttattaaatacgccccagggtgaagcgcgttgttttcacggatgccatgccgggataggagggtctacttgactgcttgatccttaattaaacgttaaccttctatttgactactatgtggctattgatctgttaataacaccccctggtcaggggggcttacgttgtctgggcatgatgcactacactatgcgaaccatgagtcgaggctgccttcgggacagaggaactccatgcacagctgagccacatgagcctcatctaccaaaaaagggatgttacgctctcgctaca

SEQ ID NO: 3631 - DNA, 104 bp, Bacillus thuringiensis
tattttttttatccgggtatcgcgcatgcaaaaggggggggttattgcacactagggagctcaggctctgatataccgccgcgaataaaaggtacttgccagat

SEQ ID NO: 3632 - DNA, 233 bp, Bacillus thuringiensis
aatccaattcaaaaaacttgtgttctatttctatggttacataatgaagctcgggtgatttagggttcattggatgactgtaataaaataatcattgggatctaaatcatagaaaaatggactttagtttgaagtttatatatcgctatgctctatagattactatttgcatacagctttgggcaatcatttactaaaatatttgggattctctcaaggacaacattttaaaa

SEQ ID NO: 3633 - DNA, 143 bp, Bacillus thuringiensis
tgataaaacgcaacagatgcactcgttttatgaatttttttttatgcccagtcagccacaggtgcgtaggattgataaacggcaaggtcggggccacacggatggataaacgcttattcaagttgtaagcgcatgccacaatt

SEQ ID NO: 3634 - DNA, 272 bp, Bacillus thuringiensis
caccaatgctagaagtcaatggaaaagaaggggatattgctcgtatgccaagaccggcaatgggggcattggaataatggtctctagtacaacaggaggctacctgtcctcaatgcaaaaggtaatactggtattactgtggggagggtgcaggccaaatgctcgcgtgttagtgtggctattgagagatattattaacactgcaagagcgacgtggataagaatcgggaggcacagtccaggaaacgctgacgatcaaaaatatatgaaac

SEQ ID NO: 3635 - DNA, 157 bp, Bacillus thuringiensis
agaaggcgtgatggaagctaaaacggaaacgtaagaacgattgttgacaacgaactagacagaacaaccgggggggtttataaaagatttcgctcggccagccaagggagcaaataccatggaaacgagcgaacgaaaccacgtcaccaacgagaag

SEQ ID NO: 3636 - DNA, 452 bp, Bacillus thuringiensis
atgcacgatcaacagcatccacattgtttatctgactaacccctggagcaacagggggattacttacggttgcttcatctagcggaagcgaatcaacaaaatttgaaaatgaaggcgctccatacgcaaaacaagaagctacgacaactgctcccgccatactagaaaaaactacacctacgtgctgccctgttccagcacgtgccatacaaacacgttgaataccaatgacagacatagcaaatgacccatctatcagacaacacttatgatccacctatacacgttaaatgaatatgacaacaactcctttttgaaaacctgtatgccctgtgcgctctgcgttgggactatcaaaggataaacccagtacaaattcatttcccattagcgccagtaacccagggtatcgcccaagatctccaatgggagtatgaaagaataaaaaggct

SEQ ID NO: 3637 - DNA, 296 bp, Bacillus thuringiensis
gtcttctttagtacgcccctgtgagccgcgctttttttgctaggttaccacgccagtattggagggtctactgcacagcttgatccataatacctttttcagctgctactccagtacacggtgactattgacctggtgactacgaccccacgtcagcgctgtctaagttttctgttcatgattcactaccctatgtgaaccatgagtcaacgcctactacgggacagagaactccaagcagagcttttccacatgtgcttgctctaccaacagctggattttatgctcttgctacc

SEQ ID NO: 3638 - DNA, 381 bp, Bacillus thuringiensis
ttctgatttaatacgcggctgagacccatttgtctttacctaggctaccacgcccgggggggattgtctacgggatagctggatccatcacacattggtaagctcccactcgacttctaggagggtgctcacctggagatagcgccccctcgtcagcgctttcaacgttgtctgttccggatgcacgcccctatgtgaaccatgagtcaacgcttactacgggacaggcaatgccaagaagagttgtgccccatgtgcttgctctaccaacagacggattttaggctcgtgctaccacgcggtgctggcctttagcagccttcccattccctaggtacccgggagcgagaccttgagtgctcctacgtacgggaccgattg

SEQ ID NO: 3639 - DNA, 331 bp, Bacillus thuringiensis
gacttttttaatgcgcccctgtgagccacgctttgtttgctaggatgccacaccggtattggatggtctactagacagcttgatccataatacctctttaagctgctatttcagtactaggactctattcacataaagataacaacgccacgtcagtggcgtcacccttttctgttcccgatgcacacacccctctttcgcttgattcgatgcttactacgaggcccggcagttctaagcatagctaacacacgatgtaccttatctaccaaacagagaatgttaggctcctgctacaaagagatgctggcctttttatgcatacccttac

SEQ ID NO: 3640 - DNA, 130 bp, Bacillus thuringiensis
cttcaggcttatttaggtctcgcccatgaggaaatgggaggggtttgattacaatagcggctggtctttgattttcgagctcgtacaaaatgtatatgccacttacaagagtcacttaccggacacccac

SEQ ID NO: 3641 - DNA, 194 bp, Bacillus thuringiensis
cgagatattttctagtgtataccgtaaattgaaaaatggggaaccatttttattgagaggtgcatatttatgaaactaatcgttattagtggtttatagcattactttctccaattgactaaaaatagtaaggtgaacaataacgacaatattcgtttgttgaagaacttaattccaattgtatctattgttta

SEQ ID NO: 3642 - DNA, 495 bp, Bacillus thuringiensis
atctgttgaattgttttgaggaaagaatatgacaaaactaactagtcgagtgccaatagagaaattcctagctgactaataatgttcagataccaataacctgcttataaagtgttagctattcgcttgtaatatggccaacttacttagccatcatttttcttttcagattaaatgggatatagaaagacatggagtaagtatttgattttatttttctatattgccgtcagattattaaacactgtgcttattagattacaacttaccacaaatataaataaattgtttgctctttaactaactgttactaggccaattaaaccaaaaattcaatctgggtggattctttttattttcctgggaatcttcctttgtattttggtggcaaatgaaacctaaacaaaaagatttaatttaatggcccatgtattaataaattattttggcaaataaacttggcttccccttcaacattacccattccaaaacctt

SEQ ID NO: 3643 - DNA, 164 bp, Bacillus thuringiensis
ccttgtttttagagagctatctcgcatgtctaggggggtgttttttgaaaccgaggttacagagtctctgatattcgagaatgtttaatattggttaagtcagatatgaggcgcggtgggatgcctatccacccggattggctgagggacgagtactaacgtcc

SEQ ID NO: 3644 - DNA, 293 bp, Bacillus thuringiensis
gcgtgatgacttactaaagacgccccagggaaaagcgctttttttgcaagcaagccaaaaccggataggggggacttcttcacagttacattcttaaaaccattttaacctgaaaataccacctcattgtggctagtgatatgtggataacaccgcctagtcaggggggcataagctgtctgagcatgacgcaatacagtatgcgaaccatgggtcgaggctgccttcggggcaggcaatgccaagcacagttgtaccccatgtgcctaatctaccaagacacggattttagg

SEQ ID NO: 3645 - DNA, 212 bp, Bacillus thuringiensis
tcgtgatacatacgagcataactaattggtggaagttttactttgggccccgtatccacacatgaggcaggttaagtacattcatagaacactacggacctgggagagatgaaatccgcctgtatttacatacgaaaccataacccgtttcacctaaaaatgcggaaacaaacataaccgccatcagcgagcaaaaacgtaagaaatcatat

SEQ ID NO: 3646 - DNA, 125 bp, Bacillus thuringiensis
gcgtgatttatataaatgtccaatttgctcttccatactattttccgattcaaaaatctctgttttgggcgcgtgctcccacctcatgaatctggggtccagccttcatatgaacttcggacgtc

SEQ ID NO: 3647 - DNA, 268 bp, Bacillus thuringiensis
gctgtactcataggcccacaaagaacgggtgaattgttcgcatatgactttagcgtggggccgactcatgtaggatgatgagcagcgggacggtaccgtctgtaacgttcgacgacacaccgtgcctacaatggatagccatttactctaataaccatatggcccggccagaaagacgtcttttcgaggaccacgctgattctaacgcatgccttgagaacaatgctgtggggattcttgtagttgaaccatatcgaatggaaaagtt

SEQ ID NO: 3648 - DNA, 297 bp, Bacillus thuringiensis
tgcggggggtttaatagagtacatggctgccatcctgatacacacatgaaaaccctcaacatcacgagttctgcccttttaatcgtgccgaccttgagcaagtttatattctagcacaccagcgagccatacataaacaggatccatggcgcgggtgaaggaataaatacaaacgctctgacctttcatgagtactaaggggtgccacacgtgaatgttgggtcatggcaactatgagcacgctttacacgcgttgcacggtcaggatgacctttaacaggagccccttcaaaggag

SEQ ID NO: 3649 - DNA, 331 bp, Bacillus thuringiensis
agcactgattttggtcagaacatctgaaggggtaggggggatccatggaggtcaatgttcatcaaacacctctggaataataggatgcaagcggagattctgcttacaaggaagggaaagaccacgtttctaacacgattgacacaatgccgggcggagaggaagctgtcatatttatatactttgaaataggaccgttcgtaatgcggccattgtaaatggtggttagcatgaaacttgaactataagagagcgcaatgacaagagctgctgactaggctgtaagaatgattggatgcatcatacatttaaacggacatgttacaaaatg

SEQ ID NO: 3650 - DNA, 318 bp, Bacillus thuringiensis
gaattcggataggccgattattaggcgtgatcaaaatttatcttctatcaaatagtcaagaagagtaggatcaatcttctaaaacccgctttgagaagtatgaaaaacaatcttcgtatcgcacgtaatgtatgaactgaggggcaaggcgtagttgtagtacgagtaacaggttcgttgaaaaaatagtcattggtatcactgggacatttctactaagcgcgcgcagtttctggcaaacaaaaataaagtatgagagattaataaaggcatgggcatgaaggtgatatgaagacagttatgtttgcgagtgatgat

SEQ ID NO: 3651 - DNA, 311 bp, Bacillus thuringiensis
tgtagtttttgaaattcaaatggagctataggaaatgaggctatgacgaaccgaatgactagcataatgtatacgagtgcgtacaacccatcagtgactatatgaaagagatggatgcggtaatcccacccggctgataaaacaactggaaaaacgggccatgcactacacaggattcctacatacatagattctgccgccccctcaggacttaaacgatgatcacagtgcgagacaaactacgctaacgctgcttaaaggacattccccacctggacatgatagcatccatacagattaaaggatccgca

SEQ ID NO: 3652 - DNA, 280 bp, Bacillus thuringiensis
cccggtattttgcgaacacaatgatgaaagcgagggggggttttgtcttatggctcgagtatgaaacaccacagaagccagtgggaaagctgatagctgggacgctagcatacttagctggtttgtacttatttatgtcgcgagtgaaaacatttgcggcataaaacagcatgtgcatgagcagggcgtctcaagtgaaacgaaggatcaacgcgaaaagatagtaagggctacaggcctgacgcatagtaaggaccaaaaagaggttctcgcacaaatg

SEQ ID NO: 3653 - DNA, 132 bp, Bacillus thuringiensis
ctacagaagttcccagagtatattcagcatgtcccatgtaaccaaaatctggggggcaatgcgcaaacaaaagggatcgatcgcaaacgtgaagctgcaagtactatagaacaacacgaaaacccaggagat

SEQ ID NO: 3654 - DNA, 433 bp, Bacillus thuringiensis
ctcgacgcataacaagctgctttatctctgactaaatatagtttgcacctgctgtggacaagcctgtggatactgttgcatatatagtgacactgggagatgcatgctgtaacatgtgaatttatgcatatcattgagtcggtgagaacgatggcagaatcattacagatactcttgttacacatgaatttgtatgtaacttgcatggtgactgaaacgaacgggacgattgattttacagttatatgcgcacactctgtgcatattggtgaaagatttcctgattattttgtaacagataaagtgagtgttatgtttacatacgtcacactatcagctaacggtccgtatgattatataacagaggaacttggttgacatgacctcgatccggatgcttgaaaggtcacgtcaccatttcagtatgatgaac

SEQ ID NO: 3655 - DNA, 252 bp, Bacillus thuringiensis
cagcataataaagacaaatacccgggacaaccaaggggcggtttacaacccaacgcgacatataaacacaccacgcgcctcggaacccacaagaaacgcaattagcgcaaaagaacatccgcccagagcctaaagcatcacttacaggaaattaccctcctcaagaacctacaccaccaacaactgaaactctcacacatacacagcaagaaccgccaaaccaggcccaagaataaagcaaaaaaccaccaa

SEQ ID NO: 3656 - DNA, 132 bp, Bacillus thuringiensis
gctatactatccaccctactcgtaatatgaaacgtcgcattttttaaataactgctctcttacaccagcttaccatcctagaaactcacatctctcaaaatcgatctttatatccactacaaaagaaaatta

SEQ ID NO: 3657 - DNA, 251 bp, Bacillus thuringiensis
ctcttactaattttctactgctcactgtaagtaacagtggactttttaaacatgctgggcgtaaaataccacattcaagcgcctattcctacacatatctttcatgttacaataacttatttcaatattgtcaaaatgtaagcataaatctaatataacagctctaatgtgctaatgagctgagaggagggcacttcttgaataaagaacaacacgtcaacgatccggactcagggaattatatatataaa

SEQ ID NO: 3658 - DNA, 522 bp, Bacillus thuringiensis
tatggattttttatacagttatgcaagaacttgaatctgggggtttgttacgaacgagggaaatatacatatctaacggtgcgcatgagccagtattcggagtagctacaggtgctatgaaaccaatcgctaaaaaaataaaattaaatcaagagttagctgaagagctttatgccacaggtaactacgatgctatgtactttgcaggtattattgccgatccaaaagctatgagtaagtctgattttgatcgctggatagacggggcatatttttatatgctatctgattatgtagtggcagtaactttatcggagtcaaatattgcacaagatgttgctgataaatggattgcaagtggggacgagcttaaaatgtctgccggatggagttgctactgttggcttttaggaaatcgcaaagacaatgaatttttcgaaagtaaaaattccgatatgcttgaaatggtgaaagatacaattcatcattctcccaacgaacaaaatccggtatgaataattt

SEQ ID NO: 3659 - DNA, 350 bp, Bacillus thuringiensis
  unsure (1)...(350): unsure at all n locations
gcacacgagagtagtactacctctcagccgcngacgaggggggtattgtgagaaatgttcatgcacaatcataaactaatactggtacagaacgtaacaacaggcggtagcgaactctgagccacatgccgaacacgatggagaatgaacgaaacgagataacgaaggaactgaagtaccagatggcaaaacgttgctaacgaacgtgaccaacagtgcgggaatatgcaaaacgacatgcaaaagcacgtgaagatggacgaacgaagataaaaacaaagcatggattgcgaaaagaatacaaaacagataaaccgatatgggcacactgaacacgtgggaaaaaaaga

SEQ ID NO: 3660 - DNA, 117 bp, Bacillus thuringiensis
ctgatgttgtatggagactcaccactgccaccccgggggaatcattaaaccaggtctccgaagaatatccagcagcaggtgacactaatgtggacgcgcaggcacgtgtacggagcc

SEQ ID NO: 3661 - DNA, 381 bp, Bacillus thuringiensis
atctaaaaatgtagtcggaccaaatacgtttttctgagaaccaaaaccaaaaacgcgaagggggaatgttttaaaagatagtgggtttaaaaacccctaagatgacaagacctgccggtggccccatcttaggagccactaaagtaaactaaattggggatatccacagctttaacgcacaatataaacttgtcggttacacaggcatggattcgcacgaggcccaaaacggacagtaggaagacatagggacgaaaatacacatacgagggtacttctatgagcagggggccctctcccacgcgaccattgcagtgcaaaaacataacccccgattaacagcgggtcaccaaacgaaccctcagctaaggatgcgcaact

SEQ ID NO: 3662 - DNA, 226 bp, Bacillus thuringiensis
ctattaattttgcatagataacgacggggagcgacagagccaccttacatcagaattacgttaaacaacaccattgtcaaatacaacagctctattcaacttatggatccgtacctgatttggaacgtttacaatactgaaactggaatttaacagttcaaacgcagggcccatccatgcaacatattgtgcgaaagttgcagacgaaagcacgagggggacaagc

SEQ ID NO: 3663 - DNA, 243 bp, Bacillus thuringiensis
ttcggtgtaaactggctctcttaagccgtttcttggaaacatattagacgctcagatttacgttggtgttcctatcgcattgactctaccttcatcaattaatatagcttggtctaaatccaggcttaaaatttcttgtattctatgtacgatcataacaatcgctttattatattgcgcatgcatatctatcataagttttatcggatgtcacgcgctcggtggatctaaactcactcacgg

SEQ ID NO: 3664 - DNA, 274 bp, Bacillus thuringiensis
acctttgcttatcccgctatcgcgcatgctcagacggggggggtaagcttctgagggccgcgcgtctttggttcccggttgccaacaaaatctactagcgagatacaaggtgcctctaccggacacccacccaggtaggccacgagagaagtctcaggtgtgccaagacatctcctggttaacgacctcgtatagctgacccattttcttcgggagactgcgtgctttataaaaggagagccctattgcataggcccaagccactctttagcaa

SEQ ID NO: 3665 - DNA, 269 bp, Bacillus thuringiensis
  unsure (1)...(269): unsure at all n locations
gcgacaaagccaaaagccccccgattataacaccgaccaacagcggcgcagggggggggcccaaaggaaaacgaacgagaaaacacgnaaaaaaaagccaagcgaaaaaaagggaaaacaaggacaggccaaaaccaacagaccaaaaacagcacaaacccaaaaaaaacaaaagaacagaccgagacagggaagagagcaaacacaagccggaacaaaaagccacaaaaaaaaaacgaggacaccaacaaaaaaaggccaaaaaccaa

SEQ ID NO: 3666 - DNA, 445 bp, Bacillus thuringiensis
gaaaacaataagcgctcgcagctgctgcatgcggggggggtattgtaacaaacactgtgctaacaacagaagatgtagaagaacaagcaggaaacggggacgcatatacaccgaggtctagaaaagccagaacgactactgagggttataaaccaacaaatgatgcattacaccagtgcaagggaccatatgcaagcgaggagttaaagcgaacaaattccatctcggcaaagaaacgaacaagctccgatggggaactgagcaaatgagctacgataacgttcagcagggccattgacaggcgaagtgctgtcaccaacgctccaatgacagggaaagtgccagcaccagagcgagacataagctatggacgaccacctgatagaatcggatcaaaacttacgacaccggtacataaagaagacctgttccttctacactgggg

SEQ ID NO: 3667 - DNA, 423 bp, Bacillus thuringiensis
agaaatagtaactactctataacagagaccagaacgtagggttttttaacatgatgtaaatacactgccttataatgagtatgaaaagaacaatacaatcacataaaccaaatataaattgtatataaataaaaaaaactagtgtgcggctacacactagtccacgtaactcagcagattggattgttcattcatcctatttgtttcttacaaacaaaacaacccacattctataggcataggagggttgctattacttgagcttgtctattaaaacgacgacgaacgttaacaatgcaccaagaaacagtccaccctgcactagcaacgctatttcactcacgcattatcacccccctactactcggagaagtgataattgaacaaccaaccgtaccttaagttaccctttaattttaccat

SEQ ID NO: 3668 - DNA, 176 bp, Bacillus thuringiensis
aagaaggttgacgaataaagaacacgcccagaataaacccccccccccccaccccccacaaagttgattatacaaagtgtggcccataacccccaacaaaaaacaagaggacgaagcgccacaaagcacaaaacccgaacccaagaaggagcaccacaccaagagcctaaagaaaa

SEQ ID NO: 3669 - DNA, 155 bp, Bacillus thuringiensis
acccgagcgctttctttatagcaggtgtattatttacactcattcccaagtcatctgctacaataggacagtcccgattggtatgcaggttgtataacgttaacttaaggtgccggtattacgcaaccaaagaccgaaattaattttttacattt

SEQ ID NO: 3670 - DNA, 284 bp, Bacillus thuringiensis
ctctgagccgattaattttattttgaaattcctgctagacgttggttttgagcgtcaaaatgtagtgtgctcataaaatatatcgtatacggagctataacaatgctaattcgagatagattatcatatacaagtggatgtggagtcacgagaataggccaactatataccaatctaattaatagtgattctcaatgaacgctaacagggaatggtaaggtagctttaagtttataaatggtgaatgattgtccggacgaggagtgtgagtgttaggaatatgg

SEQ ID NO: 3671 - DNA, 114 bp, Bacillus thuringiensis
attgcgcaagaacgggtttattttttcaaacagccatcccagcaaacttggtgtgttataagaacgcaataacgcatacttgaattctacctggacagtctgagattggccata

SEQ ID NO: 3672 - DNA, 109 bp, Bacillus thuringiensis
tgaccgaaacgagtctggaactgtagttctcaccggcggggcatcagcggcgttggggattttaagatggtgcgcccactggagaagacctcaacacccgattgaagaa

SEQ ID NO: 3673 - DNA, 119 bp, Bacillus thuringiensis
acaattatgatcgctcctgacagatgtaacacatatcttagggaacatcatcagtgtggatcactgaccgaaaatgggaacggttacctttatgggaacacacatatcgaaatgaacac

SEQ ID NO: 3674 - DNA, 101 bp, Bacillus thuringiensis
  unsure (1)...(101): unsure at all n locations
aagttgtcaacaagcgttatgtatgtatgagaaaaaggaaggtttttccctcctccctnttctcttctcactaattagctcaatcactctctggtaaaaac

SEQ ID NO: 3675 - DNA, 208 bp, Bacillus thuringiensis
gaatatatgaaaaagcatatattggacgcaaattaaatgccgtagcgatggggggtgccatttgtggaacgttaaagcgtatatcatactattgttgaggtaccatatgtaagacattgcggagtttacattgtaggttgtgggcaggttaagagacaaacatcgattataaagggtctgccaaccggataaacgagtgatgaaacca

SEQ ID NO: 3676 - DNA, 341 bp, Bacillus thuringiensis
tgccgccgaagacagatctacattcactgcatgttctttctaatgtaaaacgctacctttccatagtggtgctctatctatatgtaaggcatcttcactcgccattttccgccatgctcacacttggtctataaacttgcctctgcacagtacttgtaaataatgtgctagctgcaacagaataagtgggagaagacgccccagtggagaggacatagaataagctaccattgatctctacacagggttaataacggtgtacgaaagtacgcttttacattatacactgcctattctgcaccgttgagaagcatggcgcttattctttttggattattgcc

SEQ ID NO: 3677 - DNA, 222 bp, Bacillus thuringiensis
ttacaggaatctttatttaatcttctctcgtttggaacccaatggggttatataggggatttactatattccggtggaggattttattgagggttcagtggattagttaatccttgagatgatggactctttttaagtgacttaatgcaaatcgtgtctatgttggaaaaaaggccgcctgttttggcacataaaagtattacctattattgagatatcaat

SEQ ID NO: 3678 - DNA, 286 bp, Bacillus thuringiensis
caattgtgttcatcaaccgccatccgctttgttcactgaccgatggagactgacagcatacgttacagatcttgataaatgcatggtatgcgagacgcccccaccacgctgataatacgatttccatctatttgctttaataaaacccgagtgtgacgcgcttgattagacacccctgcgtaaccgtcgatgctacacggcctgagccaattatcagatctatagcgactagatgccgcctggctacacctgatcactgtggtgctctcataatacatgcctagtg

SEQ ID NO: 3679 - DNA, 204 bp, Bacillus thuringiensis
acgcgagcccacaagttgagatggaaaccgtaatgatttttttttccaaggagatctggacaccgtgcactggccgaaaacaaactacaaacaagggaggctttgctacatacatatgattatgacaaggatatacagtcgatgccttgctgtgaaacgggatctcctacagagactacattgagaagcatgctgccagggaaa

SEQ ID NO: 3680 - DNA, 123 bp, Bacillus thuringiensis
agtgtgaaattgcaagacgtttactttttcacacaacgtaccagccgaaaggatgtagagatatggctcggatgcctaatgcgcgagctaactgacctgcatatgtacgcgttgagggttccg

SEQ ID NO: 3681 - DNA, 230 bp, Bacillus thuringiensis
tgctggcccacgaattcaacacaggacacgaagtatattatttttgcgctacggttccagggtgtaatgcggggtgttgattaccggaaatggcatggaaaacctcaacaccttctggtggaaaatacattatgaggccaccacgttttgaatagaaaaaacactaggtctgaggcagagaatggtatactttgcccgttcagtaacatcttagacttaatgacttaccg

SEQ ID NO: 3682 - DNA, 323 bp, Bacillus thuringiensis
aatcattataagactgctcgactgtttggtcatatagttgacaggcagctgggatgtcttgaagtatcatacacgagcttacaactcatttatatgggatgcgcacaagcttaatgggaacttactgagttgaagaggtgcatacataagattgcagagtcatcaagtttgtgtttgaatatgatacacccatagtaatggaggaacggtgcatattgaattggtaacctcatataacccaaatgggaagaaaaaccaatctgccagagaagaacaaccgcttctgtgactccaacataaagctatggggaaagctttatgaa

SEQ ID NO: 3683 - DNA, 132 bp, Bacillus thuringiensis
  unsure (1)...(132): unsure at all n locations
accagagncagcacggcgaattttaacttgcagaagacacagccagcggaacaggggattgtacatggaaaaacacgggactacccaattacattagcgaaagagttacatatcgatgaaaagaaacgagcg

SEQ ID NO: 3684 - DNA, 431 bp, Bacillus thuringiensis
cgaagctggaggacgaatacagattcagttcgtgttaataaccttttatgttcttgtcggaaaaagttatattgaacagcgttgtgaagatgtattacacggcagaaaagatgaaggctaaaatatgactgatacatcaggagacatagatggcacagagcaaatattatgtggaagaagtggtcaatagattaactaaaaggactggatagagaccagcagattgaccgcggacgggagtagagtctcctacttccgagctctaagagggcgataggcgactgctatatcgagcatgtagttgccatgacgaagttcatacatcaggcatgatatatcacaggcaggcacaatgattgtagacagaggagggtaaagagaggccgaggagttgacattatgaaacatgacaacttatgatgagcatagca

SEQ ID NO: 3685 - DNA, 156 bp, Bacillus thuringiensis
tactactgtacgcggtaaaaacctataaagggcgcatgaactgttatagacatatctatgtcgatacactaccaagcgcatgttgacgttttgtgaaaatagagactgtacccttttggggccgattttggatctttggtgcagtagcttcttcca

SEQ ID NO: 3686 - DNA, 116 bp, Bacillus thuringiensis
taatattttgttaaagttgggcgcgactttgtgaaccttcacgtctgttttcagccaacagggcaagatcggtagaacccctgccgctgtcctgcggcagacgcctttctttctcg

SEQ ID NO: 3687 - DNA, 160 bp, Bacillus thuringiensis
cgatgctaggctcgaatacaaattgagatactagggagccactttctttgttcgccatgaactgactgtcccacgtccggtaattaatacctggaagggacttgcataaacgaataggccaactcgcgactagaggcattaagcgactaaacggctcttg

SEQ ID NO: 3688 - DNA, 435 bp, Bacillus thuringiensis
gtggatgtatacggacggattccggaagctctctgtgcaaaagagaaagagtgttgttaaactaggtcattcggaaaaccttttactcgcgtataaattgaataggatactttatctcctactacgacacctactcgattaaccaaatcattgagaggataagctaaggcactccacgatgatcggttttcaacaactgcatcacctcggaaaacaaacatcgagattttaacttgatcggctgatgtaaaccaccaacgatggagtgcttgcgcaaagctcatggcaccatcaacagatatagaaccgctgaataggatcattacatatacctgaacgcgtgctacactctctttcactagcgaaataactatcacttgatacgtgcacagacattctaaggtgttgattatacatgtatgtcacactactatg

SEQ ID NO: 3689 - DNA, 248 bp, Bacillus thuringiensis
ttagagccagctctccgctgctgaagctcgaatacaaattaacatctatcgtccgctacttttgtttgtttgcagtacacgcacctcccatgtcgagcgaaacaaaaatcgacactgaagaatcaaagacttaaacccatcaggagtatacagatcaccaggtgagttctcccattgaaagctgatttgtctactcatcagcctaactgctgggacttgcacaaccaatggcacgctttttctattct

SEQ ID NO: 3690 - DNA, 127 bp, Bacillus thuringiensis
ccgaattaataatttcagaaggtcatttactttctccatctaattttctttctgcctttattataacatttggggtggaataccaatccaagagaatgagccttttgaaagtttatctaaccaaata

SEQ ID NO: 3691 - DNA, 114 bp, Bacillus thuringiensis
ggtgggcgaaaattggacgcgtgaatatatgaaaagacggggtgtgagcgtaaccgatgcggaattaatgaagaaccaaggtcaaaaatctgattatttttattatgcacaggt

SEQ ID NO: 3692 - DNA, 361 bp, Bacillus thuringiensis
tgatagtggtgatacacttagatttattatctaattcacgtcttaaattacgaatatggttcttgtccggtcgctcatcgaccgcataaccatatccccaaatacgagaaatgagctgcactaacgttgaaacgtaactctggatcagcatgaactacaccgattttttatacaccagatgaggttaacttacaattgcctcatcaactgcaacggcacgcgacggatactgcacatgggtggcgcgaattggttacattttatattcgctcggtaaagggctattggctgcttttttactctgtaactattgctaccctcttgctaattaaaataggaggactatacggcttctatacat

SEQ ID NO: 3693 - DNA, 135 bp, Bacillus thuringiensis
tgtagtaatttgagcgacactgctcatttattcaggggctaaacataaacactggccggtaagttcaaaaaccttctggaggtataattctctctgacctataactctattgtattcctccttgcccttcttatt

SEQ ID NO: 3694 - DNA, 118 bp, Bacillus thuringiensis
catggatgcgggtgaattgattttttgaccgcagtacatgcttattgtgttatcgtgcgcaaatgtcgaattaaataaacagcgcggcttgacgtaaaccatgcatcttatactgcgc

SEQ ID NO: 3695 - DNA, 378 bp, Bacillus thuringiensis
ccatttgcagtagaggttaatgtgggttataaacgagagcatgaagtgttagggagtttgtacatatattaatagaggtgaacgttgtggaagaaatgcttagagagatagagagaatactagaatggcctcgcatgttaaaagcgactgttatttcaaaaggcttttcattcgatgagaaatataaaattgaattaaagaatcaagaaacctattttgtaaaagtatgtgatgctgttcattttgaacgtaaacaagaagaatatacgtatatgaaacatttagagtcattacatatatgaacaggcaagataattcatttcatcctaattgagaaattgaatacacgtgttcaagtatctgaacggaccccaggta

SEQ ID NO: 3696 - DNA, 116 bp, Bacillus thuringiensis
  unsure (1)...(116): unsure at all n locations
cncattaataaagttttggttttgaaacggacgacataataccggtatgcgattgggcgaagagacatgtacggacaagttatgctgagttaatggacaagaacagcctaataatg

SEQ ID NO: 3697 - DNA, 113 bp, Bacillus thuringiensis
attatatagacggaatgttttttttatatttgaccgataaaaatgaaagcgaataccgtactatgcacactcgctttcaatctaaaaagacgatcgttaaaaatgaaccgaca

SEQ ID NO: 3698 - DNA, 307 bp, Bacillus thuringiensis
ggtactggcacaagtctaactggtttacaaggcacagtatgcttttttcctatatccattaactcccctagtacctggtaaatcataaaacgaggtacagccggttgcatacttacttcatagcctgactctggagaacgtgtaaacaacccaatattcgctttacattcacgctgcgacgataccaacttttgggggtactttataattacatccatcggcaacccctcacaaactaagtcgctcttaccgcaaaacgtcgattttgccccgcgctactttttactttatcaaaaacaaggtgcta

SEQ ID NO: 3699 - DNA, 142 bp, Bacillus thuringiensis
ttacgctaaagcagacatggggcctattcactgaggctttccggatgaaagcaccccttctaccgaaggtacgggggggttttgccgagcttcttaaccagagatgtttcgcacaccttaggagtttttccttcgcctacct

SEQ ID NO: 3700 - DNA, 101 bp, Bacillus thuringiensis
aaaggccagtaaaaggccagtaattttaaaaaggtcgtgatgctggcgttatttcataggctccgtccccctgtcgagtatgacaaataacgatgcttatg

SEQ ID NO: 3701 - DNA, 282 bp, Bacillus thuringiensis
caccgcgtgatcacttgtggtctcgagttcatctatgatttacaaaccagtttttttatacagagaaacgtactaaacaacatgggaccaaaactgaaacacatgaccgataacctcattagggcacgtttgtatacaaccgtaaataggctcctctcttcacacgggccttaaaaaacataacccacatctctgggggagctataccctaaagaactagacttcaaccagaatccgaacaatcggaagcgactcccacacacgaaggatactaccttcccg

SEQ ID NO: 3702 - DNA, 128 bp, Bacillus thuringiensis
actatttttcgttaactgctttatattagttccaaatccctcacaatcctgcttgggctagtttacaatcatatcaacgtcaccttgacctcttcgtacatcacaaatagtctctcggtaactttttt

SEQ ID NO: 3703 - DNA, 105 bp, Bacillus thuringiensis
ggaacccaggggcaattggaattgttgcttctaaaacacccgaactacactcatcgccgacgattgtataaagcatggggcctattaaagaaacagcacccggct

SEQ ID NO: 3704 - DNA, 135 bp, Bacillus thuringiensis
caagtgatctacatgagctagctaagctttgggacccgtttttgtactttacaacttagtctagcacgcggtgatatgaataccgagcgcaaatccttcactactctgcttgcacactgtgatcatcgagcaaat

SEQ ID NO: 3705 - DNA, 236 bp, Bacillus thuringiensis
cgaaggaaataaaggcactagttctgtattcaccgctattctggtatacccttccattgaacgtgtactataaggactttacgacgaaatcaacggtaataaaggacaacttgatgaagctttcatctacctgcaccggacaaacttaggccaatagaagcctataccctatgaaagcagaacattatctcaccaggtatatagcgcgaccaaccatatatgactaaaacagttca

SEQ ID NO: 3706 - DNA, 258 bp, Bacillus thuringiensis
ctatattgagcgaattggctacagatttatttctctttacaatgccaagtatgtgaatataagaaggtagagagctacacataaaaggtgataaatgtgaatcatcgtcaaatactagcgtactggtttcaacggagcatctataactaagaattatagctaaaaactgtagaagagataatgcaagtagaatttttgaattcggaagaactcgaataaactaagaagaacatatgaaacaatgaggaacttatcgaa

SEQ ID NO: 3707 - DNA, 126 bp, Bacillus thuringiensis
ttcgttataggctcttttacttttacaagctttacaaaaatcgactctcatgtcagaggtgcgcgatacccgacaggacatataatatatacctaggtctttttccattttgcgaagtttttctta

SEQ ID NO: 3708 - DNA, 161 bp, Bacillus thuringiensis
gaacgcaagaaggtttcctttttttgaaaggcaagcgtaatgcctggaaccggttaaaggtcgatatgcaggcctttggccataggcttaaacggcgtgacgggcatgacaaatactggcactccagtcaaacggggctttacatctcgggggcatatgag

SEQ ID NO: 3709 - DNA, 225 bp, Bacillus thuringiensis
gactctatgcttactgctacattaagcccgacagcgaccttgtctattactcataggagcggttattcaattggaagcacaaccaaatggtcaacatcataaacagcacccgctgctgacgttactaaatgggtcaatttcagctccttggcttctgcccctatgacactcaggtcttctgcgtccgaatccgatgtgactattttcatactagtcgttacatcc

SEQ ID NO: 3710 - DNA, 100 bp, Bacillus thuringiensis
ccaaatcctattggtgatggcatgtttttttctggaagatagtacatcgctcgccggaaaatgactttttgctgaacggcaaatattaacactcgccccg

SEQ ID NO: 3711 - DNA, 389 bp, Bacillus thuringiensis
gcacgctaggctacgaatccaaatcatattggttatggaatgtctgcacaggtcggttacggccaggcggtccgaataatgctctcttgcgactggcgtgatctcaccctagatattctgagagtagtgcatgctgcaaccgagtaggtgcggcctctggatgtgactggactgaccggccgcatactcaactgactaggctattatgaatacggttaaggcaaatcttaggactacgctgggcaagcattagtgagaccaatcgagcacccgatgatctatcagacggatgactttcaccacatgtttgggtgaagcataggcgatggtggcaagagagccacgttatgaggcaatgtggccgacacggtgatgttcaatacgcatgc

SEQ ID NO: 3712 - DNA, 430 bp, Bacillus thuringiensis
cactcctgcctaagtgataaatgacggttgaccgatgatgtgttttggtgtacaattatgatacggttaaatacgtgcctttggctttgtaagaccagctactgtcatatttacacataggtctctcatggaatcaatgatgatgcgatataccttggctctacgagccggggatcaaggaggtgttgtgtatcaggagggaactgcgcgacgctgatagaatacgctcgcccgcacgaaaatatgtacaaatcgctgagataactaggagtagcgccgctatatgctgactgtgaacgttttaatcggagatggggtggatgaatctgccatatcacccgtatgttgtcaatgaccggatctaaatcaactactgagagagctggagacactaaatgctcgggcctgagcccagacgttttacttcatg

SEQ ID NO: 3713 - DNA, 240 bp, Bacillus thuringiensis
gggcagatggaacggtcacaaacctcacacttggttttacaatacgtacgtcgcgccattgagttccggctgcacccaaagggagaccggagatattgtactttattgtactaaaggccctcgagatagacgtggggacatgctgaacaagcctcacctcgttctacacttagggaggggataaggttggattacttcccgtgaaagcctctttgcatcacgccggggataccttgcctc

SEQ ID NO: 3714 - DNA, 441 bp, Bacillus thuringiensis
ttccgggatcacttgtggttttaaacgcgaaaactcaggacggcgaggctttttttcggaatgcataacagaatgctgcatatagtttcaaacttttgcgatagaagcgctcatttttgtcgcaacaggcaaccagccgcatgcttttcattgctaacagctactatgcgctataactataatgtacctgcaaagaaggtattatgcttcaacacacacacacttaattctaaaaggagaacgatttgcaggacacggattgaacactcgaactcatcacaaagataacgcatgatataacaaatgttcctaacaactttgtcgatgacatactattgcctaaaacatgagataaagggggcgatacttatggctaggctaatgcagacacacagatgactctgaacgaagatccaagggagcacttcccaaaatgattaa

SEQ ID NO: 3715 - DNA, 155 bp, Bacillus thuringiensis
gtgattaatggctttgacgactgatacaattgacggctctgcaattttttgaatcactgcaaggattgctccaatatgtgtcctctaattgcataaccgaccaatgagtacattaggccatgttttaataccattaatttgatgctcttagtttg

SEQ ID NO: 3716 - DNA, 254 bp, Bacillus thuringiensis
cacaccgtaggattttatctttggctacctcagcttgtttgcggggcaggctccttgcatctcgctcgaaacctttcttggctgaggggaaccaaagacttcgctctattaagtgattccgggtatacatctcagcctacacgttaaacggatttgtcttctcatcagcctaactgcttggacgtgcactaatcattgtacgcttattctatccttttgacgccctccattgttcaaacgacaaagaggtggtt

SEQ ID NO: 3717 - DNA, 158 bp, Bacillus thuringiensis
ttacgttcgcttgcttcttatcgacatacgcttgcacagcttctgctaagaatacattgagagcaccgattacgacatctggcgctactgatacgtgcgtgtcttgtactccttctactggacgagggtatgcgttatcaccggcaactaagactata

SEQ ID NO: 3718 - DNA, 197 bp, Bacillus thuringiensis
acacagcacctcatgattatctgctattgcaagtgctactgcttacggacatcatgtttttatttttggcgtaacaagattttcaacatgtgctcttacattacggatacgagctgaaaacacactatcaattgctctagtaccagttattgccatcatggagtatcaaggcgagagatttctttagtatcgcccta

SEQ ID NO: 3719 - DNA, 186 bp, Bacillus thuringiensis
acaggtcatggccgttgtttcagtgataacggtgatcgcttgcatgtatattaagagtactgcccggcactccaaattgtctaggccggtgtccgtggagtgcttactaactgaatttagttggcaggctctccgggtaccgtttcaagacaagttcccagtccagcccagttcctcattgatgca

SEQ ID NO: 3720 - DNA, 332 bp, Bacillus thuringiensis
tatagcaccttgcaaaggcctgtggggctgaagactcatatcgacgagtccgctcactatgaacgctaggggtacctactatacagttagcaatagattgtccactaactggaccatattaatactggcatcaccgtttggagctttacttgtgaaaaaaatttatccgtaaaaaatgcaccttcgattgctagaatcgtgttaacaaaaggggtgcgcttgagagcttggatgcactttgcacgggtttttttatgggaaaagttttaatgccctttctgtttttcaaagaaaacacttcttgtccttattacgggttgcctttttcattt

SEQ ID NO: 3721 - DNA, 260 bp, Bacillus thuringiensis
cacattgatcatactaggtctcttcttgctgcgcacatcctacccactcaataataggggcatctcccttcacaccaacttggacactagtttctcgcagtgattatctcgcttctaatcgaagacgaactgcatatagatctagctcttggacatattgttgcaacgatactcccttatttgccttacatttttcctctcctaacaaaacagcaatgagtcctgcctggcagaaggacaaaggttctacttgctacctt

SEQ ID NO: 3722 - DNA, 411 bp, Bacillus thuringiensis
agatgagagataagattttactattacgggaaacaggccataccgacaggtaaggtcccaaagtgtgtatcaagagtaaaaggatgtggagtacgctagacaactcggaagttggctgaaaagcagccaccattatatgagtgagcactagctcactagtcaagagactctgctccgaaaatgtaccgtagctaaatacaccaccacaagctgtggataagataccaatgggctcagggttaggggagctgtttccggtcagcaaatagagaccgtgaggactgttgttgtgctactaaatgagaatgtcgacgaccgttggatggactgtggatatttctaccacacctatgacttaagaaagatgtgaaaagcttgtccattctaggtgaacgaggacctacagtgcct

SEQ ID NO: 3723 - DNA, 105 bp, Bacillus thuringiensis
attcgcgattttacaaacatatttttccttctccctttattaaaacacaaaagtacaaatctttattgggcatgtttacatgccatatacatagcgaggagggaa

SEQ ID NO: 3724 - DNA, 271 bp, Bacillus thuringiensis
aatatttaagtcgggtttttattttctcgggccaaaggaaacggataaggactggcgatccgaatggaaggtgaccgcaactcatgctgcgtaatatattaacagtagctacggttatggtgggagtgcgtgctgcttcatggtgtagatgttggtacaggaacctggggcatagtaaatgtcacgattcatgtggtgaaaagaacacattcgatgacagagacaacaggaatgcgcggtgtgaattgtatacagagttcgaatcgccgtg

SEQ ID NO: 3725 - DNA, 268 bp, Bacillus thuringiensis
tcattttccgttgagacattgattaactcgcgcactgcagtttgttcagacatacctacctccaaccgataccggtgttgacggtttacggcacctcgtagttctgcacgatctagcgctccctattgtcgactcacgtccgttaaataatgcttggttctccgctggtaacttgctagatacgctcgctatacatggttttgagcggatatatctgtaacaagaacaaggtacagcctcagacagacgtaacaaatgagacagtgat

SEQ ID NO: 3726 - DNA, 248 bp, Bacillus thuringiensis
ctaacactgtgttaaagcatagcttttctttgctaaagattttattcttgcagatacaaatgctacacaaaatgggggggctttaacattacctcaggcgttttacaaccttctggctcactctcactgtgtgcacgcatagagatattccttctgggccttcttgaacttaattagtaatacatttacgtataatagacctggtccagaccatgctggtcaggattttaccccttgcaggggtagat

SEQ ID NO: 3727 - DNA, 138 bp, Bacillus thuringiensis
cccgagatctgcttttccgctccaattcatacaaatccgaaatcgaccatttttttaaacaagatctactatatccttagagagggggggaagcatgctaatactacgggggacgaaccaatgacgagccttatgaag

SEQ ID NO: 3728 - DNA, 123 bp, Bacillus thuringiensis
catccatcggaggacgaaattttttaagcataacatcagcttcctggccagcatcggtaaacatagcgcgactaccagaggccgcaatacctgatacgatccatctgtcaacaacattcaaaa

SEQ ID NO: 3729 - DNA, 190 bp, Bacillus thuringiensis
agtatcgccgaaagatgtgagagccaatgcaaaaaaattaaagagtgtcgaagcagaggcagcgcaagaaccaacgcacctaagggaagtgaaaggagacgcaacggacacaaacggtgcattaggggcacaaataagaacagcgaaagattgtatcctccccgaaggaaaagagtcaccagatgggaac

SEQ ID NO: 3730 - DNA, 165 bp, Bacillus thuringiensis
tatgataaacaactgacgcttgaagaagtatcattttaaatgcttgaggggagagacgtatagtgacgacgttctatatgaaaacaatgtcatgcatctattacatgagaaactgagggggttatgcactaacttgaacataaacaacgtgacatacatgaagct

SEQ ID NO: 3731 - DNA, 413 bp, Bacillus thuringiensis
agacggacgagaaggcagaagccagaagacgaaaacagatgcccaggaaacagtttaaagttaatctagaaaaaggggccatacctagggggcgagcaaacatataaggggggaagcagaggaaaaaagatgagatacaagatgaaaaagaaacatatctaataaattggcatgccaaataaaaaaggaaaaatgtcgggttctcaagaatcaggagaaaagggatttgtcaaaaccgactaacaaaaaagctggttggaagcagaaaatttaaaaagaagcagtacgaggacgaaaaaaaaagaaaaaggggtctaaacaaaaaaaggaagaaacctaagcgtacatactcggtaagggaggggtgaaaaaaccgaaagaaacacaaaaggaatacaataaggaacaaaaac

SEQ ID NO: 3732 - DNA, 448 bp, Bacillus thuringiensis
cgctctaagccgttttttatttttctaccgccaatagcggatacaatgtggctgcaaatcacatccaaaacccgcggaaacgtcacggcacaaaacttaatcgtggcggtgactctccctgatgggacgccactcacattcaggcattcttacactcgttattaggacacagtatctcgcaaagtcaagtaacggaattcatactggaaatctacacccaaacggggcggacgagatgactcttagcgcacgtgtttcaaacaatccgaggttaaatccagtctataactataggtctgggcaaaacgcacatgtcagtaaggcctagacagcctgccttatcgcaaacgaatgaatgtaacacgggttggacatcgattaatagagccacatcaacaacagacaagagtgcgtgttgatatatagtatgagctggagataccattac

SEQ ID NO: 3733 - DNA, 130 bp, Bacillus thuringiensis
gtactaccagcatttttccttttggatccaataccgagagaacaatggaagatgtcaccctatgtgggcggcgactttatttgatgatatacatttacaccctaatgttggagaagccgttagtggcaaa

SEQ ID NO: 3734 - DNA, 358 bp, Bacillus thuringiensis
cgctgtgcttactgaccggttttcagtctgaacacctgacaggccatgtgcatgaatgaacatgtcatcgcgcggggagaggggcacaggacctgatcgctataccttacttgtactggggctggctcgagtaggctgggaggtgtactagacaggtcaaaggcggagagcggtttgcactataataggggagaccgtctgagagaacatgagagcagcaggctcgcacgatgcacatgaaccgaagaaaggccgcgttagttgtgcgtatcatgatagggtccgaccgatggcgagcctcacatacataggctgtgatgtctaacgtggctataccgggccggactataaggacacc

SEQ ID NO: 3735 - DNA, 361 bp, Bacillus thuringiensis
aaagggaaaggagagaggaagaaaaaaaaaaggaaggtttaaagggggaaaaagaaaaaaaaaagggaaggggaaagagggaaaagaagagggggggagagagaataaagaaagaggaaaaaaaagaaggaaccaaaaagggggaaaaaaaaagaaaggaggggggaaagaaaaaaagaaaaaagggaaaagagggaaaaagagagaaaaggaaggggggaaaaggaaagggaagaaagaaaggagaaaaagggggaaaaatgaaaaataagggggggaaaaaaaaagaaaagagaaaaaaaaaaggagaaaaaaagagaaagaaggagaaaaaaaagaaagggagggagccggaaaaaaa

SEQ ID NO: 3736 - DNA, 132 bp, Bacillus thuringiensis
cagaacccgcgatcaaatacagcaaagccaacagctaaacaacgtggaacactcttttttttcaccacaaaaccatcaagtggaccgaggggagcgtaagacagcacaaccgcgactcgggcaaactccaga

SEQ ID NO: 3737 - DNA, 146 bp, Bacillus thuringiensis
tacaatctgataagtttgtaaacaaaacaaacactgtcactcctctcgatgagcctaacgctgcaccttttgttggatctttgcttaatacaatcgcgcggaccatcaaaacgttctaccaatttacaagcttcaatttcaattac

SEQ ID NO: 3738 - DNA, 225 bp, Bacillus thuringiensis
gagatacgaagcataatatgcacacgtattgctaaaacatcttggatttattgaagggaatgagcgagaaccgctaatatcgcgcgatgtccatgatcggtaacaagaatagaagcgagcagagctggtactacatcattttcagctatgaactgagctggtgaaggatcaacaagcggcaagatttccaacaatgtgatgtcagttggcggcgaaagttctggt

SEQ ID NO: 3739 - DNA, 177 bp, Bacillus thuringiensis
cgtcatactgaccaccggacgctgcatcccgggcacatgcgccctgttcgatacaagtatcatacagaccgggcggtttttccagccgtgcctccaccgtagcgagcgctgcggtgtaatggctcccccctatcactgtacacattgtaccaaaatggaatgtcaaggcttcagaac

SEQ ID NO: 3740 - DNA, 275 bp, Bacillus thuringiensis
aactggcccacagacactgtctcccgggtggatatgatttggaggacagaatgtcaatacagacagggcggtgtcctatcagtgcctacaccgaagctagcgctaaagtttcaatggcattgcgcctatgctgtacacactgtaccaaatgtgaatttccagctacagaaaagctccaccacgttctatgattctgtatggggtaacctgtatcttgacaggacctatgattgcaccgagattctgaacacacagcgcccaaagacggacgcctt

SEQ ID NO: 3741 - DNA, 143 bp, Bacillus thuringiensis
attcaaaaagtttttaagatttattaacaaaatgcgttgcatggattacctcctagtacctgtgatccaagaggtttagccctctatgctaccgcatttcaatatatggagtgggcgcttgtttatggcgatgtggacgcaag

SEQ ID NO: 3742 - DNA, 195 bp, Bacillus thuringiensis
gcctgaaggagacgtgaaacaccaacggtttctaccgtcatctttctaacggaatgcatacctccctactgggagacactggtcttacctacgtttatctgtagaccaattaggctgaactttctcaccctgtgttgaacaatgcttcaacgagaccgcataccccatcatataacagattctgtggtgcacata

SEQ ID NO: 3743 - DNA, 129 bp, Bacillus thuringiensis
taaatcaactttttggttatgcgcttctcaagcagttatcgatggatgatgtaagaaggagtgtaggctacacacgccataagcaccagtgcaaagtttttagctccaagctttgaagtgcattgttac

SEQ ID NO: 3744 - DNA, 254 bp, Bacillus thuringiensis
ggtagcttggcacaccggattgcgcggcattatcgatcgcgcaggtataccagcatgtcatacaatacctggtgcgatccaacagaggactgaaggaagcccattccatcggcatatgagatcaaagcccttaatggtgactgcacctgaaggcaggcggaaagatggttcctcaccaaatgaatatggtagtacacctagagcctcgtatatacaagatgcacatattgatcgagcgacagtacatatgtgtc

SEQ ID NO: 3745 - DNA, 116 bp, Bacillus thuringiensis
tagccactaaggttatttttatataaatttgcgaaacagaaacatgtggggtttattgctaaccgacaacggtgctccattctcacaaaaatccggagctgctcgcttaacatcat

SEQ ID NO: 3746 - DNA, 251 bp, Bacillus thuringiensis
tcaatgcatagggtggaaaaatatcacgctgccgttattgtattttgggcgagatatcctgcctttctatccagggggctgcttcacgcggaacaggaggcagaaacaaaacatttgggcaataaaggcacttcgtatacaacaaggtgtggaaggggttacacaggaaaagtacgaatattatcttatgttacgggacccactccgatattcaactgctattccttcctttattcttactggaggccaac

SEQ ID NO: 3747 - DNA, 256 bp, Bacillus thuringiensis
gaatccgcgatggacaagaatttcttgctttttatttaatgctttaccgtaatctcgtttcgctaatacagctaccattaagccgttggtggtctcattaattactaaacgcgtgcgaagtgctaatggctcatcgctactctcggggatggtgagacctactctcctggatatccgcgcttcctgtagaaagtccaaggactgtcatcgcttacgaagaacgtcctggtacaataggcggttaactcgtagctcc

SEQ ID NO: 3748 - DNA, 396 bp, Bacillus thuringiensis
aaaacctcggtgattaaaaactgcaggattaacgactcctgcactcgtggtgcaggattttttcgttaccaagtcatgacaacacataagactggggggggtggtatatcatcgactagctcgaccataaccagcttatagattgcccatttacaaaaacttaaaaacataccgataccaaataaagatttgtggaccaagaaaaaagccgccctaattatagggcgccagttatatacttactgacgaagactagtgggcggcactaatgttgtcgctacaacaggaaatattatctcatttgataatggaacacactgttaattaataaaatgtacttcaccactcacatgcaagaactgcacacattatagcgtcaaaatttatattttttga

SEQ ID NO: 3749 - DNA, 264 bp, Bacillus thuringiensis
ggcggttagaggaacagccgtctcaaggagaaacaattccaaactctacacgggacggcatgatcgcaattgaccgagagggacacgcccagccttctaataaaagtgcagagcgaatcacccgcactaaaaccgaagaggcgaaaggaacagaccacctaagaagccaccccaacccagtcaattactacacatcatacgtacaaaacaaatacaaccaaatcatgaatctgacaccagagaacggaaagaaaaccaatacaa

SEQ ID NO: 3750 - DNA, 334 bp, Bacillus thuringiensis
gcgcgcatgaacattacgtcatgtgaagcctggacgggagcaatatgtgacactatacgacgaaagtgtagctcatttttatatgctgggcctgcataagcgcacctatgaagataatccatcttcagctattgtgacccacggatctgtcgttaaagcacgaatgcgttgaccgtgagcagcgtgaagctccacaaggctcgagccgcgattcaccatatatggccgtgcttcactctgaccattcatacctacgctgtttattaggacgtaagcatgttttatcgcgtttgcatggactaatcctagaacgccggctgcaaaaagggtcatg

SEQ ID NO: 3751 - DNA, 262 bp, Bacillus thuringiensis
cgccaggtcaagacgaagcatctcaagccgcaaaggcaccaaatgcaccgatagaggaatttacgccaaagcgaccggccaggaaggaggacacagacggacaaagaccgcgaaaaaggagacgaaaaacccggccagccaagcaccgacagacgaagagggcaacgcagcagccagataaacaggaaaagaaataggggcccaaagacaaagacccgaaacggcaagggacagggcaacgttcacacaacaaaaaaagaac

SEQ ID NO: 3752 - DNA, 204 bp, Bacillus thuringiensis
atatgttaaggcaacggtcgttctataccgcctagataaagataataaacggggggcaggtttggccaatgacgcgaggatttctaaaaactaaaagacatatacattataatcacatgatgcgataatggtcataaggtgatccatatcatgcccaagattctgtataaagcatggcaacgtccattataataatagcataca

SEQ ID NO: 3753 - DNA, 160 bp, Bacillus thuringiensis
ttatacattttgctatcagtagactcctcggcgagagaagaggatatcaccccatagtagccttttgaggactatatcccctgcttagaaaaccatcacagcgctagagcagaagaatgaagccagattgtcaggtgctcatgagaagaatgggaacgag

SEQ ID NO: 3754 - DNA, 254 bp, Bacillus thuringiensis
ccaactctttcgaagttttaactcctgaaagccctgactacaaaacggaatacacatgtatcttatacaaaaaaagcaggagtgcttgtacatgtatccacgggcacaggctctctggcattgctatacatttaagaaccactctttttcctgttatactatttccccgtgcttaaatgaagagtcatttttaagtaacttttgacttggtgaacatacagtacaatccgctatttcgagaaaaccgggaagaa

SEQ ID NO: 3755 - DNA, 233 bp, Bacillus thuringiensis
acaaacacccctacagacaaaataggtggatctattaaagacgttggccgcacacaatacccacttccaaaaggaatacctccctagtaatccgcgctaccctcacaatataaaccttaacaaaagatatcaccgtgagcaattacaaaaacaacggacaaaataagaacacccaccaaaaagaatatcacatattatttgggggtatcagagctaagggccaaaactaaaaa

SEQ ID NO: 3756 - DNA, 226 bp, Bacillus thuringiensis
atatattccgctccatagctcctgcgtatcggaatgctcccaatcaaattatggttggtaaaacttattggcgcactttaccttgctcggttatcagcaaaatactttactgataagcgtaaaggagcaggtgaagaataggacgctgatggtctgaaccaaaacagggccttcttcagaatgttcgctgtcccctggggaacagctgccctggacgaacccacgg

SEQ ID NO: 3757 - DNA, 333 bp, Bacillus thuringiensis
catactatctttatcgtgctgtgccagacggactagatgattttttctgttttggatacggcaaacaatactatggtttgaacatgccaaagcgacaacaacctattgcataaacattatatactcataatactcaggatgggatgccagcgttcgtagacacgatgcacatagcgaccagaccaactatattcattctaatgcatggaaacatttctactgcggcgcgctccgcatgtggaaataaaaccatctgtatatactttgatctgcgaaacagcatccgagaaggtggacaagcttgtaccgccttggctacctctcgaccacacg

SEQ ID NO: 3758 - DNA, 190 bp, Bacillus thuringiensis
ctcccagcacggaggacgcttgtatggagaaagagactattcaagacataaataacgagagatcctataaaatcgaaaaaaacaggtataagactagtgcgaagacatcatcatggcagtctcagcacgaaagaggcttacgataaggactggcccaagggggacacaaacggaaaaggcgccagagagc

SEQ ID NO: 3759 - DNA, 317 bp, Bacillus thuringiensis
aaacttacatcggtagtcgacacagttgttgggctgctgttctattcgcccctagcatctttaactgttaatgatgctatattggaaccttctatggcatatacatgtactggcttcacttctgcacttgtgctctccatcttcaaattcccataaatgagagacagttattacatcttgatcggttgagccatcactgttagatagaattacctctttcacaagaccgttatacgggccattgatatgcaccgatggcgacagattacctacatgatctaccgagataccatgggagactacatcatactcagact

SEQ ID NO: 3760 - DNA, 110 bp, Bacillus thuringiensis
cagttgtctcagcattacctttatttacattacctgctcgccgagtgaaggaagggggcaaccttgtggaggcagcttttgacgtatcccacgcttctattctataaatg

SEQ ID NO: 3761 - DNA, 270 bp, Bacillus thuringiensis
cttatttcctcagactataacttaaatagactatcttataccactttaaaaaaaatgtacacctttgaatgctaattcttctatagatgttatatttcccttgttatacggtttctagatgggagacaccaaaatctggtgtttatgaataatccattaagaccccctctttttagttattggactgactcctcaaatatcttctccttcctttttatagatccataacgtctataataccccttttcattccatgaacatacatttata

SEQ ID NO: 3762 - DNA, 482 bp, Bacillus thuringiensis
catttcatttttcacttcttcatattgatggttttgtaataaagtagttacttcaccaaagtccatactatataaaactaactttgcattttgatcgtattgagagagtgtaagtgtattaatatgtttatagtataatgatgtagattcccaacttaatcctccaatcaaaccaatagctttcataatgcattcctcccgaaacgattatgaatttattattccacaattccgataagaatacaatgatttatatgatctatttaataaccaataaaagtggggagaaaagtatagaaatttacactatttaccgccataataccaattacatataacatacttatccagagaggccgagttaacggccctaagaaacctcagcaaccactatgcatattttataggaaggtgctaattgcgcacaggacaccttgtgtttttcgcaagataagacgcattcttgtatgggaaagaaaatg

SEQ ID NO: 3763 - DNA, 169 bp, Bacillus thuringiensis
gtgatctgcattcccttgtgcatcgctatgagcaagcatatgtagttttttttcaatagtgtctatacaagtacgcagattgacttttataatgagaatgtaacctcttaatcaactagagctcctactacaaatacaaatgttagtggaaaacgggtattgacaacat

SEQ ID NO: 3764 - DNA, 353 bp, Bacillus thuringiensis
atgaccgaataaaacaggttctttatagaaaactggaagaccgaatttactagcgggcttgttttatatctaatgcagattgtattaaatttccacactgtatttgcctacagcaacatagctgagatctgcaaccgactacactgtgtatgatacatcttggtatacaatctaaaacacgctagcatctcccactacaagatgtgactcgcacctgtctaacaatactattaagggacgaatcaaaagacaatgatcgactacatacacgttacgggcacgatcatcagccgactatggactcaacagatctatctatgatgatatacgagttgaatacaacttctaagcta

SEQ ID NO: 3765 - DNA, 338 bp, Bacillus thuringiensis
cttgtataatactataagacatatgggacggtagggatacatgtgctattttataaaaaatgtgaccgcagcatgtagcggtgggaataccgtcaagcactagctgtgcaagataattaggggcatgcacaaattgcacagctgatacagagagtggtgctttgttgtagccacagtaacaataccaatgtgtgtgagctaatagcttcattattaccgctacctaactctaattcatatacagattattgataactcctaggaaagatactcactcactaagctacactgcattcgcactcatcgaaaagccgtagtgcggcgttgggaactacaaa

SEQ ID NO: 3766 - DNA, 359 bp, Bacillus thuringiensis
atcggactagtgtgtggtaccgacattgtatcgcgaacaacatgttttttcgagatggaccgcgcctgaaatgaattggtggtaaaacctcaacatgaacgccggctactaccttctaattggacaatgtcaattgtatcccttactttgtgtagaaagcagacgatgtgactggtacaagcctggatatgaccaggcgtgatgagtttcacatcacgagtaatgttagcaatacgcagaacgttgagtactcgaacgccttccgactgaggggcatgaatcttaatagaatgcagtttaacatggtcttttaccactacaaccatcggtagcggtgacttgaatacaatgtttttctc

SEQ ID NO: 3767 - DNA, 135 bp, Bacillus thuringiensis
catgcaagcttatgtctattcattatttcccttgccgtaccgagacagggatttattgtcttccccaaattggactgcagtggcaacatcttgtttaactgcaacctctgccttccaggctcaagttattctttt

SEQ ID NO: 3768 - DNA, 406 bp, Bacillus thuringiensis
aagatctaccttgtaagtagtctcccacatgctattcaacttttttactccacactggtaccacactttcatgactgcctttatcactccccacataaacattcattgttttctaaatgtccttgttatgccagccaaaaataagtatccactcacagcaacccactcagaaaaagttttcacttcaattctttttccaaatgttcaaaggggggatggatatcacagaatttgagacccagcagctgattttgataaggcctattggattcatttttttcttccatataattggttaagaaagaaatataagcatttccctaactaaaaaccaaggcaagattacttagactatcccaagtacagattgttctatagacaaaaaacctgcctcgtctccatggaa

SEQ ID NO: 3769 - DNA, 413 bp, Bacillus thuringiensis
gcgggggctccatgcgcaggcgacgatgtaagttatgcccaattctttatatgatacactcggatgtgtacatgggagcccattatcggaacatcttggtttctctgggagtaagtcatatagtaatgtaaatgcgatactagctcatatgtggcaaagagatacagatagaggcattgcaccttataaatagaaaagggagttaacggtcgataactaccgatcgataaatatagttgagcgacctggaatataacgtgtaggacaacagggccaacagggataactgatgaaacacatgctgcgggtgcccatccaagtgatttacggagtccgagggttacttgcattacttgtcagaggaagagactaaacaggacaccatgagccatgcgtgtatatctaacagctgt

SEQ ID NO: 3770 - DNA, 110 bp, Bacillus thuringiensis
tgatgaagtattaaaatacctaaagatgtgcacggaacagatttttttttttaaaaggaaaacggaactgctcacaaattggtcttacatcgtagagtaaaccggagcga

SEQ ID NO: 3771 - DNA, 269 bp, Bacillus thuringiensis
taatagtgctaaacgaaagagtgttgttacccggtaacaccgctgattacacatatagcactcaacctgtggtgatctgaggctgcatacttacattctatatgggaatctatgagaagactatgggggtgcattacgtttaatcgagagaagcgagcgcatcaatagctttaattgtcagagcacattaagcctggagataggaggtgatttttgatgaaggagggcgagatgtagatgaccgaaataacggtccgtttagtgatgat

SEQ ID NO: 3772 - DNA, 157 bp, Bacillus thuringiensis
aaaaaaaataacggagaagcgagagcaacgaaaagcacagctttgaataaacaagcagaggtagaaggagcagagcgcgaaatacgaaaaccagtggaggaggaaaacaaacagcaccgagaaaatgcggatactcaacgaaaaggggaaagaaaaa

SEQ ID NO: 3773 - DNA, 114 bp, Bacillus thuringiensis
tgagtttgcagatggattagtacggcaggacatagagagagggaaagaggcgtgtaaaacagcatgacattgagtgggttgaatatcatacatgctaccgcgcaatcatcggtg

SEQ ID NO: 3774 - DNA, 218 bp, Bacillus thuringiensis
cagccacgttataaggggggggatttaaagatgccgggaaggcaacaaggagttggagctattgggaatgttgaacctgctgtggcggaaccgtctgggaaggcctatgactctcacattctaccaactttccaagatacagtgcagcctacgcttcctcttattatggatggaaacatttagtctagtcatttgcaaacgattgatacatacacagg

SEQ ID NO: 3775 - DNA, 248 bp, Bacillus thuringiensis
cgggaaataacgccgcctacagcacctttttttactgtagatcaggtgtcacaaataactagattcattccctattcagccgtaaacggaacacacttgccttggtctgcacgcactatatggtatgaagacagggtcatgtgcacggactcgataacagattgagcataaggagttacgtctaagacaggactcacagcttgtacatagaccgacttgatcagtcgtatagtccactacgggacaca

SEQ ID NO: 3776 - DNA, 404 bp, Bacillus thuringiensis
tacagatccgtagttgtggatgtctgctggtaaccgagacaggacttatactatctatgcatgactagtggggaagaaccgatagatgctactagcatagctatatccgaagttggtgtatgtccgggagactctgtcaactctaacttctctttcataacgtgaatttacgatctcctattgcatcaagagctaacatttgagtgacgagtaactacaagtaactttcgcaaaaaggctagcgaagattccaatattcatcagggcgaatactattcagacattgattttattactgaaggacgacctatttgagaattcaattgttgagcggactcgaaatcgtcttgaaggttataatcgatgtcctgatctttactaagaagaagcgtacacatacgaat

SEQ ID NO: 3777 - DNA, 303 bp, Bacillus thuringiensis
ccgtctttttgacccttctgtaacgggacagtcttgtactatctatgaagagttgttgtaacgcaacgttggatgctactcgcatagctaaacccgaccttagtatatgaacagatgactctctctagtctaacttctccatcataactatatacaccagatgctacagaattggtgctaacattacagtgcggagctttacgaggcacttaggcgaaaaggctagcgaaatttccaataatcatcaaagccgaatgctgcggatagcattcgattatgactcaaggacgacgctagttaaaa

SEQ ID NO: 3778 - DNA, 377 bp, Bacillus thuringiensis
agatcttttgaatcgtgcagacgcacatcacactatgcccatcgtcataacgacagatgcttttagtacatactcgttatgttgctgacgttcgaagactcttactgatataccgacctttgcgcaggtgtattgtggcactatactaacatccactgtaggggtccgtattacgcttccaaccttacttggatatgcccttatatacattaatgtactcataaataaacagcgtctgctgcgataatagcacagtatatgacatggatgcaagaacaccaatataccgtcgtcacagactggaatatatgtatactactcacgtttatgctatgactttcctgctatataatgctatctctaccgaaaagatatca

SEQ ID NO: 3779 - DNA, 361 bp, Bacillus thuringiensis
tgtagacgtttagagtggcctataacactgaatagagaacgtggaattagttgtaaggcatgctaatatagagcatgtactccgataatgcaaagggtgtaaaagacattgagatagctaacgaccaacacagatgggagtgtaaggatgatggattactatgtggcgcgtctcattacactcgaggaggggaaaactacactttatataaaagatgtaccgaacattatttttatagtataccatctggatggcatgacacgacctactggtatattgagggatcggattatttgaggcgggattgatatttaagcataggatatgaagcatttgaaaaagatcccgctagtggtactta

SEQ ID NO: 3780 - DNA, 181 bp, Bacillus thuringiensis
agggactgcctttatgaaatcgactggggtcatgactgtaaaacagttgtcaacacactacctagatggactttctatacagataaggaggtgaaccatgaacatcgtatcaatggtttgatagctgcaattgaaacggacgaattcatattatttatattaactggccgtacatatgaag

SEQ ID NO: 3781 - DNA, 245 bp, Bacillus thuringiensis
atgctgatgtatacttgggggcgcgagtgggaaacaggggacttgttataaaactagggctgaatcccaaacgcaacgcgtgtgctgcatgggcgtgaccggaatgtacctattgtgaggcctaatagagctgggtgtcgtcaaggtcatagttgacaactgtgtgaaatggctaatacgtttacaatttcacacaacaggcgaacctgaagcataaaagcgtaaatggctggggagcctaatga

SEQ ID NO: 3782 - DNA, 177 bp, Bacillus thuringiensis
gatattgagattttcatgggaaatgcataacccaaaggccgggggtctctgaatgacctaaactgaggactgttgaacacggttactaccatgacaccatgccagcacattactaagggtctagtcacatctggaacgtgaatacagtatgttatggccagctgtgaaacaaaaaat

SEQ ID NO: 3783 - DNA, 186 bp, Bacillus thuringiensis
cgaaatatactgatgagaaaaaagacgcaacgctggggattaagtgaacgaattaggaaaagggcttctgcacactgttacttccctgacactttcccgtcacatcactggcggtatcgtcacatctatcccttctctacactcttttattgccacctgtcacacaaccaacccgtatcgtcaatc

SEQ ID NO: 3784 - DNA, 358 bp, Bacillus thuringiensis
cgagataacgcgcgttgagaagaaggaaccgatgttgtgcaaagaagtttatgtactgatcaacagggattctcttataatatccacggttaccgacagtctatgctctgtacattgacataggaaactgtgtgctacttacttgataggatgaactcccgcctgatggaaccactaagaggagtttttgggctttgatcctagatggacttatcccgcgccatgatatggggctgcaggggttgcagaatctgttcgacggtaaacattgctaggattgcaacacctagcctatatgcacgacttaatatggaccaggaagagtgcacaaatttatttctgagctctgaagcggatg

SEQ ID NO: 3785 - DNA, 346 bp, Bacillus thuringiensis
aggcccaaagcccgggggtcttttaatgaactaaagtgcggactgtttcacatggctactagcatgagcgaatgacgggacactactagcagtcccgtcacatctggaacgtgaacacagtgagttatggtctgctgcgaaacaaactatactaattgtgagaacctatacacgatcgcgtatgcatatatgcgcggctccacgcggatcctagagaaagtcggagcagagcttgcaaagattattggcttaccaaagttcggaaggaacttgtcacatccaacagatgtttgcaggacacaccgacccactggctgatgtgccagatcagtaatgtgtgataaaa

SEQ ID NO: 3786 - DNA, 226 bp, Bacillus thuringiensis
gtcatatattgatggacgaaccataccattttcatgggggtgttgatactagacctttaggactgtgatggtaaggcttcgggtgaggaaacgccaactgcaaattcaataataagaacttggcagcaacaagcactcgggatcggtaataccacagcacgaataacatagtattgacccgttgcgacaataatgtgctctaacattgctccctatatcatacttg

SEQ ID NO: 3787 - DNA, 272 bp, Bacillus thuringiensis
tgctgtaggtagagggccacaccaaaggctttttatggcagtgttcctactagatcccgaggggtgttatatgaagaagtctcgccattaacatacctagcccgattgactacaaatgtcagggggaaaacacaaatccctatatctccggttcgaaacagcatactcgtaacgatttcctgagtaaacttccatttgctatgcttatccctccacaaaaacattacggggaggggaggataatccatactatatgccatgcactctccatt

SEQ ID NO: 3788 - DNA, 309 bp, Bacillus thuringiensis
actgtagtaatataaagcggccgcgcatagcataggggggttttgagagaactagcatgctttcagcacagcctgttcatggaaaagtcgaaagcagagactttaatatctaccgacctttacagagggttagagagacaggacactaacagcaaatgtaggggctcgtattccgctccacagccgtaactggagaagacctaataaggggtgatgtacacaaaaatcaaagcgtcgattgtcaaatggggtgtgtcaccatgggtgcaggtacagaacatcccattgtaacagatgggaaggggggac

SEQ ID NO: 3789 - DNA, 402 bp, Bacillus thuringiensis
cctcgtcaaaaataaggtaatccgccgagtgtatattgcgagcgctgtcagacgtgaggtaggacggattatgataggccacccctcattataccgcggttattttgaaagatgaaagtgttatatggattactcgcagaattagtacgcgcttactcaaaattgtacatgtatgtagtaccactgtactagtggggaaccgcgctggtacgatagacgatctagagccgagtcccttctatttaggtaaaccatcaacgtatcaagattcctataccacaaaactcacgacctaagttgtcagtgagatgctcacgtgtaaatcgatgttcgtattgaggcggacgagttggcccggggaattcttgatgctaggatgtccgacaaataccaaagcatctg

SEQ ID NO: 3790 - DNA, 381 bp, Bacillus thuringiensis
gccctagtgactatgatgaaaaatagtttgtcaagggggcattttgagagaacatgttaactgaaccttagacaaaagctattttatataaacacgcttgaaagactgaaatcacacatgtaaccgagtcagataaacaaaatatgcctaaccttgatgaatgacagcaaataacggttacattttgatgagacagggcttgtgagacgatgaatacaaatcatagctaaggaatggagcctacgcaagcttataatacagcaacttgttacaccgttgattcaagctcacaggattataacgaaagaaatggctgaatacttacaacacacagaaaggggagtacacgtataaagttcgcatgccccattgcatcattaa

SEQ ID NO: 3791 - DNA, 291 bp, Bacillus thuringiensis
gcccttatggtcgtaagcacacatggggtggcagggggggcatttgatgagaacatgcgaactgaacctccaaaagggaatgatgtagcgaacgacgctagtcaaactgaaatctacagtgtttaccaggtcagatatacgaaaaatccctaaccttgatgaataccagtcaaatgaccggctacattttgctcagacagaacttgtgaaaaaggggctagaaattaagctaccaaatccggtattacctgaacatgaagagacatcagttgttacaccatccattcaaga

SEQ ID NO: 3792 - DNA, 436 bp, Bacillus thuringiensis
cccacacgtgtgggcaaagctcgcgctctgctctagaggcgcgtggacgcatttacatatcagaagtttttaaaaagggatcggattcactccattatggccttgtatttgcgacagattgttaaaaaggggtgccagcgagaggtcttgaagaaatatcacacattgcaaggtgtttatgtataccgattacagcagttcgtacggaattaccccacaaaacacaatggatggtcttactaacagtgcaaggggaattgcattacatgattggaattgtaatgtctgtagaatcccgcatagcagagtgaaatcttataaggaattaataagaaagtgcactgaataacatgtgtgagaagtatgatactcataatattgagggtggcgtaattggcaggacagcagcacattttttagcagaaagaggacataa

SEQ ID NO: 3793 - DNA, 202 bp, Bacillus thuringiensis
tatatacatcctttttaaagcatggcataagcaaacaacaggtgaccgttatggggcccaaccgtctatccaaaaaaacggcatttgaaaaaaatccaataaccatactacaactacgaggaagcgtgatcgttacattgaaaggatgcacaaacgatgcacataaaagtgggcgttcgtttaaaagttgctcctacttatg

SEQ ID NO: 3794 - DNA, 183 bp, Bacillus thuringiensis
atattcatatattcaagtgatgactataagaaagaacatgggagagcatattaggccagtcatgacggcccttgtaacctggtaaaatggtcattttcagataaaatatgtataggatcaggtaacgtgatatcaagacgagcattactaaatatattcggtgaaatcagagggcgccattct

SEQ ID NO: 3795 - DNA, 342 bp, Bacillus thuringiensis
atattcgatacgaactaaattacggatatttttttatgcaagcggtcatattgtggcaccagccacacctatagaagaaattgcatctgtaagattagttcatctgttaatagctccaacattcgtgtgttcttgagatcctgtctacatattcctcctctagataccatgtatgtgctaccctaaaaataagagtttggcacggttcgaatctacacactgaaaatgcacctacatatacttcccctcctatacaatatgtgactttgcgtctgacacaagatagacattgccgcttattaatgcgtcattctgtgttctatcgcatattgaattcaaaac

SEQ ID NO: 3796 - DNA, 262 bp, Bacillus thuringiensis
aatatagtaaatttgatgcgcaaacagcttcacaagggggcatttttcaagagtacgctgtttgccccatcaacactaccatttgtagatctacgggagacactgatttacagttaaagatgtaaacagtacgcttgatgctcaattatactgaacagatacaagattggcatcgtatatcatatcttgcgattacaaggtgtgttgacagttaatccagctcatagagaatgaacggatcctatgctggctggtaatacac

SEQ ID NO: 3797 - DNA, 288 bp, Bacillus thuringiensis
cagtccaatagcggcacgtaccgcacctcttttggctctggttccgtcgtgggaatcacctccactcattctagatactgcggtgaacggaacaagctcaccccgatctggaagttctgtatggtatgatgaacaccttcctgcacatactcaatgacagaccggccttatggtggctcacataaagacagcactaatcgcgcaccacttaccaactcgatcaatcgcttcattatctacaggtaataatgtacgacccatatagttcacaatagatatcgtacccgc

SEQ ID NO: 3798 - DNA, 390 bp, Bacillus thuringiensis
gccactgtgtattagttaagaaacagctgcatgaggttgcatatacctagggagcgcattgggtcgtaacaactaaactatttgtagaactacgggagtaagtgagtacaatggaacgtggatacagctctgattattcttagttttactgaacggatgtatgattggctttgtatatcatattgggagataataaggtgtgttgacggttaatccagcgcatattgggggaacggggcctacgcactgtgctgatacaggaagtgagtatatggctgagacaagctcacggccttatggtggcgctgatggcttacattatttataacaattcagcggtagtacagtattggtgtgcgccgtatccggatccgcatgaggactcggtgt

SEQ ID NO: 3799 - DNA, 301 bp, Bacillus thuringiensis
cctgcagacgtttaacggaaaaggacacagaatcggtgatgaaacaaatatgctgatttgacagacgctctttttgtgccccccgcagacaataaaaggaggggtttccgaaccaaaaccggaataaccaggggagcaagcattggaatccacgggtgtaaatgggaaacatcgggtagcctgtggcagatttataaattgtgcgcttgagaggattaaaagtgccagtacccgcaatggtttacccggtacctgtccctgcagttagggacccaattttaatccctggtacgggccaaca

SEQ ID NO: 3800 - DNA, 278 bp, Bacillus thuringiensis
cggattgtgatatacaagaacttgtgccactaatggctgttttattgagccatcacggagcgcacattaaaacccgttccggcgattgagctcaatctcttctagattggcttgaatgacgtctttccatcgatagctattttgatccagtaactaacgcatcaaataatgacgctccgtataaaacatacgacttccaatcgattattggggatccgactcacatgaaaatggttttggtaatcgcccttggggatacatatcacttaggctccttg

SEQ ID NO: 3801 - DNA, 392 bp, Bacillus thuringiensis
gtgtgatagcgtgtttttttatatgaccagggatagtcactgcatgataatgaaatgcgataaccgttgcacacactatatgtgaagcatgcacaccaagattcatgctgagtgcattatgaggggctaactcacattaacacgcgaatggactgctcgctgctaatacagtcactaaaccttgcagcgccacgctgaatatatgaatgctcgcaacgtccagcagggaggccgtcagcaattggtatgctaaatggattcatagttaaatgcctccttaagctcggtacatacaatgcgaacggttgaggagggatgctacatggaagtaaaactgtattatacaactttatgtgattactcatgaatgaacacgtgttgcatacgacata

SEQ ID NO: 3802 - DNA, 297 bp, Bacillus thuringiensis
gttgcgcaatgggtatcagatactcggtgcttgcagcgttttttttacttaacggtaaacttaataggtgacgtgtcgagtttatagtggtaaggagctgtcgtttgaataaacggattggccacaggacgtagataagaagcagagatgtttgcatggacataggttgaaaggtcagtgccaatgacgtgaccatacatattagtggtgtgaaatatcgcaccgctaagagcagtgccatgtacatgatctactttagacagttccacagagcctttcgataggctattggtagct

SEQ ID NO: 3803 - DNA, 394 bp, Bacillus thuringiensis
aaattctaggcactttctggaacaagttacgagaacaatgtcagcgggggtgaattaccagcatggaatcgaagcgcatgactacgggcgggactacgaaggtggagaaatggaaacaggcgaatcaaggaggactgataacgaaaggaagatcaaatgcactcgtagaactccagaagatgcagagtcattgcatgcaacgatgactgagattaaacgagctgactaactagtgatcaggccaggaggtttcgctaccggaagatggcccatagaaggagctagcagagcagaatgacgcagaattgctgcgggggcgaccagggtatgtgtatgacacgtaatgacatacgcgtgagaaacgaggtaatatacttgaatagatggtggacgc

SEQ ID NO: 3804 - DNA, 189 bp, Bacillus thuringiensis
gctcctgacggtaatacttcatacaaaataactgtcattgtggtaggacttgtaatcgaagcaatagcttttaaactcacgtgaataactcaccttcattgcatgttcttacatgaatcgcaacatgttaccgctctatactcttactcggatgcgtaacttaactaccttcttgccactgcccataca

SEQ ID NO: 3805 - DNA, 351 bp, Bacillus thuringiensis
tgaagttttttctgaataggcctacataggtgacttgcgttagcggagcgtataacatatatgtctatcaatcgctgtataggatactcagaaatgtcacatgctcgctcacggtttgaatcccctcaaatcatagctgaaccgagcagtaaattcgagagatgacgcacgtaagaagcgtaacctgcctatagatcgcagagtgatattgggcgtcgccttcggagcatatggctgagggaaagaagtgtaatgactaatctattactcaggaagaatgtggcacaaggatgttcattctatttgcagtgggagtactgccgtataataactgactacactgcgcactaa

SEQ ID NO: 3806 - DNA, 417 bp, Bacillus thuringiensis
tgctgctctatataatatagtatccatttgaagctcgcgcttgtgtagaataaaaaatctatgtttattcatctgtctttacgctagtgatcaatgcaactagcttgccaactgtgtaaatccactaaaatcagcgcttgctcgagcattaactttgtgagttaacgctttcaatacgtgtgtccaccaaaaaatgcgcaggctgttgtaaaaccacgcgctcttaacacataactgagtgcaagtagcttaaagaggactcgttgatgtgtgtttaacatgaaataccactaactgacctgtttcactgaaatataatttattattataacccactatttagtgcagtactaaaaccttgcctaggcaaggcttatgcatgcaccgacatgttcctatatgactctacagactcac

SEQ ID NO: 3807 - DNA, 284 bp, Bacillus thuringiensis
gcagattgtattcgagaagaacgacctaaatcgcgtggtgtatttgatgaagcaacatgtgcagatattaatcgtattcaagatggaattgtacactaggaggaatgaatctgtctagtaactcgacaagtcatggctgtatcgagtgaagcaattgaagatcacacggtaatgttactgttaacgcagggcacaaccaaaaaacgtattagcacacttgccaaaggtgggtgtgcttatgtcgatcgaccgaaaaatggtccctatggattcagttatagatt

SEQ ID NO: 3808 - DNA, 268 bp, Bacillus thuringiensis
tactcgcgctgctgaactcttacgttttacagagcactttttttcaacctgtgccatagattgtaatgcgaggattatttgtcgcataattaggaggacacgtgggatttgcgctaccagtggatactacggtacagcatacacgcgggagttggttataaactatgatagcctaagcaggactttgggaagcatgccattcagcgcaagctgtaacatttgcacaggggaatttcgacgacagatgatggcaggtcacaggttaaga

SEQ ID NO: 3809 - DNA, 387 bp, Bacillus thuringiensis
gcttatgcgtggcgacgtagattaactcacaggactgcttgttatcaaggcgaaccatctggggaattattgaaagaggctggacagttgttatctaatacatatgtagcggcggatttcgccatcattcgcagcaggaggatcactatggtctaacgaatgggatcggagggctaccacaattttcgtgtaaagatatttagagctaacactgatattattatatacttatactcggatgatacagaaaatgaggatggtgggagtatatctgattgaaatgctgcatcctgactatatagcattactgttatgtaagtgagaggacatacatgagatgcatatagcataaatggactgttattcagaactttcaaaattcaacac

SEQ ID NO: 3810 - DNA, 454 bp, Bacillus thuringiensis
caatggctggatcgcgtttattcctgctagtttccattaaacattcaatgatggatactgcgattctgacaacatgctcttgagctagcgcctcctgttacgctgtctttcgatacatggagtggcccctcggcatacatttcattatcttaacttggcaagtattatgctgcgctgtatttgcttcaattccttcatctggtgacaatgttatacgcttcggacaccataagcggttcttctatcttattctttacaagattcacttaacgaactaaggtgaatcccacgtttcacgaggattgtagctaccgctgccttagctccatagacaccgttattaaccatctgatgaagctgcgatcgtgcctgaatctagaagaccgtattcgattaattgtacatcttaaattttactgacaaccattgagcaagcaacaacttcaataacatc

SEQ ID NO: 3811 - DNA, 121 bp, Bacillus thuringiensis
gatggaccggattatttttttggaagatccttacgagcaccaagagaagtgcctacagaacagctacagatatcagatgctccaacaaacccactcgtttaaaagggatttattgcaaaaa

SEQ ID NO: 3812 - DNA, 351 bp, Bacillus thuringiensis
ccgcaccaattgcccgctttgttccacagataaattgcgttttactgatccgctatacaccagaagggtgatgtgcattaataatcacacctgcgtcattactcgatgatacatcagaagcattttcttggattgatacaatcatacttgattcaggcgtatcagatgtaggcgctatttctccccacgatactataacaactggtcacgttaacgttgacatagcagatgctcatgtgtacactgcgcgaatgggccagctgactttataacctgtccttgtgcacgcaattttctattgatcacggtttatactgaaccaggaggtgacttcttactcgattcgactac

SEQ ID NO: 3813 - DNA, 531 bp, Bacillus thuringiensis
tcacactatccagaaatggctggacgttactggaatctattttagcataaaacaggtattatgcatgaatcatgtgtattattagaaaaatcaatgggaaatagtcctcatcatattgcacgtgctttaaagattaaaggcgattctaaccatataaaagggttgtataaagatcaacctttatcttcagtgcagaagaaagtagcagaggagttaatttatgagtataaagaaacatggaaagataagctagttcctttcggctgtctagcattgcttgcttccctcctcttttctgccgatgttggcctattcactatttggaattggattttttaatcacagggggaattttcacatgtcaaactacgctaaagaagaaaggctaacagggggaaacgtctcaagcgtatatcgttctgaaactactgttcggcgagagttaaagccaggcagcgaaaagattcataagctattgcaatatttagaaaacaaaagatttcattatgcttcaaagttttaggtgtcgat

SEQ ID NO: 3814 - DNA, 396 bp, Bacillus thuringiensis
atgacgctgatgtttttttataggatcttgcgctggcacgggagcatgcgattgaatgatgcacacaggcacagccactcgtacatgaggtatgtttggttaacgatgaggctcattcggtgttacagtagcaaaacatagctggtgcaaatcagacagtgttataacacttcaaccgatgatgagatttggagatgacccggcgcaatttctggaccttgcgggccaagtgtgttaaacggaaccgcctggccaaccttgcgactcttaatggatattctcgtgtaataggtgactcacgactgtgaacaggcgcttcaatcatgatctggcacattatgttacctagcggagatggataataggacgggtgttcagagctcatataaatgtgct

SEQ ID NO: 3815 - DNA, 255 bp, Bacillus thuringiensis
ttaaatctttatcgtgaagaacgaaataaatctcttggatatattgatggagcagcattggcagataccaatggtatacaagaggggctcgtacactagggggcagtacttagtctggatacgtgacaagtcatggatgtatcgtgtaaagcacctggcgaaacatctagtgtgattgttaatgcattgcagaaccaaaggacgtagtagcacatctgccaaaggtgaatgtgctttacacgctcgcgcgacata

SEQ ID NO: 3816 - DNA, 129 bp, Bacillus thuringiensis
gactttgttaattcctcgccagaaaaaaaacttagggggtccttttgcaaaataaggggccaaccccaaacagccacacaacaatgaaccggcccacatcatagcacaggctacaatgtaaaagcataa

SEQ ID NO: 3817 - DNA, 304 bp, Bacillus thuringiensis
gctttgatattgtccgaaaaacattcttaacggacgcgtgaggtagtatgataggggaggaactctccctacacttgactgcaaggatgcattacgtgctcagagagcacgatgagctggtatcggctaggcaggcaccagaatcgagctgttaacataatatggtaaacagcgagcgtattacacattcagcgacaaccaagcacttatgacgacatgcaccatctattttataacggcatgaaacttaacgtgattgtagaataaaactgtgggcttcaaccacaacactgactggacaaac

SEQ ID NO: 3818 - DNA, 167 bp, Bacillus thuringiensis
aattagatgaaccattattgtaaaacgacagaccaaatattcctggggagcatatactagtacgcggcgcgacctgcgagccgcgcagaaaggattcctgctcaacgtgccatatcatttgtgcataaacaggaaaaatatttactcataaccggtcttctcacgaa

SEQ ID NO: 3819 - DNA, 291 bp, Bacillus thuringiensis
acgtttttgttttacgcaatagtgattcaacagcgtgggatataagtttgtatgacgggtggcgctgttgagactacatcggatggagtcgacgcattcacattgtttgctgcgcgtgcggacgaagtatcaagctcttaactgaaacagtaactcgcatgtggcctagatacggatggtgcaagatcgactgaagtcatgcacctatgtgatcttcgtgaaacaagtgtcggaggttcggaagatccacatgatggtagcacagaatggggtgtttggcttgaacagtac

SEQ ID NO: 3820 - DNA, 119 bp, Bacillus thuringiensis
aaacattaatacttctctacacatattattttttcggggggatttaacaataatacgcggctctacccttgtaaccagttgatatgaatccggaacaactatctttccttttattttgt

SEQ ID NO: 3821 - DNA, 270 bp, Bacillus thuringiensis
gtcttacttaacacacccactgtgttcacggatggagcgctgtcgtctatcaagaacggcgaggttactcagacgctgtcttaatgaaccactgatcctgtggagatagacgatccacacgtgtgaaacgctcaaagcaccactctagctcgccgtcgtagctcccttgaacaatacggatgcatccgcactttattaatgtgcttgaagccgatcattctgtgaaagccacaaactcggcttatcgacagacagaacatgttagcagaa

SEQ ID NO: 3822 - DNA, 281 bp, Bacillus thuringiensis
atcattctgtttaccacgcgcttgtgacactaaggggggtaataatgctccatcaccggttgcgctgctaaagccattacggaaacagagctcgatctctttttgttagtctagccagacgttgaaccatcgaagtcttttctgatcaagtttctaacgcgttagattgtaacggaccgttcaacaaatacaaaagtaattgtattatttgattcacgggtcgtatctgactcggtttcgaaagaaccctaggatggacacatcaaagtggataatttgct

SEQ ID NO: 3823 - DNA, 174 bp, Bacillus thuringiensis
cgataacaatgtatggtgcctacaacgacaaaggaatactggggatgtatcaaggaaatcggccaatgcggtcaccatcagcctgaacaaattattcgggaacgttgagctgataagcgctgaatcggaacgaaaaggggctctcgacacttagaccttgcgggctgaagtcgc

SEQ ID NO: 3824 - DNA, 363 bp, Bacillus thuringiensis
gaacaacttatatgagtatataaccgaatatttaacgcgagacattgtgaataaggaggcgattgccataccctcatggatattacagccgtacaaagaacaacgcttggatgtatctctgaattacggcatgtgacacttgcgtatggagaccatgatgtgcgcccttatattgaacaacagcctaatgagacttatcgctaaggaacgaaggctataaaagatggtgacatgacacgacggatcttacggaacatgtagagaaggctttacctattgaagaggcgcgcaccgtgtgacaaccaacgctgcatttgtgatataaacagatgagcccgagcattaccgaagggaataaagcta

SEQ ID NO: 3825 - DNA, 413 bp, Bacillus thuringiensis
ttggacttttgctccatttacagacaaaggagtatgtcgttgacggaccagagaataaaaaatccgatctgactctgaatgggagcctaaaagggaccatgattgtaaggagagactaacacaaaccgaaccattctgctgttggaatggtcgaaccgagaaaccctagacgtttagcagccttaggcgtcagaataccatgtggattatatggataatacggaaacggacaacatgaatgttacatatggcagactcatttatcaaaggcatacaggaatactcattaaggttgcactggttaaacagaggtatagttccataatacgctggaggatctagatgcatccttttggacatgaggaagagctactatcgctaacctataatatagcgcgggggctgaatgatac

SEQ ID NO: 3826 - DNA, 242 bp, Bacillus thuringiensis
gaatatttttattgagtactgcaaaccaagtactggggagaaacatacacagagggctgtagattcattaacgctgaatatgctagaaccgtgctagaggctccatattcatgcccttaaacactaagaacctcgaatccttccttcatataacataaaagtggttatctcgtcactgatgatagtgcgtgctgtgttacacaatgccgggtggttatgaataatggggagacagtgtctcg

SEQ ID NO: 3827 - DNA, 426 bp, Bacillus thuringiensis
gaataactttattgtgtcattagatgcatatacagcgcttgatactgcagctagagaggtggatgctctaacagagaggctaccaccatggatattggagcactgtatgcatgaacttaataactcaggagcgctaaactctcctatatataaaatacgggtggttcactcatctatcatgagattacatgctatgtgaatcaataccggcagcttagaaataatgggaataaaaagtctattaggttccttaacatttaaaataggaattttggttgaagaggagcgggtagtaggatctacaaattgacgatacttacgcctacgattagggcctgcttttgaagctcgggattttacattgaataaggtatgaccactacgccattggaagcacagaaattcgatatcacagttagcgattca

SEQ ID NO: 3828 - DNA, 136 bp, Bacillus thuringiensis
cagattatgataaagaacccgagacaaaggaaacgggggaaggtggacaaaatatccgggcaatccctctagacgcataaagaagcaacccaagcagacgataccaaaagtagcggcagccaacaccggaaaagca

SEQ ID NO: 3829 - DNA, 171 bp, Bacillus thuringiensis
ttcagatgaccctttgttattaagcaccattaccgaaatgacctggggaacatttacagatggggctggatccatggaagacgcaaacgaaagttaacggctgagactataacaactttttctggtttaactgtgaaagacgatcgacaagtttaggtgcttttacaaaag

SEQ ID NO: 3830 - DNA, 165 bp, Bacillus thuringiensis
gactgggttgtatgtttgtctcgtagcaggtacagtgggggttctttctcaaggagctgcggatgcgcaaataacacagatatgctggatggggacatggcaaactggatttcgtggaatggaatgtgtcaagagttcgttataagtctcgtctttatgataaga

SEQ ID NO: 3831 - DNA, 408 bp, Bacillus thuringiensis
gaggctttttaccatgataaaacatcacctgtcaagccagcattgggagagatcatgttaactgagcctttaacaactgctattctatataacgacgcttgacaaactcaaattacacattttaccgatgttagatatactaaatatgcctaaccttgaagaatatcaacaaataactgttacatttgcttggtcagaacttgagaaacgaatgtgatcagaaattaatgctaccggcatacgcctataagaaaaactatgtttgcattgactattacaccgtgcattcaagagcgcgtggatatgcacaaggcatactgtgcatacttacatgcagcagatagtcttgcccacgtattaagctctatcttcccatagcctagtgagcgaattgacacgttaatttat

SEQ ID NO: 3832 - DNA, 565 bp, Bacillus thuringiensis
tcattgtgttatcatttgtgctctagaagtatacgaacctcatatggcgatcttaaagcaggaacctttgagtcttcggacagttgctctaacccttatgaaattggaggctgttcagcataaggatgtttccatattcatttaacaaattgcatagcaaatgaagctgcacaaccggcgcccatatgtgatcttgttttattccggtatttcacaattgtttgtaaacgcgcgaacaatacaaattgtcttatgtatatcatggaagatgatgggatcaattgcattcagtctgatatccatcgtcccggcatgattgccatcaataagccacttatcatcttcagttaagttatttggagctgctattggttgattctgttggaacacattgcgacagtcggttatcaaagtaatgcatcaggaggacgctccttaagtagtaacttattatctaactgtcttgctaatgtagattctgctgaaccagcgggaccaatgaaaagtatatgcttcatacctttacgagacgttccataacttctttaatagctaccttattagc

SEQ ID NO: 3833 - DNA, 386 bp, Bacillus thuringiensis
aattcgtgattgactcgctgttcgctgtcaactaaactaatgcttgccgttatcacggtaacctaacgggggggcgtttttatacagatggaggtctccgctcatgactctctgctaatatatctaaaaggtctccgaactcaaaacccttgaacaatataatgacatcaattacttcatacatctcaatacgccctttgatgaacacgaaccatagggtaacatgtgacctaatatcctgtagatacttactcataaaagcttgttattcatcatgtaacctacacggtttctatctcttccaactcacttgacctcatattgtcacacattctttaaactgatccagactgtgcgtacaaaattagtgcaaatttttcaccaat

SEQ ID NO: 3834 - DNA, 382 bp, Bacillus thuringiensis
tatcacaaaggtatgcccaacatggcattatatggaccgagaacaagagactgctgaccgggaggttatctatcaggaggagcacgtgtgggagctagatcaagactatgaaaaattggagaaaaagaagcgttctcttgatggggctaaccaggagaacgattgagaattatagcagcgatgcaggcagtcgttggacctcctgctaccctggtacacgcaacggcagataacgcttgtgctggaagacggcttagcttgtcgaaggctggacatggatcatatacatatcaggttaatacagagaaagaggatgcttagctagcgcatgcaatttcttcgtcgctagttccttccgacacaagaaagcaacatcctctac

SEQ ID NO: 3835 - DNA, 459 bp, Bacillus thuringiensis
gcgtcacattatagataggacaggtcgtcttaataatctctcacaaaggcaaaacgccggcgattttacaacccgggagctgatttgtctgaaggctcacctaacgaacttaaccagggtggctatacgaaactactgcacattgtgacgagatcacttgatccacatacgttatacgtcatatcactcacaccaacagtgatggaggaacaacgtaatggtagatgttggctcactactcatacaagctcgtgctttctaatcttgcacattttggatgaatttacgaccacttacatgatcaaatttacgacactgacaccaatccgatccagactgtgctaacaaattgcaagtcccatattcaccgtctactgtgacacacatggagatgaaacactgatctctcacataagctttactgccgacttatacctacggcgttctagcggattaaac

SEQ ID NO: 3836 - DNA, 428 bp, Bacillus thuringiensis
gataatagtttctgtatgctttgatgcatatcgagtattcgggggcgttagtaatttaaaggggaaaaaaaacctgcaatttactaagttgcaaggaagcagagtgtatgaaacatatatagtacggtacacgcactgggggcgaatccagtaaaaaaaaaggcattccatggaacatggccatcttaacagacgaattaaaacatcccatagaaaacgtatgccttcaagcaaaaaatgaatgatgaaaaatatacggtggtggcacaggcaccaagcatgtttatcattttcaggtcgaatttttatggggtgagaaataagttagtcatgactgcgatggtcgtcaagtgttacatcaacttgaagaaagctgaaaggacaaaggggacgggttcagacagctagagtcatacaattttgaagcg

SEQ ID NO: 3837 - DNA, 283 bp, Bacillus thuringiensis
taacttaaaaaaactgaacggcgtgcggggcataaaggagctgcattcccagactgaacataagactaccctaaagggcatattacatgtcagctctctgcctgttgacgcacccttgggtgcaaagatactattataatacagcgcatgttacgaatcacgataaggcaaaaactgtctggaactacgctcaccctccgttgacaacaaacctatatggaaccattaatgaatgcctggcgtacacttagcgtccgaaatgtcccttgcttcaggaaggaac

SEQ ID NO: 3838 - DNA, 398 bp, Bacillus thuringiensis
tgtacaccttttttttacgggaacagaaggaatactgcattgttgttaaaagcaacggttggccctagcccacgctagataatctggactaagtgcatctttgtcgccggtctcttcgctgggctcatgcgcttaaatggctctggtgttcgtaggcattggagtaattacggccactggcccatgtgatttgagcacatcttatgtaatgcacgttacttttatgcgctcattctgcatgcgagcttgaataaaggcgatcagtctcacgaatactacacgcaacccgtattgaagcacgcgagcctctggcagatgaaaaagcgactggtccattgcggttcacgataacatgatctaagggatgaccttgaccattaacaccaccaagatctgta

SEQ ID NO: 3839 - DNA, 416 bp, Bacillus thuringiensis
agacgttggtgaccatgtgagtcgacagacttttgcacagggcatcctgtaacattacgcggtaatgatcagggtgatgattcgtcacctccgtgtggcccagcagagagctatgtgatagccgttggttgcgcgtccccgcaatacgaaatgggtcgcaaatcaccctcgtggactgacggcgcttaatgatctcggatttgcggaaatgattattcacgttcgttgtccgcgaacccttgtatcgctgtcgtctaatccaacgcttactccgaacaggttgggatactgtgcgatttcacgggtgactgtgttatctacttcagtgtggaacacgccaacagctgttcacccatactccggcttgagtccagcgccttgatgaaactgaccttccgcagacgatacaagtactg

SEQ ID NO: 3840 - DNA, 212 bp, Bacillus thuringiensis
aggcattgttcgccataatgatcgacatggtttggaacggtgtaccaccgaatatgccggggtagttaccagtgcgcagatatgcgcctaccgagcgcgcagctcggatccactggaactcatcttcatattgcggcactctattcggaattgctagcatattaggcccttgcactgatggcccctcacgatattaaacatgctccaagcat

SEQ ID NO: 3841 - DNA, 235 bp, Bacillus thuringiensis
tggtgctgtttgccctaaaggtctagagggctttagatcaagatatagctgaagatgccgcggtagcggctagtgtgcagacatcagctcccgcagcaatgaactaagcaccactggcacacacctttgcagcctcacactctgatcgtaaccactagctaacgaatccgatgaacaggtggtgcccgacgatattaaatatgtaccaaggatcctctccgttcgccctcgacgg

SEQ ID NO: 3842 - DNA, 151 bp, Bacillus thuringiensis
atgaaactgtttttcaattcaaggaagataacgacacctggtacaataagagcattaaacggggcaacaccaatgggtcttactggtgaagcacgaacccaagtattcatagaagcaaattcaccactggataacgatacaccacttacac

SEQ ID NO: 3843 - DNA, 346 bp, Bacillus thuringiensis
aatgattagcgggatgcacatggggggaatgaacaatatccgcagtcgataacgagctgtcaacgagcagggtgcctgttaagcgcatattggggaacataagcgtgcccgaccgtgcggtggccataaggaattgcaccggcgcactatagcctggcttctccatgacgttacaccgcatgcatcaactcctgcgtccgcacgcatgcgacctctgcatatgctgccattcgcggcgagaagcttattgaggagacaggtgaaacccgccttccgttacaagacatacgtgcagctgacgcgccaacggcaaaggggatcatcagacttaaatgaatacccctgc

SEQ ID NO: 3844 - DNA, 172 bp, Bacillus thuringiensis
gaaggaacccattttttttgatcggggactcctgtaccacactgaaaggacactacagcctattgaagagtatcacgacctctatacccgatacctagcgcgtccgcggcatgcgcggaacctagcaagccatatagagcgtctgatgatagcttggcaaaaacaaggccat

SEQ ID NO: 3845 - DNA, 273 bp, Bacillus thuringiensis
  unsure (1)...(273): unsure at all n locations
gcnnnnngatagggtacaacggaattaatgattggaatattattacaatatatatgaacggatactcaagcatctgaatcaacagacgagctaatcgagcctatgtatgcattagaacacacgtgtggtgctccaagcttaacgtcattgacttctataatgtcacctaagacgccatacaggtcaatgaccattattttacaacttggtaactgagaaaacgctggcgcaacacaacttactgtgctagctacacatacgcctgtagccagc

SEQ ID NO: 3846 - DNA, 262 bp, Bacillus thuringiensis
gctgagcggagcgtgtttttattttcacggatcgctaaataaccaaggagcggtgggaatgctatatgcaaacaaccatctcatattcctttgagcactgtatgtgctcgcatcatcaattggaagcccccattcataggaagcttatagttgcattcccaccggattgtgacagggggtataggcacacaaggatgaactttactgacgtacgctatgaggtatgcgatacttgcgggcgctgtgattcttctatcatcta

SEQ ID NO: 3847 - DNA, 142 bp, Bacillus thuringiensis
gtgatcattgaacgtcaaggttggcggtcctaggctaactattttttaaaccccgggctgccagagctcgcggccgttgttttttatagcaggacctaataggccatcacaggacagtggccgatagccatacacacgatta

SEQ ID NO: 3848 - DNA, 319 bp, Bacillus thuringiensis
gaaagaacaggggtgatatccgtaggaattatcggacctgttacttgtagtagaggagatgtagcaacaagcggatgaggatgggtatgtgagacaagaccatttttgggtgcacgatcaattggagaggcaaagcaccgctcgatactacaggcgtgggtgatatgtctattggaattggtttacaatcgagtgcactagatggcggatcatttctatggccgatgattggcatctttaacattgcgcaaggcggggcgggactcgcgatgttctggatgcataacgatccacatgctcaaggtggggtaataacata

SEQ ID NO: 3849 - DNA, 221 bp, Bacillus thuringiensis
ttgaggtgcactcatgaataaaatgatctgtatggtagttcgcctaagttcttataaaacgcgttaccacaaccactgctgaggcgtagtccataagtatattttccaagcattttaaatgagtcatttgtgagtgcggactttctttatacatggtctcataagaaaatgtataatgcttacattcatgcatcatataatgtgcgacacactttttcatt

SEQ ID NO: 3850 - DNA, 206 bp, Bacillus thuringiensis
gggtcactacaaaaataggatagatcatattcatatacactcccacgatcacaagatggggcatttaccaagcccgggcgcaaatcgtctaaagacggagcaaaggaatttgaacggaccggctatccagaactcttccatcttgtgacgacagcacgcgatccacttactcgagacgcgatctcattcacaccaaacgcgatcgg

SEQ ID NO: 3851 - DNA, 195 bp, Bacillus thuringiensis
acatggttcctgcgaatccagtgattgtttttttaaagatgcgtttctaggcaagatgcggcataaagcgcggcctcgcgttaaatcactccagacgacgcattggctgcattggtcatcacgagtggcgctctgtgcataggcgtggcaaccgatggcgagcctcttggtctgaacgctgttgaataggacacg

SEQ ID NO: 3852 - DNA, 293 bp, Bacillus thuringiensis
agaatccgagatcaccgatttgacaaacccatataaacttggctggttacgcaggcattgatggctctgtgggggaatctggacaatctgaagccacaggcacaaatatttacaaacgcggatattctcaatcgtgtagagtctgatcccaagaggttatgacagtgtaaagccatgaccgtgtattaaaagctaaatgtgagaagacacgaaagcagggaacgcactactgatgttagcataggggctagtagttagaaacgtatgcgtggcaattaaatatgaccttattt

SEQ ID NO: 3853 - DNA, 232 bp, Bacillus thuringiensis
atttaccttgtaactcttctattactctatgttaaacgtgtatactctagatcttcatgttgatgacgataccactctaatgcactttattatgcgaggtgatgaaacaaccgcatggcataccgaggatgaaacagaacgatatctgctataacgctgaaataacgaacccatcttctatccgctatactgatgctcaaatcatgcatagtcttccttacatatattttcc

SEQ ID NO: 3854 - DNA, 315 bp, Bacillus thuringiensis
cgcaatacgataacgcggctaatgtatggaatttcgcctttgtatttaatactttcttcttcattggggagaatagaataatcctgtcatatacgctagacctaccgaggtctacagagctttggttgaacttttgccacagcgtcggagtatgatataaacactcctttcacgaagtcatacatattccaacaggcaggacctattaagcgagagatgaactcatctcatatgacattctctattctatgtttccatataaataggggattaccggctcaagatcatataaggtgcattatccggtgattcaca

SEQ ID NO: 3855 - DNA, 222 bp, Bacillus thuringiensis
ggcaatcggaggttgacattttgtatagatcgtatgggacttaacaagggctggggacaactctgtattcggacaagctggttctaaaagtggatgctccgagcgtttttaagtagctgtttgcgagtcgtgaatggtctgtcacacgtaagcttgtggaaatttgttaattatttcgttttttgttttgttttttagttatttataattttatttgttttt

SEQ ID NO: 3856 - DNA, 266 bp, Bacillus thuringiensis
ttcatgcagccattacacctatccattatcaaattgaactcgggcttttggctaccgtccgtaacacgtttgctgcgtgcttgggaccaaccgatagttttagcgaggacatttcgaactcgttgggaagctggctctatatgtataactgcgacggaactaggagacggtacacacattgcctacctcatactgagcagacagcatgaagggtgaagcctggcgtgtcatacgagtgagcggactcatattaactgtgtgaggct

SEQ ID NO: 3857 - DNA, 339 bp, Bacillus thuringiensis
aatcgatgttttttttgcctttattgcatggatagtcgctcgttgtattatgaaagtgcttgccctttctcatgctacagaatcatgcatatgcgcgcctctgatgacgggcttatctttgggatcatacattgaagtggtggtacttgctgcccatctactagcggatgcagccgctacggctgttcatcaaacacagtgtacgcacgacgcggcacatataatcgctcacagaattgcttatgcactattcggcccagtctccttcgaatgtatcctaatggaaactacatttgaagggataaggcgccagcttggtatcattgtgacgattactct

SEQ ID NO: 3858 - DNA, 349 bp, Bacillus thuringiensis
gctctgcgctagaggcgcttgtacgcatttacagatacaggtttttccgcaaggaaaattgcaggcgtaccgtgggcgaatggagcaacaaaatggatttaacggcaagacctagaagagtacaggatacggaactggctatcgacccagaagagaaagaagtatattgaaaaggtctctacttttcattcacgaaactacactgataagatacaccattaggccctggatagatataaacagggtgagacatgcttaaagactgaacctcttaaaaagcatgatactacaggatggtttgttttgtggatgacatcccaacttacagttacgctatctttactgtagc

SEQ ID NO: 3859 - DNA, 229 bp, Bacillus thuringiensis
accgagttggctccaactagcaccagccactacgggggggcaatgtggtattcccacacctaaggtggggaaacacgacaagtcaccagctacgcgaactccgtcaattatctatgatggctgagcacgatgatgcttatagcgatatgaagagcgggtgcgagcaccaaaattatctttaatattacttgcgagtaaattactgataaacaagcctggctaggattac

SEQ ID NO: 3860 - DNA, 409 bp, Bacillus thuringiensis
gataagttcgcacttgacctatggcgttggtatgtcgggccgcgaaccacgctccttgcgggggtcactctttcgaaaccactgtccaaaccaaagtggttctggaagcagcattgttacgcgcagttgacctacgactaccgtgatggctattgccgttcttgactaatggcgccgctgttgagattacatgatgatgctcacgcatagcggcccctgacattcaccgcgaccatcaggcgatgggccaagcactggatataacaacgcgaaaataaccgaaaatctcgtagctagaacagcaacccctgcagccccaactgccgcttgattagcaattgctaccactagctgtgcacttgccacgaccgataccgccccgcatatcgctgtaccacatgcggataaa

SEQ ID NO: 3861 - DNA, 340 bp, Bacillus thuringiensis
attcgcgatgttagaaacactatcgtatttggacaatggtttgtaaatgcataatctgacagacactacattgatcaattataattaaacctgcacaaaaagatgacattgaaatattaacatcacatagcttcttttaaatatgtaactaaccaagcacatttctaaatttcttggctggctcatcatcttgatacacaccaccttcaacactggtaaccaaaggtaaccactgacaactttatcatactacaaaatctacccttgaccaattctgaatgaaatccatgaaataattcggcttatgatacccatgcacctcttcattgttgtagctcac

SEQ ID NO: 3862 - DNA, 361 bp, Bacillus thuringiensis
catgatataatctcccatcgcccggggagaggcggggggtttcttgagcgacggttgcggtgccaaacatacatgacttatcagagactggatgagcttatgcacgggcttaccgaggggtgctttatcaatcggctgggcatccactacgtacacaacgattggtatatattttggaagactatccgactataccgactccatatggcctgagacctcctagaaggccgcgttgatggcgctagtcagctggcatgcgcgactgacctggaaagcacaattggacgatcaggtgaaaagcagatagacccgacaggactttaacgaaaccgggcataatcctctggaagcatattcccgc

SEQ ID NO: 3863 - DNA, 382 bp, Bacillus thuringiensis
gataatttttttttcatgctttggtgcatatgaccgatccggagcgattactttcctaaagggcacaaataaactgtagcgtactaagttgacgggcagtggtgcgtctaaaatatattcagaacgtaacgcgcctaggctgagagtacctagctaagcacttcatgcgatttaatatgtccatcttatcagatgaagggaaacagcgcgccgagagagtaagcctcgacgtacttgatgaaatgagagaaatctccgttgatgtgaccgggaccatgtatgttaatcatattcatgtcagctttttacggcttgactaatgaaatagtcatgacgagattggccgtcagctgtcactgaaaaacgtctacaatgcgcttga

SEQ ID NO: 3864 - DNA, 388 bp, Bacillus thuringiensis
cctgcgctcgaggcgcgtggccacaaattcagatcaaagagtataagaaggaaacgaattgactacaacgggggcatgtatatgcgaccgaccggtaataatgggtgacgacgagagggcgagtgaaaatgagcaaccaggctaggggcctatctatacgaaaaacaaggattggcagtattaccaatcgacagactatgaagaggctcactgactatgcaaggaggactgtatttcaggggggcagggaagtgaagaagaacccgccgtgctacaatgaaattattgaggcgtcagtcatagagatgcgcgagattgcatgccacaaaagactgatgtataaaatctcgaagcatgctggggtggcaggtggcacgatcattttata

SEQ ID NO: 3865 - DNA, 119 bp, Bacillus thuringiensis
cctttatttttcgaagaatatacgacagaagaaattagtgcttttattgagcccactatatgtttaaaaatagaatatagcatcgagtccttatatgacaatggcaccatatatatatg

SEQ ID NO: 3866 - DNA, 360 bp, Bacillus thuringiensis
acattgtttttatacatggtatacgctgcttacgatattgatgctttgttaactacaatatattaacagtagataggatactgttaacgagaggacaacgggtcgtaggaatacgtcatattggctatttagaagtagcaccaaatggaaacgcactaactccgtagacagactgtactgagattctggatggttactctatgagacatcatattcacagcagtggggtctttttactgttcaatgaactatcatgaaagacagatgtagacacatactcatatgtaagggacatgcacgggtggtaatatatggagagacagagacgctatagcactgctagatgctcttgcagaaaga

SEQ ID NO: 3867 - DNA, 240 bp, Bacillus thuringiensis
tcgcgatagtagaaacaattacatgtttggacagtggtttttaaatgcattatctgagagacactaccttaattagttataccaaaattgcacaaaatgagaattgatatataagagatttctcttgaccatattcacccacaagctatctcttattcatttgtcggcaatacaatcacggattcacgaccacatctctaacactggttagatagacaagcgcatacacacctgctcaat

SEQ ID NO: 3868 - DNA, 237 bp, Bacillus thuringiensis
ccctgaaaaaatataaggatagggaggatgatgcgaaagagttcgttcgccacatccataaaaacgaacaatccttttagtcacgagcgcgcgtgacgacgacaccgttgtgttgaaaaaggcactggcaacgtgttaatcgcaacggaaaacgcatcgttattatctccagcacgagcttgtaaaagataaaccggaaacagacaccactactattagcgtacttgcataaccacc

SEQ ID NO: 3869 - DNA, 358 bp, Bacillus thuringiensis
cattatgtaatatgtcaactcccgcggtgcggatgatggttattattgcgctcacacggtgactccttacatacgcgttgtgcttagtatcgaaagagtgctgtgatgcggataacggtagtcgaaggcggttgtgcagccatacacatgctaaggggatatcgcactacaaaagcttttatcgacatggctgctgaaggcctggtgcctccaccaggtgcacccgctggtgaatatatataggctacactctttagacgagcaattcacacttctatgtttaacacagatgcagctgttcccgtcaggaatataattaaacggggcataatactctgggagcatattccgcgctgtg

SEQ ID NO: 3870 - DNA, 431 bp, Bacillus thuringiensis
cccttgcagtgatatcttgtgctgtaacaatttccattcccgattcggagataaccgaacgagaccctttatgatttgggacatttgtaatgacccttttaaaattgccgggcgcttactcttaagcaattcccacatccagttacgcatttacaaataaactcattctggacatcccgcgcccatacttggtcgtgttatatcctacaagtaaacatgtctgttcaacgcactaacaacaccaaatggtccctgaatatcaaggaagattagtgtatcagccgcatgcaggctgtactgcatcgtccggccttactaccacgcaataatccactactcatctctcattaggtctttgcaaaccggtatgcgcacttctatcggagcaccttgccaaaccggctaacaatgcaatgcatacagatgatgca

SEQ ID NO: 3871 - DNA, 489 bp, Bacillus thuringiensis
gcgaatagtgagttgagaccggtgagaggactattaaacagacacgtgctgcaggtgtagctaaaagaagcgacggtaagtcaggaaagagtcgacccacctactgcacaactcgctcatatcctgcgacgcgactgacccggatatcatccaaaagcgcgcatggcgacgacaggcattccgcgactagtaaagcgcggcagccgagcagcaacgtcataccaatgagagttggtctcactcattaggcgccacaaggacagtacacaacttaagccaacacgctgccctttgagatgtaggctctaatttaaaccacaacaggaggggctgcgcagctcgcaggcgctgttttctacagcgtgaagtaaaaggacgctgaaaccaatggacgctaatgtacaaacttgcgaccgcgaaaacgttgccgatacccgaggtgctcgcgttgcaggacatccgtctaacgctaggcgacgcaatatatgc

SEQ ID NO: 3872 - DNA, 420 bp, Bacillus thuringiensis
tgaacatgctattgtgacaggataaggtattttgtattcgatacctgaacaagcaacttgtgaggttacctatgcggcttctaaaactgattcaataaacgatttgacgcatgtctatgaaatatgcacgttaggtctctcgagtacgtctcgggggagaggacattccataaggctcacagctattatattaatacatgcattagaagcaaaagcttaatggcacattgctgcagtaacaaaacgaatgtgtatgatgttacttacactcggttttccaattgagcctatcgatcatccatttcagtgtattgatactacacaaggtgttccaaacagactggatgctggaatagggcgtacgcattgggatgatctaaacgaatttctagatgaggttcagggtaatgctcatgctca

SEQ ID NO: 3873 - DNA, 383 bp, Bacillus thuringiensis
tggggaagctggaactggaggggtacgtgttataattggtgcagaatgtggagcaggtgtcgatgtgactggaatgaaacgtgctatggcatcgccaagtagatggggagcaggttcttgaaaagatggcgcgttgtattgaaggggtacacacttcgtaagcgctggaagagctcttgagagagcagttgacgttagacgaaaagtcaggaccctgtgaggccgagcgaacacttaccacgggcgtaaaatccattgcttgatacgatcaaactgctggaagggaggtcgagacggaagtatgcgtaccaactggttagagatacatctggccatccgctgtcatcatgaagtacatctataggaatacggccaggcatttg

SEQ ID NO: 3874 - DNA, 156 bp, Bacillus thuringiensis
taatacaatttttctttagaggaactggaaaaagagaccgggggcatggataaggatgcacgcagtcacgcacagttatatagatgggcagcaagaggcccggatccgaatacagtccgcccagctgacttactggcataggctcagacctccgga

SEQ ID NO: 3875 - DNA, 334 bp, Bacillus thuringiensis
agatgcagcttttattacattgactgaaggcttatttgataggagtgcgaaatgagttcatgcgagatcgcttattatatgataatgggtgtatggatatacaacagctgtaatactcatgtgatcactcatgaacgtgtttatagtgtttgtaggccaggcaccaactcatgcaggacagaaacatgtgcgagtacgattcatggacggcacaatcagattgaggcaatctttctggtaacgtataactgaagaaggtcacgatgatgttggaatacactgatttcagagcacaccatggatagattaatcgcgatatcaagtgctaacgaat

SEQ ID NO: 3876 - DNA, 238 bp, Bacillus thuringiensis
tggacctgtgctgtctaattgtcatgcgggtttgtattggtgtccattcgatgatacgttggtagttactaacgcgcctatttaagcttactgagcgcgctgatcgcatcatctggaacggatctgcacattgagacactctgttgcgactagctggccagatcatgccattaactgcgcacccaggactatattaaacatactccatgcatgcggttacttgaaaagctaaggccga

SEQ ID NO: 3877 - DNA, 302 bp, Bacillus thuringiensis
cagcagggcatttggatttcgcaacaccgattgtcgcccttcgcgaaacgagacttagggggggattcttaggatgtgtacgggcgatccaaagagctggcgctatgcttgtgaacacagcactatgcgtagaagatacaggaaggatatgcagtacgccgcgtttgaagagaaacagctatacctgaagcattaccgctatactgagtcgctgtgcaacgtgtagccaacaaatacacaaaccatccatgaaggatcgatggtaccataactgcggtgcacaggaagcgtagggacgaacg

SEQ ID NO: 3878 - DNA, 250 bp, Bacillus thuringiensis
tttatgcttttgtctcgcctgttgtgcggaagtgtgaatggggggctttattacacttcatggggcgccccactaaacgagcaggtggatggtaggcttccgtaccgggccaacgaatgcccttacggtttgccatacaacactccgattcacaaaggaacgagtattaaaaataagtccagcccgccaaatgcaatgcgctcattgatagccaactaaatgatatatcggacaattacgatctagcttg

SEQ ID NO: 3879 - DNA, 299 bp, Bacillus thuringiensis
cacaagggttatgattacgataatacaagaaaagagggaggtgacagaaaaacgactgtacgtttaccaacggtaaataaaacccattgtcactggaaacgatgattatatgagtttgatccaataaccagcggaattaattcattatatgaggaggatctacgtgtacagaacatggtgacccaaaggaaaaggcctaataggagacttgaagagcgttggattggcatttaacatactgacttggaggatagcaccaagcgcataggcagcgcacgcaggttgaggtatctagtgcc

SEQ ID NO: 3880 - DNA, 321 bp, Bacillus thuringiensis
tgttggattaagtttaagaaaagtattccagggatcaacatagctactgtgaaatagtgtggtatttaaaggattatgcggtatggaaccaaatacacagtaagacgtctctgatccagatgactatgaatagcactaacttcggtgaagaggcaatggacggactactagactgatggagcgaggactgggatgacagccgggctataagtcgatatgaaaggacaagtacatgtatgatagtgcaattgcgcccttatggtttacttacaaaagcggtagcacgagttaataataaagcaaaaatacctttatgaaata

SEQ ID NO: 3881 - DNA, 339 bp, Bacillus thuringiensis
gtgccaacatttcgagcgaggccttcaagcatgttgcgcgggtaatcatgcacaaggaggtgcataactccattacttactcggccttaagagtaactatgttatgtcgatgtctagtaccctaggcacgaagcgtgagggctgactagaatggactatcggcatcgcgtacgtggagtttacagcatgggcgaagacctcccggagacgcaaaggtaacgcgagaccaaattatgagggataccgggctaacatgcttacatccctagcatgacgtacaggtattggcatggcacagcacataatgataaggcatccacgatgttatgaccgatggag

SEQ ID NO: 3882 - DNA, 159 bp, Bacillus thuringiensis
taccaaaatgtgttttgtcaacagcataagccattacctatggggtgaatagtaaagcatagacgcgcttaccaaccgaaagaaatcacgctcgaagacgttttgacccacacattctaattgtagcaatccgcaccactgcaatcttagtgtctagct

SEQ ID NO: 3883 - DNA, 116 bp, Bacillus thuringiensis
tgatactgttgtttttggttctgtggggctccatatggatgttggtgatattggcgtgctggattttgtggtgcttcatatggattgcgtggatattcgtgaccttggttttagtg

SEQ ID NO: 3884 - DNA, 413 bp, Bacillus thuringiensis
ggtccgtcattcgtcatcgcataagcgctttttttctttttacggaatgcctgtgttttgagcgttgactaacacggttttattttttgcctcctaaaatgggctctgccaagagatgtagaagtttttgctcatttacgttctcgaagtataatgcgagcattgtggagtatatctaactacgttcaacgaacgcccagatagaatcagctccatcgacaccatcatgattgtcgatgctctgcatttgtattctgctgtgctacagataattctcgtgcctttgagaagcaagatccaactttcgcatgttcttatccaattgacgcaattttttcttcaagatcggaaatggaacatacaatcgtttcccattcacgctgctcataatatgaatgttaacgtttacgttg

SEQ ID NO: 3885 - DNA, 140 bp, Bacillus thuringiensis
tgctcaaaccgatttttatctgacggatgagcacatccaaactcacggggggcttttttaacctacaccaggggttgaatcaccccaagcttcaccagcgtatacgattgtagtaactaactctgctatgaacatatcac

SEQ ID NO: 3886 - DNA, 142 bp, Bacillus thuringiensis
ttcgtgatgttcttgatttccatttaatacacgaacttttttttttatcacaatgcaatgccttaacggtgtgatcaaaaagaagaaggggacgcatttccataatcttttttagcaacaactcgttacagactcttcatcg

SEQ ID NO: 3887 - DNA, 366 bp, Bacillus thuringiensis
aaattacaatgcaaaagtaaacccaacattttttcaggggggcaggggtatcttacatcataggggagtcactacaagatgcgctctttacttattagttcaatcttgtcatgctgcatcctgcacatcctctgtccaaataccatcatccgattggaggccgaatcctgggatttgaatttattcactgggcttcaagccatcttgatagcattttagcatatccagcatttgatcctgcgggaagtgtgctttcacgagctgttgaagggcgtggaacaccaaggcttagcttggttaagaatagaaggatgcaccttttttattaacagcttgcattaccagccgtttgactcatctgaagac

SEQ ID NO: 3888 - DNA, 436 bp, Bacillus thuringiensis
aggctcagcgttaatacctactgtgccctcgtgcattccatttatgaagcgtgtagacttcagtgtaccgtgtggtgctaaatctatatcgcgatgtttcttcagatctaagtgtaactgatatgcgacctcatacgatatgcatctgtaaaagcccatcgggctatgaagtcatgagtagcataccttctggtgtcaatggtacagaacgcattttgaccgctaggatatgaggagcgttcatttggactcggcttcgagattaagttcgtggacgagctcatttgctgcaacccatccttgctgtcctaaatcaagacgatcgactcgcatctgcagaggtctctgctatgtcatgtgcaacttcaatagatattccacgagttgactggaaagggctatcatagacagtatcggactgtggaggttatgactg

SEQ ID NO: 3889 - DNA, 270 bp, Bacillus thuringiensis
atgatggatcgcgtacgaaaatatggatcgaaacgggcgaggttgctgaagtatatgcgctactgacgaacagagatgcatacgtaattgtataaccggcatctgcaaaagcacggattgaattattagatgacttttcggaagcgttatctacacagtgtagcgattatcgagatgagactgatcgtgaatcgggcgggtcatacagatctacaacaaaactttattggggccgtgacttgctcgagaaagtataatgcggacgaggtg

SEQ ID NO: 3890 - DNA, 324 bp, Bacillus thuringiensis
aacctactgttaagagcaaatggatgactcacggggcatttgtgcgagacctacacatagaccactgctagttatggaagattcatgtggtgagtttatttgtaaatcgggtgagtcatactgggattaaagaaaagctcttatgtgtaaggcaaattagtctatatagactcttaatgaggctttgtagacttattttctatgcctggacacaaagcatataggataaatagtctacataagaaagtaggtttacattttgcagttgaaagagaaatctttgtaaagaaataggctggggtaacgcaatgtaacagctaaaaa

SEQ ID NO: 3891 - DNA, 321 bp, Bacillus thuringiensis
gcgagacgagtactggtcaatccctgtcccacaggtgatacacgtacttctaatactaggggacccacgtagcgcaatccatcgtaattcagcgcccggcatgtggcaggcattacacgaatccctcttcaggtcattttcggcgtgctctcgcagtgcattattgggcggcagtaggtaaagccgccctcttcaatccgaggcaagtcggtttaaaccaaggcgctggaagaccgctctgcacaatgactgctaaatacgggccaacggcaaaaccaatgccgaagaataccccgattctggtcacgggtcgccctatct

SEQ ID NO: 3892 - DNA, 150 bp, Bacillus thuringiensis
catcgaaggtcatgggcgtgccatcgctttagacgcctgttcttttatacagatggggcaagaccaagctagtgaggcattactgtacggagcaaattgcggccgctacagccaatgccttaccttgatagggggcaacatgacgtcatt

SEQ ID NO: 3893 - DNA, 483 bp, Bacillus thuringiensis
gcgtcggggacccagaacgcgagatcaacacagggtctatccctactgcgcccttgtgtcatccatttacaaattgcgacatattcatttgtgcgaggggttctaaacgtgtatcgaggtccttctcactagataagtctaacttaaatgcgacctccccgatatgcagctgtacaaaaccgtcggtaggagaagccacgacttggataccttgagcgcgtgacgggctattacccattactgaccgcatcgcgtggatgaccgcgtacgtgtcagctcgcgccatgaccttaccctatatcatgccctcaacgagctctactactgatgcccgccgcctgcctcatcaaatagatcgactactgccggctccgaatgacttagcactgtcggatgcagcttcggcacagtccctacgagttgccaggtaaatgtactgacagacagtattagatctggaaatgaatgccactacatatgtat

SEQ ID NO: 3894 - DNA, 262 bp, Bacillus thuringiensis
gtattgcaattgctacgatcggtgcatataacagaccgttttcatcaaggacattaagctcggtaccagaagtgagtgaatataggactagacggtctgctagtactcagagatcgtactaacagcattctcacaactgtaaaaacgattgataagcttcttgaggaaaatgacacaccaccgctgttttgataattgtaccactatggccttgtaagaggttaaatgctattgctagaggatatttgaagtgtgacgtgag

SEQ ID NO: 3895 - DNA, 126 bp, Bacillus thuringiensis
tggttgtcactgccatttcttctcagtctgtccagttccactggatcctcatgctttcaccagctcttgccgcagagcctatggcagcaagactgatatctctggaaatgtgttgtggtgtcaaga

SEQ ID NO: 3896 - DNA, 134 bp, Bacillus thuringiensis
ttctatccacatgatctaatctatgaagatttaagaaaaggaaaatataaagcagagaatgggttgagttgttagaaggagagaaataacgaagcagtctaatcggcttgctctcttatgtaaaaaaccttgaa

SEQ ID NO: 3897 - DNA, 420 bp, Bacillus thuringiensis
aattcgtgattctcctaattcatgtacatatggatttctattacatatcgctactgatctatgaagtagatttaaaaaagtggaggcgctccaacctttcctacaccacaaaaaaaagcggaacccctatgagatagacaaggtaaaccgatataatacaaaccttacactggaccaaatacaccaataataataggaaatactccctcatacactgtcagggcaatagcaatccaattataaatgtgaacaaaaccaggttaccataaagcaaacgactccttaattcttatcttcccagtagtttagctgcctgtacccagtcgatatattttctttgatgaacagaccaattcagcaaccttttttcccaattataaggtgctgaaattttgtacaattcgttcattcctaccaaaa

SEQ ID NO: 3898 - DNA, 207 bp, Bacillus thuringiensis
tgttatcccaaaacatgtaaactaacgcttgagggggttttttgaagctgggtcagaaaaatagctcggaaaacataacgtttcacgagctttttattattattgcacttgctctagaccatttgcagtaatcttaaaggaaattctcgtaaactttttctaatctactgtttccactaacttaactcttttttataccaactttaa

SEQ ID NO: 3899 - DNA, 898 bp, Bacillus thuringiensis
  unsure (1)...(898): unsure at all n locations
agataatacttcattcttatttcacaaggctagtaaatggaaatatttaaaaacgtaaaagaggaaccccctcttctcgccttctttgtgttctacttgccctccttttcctttgcttttttttcttccccctcttgtccatttcgttcactctcctttttctcttctttttgattccctccactctctcctacaggcttcctttctcctcctttctctctttcttcctccctttccccccccttctttcctcacttctctcccttttcatcttttcttttttctccttctttcttctttccctcttctattctctcctttctttctcttctatctccttcttccctcctctccctttccctctccctctttttcttcttctttccgctcccttccctcctccctcctccctctttcttcctcctcctctttccctttcttttctcccccctccccttcttttctcttcttctttcttccgtctcttttccttctcttttctcctgcttctctcttcctctcttcctttccctcctctttctctttcttatccctcttcatccctcctttcctcctccctcttcttccttctctctctttctccccctctctctctctttctccctcttcccttctctcccctctcctcccctttctccttcctcttncatttcctttcctcctttctctctttctttcctttcctcttcttctccccctccttctcttacttctcctttctctctcccttcttctcttctcctcctctcctctctctccgccttccgttcttctcttctcctctctctttttctttcccctctccttctctcttcctctctcttttctctacctccttacttcgctctcttctctattttctctctttccctcttct

SEQ ID NO: 3900 - DNA, 249 bp, Bacillus thuringiensis
tattgtaaatgaaatagaggggggggctgaaccagctatgcgaggtaatcaagttattctaacgacagaaaaagaccacgggcggaactgcgcagttggcatgtaccaacttgccatgcgagctccaaaaaaagatgcaatgagtcattacatgtcctgcaccaacaacacccaatcggtcatgggatcagtatactaactaaactgtcgaagcaagtttaccaaaaaaaagggtgtcaaaaaaaaatg

SEQ ID NO: 3901 - DNA, 554 bp, Bacillus thuringiensis
gaaaataaaatttcacatattatcaaattcccataaggagtacaaactgtccctgagtgatacttgataatatgcaaagaaaatatagtgttaaattgaccttaattactatcttacaacaaatggtgggaaatagcaagtgctggtaataccactgagtaatctgggtgataatagtaaaggcacaaaggcacctcttttatttatatattattcctaattgggatttatgcaaaatcatgtaagaaaaacttagagtaaatattaataatatatttttcgtggtaaaatatgggtggttactgttggtagttaaatattataaaaggagaaaagaaagtgaaaaataattcatttataataattgaagcagcaaaagcagggagaaaaaaggtccaatcagtctttgctgtaatattagccattatattttttgactttaggcgaactctttatggaattgatgtaatttttacccgaagctggaacgatatttatgaaagggatttatgacaatgttagaatggggttaccgtttggcggagcttatttat

SEQ ID NO: 3902 - DNA, 216 bp, Bacillus thuringiensis
ttgatgttttattgcgttggacataatcgtacgcgggaggtttttatataaaagagggggtttagagtctgttgggagtacagatggacttagcaaatttcaaaagagaaggggcaagtgaatgaatcaaattcatactgatttagttaaaagattgataggggaacaatttcctaaatgggcacatctagaagtgcaacctgtaaagtttactgg

SEQ ID NO: 3903 - DNA, 363 bp, Bacillus thuringiensis
ttgatgaggccctgagagcaccgtgcaccagacatctttataaaaaagagagatgaccaccaacgatgcggataaaaaaggagcagcgcgaaatcgacaagtaacaccattacccgttttcaacagaacgcgcaatgtactacaagacggctaattgaaatggctgagatgccacaaaaagtgggaaaaaaaacatctcggaagttgcctgcttttacccatacaaagcccataacaacggccacccagtatatctttgaaaccatctataaaggtaactaaatgcgtaactgaaaaaagcagcgctgagaaaaaattaggaagaccgactactatggaacaaaacattcccggaagagccac

SEQ ID NO: 3904 - DNA, 150 bp, Bacillus thuringiensis
ccttaagagcaaaaagtaaggtttcccgtagtgaaagaaattctgcctcaagactgcagcctcaactcctgcctgagtttccagtcagccagccagcctaaagatttgctaggcattataatcacatcagctaatttcttaaaataaacc

SEQ ID NO: 3905 - DNA, 414 bp, Bacillus thuringiensis
tttgaaaatctagtatttaaaatataacttattatatatattatgaattctatattagagggtggcggaacgcatattggggctagatttcaaaaatagataaagagtctattcgatatatgatagttttctataaattcctaattaattgttgctatgaactctacatatcttattttgacaatgttgctttcaacgagatgataaaacgattactctttttactaaaaaatatactgcacgcacgtaatgggcaattcgtaggaagttgctatcgcacgccattctatagtacatgctcctgttaaccaccatggctgaacacatcactatccacgatcaatattgattggtttgcatttacatttaatgtatctaatacatgaagacttccttatgggtcaggttttggct

SEQ ID NO: 3906 - DNA, 290 bp, Bacillus thuringiensis
cacaccatgggataagcggctattcttatgacaaacgatcattttaaactaggacacttaaagtacggctacgtgcacaaattctaaaactccactggcggtggacaatcgtatgctgtatttaccaattactttgccttggaatactggaagcgtggtataaccggctcctactgaagcgacctgcgaactgcgcaaaatgctgaaacattccgcggtaaaattacgcatgacggacatgtatatgaagactgaactgtgctagccatggaaggaaagggtgaatatct

SEQ ID NO: 3907 - DNA, 104 bp, Bacillus thuringiensis
ctcatactttcgtttcaaatattgagcattattagggtattcgctatgagcggtacatatttgatgtttagaaaataaccataggggttcggcacatttcccga

SEQ ID NO: 3908 - DNA, 102 bp, Bacillus thuringiensis
tgggtgacattttgatcgagaagtaactctgtaattgattctggttggaaacgctatgacatctgcacactaggagagaccttcactctctatttgtcgatc

SEQ ID NO: 3909 - DNA, 176 bp, Bacillus thuringiensis
acatcttttgaagggcgatcatcagtctattataaatacacctaaacccatagagtatctatcgagtaatatcatgtagtattttgaacagacttaatgtcctcttaccgtaactaaacaaagggtatctcaaactctatttatggattgtccatagtctgaccttttacagcatc

SEQ ID NO: 3910 - DNA, 202 bp, Bacillus thuringiensis
cttcttttcttatattacacgcgccatatacatctggggagtttttaaactctatgggggataacatactgatgctcaacaaaagccaaacgtcttatgagggtaaacaaaaattaaagcttcgttctgctattaaagaaaattttccaagaaaggactgacttctctatgcctgtccctcaaaattataaaaaaccattaa

SEQ ID NO: 3911 - DNA, 172 bp, Bacillus thuringiensis
catttattttaaatccagacccccacataaagagccgggggatttaataaagacaatctgcgggtgccataaaaccacattatcttattacatcccatatcgaaatgcaactgacacatctatcgactatagcaaaccctaaagatagaatcccatggtaccaagggaaagc

SEQ ID NO: 3912 - DNA, 405 bp, Bacillus thuringiensis
ctatattcacagagcatatcatgacagactacattttgattcacctatccttttaaaaggggtcggccaaactactgggggaggtgaaacaagcactttaacgcttgatgtggtactacatgctgagacagaaatgctagaggacgtgtgatatgatgcgctcagtactgaggtatctgtaggggatttttttatgggacgaaaaggacaattattggaataatatacaggagcacttgagcgtgcagcgattctcgttcaattacatgagagagcttcagtgggagatattggtgcacatcccggcgggatgagcgcatcccagactattgcgcgggttacacgtgcgccacatggagagtcctttgatgcatcactgggtgcctgtgctcaggcgaatattga

SEQ ID NO: 3913 - DNA, 418 bp, Bacillus thuringiensis
gggaattcagatctccacaaaaagctattttaaatttcatttggtatgttctttgaaaactatatggcggggtcactgaaattatggaggggtacaaaaagaaagatacaaaggtcacactgtggataccttgacactacgagtctatgaaggacagtactaacgcccctattcttgtgggagctataagtaagctttgatcctaatatttcccaatggggaacctccctatactcaatggtgataggtctccttatctcaatacatgaaagtactgttatcaactcagagaacttaaacatctaacatactccacgaatagaactcgaatcctatttcctaagtagcggctagcgaaacggaacataccccaaaccaagaggcttaactattggggttgtccgacattctataccga

SEQ ID NO: 3914 - DNA, 217 bp, Bacillus thuringiensis
aacatatcgagagtcattaattgcacattctaatattggctatgataatcttttccagacaacaccatgaagaatatcttgaggaggactatgacctccgaaaagacatttgaagatggaggtaaaacgattgatttaagagagcaaggtgaggttgctctttaatcaatcgttgatcgagttcaatcgggtaagtaccaaggccaagatgtagcga

SEQ ID NO: 3915 - DNA, 111 bp, Bacillus thuringiensis
atgaccatgattacgccaaattacattggctacagcttctagagcctgtttagtttagaccacacagggggggccggctcgggcgtgattatataggtacgtaaaggcgca

SEQ ID NO: 3916 - DNA, 283 bp, Bacillus thuringiensis
gatcctattcccctcttgggaggttttatgacttgtgtgggggtccctcccatttcgctttcgagttccgagggcggttctatcgtaaagtgcgccccattcttagcgatacgattgcgaactacttctacggtgtcactgggcggtacgcgatccatatttggcgatggctcttcctccaaaccgagctcgctactgccaagaatttccccaacggaccgcagttcaacatttctaccttggttcatatcttgattctgcgtacccaaattttatcatatgg

SEQ ID NO: 3917 - DNA, 236 bp, Bacillus thuringiensis
taaacgcttaacaatgcctttttctttcgcgtatattttcaccccttgagacggtatgtgagcactttgtggtggaccacatgaatttgggcggcctcccatggtggttggatactgaaacagtacggtgctatttgcgtatttaagtatcctggacgtttgcgcaaccttccctacggatctactagtgcaagattacagtatccaataccggtgcatgaaaccgtatgaccaat

SEQ ID NO: 3918 - DNA, 328 bp, Bacillus thuringiensis
gcgcgaggcgcgtggccacgaacacataaaatttaatctagcaattatcatacactcccaaagcctccaagccaaatgggggatgtttttacgcaaacaaccggaccgattcatagacgacgtagaaggcatttcttggaagggatggtacagactccaacaacactatgcccacgcgacacacagcttatactgtaagagaatcaagagtagacataactttcaaaaacaccatcaattgatcgaccgaataaaggagcggcgcaccaataagatgacaccgtctgtgatacggcctatatacgctgcaaaccgcaaacacactcat

SEQ ID NO: 3919 - DNA, 277 bp, Bacillus thuringiensis
aaaccccccacagcaccccaaccccagccgccacaggaaaagcaccaggcaagacccccgacgccggagaaccaaccgcgacggccgcaaaagccggcagaaaaaaaagaggagcaccccgaaccggaaacgcaacgcacgcagcaagcgcagacaaaaaacgcaaccgcaccagaacaggcgacaacggagacaacgcagccgcagcacaaaagaaacccgcaaacgacgaaagagcccccgcgcgcggcgccacaaaagcaaaaacacccacacc

SEQ ID NO: 3920 - DNA, 128 bp, Bacillus thuringiensis
  unsure (1)...(128): unsure at all n locations
gagaaattggagatgggaatccaggaagcgnaacgaaacaanngaccgaaggagntaataaagaaacgagagcacgaggagtacgngnacccgggccgacggaaagcacagcagaaanaaggagagga

SEQ ID NO: 3921 - DNA, 294 bp, Bacillus thuringiensis
gaacaataaaaaaagctggttatttgtttaataaatggctagatttagctttttatgagctggaacttaacggtcctgaatatcctatagaagaataaatattattcgggacgcaagaaaaatttcatgctacctttttcttattttaatagctaatgaaaaggttttctacattcaatgttgcaatattagaagctgatataaccacataaaaagagggatagaaatggaaactgttataaataaaataaaagaggtacaatctaattgatggggagaggcaatttattctac

SEQ ID NO: 3922 - DNA, 251 bp, Bacillus thuringiensis
tgtcggctccatacttcgtgatatggccttgtatcacatcctcctttggccagctggcgtcttttcgaagaggctcgcaccgatatgcccttgccgacagttgggcatcctttatggctaatggacgttgatagcgtttgtatttatgttaggattcgcgctaaatggtggttaaatgagttcattttttaactcgttgggcgaaatatgcaaaatccctaatctatcaaaagatatgtatgcgttggcgc

SEQ ID NO: 3923 - DNA, 337 bp, Bacillus thuringiensis
aggattagctgttgcagcataattgtacgcacagtcaaccattggatgtggataacaccgatattgtctgatggtcatgtgactaacattgagtatataacacgaggtagacagagtcactacctgggggacaggagtataagttatcccttggtttaaataatcagaggggcgtcgaggtgaaacttagcaacaaatagggtctactaaagagagccctgcctgatatgtttgagcaggaaagtcctctgtacaagtcgaataaatacatttgagatacgaaactcgcgggaagaacagtatatgaaagcagatctttgacgcgccgatattcaaa

SEQ ID NO: 3924 - DNA, 145 bp, Bacillus thuringiensis
ttacttattttatggggacatcgagctgaatgccctttctgacagactcatagactgtaaggtgaaacggcactgtatgcatatcaagattgtcaaaacccgagtttaaaataagccgaatctgctctgaatgaaaccaatcagc

SEQ ID NO: 3925 - DNA, 360 bp, Bacillus thuringiensis
gctagcagatttgagtgccgtcccgactggtcaattatcttatcgcgctacaaaagaatggaggcttgctatgcataaagaggacgcttacgaaaacaatactaatcacgatcgccacgagcataaacgagacacacattgcggatcgagagttacaccaccgacagcatgcgcgaggaacatgagagcagcttctgcaattagccgcctgagatctataaatactaacgattgcgcgtgagatggaccgcggatatcctgtgacacctcatgtgattaaaaaggatgctgcggtacaagcttacgccattataatagctacccgctctgtcataccacctgaaaatacgagtggagatt

SEQ ID NO: 3926 - DNA, 226 bp, Bacillus thuringiensis
gggaacagggcttttttaagcccaaacaccggaatctgaccaggcccgggaagaaatgatagcagaattgtggcacgagaagatcagcacacctggcaaggaaagctgcaagggggaacctaccaaaggggcatgaagtaagcagaagtaaaaaggcgcgaagcttgtcattgagataagggggggggcgaccacggttggaccaaaaaagcaaagaggggaccaa

SEQ ID NO: 3927 - DNA, 327 bp, Bacillus thuringiensis
agacttaatatgcaagctcttataatggaggcagtaaacgtgccacacgcggacgattttgtcggccgtcagagcgaaagcggagccaccgttattgatcctaggcggtatatataacagtccgtagaaattgctaagaaagaggggctggaagacattgctgccggtgagacacatactcaggctgattttctttgcgggtctacagaactttttactgtttaccatgcgaatttatatgtatccgatgaaggggcttgtgatcggacagatcaagatctcaacgaaggtcgcctcaaaagggcttgagagggcacggcgtttaaa

SEQ ID NO: 3928 - DNA, 242 bp, Bacillus thuringiensis
cacagaacgaaggcaaaacgaactttataaccccgcaccgaagacgggaacagagaggaaatttacgcgagcagagacaaacgcacaagaacgccgagaaacccagccgaaacagatgcaccaggacaagcgacgaccttaggcagaataaaagggagaaagaaaggggaaccaaacaaccaaacagcaccaaacacggctggacgaatacctgaagcaacaaaaaaagcaccacaaccaac

SEQ ID NO: 3929 - DNA, 375 bp, Bacillus thuringiensis
  unsure (1)...(375): unsure at all n locations
actttncgacaaaacatgttcacccaaggaggggccaganaaatnngaggggcgataaacgcaggcaccggcgaaccggcaccatcaaggaaataaaccgcgccgggaaagacattcaccaatacgtacacagggactacaggaccgagtaaccaacgccataagctattataccaaaactgggctaacaaagaagagccccccacgagcgaagcaaaccctacaaccgcaatagaaccccccaccaatgcacatcctccacgcccaagaaggacatggacaaacggacccaaaacgacaacagacaacccaattgagcaacgaccaggagcaacaaaaaggacaaaacctccaaggaaaaacaacaaaaaggcg

SEQ ID NO: 3930 - DNA, 408 bp, Bacillus thuringiensis
ctatctattgaacggtggagacattattgatggttctggatttttttcgtctaagggttggctggattgatatgaacgacgttcgttctatacccgagttagttaacgaccctgcttggatgcagttaatcggtgacaaaggagttggagacttaaatgatgcacaaattattttagtcaacggtcccatggatccgaataacaacctgggtttcggctctaacttagtagaccgaaaaaaggatctcaccccaatggttatggggggccttaataaatgagattcattaaacgccgtatgtttcaggtttgcctttttagagacatcccgtacaaaaggatatggttccaggccagctgtctgtgattttcaaatacgggtgacaaaagctcggcttgaaacgaatt

SEQ ID NO: 3931 - DNA, 127 bp, Bacillus thuringiensis
cgggttcacctatagatttacctctgtattggccggttttgttggattaaaaataggattcggaaccacaatatcccccgggcggaattcggggaaagtaaaaaaggctggtttttgggccaaagcc

SEQ ID NO: 3932 - DNA, 199 bp, Bacillus thuringiensis
  unsure (1)...(199): unsure at all n locations
ggcgcataagaagaacccgaagacccagacaaagaaaccgttagtttacgaccaccaaggggagaacacacgggggggcatttttggagngcgcgagcacaacatccccacgtagccataccaacaaaaaaacccgcggcaagagggacaagagccaaaacacatgccaaggggcccggcagcacaaaaaaacgcgcac

SEQ ID NO: 3933 - DNA, 132 bp, Bacillus thuringiensis
atgactatatgaacgttttaggaatttttaaagggagatattttatgaatggaggcattgcgaagactgagtcttcttaaagcttggcggacttacacgtatcaattgatggcgaagaaaattgaaaggcgg

SEQ ID NO: 3934 - DNA, 367 bp, Bacillus thuringiensis
cagaacacctacacacgtactataagatggagttgcatctctttttataccgacctaatacgataagatggataagtactttgatgcacaaggatggattattgttgtacgtccagatttaacaactcctttagcgagaggtcttggaccacaatcgtgggatgccccattcaaggagacctttcaacgtgaatgtgtaccgggcgatatgattccgcaacctggaaaatctagtgaaatcattcaaagtggtctggaatatatcggcattgataatgcaggagctgggcccagtgtgaattgagtgtcatacacgcactctctaggcttaaggtgctataacatacaattgaaattgggcaagtac

SEQ ID NO: 3935 - DNA, 119 bp, Bacillus thuringiensis
ctgggcgacagccggcttaaacactgattaggcaacctatctttttgagaacggaatggagggtgatccagtcgggagcaatagcatgctataaaacagcgatatcatcaacgggcaac

SEQ ID NO: 3936 - DNA, 387 bp, Bacillus thuringiensis
ctctgggggagtatggcgaccatctgcccataaagcctgtcttttttagcaactcattcgtagaattgctattgggcgccttggagaacgctgagactattatataacaaaagcctcttggaacaggaattcgaagcaagaccctatgttgaaaaaaaagagacatcctatggcccaaaatcctccataggacccgacaaaaaatttcatgatagaatccttgatggagatatacccttaattgcagaccaaggcgactcttacatgttcgacatgtgcattacctcactgaggggcgggctggctaaactctgaccgagatgaaacaaacgccctcctgtgggaatagcggcacaaccctcaatgtggccgctttctgcgtatgaa

SEQ ID NO: 3937 - DNA, 186 bp, Bacillus thuringiensis
cgagatacggccgtaatcgacaaaatccctgattgctcaaagatattttttgagaccaggtgggatggtggcacagatgggcttagcgactagcattgaaacaataagggctgggtctgttccttcagaaccttccactgtgaataaaaaattggggtttctataacaaatagagtcatttgccat

SEQ ID NO: 3938 - DNA, 453 bp, Bacillus thuringiensis
tttggcctgaatacgcatatcaccgagattgatcaagcgcttcttgcgtggtaggcttgtgcgttgatcctgcatggcacatgagggcactattctcgaacgtggtcgctaacgcaataggactaatcaccttatcatagggcctatgacaactataagaaccagaatcatacataggatccccgcggactaggggtcaccatgctctgcattgagaccctataggagcctgtgtatttaacgctacggctgtaaagtgaacgaacggggcgagaaaggggggtatgatggaaaggggtggcttctgcatggcgctgtactgtggaatactgacgctatacactatcgcgggagttaggaaactaaatgcgcggatacacgactggttcagcatgactcggtgcgaagctgtgctcagttcaccgacatgattaggaggtaccaccatgccat

SEQ ID NO: 3939 - DNA, 419 bp, Bacillus thuringiensis
cagtcttgccctaggcgaatgttgcttctgacggctctctaactcagacatcgttagagccgaccgcaccggaacttgctctgaatctttgaaatatttctatctgggtttacccgctcgatacactgcaaggggctttcacctttctggtgacgctgactgggctactaccggttacatgtagtgggcgacgagcgctcaccgcagcatttctggggctttgtgtcgcactggccgtatagctagcagctggctcatcttacacatcgatgaccaactatgctactgcgctggtatctatggtatgagctatgtatcttacaaccgacgactgtcgctggaagtatacaacggaccgtgagaaaccacgggctgatagatgatgcatggattgtactaccgtgcttggtgccttgaaa

SEQ ID NO: 3940 - DNA, 227 bp, Bacillus thuringiensis
gcagaacgggggggagatactctaacttgaccgcgttgctttttgacgagatgtttgctaaggtccgtgccactcatcatcactatctaaaatactgctccttaatgagtaccgccttccatggattccacttttgatcgtgccaccccgtcattgggctaccactttattatggtgtccgacgcgatacggctttggctctttggatttgtgggctgatacggttg

SEQ ID NO: 3941 - DNA, 123 bp, Bacillus thuringiensis
caaccaatttacataacaaccgtagcacccctaacccagatcgcaaacagactctacattgaagagacaggcgggctacacacaccgccggaaaaactacaagagaccgcacaactccgaaca

SEQ ID NO: 3942 - DNA, 130 bp, Bacillus thuringiensis
  unsure (1)...(130): unsure at all n locations
ctgaacaangtgaacatatggtcacagggaggggaacaagtacacgctggggcctaccagagggcaggaggagggagagcatcaggataaatagctaatgcatgtgggacttaatacctagtgatgggtt

SEQ ID NO: 3943 - DNA, 174 bp, Bacillus thuringiensis
tagctctgaaccacacctgtgggggccaccgctggtgcgcgatggtttctataatgcctgctgatgggccggctgggcactgtccgatcagttacaacatggatactgggataaccgagaacggacacaacttcgtacagacgcagcgaatatttttatactcacatggggtgc

SEQ ID NO: 3944 - DNA, 246 bp, Bacillus thuringiensis
catcaatgaccctgatcttgctgacctaacgaggatgcacaattcttgagaacttgctatgaaacgagtcacggtgggaagtgttcgatcctatagtggcatgatgcggcatgcctagtgtactagaacgagtgggtacagacccattgagtctttcaaaactacacatgtggtgcggtcgaaggtcgaaggcaagaacctccgcacatgaaatcaggatgtcactgactgagcgagacaacgcac

SEQ ID NO: 3945 - DNA, 233 bp, Bacillus thuringiensis
ctatctagatacatacaaacacgtttccgttcatgagacagtaacctggatcgatgcttatatagtcgagagcaccgaattacatgagaagaccacatctgcctgcctacctaagacccttctgagcagaatggcgactgcctactcaagatcacactaagtcgctggtgaaggtacaaaatgttcataacgggaaggcttctcctgtgattttcctagatatcggaccacta

SEQ ID NO: 3946 - DNA, 424 bp, Bacillus thuringiensis
ccataggcacgcataccgcgcaaccgcttctatcggcgagatattattgccaaccctccccatactgctatactacgatgcgctcgctcagactgctcctgcggagaaaaacgcatctctaataatgatggcgcttacctcacctatcatctcgcgaatcaaaactttgctcccactgctcgcctcactagtatgaacatacaccgatctaacaggcggactacctacgcatactacatggctgcttaaccccgcacttaggacggtcatgaggagttaaactccgctagacatgacgcccaacgcacttgctacaacgggatctacgtacggacctttatgtgctggaactacttcccaactttgaccgattgctcttgcgctcagtagtgctgcaaggactgctttacaccaagcgagcggg

SEQ ID NO: 3947 - DNA, 468 bp, Bacillus thuringiensis
cggcgactctagtgagcgatacatttgtctccagactgttttccaggcaaccccgggaagacgagctgcgtgggtcaacaaaggcgggggaattaggacataagtccttgatgatgggcgctctgcatacaacagtctatgaataaagcggaaagctttcactctgctcgaagaggcataattatatactaaatcattgttatcggtcctttatatccaagaacatacaaagtccaaccgcgtggagggctggcatagaaaccggctaccgtattaccgcatgacactggagtatgagctcaacggtggaatccacctgccacctaaactgacgcctggaattgctggtgtactaggaacgattagagcaacttgcgcagtacttatatcaaacgactggccgtacgacgctggagatatattggtatttacaccagctacagagagtgcttaaaacggctgaatgtc

SEQ ID NO: 3948 - DNA, 244 bp, Bacillus thuringiensis
cctcggggattcctctatggtttgtagcataactgtcggatcgccaggtttacgacatgacggcggttcacatagtaaactggtgcgtatgtgttccacatcggctttaaatatcactggtaagtacatatttctgtcgcccttccaccttgagtaacataactggataaaaagcttatatacaataaagaactcgctacggtcatacagcgtgtgccatagtacattacgtttatgacacgca

SEQ ID NO: 3949 - DNA, 436 bp, Bacillus thuringiensis
gcaatgtcccttgtaagcgctccacctgtcattccggtttttcttcactgtccacaggacactagccacccggggatactattggtatcaatgcggcgattcagtggtgtaaaaagtcccgggccatttgcgtcgcagattctctctactcgagtgctaacacgcactgagtcaatggaagctgatcctaagccaacgtccgatttcattaagacactacacatccttctacacttataacacacttagtgaccttcgctggcgttgagagctgctacacattccgactacgcttcttatatctgccagaaaggactcctaacgttaagtatattggtatccgcagcatgagggcattctttgacaggaagcggtccaatagttcattcaggcctctacctaccacgactcttaccataaatgttagtcctaaagt

SEQ ID NO: 3950 - DNA, 430 bp, Bacillus thuringiensis
actcgatggatgcttttttttcgactcaacgagtccatgtgcaccatatattgggcctaacgactgggaagaaacattgctcaaaaaggatgctacagccgcacttgaaaacatgtcctaaggtgtgtattaacaatgccttgttcttaccggtgtatgaggttgtcgctcataccgacgtctggactcggcatatgaaccatacgcaagacgccaaggcagaggcggaactaattcgagaagctccattgctggtacatgagagcgccgaactggtttagctacgggaactaggacatgatcaggttaaaacgagattagagcctatctctcagatataccggagctggaaaaacgagcgcataacacgctcacgaatgcagcattggcacgcgctactcatgagatgaaaccgccacaggagaatgtg

SEQ ID NO: 3951 - DNA, 342 bp, Bacillus thuringiensis
cgcggcacctctttggcctacagcgtggtcatccaaagttgtcggtcgaacatcgctggagacgataaaattggccttatgagtgacaccgatcgtggtgatggtggaggtaatacgacatgtaccggcgggtgcatatgccacatcttgcgggggtgatacgcggttgtctgtaaccacgtgcctgcgggacacaccctcgagagatactgctgccggatgagtccagcgaaacctatgtgtcaacggttgagaccgggtgttctaataacggtgctattgggccacagttgccctagctagtagaccaggcggaaccatcttgagtgtatgcgtaattga

SEQ ID NO: 3952 - DNA, 533 bp, Bacillus thuringiensis
tttgaaaaggagttacattgtgcttaactaataattcagagagcggatactcctgattttcatacccgaataaagccgcttgttcaatctcctttactaattggttaaaggtgtgatgcggctggatttcactccctaacggaatcaacttattaagagtctcactttgttcaagattcttttccattataggcataccaattgtgattctttcttgagctgtataatgtgccaaacaaaccctcaaagcggcttgaaaccagctaaatgataataaatcttgagacttacttattttttggatacttttactaaattctacattcactatgacttgaacgtattcacaaggtgtttctttatttagatggtaatcgctattaaatttaaatacagaaaaatttggaaccttgggagataattgattcttccaaaacgcttctactctttattttcatgaatcggactttcatctttaatgtgcctttttatctttattcccctaatattcatttcttctactcggtaatttt

SEQ ID NO: 3953 - DNA, 425 bp, Bacillus thuringiensis
cgcgtatttatcgatccgcattggggatgccgcgacccttttaaccacttcatctgtcctcaaggttatattacgctgttctcagaaggctcgcctactagtgatactattgctatcactgctgtgatttagtggtgtatttagtccagggtcataggcatcgcatagtctctctacacgggatatattgcgggctgagtgaaaggaagttgctagtaagcccacatcctatgtgctgaagccactacacatcctgctacacttattacacaccgtgggaccttagctggtgttaatgagctcgctatacaactcgacctacgcgttcttacatattgcgcagaacggactcataaggataagttatcggcattagcagcatgactgcattctttggtaggatgcggtccaagagttgattcagg

SEQ ID NO: 3954 - DNA, 463 bp, Bacillus thuringiensis
ccatggtcgtgtatagcgagcaaccgctcatagatacgggattttattgcgaagcgcttgatgcatggtcatgtgggaactgttggctcgcggtgtcaccgcagtacgaatggcgctttgattacgaactcgttcacctgacgattatgcataaaacgggcgattcattggactgtgcacccgaggaggctccacatgtaccttctatgcatgtacagtagctagggtacacatctcgctttgaacagacagcgagagatactgatggttatgatctagaactaactgatggccgggccctcctaggttcgtagaacgcacacggccttattcgtgaaggaacaccgtaccaactgtcactgatggctcttacggttcaagcaggggcatgtatagatttacgttgagcgcccgtggatgctctaaagccattgatagcgactgcggcctggatgattgcaga

SEQ ID NO: 3955 - DNA, 354 bp, Bacillus thuringiensis
ccatgatggcatatgcagctacctcctacatttttacctatgatggcaacagctaagccacgagtcattgaagatgcacgccggcagtgctggccacatgcagatacattataggccagagggtggttaattgattgttaaaaaaccataaacgctggaatacctggagcgcgaccagcgggagctgtacaattcatactaacaaactaacaacacagaaacctggataggtgataaaggggatagaaaacccgattcctaaaaacgacataggcctttaatcaaaacatagatgttttctatgatcgtcaataatcttaccattaccaaaagcaaaaaggcttggattaaaag

SEQ ID NO: 3956 - DNA, 109 bp, Bacillus thuringiensis
caccatccttttttagatagaaagaccgcgtatcattttccacacaagaaacagaaccaggggggtttttaaatacaaaaggggggacataacccccatcattcaacat

SEQ ID NO: 3957 - DNA, 260 bp, Bacillus thuringiensis
gacgacaagcacgaggactttccggacactttgagcgtggtgtctcggggctcttgcacaggcactcctaacgacaccgacgagaatcctcgggtggagctgtccaccccatacacaaggtcttatgcacgttgggatctgaggcgttcatgggcggtagctgcccgacggcggatgacgacaatgttggtgttattggggctgacggagctggcgatggtgtttgttattactgacgtgaccccgtggcggctggtggc

SEQ ID NO: 3958 - DNA, 254 bp, Bacillus thuringiensis
aattcgtgatgaattttcaaaacagcgggtacacctccagtcaaatagcggacaccactctgccactaggggcttcttaaaaatatccgcggggattactaccaactgccatgcccaaatcaaagctttttgggaaccgctgctctcccatgatcttattccaatgaggtacccatatgcatagtattgtcattacttgacccctacgccaacttccaagatattgtcgacctaaataaactacttcttttgag

SEQ ID NO: 3959 - DNA, 124 bp, Bacillus thuringiensis
cgccttattgttgaccgagaagatacaacagcgggggatattaaaaaactagtcgcggctactaaccacccgaaaactatcccctgaacaaagcacccaaacaatgctcacaccttgaccataa

SEQ ID NO: 3960 - DNA, 340 bp, Bacillus thuringiensis
tttctttggcatatatacacaagcatctgatggggcctgattacatactatgcgggttccaagcgcggaagtaaaactgctttcgtctgttcgcgattaacaggggttactacggtgtacgggaccggctggatctgggaagacgactgctttggatggcttacgagcagtattttgatgagttacctcacgatatatcgttccacttgatggtacagctgccataagaactgacggtatacgacaaccctaattaaatgaaaacgtggctatcgcatatgaagcaggatgaaaggatctatcacgatatgatgcagaacttcctttagtcggtgaaaac

SEQ ID NO: 3961 - DNA, 262 bp, Bacillus thuringiensis
ggttttgtgcatgagtggaacaaccgatatgggggttacttatacaatacagggcattcatcttaatcatcagcgtcgcttcaggtatgttgtacaataccgaattaaattgacatacggccaaatggactgatcctatgggcgcttctgattataacctagagctggcctctcatgccttcatgaacagcattcgacaatccttcgtagatactacttctattgcaggtgcggttacgcgatccgataaggcaaccgagcc

SEQ ID NO: 3962 - DNA, 308 bp, Bacillus thuringiensis
caggttattaggttgatggagcgctaacccagtggtggcaaaacgaatagataaactatattctataccagggcatgaaccgaattcaggtgttttaggtgagtcatgctactttactggtcaataacagcattgtatgggcatgtagcaaaaacaacccccatatttagatgttgagcaggcgaagcatgaaggagctggatggatatatgacgagcggaccggacagagacagtacctccattcgtggtgcctgacttaagagtcaatccaatcaagtgagggtggattatttggaacgacatttg

SEQ ID NO: 3963 - DNA, 363 bp, Bacillus thuringiensis
tttgaggttattagatgctaagtcacagaactcaggagagagtgagactcgtgaaccgacatgactgcaaacagggaagagagacgttagtcacaaggaacggactgccagtcatacgtctaatggtgaaggaaactcggagcaggtgaaatatcgatagcgtgccagcatgcatatgggacgaagagcgaatacgaccttcgcatggcaggagaagataccaaatgagtacacattctgaactcagtattaggatgacggagagatacggcgcacattaaggaagttttgtaagagactacagagagatgcaatgagagaatcttcacatagattattacggacaggttactgaatatattg

SEQ ID NO: 3964 - DNA, 338 bp, Bacillus thuringiensis
atttttttattaaagctcatcaagaaaaagtaaaagaaccaatacacttatcaaatatgaaagaacttatttcaaggtctaacgattggcatacatctcctgtattaaagaaaattcagattttcggttatatcgatggtattccaacttctattaatgataatgttttaaaacgatatttccaaggtaagaaaagagaacaaatcattacatcttttgaacttaattattggataacagaaagattttgtgttgaataaagaacttttgaaagagctattgaaattttaatgaaaaatcctcaaaatgaatattaccaaccagttcctttaatatct

SEQ ID NO: 3965 - DNA, 337 bp, Bacillus thuringiensis
atttttttactaaagctcatcacgtaaaactgggggcacccacccacttatcaagtgtgatcgatcttagttcgaggtgttgcgattggcatacagtcccctgcattacagaatgtacggatacttggccattgccacggcattgcaactcgtatttaggataaagatctgaaacaatgtttagatggtaagatgaagagatcaaatcattacatggctcgagcttacctattgcataacagagagaagctgggttgctgatgaaatatatgaacgagctgttgagacaatcagtgtacaatgtatacattgaatatgacaaacaggttctttaata

SEQ ID NO: 3966 - DNA, 241 bp, Bacillus thuringiensis
agcccgccggaggcctcaccaaagacatttggagaagtttacattgtggcagaactattaaatgggccctgtgcagcatgttatggacgtatgccaaaccatggcctatatggcaggttttctccgtctacctgtagtttgtgggcttacggtccgatagaatgtgccctggccggcgaaaccgttggaccggttgagtttactatcctaaagggtaacccatggtatgaaatgggaagct

SEQ ID NO: 3967 - DNA, 321 bp, Bacillus thuringiensis
tttatatgggtatacatgaccttgccaagatagcgcacatagcatgaccttcgacctgttacacggaatggggaagctcttcataactaccttgtaaattcatccaggtgcaagttgattcatccaacgatgaaagagagtgtgacgaacgtgagcttaacttcgttaagagacataaagggtacttctttacggaatagctttttgcactgccactctgtttcagatgggtcattttgcactgactttcagtataactcataatgcctctaataagaataagatcaactgatatctacttcaaatagcgaccaaaaacat

SEQ ID NO: 3968 - DNA, 288 bp, Bacillus thuringiensis
caatgttccttatgaaggtagcatggtgcttgcaggggcttcactatgcagtagcactaggatatgatgctgtacagtcctgcaaaggctgcggcagcgaaaacgctcaaaaaaattcatattggcatcagtgcgggttttccttatctgtggcgcagaaatgagaccaatcatgactattgcctacaccggatggtgcttctaacagtgaacctaaagctactcaagccgtgcgacaaaaaggttacatcgcaaggagctgttgcaagtctttgtcatggtaattgc

SEQ ID NO: 3969 - DNA, 313 bp, Bacillus thuringiensis
atttgcttgcggctggagatcttctctacgtgcttaccaggcgcgctcttcttgtcgcttctaattacacatgatttttcaactccttctgttcttgatccatgtagacttccaaaatcagacagaaagctatgcacgcatcaaataagaaggggctatccactcattgcactttagcggagcagaagtgcatgacacgcctcttttaactgcataagagggccgtgatcatgcaaaccaagaaagtgagcccactgatacacactcatatcatgtgcaaacagggtgccttaatccattttcagataaatct

SEQ ID NO: 3970 - DNA, 177 bp, Bacillus thuringiensis
agcctatttgggtccgaaaaactacctaatccggggtcattctatagtatagcgggcttgccagaagagctatcataataagccttgcttgttcagttaaccattcgtacatttttagtcggttacgcagaccgagacagtcaatatcggttaagacggcgttatcttctatcttca

SEQ ID NO: 3971 - DNA, 366 bp, Bacillus thuringiensis
atagccagataatgcatgctttaatatgtccgttagattttactccgctaccatgtagagaagctaacaaagttactaaagcattatcagtcggcctatggttacatgagttaaactaaaagagcttcttacttgctataagaaagacccattataacttttggtgacacatatcgagatgaacatagtacattcaagtccttatgcttaatgaccaaacaactatctagaaattctagtgtggttctatctaaatctttttacatttctgagctcattgaagctatagagctaatatacacccctattgcacctgctagctctaccgctagttttggatccaatactgatcacggctgcatattg

SEQ ID NO: 3972 - DNA, 335 bp, Bacillus thuringiensis
tttatatttatctcttctatatgagtaaagggtggagggttaatgctgtccttggcattatgtatttaactccatcgagacttgtttaccatttaccaaaacctgtacttccgtttctaccactttcattacttattacatgtctcatctcttcttggttttcgtctcatttcttactttcagaataaggaaatgcagcacctacaactgtcgaattggctgacaagagaccgacagcgtcgtaaggctcaccacttaatcgtgggtatatgagattctagatgtgcgatcagaaatttatagtcgttttgagctattattagacagagggggga

SEQ ID NO: 3973 - DNA, 259 bp, Bacillus thuringiensis
ttataatttgaaagacattattctgacgtacgtaacatttgcataccagaatttcgtacattttttgatgatttaaaaatccgcggcgaacctaaacctataaccctgactgaagcttaaaagtaacaagagggctctccctcttgttgtttacaacgctgacctatatattgctaaggtttcgaaatggcttggtggggtcaaaaagaaccatttacctttccctttattgacaaagcatttgaacaccttatcttga

SEQ ID NO: 3974 - DNA, 316 bp, Bacillus thuringiensis
attcaaaaaagtttgtatctaacgttctttggttagtcgctgtaacagaaaaatgtgtttatggtactccgtggcgcgagctattctcgaatgctcaaacatgatgtatcgttgctggatactcactcgaataaggaggtgctattcttccgtctgaggaaatgtaccatggcctgcgaaactttgtggacaggtagagtataatggtcgaccggtttcccacaggatagtaagtggaacttgttcacgtggatcagtacgatcttaccgaactacaaactgacatgatgatgggtgtggaactgccgaactccgc

SEQ ID NO: 3975 - DNA, 392 bp, Bacillus thuringiensis
aaagctttactacaggatactgatagtttagtagatggactaactggacctgtagcgtaaaaatttgatttatctagttcaggctatttggaacatcaagtgaaatttaaaaagtctgtcacataggttgatgatgagatcggtaaaagcgcagacacaaaaatgggtcctatacgactagtacctgatgggaggtggcaagaacgaaaacctatttatgtatgaatggagattgaattagatgctcaattgcttactgtacatattattgatgctacacgtcagttgccggtcgaagctaaagaaccgttcacatcagttagtgatgcacaaggaaatggtgctttaactgatagacttccatctaacttaggatgttcaacagctggacg

SEQ ID NO: 3976 - DNA, 331 bp, Bacillus thuringiensis
atttttttttcagctttaacagtatgtaaagacagtaggtgtgctcagagcccatggtcataacaggatacatatattctttatttattagcatgcatttcataacccctcctaagcgtattagatggctgtcctttttttaaaggtaaagcagagaagcgtactatttctaatccccttagagatgagtatgagggagtacgtacttaaacaaagtatcctatccttagtatatatacaccgggtcatcacattcattctctagaaaagtataactattaagtatgagggtgtaagctgcagattgttattctggatacataagtttaag

SEQ ID NO: 3977 - DNA, 110 bp, Bacillus thuringiensis
tacttttttaatcgtcataattatggcatttggggcggggtattgtaaaataaacgagttgaacattcaccaatggattaaatacgaaagtaggttgcgtaataataata

SEQ ID NO: 3978 - DNA, 436 bp, Bacillus thuringiensis
tggtcgacgactacagaagatgcatgttcactattttcacaaaagcacatggggggcgagcaacgctatctaaacggtacgccttggggggtgcataatgagaaagctggtacaactcgctttgcctcgagtctttatctgacaaacagcgagagcaactgactttagaaacattaccacaacaactagacgctatgcataagattacatcatgtgtggacgggctcgttattgatcttcagcaactcactgatcacgtaaacaacgcagtacacagatgtgcgaaaacaactaactggtgcctacttagatgatcagacatgcgagtggcgagacatatggaaagaactaactgatcatatgcagtcagttacgcgacatactacaaagacttctgtgtgaacgcttacacaaacacgcggttacttggcagaaa

SEQ ID NO: 3979 - DNA, 539 bp, Bacillus thuringiensis
gtgtgttttcaggatttaattacaaaaacgaacgtggtaattcttgtctattgaaaggaagacctttttatatataaaagggactttctgattttataagtatatggggaatgtttacagtatggtaaagctaaaatgtgtaaattctatttataatagattgaaaaataacattatgatataatgattgaaaataatatctttattccgccatattgtggctgattaaaatttcactttatataatatgggggagattaaaatgactggaggtagcgtcatcttttgggggatttcatttttcatcggtttagctttcgattagcgtaattttaagatagaagaatgattaaaatgcaacttctacaagtaaaatagcaatatttcgtgattgcacactaatcttataaaggagtatactgaatgacgtgtagacttatagaaagggtaatgaaaatgaagctcgcaggaaaagttgctatcgtaactggcggtggcatttctattggacgtattcgcttcttttgtttggctaacaa

SEQ ID NO: 3980 - DNA, 310 bp, Bacillus thuringiensis
caagatggtaacctagcacacaacaatacaactcagggggctttttaaaaatttttggggtccaacaaccatttgcgcgatgctaacatcacgtcagcaccccactatcatacgacgaaaagctattatggcattactcgcactactgacactaattcaaactacataaatataaattcatttcgctgacactgatactgtacaagcccacaatctaaaatagtctctcacaaatcactacaacgaatggcaagctacaccacaactttgatgcaccaggctatcacattacacacgcataatcacctac

SEQ ID NO: 3981 - DNA, 221 bp, Bacillus thuringiensis
  unsure (1)...(221): unsure at all n locations
tttataaccaattatttatcaacctctggaacactaccacaatttgttatttttacgcatcttttggttcacaaaccactncttaaatcacaatataattaatatttacattcaatttcaccatataatacatcaagctgccacgacctgcacctacttcaatattaatctgttgtccgttctacaatactactattcagatacaaacccgctcctatgat

SEQ ID NO: 3982 - DNA, 147 bp, Bacillus thuringiensis
agacggtattaccggaggcggaaacagcgcagtgttgcatttgacgcctataggggaaacaccgacctaaagcagaatctcggcctagatgcaggaccactcccaaaaactacacctacacaacgagcaaatcgaaaacacgaggtc

SEQ ID NO: 3983 - DNA, 197 bp, Bacillus thuringiensis
gagagcgcaccatactgggtgtcgttccgaggcaaaattggtggaaccattcaaaacaaacgatgctacatgaagcaagaaagaaaacagatactaataaatgagcctacaaagagagtaaaatacgacgagtgctcgcacagacacatacaactccatatagcctcgaaacgcattaaaaacagcgagtcacatat

SEQ ID NO: 3984 - DNA, 287 bp, Bacillus thuringiensis
tagaggagtgcactcatacatgtgtttcggtttctgatgcaatagttaggtggaaccactttaaacataagagcgatatctactatgaagttaagagaagaatatatatacttaatataatgagctctacagaataggagtaagtatcgccgtccttcatttcacaatttacagtacagactccatatatggcttcgaagatgcatatattattagtcttggtttcattatgttttctcgtaaagtctttcattttaatttttctatcgtcttttatcgatattttg

SEQ ID NO: 3985 - DNA, 316 bp, Bacillus thuringiensis
ggttttttgactatatgctatccaacgacctactgtggatacaacctgcttggaaagtgagacctatacttctagcgtcttgaagatctatatacgagccaagcaatgtgaaccgtgcaaaaaactggctatactttacatataaactcataatggattcgatccacgatctgcacgaaacgtattttatacaagggacacaccgtctatcaggaatgatgtatgacccattcgcaacgcattcgactgtaccagatggtctatacatgacataacccgaactatttccagagagttacacgaactattcacagta

SEQ ID NO: 3986 - DNA, 279 bp, Bacillus thuringiensis
ttttttttgccgatgcatgcgttggtctgtaggagggatttcctggaaacacgatatgtaacaagttccacgaccttaattctatccagataggaaagctaattgcacaaggtcaccatctttcacattgcgctctatgtcaagttcaggcgtaacttctgcgaacactgcaaaaactgttgatagaataccagccgcattatgcgacatattgcccttcatggaactgttttaacatacgaccatttaaaaaaagtgaatcaggcctatctggtgcta

SEQ ID NO: 3987 - DNA, 101 bp, Bacillus thuringiensis
gtctttgaaaagcttacgactgaagccacgcggggaactgaataatcagccgtagggatttccattattgttttctgttgttccaatttatttttggacta

SEQ ID NO: 3988 - DNA, 129 bp, Bacillus thuringiensis
ggtaactcgtttaagattaagttagtccttagcaattttttggcttaaagcgcccttacagggttcaacaggtgaaggttttttgggaaaatttcttgggaccctagaaaaattactttttgtggaaca

SEQ ID NO: 3989 - DNA, 203 bp, Bacillus thuringiensis
tttttcttttcttagaaggactcgcttcctgtggggctttctttagagcaggtggactcactcggatctcataacgaacgccttttggaatcgagaaagagataataccatgctcatggtagaaagctctttgtatactacgacgactcttaagttcttcactcgcatatcccaaagagatccgtatacgatctgcatccatt

SEQ ID NO: 3990 - DNA, 111 bp, Bacillus thuringiensis
tcggaaccgaatgacgaggatgagtaggattcatgcaccgaaagaattagtatatttgttttttaagggagtataaccgatatctgtggcggatgcggttcgagacttacc

SEQ ID NO: 3991 - DNA, 247 bp, Bacillus thuringiensis
ctttcgtatcgtgtatgaggcactatgctctaaattcttttgaatagaaagaagtacatgtacaattggcttacttattttatggatcctatcattattactaagatacgaagacaacatttttcatacgaagagtactaccattactatataacattgagcttaattctctccaaatcatatcctggaaccatcttatcaatcatcatagctgttatgctacagctgatccgacgctatacagtat

SEQ ID NO: 3992 - DNA, 112 bp, Bacillus thuringiensis
cactgtaagcactcacacatccatacattatgccgtttttaaccccacccacattacaactccatatcgcgactactcacctgtactgccctggagctattgtgcatagccc

SEQ ID NO: 3993 - DNA, 196 bp, Bacillus thuringiensis
ctctccgaacgtgtaggaggcactttgctctaaaatcgttctaaaagaaagaagtacatgtacaactgtcatacatattttaggatcctatcatatcacaagatacgaagacaacattccccatacgtagagtacgaccatctgcgaataactttggcttaaatcatgccaaagcataaccggaaccatcctatcc

SEQ ID NO: 3994 - DNA, 112 bp, Bacillus thuringiensis
gaccgctagcacatctatgtcgttactctatgcttttttatcctactgcacctttcgaccttgaacgggatacataccggtacagttttacagcgaatgtgcgtcgcccttt

SEQ ID NO: 3995 - DNA, 178 bp, Bacillus thuringiensis
gaactaaatcaacaggattcaaacgggattttttgcgcattatcagcttatgagctggggggccctacatgtattggggggttatatcacgatatacaaacagtaagcaatgaaagtcccactgcgcttgtatgtcaagagttcattttcagccagatacaagtctttacatggaatg

SEQ ID NO: 3996 - DNA, 137 bp, Bacillus thuringiensis
cgcactaattatagcgccaaaacatcaaatctaacttttttttgatgttggaaatacaatatccattacggcgagctttactattaccgggtaatgagaccggaactgaagtaactttaatatgctcatgttagatg

SEQ ID NO: 3997 - DNA, 236 bp, Bacillus thuringiensis
ctgttgaaagagttagtgatccctttattaataagttttattaatagtaaatataccagggacatacggattgtaattactacaagtgtacaggcgagttgcataatactagctttattagccatgtagaattgctattgggattgtttgacttaaacaagaaaggatttggcaaacatgattgttacaccaagctcaatgagcgctccgacaaagtgttaaattacattccgctt

SEQ ID NO: 3998 - DNA, 111 bp, Bacillus thuringiensis
gtcattatgatcatacacatcgttctgctatgcttttttagcctaacgcaacttgcgatcgataacgcgactttcaccatttcaagtgatcagcgtttctccattgccctt

SEQ ID NO: 3999 - DNA, 170 bp, Bacillus thuringiensis
  unsure (1)...(170): unsure at all n locations
gtgagttagcacacactnaacgttctgttaggcttttttataacaacgcacattgcgactctcatcgcgactgtcacaattactactgatcagccaaggtgcattgcacttnaaggaaccgctctgcatatggttcttgcgtgtgattgtgtgacctccatcaatatttc

SEQ ID NO: 4000 - DNA, 105 bp, Bacillus thuringiensis
catttgaatcgaggatgaagctcttggctcgaatttcgttttaaaagaaagccgttcatggacaattgtcgtagtcattttaggaaactagtgttatcactaaga

SEQ ID NO: 4001 - DNA, 158 bp, Bacillus thuringiensis
gaatttaagaacatacataatattccgttatgcttttttatcaccatgcacatttcgattcacaacgggaccgtcactattacaagtcatcagttcttagtgcatagctctagcattaaatagaatgcaaatcgtaccagagatcgattgtgttatac

SEQ ID NO: 4002 - DNA, 157 bp, Bacillus thuringiensis
acgttttacgaagcacctccagaagacgtgatgaaacccagaggagctcgctggcagctttttttttgcattaggaaacgaacaaccaggggggcgctgaattaggcacaggtggaggcccgcttcatgtatgaaaaaggtaaaaagcgaattcaca

SEQ ID NO: 4003 - DNA, 180 bp, Bacillus thuringiensis
tcctaattctcaaatttaaacgttaattttatgttaattatgaatatttcccattccggtaattattattgtcataacctattatggtgaatcctttgtaaagcttaaacaattagactccccttgactatttgtatgagtaatagaatcttaaaatcaacagggagcacaagccagagg

SEQ ID NO: 4004 - DNA, 171 bp, Bacillus thuringiensis
cggttttatttcaaaagcaccatgagaaactgtgggtagagactatacaggacgatctgactctgcatcgatcaatgctatcgcaattgctatatccctattcgtatgtaacacatgatggtgcacgaaattgccaagaaatacaaagacatacacacttgcacacgagcc

SEQ ID NO: 4005 - DNA, 509 bp, Bacillus thuringiensis
tatataagttttattttcagtcctaagtataatactgctgctagcgcaacaataaataagccccaaaccgcccctgttggtttgtttttgctcatttttacaagaaccatttccattccgccgataactaaaataccagctaacattttcaagccataccacatgtgcatgctacctgttgctgtcttcacaatactcatgtacaacatgaagcctgtcacaataatgatgatatacattaggcgaagccccatatgtacacccttaccttttcttcctgctgaataaagtgaatacgcaacgaagaataaaattaaacctaacgcccatgctgtaatatgcatatgtaccatcgtatcccttaccttcttttttcacactttttcactctatatgataacatgttcatttatttttcaggaaatgtttcgttttttttacattaaatgctataattttagagaattacaaactttttgaataacaaagggggaacattatgattaaac

SEQ ID NO: 4006 - DNA, 499 bp, Bacillus thuringiensis
gccatacgaacgcttcgcgcagagcttgttcaaaactactcaacatatattattcaaataaagcagcgaagaccgctttatgacctgctaatgtctttgtgatctggaaacacagacagaccccctaaactttctataccaccattataacatttagttttccgataaagatgctgacaagttcataactacagttatatggcgcgtaaaatcgcagatccaaaagtctgctatatacacgaaatctgccaggaaaaaaagtatagcgaaatgacgacgagacgatatatgaacaaaatattgaccactaaacacttgcatcgtgacctgttgagttaccatcagtgactcttattctgtcaatggaccatccactgactaataactacctacacatgaactatggtattaccgcattggctataaacagctaatagcggatcataaaataggtcaggaccgtgcacctacattgcacggtgcttgtcatacactacac

SEQ ID NO: 4007 - DNA, 437 bp, Bacillus thuringiensis
attttttactatcaaatttaatggaagactattaagagaaaattagctgtatgtaaattttttgttaacttatgtaaatatcagttataatttgtataagtttgtctttttgtatcaatcattccgccctttacaatttaaatataaacaagttggatttcatttaacgtaaatctctttttttacattttgactctatgtttatgaaaataaatagaaatgcggtgagcctttatgaaaatagtaaagctaaatgaatcttttatttttgaattacttaatctttgcaaatctgttggatggttacacgatgaaatttttatgaaaaaacaattcgaaatgtatctttctatcggcacacttgtaggttacattcatgaaaacaaactcattgcgactggaggagtatttccctttacaagtaactttacttccat

SEQ ID NO: 4008 - DNA, 233 bp, Bacillus thuringiensis
cgactggatcatgcaacgattttatgttgtttgtctgcacgataaccagatacaggggggggatccagccaatcttttgtcgcatctttcaacctgtttagaggagcctctgctgaagggtaactcggcaatgtttgctcttgatcttacagactaataaacggtacactgctcctccctaagtcttcaagaatgaatcgagaagggtagtcttccgacgtgaacaagcaaat

SEQ ID NO: 4009 - DNA, 426 bp, Bacillus thuringiensis
tgccaaacaaaacccagaggggattttacaccacattgagtgctcccacaactcacgaatcacccaccgtctaacgtctaactatgaacttaaagaaccactctataccacgcccttcagacaaaccagttcaaactcttacttacctgtccatttctaatggaaatacatgttcccactatgtctataaataatactgagagctttatctctttaaacatttctatccaacatacctaaccataactcgcctcttcacatgtatccacgtttggacaatgactacaatcaatacccaacctacccctggcaactcctttatccattcagaaaaatcaacatccccaccttttggaaaaaactcctgtccacaaaatgacaaaggaaaattacctccatcctaacactttaattatcaccccagcc

SEQ ID NO: 4010 - DNA, 106 bp, Bacillus thuringiensis
ccacacttaattatgtgctatatttctacttatctggcaagtaattacatatcataatgccattgcggataaaagggagaggtcccaatgcacatcaattccccct

SEQ ID NO: 4011 - DNA, 460 bp, Bacillus thuringiensis
agtcgccaccagaagtgatgatcggctaccgtctgtaaaaggcccgaatttacaagaactcatatgaccatgcgagggccgagctttgtagatccaatcgcgtaaataaaaagggcatacatattatattctgatagcgaatgagcctattagcttatacatacgaagcgcagaacacaacagaactagagttgcattgtatgtagaagaacactgcatcatgcgaatgctatgttgataaaaacggaagaccattacctggaaaaaagtgcaccgttgcatatgcctttggcaagcgaacacccaaataagacgtaatcagaaactataaagacactggacatattccaggtggacaaaaaattaaagaacgctctatcttacattacaactgtataactatgcgccataacatataatacattctttatttgctactgacatttatagccacatacac

SEQ ID NO: 4012 - DNA, 131 bp, Bacillus thuringiensis
cagacgtgatgataagacataagatccgtacatatatgttttttagaacataatgcatactcacattgagtacatatatcttgttaaaggactaattattgaactttgtgcggcgatatttatgatggcat

SEQ ID NO: 4013 - DNA, 233 bp, Bacillus thuringiensis
tagggtttttttgaacgagcgcgggcagaagagctgaggggcttttcaaaataatctatttcttacaaggccgcccagttatgtcgaagggagactgaactaaacgccatctgatgcgtcatagccgacgttttagacccaggggggtgcgctgaaccaatactgccatcactacgggttgggacagttatgagttgccacgttgtgagcacatgatgagtacctctgtaagg

SEQ ID NO: 4014 - DNA, 170 bp, Bacillus thuringiensis
ttagttttccacctatctagaatatccagggaaaagcaatacaaaaccatggcgtaaatatctccatatgcaatacaagcgtatcaatagctaattccgccaaagaacctactctacctcctccgagctaaagaaatacgcactcatacaataaacaaaaacaccctccc

SEQ ID NO: 4015 - DNA, 160 bp, Bacillus thuringiensis
catcttccaacagaggatataggctcgtttgctcgaaaatcatttttaaaagaacagacgtacatgaacgatctgtcatacgtacattttatggaatctatcatatcactaagatactaagacaacatccctcatacatagaggactaccatctacgtat

SEQ ID NO: 4016 - DNA, 323 bp, Bacillus thuringiensis
cgcctacgtttccagatttatttcttacactataacgtaaggattggggttggttaatatgagtcaccctcataccatctcgaatttttattcaatagggcgataattccataccaataacttgtggacctatttattcttaaaaataccctaccgacacccgcctcaaattattatcgcactcctacaaactaccttagaatcgaaaatcccctcaacggaattttgcacaatatgtcttccttgcgaaagcagagtggaactccacccggactgaacagatatcctccgcattagtaatatattcgaatccctatcccttg

SEQ ID NO: 4017 - DNA, 540 bp, Bacillus thuringiensis
  unsure (1)...(540): unsure at all n locations
aggagaaganaaagacgaaaacagaaaaaaagagaaggaattaaaagaagaaagcaaaagagaacaaagaagagagagagaaaaacaagaaaaaggggaagaaaccaaaaggaaaagcggagangaaaaaaaaagaaagaaaagaaaaaaaaaaagggcaagaggaaaaagaaaaagggaagagaaaaagacaaagagagaaaaaaaaagggggaaaaaagggaaaccagaaaagaaaaaagaaaaggaggaaacgacagaacaaagagacagaaagaagcanagggaaacaaacggaaaaaagggaagaaaaaaaaaggagaagaaaggggaagagaaaaaagaaatgaaaaaaaaacaagaacgggaaaaaacaaacggagaaagaacggcaagcaaaagaaacaaaacaaaggaaaaggaaaaggaaaagagaaaagggaaagagaaaaaaaaaaaaaggaagaagaaaagaaagaaaaaagaggaaaaggagaacaaggaaggagagaaaaagggagaaaaggggggaaaaaaaaa

SEQ ID NO: 4018 - DNA, 124 bp, Bacillus thuringiensis
accggttggttgcaaatcctccatcataaatgttctttgtttagttgccctacacgtctagacccggggtggaggctactactaaaagcgcgcttcatcctagcagaatctttaccttctgaaa

SEQ ID NO: 4019 - DNA, 129 bp, Bacillus thuringiensis
atttaacgaattacgcagagccatatacagataaccaaatgtatgatgatgcaccatttctatttgaaacacggtattagtaaggacgaaggatgctgtgcagagaaaagtcatgcatgtggaaggtta

SEQ ID NO: 4020 - DNA, 113 bp, Bacillus thuringiensis
cccatggtctagaagcgtctggcaccaattcacaacgctcgcattggatttagatttattatacaaacacattattgaaattgctgaactggtccatttctatgaaagaattc

SEQ ID NO: 4021 - DNA, 147 bp, Bacillus thuringiensis
tggaggaaccacaattggtgatacccgatgactgatatactgtagtcataacaggatttttttaattgcccgacacatatagaacgccgggggaactgctcatatgtaggcgcttattctctagaagaatactaccccttatagtat

SEQ ID NO: 4022 - DNA, 122 bp, Bacillus thuringiensis
attttttgtattattcgcatacttttgtggggctctcgatggagcacatagtacgggaaaaataggtaaaatagaactcgcgcactgcggtactctatttctcgatattgaaatgctatttt

SEQ ID NO: 4023 - DNA, 107 bp, Bacillus thuringiensis
ttatcgataaactccggataatagggggcctactaaaaaggagtggctgaacacgaaatcgtacttatgactaccatgctaccaagacacattcggagatcaagata

SEQ ID NO: 4024 - DNA, 209 bp, Bacillus thuringiensis
agcaccacgacacccttttggaggcgcgtctgctgttgttcgctctggtgctgtaatcacaaactgactcggtaagctcacatcttctttttataggtgccggatcaggtgtcttaatggcagtaatacggtcatcctcgctatctaggcatatcacgcgaagtttcttctgacctgacccccaccgaattgccataaaccttgaaaag

SEQ ID NO: 4025 - DNA, 152 bp, Bacillus thuringiensis
ctccatccaatagattttttgacggagtctggaaaaagattatcattgtctctataaattgcagatactagagaacttagtaatatgtttaaagagggggttagagctttgctcattatcgggctatcatattagagcggttgtggacgatt

SEQ ID NO: 4026 - DNA, 126 bp, Bacillus thuringiensis
ccccgatcaaaacccactcggggtactttaggaattaacgaggcagcaaacacacccctgaacagctgaccccagcccataagccgacttactctatcacaaaggacccggaacctcacgaacaag

SEQ ID NO: 4027 - DNA, 108 bp, Bacillus thuringiensis
cccacttatattaccttatgcgagcttttttttttgggcacccgcattgtagggagcatggctgtacctatgggtcagcagtaaatacagtacctcaagggaacatcc

SEQ ID NO: 4028 - DNA, 226 bp, Bacillus thuringiensis
cgcgagtacgtacacgaaacgaaagatctaagcggaggaaaaacgatatatcatcgcggttttggatcgaaaaggatgagtgggatgaaagcgaataaagctttaacaatcgcagggtctgatagcggcggccgtgctggaatctatgcagatttaaaacacattcccacagagctctggtagtatactggaatgacttgttattactgcgcattacctgctcaaa

SEQ ID NO: 4029 - DNA, 262 bp, Bacillus thuringiensis
acttatcataacaaacaaacctgctactacgggggaatttatgcgaatagaggattgtaccaatcccaaagaatccactaaatcatcaccggcaattaaccgctactgttccttacatggatgcccacacatggtaatttccaatctcataaccagtctttttctgcgcaaccttaagtgctaactaagccttttcaacattaacctgcacaacacctaaaaacgcccatatccatattgaagaattattcacatgtcaaac

SEQ ID NO: 4030 - DNA, 144 bp, Bacillus thuringiensis
  unsure (1)...(144): unsure at all n locations
ccatcagggtagataacgcagagtgttattccatangtgctgccaagggtactttgctgtgagagtgcatgctctctctctgggtctctctctctctcactctgtcccactctctcactctcaatatctctccccctccctcta

SEQ ID NO: 4031 - DNA, 254 bp, Bacillus thuringiensis
aacggtataacgcccaacatatgcatgaaccatccggggggaaataagaatagttctgaaagcattcctcaataatacactcacacttatgcaagttcattcaaaatctgcggcactgcggactcaaaccgaaccggaccgatacttcatcaagctataaaggcacgccagcacctgagaagattggacctacatcttcagctcttcccaccacatactatccaacaggagcaaccggagccccaggcgccaca

SEQ ID NO: 4032 - DNA, 236 bp, Bacillus thuringiensis
ttatgatcagggctttggctgtatggctatagacatttcatcttacgcgacacactcgcgatttataaatcgagtcttcaacgcatgagctcgttatggtgattagaccctctagccgcattgtacgcactatggcggaatgacattgttagcagctggtgaaatgcgcactttgaaggcgctctgtattcatttcttatgacaatcgtgcttgttggaaacgtagtgtactatga

SEQ ID NO: 4033 - DNA, 149 bp, Bacillus thuringiensis
gcccttcttcataggctacgcgcgccagcccagcctgacagaagtggaccctaaagcctgaggaggctaacactctctgggagtatgaagaggccaggcgagatctactgaaagctatttcggacacttttcggttcttaaccggccat

SEQ ID NO: 4034 - DNA, 358 bp, Bacillus thuringiensis
  unsure (1)...(358): unsure at all n locations
aaggacggcatctatttttaaatcttgagtgacgacattggtttgagtcatagcaacggctgttgtcacgatctccacacaataaggcacaagcgaaacggaaggcatgtgtccaaattgtcggggatggccaccaaccgagcgggtgccgctttgaaggcgtcgggtcatgaggatggggacccctgaattgcattacacacgtagttcactcagtcatacgaggggatgcctgtccggactagaacactactaaacatttgcccctggaagcgctaaagtacgcactgctgtttcgatcatgtcnntatccgtatacaagtatggctttatcccttctgcaagagttgcgctaagt

SEQ ID NO: 4035 - DNA, 399 bp, Bacillus thuringiensis
  unsure (1)...(399): unsure at all n locations
gacgctgttcgacgcggccccaccagacgtgatcaactatcacttgggatcacgattataacccttttatttttattccggngccctcctctgaaatccgggatatactattaaacgtgtcgcttaaattctggaatatacagcatcacgacccattatcaaaaaaactctctctttggcatagggcctacacagggcatagccacctttaacacgaccaagaacggtggtaattactacagaacggcccctcttatgaccaaagcaacgacagaactgcacaccacatgtacactggcccacggaggtcggacaatcatagaatccgtcacccacctccttattagaagcccattaaaccctgtgccgaggataccaaaacggtgctgaaggaagacc

SEQ ID NO: 4036 - DNA, 246 bp, Bacillus thuringiensis
ccatgattggatcaaatacaattcaagaatggctataacaaaactggctaacaaaggaatggcaacactaacacgaccggtaatggaaatatttactacagaacgtgccgtatcggtcccgccatagagacagaactgcacaccatatgaaaactgaacttaatagtgggtgcatacataaatgcagtgaaccacctttggattaggcgccaggtgcatcctgtgttgaggcttgaattatcgagc

SEQ ID NO: 4037 - DNA, 347 bp, Bacillus thuringiensis
caaccggaatatcaactcctacgaacgtctctgcaatgggggctttttttgctgctactaaactatgcggcctctgctccttctctttcttcggcccgtccttttcaacaatcctaaaatgatacgtcgctcctcttacttttagtcccgcccaagtaacggcattaatactatccgtcaaatggcgctgcacatcatctacattcggccttcgaaatcgcagtcacccttctttaatacccatctcatccaactcctctcatcaacatatattccgcctcaggcttcgctcctgtaatcacaactctccaaaccacacttgacaatgcactcacaccacaacagaa

SEQ ID NO: 4038 - DNA, 317 bp, Bacillus thuringiensis
acctccatactaaatacagtataagggaggttttgaagatgaaggggactgcctataactttattgatcgcgatgctagcgaaggctggctgcaatacaaacaaagaagaaccgaaacaagaaaagaaacttgaaagtgtaaacgtagcatttcaaacgaatccgaaagaaatttaacctggtgaaaaaacagaagtacaagcacttgttacacaaggaaaagaaagagtaaccgatgcccatgatgtaaaagtttgaaacttggaaagattgccactagaagcacgaaatgttagatggtaagcataaaaggaaaa

SEQ ID NO: 4039 - DNA, 313 bp, Bacillus thuringiensis
gttcaatattttgaaaaactagttccctgtttttcctttttttatctcttaagtttctggttcccgtgcaccatctttttgggtattttttgaataacctttccctttcttacctttttttccttataaaaacatttccttttttaattccaattttcaatttattaaagggaaaaaaattccactttaaattttctccaattatttttaattgttaaaaaatattccttctttcttttaaaattatttaaattaaaagggttgtctggaaaaattttctatccaccccttttttctatttccctttaattta

SEQ ID NO: 4040 - DNA, 145 bp, Bacillus thuringiensis
  unsure (1)...(145): unsure at all n locations
gatgcaaccgttacttcacgagnctcngttagaacctactttatcctcaaggggggggtcttattgcgcatgaggtgccctctcttacgcagcacagtgaatatccttatatggttttattccttgtcccatacgtcgtattcgg

SEQ ID NO: 4041 - DNA, 334 bp, Bacillus thuringiensis
gaagcaaccgatacatctcgagttctttttccgtatcttctatatgcatgggggggaactttctccgcatgaggtactttcgcataagcaacacaaggaataataatctgtggccttacatcttaggccacttgctgtatacggtatatcattgccacatctaataactgtgtatgaactggatatatatactgttcttaccagtctaactcctcaaatagctgctcttcctaacaagaccgaatgctcctgctatgataaccctgtctttcatttaacatgccccttactggccctttgatggttgccaccagcactcattctcatcatacca

SEQ ID NO: 4042 - DNA, 295 bp, Bacillus thuringiensis
aatgttttttccgctgacatgaggaagcatgaggaggtttttttctttctgagtgcgatctaaccacgcagcagtcgctgctattaattctacaacgggagtcaaacttgatgacagtgcagatgattcttccgagccaaagacatgttgtgtgcacatttctagggtgtcccgtacttccgtctacttttgttaagcaatcatttactatttattagtagagattactcagttacatagcaatgagtatccccctctaaaaaataataaaggtgtgaaccttcacccctgtgtg

SEQ ID NO: 4043 - DNA, 272 bp, Bacillus thuringiensis
ctttatttttccccctaaaaaaagcagtaggggcgggttttttatctatctagtgcgaactatatattcaaattcggtatattcctctagcaactatgctcttagcttttattaccttagagataattgggggaacatttgatacctagtttactaccattctagtaaaaccgttcacactatattgtatcggatatgacatgctatttggactaacattcctgacatctctagctacggggattacgcatgagcgaactatcaatctatat

SEQ ID NO: 4044 - DNA, 322 bp, Bacillus thuringiensis
tgggggccccccaaagacactaagtaattttattggtttacatacgtgattatacaatatggaagcgtagactgaaagattaggagaacataaaaaattttcaatacacataaaataccaaagaactgcactaaaaaaatgtctagcgcccaaaaaacattggcaaactatacatacagaagtacacatccaccttataccaaaaaatccagacttaacatggatatacaagcaataaaacaaaagaaacgtaataagcactgaacattcgatacacaaaagggaaagcaattttattactaagaaatatataattaaggaa

SEQ ID NO: 4045 - DNA, 322 bp, Bacillus thuringiensis
aaaagcagtaatcatggtttatttaatttattaccagtaactgctttaaatggcggccattaattcttctgcttaattgaagcgagacaagggaaaccaaaagaatcccaaaaaggaaagaaaggtcaaatcaataggaattggataattaaagttacttatgaaagttgtaacttgaaaagacattcgtaagatttaaatggtaaaataaagggaaacttataaagaaatagagctaaaaaaaaaaaatccctcacctaactcaaagtgaggtaataaactgaaaaccaaaaaaaaatgaaaaaaagcaaaataaaacaaa

SEQ ID NO: 4046 - DNA, 108 bp, Bacillus thuringiensis
cagacccaaaaaattgcccttttaaaagaacacagggccccccaaaacccggcacgcctacaatatttgaaacatcctacaaccaaacatatacttcagactacttaa

SEQ ID NO: 4047 - DNA, 164 bp, Bacillus thuringiensis
agcaggccatctagctgagggctatttttttaaccgacggacgctctaataggccagtgtgcctttacgctctggggacttaccaatagtccccatccgtgcttgtcctggcctccactgtttttgagaattagatcagcacccaagcacagctaacggatatt

SEQ ID NO: 4048 - DNA, 206 bp, Bacillus thuringiensis
ttaagccaagttttttcgcccttttttaagcccctacggcagctgatcgagtgaggggccattggagcggggaggggaaagaacaaggccaaatagcaatatgcaattaacgcgcatgctggacaagcgaatgaaggaaattgcagcgctttgtaaagcgcttggtaaagaaaaattggaaagaatggttgcaacaggctctggac

SEQ ID NO: 4049 - DNA, 160 bp, Bacillus thuringiensis
ttactaacacatttttttgaaggcggaggaaatatatacgctggaggacggtgaacgaaaatgaatgatcccctcgagattttcaattcgagtgaacttttaaatttctaaggataggttacgatgtattaattcgtatcatattaactcgagcgtttct

SEQ ID NO: 4050 - DNA, 114 bp, Bacillus thuringiensis
ccatctcattcgcatttcaggggagcttttagagccgaagggggcctctctactaaagtatccatctttacgacccggtacatacctctaagctcttaagcactcctcgagcat

SEQ ID NO: 4051 - DNA, 141 bp, Bacillus thuringiensis
ctctacctgccacaccaagggcgggccctaatgcattccaggcatccagcatcctatcacaaacaggaatatctcctggacgataaacaacgaaaagaggcctataaactatataaacatatctctcattttggaaagcct

SEQ ID NO: 4052 - DNA, 185 bp, Bacillus thuringiensis
taactcgaacttttttgacatgtttttaacacgcacatagatgcttgaaaaggcggggacttgaaacaagcatgtcgactctatagtgagaattcgaatcgggcaggaatgccatactgatagcctctcctcatacacattgagttcctataatcgacgcgaacgaaaacggatgtttaattgac

SEQ ID NO: 4053 - DNA, 241 bp, Bacillus thuringiensis
tttaaacttttatttgcgctttttatactccccgaaagattctatcttccgcggaggttaagattcaccaggtgggccctgcgtctcctttctcacctaaaatacctatgctccccttttttttatttatatccagcttatcagtctaaggaagttaaagagtttatcgagaaaaaattttgatgggtcaattttttccatttttggtagggacctctccataattttttgaatttaaaaa

SEQ ID NO: 4054 - DNA, 122 bp, Bacillus thuringiensis
caccagcgacgcaacccgggggcggttttttaaaaataaggggggccacaacaatgcccaaaaacaaaaagccgtactaatgtagcaccagagaggaggacgaccaaacgcagcaaccacac

SEQ ID NO: 4055 - DNA, 178 bp, Bacillus thuringiensis
cactgtcgtggatttcagtgttttttttgccgcccttgcctcccaagcttagtggggattagaacgcgcttatacttccatctcaactgatcgacagtgcgcggccacccagcaaacaacaacatctccctatcaggcacttggatcattaccaccggcacaccagcttggtgtgcaa

SEQ ID NO: 4056 - DNA, 428 bp, Bacillus thuringiensis
ttttttacgatttggaaaataagaatggaggtggattttgttatactgaaggggattatttatggcaggatatgcggtgtgcttaaaggcattaaaatgaacattggcgctatcataaacacttcaaaagaactatatagcatactacggttactattaacattgatgctaatgtgcatccggatggttacagcaacacagtctagagctcgcatagctggcgcattacctggcgttttaacgacatgcatgggactgccaggtccaccccgggagctgtattagacaggagctaatactgggaaagagaagttaacagcagactacattgagcttcgtatcacgattatataacaacattagactaggtactcatatactgtatactgggacatgcataaccagtggggaatcaagtttttatggca

SEQ ID NO: 4057 - DNA, 337 bp, Bacillus thuringiensis
ctagccctagtgcatatagcagttcttttagcatgttagatgaacctgcgccaattgtgccaccgctcgaatctgacgtcgcctcggttatatgcatataatagaagaactgtagcaaatacgacagatgatgacagtgcacaagcctaacgtcaaatactaataaatatatggatgcggcctttgcgaacatttgagtctcaatctcacttcttcgcagtacattgattactagatacgggagaaatggattaagcaggtgcagtgcatactccgagaaggcaagaaccaatttgtggcggaatggattaacaacaaagaaagaggatgcccaaaa

SEQ ID NO: 4058 - DNA, 199 bp, Bacillus thuringiensis
acgcagcagtatgtgtcgaatatggatgctccaaatgaagaacgaaaactttcgaatgaccttcgccgggcccagttgaacggagctatactagagatgtgggagttcgtaaaacagcttgtaaccgatggcttacaaaagatggatgaacgaatctgctactgtaaaaaaagcagaattttttaggttggttttttat

SEQ ID NO: 4059 - DNA, 323 bp, Bacillus thuringiensis
caacttgaagaacagggggggcaacttcaacaagagggggggctaaaaaacctcgaaaaaaggggggaacaccaaaactcggagggaggactcaaaacgccaaggcgaggagcacaaatgtactgaggccagatcttaacatagcatgtgagacccgaaagaggattagatccgggagcgactgcaatccccaccacgagcgacggcccaaatgaaagacagcggtgcctaatatctaaggggctcacataattcaacgccagcagaacgtttacgagagacaaagattacatggcaacaaggtgaagtgacagcgaaaggga

SEQ ID NO: 4060 - DNA, 127 bp, Bacillus thuringiensis
ctatataaaaaccacttttcaacttttttttaacctcgttcttacacactacatgagggttctttactatcaaggggggcaaccaatcgaaaccaactatatacgaacacattatatcctattatcc

SEQ ID NO: 4061 - DNA, 578 bp, Bacillus thuringiensis
  unsure (1)...(578): unsure at all n locations
gacaaantacaaccaacagtataagccggacctaccgctagcacgacataccaaaaaaacggaagcagaaaaaaaaagaaacctaagctcccaaagaaaaaagggaaccacccgaacacaagactgtaacaggtaaatctaaacgaataactcttgcgagagaagaatgaataaaccggatataaccaacgacaaacgctaaaaggacataacgagcacacaccgaatcgaaatcacgaataactatcttatgtaaaaaaagaaccaaatccaacaaccgggcaaaacaacaacaaacgaaaaaaaaatttgcaattaaaacacgaaataatgctaaaacccggaagggaacaacttaatgcaaagggcccaaaaaacgggaaaacaaaccaaaatatatacataaaaaacctttttacaaatttaaagggcaaaaaaaaaccccttaaaaaaaaaaattggaaaaacccacaaagaacacattttcttttcacatcaaaaacatcacaaaaaatgttcggagcccataaaaaaaacaaaaatttaaaaacacattctctttttcaaaaaaaaaaaaa

SEQ ID NO: 4062 - DNA, 212 bp, Bacillus thuringiensis
gtttctgagccagtgctagaacatgatggaccgccttctaaatgaacttagatcgcctgcatatatgcagtaccagccactgcaggtgctgcaacacgcacattactttatctcataccctgctacggacagtcttacctggatattgagcatgcagcctgtacccagataacgatatgaaagacatcatgccagttgcattaactctttac

SEQ ID NO: 4063 - DNA, 525 bp, Bacillus thuringiensis
cccaggtacaattgtcagtctagattcgagccaccctgattaaagcgaagatatagcatctacaaaaaacagacgctgcattaaataaaaaataaaaaccgtcggaagatgaaaccatccgtcaactgcaatgagggagagctgtagaattcgctaataaaaagataaaccattgcagagtttcgatctaatgatggtagctctgtagagtgtgcaatggtttcatgcgatgaagctttcctatgcaaatatatggagagaataaaaaaggcgagttctatactcacgattcgaaccttcctcaagatataccaacgactcttctagacaagattatttaaacccaccttatagaaactgacaacgacactatgttctttatacacgactaaacgattatgtgtttgacgcgctgctgcttaaacaacgcaagttggatacaagaaaacaaagcgtgctttagcccctacatacggccatactcggtagcgtgcattaatgaacggggctttacccctgtaataa

SEQ ID NO: 4064 - DNA, 110 bp, Bacillus thuringiensis
agtccgataattaaatcatcatattggaccgtttttccgccatcaagatgaacagcttggtgttctatttcaatatttgtcgcctgtcccaaattgaatattgaggcgtg

SEQ ID NO: 4065 - DNA, 347 bp, Bacillus thuringiensis
gattccttttgtagcatttcaagtataatccatagaggaacacctttatcctttaacatcttccataaatctaattcattaaatttatgctcaggctgtttcatttctttttcagatgaacgaatatcaaacttgataggatcatttattttcttactttcaagtttagtagaagagatagtattatgctcaagagtagatgaagttattttagtaggttgagataatgtatgaatattcgatccgatttgcatgctttttcctcctttgcaagcaatgagattagttttcttatggtttataaatctttttaacatgaggcaactatatctaattatatattcaaa

SEQ ID NO: 4066 - DNA, 297 bp, Bacillus thuringiensis
  unsure (1)...(297): unsure at all n locations
aaccccagaacccaaagatggganggtcctttttgaagtggcataggcctcacctctccatgtatatctactatatagtaagaaaaaaaaggcgcatggatcgcctattttcagacgatacatgcaccttttcttctgctatatgcatacagtcagattcccacctacaattcactgaatacgaagtaactaataacgtgatgtaacaccccaccgcttacagtacccgctttattatgcaaaaacaggtttgtgtataaaatataatcgtatacaccaacaccctaatcctgtaaa

SEQ ID NO: 4067 - DNA, 270 bp, Bacillus thuringiensis
ttaaacatggaaatccattttctttttgaacggtgctagagagccattctaataaatggggtcaagaagaaaaaggggctctacaagataaaacaaacccgctatgtgaaaacaaagctcgtatgcacctagagtagggagaatatgaagccactggacagtcaaaaacacgaacaccgacgggggaaaatactagtccaattattaaaaaggatgcgtcaggtgatattacatgcgtaaaagcggggagcgggatgaaataattaaaag

SEQ ID NO: 4068 - DNA, 512 bp, Bacillus thuringiensis
aaaaggaaccgatgaattttttgtgttgtacgaggctggatacccagggggaaggtggacgctatgatgggaagagaataaccacttatatagaacagcctctacgagagaacacggtaaacggtaatatcatgtgttacaccaaaacacaccatcttgtataacacaatatggagaacagctatgtacgcataaaggatgtttagaagatacagtaggtgttatgacacaggtagttgtggagtgagaattggttacaataaaagaaggcgtcataattagggtagacaaaaaacaaacgcgttgtataattgaatggaatacatatcgtgagaaagtgttccactgaccagtagaagaagagttgggtcatagcacatatgagcagctatgtacatggttttgaacgagtggtaatcataaaagaatagaacacttaggctgcaggaattggatgtacaaacctgtttagatctaaggaggattcagatatatgtatttcaagcaacata

SEQ ID NO: 4069 - DNA, 234 bp, Bacillus thuringiensis
atgcaatcactgcaaatgggttgggtggtaatgatgacgggctccatactacactgtcacgcgcctctctggcggacagagtgggcgactacatagtggcgcatccaccaatcgtacacgttttcttgccggtcttaatccaacaccaagaaattgcagcctacgctatcttaagaccacacgcgtggtggccccagatagtggcctgtgctttctatagatgtacctaaaagg

SEQ ID NO: 4070 - DNA, 276 bp, Bacillus thuringiensis
aattaataatttcctcattctaccccttcaataaaaactaattcaattaataaaaatccaaaaattgaaggcttttattaaccctgcgccaaaaaacccatcataaaatcctatcattaaaatatcaaataaaaacatcaatcaacctcttttcctcatcctcttatacaattacacacttccccaaaaccctttctccatactataaataacacttactaccaacattaccattactaatacccctaaaatatcctcttcaataaattttactac

SEQ ID NO: 4071 - DNA, 222 bp, Bacillus thuringiensis
tttttattcacatttttatcacaccgatcacctaacataccaaggttgcattttaacacaccaggggtcccccaccccacatatagagctttatacaactaacatggatttatctgcataatcctaactatatcaagtcctttatgattataatattccatattaatcatatgggactttaattgaatctataaaaactattcttaaaaaatatattaaact

SEQ ID NO: 4072 - DNA, 333 bp, Bacillus thuringiensis
cgtgtttttccgcctctaacctcatcaatacaagtgattgttcggcatgacgccaagatatggatatcatgacagaagacaccgtgagtgtcatgtgatgccaaccagcagggacgaagtttattcgttcttttcatcactaatactggattccacccagaacatgagtgcggcatgcgtgttatcgagctatagctattgggagccagctcatagctagacctgagaaagaggctagcggttcatattgtcatagggttagaacgacacgacaatacactccattcgaaccatgtggatctggtgttgagctcagcggcgcccactgagtga

SEQ ID NO: 4073 - DNA, 163 bp, Bacillus thuringiensis
  unsure (1)...(163): unsure at all n locations
cccaaccagaaatctagattaaattccgcacataacttttgcttttaaacactgncacaaacaaacaagggaccttacaacaaaaaatatgctgtcacccctctaacccatcaaacaaaagacgaagatctttcagcactggatcacaataaaactctgaaaa

SEQ ID NO: 4074 - DNA, 206 bp, Bacillus thuringiensis
  unsure (1)...(206): unsure at all n locations
ccccaacaaacagggggatanaaaagaaaaaatagtagaaacgaatatgtagcaaacatagaaaagctggaaagggaaaagagaacaaaaccagatgagaaaacgagcagaataaggggaacgcacaaagaaacaaaaacaagtggcaaaaaaagaggcaaatctaacactacaaagagaaataaggaacgtgagaaaaaaaaaac

SEQ ID NO: 4075 - DNA, 148 bp, Bacillus thuringiensis
ttttttgtctccagcatatcacacatacaggggggccatttaaacaagcggggggataactatcaacattaacatcacttgattcggtaatccttcatctctctttcttctcaatattgtatttcatcatgctctctgtcctgatccc

SEQ ID NO: 4076 - DNA, 286 bp, Bacillus thuringiensis
atagggcaccaccacataaactatgtctaccatctgccactgacgccggtattatgtactaaaaacgtatttaaatggtcttatgcgtgccacaatatatttgggaaaatttgacacacttctagctcaagcaggcatatcacattgaatggtgcctatctaataagacaaatttgactttatcataagatctagttattaataagtagaaatttacaacattgtaaaacagtatgcacataagaatctgcgtttcctcactcaacatgacacttggctaagagcg

SEQ ID NO: 4077 - DNA, 357 bp, Bacillus thuringiensis
ttttgtttatcatgacgtcagttatactggggatttaattaatgtgcatgaggtacttctagcttaactttgtgagccaatggttcgtcgccagatggtctttagcacacaggacgtccaatgaatcctggtttaattaattttcactacgtctaacagaattggtgccattcattgccagccgcgcataatacgaagttcttcttgaaccctaatgataccttataagctctaaaagcgtattaataatggattgaactcttctctagcaggtaaaggggacatttgctcaatacgaacgacatgaaactatgccaaacctgctctcatgcctaccagtacctgatttcactgcta

SEQ ID NO: 4078 - DNA, 347 bp, Bacillus thuringiensis
ttttttaatatgccgatgccaatgtatgagggcgcgtatcaatacggggggcgggctgtatcatagcagggacaaaccaagaatatctcactacttcttcaggtgaagaacagaatagcgggtatcggtgaccatacgggctcacagatcggttgtatgctgtccgtgtaccgataccgacagcttatgcttagggtcgtaccgatatagagtatgatgctgtctcatcaacgttgacgtgcaagcgccaccatgtttgcctgaaaggatttcatatgtcgtgatgacaatagtaccagtgcagaccgtaccaacaggtgacagcccttcggaggacgcttctgcaa

SEQ ID NO: 4079 - DNA, 131 bp, Bacillus thuringiensis
ttcgtgatgcgaaccaggacctacgaaagttatttcccctatctttttttacatgacctaaaaacagggcagtatcggggggtatttgagtggaagatccaagccccctcatcgatacttgccgatacagg

SEQ ID NO: 4080 - DNA, 100 bp, Bacillus thuringiensis
ccactttatatccaatctggaggcataaagtgtggggggggttttgacaaacgagtgggctcaatcacactaattgcgtatactctcactgtccgctttc

SEQ ID NO: 4081 - DNA, 144 bp, Bacillus thuringiensis
caacacaactcgttatctggcggcgtatccaattacggggcggtctttaaaggagaggggggactaacatcaatagacatgctcctactcgtatgggtattccgtgaaaaacctgcacttgccggatcatttatttaatcgttc

SEQ ID NO: 4082 - DNA, 137 bp, Bacillus thuringiensis
ccacacatcttcttacccacccgcataaagctcaaaggggggccttttaaaaaatttggctcacaaacattaattgccttaccctaactattctcctttcacactaaaaacaacgtttcccatctgcttcaataaat

SEQ ID NO: 4083 - DNA, 145 bp, Bacillus thuringiensis
catcacgatatttaccaccctggcgtatttcatgatgggggggttttgtcagaagaggcgaggaagacagcaacggagttacactaactgtccgctctccagtcgtacaacctgcctatccaatctgcatcatatgaatcaggtc

SEQ ID NO: 4084 - DNA, 112 bp, Bacillus thuringiensis
caacacatttttctaactggcggcataaagcacgatgggggggttttctaatgattgggctgactcacatcaatcgactagccctaactgttcgcttttcagacgtacaaca

SEQ ID NO: 4085 - DNA, 120 bp, Bacillus thuringiensis
ccacacgtttctctacccggcggcaaaccgggcgaggggggggctttaaaaaaacgggggtcactcacagcaaggcggttgccatatcggcccgccttccagtcgcacaaccactgtctc

SEQ ID NO: 4086 - DNA, 158 bp, Bacillus thuringiensis
ccactttttattctatccggacgcataaagtgtggggggttttttgaaaaatgagggggctcactaacatcaatcgcgttacacaaactgtccgctttccagacggaaaacctgtcgacccacctatattaatgaatcgcccaactctccgctagagg

SEQ ID NO: 4087 - DNA, 194 bp, Bacillus thuringiensis
caacccctcctcttcactttcgaaaaagctcaacccgagggggggttctcataatgggggagacaaatagcaattaccattcaggactatttcaattttatgcctaagatcaattgattcaatacgcgtcatagtaaaggctaagacacacgaatgagcagaaccacaagtgagagtgcctataacaactattc

SEQ ID NO: 4088 - DNA, 411 bp, Bacillus thuringiensis
gtttctaacagacacccggaaccttctccgggggggtattttcagcttggggggattccaaaccgggtaaaacctcttcctctttcaggcatactcaccctgcacctgccacaagtggattcattatatacataccttacatcattttgtacacctaatcgctcaacactaaaaatatactcattttaacacatcgcatatttaccgtaataatggcacgatttccattctcagactacaaagtcccacgtgatttatacataccttaatcccaggggactggttcgtaatccattccgaatagtactatctgaaacatattcttggaaacttctaccaaaatccacatactagtcacttgcaacctaccttacaatattactaccaccatggaacccatactgaaaacaa

SEQ ID NO: 4089 - DNA, 407 bp, Bacillus thuringiensis
acgtatcgctgcggaattcgtgatttactataacctccttctgataggcgttttacgacgcgcttacctaattcttagagtgacgctttttaagctgctgggactacgatacgggattgaccaatgaaaagcgaaagttcatacacggagaacagctaatatgtcgcgtgaagatcgaaaattcatacacaattttcttgagacgataggattattcaaagatcggtaatttcctaacaatcaataaataacatcttataacgtcacgagtgccatacgtaggcaatcatcactaacgtaatgtggacacaggaaatatgctctgcttgtggttctaaatcacacgggttgcctgcatccgcaatgctcgtgaatgacagggctgtcacattctcatcttaagcact

SEQ ID NO: 4090 - DNA, 130 bp, Bacillus thuringiensis
ctttttttttactgcctctctagaaggagaatccgggggtgattaaaaggcctttgcttcactaaaacacgggatcaatccactcgaagtgccactgtcatactgctcacggcatgacacagctcataca

SEQ ID NO: 4091 - DNA, 329 bp, Bacillus thuringiensis
ctacttgttttattgaacttacataactatcaggggggggcgcatatattcataaagggcacacattaggatctggtgcttatgcctaaacaagtacactcgtcgcacgagcaaatgcaagacgtaacgatcaagatgctccactgacgagcgaaaagcctcatttggcagcatcacaatgctgtgagacaacacgtacgttcgttgccaaaagcatgtcacgttcactaccaacttatcactcgaacgcacaaaggctttagacaagtcctgcggtgaatgaagatctagcgtacaccccaaattgaccgattgctaccccgtacgtt

SEQ ID NO: 4092 - DNA, 263 bp, Bacillus thuringiensis
caagttttttggctacccatcccgaaacaaattgggggatcacatacactccccgagggcacacaatgcgatgcctgagcaaggcccaagcctgtttcactagatcggaaacagccgaccacagggcaatgataacgatagctaactatctcattaaaagccgacgttagtatcatagcaactcagcgccgcacacttgacccctcataccatccaacttgctgtatccctttcagtgccaaaccggtttacccacagctatg

SEQ ID NO: 4093 - DNA, 251 bp, Bacillus thuringiensis
ctttttacaacatgatattattatcatacatatcattctatttatttgcattattattttaaaaatccaatattctacctgttgctacatgtaagcatgtatacttaggattcctttctatacacttaataaatacttgacccacagttttttattccatataaagccacctaaaaacacattcctatatatcattttaagaaaattgcataatgatcaccatttatatccacaacattaatcactttttg

SEQ ID NO: 4094 - DNA, 224 bp, Bacillus thuringiensis
ctcacgtcttggcctaacggaggtaaacatacgtggtgatttgaaccaacggggggttacaacacgaatccttcttgcaaacgtacaatatgatactcttcccctagttgaggattgggactggttgagggtctccggttctcgctcaaccgggaaaaacgggcttttatagctcaaggacccagtttatccttcggcacctgggtaggcgctaacataaggta

SEQ ID NO: 4095 - DNA, 142 bp, Bacillus thuringiensis
caacaccacatccttatctcccctcatacacaaagtagggggggtttaaaaacgtgtcggttgtctcacatcaactgatcacattcaaactatccaccctccagactttcctcaacctctcgcgcctacatcaaaaaataga

SEQ ID NO: 4096 - DNA, 214 bp, Bacillus thuringiensis
caacacaattctttaactgccggcataaagtgcgaaggggggggtgacgaatgagggggctcactaacatcaatggcgtagggctaactgtccgctttccagacggaaaacctgcttagccaactatatcaatgaattgtccatctctcaccgagaggcggcgtgcctagagagcgctcttgctcctgtctcgattcactgactacggtgcgct

SEQ ID NO: 4097 - DNA, 134 bp, Bacillus thuringiensis
ccacacagctctcaatccgccggcataacgcgcaagggggggtttttcaaaagagtggccttactcacatcaatggagcatccataactgtccgacttccactcggaaaccctcgccacccacctaaatcaatg

SEQ ID NO: 4098 - DNA, 145 bp, Bacillus thuringiensis
ccacttttttttctatccgcacacatacacgagcgggggagtttttttgataatgtggtgtttaacacacatcaattgtgttagctcacactatccactttaccagacgaaaaacctgcttacccaactgcatcatagaattggc

SEQ ID NO: 4099 - DNA, 133 bp, Bacillus thuringiensis
cctcacgttatgttatccataggattacacagcttaggggggtattttgaatgatgggcttttacaataacaatcgtattcacatgactacctaccatcctcacttacatgatcgctaacctactatttctat

SEQ ID NO: 4100 - DNA, 117 bp, Bacillus thuringiensis
ccacacattttattatccggtggcataaagtgtgtagggggggttgttaaaagagtgggctaattaacatcaatcgcgttgcactaactgtccagctttccagacggaaaaccttgc

SEQ ID NO: 4101 - DNA, 111 bp, Bacillus thuringiensis
ccacacattttcttaaccggacgcattaagcgtaagggggggcattattaatgactgtgctttctcacactattcgccctgttcacactgcccgacttccagtctaaaaac

SEQ ID NO: 4102 - DNA, 131 bp, Bacillus thuringiensis
ccacacatcatactacccagaggcataatgagtggggggttttttaaacaatttgggggttcactcacatcaatccttttactctcactatccgctttccagacaaaaaacctgtcgacccaactacaaca

SEQ ID NO: 4103 - DNA, 114 bp, Bacillus thuringiensis
caacactatacttctaactggaggcataaagagcataggggggtttttttaaagagtgggcttactaacatcaattgatttactataactgtccgctttcctatcttaaaacct

SEQ ID NO: 4104 - DNA, 159 bp, Bacillus thuringiensis
cttcacattattttagctggaggcataacctgtgacggggcggttttaaaatatgtgggggcattcacattaacggtcttggacagactgttcagtatactgactaaaacccagtaaatgcatctgcatcaatctactgtacacctcgcacgggagagg

SEQ ID NO: 4105 - DNA, 115 bp, Bacillus thuringiensis
ccacacagtactttatctgccggcgtaccccatgacgggggggttatcaaatgactggcgttactaacatcaattgccttacaccaactgtccagtctactcacacgaaaaacct

SEQ ID NO: 4106 - DNA, 142 bp, Bacillus thuringiensis
caacacatctttttaactgctggcataaagcgcgaaggggggggtttcaaaagagtggggttactaacatcaattgagttgctcaaactgtccgccttccagacgaaaaacctgtagagccaactatatcaatgaatgggcc

SEQ ID NO: 4107 - DNA, 138 bp, Bacillus thuringiensis
caacacatttcattatctggcggcataatgcgcgaagggggggtttttaaatgagtggggtttttaacagcaatggcgtatgcgcaaacggtccgccttccagtcgtaaaacctgtttatccatctgtattaatgtat

SEQ ID NO: 4108 - DNA, 100 bp, Bacillus thuringiensis
ccacactcttacaacccacacgcataaactgcggggggtcttttaactaatgacggggcttacacacaccaatccccatgccctcactgtcctctttcca

SEQ ID NO: 4109 - DNA, 121 bp, Bacillus thuringiensis
ctacattttttactatccagtcacataaatcgaggggggccttttaaaaaatttggggctacaaacacatcaatcgacctacccacactgtccgattaccagacgaaaaatcagcatatcc

SEQ ID NO: 4110 - DNA, 144 bp, Bacillus thuringiensis
ccactttttttccaatccacaggcataaagcgcgggggatcttttaaactcatttgtggcctcactaacatcaatcgctttgccctaactgtccattttccagacgtaaaacaatcatacccaacttgtaccaatgaagcaggc

SEQ ID NO: 4111 - DNA, 340 bp, Bacillus thuringiensis
gtctactgggttagcagctagaatgcctacgcacacgatgcactctttctctaaaggagttgttagaccgtttggggcataagtaccactaaaaggaagatgatcaaacaaccgttcttgcatagaaatatagaccgctgcctagatcttcatgtggccaattcacatactcatgaaccattacagtggttacacggtgagtctcaggttcattatttcgcaacgagaaataaatgcctaatggagagcgttctgtctccattcctcgagatggttttcctcttgaaacaacatcttgttcaattaatgtaagctcttgataggagtagttcttatggag

SEQ ID NO: 4112 - DNA, 506 bp, Bacillus thuringiensis
agccaaggaatgatcgccgatcttacttgagagtattgcgaccatggcaacataggcaattctttcaccaataacgtgggcagaacctattggagactgtcaagacatccggttcctcaaaggattgctggaaggacatttaacgtttgaggctatgggtcctctcgtactatcaccagtggacgataatgcaataaatgacaacggtataccagataagcaatctgtaggacattatacacatcgtgtgcggcagtatcgctgcactattgctaacactcgtttatatcttactgggttatattcgatcttgatacggcaaggtacggctatattagcaccgtggtctactattacccactggtatctatcaatacttggacacgtgcggacacgctataataagtatcgcgatcatcttcgcttgcgaaacatcggttgatggcgttgtctgtgcttctgcacattacttcacatcattgctcacctgcatgactacatacagc

SEQ ID NO: 4113 - DNA, 254 bp, Bacillus thuringiensis
tctttctcttcatgaacgatacgaaagttcacatgattgttacagctttccaggtaataaaaaccggtcgtgggattttcatttataaacgcactccgcactaagaaaaacccaaactaaccatacaaacttttcgatcaactgctgtgtatgcaagattcgaaatccctgacgctatgcacatcgcaaaggcacttacaacaccacttgtcgttgatcaacatgcaaccatagtggctatactcattgaaaca

SEQ ID NO: 4114 - DNA, 306 bp, Bacillus thuringiensis
tcactgattgtccgctagattgattatgcgtgatctgagttttttttacaacagcgactccccaatcattgggcttttgatgtgatagagcttatttcggtgcctctaaagctcaatattcacgttcagctaaaggactattctcacgtgttacaaacctgctcttgaaaagttattcgataaaatgggtctaaaacatctgctggcttggcacttacgtcatttcgttgatgaacaacaccttgtctatctggtctatcgtggacctcgcatgaatccacaatgcccattgcacttaaggcaaat

SEQ ID NO: 4115 - DNA, 120 bp, Bacillus thuringiensis
ccccccgccaccaccaagcacagaggggatcccatttgcagcttttgcggagaacccccccgacgctattttcccactactacatggaccaaacggtgaacctcgaacggcccaaggacc

SEQ ID NO: 4116 - DNA, 120 bp, Bacillus thuringiensis
cattgtggaaaggccgaaataaaaaacccaacaccaaacaagcaaagacggggagaaaattaagaaaccagaacgggtaattcccaaaaacccaaaaaataaacaaaacaaatacgcaag

SEQ ID NO: 4117 - DNA, 247 bp, Bacillus thuringiensis
ccatccgctattggcctttggccttgattttcatataccttctatctttccaagggggggctgattagataagatagtgaacgttacgagcaagttgtattcctccacaaccagacgggcggtttaaagacacactacagtgcccatgcataccctgagtaaacgaggaaccaatactgcggcagcaacaagcatgttgtccattgtccctaaagcacatacaatcactaagagggggctcatctta

SEQ ID NO: 4118 - DNA, 308 bp, Bacillus thuringiensis
tgtctacaagaaaaaagtacaaaaagctagggggtctttttcaagaatgagggcttttcacacgaaaaagcatcaaaagatggcatttattacattctgcgttcaataagatcacaatggaagcggccctcttcccagtaacttatatacgtttatccaattttcagccagtatgttcaatcgttctaaatgacagtactcttgatcacaatcgggcattatccgctttggctcgttgagatgctatatagaaacttaactgctgacgtttacgaaaagatggatgcctctattactctcctttaatt

SEQ ID NO: 4119 - DNA, 138 bp, Bacillus thuringiensis
ccacgagatgcgatagtgaaacgacgagttcgctaaagaagcagacgaatttgttttatctcacgatgaataaaaagcaaaacgggggacaaacttataagaccgcagatagcactaaaccacacacgtgggggcccc

SEQ ID NO: 4120 - DNA, 327 bp, Bacillus thuringiensis
ttctggaaatgcacgagatacggtgacactgattgcgtagttttttaatgaggttcgcatctggtgactactcttaattattggaattcgagcattgagatgattgtgagacatcaacaagctcctaatccacatttgcgacacacatacatcgattgatatgtctagtacgggaattcttacagtcccgacattactgacttgaatattaatgaccttcacggatgttgcacttctgattggatcaagacacaacgtgcctgtgcttcatatgccattaagaggtgagatgcaacgtgtgcaacaagtgcatctagaagggaaact

SEQ ID NO: 4121 - DNA, 292 bp, Bacillus thuringiensis
gccttgaagaccttgaggttccggaggtccttccagtccttgcatccctggcacacctagaaatcctaccggtccttcccgcccttgcgggccctgaatcccttgctcacctcgaggtacttcccgaacttctggtcctagctgctgctgacactgttgtacaccttgcgaaccctgagcgcactctatgaccaagatatcctggttgtccagtggcatcagcctgccacccgattgcgatgaaccttgtaccggactatctaagactacgtgctgaactatctgaatgttt

SEQ ID NO: 4122 - DNA, 256 bp, Bacillus thuringiensis
gctttttcgttactaacgttactaaagtacaaatggttgttgttgatctcgagcgaataaaaacccgtcgtgtgactttcgttcataaagacactccgcacttagatgaccccaaactactgacgcaaacgtttcgcccaaccgctgtttatgcaagcgtagacattgctgacgctaagctcatcgcagatgcacttactacactagtcgacgttgttctacatgcaaccagactggctatgcacaaggaaacttt

SEQ ID NO: 4123 - DNA, 410 bp, Bacillus thuringiensis
tgtaatagggtgtccaactttggctgtgtcacaaacacataaccgaatcagtgccatcatttgctatacgaagagattctgaaagaggacattctgcactagaaaataaccaattgtatttcataaattattgacgatggattttacttgaagctggggtggatacagtagaaactgcagttgaattaccttgccgttattagatcaccgttgtgcctgcgccgcataactgctcggatcacgccgttttggtccctctttagaaaataggaagctgatgtctgctcttgctaatcgcgtgtgtaatattatatatatatggtgaatttcggttcatgatctccgtaaggataagatctatgtagaatcctcggcatacttgtcgttttggacataacgacgacggtctc

SEQ ID NO: 4124 - DNA, 261 bp, Bacillus thuringiensis
tacctaacaatagtcgattctgcatccgattgcacatgtgctttttgatcgcgcacaccccttgctaacactcttttttttatgccagagagtataatgagagtgtagaattacccaaccgacttgcatttcagatgaatatcactttgcgtctacaccatgggctgcaacatggtagtttagaatgcgtccatcatccatacgcacgttatacagacgttagttgccagatgagcaataacttatttgaacggacaattg

SEQ ID NO: 4125 - DNA, 180 bp, Bacillus thuringiensis
ggcctgccagtacttttccaactggctgtagtgaacgaccacagatagctcactattggtatcactgctaatcactgagatacgacatagcgtatgacccatgacgggatcctaacgtctcgtatatggaggcacacgatagctggctcgtatgttaggacatatcatgtgactgcgtga

SEQ ID NO: 4126 - DNA, 235 bp, Bacillus thuringiensis
cctcaagcagctcgacgactaaatcacacttttgtgtatcgaactgtcggccatactacggggggttttctaaaataaagcttggcgtgtgaccacccatgaacaacagatgagcccggatatataaacgaacatgatgtaaggaacaagaaatgacaagccccgacacgagttaaccaaataaggcaagatcaactcccaaaaaaccttttttataggagtccacaaaaaagga

SEQ ID NO: 4127 - DNA, 389 bp, Bacillus thuringiensis
agcttgtcacaattcatatcactttctagtatggagtgcctttacagaagggcggggtattaaatgaagaacgtgcgcaaactgaagcatggtatagacctaagcactgaacaaattgacacgatatatatattgatgagtaaaaatattggttagttttaccgaacatccacactgcaaaacacactggaaaatttatgctccacctttaagagactgattgagatgtaggaattgtttaccgtttaccgtttaactattaacttaaagaggcactttctaatttagccctaagacaaactaatttgactaacgaattacaggtgcatttgttaaggggattcatgtttctaacatagctttaaaacatagagaaaacttctaatcta

SEQ ID NO: 4128 - DNA, 270 bp, Bacillus thuringiensis
gaaaattattttcattatttacacgagcaaggatgggggattttttaacatggtcggcggtatgcaacaatatgaaggtgaaacgaagtactatatggtttacaacttgaaacgagttttttacaagatggttcgcttttgcatacagcatataaaaggaggatcggagacgatgggaaatcacttgcaatcgagttggaattttatatgctacacgagctgttactgttggcaagtgatttaatctatactcttttgctgtagcaaagg

SEQ ID NO: 4129 - DNA, 307 bp, Bacillus thuringiensis
  unsure (1)...(307): unsure at all n locations
ccaattcatatatatctttatctaaatagaacatatcttacaccccttgtttattttaaaanatggggctttcaaaccccnaactaataacctccactcccttaaaagacatacaaataatcaccaaagctcatcaacctccaactcattcataaactacttattctacataaactccactctttcttactacttccaaacttcanttatatacttcacaacactctatctacaaatattactttctcataaaaacancttccctttcatttataacttcaatccccntccctaaaaacctacctta

SEQ ID NO: 4130 - DNA, 439 bp, Bacillus thuringiensis
accaatacatatatatacttttttatacttctttccaatctaactcatcggataattttaacaatatcagtgggcatcaaaagaaaacattctaataaccattaattgatctacacaatcaatatatgcaccaaccaatggccatactttctttaactttatatcagaacgaacatgctattatagaaaactatttaacaaaactttatcttattgagaaggaaccatcattacgtttaactcactactatattctaaaacaaaatcatgcgtcattaacacatcttttttcgctaacaattctactaagctttcttatttatcaatttcatgctcccttacaaatttgttaaattaacaagctgactaatcataatttttcatacaaaaacacacaatttttaaattttataacccccgctataatttttcattccga

SEQ ID NO: 4131 - DNA, 381 bp, Bacillus thuringiensis
gaaactttaatcagtaagattttttgttcattgtgcgactgattagtagtcagcaccaatcggactacctgcaaatagcgggataaattcacagctgttgacctatagaatataagataaaataaaatattgcagagaggtgaaatacatggataaagaattagcaaatacaattttagatcagctaaaaaatggtgaaataaaggagtatgttgttacaaaagatgtattctatactggcagagaagtagttgcaaatagagaagactttaagcattggattggtaacgcacagcgaggcgggcaagtgatttatacatattcagaagcgccacgttcataaaggagaattttgatcagcagggcgtctatcactgatta

SEQ ID NO: 4132 - DNA, 399 bp, Bacillus thuringiensis
acgcgatctgaatccacatcaatgccaaaaacatttttctccctagtgaccacagcacccccggtgtgtaaatgaacaaatggcgggtttacaacgaagactacaacgaactgactccaccctagccacacgaacatatcgccctgaggcgccatttaaactaactagcgaactgtttctcacacgcacacaaccacaaacaaaccacgatcatgcccgaggagcctcatcagatcacgtagaccccgataacactagctcgaacatcacttcattcattgccattgcaccagatgaaatagtaacaagtgcaacacacacactccctgaaccggttcaaccatcaccaagcttgcttgaaccaaactctcccgcaaccgatacatcagtagcggaaac

SEQ ID NO: 4133 - DNA, 581 bp, Bacillus thuringiensis
atattggcaaatacttcgtaatggcatctttaatagctgtcggtcctgatttgttttgggggaaatgcatataggaaagcataatccaaattagatttgcccagatcagtatatttacacctaaaacagctagtctattaggtgtagtcccgtaagatgaaagtctaaatacgatggctgacaatgcgacagtgtcaataataagcgccagaacaattaaggaaacatttatataatctgaaatgttctttttctcgtccgagtcactctcaacgatagaaaatatagtaacagccaatacaccaagcagtattccgttgaatgccattaggaaattacgatccaagaacgggtttttcccgaccaaaattatcgttataagataaataaacaatgtgaccagtacaagcggactaaagattttagatatgtatggtgttatatttatagcaagcttaagattcattgatactaagcatgcagccacaatagcgagagccgctgctccaaataaaacaacattactataatagaattctgctatatctaagtcaacgaagctaaataaacgcatggtgaat

SEQ ID NO: 4134 - DNA, 148 bp, Bacillus thuringiensis
aaagttttttttgcgcagagagcgcgctaactcagcggggactgctatggcgctccctgtccgacattcacacgcccgtgaaacattgtccgcgccacactgcatgaatgaagctagtcacctctcaggcaggggctgactgtgacta

SEQ ID NO: 4135 - DNA, 119 bp, Bacillus thuringiensis
ccccaacggagcaccagccggtgtactctctaaaaaaaacaggcggtaacccaccccaaggaacacaaccaaacggaaccgccccacgacaaagcgaaccccccaccaaaaacaacccc

SEQ ID NO: 4136 - DNA, 460 bp, Bacillus thuringiensis
cgtgtttttacctatcagtgacacctgactaacgatgggctaagtgtaacccatcatgatgagctcttatgctacatatgggtgctatcgtatgtacatgggctgttaccatcccgagcctatatggatgcaatgtatcatacgaccacgtgtaatctagaacacctatgaatgtcccagcatctttacgaatggatggagccgctcacctactactattagatgccacggtgtaaagtccaaacccacttatcatattagctgcatcaattactagcgctgaacctatctgattttgtgccaacagctgattccgtacatattacaccttcgataaaattaaatgattggctcgctttaacggttgcgaattcacagtcaacgttagatcacaacgctatggaccgattaacgacggcatcatctgtagtacatcacggagcatgctcatattacgtat

SEQ ID NO: 4137 - DNA, 379 bp, Bacillus thuringiensis
gtcattggaacatcaagctcaggctaaatttatagggaactgtaccaacggataaagccgagcatttaaaagagcgctggtttttcagatgctcaggaactcagcttgcagagggtgtcaaaaaacggcgcggctatgctatctctgaatgcatacacgcaagagaagtacatgggtgagcacctcagtacagacaccccgctggtattaaaggagaaaacgaagcgctcctacaagtagtgcatccccaagaggggaatgagctacaccattgtatacggggccagtgtgtacatcaggggcgaaaaattacagcatctcgagaaccatccggagagccacgtgcccaacgttgttaatgatgacactggtagggagg

SEQ ID NO: 4138 - DNA, 338 bp, Bacillus thuringiensis
tttattattgaagctctctcatttttaataggaggggttattttaaatagaacgctggtactccaaaaagaaagtcatccacatatcttacatattagagccttctataataagcatgcattggattattataaggtgtctgtcacaacttccctaataatactttttgatgttctcttagtgccgtaattaaacgtacttctcgatttagataagcagtgtcgaaactaccttgaaaatttcacctcttgataccgtaaattactatactctatataaatttgtcaatgtcgccctgattcaaacctataccgatacttttttatttacacatctaa

SEQ ID NO: 4139 - DNA, 224 bp, Bacillus thuringiensis
aaaccaagaatatcaacctttattaaatcaaccaactaaactaattgccacactgaacacaattaaagatggaaaatgtgaatcaatatcgataaactatatactgcttcactaacaccaacacgtggaagaaatgctaaactacctcagatcatggcatatataaatcttgatgtaaaaatgcctaaagcactacttcttgcatgccgacaagcaccaaatcc

SEQ ID NO: 4140 - DNA, 129 bp, Bacillus thuringiensis
ccactcatcattctacccggacgcttaaactgtggggggttttttaaaaaatgtttgttctaacacacaccaatccctctactctcactatcctccttccatacgaaaaacctgccttcccacctacaa

SEQ ID NO: 4141 - DNA, 168 bp, Bacillus thuringiensis
taatactctgggtgacccagaactgcttactttacactcacatggctcacctgcgaaggggccattaccaacggagaacaggccactctttgacttactggtacagacattctctaattgaacacgcaacaatggacacgccaaagcttaccacggactatggagaac

SEQ ID NO: 4142 - DNA, 128 bp, Bacillus thuringiensis
tttcttataatgatatgtggtacaagcagggtgggaaatttaaataagtggggggaatataataaccccctgcttggaatgcaaccatctgccctattaccaccattaatggaaccaatatttacacc

SEQ ID NO: 4143 - DNA, 154 bp, Bacillus thuringiensis
catactcttctattccgattacaatcaaccgtaaatggggggggttaaataaaacaggggctggatacacctaattttctagaactcctcttttctcaaagcccaattctaataatcccttgcttcgcaagccttcatttcttcaccaaactaa

SEQ ID NO: 4144 - DNA, 113 bp, Bacillus thuringiensis
tcgatcgatcgggttcggtagagatgtctttattcaatacatctccttatctatcattcattggattgtggacacatattatttacgggaatggatttggtggaatttctagg

SEQ ID NO: 4145 - DNA, 125 bp, Bacillus thuringiensis
tttattttgatgctgaggaagatgatgcagggtgggttattaaaaaccagagggagacaatcgttacccgaacgaatactaattgtaatctatatactaaaatacaacatggacatggccaaact

SEQ ID NO: 4146 - DNA, 217 bp, Bacillus thuringiensis
ctgcagacgtcgtacgtaatcgggtgcgggaattcgtgaccaggatttacaggatctacaacggttgttttgataccacaaacaggaccgatcgggggggttttttaggccatggggggactggaaaaatcacctcaagggcaagcgctccatctgtcaggcgcaaaacctcaccagggatgagatgactactttcttcctctatctgattccccat

SEQ ID NO: 4147 - DNA, 190 bp, Bacillus thuringiensis
tatcaatagaccatccaataatcgtggcttcattgtacacctttccactgtagtacatttggattacggacaacaattgtgggcgaagttcatcacataaatgaactactagagatcggctagcatcaaaccttcttaagtcacactcagaaataccgcccgatgacattacaatgtgattcataccctt

SEQ ID NO: 4148 - DNA, 243 bp, Bacillus thuringiensis
aatccaatggcatcaaatggattgctttggatcagaacggaatgtaaaggaactggctcgggataaatgaactagattgggatgaataccaatggaaggcataggaatggaaactattggaaaggactgtcatggaatggaatggaacggactggaacggactcaaatggaatggactgcaatagaaaggattcgaacggcatgaaaaagaattgaatggaatagaccagaatggaatcaaat

SEQ ID NO: 4149 - DNA, 121 bp, Bacillus thuringiensis
ccccttgaagtttatgctttgagggtttttatcgtttttaatgtgtataattaaacggggggtgctttgatataatgaggattttacaaccatgctacatatttgtaatgatagttcaaac

SEQ ID NO: 4150 - DNA, 410 bp, Bacillus thuringiensis
ttttttttacaccgagttcaataaacccatggagggcttattaaagaggacgggggcttgatacatatcgctctttgggacgactgctttattagaagcctaaggtcaataggacctgcttggaagcgatactgttgataacgacaatggctcccttccgcttgaagacgaaacgtgtgggaaccgtatgagattaactcagaaacagattcagtggcatatccggtgccccagctgtcaggcacaaagggcttgcttatatagaatagtgtatgctcagcagaccggtcgtgagaaccaaaggcaccaaagagttgtttcctgtctttggatttgaactcccagtatataccggtttgtgcattgaacctcaccctaaaactgtgagtgctctggtttactagaacaat

SEQ ID NO: 4151 - DNA, 174 bp, Bacillus thuringiensis
tagatcatgcggggtttgaacagatttcttagcattaagaggggacacctgcgagggggactttacgaacgagcgcggggctttttgggttgactggtagcagtgaatctctgattggacacatatcatagagcatccggattctcacctcgtgctttgggagcttttgcgctc

SEQ ID NO: 4152 - DNA, 212 bp, Bacillus thuringiensis
gcagatgtagcgtatattagacgaaaacctgtaataacggccatttatggggggtggcttgcagcgtggacagcaagaattccagcgatcactaactgaaatgctgatattctttaacggacgttgcaacttgtctgacgtacctgatgacctgttcctggtgttgcttctattagctctctaaagcacatacctggatgggtatgtacatg

SEQ ID NO: 4153 - DNA, 316 bp, Bacillus thuringiensis
acgcgtattgatgggatcctcaattcgtgattcatacccttcatacagaacagtatgcccataagtgattgttgaaaaatggggacaagcatatggcggatgcattttctgacgcgccagggggtgtagctgcactcagccccgaggaagaaggccgtctggcaacaaagaagggcaaaaagacgctttcatcgtagctctcgttgattcggccttactcggtgacaactataaccggagcgcctcctagataccgtgctactgacccgacagcggctgtcatggccatcagctgcccaattgtaagtgaccccaa

SEQ ID NO: 4154 - DNA, 141 bp, Bacillus thuringiensis
gcggagaccaatttttacacaactcaggcgtcactcaaataacgggtgccttctggttaggacgcgctttaaactcctttattaaagtccccatctcagccgccgaaactcttacaacggccattttaacgtcttggttat

SEQ ID NO: 4155 - DNA, 339 bp, Bacillus thuringiensis
cagttctttggatctctctaacaaacccaaatataaattgttttaccacaagccatcacaacaatcccgtccctatctgaacaagtatcagtgcgactgttaaaaaatggatcgagtcctttcagcagagtaccgctagaaatacaaataccttagttttctataagagattccagaagaaacttgatactcgaacgacgcttggaaatactccggccactggaaatgctattgtctacaaacgaatcgttattagggtggaaactactgctagtgctttcgagacaaacagtcccctaattattgatacaacgcagatggtcccaaggccttgactac

SEQ ID NO: 4156 - DNA, 371 bp, Bacillus thuringiensis
gacgtaaatcataatataacggtttcgtatcatacgttttaccaccgggcataaccactaaccgattggaatctttatcatgattcactacagctattacagaatggatagagtcctctaagccgcgtaacccttgaaagatagatacctcacctgtctttcactgattccggtgagaacctgatatctaggttacgatacggaaaactcatgccaaacaaaatggtaatttggaaacacgagactgcttccggaatgaaataccaactggtgtatacgatacaaagcaccactttattacgacatagcatgaagatttttcatgtggccacacttcaaaaacaagatccatctgaggtaggaatttttca

SEQ ID NO: 4157 - DNA, 220 bp, Bacillus thuringiensis
ccacacttgatgaaacatgctttatttaagggtcattactgacccctgtttttatgctcaaaaacgaaaatatgtcctttggcttgatttatttgcaattcaaatgcgcctatctgctgatgccccaactgttttcattacctctttctattaaaacgctctattttactgttatatggtacatttttggataaaattctgtcctatgttttgcaacaca

SEQ ID NO: 4158 - DNA, 101 bp, Bacillus thuringiensis
tatttaatgaatgcctcttctcgcgaaatgtcacttgcattttgctgggcgaatgtgcattttgcaaagcgaaaagatgttgttcattcattgatgacatg

SEQ ID NO: 4159 - DNA, 194 bp, Bacillus thuringiensis
ggttggaacgtatttttctgcgaccatcacaaaaatactgaggtttgtctgttactaagaaggctgaagtagtgcgcattctacagccctaggaatgttatagtcattgggatggacatgcaccatatactgcaatggctgccgattgatttggtcggatccacttggtatacggtttggatgccgattcggac

SEQ ID NO: 4160 - DNA, 413 bp, Bacillus thuringiensis
atgagatttatggggtgagctgatcgagggaaaaccttatgagccgatcttatggggagaggtacggaatcggctcgcaacagatccccgaccagtctcttgcctgcatataatctttaacggccggagcatcttgtctaaagtaactgattggatcactatcgcccaactgctattatatatgccaagcactggaaggctgggtgtctacatttatatgagcgatcacgaagaaaaacaagcgccgacttacgtagcacatgcgctagtggcaactctgcctctatagggcctgtgggaggatgcatgatcatacatccgtgttatgtcacgcgaaacagtgtaacacccgaattacgaccactgaaatcatcgatctgatcacccatctaaagatcgatggtcagacattc

SEQ ID NO: 4161 - DNA, 215 bp, Bacillus thuringiensis
atgaccttcatggggtgagctgcttgcgggaaaccctgttgttcagcgcttaaggggagaggctgcacactgttcacagcggaaatacagccatcatttaacctgacagatcatatccattaccgggcgatcaatattgtataatgagaacgggcgaactatcaaaggatagctattattatgccttgagtcaggaaacctcatggccatttcta

SEQ ID NO: 4162 - DNA, 317 bp, Bacillus thuringiensis
gatgactgacgacgagcactgataaggctaagtgctttttcacgggattatcctgctgtgacacctggcgggataacctcaggcgcaagatgcactatactaagtacgacttgagtgagcactcactaatgaccaaaaagcctctcactgatggcttgacctgcagagaattctacaaggcagccatattcatgagtgatatcactggggacgagatgctccatacaacatgggacctgagtctatcgataaaaacctgcatcttatgctacaagaataccacacgcgtggggggcacaactattgccatgggcatg

SEQ ID NO: 4163 - DNA, 318 bp, Bacillus thuringiensis
caaaaatgagtatcatcattggaacgaaaaaatggatttactcgaatcaagaatgcatgattggctgatgctacatcattccaacaaaagcgtaccactatcaaataccagatctgtttgaacatgaagatgagctcaatgatgaactgcaaggactggtactacggggggagctacaagcaaatgaaggatatcttatatgatcacatcgaacgcgacagaccatacactacattccttgagacagtacatgaaaacgtccatcttgtattacgaggattacaactacattgtgtgtacgactattgcgatggtcaa

SEQ ID NO: 4164 - DNA, 208 bp, Bacillus thuringiensis
atcttccattttttttataagaaacccccagtatccataaaggagactgttcaaccttcggggcatgacacttcagatcgcgtcaagcgcctgtgatgctacagtggtcaattttagaatgggtacaacaagacttggttaacgagatgggattatggacctagagctatgtgctttatgcccgctggcaactgcatattatcttgta

SEQ ID NO: 4165 - DNA, 236 bp, Bacillus thuringiensis
cgtgacaaatgacgttaaagcactttgagatcttgatttattcaagcggaaaactttggatcgaaaggagggagcaataaaaggacaggagcgttcgcatggacgctggcaagagtatcggttacacagcgcgtgctctctatacaagctaatcgagctgcgcctctacaaggcgcgtcatgtcgcacactcacgggataggcgcgcgaaacacgcattccgcttatcaaaatatg

SEQ ID NO: 4166 - DNA, 364 bp, Bacillus thuringiensis
gtcttgaaaatagagaaaacatgaggactgccttgttttttactggtcagtaaggctacaagcacgttgtgcaactatattaaaagcctactaaccaatcactacagctagcacaagccgtggctcgcgcccttcaatcaatgtgggagtggttgagctgcgcgcacttgattgccaaccataggtgctgctaccgacatcaaatcgggccgagatcctaccacatatactccatatactagatttggacgaacttctactagtcgaaccgtcgcagagagtacgataacaggaattgcaaacattcgaggatgactcactactgctgtcacacgtgctcattgccaattggactaacccatct

SEQ ID NO: 4167 - DNA, 107 bp, Bacillus thuringiensis
gattttttttagttcttgtattaaatagaaatggggggttgaactaaataaaaggggtcgttataataacggtgcgatttcttctattattaaaacagaacgatgct

SEQ ID NO: 4168 - DNA, 245 bp, Bacillus thuringiensis
tttttaaggagaaccgcgggcaattcataatgagcgtattgagttattgcctttaaatgagggaaggattagggagcatattcatagtgagaaagagctattaatggaagcagacgaaacgtaaagcttcttctcatgacaaatgcacaggccttagttaaacggagatgtacatactggtgctgaaagagcgagggagatctggataactagcgatacaggttaatacaacgaccaaaaaaaag

SEQ ID NO: 4169 - DNA, 142 bp, Bacillus thuringiensis
tggatgtgaaccagatgatgagttaaaagggtcaagcgtggtttatggttgaggttcatgatatggcagaagccataggtatactacaatgaactatgtatacaggcagattttgaaagagggatgagatttttaggaaagg

SEQ ID NO: 4170 - DNA, 223 bp, Bacillus thuringiensis
gggacattaggcattattcgacgagattaccgaagtggtcacagattgttgagataccgaagactcggaatggagtgaagataaaattaagaacgatgtcacggtaaactgatactgttttttaccggtttccagagaattaattgtcgccggagcagaagttaggtacagaatgtaagagggcttgattgagggtgttgcaaatttccaaatgaggaatggg

SEQ ID NO: 4171 - DNA, 281 bp, Bacillus thuringiensis
gaggcactgcgggaatgtatattaaacagataatcccgagatgctccaaagcgctactaagcttcggcaaagacgcaggacccacaccatgcagatgaaagatttcgatgccactacagtccgagagttcgtatacaggttgaatcacatgggggtctaaggcccttcctgctggcgctgacagacgggagagaaaacgcttttgcggcttgcgatcgagctcacagaactgggcaacacggacaaatgttgcgacttttgatcttgcggacctgtgggca

SEQ ID NO: 4172 - DNA, 278 bp, Bacillus thuringiensis
ctgccttaacaaactcattgaatcacttgttcatgcctcaaacccatccaattgtcggatttcccccacaatgtggagaaatagtttgttccccaggaaagatctctatttaatgattgcaattcggcacaggaactttactaaaagaaaggttggtttctctcgacggacccccaaaacgaatcacttattacaaaactcataatcgggcccttctttcttctttagaaccccttataattccactatattgactttaaattcccgttcgcctattt

SEQ ID NO: 4173 - DNA, 290 bp, Bacillus thuringiensis
tgtggtatgggctacactgatgtctcttttacaaagaacgtacatttatatatgagaggtagtgcttgcaaaactgaacaaaaggaaacacggggactttattgcagaacagaggcaatgactagttcatagaaaggaggagatgcacgcgtaggtgacgaatcggctagctggtctggattctaccccagacagcggtcccaccttaggcggcaggcacgtattaggggacgtccacggctacagttgttacaaactctcggggagagacaggtggggtgaacatggcc

SEQ ID NO: 4174 - DNA, 134 bp, Bacillus thuringiensis
ccacacatttttttatccggacgcataaagcgtaaagggggggtttaataatgagtgagtttaataacattaatacgccggctctaactcgtcctcttttcactctaaaaacctgcatacccatctatatcaat

SEQ ID NO: 4175 - DNA, 141 bp, Bacillus thuringiensis
ccacacatttttctatctgccggcataacgtgcgaagggggggttgactaatgagtgggcttactcacatcaatggcgtagctctcactgtcctgcttccagtcggtcaacctgccgcgccatctgcatcaatgaatcggc

SEQ ID NO: 4176 - DNA, 161 bp, Bacillus thuringiensis
cctcacatttttttacccgccggcatcaactgtaacgggggggtttattcatgaggcggcttactaacaccactaacttcgctcaaactgccctcctgccactaggcgaacctctcgttccacctgcactaatgaagcggccatctctcaccaagaggcta

SEQ ID NO: 4177 - DNA, 198 bp, Bacillus thuringiensis
tggtagatatgcgagaggccaaacggcactgcaagcgggatgtgaacaagcaggagggaagccgggacataggagcgcactgtgtgaaattgtaaacggagcatacacacctgcgaacggcgaagctgaagtgacagatgagttaactggacaggcttatgtgggggaaaacttaaattagttgggttagccgttacc

SEQ ID NO: 4178 - DNA, 363 bp, Bacillus thuringiensis
ttcgtgattcatcaccacccccccctgtatacaccaacttttctaatttatacgaccgcagcgctcatatgggggttattgtttaaaattaaaagggcgatctccccttgacaatacttaaaggaaatagagctcacataactctacatgatcctaatgttctagcgactagagattccgcccccactcaaatatcgacgattcatattaacgaagcttaatatatgctgtaatttctggatcacatacgcttatttcgcctttttcaatcgtaactcgttacacacgatggaattaccaaaactgtatccacattaacttgatgaatcaattggtgtacgctattagttcccgtatagtgct

SEQ ID NO: 4179 - DNA, 114 bp, Bacillus thuringiensis
cgagttgtttgcgataaacttatcaccattgagggggggattaacggacttggtgacattgttgataatgatgcgttctcaacggtggaaatgaacatgggaagcgtatatctg

SEQ ID NO: 4180 - DNA, 146 bp, Bacillus thuringiensis
taacacatctacatgagttcgacatatttattttcccatgaatccacatatcttagtgcggggcttacaaaatctattcggggttaaaatcttacctttaatgaacatagcctggagatccgcgcacatggtctcaatattcaaac

SEQ ID NO: 4181 - DNA, 303 bp, Bacillus thuringiensis
tagcctgttcagcatttgtgaaggcatgcttgttttcctgggtcccatcaataaataattagggcatggggaagttaatagccgagagcatactcaatcatacaactttggtacggttgaaaacctgaagatcgaccgggtgaaacaccgaagtcattacataagcggggtgagaatgatgtatgaacgtcccaagattgacaaaaacgagagtgacgccctgattctcgggcctacactttaaaagcaagtcggaaactattttagtgaaatcatcacaacctattatataggctatgtaaa

SEQ ID NO: 4182 - DNA, 301 bp, Bacillus thuringiensis
tgaaatgctttgctttagcactaccatacccggatggaggattttcatagatgctaacttgcacaccatatatactgaacgtgtgctaaatgtacatcccaggcgtatacatcggcgttatcgtatacacacagacctataagttaaacttgatgcgatactgactattgtgcaacgaaacgagtcaatcatggataaccagccgcgtgctacaatctatcgatttaaattaggtcgagctaatccactttctcgagagtaagtaatagcggcagtaacgcttggtataaaacgttcccga

SEQ ID NO: 4183 - DNA, 152 bp, Bacillus thuringiensis
  unsure (1)...(152): unsure at all n locations
cgagatgtttttttttaaactttaccaccaattgaccagtggggggtatctgacatancttacatgtggtgataaataatcgcgttccaacaggtggatatgaacattggacaagcattaaatctagcgttctctatacttctcagaaacta

SEQ ID NO: 4184 - DNA, 271 bp, Bacillus thuringiensis
aaccgtttcaccatcgtatcgtcattaatagtgacttttggcacatcaaactctactttggacggggaaaagtcaatagctgtgatgatattccctcttttaacttctgccaggatttcttcatcgcgaaccttaggtttataacccgatgcttctacatcagcggcgaaagtctcatttataaacgttattcgtcttacagaaatgattgtaacgccctctttattagatctaacacttcttgctaattctgtagcttttttagtgcgag

SEQ ID NO: 4185 - DNA, 420 bp, Bacillus thuringiensis
cgagatgattgctgtaaacccatcacaattgatagagggaataacggacttgctgacgttgttgagtaatgaggccgctcaacggcggactgaataagtgacgcattaatctgggttgtatacttgagaaacagagggaaatattacaccagagcggttactgactcttatgaaaacagaggtagtaacacgtgaatgaactggttcatacgaaggtacaaccgcaggtcatagacacgtatataggcgactatcacatgaactaattaatagagggcgatacaactgccaagcatagatacaggattcactcctaagatatgccttgaagcccgggcggacgatggagatgaatcacatactgatctttcacatgatcaatgcgcgtttggggatcatcgctaccttacagctgctacc

SEQ ID NO: 4186 - DNA, 395 bp, Bacillus thuringiensis
aaccgtagctgcttcgtttctactttaatggttatttctggcacctcaaacgctactttgggcggtgaaaaaactatagctgcgaacaggtttcctcggttaaccttgggcccggattctgaatcgcgaaccattggtgctgcatcctatgatacttcatcagcggctaaagaaacataaataaacgtcatgcgtcatacataacctactgaaacgacctataatattggaactaactcttcatgctcaatatgtagctttaatggtgcgagcccacgtggcggttttagagtctttataatatatccttctgccagctgacgaatgatctttagggtgtggccgccgtactctagcgatagagctacgcagtaccatatgtgcagtccaccata

SEQ ID NO: 4187 - DNA, 234 bp, Bacillus thuringiensis
  unsure (1)...(234): unsure at all n locations
atttgaggggctgtccactggcagaaaatccagcattttaaggtgttccgcccgtttttcggccaccgctagacctgtgttttaacctgcttttaaaccaatatttataaaccttgtttttaaccagggctgcgccctgtgcgcgtgaccgcgcacgccgaaggggggtgtttnttttttttgaatttttttggttttaaaagggatttatgccttttgtttttagatttgatt

SEQ ID NO: 4188 - DNA, 137 bp, Bacillus thuringiensis
ctgctgtttttgcaatcaatcctacacgcggattaccggatgttttagatgtgcgttcatactgtgaggagatattaaacaattcattgtatattgaaataatttactatccaataagcacgaatgggtacaatgca

SEQ ID NO: 4189 - DNA, 286 bp, Bacillus thuringiensis
acgcgtttcgcgtcgggcccccagaacgcgagaactggtgctgcgcgtatcacctaccccttttttttttcacgaggggcgaatacacctttgtggagctctcgatcactaagatgggacgcgctaactcaaagcatcggcggggcctatgtaaggctgccggagcaggaccacactgcgatgttcgaccactgggtggatggacagggctgatagccagtgcgaactaggttctcctcttcacctgaagggtggcagaaatcgcgcgcaataccagacgcatcgc

SEQ ID NO: 4190 - DNA, 278 bp, Bacillus thuringiensis
tcatctttaagagaagatatatatccccctcctcattaaccccaacaaaccaccctaataatagggtcttttaatcttttttagggaatcatcctatgaccctatttatatatgaaaacttctagtactatataaaaacctaatttcaatttactcaccagcttacctaattcccctttacttgagaaatctgtaaagatcaatctcaaatccatcttcacttttaattatgggaattttttaatttttaataaccacaaaaggaatataatggtgca

SEQ ID NO: 4191 - DNA, 225 bp, Bacillus thuringiensis
gaccatatcaccctacaaccgacatttatatttcccttagaaacatcaatctctaagttggactattaaaagctaatggctgcgatcatattcccttttcacactcttgcgaggcgaccttcattaagaaccttacttgtaaaacccgatgctctgacatcagcggcggaagaaccatttatgcacccttggtgaatttcacagacgattgaagcgccctcttta

SEQ ID NO: 4192 - DNA, 216 bp, Bacillus thuringiensis
cgatttgattgggtgaaacttataccaatagtgaggggggatatcggtcttccttacattgaaaataaggatgctggtcagcggtggtaagaccatggtatgcataaaccgggctgatatactcgagagaccgaggggcctattgcaccaacactgaaacagactcttctgacatcatagctagcaaaccaacgaattttatgctttatacaaagt

SEQ ID NO: 4193 - DNA, 276 bp, Bacillus thuringiensis
cgatttgaccgttataagcttatctctattgaaggggcgagtggctgacatgcaaacattggtaatagtgatgctggacaacgggggacataccgtggatagcgtgaatttggcgtctgtggtctatatacagttggatagatcactctctacctgaaactgacttttatgccatcatggcgtagcgaactgtgattgttactgaccatacgagggagcttcggatgaagctgatcgtacatgagctactatgccgtgaacgaatctatgaggcgc

SEQ ID NO: 4194 - DNA, 230 bp, Bacillus thuringiensis
ggccaaaaaaaacaggctgtccccacaacgaaaagtattaaccggaaccaccgaacaacatttctactcgcaatttcagaaagaatcggcaatcacttcaaaatgccacaagaggtaccaccccggaccgccgggggcgtaattagaacaactcggggccaatgaaaaacaatcattccaatcattccaaaaaggatctttatcgctaacccactagcaaaaaaatggac

SEQ ID NO: 4195 - DNA, 178 bp, Bacillus thuringiensis
ttgctggttttctttggctgaggatgttccgcgcggagctgggcggaccgatgagaatgtgtcgcagccgtcaactagggttttcaccgtggatgagagggcgcctgaaccgggcatggagaatgaggccgttgagcctgaggtcttcgagcaagacggtccggatcttttcggtgac

SEQ ID NO: 4196 - DNA, 189 bp, Bacillus thuringiensis
tggatccgctcttgagattttcaaccaggtcaatggttccaatgtagggggaaagggacccgatgaattctgcacctttacacatgacccataggacgttagatgcgggatgtttggccttcctgttcaggccagccataaaccaccggggaatgcaaaaaaagctagtcctggagccagacgggtccc

SEQ ID NO: 4197 - DNA, 438 bp, Bacillus thuringiensis
cacgaatcgattgaataccgttatcccttattactgtccgaaaaaacattgtctttgctcttgggccgtcatcaacgcggttttattcgtacatacactcggcgatgacacgtattaattagacctaccaacttgtgtgcaccctactgactataatataccaaacgtacacctgagtatgatacctttgccctataaatggccaaccttgccgattaccaacctgcattcctacgtgctgactgcgcgcaacgtgacgctggactatgaataacactgtctgattgtgaatcacttgatgcgattgaaatccggactaggatcaccgcacataccgaagcgacaaacagaggtctggagctttggcatgaactctcgcacctgggtctacgccttgtgacgcaacaattcaagtctgatagaagtacctgataacta

SEQ ID NO: 4198 - DNA, 276 bp, Bacillus thuringiensis
ataagcttatctatgatgcactgtgacatatgagtgattttccctatacaaggcgtattgagaatccacctcggcgtgtgagatgtggtgaaaaaggctatgtattgaatattgcaaatcagtcggacctgcactttcatgcggctagtgactagtgggataatgggaacgagcaagcatctggaccacgagaatactaggaagcttgagcacgcacacatttgtaaggtggatattcatttgaccctgatacacataaagcgggcttatggaaag

SEQ ID NO: 4199 - DNA, 292 bp, Bacillus thuringiensis
tctagatctgtgaattacataatggagaatggaattctgaaaaaacatgtgcggccaatccactgacgtatctagtaaggaaaaggcgtatgccacgcaatatacctctgataattgaatacctcgccttgttagggttaatctgttgcataatcatatacaatactaacattgactcctaatctaatcatagtgcgatagtggcattagacactatgatggaatcatttcaagcgcatctgagacacgaaataggccctatggataatgccattcatcttttgagtgctct

SEQ ID NO: 4200 - DNA, 250 bp, Bacillus thuringiensis
ggctattctgttaaacacgatttcagcaggtgcatcaactttagccagaattactggagctactgctattgtccctgacccaaaagtggctgctgccgctgcagaacaaagttggacaaaaccttatgctttgcaaactggaggtagacgtgaacatgaacctattttccttcaaacaggacaataactaacaattcattctaacagcataagctcctatttacagctgttatgacccaaatcataccct

SEQ ID NO: 4201 - DNA, 285 bp, Bacillus thuringiensis
tagagcgtctagacgccagattccgatgccagattatctaaattgtcctctcttcgcgggtgagatatcatgtaccaacgacttgcacataattgttgacttggttctatagggtcctgcgaccatgctactgaatgagcacgttctgcttggtcggcacgcatgcacatattgtttggggtaactgtcagcccactcccgatttatcaaggaatctgatattgagcctcacaatcgtgttttaaccgctttagaaactgatcagtttgttctttggagctcatc

SEQ ID NO: 4202 - DNA, 207 bp, Bacillus thuringiensis
tcaaagaatagcgcacgcttttggttgcaaactacgtggaaacagatcgcctaacgtatctgtatctagattacgcggaggtaccatcacgaagataccgaatgaacgctgctcggtagctcaatgcttatgaatatcataggccggggtgactgtctgactactacccttgtataaagggggcgaatgtatacattttaaaatgtg

SEQ ID NO: 4203 - DNA, 173 bp, Bacillus thuringiensis
catgactgactacatacgaacatggcgcatgaactacatatttgttttaacgacctcacgtgcagtacaaaagtggagatctcatcacgctaatcacattgagcaaggataattccgccggacatgagcaacgaagatttgattcaatctacgcatcactttgcccacaagtg

SEQ ID NO: 4204 - DNA, 428 bp, Bacillus thuringiensis
gaattctgcacgtgaatttgtcaaatgctagcatcagcgggcctgctttatacagtaaaaaggacccagagacagaatccattaccaaaccgccatagattaggcatgctcacactctctagatataacgctttgggaacacctgaatgctatcacaatcgttgcaacatctaatggatcaatgcttgataccacaactccataagcttggcttcatagtgcgagaaaccgaaatggcgtagcatagggtcctcccaacgaatgagactatatgtgaaggataatgaaccatcagtgtgggcacatgtggtgcgccgtttcctaattgaaataaggtgagattaaattcaaatgttgtaatgccatctattacaccgaatatagtggctcatcagattttacttcaatgcaaaggggatgctgggggg

SEQ ID NO: 4205 - DNA, 208 bp, Bacillus thuringiensis
cgacttcttgacccataatcggcatgagagatgacattcgtacctgctaacactctatgacggctacgctagttgccagtgccgcaaaggggcagtgcctcacacaactcttattgtgtggagcgtacatactacgctaagccatgtgctggttctgatagtccttagcaatagatcacctgctatacgtcaccaaccatgagcaagt

SEQ ID NO: 4206 - DNA, 299 bp, Bacillus thuringiensis
ctcggacacacctgcccgagacaccacgagagtaggctacacctaaaccacgcgtggggacgtcctagcagccagccgctgaatgcggtacagataactggggggaagtacaaacaacggacccgaataaacagcgccgtgacagcacctaccctgtatggacaatagatgaacgctgtgcatcacataaggctccgagcagctggcggaacagcgaagagagaactatctatcatatataaaagcatgtgctctgactactaggtgacagggaagcgcatacgttaaaattttgagaa

SEQ ID NO: 4207 - DNA, 205 bp, Bacillus thuringiensis
ccgaatacctagtacaaatactagtgacataccaattgctataacgacaagtgtccaggctagtcgcatataacgtgcatcatgagccatgtaaattgcaatggggattctctgtcatacttttaaagtgccccaaataggcatgctgtggataattctaaacctataattctcccgtaccgtcccaaaaatactgccacttttg

SEQ ID NO: 4208 - DNA, 234 bp, Bacillus thuringiensis
tactcctgatgatgcgtggttaattcccggtgcgaagcaatcacaggcagctttctgggccctaggccatattcatgttcgaggaatgttatcagaggaagcatacattatacacccaggcaacatgcctgggcgccctggtaaggaatccggcgataacggtgcataccttactgaacctgcgaatgaaggaccgcattgaacattaatccatactgcagatgtagcatggga

SEQ ID NO: 4209 - DNA, 243 bp, Bacillus thuringiensis
catatagccatgccgtaacctattgataccgaaagcgccgtaaaggagaaaatgcggcttatctcacatcgaaatttgcttagcgtatattttcggaaaaatgcgggcagtataccaccgacactgaactaagctcataccccacatataatcgtttagaccatacctaaaacatccaaagaccccccacggctcactgagcacctaatgggtctcctactgaatatgccatattgacaacta

SEQ ID NO: 4210 - DNA, 263 bp, Bacillus thuringiensis
ccgatgaatctttaacactttttcttttaataaccgacctgtgatagcatgacatgtctctggttgcgcacctttactgacaccctgtttcactaggattcccgatcatttgaggaacccgctccgcttaaatcccttttccctaggcgactgcgctacgctaatgccggtagagctcactcattggaggaaccttactgggaattctgtcgctaaatcgctgctttcttatcatctgtgccacccggcattgaactggcttt

SEQ ID NO: 4211 - DNA, 452 bp, Bacillus thuringiensis
ccgctacggtacaccttatagctatgatgccttacatcaggattgaaccatgccaacgccattacagagggactcacttgaaagaaagttaagtggggaactactaaatgggcgcacgggggatgcctagaccccttgattcatagaaaagacggacatccgccaaatatgcttgaagagagcgcgtgagaacactgtacatcacctagtgcgagtggatataccgccgatgaccgcatggtatggtatagccatgtgaatacatagggtacggaagacataccctgtgacgtgaggccgatatttacctggatgaagagaagggtacgcaatgaatcagagtcaccgtgagcgacacacatcatagcccaatgattatgctcggctcttgggggtgtattgagatctacacagaagcccatatgcatcttgttacactacacgccatgcac

SEQ ID NO: 4212 - DNA, 242 bp, Bacillus thuringiensis
ctggactacttactattgctttagttactccactttgcggacctattgctgttcttgaaccacctcagccctggattttgttacacgggttttcctgatcaacactataattcgcttcggtcacatttgttccatcaactgcattagctgtggctatttctctaatttacttttcctcgcgcatatccgactgagacactggcacctttattaccgcgtcacttctcctttaatacttggtc

SEQ ID NO: 4213 - DNA, 118 bp, Bacillus thuringiensis
ccaaatggcattcgccggcactgttttcgtgttgctaactcctgtggccaaagttatgggtgagtgcaattggcactcctgcttcagcagcaagaataattagcttagcccctgggat

SEQ ID NO: 4214 - DNA, 267 bp, Bacillus thuringiensis
agctaatggtacttatggatagctatgatggtgttggcaaaatagagttgagaggactaggcttttgagacttggaaaatgattatcactaacctttgaatattatactgaattcgaagtggcaaaaccatttaaccgttgggtaatcattatgcgcctgggaatactacaaaacgcatttattcaaaaagttcattctacaacgtaccaatgggaaaggtcgaaaatcgacaaccaatttagtgtatgcaattgggagagatgagc

SEQ ID NO: 4215 - DNA, 267 bp, Bacillus thuringiensis
taatgatacagtaaccctgataaaagctctgatccgattgttgagaggagagtatgattattaatcctaacgccgcctaccttatgccctttaatgccggattcggacgtgatgaccatgcttacctcataatcggctactgagagccaagctattgccatataggaattgggggccccaaagggcaacatcgagacgcatgcggacgagggaagagatccccgagagctgcatcccgcgatgaccgaacgagcatgaggagcacat

SEQ ID NO: 4216 - DNA, 447 bp, Bacillus thuringiensis
ctaggctcgctcgctagctagcaactagataaaagctcacgcttatttattttgacaggcgagctgaacgcgcctgaccatgctcctcttacagagtgcgatacagttcgcaggattgaacgagcatccagtgggattactgggtttggaacaggccttcacagggcctgcccctacctcgttattgatggagaagtttctctttaacagatcagaattttcctatcgtaaaagccaactgaatcaccttgttgcgagccatgccgcctaagagtacgtccaactaaagctactcccatattggatcttaacaagaacaatgctgcgaacgactgactgtcttgtcaggggatgtattgcattattatgctggtggtaatacacctgggggaccgcaatgacaatcggtggaggaagtaaaagggttagacaggttattgcttttaa

SEQ ID NO: 4217 - DNA, 100 bp, Bacillus thuringiensis
cgatatataaagagcgttctattattcaaatgcaaaaccactttacttgtgggttacaacaagctccgaaacctatttcaaattgggcgggcaagaaagc

SEQ ID NO: 4218 - DNA, 143 bp, Bacillus thuringiensis
aagtatccgtacgcatacgcctatctgacaagcattacaaaagaaaccgctcggaacagaggaggggcgaccacaccggacgctaaagatacaaagcgtgttcgcctgcaagctcgaatgtgcgattttctgtctatagaaag

SEQ ID NO: 4219 - DNA, 138 bp, Bacillus thuringiensis
cttttcacaaaaactatgattatttttgaaaagagtactggtacactacataaacgaagagaaaatggattatgtgtaatatcatcacattttatagtttttgattcaggagagtatattcgttctgaaagaaattta

SEQ ID NO: 4220 - DNA, 275 bp, Bacillus thuringiensis
cgagcagtgtcgactcttattgtggcattctaccgtgccgcttatcttctgctcctctcgccttactcggatgtcgaattggtaccaggtgctggaatcaaagtatctgcttcctcactcaaaggggggcacgtcggtgactgaatacctgatctgttaacagactttgtcgcagccgctcgagtcgttggagttgtccgattactacacaacgaatgattgccatacgaacctgtgaagctgccttcttgagtggtagaaccaggtctagaggc

SEQ ID NO: 4221 - DNA, 468 bp, Bacillus thuringiensis
atggagtgattgctcgcatcaggcacacacccacggcattggttacactatgaagaacactctctgtatgtataccactgacagccgggttatggcacatggattaaattggacgtcgaccgcaccgaccgcatgacccgagagacgcaccacccggctgccgaaaagtaatgcgaaggattgaacggtattccagagtcggatatacacgttggaaactccaatcattcttcaaccgattacacgcttatcgcgcggtgcgtactaagaggatacgtatcttattgacaaacggcatgactgaagtacccggtttgaacaagagaggccttgtgcagaaccacgactggatcgactacaggcgaattaccactggtaagcccgacaccctagtgcttgaaccatcgcgcgcatcaggttattggaatcctcggacaccaaatgcactaaaactagacacgaaaggta

SEQ ID NO: 4222 - DNA, 250 bp, Bacillus thuringiensis
atgattgggatacaggattgctacacatgtttaccctgcacttgtctgcaattcgtttacacgccgtcatgttacgacgcaaggagctactgcaggaataggagtagggctgataggggccagctgtatcaccgtacctggtaggcctagaaccacactgcttctcagtacaccgcactgtttcaaaggtttgattgtctgcataataggataggtaataaatacgagtgtgatgtacgcacctcgaggg

SEQ ID NO: 4223 - DNA, 161 bp, Bacillus thuringiensis
tggaatttaatccagcgatctttctccaaccaacagaaaatgaaaccaacaaactgaaaacaagtgatattttatatataagccaacagaactctcatgtggtcagggggtgtagctcagtggtagagcgcgtgcttcgcatgtacgaggccccgggttcg

SEQ ID NO: 4224 - DNA, 342 bp, Bacillus thuringiensis
ggctacctacataacttatatgcgcctgcgaaacaggtgcccgaggtaactacgatctcatgattgagcgaaacatagatgctcccgctccgttaactgttaatggtgtattgtcaatataccttacatcttcaaacgtgcctgcaatctctaatacgattcttcctgcgactatcattaccattggtaatgacggtgctgcctataaacatgggtcatctacaggggctttcggatgcgcgtcattatactctagcacaggatctgtgttgaattggggatgacctgcacctgactcaactcatggttttcatccacataagctgctggataaatgaggag

SEQ ID NO: 4225 - DNA, 201 bp, Bacillus thuringiensis
ggctcgtatagactggagtcttcgtatcctcactaaggatatcaagtgtcattggtgcatttatactagcatatttatgagttgatgctgggcttactccatgtgatactgctgggaaaatgtaaggcacaaaagttcctgataagctaatgcaccataaataggctgaaagatcttttgatatctgcatccaagtgcccc

SEQ ID NO: 4226 - DNA, 471 bp, Bacillus thuringiensis
aaacatgagactgtagaatcgtcaacacgaaaaggatatgctttaggctttttagaagaagatgtttatgtataagaaagctgggggtttaagtgatcaaatagtgttgttggctcctatagcagatttattaagaaaaggctactctcttttacaagctttagaatttttacagtttcaattacctgtggacacgcaagttctgttgcagcgcgtgactgaggggttacaagctgggaatggtcttcaccattctgggcatcaggtgacgtttcatcccgacatgttaagccatcaattggatgcccagccacatggagatatttctgaagcgttgcagcagggtagtgaacttctttgtgagaaagattagtatttgatagacatgatgacaataatgcaacctcccatgcacttgatggactttctacttatcatgcttgatgtggttaccctcattatattacctca

SEQ ID NO: 4227 - DNA, 275 bp, Bacillus thuringiensis
acgcgcgacgcgtcgggtccccagttcgcgagatatcgctgatgaaggtgcgcacgttgtacaggggagcagtgttttgattgtagtatacagtcattaccgtgcggggagacaagacatgcaggctggtatggacgagcgtacattagacagaattgcgagaacggctgaccccgtgggactggcgctctaaatttcgtgtgagaggagaatgcagatgcgattgactgagctggacacaatggaagagctcgtagtctaaaccaagaggctcg

SEQ ID NO: 4228 - DNA, 294 bp, Bacillus thuringiensis
agggcaaagaaagagcactcacgatgacatggatagcctacatttggggagacttgagcctcatgaatgactgcaatgtgcgatcaaccatgccactttacagaacagaattccatttaatgagaggatgaatggcgcatatcttattgaaagtcacgtgggcatgatgaagaactgtttttgattcataaagaacgctaatcacatcaaaggtcgctccatagcttcctacatccatgttcactgtaccagtagttgcacatgtaccatcaatgaataccagatttgaatgca

SEQ ID NO: 4229 - DNA, 258 bp, Bacillus thuringiensis
cttgccggcgagctaatcaggtaaatccactaaccgtggatagccttgatgggagttgagcaaatagctatgacgcatggagcccttatcatattttactaaacgcgaaccgtgagatctatatgaatattgctaaatgcactaatacaggacaggtcctggcatgtttatgagagagatgatccactattaacttattcgtctatttccttcacagcaccacaagcaggaaatgcatctgatgtaatcacgatggct

SEQ ID NO: 4230 - DNA, 248 bp, Bacillus thuringiensis
ggaactaagtcagagtacattccaagacaggaagatattatttctggaatggctgatgcatctagaatgacagagatgaaggaacaacttgtgcattatacagagcgaaattgtcgtactgcgtgtataagttgagcattacacactgaatgccaaggggcagaaacagacatagaatcggagcatacgataaattgcggacaataaaggatgcaactttgcatcctactttgttgtggacatgaaaa

SEQ ID NO: 4231 - DNA, 216 bp, Bacillus thuringiensis
tgatgatgtgaagaacttttttaggtgcacccgccttaggcatccaacagagctctgaatgttgtactctctctcgcatctatacacgtggcccacgactagagcgattccggccggaagtacgagtacaatcatatgcttggtcctcagtgatatgcgtaattcgctcttgaccacttgaatgagatgtcatagctcgttgcaagagacgctgaa

SEQ ID NO: 4232 - DNA, 218 bp, Bacillus thuringiensis
ctatgtgctgggatagcaccctctgctaatgactttttggcttatcaagacgaggaggcatagtgtggttgggggtaaacctttatacattatttatggtaccgtacatattccttgtttagaaaaaatgcttaattactggaatgcgtaaacacgataaaatggtttcaaaggtgtatactttgcggagacattaaaccgtatttcactacctaagc

SEQ ID NO: 4233 - DNA, 261 bp, Bacillus thuringiensis
aggagacggccggaccggccattaatttcccctacgaccgtttttatttccgctgattactctccgtccacttcatggcgcacatgcaaccacccctaggtgtgcaccagctgctcggaacttttgtgcaaccagtataactttttgggacctgttaaaccggtctgccgaaaatgtaaaagacctcgcacgcggactactatataacatgaatagggatccttaccgtttccaccgcttccatcatgacagcataactcg

SEQ ID NO: 4234 - DNA, 220 bp, Bacillus thuringiensis
tcatgagcagggaacactttttttctgagctgatatcatttctcgcataaggtggaattgatgtgtaagatacctagcggtacgatgataaccatacccatggaatatggtggcttcgcacatctattcctatgacgtagctatatatcatcataatactccacaaggcctccccacctattgcatatatagataggacggcatcttgacatttgtgaaa

SEQ ID NO: 4235 - DNA, 289 bp, Bacillus thuringiensis
tctgctatacgctctctcattaatcataccaagatcggttttaggagatgctcaagcgcgaaaaggacgggttacgtgggaaagctctacagcgtttatataagctactacgagacgttctactgaaaatggcgctaacgctgacgctgaaaatgaacctactcccccaattgctaagataccgactgaacgatgctagtaatagcttgaagctgcttctttgccgaaggctctattcatatacgtgaaatattcgatgtaacaattcagctattctcacttcttaatt

SEQ ID NO: 4236 - DNA, 237 bp, Bacillus thuringiensis
aagacgcacatgttcggtctgtgattacccgaaaaaaagcctatgctattttttcatgtatggagcacgcaatggatgatgcagtagtgcttggccatataagagagttggtttgtgaacgaatatcataaaccgttcagccaatggtaaatacgcaaaattaaataggccacgtgtaatggataatcgggaagcagaacatataagtgtgccatctggcaccgcatgctagcataa

SEQ ID NO: 4237 - DNA, 254 bp, Bacillus thuringiensis
caggattcaatccgtgattcgcctgctacagattgcgctcagcattgctccgggacaaagcctcatacgctagattgcatcctaccgaaagtgtcatacggcgcacaactgacatgctgtcgcgcaaaaggaatcatacttgacacctccggaagctcccatcctaatgactctaatgtgcccacgtaaggagactgtgcttgcacatgcgcatttatatctttacgctacctactgtgaataacgtgcatatt

SEQ ID NO: 4238 - DNA, 221 bp, Bacillus thuringiensis
cataagactaactacatcttagggcctaaagaacaattagacttctgcaccttcgttcacggctaccaccatgcggaagcgtaatatcgaacgtgccctcctacatgttatacacatgttatgccaggcaacatacagtgctgcctcccaactaggggcagatctttcccaacgatccgatgatggaatctcctcacactgggggtcacccgcgctcaagc

SEQ ID NO: 4239 - DNA, 254 bp, Bacillus thuringiensis
ccatcctcttaataccatcctttgcgcaaagactatttacgctctattaactgataccatcccaataccgatgcttaaggacaccaacctcctgcaccgcaagatgccactggcctattataaaggccactatttggtgcatatagagctcaaccccatgctcgacaatgggcataaaatactggaatattatgcttcacggctccaccgagcccaacggtggaatttctacgctttcatccccatgacgtaac

SEQ ID NO: 4240 - DNA, 241 bp, Bacillus thuringiensis
gatgggtactctcactacatcttttgggcggtatgtagttaagctgcctacgataggccgacctaatatcggctgtactgggtgaggcatctacttacaccctttcaacgtgcttatcgacattatgtaacaaacccttcggtgagcaaaaagggatatgcattccaggatatgtggcaacatttggaatgccctggcattagaacacacgccggtaaaggctgacactaacatatacgtg

SEQ ID NO: 4241 - DNA, 122 bp, Bacillus thuringiensis
gacgggagcatccagctgtcctttcagtgccaacgcctgattaatcgaatatagacaggcgggactatatcaaagagagtctgcctgggaagcaagcgcctgtatgcatctatatctgtact

SEQ ID NO: 4242 - DNA, 106 bp, Bacillus thuringiensis
tgaaacaatgaagagttatgagttatttcaacattttccggtgacgccccttatctcccttttatttgccggaatattagcccttcccttgtttttgctgccccca

SEQ ID NO: 4243 - DNA, 116 bp, Bacillus thuringiensis
atgcgcctacagaatttttttacgaaagccggtcgtgatgatggccttacgtagacaaatatgctatatgtttaacagatgatccatgagttctttccatagttaagcaagatgct

SEQ ID NO: 4244 - DNA, 501 bp, Bacillus thuringiensis
aatcacaaaaatgacatgagcctatataccatagtccaaaccctatggatgttgcaataaattgcatgctacgaatgttgaacgtataccgtacaataccccttttactggctaaagccactccacactgtaatctccgccccagaggcgactcttgacgcaccagggcaagcaggaacactaacattaaatacccctggttcatactgtcttacctatactacaggcggagacagtgaagcagcatgaccatcaatctgcgaaaaaatacttgctgtgatcaggaccagaaaccacatctacatacagattgaactgatcatgaacacgctgcatttataagaccggaatatcatgacaattcatgactttgatagatagctcatatgtcccatattctttcggacgaggactatcaagaaatatatctctcaggcccctgaacgtgaccatgatcataccctaaactaatctcctctataagagacgtgcctagaaaca

SEQ ID NO: 4245 - DNA, 612 bp, Bacillus thuringiensis
ggcctatagacaagcgaagaattactgctatacctattattgcgacatcacccgacctattaaaaactacaatgcacatctatcccacaacgacgggatagctatagaaacagtattagtctgcctaaacgtgaaaccatcaacaactctgtccacctgttgaatgcgcatcgccacaatatcattgccatcatcaggtatatcgacagggtctggccctatatctgccggtacagcacgagcgagagttactatgatatgagcgcctgtccttctgaatgcgaggttgcagaaagcatcatgtactcctatttggatactaggaataatctgaaaagactctgctctctgcaaagctttcccgtgagctaccctaacagcaggggactgcaccaaccatagcggcgacactaatggcaatgactattatatatgtcagcgtatcataccccaggacagtgttgatttaagcttgctgcacaccgcattcatcttatcgatggtacgatgtgcagggatcctgatgaacctgccttgttcacagagcactcacgggatagcaataaaaggaaacagactgacgtgaccgtctccgggaccaagatggctact

SEQ ID NO: 4246 - DNA, 288 bp, Bacillus thuringiensis
  unsure (1)...(288): unsure at all n locations
accaaaaaaacaaaggcgaaggagagcacagaaaagagacgaagccagcaacgacaaacccagggacgacagaggaaaacaccgggcgaacaacaaagggaaaaacgacagaagaaagaacaccagaccaaaggccagcgagaggcagagaagccanagcacacccgccagcaagaacacacncaggngnaccaagngcaaccagggggagggacacaacaaaaaaaacaagaaaaaccgaaagngaacaaacaagagggaggacnagacccagaacagggaccaaga

SEQ ID NO: 4247 - DNA, 337 bp, Bacillus thuringiensis
  unsure (1)...(337): unsure at all n locations
aagaagaaaacanagacaggagaagaccgagagaggcacagaacccaacgcagaaaggcacacacaacccacaaacagcaaaaccccgaacanganaggacgaaaacaccaaacaagcagaaagcacaagccaaggaaccgccagaacaaagcaggcaacaaacaacgaaaaaggaaaacggaaccaagaaaacaagaacagaaagcccgcccgagggacagaacaaaacgaacggggggcgaaaagaagaaagaaaaacaaaagggagaaaaaaaagaaaaacccaagaagaacaccgaaaaaacccaaaaaggcggaaaaacgagaaacaggaaa

SEQ ID NO: 4248 - DNA, 161 bp, Bacillus thuringiensis
taacatcatgatacaacatagctctttttctttattttaaatatagcaactatacctcattatcctcaatcacccgatacatactttttttataaacatcctaatgataaaaaacaaaatattataccattttactgagaaagtatactatattaaatcac

SEQ ID NO: 4249 - DNA, 321 bp, Bacillus thuringiensis
gagtgggctgagggagactccttcccacacgacgaacgagaattcctttgcggcaccaggaaaacaacggctcagggaccgtatggtaactcccaaagaacagtaatcaagctaacatgcgcctccgaacggtcacaccacatacacaacagacgggctcaccctcaggactaaggccgttttattatcacctaaccaaccgtgcccgagattttttatcttcgaaaagaacgcgctgatgacgtatatcactaaaagatgcatgagtgtcaacatctcccaagtctaggcgacggtgcatacgcagtcagtcgaatggaa

SEQ ID NO: 4250 - DNA, 315 bp, Bacillus thuringiensis
tgtacagtgcctagaccaccgacataatgctcaacaaacatttttgctactcatactaccagagctatggcagtagggtgcccacccgctttagctcgctgttgttgcataccttgccagggatgaatttgtagtatacaattccccgttttaaaaatgccatctgccggccaccggacggagaaacacgctcgctaaaatccacttgagccacttctaccggctggatacttacctttgattccatccacacttttctgaatctcggttgttgacaaggtgaatccctcattacttacggggtactcctggtgc

SEQ ID NO: 4251 - DNA, 174 bp, Bacillus thuringiensis
  unsure (1)...(174): unsure at all n locations
aaagaacaaaaaaagcagatgcaggcaacaagcaaacacgctccttcacaagacncaacagacaangnacgcgcgcgggcccggaccaaacancacgcaaacaaccaccgacacacaacaacacaacacgcacacnacacaaagacgcccacacacaaagcaagagaaggaaaa

SEQ ID NO: 4252 - DNA, 340 bp, Bacillus thuringiensis
  unsure (1)...(340): unsure at all n locations
ggaaaacgcacgggcgacaaagcggccagacttttctataaacccaaagggaagctaccaaggacgagactgccagggcagactngagagacgaaaacccaaaacagaaacgaacgctnacagaagnnncagagcngaaaataaaaaaagctcgaaaacataatggaacacgagcaatatctgattacagcacgggcgctaaaccagcaggagtaaacacaaaggaaatttctttaaactgtttcttatctccttatccaactaactcactctgtgtataccaacttaaacgagctgactcggcatgcgacactcacaaaacggcaccataccccgaacg

SEQ ID NO: 4253 - DNA, 294 bp, Bacillus thuringiensis
  unsure (1)...(294): unsure at all n locations
ccctccacccgaccgatttgcccatagacggngcagcaaagggacaaccacaggagcccgagggacagaggaagagcacaaagacccccaacgcgacaaagagggaaaacagacaagcaacgaaaaacacaaccgagaccgcacaacagagcaccggaaaccagaaccaggacagccagggaagaacaaccaaaacgcnagggacgcaaaaacggacaacccagacgaaacccacaccaaaggaggaaacgaaaacgccacaggaaagaacaaaaaggacccacgacaaaaaga

SEQ ID NO: 4254 - DNA, 262 bp, Bacillus thuringiensis
aaggacaagcgaaagagccaagaaacgtaacgaataggggcacccgacagagaacgagggcggggggcaagaaaaaacggacggaaaacgcaacaggaaaggaaaaaaggactggagccagggaaaggcccagacgacacgggaggcaaggaaacagacaaccgccacacaagaacgacgaggggcaacagggaacaacgggccagacggaagaccacgaccagaaccagcaaaaaatcgaatggaccgaagggcgaaagag

SEQ ID NO: 4255 - DNA, 233 bp, Bacillus thuringiensis
  unsure (1)...(233): unsure at all n locations
tgtgtgtacgaccacttttccaatttttacgggaaggcctcaccccaacaagggagaacagatangagctaaagaaagggaccggacactatactggaaatgctaaaccggcacttgaacgattaaacgttgctattgcttatcgaggagtacggacttacgcttcatgtgctacacaacttcactgtctacaagcttaactaaaaaatacgcatttacagtgggacaccaca

SEQ ID NO: 4256 - DNA, 340 bp, Bacillus thuringiensis
attaacaggagcatctgaagaaggccggactctacggaaataacgatttttcacacacacccgaaacaagcaacggggacgcggaggaacacacagaaggggacaacttcgtacgagcatgacgcatgggcggtgccacacgagataccgaaaaaacaccgatatacccaggcacaactcaactaataaaatctaccaccagtacaagagaatcaggaaaaaaaaccgcaaaaaatccagcaaaaccgagcaccgaaaacaccaaaaaagcgatacaaggacagaaccgaacgcatagaccacagcgaacgcaagaagcaacattaatactgacagcaca

SEQ ID NO: 4257 - DNA, 322 bp, Bacillus thuringiensis
  unsure (1)...(322): unsure at all n locations
ttcaccgattccaaaggccacactttatccttttttaacagcaggcaacaggcccgcaggggcaagggggcgaacaacgacaagggaaaagggcccaaacccagcaacaaacnccgcgagcacaacaaaagagaaacgggcagacgaggcacgcacagcgccaacagggacaccgacaaagggcaacgccacaggaccaacgggaagaagaacaggaccggcccccgcaaacggaaaacgaccgcccagaaaaaaggaaggaaaccccacaacaacccaagaagcgccagccaaggcagcagccccaggagcagccgctacg

SEQ ID NO: 4258 - DNA, 148 bp, Bacillus thuringiensis
  unsure (1)...(148): unsure at all n locations
tcctgatgatttcttatttttttatgatgcaanggatnctattgatttaactggggaaaaagccgcagttttccgaatggggtgatccacttattccgaattccgggtggccggtggccttttaattaaaaagcttccagaaccccgg

SEQ ID NO: 4259 - DNA, 228 bp, Bacillus thuringiensis
gatctcagaggaacggttcacgtggacgggaagagctctggagtactacagacagtcacataagcgaacatgctaccactggctttgctactggccgtaggtgttacacttggatccggtaatgcatatcaaattccgcagtcatcaattattcagactgcgtgcaaagcagattggttcggacaggtcggaccatttttggaactatcgggggaacttacggggggt

SEQ ID NO: 4260 - DNA, 218 bp, Bacillus thuringiensis
  unsure (1)...(218): unsure at all n locations
agcggacgagccggcctcaggaaaccanaggcagncngtgacgggacncacacccgacnnncgctgggcgggccggcatgcgcactnccaagcactccaccagnccccacgggcggacnncacaggccacagaacgcgccccnaccacnganaccaangcgaccaanccgcagcggcgggggaggananagccccgggaccagnacggcgcagagaca

SEQ ID NO: 4261 - DNA, 226 bp, Bacillus thuringiensis
tctccatgtttgacctttctttgcgaaatccgatagatttacatatggacagcatgacatgacgaacaagtacgtcatacaatatcacgtatcaaattcaaaactgttcagccggcatgtctcttatcaaaggacagctgtatccaggttttacacttgcggggctcccgcgatctcctggtccaaatctaatggcatccgcattccacatccgtatttatcaatt

SEQ ID NO: 4262 - DNA, 244 bp, Bacillus thuringiensis
atgataacaattcgggaaagactcacaccctcactatgacccgcgttctgatactgcgcgcaagaacaaaaaatgatgcgccattgggtctatcgcttcatgggaacgcgtcgacattgacaccgatggatacgtcgcaccttgcaatcaaggagccacagcatgtcatactcttgtactacttggacgcgcatctaaaggctctgacactacccctcaacaacgcgaactcaagatgataccc

SEQ ID NO: 4263 - DNA, 361 bp, Bacillus thuringiensis
  unsure (1)...(361): unsure at all n locations
gngtggcatgcgctggcggcatggcagcactgagctggaacaactcgtgaatacagcgtaaaaacacatgaggaggggcggttcttatgcccaagctccgaaggaacagctcggagagagagtaatggaatagtgcattagaatcagagagacggtctagtagaatagaaacaatgcgtactcccttaatgcctatccagaaggaatctgggtttacatacaaaaggcttaaggcgcatcacatttaatacaggggatagactagcatcgataacagcgctcgcacgctgttgtggtagtcatatcaaacaacggacagcgcgattgtatgtagctatcatatgtggtacgccactcttta

SEQ ID NO: 4264 - DNA, 168 bp, Bacillus thuringiensis
caccatcagggggacctggggctgatggatacaaaatggctaagattacacgacactctcgccctatttacattgattctgctcccgctttttaggttcctataccagatgcacaaggacctatacgttgaatgaatcgtactgataaagtctgacgatctacacatt

SEQ ID NO: 4265 - DNA, 424 bp, Bacillus thuringiensis
aaaaagaatttgtgcccacgtgtgatgggaaaatccttgcatattatttttacgaaagaatgagaaaaatacgagggcagctttccgactaaaaatacgaacggtcgaaacctaaacgggcatacattaaccaaaaccaaagcgctccatcaagagtgctaacatcgtatgaaaggcggccataccgtacaccctgtacaccataattcttataagcatggcggcatatacttccatatgacataacgcgacacagaccaaacatatctatatcaaaaccacatgctcgaaaaatatatccaggtaccttctcaagtacataacgctaaaaaaaaacaatgaagaaaatcccttgcaaaaatgataccattatgacgtacagcagcaacacctgaggttatttgagagaacgagaactgctgat

SEQ ID NO: 4266 - DNA, 171 bp, Bacillus thuringiensis
tgtgatatcagcattccggttcccgtggcgtggtcaagctcgcatgtactgttgtctgtcacataagcatacaggcttcacctatctttgcagaatggacgtcgcggttcaagcaagaatccgatgaagcttccctaatacgcggattatcaattgtcctgtctgcgtgga

SEQ ID NO: 4267 - DNA, 209 bp, Bacillus thuringiensis
aaacgaccaggcatggccaccgacgcggaccggaacagcagccctccttggcagaggcccacaaccgccgctggggagacaaatcgggccaagggcgcgagaggcgaagcccggacaccgacaacacggaagacagccgcagcgcacccccggccgaacggaacacggcgacaacgagagcaaccggcagcagagcggaagaccgcacg

SEQ ID NO: 4268 - DNA, 358 bp, Bacillus thuringiensis
  unsure (1)...(358): unsure at all n locations
caccaggcgaagtacaaggggggagacanaccgcccgtatatgcggtgtaananaacaacgannnacgcaaaagagggaacggagacncgggaganaaaaacgaccannccgaaacaccaaacacaaccnacaaganatcaacgagggcgcggatagatcgacgaancgacaaaacataacaaaaaaagacgcgcacacacagcacgtctttgtgggacacacctagataatggacataaacaccctcaaaggagacgagacaacgaacggaacaccagcaggaagggggccaaaaacaacaggaccaaacgacgacacaggtgaagcaaggcgccacacaataaacggagcaaaagc

SEQ ID NO: 4269 - DNA, 251 bp, Bacillus thuringiensis
ggcgcacaccagcacacaaaaatcacaaaacagaaccacggctataggaaaaccgtccaaaaaaccaacttatcaacaggcgggacactaaaaggagtaaaaggagcagaatggggaaggaacaaaattcaaaagacttagatcgggaaaagaactaattacaacagagaatgggaaataacaaaacaaaatacgatgcattgaaaacgtaacgacgaatcccaccaatataatcgtccggtagaaggaaa

SEQ ID NO: 4270 - DNA, 122 bp, Bacillus thuringiensis
aacagaaccacagactccgggggaaacgccggactaagccgcgggtcccccttgactgacgcgatttggagctcgcagggggggaccaggaaatcgacgcgcacagctttgagcctagcagc

SEQ ID NO: 4271 - DNA, 360 bp, Bacillus thuringiensis
  unsure (1)...(360): unsure at all n locations
ccaaaagggaaaaacggataattataaganagaagaaatatgctgtattaagcagagaaaaagggagaaaagggaaaggggggcaacgctatacagaaacaactaaagttagaaaaatgaggaaaggcatatgtgagaaaagagggtccctagcgaaaaagaacagaagaaaactagccccaagtataacaacggccactgaaacagccggagcaaacgcattcatatctatgaataaagaatccaaaaacaaaggtggcccagcaccaagggcagcaatccacaataacgacgaaaaggaagaggactatcaacacataagggaaatgcccaccacaaaggcgaagtggaaggggagaa

SEQ ID NO: 4272 - DNA, 164 bp, Bacillus thuringiensis
gcgagacacacaaaaacaccgaggggccgggagggaacaaagcaaagagcccacccccacaaaacaaaggacagaaaagaccggagaggcagcgcaacccccaacaaggccacaagccaaaacagaaaacgcgaaacaaacgagaggcaagcacccggccgcaa

SEQ ID NO: 4273 - DNA, 230 bp, Bacillus thuringiensis
  unsure (1)...(230): unsure at all n locations
caaggggggggagaaacaagggggcgccaaaaaacccgcccaaagcgggaaaaagaanagacaaccacggagaaaggggaacaagggaaggacaaacaaaggacagacaaacggaaagaaaaaacgggacggcggccaagaagagaggcaaaaacacggcgaacgcagagaaaagagcaaaggcgacagaggcgacgcaaaaacaaaagcaagaacagccgacgacaggc

SEQ ID NO: 4274 - DNA, 344 bp, Bacillus thuringiensis
  unsure (1)...(344): unsure at all n locations
ccgagaagacagacgacgaattcagactccttcccaaaacnaaataagccattggaaagnccggaccgggaaaacaaggggaagggggcgaaagaaacaacaggaccacgaccaaangccagcacaccaacaaaaacancgccaagcagaagcggcggaaaaaaagaagccaaaccaacagcaanaccngnngnaccgancaccaaaaaaaaagggaaacgcgcaggaagaacaaacggnacacanacggaaccaacaaagagaacgggagaaacaacggcacccaaagaaagagcacggaccaaggccacagaaaccngagacaagccggccncagcaaaacg

SEQ ID NO: 4275 - DNA, 101 bp, Bacillus thuringiensis
aaaaaaaacaagggacacgggggggaaaaaaaaaaaaaagaccccccccccaaaaaccccacaaaaccgaaaaaacaaaacaacaagcaacaagaaacaac

SEQ ID NO: 4276 - DNA, 594 bp, Bacillus thuringiensis
atgctccatcgcgctggtatccgatccagattgggtgatgaggctgtcattgcttatgtaccggccggacattgcatcacacgaagtgattgtgcattatacacacgtgaggaggcagatagcgcaaatgtacccgctggcaatgaaactgcttatgcaggtaaaattaccggaggttactcgattgcgtatcctgagcacgatgatgcctgctctcaaactaaaagtgctggtatatctagagactccgaataatgtacagattgaaactccgtcttcgagcggtcctatcatatttacccgaccaactaatactgtaaacggatttatgaccttagctataaggcaaataacattattttatgcacagagaactaaatcaactgacactagggattacctctgcagtgctaatcggaacgcttactagaacaaactctggtcctgtaaacggccttggtaccattttatcaacggtttgccgccctataatactcggtttattaaggacttgcattaggtatcttacatgccgcaaggtctctcctattgatttgatgacaagcaaggctacagcaacaatgaactggggtc

SEQ ID NO: 4277 - DNA, 222 bp, Bacillus thuringiensis
ccatagcaaccttcatatttaacggtaaccgtgcgcctgtttttgtgctttttttgcggaaaagacatgtgatgttaagaaagggattgatattctagcgaaaccacttgtccacccatcataatggggacaaagccgccagatgtacttgaactacactagagcgcgcctaaaaagaaattaatcccctcctaagaaaaacagtccgagccagggtatccc

SEQ ID NO: 4278 - DNA, 355 bp, Bacillus thuringiensis
atgccggcagtcatagcaggctttatttgtgaaggctgcataggaccctatactgattgggctgagtatacacgaaatcctgtagaaaagacgaatgcttttcaaggttcgtcatcgtcttctccttgcttgattgatcaacttcccagagggattcgtactgctgatagccgcgttaccgaccctgatgaccttgattagcatacaccgtacattttctggattgcaaaacagcattatgcgacatgtatgtggcatgtcacactcctacctgtgagctgaaactgatagaaccgtcttatcatagttgacatttgtcgaccatcttttgtcgaacccaatagtgacctaccaa

SEQ ID NO: 4279 - DNA, 264 bp, Bacillus thuringiensis
catgactgcatacacgatagggcagtgcgagtgcccgtgagtgcggaccgcgccctgctgctacgacgcttgaacacggatcaacagacgactgaagctgacgcatagatgggactttcttctttcggctttgtatgatcatgaagcagtgctaaactcttctgactcttgcgtagatatggtcagatgctatagggagtgataagagagacttgggggattactagtcatggcacgcttgctagaagggataggggttcggtt

SEQ ID NO: 4280 - DNA, 316 bp, Bacillus thuringiensis
tggcctataggtagtctaggctgcagaagctcgacaagcaagtcagatgattcacatagccgacaaaatcattgctaacttgccttctggcgagaccataaaataaaaaatagctgctgtgtgaggcatatactttatccaacactcgttcggcctcatgtttacatactcgctgcatttgcaaattctgctgctgctggtcggctatggttcattcatagatggaaaatctgtgaactacattattggggcctgacgcaagtaaaaacaactgagcaagaccgtcgcaacatacgccggtaatccgcccaaaggc

SEQ ID NO: 4281 - DNA, 205 bp, Bacillus thuringiensis
aatgcggggagtaattggtccagtaacagtactcatcaatggaactagatagcgtaagaaacactagatgacgatccatgcggacgtgatgatgagggaaatgcgcaaaacatttatatattacaagataacgagcgtgactctcaaacgaaccgatatactgaagcatgtgaaaagcaaactcatttaacacatgtaagaatgt

SEQ ID NO: 4282 - DNA, 202 bp, Bacillus thuringiensis
  unsure (1)...(202): unsure at all n locations
cacccagaaacgcaggagaaagaaaaagangccgaagaccagccgggggcacgaggggggaacaacgaacaggaacacaacagcgggaagagccccgagagagagacgccccgaagaacggacaaccaaagaagagcccccagaaaagccacagcaaagaggccgcggaaaaaaacccccggaaagacgccccgggccaaga

SEQ ID NO: 4283 - DNA, 212 bp, Bacillus thuringiensis
aacgagcccaaacccacgggggaacagggggggaaaggaagaacaacccgaaacacaccgaaaaacaagcggggagggggacaaagccaacgccaacggcccaagaaaaacgacaggcaccaacagcgcaaaaagggccgacgcaaaggcaaaaagaaagaacaccaacagaaacgaagagcaacgacaacacgcgccaagaaaccgaaagg

SEQ ID NO: 4284 - DNA, 136 bp, Bacillus thuringiensis
  unsure (1)...(136): unsure at all n locations
accctcaanggnccatttatcccattaatgaccacgacnggaaaanaagccaggggaaaaggggcgcagcacaagagcgganacagaagcaaagaaagcgccncaaggagacaaacaaagacagcaagcaggaccg

SEQ ID NO: 4285 - DNA, 321 bp, Bacillus thuringiensis
acgagaaaaaggggcaaaacactgacacggccagggattttattattaaacacaaagaatggacaagtatgcatgggagggagagaggcaaggccaaaaaagcaagaagacgaagaagctatgacgcggatgaaggaaaagacacaagcatatcatcggaacagagaactgcccaattatggagaaaagatgatgccatagctatcggaacgagaacaaataggagaaggcatacagcacgcggataatgagagaaaaatatgctacaagcaccagacaaagagaaaaccgatggagctgcattcatccaaaaacgagtag

SEQ ID NO: 4286 - DNA, 304 bp, Bacillus thuringiensis
  unsure (1)...(304): unsure at all n locations
agagcaagaagaagaccgcagaggtagagatttgaatggcngcagagaacacgaaaacgagcgagcgggaggagaacggaagaaacaccccgcagaagaagcagagaagagcacaggagaagggccccaagcgaaggaccaacgccgcacaagcagagggcgacgcgggagacaaagagcagaccaaaaaggaacagcacaaaagaaaaagcacaaaagggcacggcgcaacggaaagcacggaggccgcacagcacgacacaacgaaaggaacgggaagaagcacccgaaagaagaacagcgc

SEQ ID NO: 4287 - DNA, 251 bp, Bacillus thuringiensis
  unsure (1)...(251): unsure at all n locations
atccagaattccgtgaatcgtcagggaattgggtaatatccgcaatcagcaattacaatgcgatgctcgtatgacccaagtacaagcaagggattgatgcaagtgtgcactgtttaatacagccgtgtattcttcatccaacacatcacctgcacattcacgtacctttatactctcgttggcatgaccgccttgcgcccccaagtattcgttaccagaaaggacnncaccggcaatatctcgcgaaaacg

SEQ ID NO: 4288 - DNA, 244 bp, Bacillus thuringiensis
  unsure (1)...(244): unsure at all n locations
gaaccgaacggaggaaaccncggcacagcagagcccaaaccaggaacacccgaaaaagngaaggaacgngaacacgaagcnggcgcagaagaaagccacgacgaagncacaacggccaaccgcacaaagaacgggggagcacaagacaaacccggagagacacccgaccaaacagcgcaaggcaaagccaacggcggcggcccaccaaacggagccaaccgggggcagaaagaaaaaacggaac

SEQ ID NO: 4289 - DNA, 185 bp, Bacillus thuringiensis
  unsure (1)...(185): unsure at all n locations
agctggcccaaaaacncaccgganatttanatataaccagcagcggaacacaaccaaaaagggggcaggggggccaaagcaaaaaaggagccacccaaaaccgagccccaacacaagacacagcaccagacaaccaacaaaacagaaaacccaccggcaaaacacggcccacccaggaacaccgg

SEQ ID NO: 4290 - DNA, 108 bp, Bacillus thuringiensis
gacgagcacaccaacaaaaagcgtgacgcccaaaagccggaagccaggggaataccgccaacccgaagaagctcacccagaaacgctcgacaaaggaaaagaagccga

SEQ ID NO: 4291 - DNA, 109 bp, Bacillus thuringiensis
  unsure (1)...(109): unsure at all n locations
ttcgaaaacggcccgtttaacctttttttgcaaaaggccaacagcaancaaagggacacgtgcgagagaaacaaaagcggacgggcacaccgcagcagcaacaaaaaga

SEQ ID NO: 4292 - DNA, 248 bp, Bacillus thuringiensis
  unsure (1)...(248): unsure at all n locations
ccgagaagcagtggacgaaagcagaaaacgacaaccaataccaataagcagccagcgccaacccgacaagggacggggggcaagagaacaggagggcacacaaacgagaaccaaacncaaaacgccaaaaggaacaaacacagcccggcgaaaacgcgcgaccaaaacagcggcaacaacccgaagagacaaaggccaaagggcgcccaaacaaacaagagcaaagaagccacggaagccgcgccgaa

SEQ ID NO: 4293 - DNA, 233 bp, Bacillus thuringiensis
  unsure (1)...(233): unsure at all n locations
cagaagagaaccccacccacggaccaaccnacncaaagganacagnaaaaccgggcangcgngagcgcaaagaacagccacgccaaagggggagaaaaacggccangngcacaggagacaaccccggaacggcagcaacgacagcaaaagaagccggagcagaagaacccgccgccgagggcaaaccggaagacaaacacgccgnnancaaagcagagcaagaaaaagggaaa

SEQ ID NO: 4294 - DNA, 331 bp, Bacillus thuringiensis
  unsure (1)...(331): unsure at all n locations
gacgaagtcagatttcaatggagaacaaacaagaaaattgccccatatcaaccaacgaggcagcacacaaaagggaangaagaaaggccagagaaaagggcccggaaagcaaaaagcgnggcgcaancaccagcaacggaganaaacggagggaccgcgcacaaaaaagacgcaaacgacccgagagaaacaccagcgncaccgancagccaacgacaaagaaagcaaggacacgagacagaagancangaaccccacaacacacccgcggaaaccggagaaaaggcgnaccaacccgaccccncagaagaaaaaaaagccaaaaaagcgg

SEQ ID NO: 4295 - DNA, 549 bp, Bacillus thuringiensis
ccttctcgctcagatttttacgttcgagagccatcgttttcacaggagactcagcgctcatttgctgtattgagaccagatgtgcaactcctacccctataagaacgaacatatatactgttgagagcccctagcgtagcggccgatctaccgcccacagtatagccatgaacatgtgcccctccactacgggggttagcgaaggcttctgtgctccgcaatgactgaattgctaacgaaaggatgcgcatgcaacataggacggatcggtcatatcgtgatcaacccgatccaccacagtcgcttgctacagcccactccaggatgagattataggcctccacgacactatgcttcccttcataccttgaatggagcagaccatggacatcccgttattcgcactcctttacattaatactgggctcccggccatgtcccttttaatttgcgtgcggatgcgatgaggtcatacactcgatctgcggttttgcccgttacgatccgtgcaacgttaactccataagaaggagccccctctaacatact

SEQ ID NO: 4296 - DNA, 227 bp, Bacillus thuringiensis
cgcgttattttcggatccacacatccgtgatgcgattggtattcatgaacacggacgatttgaactctgatgttttacctggaaaatctacaatcgccccgggccccccacgtaatttaacgcgcttaaactcaacaaatgaaagtgttacacgcgacctggataattttaaatcacggggtacctggtccgacattctacaacttcctttgggacgattcacgtga

SEQ ID NO: 4297 - DNA, 236 bp, Bacillus thuringiensis
gtgatcatgtacagtgatgcgtactcaaggcctaattcctctagtttttttcgagcaccaaatgctctctgaaataggcgaccttggtattaaggaaaggcctatccacaatatgagggaaaatcttttcgttcctctaggcctgccttataaaaagaaatcgcttcttcccaagttccgaatgcgcttaacgtttttgggaggcaataatgcgaacacaacaccacccattaatt

SEQ ID NO: 4298 - DNA, 170 bp, Bacillus thuringiensis
atgataacaccggtcatcccatcccagctgccctttcactattttttttttccttggagctaacactcttcgtggggggatacttattaagtaaacaaatccgaaccttttatatttaaacccgtactcttagtgaaatctctcaagcttaacacttatggtatttctcc

SEQ ID NO: 4299 - DNA, 238 bp, Bacillus thuringiensis
agatatatctatctttgttttctcgctgagcggttgctgtttctctgcgatcgcatagctgtgcgctaaactgcgtgggtgcctacgtaagttaaaatgtctagaagccagactcgtgtatgccctatccatcttcacggatacagatgatgaatactttcttctacaaaggtccgtataaccggtgcattaactcccgtatgagcagcctaccctgtaatggatgtgcctatcattc

SEQ ID NO: 4300 - DNA, 294 bp, Bacillus thuringiensis
cacatttcacctggacgtcgatatatcatcatcttgactatttttaacacctgatgtgttcgtaacttataacgcggggcatcacattcccactttcgtcagctggcggcataacgaagaggcccgtaccgatgcgacgcgcctaacatttgcacatcctgaatggcaaatggaaagtgctagcgttgataattatgtgcaagtctcggaataataatgtcagattcaatcgtttcataacctataaaaatgggtgcgtgaaacccccttttgaatgaatatttaaaactcccg

SEQ ID NO: 4301 - DNA, 238 bp, Bacillus thuringiensis
gttttggcagagcagcgtttattccattacttgtgattagcagaaacgcggggggtgcatcctcagaaatgattgatgaaagcaaccgcatttgaggtgtctagtctgccgtgtagaaccggacgcgcagcttactatgctacgcgagcctggcaatgtttaccttcttcatattgtagccagggtgctacatgcgtcactgatggggggcatctatctctgtcattttcagtggcta

SEQ ID NO: 4302 - DNA, 162 bp, Bacillus thuringiensis
acacgcgtttcttaggggatccagccttcgtgctcgatatgcacacgtgccacaattctgaaatcacagtttttttcttggggtcattccccaatcggaaccgaaagcactgtaaggatcgacttgcttatgacctgcaaggcagtgtaccgttccaccttg

SEQ ID NO: 4303 - DNA, 603 bp, Bacillus thuringiensis
aatggcgatatattttattgtgttaccctttatttggaacggtgttacacttggaaaaaaggtaacgagaataaaattaatttcattgaagagtgaaaagctaacgttgcaaacattaattataagattttttgtagtgttattaccgaacgtattgctattaggaattccattaatatgtaatatatatatgatgttgttccgcaaagataattgtggttttcaggatttaattacataaacgaaaggtattaagtctttggttaattgaaaaaaaagaccctttttattattttaaaaagggtcttttttgaattttatatagtatattggggatattgtttacaggtatggaaaaagctaaaaatgtgttaaattcttatttattaattagattggaaaaattaagaaaaatgatcttaactgattaaaaaattatattctttaattccagccatatattggggctggattaaaaatttcacttttatataaattaaggggggtgaattaaaaatgacctggaacgtaagtgttattctttttggggggattttaaattttcattgggtttaagtttcgatttagcgtgataataagaaa

SEQ ID NO: 4304 - DNA, 233 bp, Bacillus thuringiensis
caccggccactgcgagatatcatcgctgtattaaaaggtgcttttgtaaacgagaccaatctctgaaaggaatgacatctcgtactactatgagagcatgacacattgggagaacctgttcaactctgctaagaacaggtgtgttgtattctcctgagatagaacctgcgatggtctctcgttgcaggacaaggagcgtacccgatatcaacggtacgacacgaccagtactg

SEQ ID NO: 4305 - DNA, 139 bp, Bacillus thuringiensis
tgacttgtatgggcttgtcactaatagatatcccatgcgttttttttacaattttaacttgtgctcataagtgtggagggcccgccgtgcagaactaacctattaatgtgtattatcagaaaacacacacctatctgtg

SEQ ID NO: 4306 - DNA, 497 bp, Bacillus thuringiensis
aggtgcgtgctgactttcgagcgctaacgatactggttcttgccatgcttaggaaacagatgtagcctgagtactaagtctactgagcttaatggcaatagatgggggtgtattgttgagcgtcgtacctgtcgatcaatactacggaagttcattctctgtttctaatctgcactcatactcctccacccctgtacgcattgccatgcctggttcgttctggcaaactttaggagaattacatactggtacttacggctacactataggggaaggtgttgtgccattcccgagaaaggagacaaaaatcgaagaacacctaaagaactaatgatatcgtacgcaacgttttgtggcgctttacgagggaacatttatcttgctactagttgcgctacattataacaccccgtgcctgtagtgtgatttgtttcatccggatcccaattcacaatctacggcctacatattatccgtgaattactgcatgagtttag

SEQ ID NO: 4307 - DNA, 236 bp, Bacillus thuringiensis
cgtgctcttgttacttaacgaacgggaaatggaatttttttcgctctgctcatccacgtggcgatgtgtggctagagaaaaaactaggtggttcacgtaaacaacacatccgctgtttactgactgacgtattgctatactgcttttttccacgcgattgaattcgtttttcatgatgaagacgaaccttttcacgataaagaatcacctccttgttgggaaaaaactcaggaagg

SEQ ID NO: 4308 - DNA, 153 bp, Bacillus thuringiensis
tcgccattgagtagcgggttctgatatagggcgattattttatacaatccatgaagccggtcgttctttgcttgaatataggcatgaattcgaggacggttgcattatgaaaatacatgagtgcgagcctgctcacctggagatactgcgcaa

SEQ ID NO: 4309 - DNA, 224 bp, Bacillus thuringiensis
gatagaagcagccgcattcacattataaaatggagcgtttttacctgcaacgcatgggacatggaatgctgtgtggtatcgccggtctattcactgatatacacggtggtgtaaccgttcgcggctaataagataccatgcaatatcaactgcagccttcgctgtgcgctcacctgaaacagcattgtccattatggggtgcatatttgcattactcattggat

SEQ ID NO: 4310 - DNA, 240 bp, Bacillus thuringiensis
ttcttcctattacatgttttttctgattcactctttttggacgcactcgttcgaaagcagaagaacatgaactgcgttcagctaaacatagtgaactctatgggggtataggatatggaagaatactagaggtattactcacagtgcgcactcaatgaacgttctatacattgtgcataggcttttcaaagatttgggggtggtactgccgcatataatgaaactacaccgctcttacca

SEQ ID NO: 4311 - DNA, 283 bp, Bacillus thuringiensis
cagcaggttgtacgacctcttccggggtgtgtccatacagtggtgcatatgctgacgctgaagccaaaaaaccgccaagcgcattctataaagcactcaataggtgctatgggtattggcttatcgactctgacatagcgaccatgtggtgccagaggatatcgtgtaatgctggcttgtaatgactgaccatttgctttttaatgtctagctactattaaagcttataactcgttctcacggacagtcataaaagcatgcccacaatgtttttaacgctaac

SEQ ID NO: 4312 - DNA, 171 bp, Bacillus thuringiensis
cttggggtacacgatttataactgtgccgtggtcaatattgatgaaaagtttgcccggaatgcagttgcgaaagtgacggtatcgaatactgcgatgaacttacgactgataggcaaagtagaagccagtataacgtggcgctcttggcttaacagaaaggcagcacatac

SEQ ID NO: 4313 - DNA, 466 bp, Bacillus thuringiensis
cctctataatatataatctccttgtacacaccataggataattaataccggcttaaccaccacaaccactactatcgagtgcgcgactatatacagtatgctgataacactctcgagccacatcatgatgaatacgaagtgcttcatcacttaagcacgatccctggtacccgcatccgatagatacttaaccatcatagaacgcaaagatccagaaccatacaccaccttaataatagccggcgggggttacaagagatcccgcgcctgtagatttaagataatatcctattaaaccactcaatcgtatgatggtcaaggcggaccgcaagcatatcccatactaacttacaccgtgattatacgacacgacgctccattgcaatacataacacatgcacaccctatctattgacgagaggagcatactaggcagtgatacctaacgtgcccctttgagatttaa

SEQ ID NO: 4314 - DNA, 186 bp, Bacillus thuringiensis
gctgatgatttttttttctgaaaatgtaaaccatttgctgataaaacggggaactgcttactaatagaatagaaaataggagccttatggctcccgtctttccgcacaatatccttacggtatggctgaaactcgtatggaatggtttcccttaataaagattcaaatcctccgtcatattatggg

SEQ ID NO: 4315 - DNA, 221 bp, Bacillus thuringiensis
ctgtatcaggaacctaagggctactaactaaaggaatgtttgtacaactcgaaggcatacaaacgcttacatataccccacattgaagtgagatagctgagaaaacgcactcattgctcatagcgtgtctcatataccaaaaagactttctaggatccaattactgttcatttgaagccacaaatacgcttagcgcaagaacaacagaccaatctttcacg

SEQ ID NO: 4316 - DNA, 255 bp, Bacillus thuringiensis
aaacccttttttaattcaaaagaaatagaaccccatttaagggtttgagtgtttgtcccccgttttggaaacaagaagtccacccttttaaaagaacggtggtactttcaacctgtcaaaaggggctaaaaaaacccctcttttcataggcggaatgggccccactccccgtgtaacccttttactccctaatttctagttttttttggggggtcgaagggtgccccttaaatgctcctaaaattggggaaccct

SEQ ID NO: 4317 - DNA, 270 bp, Bacillus thuringiensis
tgttgaagaaacgaatgcgacgcctgtaccagggtattctttttttccaccactatccacatgtgagatgggaagtatgtattctaaatcaaaaaaatgatgtgctaacagcacatcattgtggatgggtacctgttttgccattggaaccgcatgttacactagacctaggagatgtgagtgattcaccggaccagcatgacaacctcagacttatgtcctcattactactatacggacaagagtgctattcactacccaaaatgggtg

SEQ ID NO: 4318 - DNA, 198 bp, Bacillus thuringiensis
attatataaagaattagtatttacttacatgaactctgccatattgtggagcgaccaatagcgggcttaacccgcgtgtgaaatatccatagggtggcttgtccactcactggttacacccactaggtggtataaactacctatggtttattgctgactatggatggtgaactatagacaaaggtgttcgaatgggaa

SEQ ID NO: 4319 - DNA, 174 bp, Bacillus thuringiensis
ggttgcagaccatgtgctaggtgggaggagagttaacttttttctacctgccacagacgggcatcccacaaaaggagcctcaaggaagaggtggccatcaccagcccgactatatacaaacctcacagattccgaccggaagcagccccgtacgcaactaagtgcctcatacac

SEQ ID NO: 4320 - DNA, 256 bp, Bacillus thuringiensis
gcaaagaagaatttggtcatccatccattaaaatagttgtcttttttctggcagtgaacttgcaataatcgggacgttcgtcctgttcactgggtacggcacctttggaagcggtgtacgcccatctgcaatcgtgatgacgtcgccgactactacaaacggcgatgtcaaatgacctatcgttacaatcagttaaagctctatcattaatcatgttaacatcgttgtttatactagaccgacgcgccttgtttac

SEQ ID NO: 4321 - DNA, 446 bp, Bacillus thuringiensis
tgctgtccacatgcgcgacaatgcattaaatacagtctcttctgtgctgaaatccacatactggccagtaagaatagaccacatcgatgcgctcattgcatgacaaccaatgtaccgggtcacctatcattgactaccggtcacatcgggtaagaagatccacacgaaccacaaactcttaccactgattgacaaaggtccaccgcattcacatgtagcctcctcaccctgttgtttcagccagtcaacaatgcgctcacgtgactggtcatgcgctgcgccaggtgcctgaactgcagcacttattgcattgaggctcgctggaatcactccactcacactcaatggaacatacagttgctgccccagctctaatagagcgcgtgcttttttctgcattggcacttgcattaccttggacaattgagcgacttcttgggcaactt

SEQ ID NO: 4322 - DNA, 457 bp, Bacillus thuringiensis
agcgcttgaaattggattttataacatctgatccgggttatgtgacgagccgacgtgttggaatacgacaacgtttacaggaggggaatgcacttgaactagaatttgtaccggcgactcaaccgttctcagacgcgtataccatttaatttaggtatttggaaggagctagatgcagatggctcttactttaaagctgtaaggtgttgtcacagcgcccgtatgtttagaatgggcattatgtttttgaattatgagagacacgatcataatatgtgcggatattgttcttatttacagaataaaacaatctgagattgtaaggtaaaaattaaatgctttgaggtgtaaagtaaataaaatgaactttttacagagagcttcttttggctgaaaaggagtaaaatttgtttattgaaccaagcctatgagcagggcatcggaacctattattaga

SEQ ID NO: 4323 - DNA, 140 bp, Bacillus thuringiensis
tgcctctacggaatgagcgcagcctactactcgtgatgatcttttccgcgaagaacatacccagtcagaagccctgaagtgcgctctgtacactgttactgcatcaagcggatcacctcgtcacacggatatcagagcgg

SEQ ID NO: 4324 - DNA, 140 bp, Bacillus thuringiensis
aatttctacgcggatccccattttttagtattatcaagaggctaatggatggtggagctctcatgtgttcgtctgggaagcctttaaagtgacctataactttcgctaatgtgaatgaattccggtctgcgaaattgccc

SEQ ID NO: 4325 - DNA, 359 bp, Bacillus thuringiensis
gcggcggatattactttagccttgaattcagtgaaaaccttttgaggcgcttcatgcctgcatatcaaggcggaaaggtaatatgtgcggtccggactggtaattagcctgacttctatactctgtccacgaatactggacataaaccctgcctcacgatatacacgcagtagtagctaatatactacagcaactactttattgtgttaacgaaatcagacaaccattgaatagcgtctgccatgtatcgtttgcatataactaacttgcttctgaatcgttagcatttacggttacctacccattttgttagacaaccacattcgggttcactccgacagcatatccccaaacgtgat

SEQ ID NO: 4326 - DNA, 142 bp, Bacillus thuringiensis
tgctctaagaccacacattgtgggggccctgagctacgcggaccgcatgtatatctattagtgttcaccttaaaatggcccgaacaagtacatctggctcgttcgtttttatcaacggtccttgacctgggaaaaaaccctg

SEQ ID NO: 4327 - DNA, 100 bp, Bacillus thuringiensis
gtatcaactaaatggaaggttgtttaaacagggtatccaacagaaatcaagggataaacggcaagaaaagaaacatgtgaagcgaaaatgggcaaacaaa

SEQ ID NO: 4328 - DNA, 205 bp, Bacillus thuringiensis
caagtgcgagaaatagaaactgtatgaccttggcacacaacatactatggcgcaggatacagagatgtgcctgagcagtctgatgagcgaactcacccacatgctaagactgatccaccctgatcaatttcaactgcttaaacatgccctgctcaatgaataattaaatcagcctttgatctacgatgggaacaaatgcgttatg

SEQ ID NO: 4329 - DNA, 408 bp, Bacillus thuringiensis
agatattaagtagaacattttttcaaaagaatatgactaagctcttaaaaggtgaaaagactgatttaattaaaggctttaaaaagggcgagaaaacgtttgatgcgaaattagagtggaaagataataagaataattttgtatttgagaattaatttgttaaaagagcatgacatataattgtcatgctcttttgttttttctttgaaatgaaatttaacgataaaaaaatgctttaaataataatcttttattgaaaaacgataaattttgtatttaaatcaaaatcataataaatgagtgtggtgcttttgttaaaaaggttacaactcgtatttttaaaattacgaggaggtataactatgaatattaacactttgattgtttaacttatggataacccccatg

SEQ ID NO: 4330 - DNA, 169 bp, Bacillus thuringiensis
taacggtacctgggaagtgttttgtacttgacccctagctaacagtgatgccattacatgacctaagttcaatgccaatataaggccttaccactttgtcatactactcaagtccattcctaatcagtacagctctaatcgccggaatggcaatgacgcttccttttac

SEQ ID NO: 4331 - DNA, 165 bp, Bacillus thuringiensis
atctacgctctgctgggatttacataaggctccaactatcagtctctcttcttaaaatttctctaatcctgtttccttctaaattttgttcagccaaaaggtatgcatgtccttttggctccattattctatgccactttttttggcttccaaacttcttttaac

SEQ ID NO: 4332 - DNA, 161 bp, Bacillus thuringiensis
aatcattggcggtccagaaggagtcgctggtgggaaatgtttttcctctaagatgggcccttactacttagggcctctttacggataacaaagtgttgtttcgactttcttttcagttctaacacgagaccattaaactggaccgttgttattttccggcc

SEQ ID NO: 4333 - DNA, 267 bp, Bacillus thuringiensis
ttcatacgaaccattacatggtgaatagtctgtacgcctagtttgtcgtgtaatatgggcccttactacttagccttgtttaacagactgaggagagttcgagagccaattccaattactataccaaaggcaagcgactatctacacttgggattttccggccttgctagagatgccgatagtggatatggccccaccctgctttctaccaagtacaagcgtggattactctctttgcgattagcaaatgttcatagtgaggccgca

SEQ ID NO: 4334 - DNA, 257 bp, Bacillus thuringiensis
tgggttaggcgcttgtgctatcttcaaaggctatgtgcattctaatccaattactgaagctgctatttaaataccatacactttcttagatgcttggttagtaaataaaccttctacggaaccatacattgtccgaattggagtgccatccaaaatggtaccattgcctgtacaacgaaattgactgtcttatttgatatgctataatcactactgcagggtggagcaaggttagtaatatggaagatggccatgca

SEQ ID NO: 4335 - DNA, 242 bp, Bacillus thuringiensis
ccagagcgtgctacattttgtaaagctagcgttgaaatgttgtttcttgcccttaattattgaaacgctagccttgaatacagacatggcttattaacgaatagatacgcccgaactaacagatggggtactattacaagctattaagagtacacttttactggccctaacctcctacggaaagaaaactcatacgctgatgcacgtacttgggaagatcccagagctatactctataacaa

SEQ ID NO: 4336 - DNA, 144 bp, Bacillus thuringiensis
cgtatgattagattcggatgcagaacatccctgcaggtaacctgaaggcggttcgtacgaagcagtctgaatagggcgtatgtactgctcgtgacaccaatcatgtgatctacccatgcttcagggtgaagcttatgtaccact

SEQ ID NO: 4337 - DNA, 219 bp, Bacillus thuringiensis
atatgataagtggtgagaatattttttttgtgttgcatgtagggaacacaaatgcggtactatgtgagtatgaacagggggaacctacaaagttattggcgcatggaaacaatatcgtcatttgacagatccatgaatatgtgattgcttgtaaatcaatctgattgagcatgaaaggtcttttatttgcaatatttagaaaggtattatttgtgtctt

SEQ ID NO: 4338 - DNA, 172 bp, Bacillus thuringiensis
catcaaaactaccaggctttttttctaccgtctatggaacggctgctaaacggggcacatatatggcgtggttttatagtaaataatgtacagttggtcttagctcgcattatgcaagcaacgcgggggcggctgaatgatagcgccgactacatatatcaaaccttagtat

SEQ ID NO: 4339 - DNA, 328 bp, Bacillus thuringiensis
agacgtgtacattacttgttatgcctgaacgtaaatgcgtcttcattacaggtcaatatgttgtatgacaacttccaggcaaaacaatcggtggctactgtgatgacggagtggaaaaatagcctaccttagcattgattgtttcagttgtaacggtacaatcgtctcacttaggaaagcgagtgcccatataaagtgtatcggccatacttttatgatatgggcccaccgtctcttgggatcagcgaaagggctcatgtaatttggagccgctgtcctaacaaacatgggggccggagcattgtttgcattacagactacaggggga

SEQ ID NO: 4340 - DNA, 336 bp, Bacillus thuringiensis
cacaaagtctggattatgcttttgtttgtaaggtctgctcatcaaaggaatgcggctcgctttaacataccccattaggcgaaactatcacgacagaggtatcggggcaaatattcagggacaacacgccttgttatctctcaatgaaacaatggatccagcagttgcagatagatgatgtgcattaatttcagtatgggctatccgagcagacgcaattgaaatgaatatagctcaaacgcagtactagagggtatgaacacctaatgtgctatcttctaacactacatgcaccgacaggcgctttctactaataaagggctttgataaaacctg

SEQ ID NO: 4341 - DNA, 138 bp, Bacillus thuringiensis
aaaaatggaccggatgcccaactggctgcgaggatgtatttttatcacttacccttgcatagaccggatcagtggcaataccgggagttactataccgcaaacacaatattcgcatatgctaataactgcgtacaagg

SEQ ID NO: 4342 - DNA, 231 bp, Bacillus thuringiensis
gtttttgcggcgcatcgctttttccatgacgcggtaatcatgtaattgaggagcatggatctctagaagctgttcatggatcaaagcgcattgcagatgataagacacaggatatgattgggcatgatcggccacgctgagagacacgctaataaatgtatacctcactcattgttttgatcggcttatcacagcctcacttatggcttgcgtattaaccggattattttt

SEQ ID NO: 4343 - DNA, 246 bp, Bacillus thuringiensis
tcgtgcaacatctcataagactgctgcttatttatatagtttttttggatactcatatgttattattgaaattggatctacaggaagctgtactgtggaacttatgccagccctgattaatcatgcactaacgggcagagcttcgtccacttcactactgtgttctaccggaatgttgctgaaggggctttactgccagctaatgcggggtagaacatccttacctctctattgatgaacaaatac

SEQ ID NO: 4344 - DNA, 213 bp, Bacillus thuringiensis
cttgtaataacttagcagatgccgggatatctgcatttttttaccaccgccatcagactgggataactctagagcacacgtgcgggggcccgagcttactgccaatggaatggatagagacacctaggtggccgcacaagtcactgaccgatggaccacaacgtcattactgagaaaaccctggaacggcccaactaagtcaccatgcagcac

SEQ ID NO: 4345 - DNA, 166 bp, Bacillus thuringiensis
acgtgtggatcaagctagcctcggtcgcaagcctaccaatccagatccagtaactcccaatgatgttcattttaatacttgatcactaattaggaaacatataaaagctctcgggtaactcgttggtgagataaaacgtgctattgttgagaaagatgttgaaaat

SEQ ID NO: 4346 - DNA, 219 bp, Bacillus thuringiensis
aaacatgcgaatttggctattttgttatttgaccaagcttcagggaacccctctgtgctagatcgtatcgagcgtgatctgtataagccactataatctgtagcggagtggggaattctggatcgacaacctaacgaccaccatgtgactctcgggcatgttggttgccacttaggttttcacgtttttaccagcctcttcttgaagagtgtactctgt

SEQ ID NO: 4347 - DNA, 280 bp, Bacillus thuringiensis
ctgatctacatcactcgtgagagtgcagacaaccactccattttgtaactgcatatgacgatcctctcatgtgacctggtgaagccccggcacttgggtttggctcactgattgcggaccctaatgcctctgctcaaactgggggaacggccagtgcctatccatcttaagagccaccctgacccgcacacggggcggctgtattggctagaaatggatgggcttgcgcatatcgagtcggggtctactcgacaaaccctattcatgccacaccaacatt

SEQ ID NO: 4348 - DNA, 237 bp, Bacillus thuringiensis
tgctttaaatcgctattctgatcacgaagcacccctttttcttgtaacagcattcaagtatcgcacataaacatagctatggagtgaaaggctttatggggaggctcacttatcggcttaccaaatgcaaaaagccgaaagtgtttgcgagcaaggggttataaagatccatgagcaccttgggtcatgcaagtatacgtttgtctgtctggcaccggaactgcatgtgtctatctt

SEQ ID NO: 4349 - DNA, 170 bp, Bacillus thuringiensis
atccagggataacgcaatatttatcatgatctgcctatcagtggccgctatgtgactggtcagtgatcagatgagacattctctactcgcaaatagtgcagaaataatgcatgcgaaattagaactacttgacgtattgcagcgagagacaatggcgatctcagaggcac

SEQ ID NO: 4350 - DNA, 109 bp, Bacillus thuringiensis
gaagatgaaataggttcgttttttttaatattagaaccaactacagatggagaaaaccatattgtagctattatcgcggctgacttatatgctttcattgttcctattt

SEQ ID NO: 4351 - DNA, 260 bp, Bacillus thuringiensis
agcgcggacgccctaaggataggcgcctaagtggacatgtctgttttgtcacgacagtagggtctattgatgcggggtttatagccaataatgatgtaaaacaagcctcgattgcagaacctacaacgaatgttgcgctaaaacacggcgatacaattagtgagccgacaaggggttacccaggcaatgggttcacaataggagcagctggttaaaggtttcatccaatcgtatcaatgcccggaacaatggatggttga

SEQ ID NO: 4352 - DNA, 333 bp, Bacillus thuringiensis
ccgtgatgaccacacaacatacattggaaagaaaaacgatctattatttacagcgctgaatacaccaacctaaaacgggagtgtgcactgaaagacctatgtaacaagagcccattacataagaaggtccccttgtcctgaaatacacaagcgatccgtacccaagaagactaatgctaaagagggtatgaactctacttggaaatattcttccggcctacccataaggcaaaattcccaatcgttacaatactgatatcgcagagaaatgaacagaagacatcaaagaatggaccgaaaaccctgtaataacaataatatcaggttttgcga

SEQ ID NO: 4353 - DNA, 181 bp, Bacillus thuringiensis
aatattaaatacttaacctgtggctgggaataaccatctttattttttagactagtaaaatggttgcaggggcccactctaagtaaatcataaaaggactccccttgttgaacacgtagaacccactcatttaaacgcgcatcaatgttcacatcgagttgtatacgaacttatcgcaatg

SEQ ID NO: 4354 - DNA, 259 bp, Bacillus thuringiensis
cacgcttgagactgcttggcaccaactgttcatgctcgtttttgcgcataccttgtggagggtgaagaggaagcataatcgcgagcgggaggtgtgatctcgctgctggttgcacatgaacctgagctctagacacagtaagaactggatcaaatgcacgtgtatgaaatggcggctggacattcactttaaccacatcgacttacacactaaccttttgatcatcatgcagcatctccactgaaattggagtcaagac

SEQ ID NO: 4355 - DNA, 128 bp, Bacillus thuringiensis
attgcaaatgccatcattttatcagaattggcatgggtgttgttggattttcgtcaaaattgtcatataatgataaaagccatttgccaataaggatttttatgaaacttgttaccgccattatcaaa

SEQ ID NO: 4356 - DNA, 317 bp, Bacillus thuringiensis
cgtgatccaaaatgccgatagccgacgggggaacttttttggtgtaggatggaaacgcgaaggggggagatgggtactcatgaaacgccgaacgaaagagaaaaaggggaataccgaattagctatacgaaaacggtagaacatggaaagctaacagaggtgaacccaggcccggattgaccaaagggtttgcagtatgtgaagcatagatttaaaggccgaacgtcctgagccggagcctgtggaaataaagtttgaaaacggccaggtaaaggctgagagcggtgctacccgcagatacgactgagagaagtact

SEQ ID NO: 4357 - DNA, 271 bp, Bacillus thuringiensis
cactagtcgtcagactgaatgaataacagtatgagctggtctttatcagaactggtcgtgtacaatcgtacctgtatccgttactagatatggacgccatactgttactgtgtttgcttagtgaggattgtgctgtttctgatactgactctttggtggctgtaagatcgaatgcatatgctcatctctaaacgctagactttatatacctatatagcggtcgctgacacatttagggacactggattctttcacgcttatccacaacgac

SEQ ID NO: 4358 - DNA, 116 bp, Bacillus thuringiensis
acaatatgtataaaggactaagaaagcaatatgacgttatttaccggtcaatgaacatacaccatttgatatcttaatgaaccgaatctcatcactcatcttttttttacagacta

SEQ ID NO: 4359 - DNA, 285 bp, Bacillus thuringiensis
tcaacccttttgattaattatggattccatatgaatggcattggccgactacgtataaatacccactgctttatgttctatagcaagccccagggcctgaattgatagatgagggcgccattcgatcattattgcccactcacttatagacaggtagagcgcttcacgatcagctcgtatgttatatttaaaaatctctagttcatataaccctttcacttacactacatcagcatcttgtgcgcactcttgtaaaactggacgctcctttatactgagcgctgc

SEQ ID NO: 4360 - DNA, 345 bp, Bacillus thuringiensis
gtccaacaggaccaattgttgcgacggcttcaacaggagtatcgggtgtaataggtcctatcggtgcgacaggttcaacatgtcctactgcagtaatgagtgcaacaggtgcaacggtttttgcacgtgcagctggtgcgatgggatctatagggccgactggatcaacaggtccaacgggatgtacaggggcgacgggttctacaagatcagctggagccactggttcaaccggttctacaggtgctacaggtctaactggagcaacgggagcatcatgtgcaacaggtgcaacaggttcagccggatcaacaggggccgcgggatcaacaggttcaacgggat

SEQ ID NO: 4361 - DNA, 114 bp, Bacillus thuringiensis
ttagtagctacaactttatttcgtgtccaaccgccgatatatcgcacgggaggatagatataattgaaaaatcgtcgatatatctttttacaattatgagtgtgatttctttaa

SEQ ID NO: 4362 - DNA, 234 bp, Bacillus thuringiensis
cgtattctttagctagaatcgttatttcgcgtgcaaccgtcgatagtacctacacggtatgctgtatgaaattcaaaaagcctaaagatatcttataacaataatgattgggtaaccttcaagataacttgtacatatgtatgatgtaatataacctatataactggaatcgggaatagtccatatggatctgacgaatgagacctggctaggggtagcctggttgttactacc

SEQ ID NO: 4363 - DNA, 388 bp, Bacillus thuringiensis
ttatgcctgtgatagccctcctagtgcagggggtcatttttaaactgggaccggaatactatacactgctgctaaagcacgttgtatcactcgatgataggcttggcacaccaatagaggacaatagttgacagtacgatgctacgatactgaagggccacgtgatcaacaggaaatgagggataactatgcggcagaactggctggtgtgttcatactaagggtggtgctcgattagaacgcttacctccagcaaagcgcacggcgttaacgtgatcatttggctacatctcactcatgagacaaagtgactaccggatgcggacaccacatattggctgctgggcctgcagtgcgcacagctgggagcctacgattcgaaccctca

SEQ ID NO: 4364 - DNA, 108 bp, Bacillus thuringiensis
gggattagaggcacataggtttggcaccgtgaacatcgtaggggttttgcctaggaccttatctttgctggattatccaacctctgaggaagaggaactacccggaat

SEQ ID NO: 4365 - DNA, 286 bp, Bacillus thuringiensis
cggtgagaattgtggagtgatcgtgctcggacactaagcaccaaagttacctgcaccaacatattggtcccgaatgagcgtacatagggatatccctggtgagtcgttgggcacgaagacttgccacccacatttataacatgcgttagataaagcggaaggcaaaagtacgcatgtacaccctgcatgctgaaacaagcgaaagcgtaaaagtattccagatagatagcgcatcgctcaatttacaaatagctgctgttgcgttcctagtgccgagagttatgtg

SEQ ID NO: 4366 - DNA, 369 bp, Bacillus thuringiensis
taatttgctggccggaattgggctacgtattgactttattggcctggtttgtacccaactaaatcgccgtgcaacacagccccctttcgcctgctggcggacaggcgctcttgctcagaccgaccgccctttttaaaagacttattccatagtttggcgatacttcatgtaagggcgaatgcaatggaggcgatcgtggtccaaacatgcgatatcagctcatgtgtcaacgcaatgagcggatgggagaatggattattctttatgaaaccatgatcctattatatggaaacttattggtcctagaaggaccatgcgaccagtgttccaggccgtggtctccaacgccaggtgtttccacatgacatt

SEQ ID NO: 4367 - DNA, 169 bp, Bacillus thuringiensis
accgccttcgctgacagctgtgctccagcatccggtaataccaacggagcgcgagagcacgcgcccatcatattgactgtataccacgccattactactatatgcacgttgttaaaagactgcacactaatttactccataggtttctaatcttgaggaagccatgttg

SEQ ID NO: 4368 - DNA, 166 bp, Bacillus thuringiensis
gtgctcggcatgtcacggtcgggcagtgagcgcaggtgcccgagggcgcccagcagctccagcagaaaagtgacgcgggggtcgtccaggcgagcggttcccgggagcagacggtcggcaaggtcgcgaacgtgggtcgcctcggcggtggctttcaggaagtccc

SEQ ID NO: 4369 - DNA, 255 bp, Bacillus thuringiensis
aaatcctgctgcgcaaattcttctactgcatcccgcaacatggtcagcatggcgcacatagacctgtccatgtcaagtatatatgaccagccccttcgttgctatagctgaatcgaacggcacttaatttggctgtattcgcgcctgcactttttgaacctgggcgtgacctatgccaccttgatggaggccagaaactcgagaacgtagtcttgaatggagacacctagatgcccgcacaaatgactgacccta

SEQ ID NO: 4370 - DNA, 462 bp, Bacillus thuringiensis
tctcatggtactacttcaaatcctacggcccatgaaagatccggtacatgacgccgtcgtgtaccgcatggcgcccatacttattatacatctccagcatctcttaacatatctctaatgtgaaaagctgagcgagcactattgctgcgcgcagaattctgtcacatagtgtcggagcccagcctatcttctgacataccatttagtggccacctgacgtgggattagatatatagagtggcctttaatgtcgaacattttcaatggcagattatataccttctgaaactgggggattaacgcgatagaacctaatctaatgtcttaagatatggctctatttttctcttattagtcacttcaaaatctttttataataatattgcaaaatacagggtaatataaattactgttctttgggagggatataatgtctgataaggataaaattgtcattcttat

SEQ ID NO: 4371 - DNA, 288 bp, Bacillus thuringiensis
atcgcattggtaacgaattacgctaacgattgggtgcaaggtgtactggagtgctacaagcggcattgtcgctacagtgctaatgctctagggacctcacacggggaacgctcctgctgcattttaggccatacatcgtgaatcggctttgacttcatcgcttcaataatcgaacccatatacgagcgaatagattataaccctttctgatcctcggtcctatatccaataaagaaatcttttactttgaccataccgatcatatcatctttatcttctgcacaaatc

SEQ ID NO: 4372 - DNA, 258 bp, Bacillus thuringiensis
cgagatttaacgcgtatacaagttggctggctaggtatgatgagctttgctgtcttaattgcgaacacgctgcgaagaaaaattgttctttaaaatctgatttctctcgcaccacgcttacaatcaacgggttttgacggattgatacgtgctgcacaagcattatcattattcacgtttaccagatcaaggtttacgtactctaagtctgtcttacggcgggaacccaaaaaacggggctcccaaggggatctatta

SEQ ID NO: 4373 - DNA, 403 bp, Bacillus thuringiensis
caaacctgactgtgccacctttaaaaccgttattcgtattgcatcccccggatgtattctgtaagtagacgctgaaaacagatcccgactctatgcaagtacgcatgtattgtcttgatgtcaatgatgcgacctgctgtgcctgatgagagacactattaattgaaggtctctgtacaagctcaaaatagatgggtgctagatcgagtgcgtctgaaagttctggagtgccacacaccaaaaaccgagaggccaataaccctttcgaaagtgggaagagccacatcaagggaacacagacaagtcgtaacaggggagtgccccggctttatttgggggggcaaccggttattcggattgaatgtccatgaataatggctgagcatgaaaaaagaggaccttc

SEQ ID NO: 4374 - DNA, 302 bp, Bacillus thuringiensis
ggcggaaacgcgtgtaagagcctagtgtaatcaattacttctatgacctctatttccaattctgctgaacgcggatataattcaaaatcaacacccatgagtcgggtgcgtgatgtaactattcgaaacaagattcctctattatagagcggggactgcaacgacaaggggcgcaaaacccaacatgagggcgatggactagaatgtgaacatatcactctaatactgttcttcggggatggggcgccctaaagcactaagttggtactctcaggggagccattacaggagagactgatggc

SEQ ID NO: 4375 - DNA, 423 bp, Bacillus thuringiensis
aaggaatgtatattatttcgacgaattgtgctgtcggaatattttttaagggtgggtgcaaaacgtaaaaagctaaagttggtgctgtagcatagggtgataataatcaccctgggtgttgacataccaatgattacgagtgtagtttgttacggagagaagcttggttcgataaatttcaacctactcctttatcaataattctggtaaaacatgtgtggtagcctttatcatatgaagaatgaaatgaatctgcaaaaatctgatatgagtttttaaaggagaatggatgtattcgttgtgccggccccaatgcattgttttcataaaaaagatatttatcccgggtgctagtaggtggacccgggtcattagatcattcagtggcacggcatataatcgttccaagctattaaacaacca

SEQ ID NO: 4376 - DNA, 257 bp, Bacillus thuringiensis
taaatttgaacagagagcaagagtagctatatccataagatataactgcaagcgatgagctaatatataacactgagcagggcgtgcaaaacgctcataatgatacagtaggaagaggatgatgcgtgtacacaccacaaggattggggagttaacaattgtcatagcaacaatgtgatacacatttggataataaacattcctatggtgaacagccactgggtattatgacagcatgtatacatggccgatatatg

SEQ ID NO: 4377 - DNA, 189 bp, Bacillus thuringiensis
tttgtaggcgcacattacttatctcctatgtatatgttatcagcaacttatgtatgtctagacccctttgcagggtttatggaagagaatgaactttattttgtgctatgaattactaatgaaagattagaccctaacttttacaagaaagtgcatctccgatctatctgagctaaccacgcttatgat

SEQ ID NO: 4378 - DNA, 227 bp, Bacillus thuringiensis
tttgctatgaagtggatggtatggaacactagaacagacctcttccattcctgttcagaaatagcacttacattgggggcatctaagtgctattttctgagatgtaagacgagaggcactctgtgggctatgctttgctttgacccgctatgccaggtgcggaattgatatctcaaagctgcgctggacgtcagtgtctggtgtggggcgaatgctgattggggatg

SEQ ID NO: 4379 - DNA, 321 bp, Bacillus thuringiensis
cgagctgagttaaacaaaaaaaggattaaagagtttgcctattttttgaaaagagatacttctagctagaatatatgggaagcacattatctattatggctgtatagagtgtaactcttatagaacgaaatattaggaaatattttattgaacagatatatagatatgcctggatattcaatattttcagcaatagtaacaactttgatttattgagcagtaacgataccgactaatcacatggggggatataaagttattactggcttgatttggaatatgctttttcctttaataggggatgaaagggccttatgtgca

SEQ ID NO: 4380 - DNA, 179 bp, Bacillus thuringiensis
gcaagggagaggaaaacgaaagcagagcacccgcagggtttttttaaaaacagaaaaatacccaaaaaacggggggagccagcgagaacaaaagcggggaaaaaccagcccaagaaaaaacccggggggaaaaaacacccagcgaagacccggaaaaaaaccaaagactatagaaggca

SEQ ID NO: 4381 - DNA, 448 bp, Bacillus thuringiensis
cggacataaccgctgctgtaatccgatcgattgcactccagagtgtcgtggcagaccacatgcagaaccgattactaacgcgcgatgaggtggatgaactactttactacactctgcaacgccggctattgcagcgtgctatgccgattctagtgatgcaagcagatcatcggtactgaattagggtactcacctattgaacctactaagatgaatgagcaccatgtgcacacgggaatttcttagagcactgaaaccaaagtattatgacttactacaatctaccagcccaggatctaagtgaagcactatcggtattacgacaattctacagtgcacctgcaccatgcttctgctctttaagaatcgaccgtgcaagatgacgcctgttctctaaaatattaactcaatcaactaggtgctactccaggaggaggcccaccaggcc

SEQ ID NO: 4382 - DNA, 127 bp, Bacillus thuringiensis
actgcgcgcaggcaagcaaaaggcccgaggagagccagttcttccgaccaaaagcagaccccatcaccactggggcaacagtgacgcaccgcacagggacaagcggcacaaaaacgaaacgcagcgc

SEQ ID NO: 4383 - DNA, 251 bp, Bacillus thuringiensis
gtgtacatgtacaggctctgcatttgccctatccgcatttgttttaatcgtatgcgtatcacgaaccgagggagcggcacccactgataaacgcgcagcagccactggataaccatactcacgagtgtacggatcaccatgaatgtggcatacagttttacagcgagtatcagccagatacactcactgcactacatccatcatgacattgcttatcccaacgataaattgcacgccgctaggatcatgta

SEQ ID NO: 4384 - DNA, 130 bp, Bacillus thuringiensis
gccagagggggttatttttgtctgctgaagaactgcagcgctaagggcgctggttgcgcaccttatagagaactatctatgggaacgccaaattagggctattgttgctggaatctaaattgccgtcatg

SEQ ID NO: 4385 - DNA, 141 bp, Bacillus thuringiensis
ggctcatactgcctactctactagaagcacatcgcgatttctcgtttacttaaaccattatccaccaagcaatggttcaagtaagggagcgttcacgcgaccagttgaaagtgtagaaattgcccaacctgaatgttgttt

SEQ ID NO: 4386 - DNA, 437 bp, Bacillus thuringiensis
acaggttgctgggccgcaagtgctgccttctgattgagttcttcatctaactgccacagatcatcatcactcagtacactattcgctgccccagatgtgtatgcatcaataatatgcgctgcagcttcaagtataagctttatgaatctttaaaataacaactggggttgcatgcactagatacttgattacagaccctcaactctattactacgaaatctccaacagctaaattctcctgctgaatgatagcccccgttgcaccatctaatgattgaaggctatatgaaacacctcttctatacgctatatagagggtaccgtctgtcactaattgcttttctcttacgtatggaacatgatgttctgagatatgatacgtacggaacggagtcctgcgaatgataccactaaaatagctgatgattagcgtgacc

SEQ ID NO: 4387 - DNA, 253 bp, Bacillus thuringiensis
tgataactaaatgttacatattaccgcaccggtcaactcgatttttgtttgatgaacaccccactgtaccacaggtctcttaacacttacctagctagtgctgcaaatggggcattcaccgacaatgtaatatttaatacttcttgttcacgccacgagactgctacactaaaaggggatcgaacgaaccatctctggaactgaagccttataagttgcgtggcaaaagcaatgatcgctaaaagcaccaata

SEQ ID NO: 4388 - DNA, 206 bp, Bacillus thuringiensis
taaaatggaggcctattgattaatcatatgtttaggtgtgagatatattgtattatgactggcactggctatgggtggagcattcgccaaagacacttgggaaagtggaatattgtgagaaggaaatgagcgcgcgagcgaattacatctagcatgtatctcacagggcgcatactcattagaggccaaacccgagggaacggtag

SEQ ID NO: 4389 - DNA, 174 bp, Bacillus thuringiensis
tagaagaatatcctgatttttgacaaaatgttgttgttgctcaagcagggaaatttatccgggtgtactctaagttatgggcgacatgccttattctcagtgctgtcatatgaaccttctatgatcgcacattaacaatgaataacgcgtttagcgcgacgaacgagtttatac

SEQ ID NO: 4390 - DNA, 112 bp, Bacillus thuringiensis
tgctacagagtgcttgaatgcgtacacgacattcattttttctttaacaattgcttgtgggagattgtctggattcgatgcgttaacttcttgcacagtgataacctgtttt

SEQ ID NO: 4391 - DNA, 359 bp, Bacillus thuringiensis
gtaatgaggaacctttcttgccttctctgtatctacctgacagtctgttttcctggctgcaaacgtgtcttgcttctttgttacctgaatggttacactgctccacgatgaggttgtttagtacctagcgagctattacgtttgctagttcactgactcgatgtgctcggtcggatctactgtgtgagctgatctgctactcatatgcatgttgagcaggatccacagaagattgggatcccgctatagctatcgcttgtacataaagccatggagtagacctgactctataatggccattgtgctagcctcattacataagctatgcgctcatgccgatgctcacactattgatgcct

SEQ ID NO: 4392 - DNA, 418 bp, Bacillus thuringiensis
cataccttctgactccattgctagacgcgagtgcggcccgcataatacctaactactcctattaagagtcccttatcatcaaaaacaggccatggacaaacgtgtaaacactgtgatgatgttgtacgttgaccgagtccaacaggactctatcctgcaagcactagtaatgaccctgatggaccaaagaggcgatcctactgacattcattgacatgctgaccaacgaactctttccgaagctagaaagcctagtgccgccacacagtgtactatgaacacgccacacgcgacgcgtaggtcatgtgtgacaaaagtgcgctcttacgcatactcaattacagcttcgatgtgcatgaacactcggctgttgtgtgcagccatactagcctcccctgacttcatacggatctatcca

SEQ ID NO: 4393 - DNA, 535 bp, Bacillus thuringiensis
ctgtactacaagacgagcttactaagcctatgataactaatacccactcatgaggtggcctcgaactggcagcccctgatgcatatattaacacactaggagagtcgacctattactgctgaaaaaaggtacatatcgctgactgaaaaaaccatgaacacacccacatcagatggtgaacgatattacataacccatatgtgctatttacacaatcgaaccgaagtccaagtccattcaccatatcaactaatgactcatccagatggggaaattggaggagataccccgaatgaattggaaaatatatatcatagtttataactattcagctctgaacataaccaggatgccctgatcaggcatactccttactaatgaaaagagaataccgaaatgggagtgagtgtgattccaatgggaaacaaacaatcattatataagaccttcatcctctactgatacactggaaaacatactatcagggaggtgggccgctacggaaaccgtcacggtaatcaaatttgatgaagac

SEQ ID NO: 4394 - DNA, 279 bp, Bacillus thuringiensis
tgaagttggtaacacgaacaaaatatcgcgtgatacaatatatgtatatgtatcgcacctcaagaggagggctggcctcatgacacctgattactagatgtactctggcgcatgtcgcactgtcagtctcatattgtgacgctatattgcatgacacatgcactgtgcgaactacctcgtatagcttctagcttccggacgcgtggcgctctgtcattgattgcgctgatagcatctcaattaagtgctagtcgtatagtcctagcttggcttggaagg

SEQ ID NO: 4395 - DNA, 165 bp, Bacillus thuringiensis
aaaagaaatgatatgagacggccgtctggctgaacaaagaatacatcccccatcactctgaagagcaaatgcacggaagggcatgtaccataactgaaccctatggggttcttgttctagggccattatcaaaatcgaggagcatcccattaccatattccaaaa

SEQ ID NO: 4396 - DNA, 321 bp, Bacillus thuringiensis
ccgcgaagcctgggcaggcaaggccacgagtacagacaagggcaaccgctcacattgcttttttacatacagaaccggaagcatcaagcggggagcggggggtgcctaaaaagcgagcgcgcaaacagcagaagccgtgcgcccagggcccgctctccagacgagaaaaccggccggccagccgaaataaggaagcaaacgacgcgcggcgagaggctgcacgcaggatgcgcgcaccaaccgcaagccgcggtcactgactcggtgacgctcgggcgcactagccgcagggagcgcgcaacagccgaaagcaaaggcggg

SEQ ID NO: 4397 - DNA, 297 bp, Bacillus thuringiensis
gagaattgttaccgaacaccgattagatcatacagcaatcttctgctctgccgtcgcagcaatctcacacccttgagcatgcttgcctgccctgacagcttctgtgtccgcattccaagctagccagctgcactgactggaaatatacagtacggcaaggacgcaatcgcaaattggtcgccattgcataatccaatctccaaatttaatgcgctactgcgaaacatcatgagctacacgcctcatgttagcaacagcaccgcttcgggtatgcacactactctggggaaaatgcca

SEQ ID NO: 4398 - DNA, 575 bp, Bacillus thuringiensis
atggaatccaaacgtaagcatgtcaaaatggtcgcaaaatgcatctgatattttgtgctgagccacgtgatgctgcagatgatcagaaacggcactcccaattactcttacctaacacgccaactggctgctattactctgagacgatctgacgaagatctccgtttatctggactacattctttacatggctatcacgtactgcaccattatcatatagttgaccgacacctgtcggataaaaagctgtttcataacaaaaccacgtatattttaccgttctcataataatccagctgtataatactatctatcaagactagcttataatcctcagggtaatatcataagtgctcatatctgctaaatcctgtcgcataagctagtatcactggtaagcaatagacattagttccctcacccgccagaagaactacactatgattcgaattcttgagctataataagatcaaaatgcgggggaggaataaagatcttctatgaaactggcgtcgataatcagctcagggtaagcaaatatgctatcgcattgtatcgacaaaaaatgaaaggac

SEQ ID NO: 4399 - DNA, 251 bp, Bacillus thuringiensis
ccctttccgagtgaaaacttttatgtaggctttgccccatgaccattaaacgactatgggccatgccttatggccatgttatgtgaagcttgctcaaggaaaagatgcgcaagcacatgcggatggtcttacacatgttcatcctaaagctgaatatgtgccggctcagcacgacctttcacatgagagcattgcccattgttatacacaacttgggaacagactctggctaaaggtctctgacttagctg

SEQ ID NO: 4400 - DNA, 193 bp, Bacillus thuringiensis
tgtagggtatgtggagcttttttttagccttcgatttctcgaacatgtacctggaagccttcgctttgtgcacgtggaaagggagcgcctattatcacttgctcatgaactacttaattcttcaaaatttcgtacgcctgccctagagttggctactacatgccgtaattttctggaatgatcacacttaagc

SEQ ID NO: 4401 - DNA, 111 bp, Bacillus thuringiensis
cacatcaacagcagacctaaaaaatacttaaggcccgcaccaatcgccctgcccagcaggggcgcatccagaagggcgaaaggaaactgaaaacggaaataaatcgagaaa

SEQ ID NO: 4402 - DNA, 347 bp, Bacillus thuringiensis
gaatttgagatgtcacatcaaaacgatttgtgctatagcatctgacctcctagctctaatgtcctcaccgaactcggaggccagagactattcgtcctccatggttaattgcctttgtagctttctttatggttcaaaatctccccgtccaatttcgtgaatatcccccgtttttttaccaatatgcaacagccccccttaaatcctcaacaatcctaaaaatatgccgaggtaaggactcacgttgattctatttggaaggagagccccctctctatggatcggggcgctccaccttctgagggcaaacaaccgtctgtgaaggcagaggcctaccccacgaacca

SEQ ID NO: 4403 - DNA, 123 bp, Bacillus thuringiensis
atgatcgaagggagtcatgaatttcctttatatgatgaagacttgtatagaattgaaagtgagaaagaaccaggtcttcaggcgagcagatttaacccccgtgtgggggcccgagctcgggga

SEQ ID NO: 4404 - DNA, 289 bp, Bacillus thuringiensis
gaaaatcagatgctgtatgcaattcatacaacgctaccagaatattttgcagagagtgaagactatacagccgccatcaaaggaaagtgctcgcacggccacacacaactggaatgcgagcggaaggccggttgaagctatgtgggcaatgcatccagtgtctatgactgccagcatcactaatgtaacctccgaaggtgatgcatccaccactgtgagcgtacagaggtgctacataaagaattaaccgaactatgccaccaacgtcgcaggagaatgggtggcctga

SEQ ID NO: 4405 - DNA, 375 bp, Bacillus thuringiensis
ctgctcagaactacacccatatatagcaaaagtgaaggataaatagtggatttttatgcgttaacaatctaacgagctgatatcaatcatcatagttggacagacgtggagatggcacaatacatgacgctactttcacgatggacatttgattcagtgcaaaccgacagtgaacacttaaccacaactgtctcaatctcacgtgtttaatacatgcaaaaaaagctggtcatgaaatttgcactgcaatgtggatacagaatacatacctttgccccaaaccgttggaacgctcgatcagaataaagatacaatgatgggtgaaaactataatagagatgtggatttataaaccgcattaaaaaggcgcaaaaa

SEQ ID NO: 4406 - DNA, 325 bp, Bacillus thuringiensis
ggagcgaagtctttgattccttgctgccaagaaaagctccttactagaatagtggtgcctgttccacggaccgtgacaggttggtacggagagagttgctaggcgtgcgagatgcctcatgttcaggaactctgtataaagaccacgaaacacaccgtgaaggggagctcgcatatcgggaagtcgagatgtatatgccctatcttctgaggatcaaacacacatctctatgttaaatcgtaaagcgagatatggggggagacacctgcccggtgctgcggggttacggagaggggttagcgtaagcgatgctgtgaactgaagc

SEQ ID NO: 4407 - DNA, 477 bp, Bacillus thuringiensis
aatacaattttgatgatatattataagtattacaaaaactggggaaagtagatcggaatactaaaatgctatatggccaaataaaagattaccgcgtggatgaatatccagaaggtcatgtttatattcatgggacagatgatatacttgatgtgaaggaactatattatcgcgtattcggataaataagaggatgctttatagatgaaagaatagtgccattaacagaggtaattacagcaaatatagttatgggaatagcagatacaggctaatgtgataaattcgtcattgaattagcttatggacgtatattgtcagcggataacttagatactcatgatgtaccgtcctttaatcgtttagccatctggcggatcttccgatatatcagtgctgacatatttagcaaggtatgaaacgccaattgtattagtagattggattgaaagagttacgaatatcgctattccatga

SEQ ID NO: 4408 - DNA, 558 bp, Bacillus thuringiensis
tttccttttcgtctgcatacttatcctctaaggaaattaatagagggattgatatagttactagaatgattaaagtagttataaaagatttagaaagagaaaaagaaccttcaattaaaggtgataaaaacttgaatgaaagtatacttgttatgaaggaaattactaaaaagctcaaaagagatatatttttattctttatagatgcctctataaagtctttaacacaggttattacaacaaatatagttaatatgataagagaaacaaaataatgtgttaaattcgtcatactaatagtagaatcgtctattatgtaagcaagtaacttagatactaatattcctccaaacaataaaataataaaagcaagtaatccttccgatatataagtgctgaaattgtttttcttgttaaaaagcttatagttcagagtagattggattatttgaattaggaatagggtaataatccatacataatacacaaagggtaattctcctgagaatagagaaattaggaagtttactactgtccttaaaatttcaatcattacga

SEQ ID NO: 4409 - DNA, 194 bp, Bacillus thuringiensis
tggcgaaatagcgaagagttttcgtccattaaagcataataacagtcgcgcagcctgaatggttctggtcaattcaacagctcatatgatctttgttaatcatgacgaatagctttagaggaactatattcgtccttaaccattaggtctaaatccgctaagtgcatttgcatttcatatgaatatgagaattg

SEQ ID NO: 4410 - DNA, 197 bp, Bacillus thuringiensis
ctacgaccacacgagggggggccctacctctcagccgctgtatgatgtagagtcacctctatggcacgacaaaacactgctcgagattcatcaacgggttgactgggaagaccctggcgatacccagccatttaagctggcatgccatctactgagaaacagatgaaagaataaccaaaaggcccgcgcgagatcga

SEQ ID NO: 4411 - DNA, 101 bp, Bacillus thuringiensis
ctgcactacattcttgctttatatcatcgacgatatgagatacatcaggtcatgattgaccgaattagccgcattcgtcaaaagaccttatcacctatacc

SEQ ID NO: 4412 - DNA, 305 bp, Bacillus thuringiensis
tcgatatctctgaatttgtttttgccattgcagaaacggtaagaggtgttgattaccgagaagtaaccattacccataatcaagtcgatggaaaacgaccatgaatttgcgaaatacaaacttttttaggatgcatgatgaaaatgaaataactggggattcagagacaaacacattgttagaataaagtgttactccttttaggtacccaatcacaaaggcgcattttttttggttttcgctccctttttatatcgtaaaatttaatttaactctctattattaactattgctatggtgttttt

SEQ ID NO: 4413 - DNA, 391 bp, Bacillus thuringiensis
caacatgcacagccatccgatgagaaatgtgtgtatcacttccttccttcaatgtgtgtactgcataaactaattcttgttttatagcaccttatccattccacccatcactgaaatgaataggctctttagggtgatgctccaaaatataatggtgtgcattctcatccataccctgtccgcgatccactgaaatacctttgcgaggttcatcatggacgctttgctagcctctgtagcggatgctctgaatgcccataggtggacccacacgagctaatgacacgaggacagggttagatcctttaggtagaatgatctgtacagggacaactccaacatcgacggctaactggtgatggccctgttgcatggaagaaaagatatgctc

SEQ ID NO: 4414 - DNA, 334 bp, Bacillus thuringiensis
ataaaaatagtactcttatttttgcattaaaattaggaaaaacaaacaaaaatataaaacatacgtattgtaacaatatagggcttgcacatgaccacgatttacgattctttccctattgtgtaacatggcaccagaaagagcgctattggaatatcatatgaccttaaactctaacttaagatttgctagtctacctacgcctcgtaaacttagcaccggatgccgattgtgatcacataattggcgacattaaagccatactatcaatcattacagaaggtatatgagcatgtcgtacatgctccttcatacttctagtaagagaaacagg

SEQ ID NO: 4415 - DNA, 242 bp, Bacillus thuringiensis
atctagactgaccgctgggataggagacgcgctggctaagcagtgtggactggaagacgaatgtgactaacgtgtagaggaggatgagatgaaccgtcttcgttcaagtgaacggatctcagagataagccactctgcagatgtactgcacaatataggtgatcgtatacatggactggagcacatggtgtgatatacacactattcaacgggatactatgagcgctatgcacgaagagaag

SEQ ID NO: 4416 - DNA, 440 bp, Bacillus thuringiensis
ggagtatggaggctatgaatactctgcaacatttggatgctctttttttattattgcagctggattcgtatcacggtgatttattatatgattctatacttaatctactctcaccacgtgcatcatggacgactacacctaacccgaaataataacgactgactagcacaaaaacctgatgagtcatcgaatgtactgcatgctcagttagagaaaaacattgcccgtcaagcaagtcttgaaagggctctagcttgacccaacgtaactcctaataaagcaaaatcgtggccacctaacgaaacagaagcatctggtgatgagccggcggtcattggctatgatgcacaaaaggacgaatctacttactatgaatgttaaatacagagtcttaaaggccgcagtaatctaggctgtgaccttgaagcgttagaatcaag

SEQ ID NO: 4417 - DNA, 179 bp, Bacillus thuringiensis
agcatcgcaaatggtgaaaatgcgacctgtataacgaggaaatgcccggcgttcaatacacctgattaagcgaataatcgcttaacaacgctggggagtaacgcgactacaccatgtaaccatcatgtgactgactccattgcaccgctatatatatacgagatatacccagaaagcta

SEQ ID NO: 4418 - DNA, 140 bp, Bacillus thuringiensis
gcacatggggtgatttgcccgttgttttttatcgctcagaatgcgaattatcattcgtgtgcccattcactgggttcacggatatcctatctttggtctgctggcggtgctacaaagaagttgaaatcgtgggctcactt

SEQ ID NO: 4419 - DNA, 260 bp, Bacillus thuringiensis
acgcgaaataaatgatagtgtcacctgacaggcctgacaaaataccggctgctttcggattacgtgaagcgagagatagcaagaacgttatcgaaagataactcatgcctttttaaacaatttggaacagtgacgtaaacaaaattacgattgcaaataaaattgctatatacaatagcactttgtgaatgcgatctggtaataagcgcgatgccatgtcgttaagtatcgcgttatgattcagcattcgcatattatgt

SEQ ID NO: 4420 - DNA, 168 bp, Bacillus thuringiensis
cgacaggtgaaccttgttttttgccgtctattggcgcaaaaatgtgctggggtgacaccgctctaacacggttttaaacatgttatctacgcttgttacgacttgtagatcctcatcatgccgcgttagtagcgtgtgtcgtacggagcgaaattctatagccgagtc

SEQ ID NO: 4421 - DNA, 224 bp, Bacillus thuringiensis
gaagcaagacgacaaaagcagagagaacaagcgcgaggaacgttaaaagaaagggagaaccaaaccgaacgggggggggcagaaacgacgagaacggaacaaccacagaacgcgaacagacgaagaacgagacagcaaaggagcgagcaaggagaaaaaccaagaacaaaaatccatgaagaggaagcacgagaggccagggcaccgggagcaagaacaggggg

SEQ ID NO: 4422 - DNA, 275 bp, Bacillus thuringiensis
ggcgtcctcatgtctggcacacttggagttcctatttctatatctcttccagcaagagggtatgcatattctgtaaaatatccatttttatttggatacacgtttatccatcttgtctataacttaaggagctatgtgcgaacggatagaccatctgaccatggcagtgcggtagaaatgtcgttacttggattagccccatgcttcgtgagtacaaaacgacctgatataactgcctatacattcccagtacaaatcacttatgtcggacatgc

SEQ ID NO: 4423 - DNA, 140 bp, Bacillus thuringiensis
cacgcgtcacgtatgcaggcatcaagtacgtgatggaattccctgcctttgataactgaatacaatggtatatatcccacaagtttatcaccctcacgacgctttaaggatgctaaggatagactaatggagttccaaat

SEQ ID NO: 4424 - DNA, 301 bp, Bacillus thuringiensis
ttttcggatgatgacctgattttttaataccgagatctctatccagatagtggggtcttttgggtgatttgatttgccaagatctaacatatacattaagaactacatttactttggctactgattcagcaacttatagattacaatgcgacttgcccactttgtatggtattaggattactatgcatccgggagggttaaaccaatgacgaggaagaatacaacgacaaaccctttgtgcatagatcaccggtttaatacctaggttaagttcattgatcagaccaatctttacgtacct

SEQ ID NO: 4425 - DNA, 424 bp, Bacillus thuringiensis
  unsure (1)...(424): unsure at all n locations
aaaaggacataaagangcgttcccttaaaaaanngcgaaacaacanaaaaaacgaggggagaaagaagacaaaacagaaacgagacacaacaacatgagagcaattccagcgcacagaacaaacggaaaaaaatagaagaatggactttcaacagaagaaggaaacccacacattaaaaaagcaagccaaaggggaggcaaacctggaaaagaatgggcaaatcgtaccattaaagaacgaagctatacgacataaaaagggggtcaaggaagaaaacaaagggaagaacaacatgaaaggacaaaaacaagaggcacataccaatcctggaaagacaacaacccatgcaaaaagcacggaacacacggaagaaaagaaagggcaaaaagagcagaagaaagagcgaagggacacaacaggaga

SEQ ID NO: 4426 - DNA, 243 bp, Bacillus thuringiensis
aaacccacccggggacggagaaagagacacacaggcacaatcagcgcacgacaaagagagatacggggacacactatcaggtggatcaggactctcaagaagctgttgcagagatattacaactacacacagaacccatccgtaaaagcgggcacagatattacacaggcgatgggatcacaagaacgggcgccagccatactacacatatggaattaagcgaaacgcaaggagatactataa

SEQ ID NO: 4427 - DNA, 161 bp, Bacillus thuringiensis
gaaaagaaaccgggacgagcaagaggaaacacggggactaccgaacaaagaaaacggacagtttaatttaccagcgcaaccccggacaaacaaaacggagcgggtgcagaaaccccaacggaccacaccccaaaccgccgaccaagggagaacgaacgcag

SEQ ID NO: 4428 - DNA, 476 bp, Bacillus thuringiensis
tttcaaaggcgaacgcaaaacccatcaggacatctgtgatcaaggaagacatgaaaaagaggctcctattgaacatggtgatgaataccatatacaaacaacgcataaccctataatcatactcatgagacattgaccatgcctagctgcaacgccacctagtcataagcagtataaaactgctaaaaaagaacaacatacttgcacttaaagaatacataaagaactcaatcatactaaaaaggactaaggattgctttatcttatgcacccccgtgaactttatatgacctaccacataatgtatgacttcgctttagatcaatgcaccctttcagtaattaatacaccacacctatagcatgggctatataaaagcatctggctaaaagagcatacaaccatgacgatactacaactgaattacacgacagtcatcttaacaatgctacatttgacgaaccacattgccttaa

SEQ ID NO: 4429 - DNA, 336 bp, Bacillus thuringiensis
gcggcctagcaatgagtgaatctgttcccaactagcgcaaataacatgaatttattgttaacgcaggcacacaagacattgggagcgccgtactgaaagataacggcaatgccgcataggaaacaaagcagaaactatcaacggaagtgttgcgccatacaggatcgtatgcggctgatatttgtacctaccatacacatcagctgagccaacacagctcagacacattgactgccacattacaaaaaaagcttgacttacacatagagatagagaccacattcatgaggctactacatataatgcgccggacgcagcaacgacttactgtcgcta

SEQ ID NO: 4430 - DNA, 349 bp, Bacillus thuringiensis
  unsure (1)...(349): unsure at all n locations
agacacacaaagagaaaccccaacggaacggaaaagaanttcattgtttagcgacagacggacgaaaaccgcangggggggggngcgaaaacancaacagcgagccgaccccagaccgcggaagagaaaaggaaaaggaacaagcccaacgcacccaggaaaaaacggacaaaaacaagaagcagacaaaaaaagacaacgacggcaaaagcccaccaacgacanacacacaacgcgccagacaaaaaacaccccagcaaacgccaagaaaaaagcacggcccgaaaaagaagcagacggcaaggagaagacacccgagggcgccgaccgaaaaggagccagcaaacaa

SEQ ID NO: 4431 - DNA, 199 bp, Bacillus thuringiensis
caacaggcagtaacaggagcaacaagaacaacaaacaaccaagcggaaaaatcaacacgaacaagaacagaaagcgcaaaacaaacaaaaaggagacaaagagacacaaacgccagaaagcgccaggaaagaaagaggcgcaacacaacgcaaggccgacccacaaaagaaaagaaacacaaaacgggccagaatgaga

SEQ ID NO: 4432 - DNA, 219 bp, Bacillus thuringiensis
  unsure (1)...(219): unsure at all n locations
ggcgcggatgagcaagaggnncttgaattagcaagagaancaanagagaacgaaggagaaggagcagagcaagnaaagcaggcgcgcaccccacaaagaaacgacacaggacgggncngaaaacacggcaccgcagaaggagacgaaccgacggaaaacgagaaacacccacacggcangcanagagcacccaaacgggcgcaggagaggagcgaagaa

SEQ ID NO: 4433 - DNA, 456 bp, Bacillus thuringiensis
cactaggactaccgggacgacctcacctgccggacccacaggcacaacagaaacaacgggggcgaccggaccaacagaaacaagacgccccacaggaacaacggggaccaccggagaaacaggagcacccgggacacctggcgctacagaagacacagcgcccacagaagccaccggcaccacaaggacgaaccgaccgcaacgggacgaccgggaacacaggcacgaccagggcaacaaacgcaacgggaccaacagggaccaccgaaaccagcggaccaaccgcagcgacaaagactaccggaccagacggacataccggggccaggggatccgcagaggccacacgaccgaccggcacaaccgagaaccacaggggccacagggactaccggcaagaccggaccggcaggaaccaccggggcaaccggcccgacaggagccaccgcaccgaca

SEQ ID NO: 4434 - DNA, 315 bp, Bacillus thuringiensis
  unsure (1)...(315): unsure at all n locations
ccgccatcgggaccggagcagtactggtcttaaacggaacgacaacattgggttaaagcgcggcccgcacaaaanacacccggcaagggccaagacccgcaaaacaatgcgcgacacaaaagaagacaaaccaagcggcaacagctggaggagaacgagactgtgagagtatggacgagggacccgacaatcaaaacaacaaagacgcacctggtgtacaaaaaatacaagggcaagaggcaccacagaacgaggcatcacgccaagcacaggaacaaaacgaaggcaaacgaagcgagtacacaaagcgcagcc

SEQ ID NO: 4435 - DNA, 107 bp, Bacillus thuringiensis
  unsure (1)...(107): unsure at all n locations
aacngcacaaggaaccgnagagggggggaacaaggcaacccaagccccgcccccacgccaaccgaaaanaaagaaaggaaagcgacgaccaccacgggnaacggaag

SEQ ID NO: 4436 - DNA, 360 bp, Bacillus thuringiensis
  unsure (1)...(360): unsure at all n locations
agggcgaaggcancggcatttttatttttattccaaaaacgcannggaangaaaaaggagaggggagcggatagaaaccaacgaccgccgcaccacccccacgnnagcgnnggacannnnnnncnaaagaaaaaagaagacacgacggccngaaaagaggaganncgnacgcaannaaacaacaaaaacgggacgaacangnncgaaagggangangnaacaaacncagangcacncgggccacanggnaaacaagaagaacacccaaaaaggcaaggggcccggaccgcagaaaacgaaangacaaaaaccgagcaaacaggannnnccgccacaanaaaaagagaggaaaacgaagca

SEQ ID NO: 4437 - DNA, 394 bp, Bacillus thuringiensis
aaacaaacaccacgctaagatccaggcacagcagctctaatcgttgagtgcatccattccatccaacggctggctatcttaacagatacgctacacatggcataaaacgcacacacaggaatcgagggcaagatggccagacttacccaagcacgactacattccaaaataaaggactcacgcattacgtcctcagacgtattagaacatagggctgaccgcctgcaataaacacacgcataagctcatatagcaatccacaatgggccggagtggagcatgtcacgagcaatcctcagcatggcatagactatacagacacatgaccttgggagaacatggcccgatctaacgtgccaatcatactgccgccatcccgtcaccgtacaaatac

SEQ ID NO: 4438 - DNA, 204 bp, Bacillus thuringiensis
aaacccacaacggcggcaaaatgcattgtaatactaaacccaacgaaaaaaaggccaggcaaagcaccaaccgcgacaactaaaaatgcccaacataaacgacgagaccggacagctcatggcaaggaaactgaaacaaaggcaaccaaaattggagcaacaacccaccgaacaaaaccagcaaggccaaacaaaagacaaacg

SEQ ID NO: 4439 - DNA, 221 bp, Bacillus thuringiensis
  unsure (1)...(221): unsure at all n locations
gagaagcgaatacacacaaaagaaacagttttattttacgagccgccaaaaaagangacggggggcgggacagaagcagagacaccaacanaagcacaaaacgaaagggaaacagcaaangaaaaaagagcacgaaccaaggaacnccaacgacaggccaccccggcaacacgaagagagcaaacaccacagggaaaaaaaaacaangaagcgggacagaa

SEQ ID NO: 4440 - DNA, 251 bp, Bacillus thuringiensis
  unsure (1)...(251): unsure at all n locations
acgcganatttcgcagacacacaccgcgagagaccaaaaccaacaggcagacttcacagacaacagaacgcagtagaaccaccgcnacaaaaagagaaacagtagaacctttttagaggaaaacaacccagatacaactaaagcgcagaggcactcgaccagagagcaagtacgcaaacaataaatggaggaccaaactaagccaacaccctatgtgcctacacaaatccacaaacacccccacaaaagac

SEQ ID NO: 4441 - DNA, 481 bp, Bacillus thuringiensis
  unsure (1)...(481): unsure at all n locations
gcaggaaagaatgagagcccaaaagtgaaaaccagggccaaaaccaaaccacgagagaggaccagaaagngcaaaaagccacggcaccccagacacaaagacangagacgaaacncgagaaaaaaagcgacgcggagcagcgaccngagaagagcaaaaagaccgcccgcaccanaaagcaaacggaccaacgggcggacagcaacagcgaccaagcaccgcacgccgccaagcganggagccagaccccacgncaacggaagagcccacaccggcaggagacccacccccaacangaaaaggagaagaacgaaggcaagagctaaagaaagaccncagaacagggagcgcaacgcacaacaagcaacaagcagcgcgcacaacagacaaaacagcnnccgacacaagcggggaagacggggagnacacagagacccacaaaaaaaccacgacccccgcagaaaagcggacagaagaacac

SEQ ID NO: 4442 - DNA, 217 bp, Bacillus thuringiensis
cattacttgaagagtacggttatcttcgtcttgaacacttgtggaagacgaataggagtacatggggcctcataccttactaaaggtaataaggaaccataagatgggctactagatgtaaaagaacccgccgatttggttgcatatgagtctctagaatacgaagaaataaatgatctgcgcagaaacggtgtaaaatgttgttgcatcagctacc

SEQ ID NO: 4443 - DNA, 124 bp, Bacillus thuringiensis
  unsure (1)...(124): unsure at all n locations
tgcatatgaagcactcgcaaatctttttctctaacgccgaggacacacacgagaaaccgaggggaggataaagggaaccaagaagggccaaccacaaacaagacaggcaacnggaagacggaca

SEQ ID NO: 4444 - DNA, 336 bp, Bacillus thuringiensis
  unsure (1)...(336): unsure at all n locations
gcacggggggcaggngcagaggccaccccacaagaaacgccaagcacggcgaaaagnccancgagaacaccggncacaacgaagaagacgacgaccggcaacgcaccaagccaagcanggcgaagagcaagaccngccacaacaccngcaagacgcngacccccccccggaagaacgccaaccgccgacggnaagaagaaagaaccnaccccggagaaagcaacgccgacggnancacgagcgacaangaacgaaaccgccgcgagaaacggcggaaccaaagcaaaacgaanggggcgacgaacancacccaaaggaagagcaagaccnacaggc

SEQ ID NO: 4445 - DNA, 279 bp, Bacillus thuringiensis
  unsure (1)...(279): unsure at all n locations
aacacaaaggggagggggggacgggcacacaaagggacccgcccacaccacgaccgaagaacaaagaaagggaccagacaaaacaaccacgacggaaaggaaaacaacagcaacagaacaggcggnaagcaaaacgaaagagaaaaacccacaacaagagcgagcaaaacgcgaccaaacaggaagagaaacacanggaggagacagaccaacaccngnacgcagagacggagcgcgacaaaaacaaagagaagcacgggaaggcaacacaagcacaaa

SEQ ID NO: 4446 - DNA, 207 bp, Bacillus thuringiensis
  unsure (1)...(207): unsure at all n locations
ggcagagtaaaagnaacgaaaggaaaggncccccgaggcaaanaancggngncnacaaancaggggaggagcggggggaaanggnacggggccccccacaaaaaccaaggtcaaaaaggccgacactgaatggaaaagaagaaatgcaaaaaaaaaccgcacaagcggaacaaaagaacaaaacaacaaaaagcggccaaaacagca

SEQ ID NO: 4447 - DNA, 336 bp, Bacillus thuringiensis
  unsure (1)...(336): unsure at all n locations
ggcagaaagcaggagaggaggacgaacgaccgccgaagaagcaaaggagaaaaaagaaaaaggtgaggaacagggagaacaganacaaggccccccccaaaacgaacgggaacaagaagcgnangaccaacnagaacaaaagcaaaagaaagacaacaaaaaaaccgaaccaaagaagacagaacgaaaggaaaaagaaccgcaccagcagaaacagcaaaaaggggaacccgggaaagaagaaaagaaaaagcacggacaagaaaaaagagcagcaaaaagccaaagacaacgcacaggggacgaacccacagaaccgaacgagaaaccacaaaa

SEQ ID NO: 4448 - DNA, 151 bp, Bacillus thuringiensis
  unsure (1)...(151): unsure at all n locations
cggcngggaaaaaggctctacggaaaggggaagagctggcaaaganagaggcgccccccaagaaacaaagggaccagacggggacacagaggcaccaacgccngcaaaagcgacaaggaaagaagggacggcaaagcggagcanaccccca

SEQ ID NO: 4449 - DNA, 157 bp, Bacillus thuringiensis
  unsure (1)...(157): unsure at all n locations
aaaacctttttttttttcgaaggaacaagngcaaaacaaanaacggggggaacaaaacttgaaccacgccgccaacccccaccaaaagaaccacaaaaaaggcagcacacaccgcacccactgcaggagcccaaatgaccaaagaggaaggacaacc

SEQ ID NO: 4450 - DNA, 483 bp, Bacillus thuringiensis
cccacatgctatctgtgtaacagctgacgataacgatcccattttagctcgacgatattgccaatgcatctgcggatgtactgaaaggcgaaggagcacagatcatgaacgtcgataacggaccagtattgtctaaagcagaagttgcagaaaatgactgtccaatggaaactcgcgtgcaagagccaaaatgtgcgcaacatgcgtctctgccgtccggatacaactggactctagaatgctctcgcattctcactagaatgcgaaaaccacacagcgaaaagagaggatgatgtgtataacttactaggcttaccagcattaacgaattgacgctcgtatggatgaacacacaatgaacgtgaaatcgcacgctccatgatacaagaagagtgaagggacaaacaagtggctctaaaattattaaacggaataagaatacatcgtaacgccgccgattaatcgctcatcaacaaccgaaat

SEQ ID NO: 4451 - DNA, 110 bp, Bacillus thuringiensis
catcacttacacatattcactattttcttccacacgattctacgggcgcccggagcgaatgggatagtgcagatgtcgcatcgaccgtttatgatgatttattcaatatt

SEQ ID NO: 4452 - DNA, 403 bp, Bacillus thuringiensis
cagttacatttattctctattacactcaacaggtttctacgggcgcgaggaacgaatgggatagagtagatgttcaatcgacggttaatgatgagttaggcaatctttattcggccgaaggaaatgacggaaggggcatctgtccttacagaatccactgggagtgacgctctcgaatactacacgaagatgcatcttcgcttatcgctacaccgcgcgtgcgcttccgagtacatacccctgtaaatcatggtggagaacatcttgtgaatgcgatggattatccattcacatggccttctaatgactcttagatcatagatatgccagtgatgagaatttggatattagatttccacgttctaaagtatgactgcgctctgtcatctgagggagcaaaaat

SEQ ID NO: 4453 - DNA, 212 bp, Bacillus thuringiensis
gaaagacttctggccatcctgtttttaatatcagatcaacatccgttctcggggtggcaatacatactctatctacttgatgaagcacttcgataataccgttaaacaccgtcgctgattacgcagcccagtatacaacccaaatagaaaatgaatctttttgcttatttacctgtataactccaatgcgacctcaaagttatggccatatg

SEQ ID NO: 4454 - DNA, 169 bp, Bacillus thuringiensis
caagctatatccactttttccttcacccacttcttctgtgcgttttatcatccctgctttatccataatattcggagactgctctttcctttcgggctgaggctcttctaagtggttctctgagtagtaacgatgactgctttccattcgaaattttggaaagtgaact

SEQ ID NO: 4455 - DNA, 178 bp, Bacillus thuringiensis
gaaccaccaattcgtgataaagtctcattgcttggatatcttttaactttataaattcgtgcgccactaaaaacaacatgaccaaattgggtggctgtaacatcaagaacggctgttacttctccgtttagaccacctccatatttccatatggatccatgccgcatgccaaaattca

SEQ ID NO: 4456 - DNA, 507 bp, Bacillus thuringiensis
gacttataatgacgtatcaccattgtgagatatactgactatgtgtatcacacctcttatattcttgagaattgaccagccacaacaccgttacctacggagattcatttatactgaagccttaggagtagcactacaatgaagctatctccggttacctcataaaatatagttgctgccggaggtaatcctttatgtatgatactgcgcatccagactatgcagggagtaggtgacatcatgaatgtgaccagagagcatttatactaggactattacatagcactaaccgaaaagtaatgatgataatactgacattagggattcatttacccgcacagaagctgatacttatcacgcactaaaaaagacaggcggagaatactgctttgttttaaaaacatttgacagatgaagtatcttcggttcctcggattaatatcatcatgtgcttgaattagatctatctaacgccgctgagctattttatgatgcacttcaagaatt

SEQ ID NO: 4457 - DNA, 108 bp, Bacillus thuringiensis
tctgcagaaccgaaccctgatattcactcttcaataatcagtcatcctacgggcgttgacaggtgcataacgtgctgcaccgagaacagctttttcgccatactgaca

SEQ ID NO: 4458 - DNA, 351 bp, Bacillus thuringiensis
cattacaggcgaagcgcttttgtgtattcaacatgtcgcgggggcacgcggtatgattatagcgcggtttcaacatatctacatgctgacaaaattggatcgaaaacaattcaagcggatagcagtgtcaattctctatacggtactaaatcaattgaaaacagaaacacgactaaacgcaaggcagaacatgatatccacaggattgtgcctgctatgatcacgcagcatggccgaggaagctggcgtttcctaatatggtacgtgggcttgtccaaactcgagaagatgcagactttgcaattcaggcgcgagcacgtgcaagactatcaagataccatgcagtatgga

SEQ ID NO: 4459 - DNA, 298 bp, Bacillus thuringiensis
cacgcgacttgtatgggatacacaattcgagatattgactccggtatgagattgcacatagcgaaacggtgctttctgatcgtattggagaaaatacagattcaagggagtgtttttatttaatggcggggaaatgactgaaactataagctactacattaattcccgaatacgctgtagcatgatacaagcttattaaaaaggtaactgaaaacggaacttctaaagtcattaaaccgaaagcgtgtcgtatgaatctcgaaaaaactattggtacgagaactgttttagttcgtaa

SEQ ID NO: 4460 - DNA, 170 bp, Bacillus thuringiensis
tgctaatgcgggtgattctatttttgccactataaataacgaattgtgcggggagtcacatgcgtgccacatcgtatcggacttgcacttgtatatagactggatcaaccatggacgtacatcactcttggtcaatcctggataaacataattgctcacgcaaatgatac

SEQ ID NO: 4461 - DNA, 138 bp, Bacillus thuringiensis
cttgggtatctttacatttatataatagccaccacattcaaggactcttggggggcatacctggctctaataaacacgtttggatgtatctccataataaaacaaccttcttcatcattacggttggtttttgcaact

SEQ ID NO: 4462 - DNA, 104 bp, Bacillus thuringiensis
tattaattaatccattatacaatcattacccacccataataccaaagatagtgtgcggctcatatcaatgggattaccggccattattctttaacagggtaaac

SEQ ID NO: 4463 - DNA, 165 bp, Bacillus thuringiensis
  unsure (1)...(165): unsure at all n locations
ctttgcgcctaatgtagacaactatactccgcactacctantacagattctagaaaatgtacaaataggggagcatttcatgaaggaagatccaggggtacctagcttctcttactcccgatataattgctgaataactccaccactctcaaactccggcatgat

SEQ ID NO: 4464 - DNA, 196 bp, Bacillus thuringiensis
aagaataacagataccccaacaaatccaaatgtacatgtaatatttggaccagaaggattatttaaactactaacagaactagacattaacggctcgtcaataaattacgtcatgggcactactcactaacgctccaaagtttgttgaactagagtacaaaacgctataaggctccatgcttccatacttttgaat

SEQ ID NO: 4465 - DNA, 146 bp, Bacillus thuringiensis
gggcgttgctgatgctacaagttcaattccggtaagctgattaattcataatggggccccataagccaacaggcaaggctttgctctaagaccacacactgaagggggtacctggcttgcggactctatagctataacgggcctcc

SEQ ID NO: 4466 - DNA, 255 bp, Bacillus thuringiensis
gggcggggcgcttcatacctccagtccaacatggtcgttctttatatttatttatgggacagcgcgacacataaaggccagtggatgcttagcgttatatattccagactgatgggccgcttatgagaaacaacgttgtgcaaatcttggagtctcaggaccacacagcgtacaatgactgctatgataatcactcctactaaaataaatgaccatatctgtacccacagcgtataccgctgtacgttttcgatt

SEQ ID NO: 4467 - DNA, 244 bp, Bacillus thuringiensis
gcgcctcactggtactactgcgctcatacagttagatgatgtcgccttcagacatcttatcctcgacaagatgaagagctatgtcttgagtgttgagacaacgaccaacagggactgatacctaaagcgcttttacacattggatgatgcctaacactccgaagctaagtttcactaccgtttttgttattaaaacacatgtcatcgtcgctagtgcttggacaccaccgatacctcctttatg

SEQ ID NO: 4468 - DNA, 267 bp, Bacillus thuringiensis
aacttcagatagatcggaatcagctcactcaacggaggctatacgatatggcacggacgcagggttaaacgctatacctcactctttacattaacgacgtccacttcatcttggaactgcatttaaccctatactaaattgaacttgagatagaaaggatttaggggtaggctgacttctggcggaacctaatgcattcacccaaaagcacatgagagcaaacgggtatcaatctttattgacaccttgggtagcacaggtggaggc

SEQ ID NO: 4469 - DNA, 455 bp, Bacillus thuringiensis
  unsure (1)...(455): unsure at all n locations
cttacgggacagtttaactgagcctataatatctagggatccggcgtatgcgtgacgttcacacgcttcaacatattggttactcattgctgatagcacatggtagattaacgcttgccaatacccactgacttgggcttcactgccgcagagaattactgaggatagttggtgtgaaaaagtcatgtggcaagagtgcatgaccgtctctaatggcaaagataatgtactcggntgcatttggaaacagctccgaacttatagagcgagcgaggtgcttgattaacacgtactcactatgacagtttgtctatcgatacactggacgaaatgatgcctccattgatgcgagaccagcggatctttcttcttgagcgaaccgacactgggagagcatccgctattttactagctgacaccttcctacggtgactggatggggagacctgattcgg

SEQ ID NO: 4470 - DNA, 248 bp, Bacillus thuringiensis
ctcaccggacctgactcactcccacgtagccgctacgctttgacttctgtcccagatatggtgtactgtgaatatcgacttgcagctgaagggcctacggacacgattgaacttaatacctctgcagtgaacggtctgttaaaaactgagatcatatgcttcgttaatgtcgataacgatcgcggtcatatgccttccggggcttactccattgtagtaccctttacgcttgtgtgagcccataaagc

SEQ ID NO: 4471 - DNA, 143 bp, Bacillus thuringiensis
ttctctgataaattttgaaactcttggcagcatccatgcatatcccctatcacgtcatatctcatatttgaaccttcattcgatttttccttggttttttttaaaagggattgagattaaaatatagcggatctgggtgtggt

SEQ ID NO: 4472 - DNA, 222 bp, Bacillus thuringiensis
gggtaaccaaccgtgaccgactgtaggcgctgtacgccctcaaataagcccctgactatcaccgttatccgataccaataccgccaatctgcgtccattaagcgattgcttgactaatgtcagatgcgtgaagcgcataagttggtccgaaggcgcctgccctattcaatccgagccaacggtcacccagtggattacgtggattcgccgcctttaaatttt

SEQ ID NO: 4473 - DNA, 284 bp, Bacillus thuringiensis
ctaccagatcgtaagaggaacggttacaaaggataatgccgtttgatacttcttgaaaagaaccgactggacttgatagttgctcaagaacaacgcgtctgagagcacacatatatttatcttttctatcaattagctctatacgaaaagcaggagtagagtttcctattgtaacatcgccgatggctttataatgtcacgagactatataaggtgtgggtaacactgtaattccaagaccgttgtaaaccatcgctatcaaagatgccaccgcaccaagttct

SEQ ID NO: 4474 - DNA, 106 bp, Bacillus thuringiensis
ctaggatgcatgaggctcgaagacgaaatgagattttcattgtcgactccgtctacgtgacgagcgatacacgaatgcgctctggcgggagagaaggagagaccta

SEQ ID NO: 4475 - DNA, 123 bp, Bacillus thuringiensis
agccctagctgcaggagcacgactgcaagattcagatcaatcgccactacgtctattttcggtgggaaacaagaatacctcgttgcacgcatagtggaccaggtttcatatgatgggattcct

SEQ ID NO: 4476 - DNA, 120 bp, Bacillus thuringiensis
cattttaatcacccagcataaggttggatatagcggatggggaatgcaccctggtacagaatgagcttttgacacaaacggatcaagatattcaataccatgttggtacacatattccga

SEQ ID NO: 4477 - DNA, 192 bp, Bacillus thuringiensis
ggggaaggaggatgtggcaattgagacaagaataatttatgttatgtgcggttttttcctgcgtgccacatgggttcggactcgcccatgttgatcgactcaatgaataatggacggacatcattggaggtgtgacctggaatgacaacattggctagctattcatacgcaacggtatgttccatgattttc

SEQ ID NO: 4478 - DNA, 220 bp, Bacillus thuringiensis
gaaaccaaatcagattggctgatagcgttctttattagagaacttaaatactacatattacactcgcttccatatacttatgcacaattgtatactaataagacattttctaactctaaaaataacgaatatgactactcaacacatacaattcagatgcgttaaacgttcttacatgcttactacaggggtggaccttatgcaaattcacgcccttaac

SEQ ID NO: 4479 - DNA, 112 bp, Bacillus thuringiensis
tttatcattaataacatatgctatttcaccatgcatttcctcttattattgctaaaaccaaagtgtgctgatggagaaggttactgcaactattgtacttgttaccatgggc

SEQ ID NO: 4480 - DNA, 482 bp, Bacillus thuringiensis
ttaaacagactcataatctgaaacataaacgaggattgcgattttgcattacaaacaggttatcacccagagaaccgtcaaaaattgtattaaagtgttgaagagagaaataagaagtgccaattgaagatagggaacattagctaaaaagggcactctcgtctgaagaaattgcagccccattacggggatttggtcatattcgacaataggctgctgtacatcgtggatatgcctagtgtactaagcatctgcttgatacggaatagtgactattgagtgatactattcatttgccgattagatgggggattcgagatgattaatcacgaacgtcgggagcgcattaacttcttatcgaagaaagcaaaggctgaaggatacactgaagaagagcaacgtgagcgacattcgatacgtggacaactatcttaaatggattgcgtcaaaatccggtgaacgaacctcaatgtattaaagcc

SEQ ID NO: 4481 - DNA, 149 bp, Bacillus thuringiensis
ctcgccgaccgtttattttctaaagaacacgacaagcagctaagggtgtgaatgatataaacagggatgatgctatcttaacaaacaatgggcccccgggaaatgtccatgacatggtagtgaatgtaccggatcctaaaacggatata

SEQ ID NO: 4482 - DNA, 465 bp, Bacillus thuringiensis
cgcatctgacgaccgtgctcgggacgggcttatcagtggatttatacatctgaaaatgtacgctatcctgtaaaggtctaatacctaggaaagtcattcgaggtacccccaaccgtatgttttgataacccatatctagtgcttccgagggatccctgcacaagagttggttatatcttcataaagccaacctagtgtcgaaaaagtcctgaactcttgactgagccatgtatcaaggacatggttatatcgactccagtttagaagtttctgctggggccaccgttcgtacttattgtgcacgagatagtgagtgggaccaaactagaatccggagaactacccaaaggtgacgcaatatacaccatttctgtacaggttgcgttcagcccgtatatgggatttctacccaccgtgacacgaacagcgctagaaatgataatttcagttgaagcactacagcga

SEQ ID NO: 4483 - DNA, 408 bp, Bacillus thuringiensis
gaccgcctagaagcgaacccacttaaagcctctttttgcactgctaacagggccagaccaaaggcccctccccacgatagcacagcctgtatggcgcatggagactgaacgcgtgaatatactcgtaaaagtacgggtaaactattgtttactcatctaatttgaacagccatatgtgcgtggcggcatagtcccttataaatccattgaatcgacctacgtggggatgagtggtgatccagttcggaacccgagtccgcttttcaggagcgtggctcttgactgccaagggctgaaataccgtctaatatggcgatagcctgatcaatgatccaagaccctagttgagtactcgggggtcgaggggccgcaaagcgctaaacctgaaccctagtgggtgcccccgct

SEQ ID NO: 4484 - DNA, 513 bp, Bacillus thuringiensis
  unsure (1)...(513): unsure at all n locations
gtctgtatcgacaccttgcgtatcacaggtgacggctcttctgtttggattagaagttgcctgtgtatatcgtgttgaggatgataacactaaccgtattcgagccaatgaacatttgacaaaattacgtcaccctccatctagccttaaacctataggtgatcttctagagggactagatcgcaccctttcattaacagacattgctcgcggattctatgatggccatagcagaagagatctattatagcaagaacaagaatgtgtacaacatagcagacactgagcatgttctgttatcaaaactatagcggactaagagataagagtgataacgactcctacatgggtgtcgctcctatatcacaaaatatgactcgtatataaagatgccgaatatatacattctaactatgggctagaatctatgacttttaactgaacgtaacactatgtatgtgaaagaaacctgaatatggcacangcctgtcacaactatatcgatcactttcg

SEQ ID NO: 4485 - DNA, 180 bp, Bacillus thuringiensis
acatacaatcaggacttgcatgcctttgttggatcaacggattgggatcaggatcaatgtcgcgtactttaaacggtaccctcatcatatgttgcccacaagccaccactaccaccttgtgtaaggacgtgatacatacataatcttactgtgccaacagagagaatgattccgtaccta

SEQ ID NO: 4486 - DNA, 356 bp, Bacillus thuringiensis
gtagctcagccggatagagctttctccttctaagcgtacggtctggagttccaatctttactgggacccttaagcaaccttgatatcttttgataacaaggctttttgcatgtctaagattagacgttggcgttatatgagtagttcattcttgatctttgcgacctttacttagatactcatagagggcgtacattcacgaaagttcttaactaaaaggatcgccacgtatactgcagtgctgcgctcattcaatttaacgagccaatatgattatgaaggaacccacctacatgtccagatgctctcaagagaatacttaccctgctttaaaagcatttaccatccttccacac

SEQ ID NO: 4487 - DNA, 139 bp, Bacillus thuringiensis
cagacttgatgatcgtcggattccaaaagttcaagaccggcttaaagggttgatttttttgcacacagataagggtagattgctgtgggctaataaagagcaattatccagcagagcgttaacgtacgacgctcttatg

SEQ ID NO: 4488 - DNA, 182 bp, Bacillus thuringiensis
tatattacgatatgggttggatgatttattataattgcaattacaaagccactttcgcaagtggagcgggttgcatattcattcggctactggagtactttcggagcagatcacagcttcttcagaggatcaagttggacgattaggataagcatctgctgtgggggcacattcattagaat

SEQ ID NO: 4489 - DNA, 296 bp, Bacillus thuringiensis
attttacacctacagccttttttttcacttcatcagacatattacttgtcacgaggtacaaatctccttagctgactgtaacattaagttctactacataaggaatgtgtgtctaatacgggatctacactgagcttattgcaatttacaaacttccggggaaccattctatatacgtctcatactagcctacgtatttatgattaagagttctgccggactaagagcatgctatttttctaaaatgaacctatcttactaaaaagatcgttctatacagaaagatcgaaggcgtt

SEQ ID NO: 4490 - DNA, 441 bp, Bacillus thuringiensis
atggggtggattcatttgttatagctactgaatatcatgacttgttatagcagcctctttccttatacgagcatgtatcttgtattgtataagtggttgggtcttggaaagctcaaactcctattgatactgtacattagaaaaataatgcgtactaacatggatacactaatctatcgatatgtatctacttctgacctcatgtgtttccttgctcccgctacatctatttgggatatagctttactgtatagcgatgtatgatgaacgacctagccttatatcagccttcagaccattataggataaagccctctaaagaagcgggggtattaataaccgggctcttaacgcatcaggtatctgtgattttgctttatgaatgcgcttaaacgaccaattgtctgagtatgatacggagacctacactccatcattggc

SEQ ID NO: 4491 - DNA, 316 bp, Bacillus thuringiensis
gattaaatgcagcagccatcttttgtataagaatccgtttattatgcctcaacgggggggagcttaaaaaaggtgaacccattgtaaagagtaagcttacttacaaaccagaggttatggaagggggtttgtgtttaaaaagcggcccgccgcgctcgattacaaatatatttgttgggtttataaaaaattgctatgcccggtcttatcagacgatttaaattccatgggtaatttaatgggcaataatcattttgaaagcttacatggtattgggcttggcatggcgcttttctggtggggggggctataaatt

SEQ ID NO: 4492 - DNA, 138 bp, Bacillus thuringiensis
aagccgcgtcggaatattatttaatacccttgctgtctttcaaaggggggccagaagcagaattagcggggggggacgccccgatcgctgccaaaatcaaatgcactgaaatcgtccccaatgaagacggtccgcttt

SEQ ID NO: 4493 - DNA, 191 bp, Bacillus thuringiensis
gctcattactcgcgtgcattaatgaatagttctgccaattttgtactctttaccgctaaacctattgtaaggggcggttcaattgcacaatccgtggagcgaccatctcgtatagcccttcccaacatattctcaaaactgcttcgcaatcttaaaggggcgccattatattttggtaaaaattctgccac

SEQ ID NO: 4494 - DNA, 285 bp, Bacillus thuringiensis
aatgaatacccgcatattgatttttattgtagctgggaatgaattaaatgaccggggggtggtacaggctgaactccaaacggggaaacggattccaaatgatctgcaaaatatgggactggatggcatttcttaaacggaattgatgtatccccctaatccaccagttccccaacctttatatcaaaatggtgaaaaaatgatacaaaattttttgttttatcccaatggaacgtgaatccatttttacaggaaaaccatattggtttgccgatggaaattttt

SEQ ID NO: 4495 - DNA, 357 bp, Bacillus thuringiensis
gtccatttgcaaagtgcgtaatacacctgatcaaccatttcataattctttaccgcgaaacatattttcaggggggcataaattccccattctgtttagcacctgctctataaaaactaacccgtactccataatttatttcccactatcaaaaacgcactcctcttaactttacccaaaaatcgtccaccaaaatttttttaccacccccctgcaaaaattcttcattaacctgcctatattttacaactccaatttttccccccaacaaaaattcagatttttctccggcttttcaattcattaacccctattatttctttataaaaaaaaaaaattttttccctttttcccccc

SEQ ID NO: 4496 - DNA, 109 bp, Bacillus thuringiensis
  unsure (1)...(109): unsure at all n locations
tatatgcaacaacgtacttaatancatttatatgtcaattatgtctaaaatagaggtaagttttaaaaaatgtaaaatcccattcgaaaatgagtaatgcttactatac

SEQ ID NO: 4497 - DNA, 141 bp, Bacillus thuringiensis
tacaacgaccaaaagtccactttccatatatcaatcgaagatggctgaatgaatgttaaaaacattgaatagggggtgcttatacagcctttcatcgggacatccatctcttcggaaactctaatgccattccattaaaaa

SEQ ID NO: 4498 - DNA, 180 bp, Bacillus thuringiensis
ctcgtcacggggggcgtatctattattaaaacccttggaacataagggctcgacggacggttgccaagtgtttgacaatagaaaaccagtgattggagcccctgtttatttggactttgattaggaacattagcgcctacatgtatacccgatatacgactaccgagcacggtgtgtgta

SEQ ID NO: 4499 - DNA, 492 bp, Bacillus thuringiensis
ccagccaaggcaatcggttcttctatcactcaagtcggagtggttgaccaccaaaaagtgtaggcgacatatgattacgtacagaggcatgtttcttatgattcgtattatcaagctttctcagcatatgaagctcttgtctactgcgctgcggcatgccacggttgctcactattcaccatgcatttacttatagaagcccggattgcctatcatctcgtgtctagaactggggacagccacccctatgcctgctatttgacgtggacctgatgaaattgctatcacctcgttacaggatgcactgaccctgtgccagataagcatggccgcggaacgatctggtatttgggcttgtctaatgctcactgcgcgcgagggcatgagtggtaccgcgggcactatgcgcgcgctccatcaaactcctgtagtacactgactaatcttattgttgcctgtagaacgaacaccgatgcatgttgccaaatcttc

SEQ ID NO: 4500 - DNA, 137 bp, Bacillus thuringiensis
aacaaccaaggaatcacagaggggtatgatgcgagcagactttgatcaccatcccaatgcggggcccgtagagacaagtctgggcagaactgcataaacaatagccgtgctcacatgtggatacatcgacttggttg

SEQ ID NO: 4501 - DNA, 115 bp, Bacillus thuringiensis
tcggccaacgctcggtgagaggcggcgtgcaactcttgattttttaatacaggacagggtcaccctcagttagctgttgaccctctgagtgggatacccagctcatggatgccgc

SEQ ID NO: 4502 - DNA, 365 bp, Bacillus thuringiensis
ggagacaaatgcaaaacacttacaagctctctgggacaaccttatttttgtagagaagatggtaaataaacatgctgcatttgtcactccaatgacacaaaaagggcccacccatgtctgaaaaagtgcactttggtatgtgagcccaatcaactccggcggtaagattacttacttcaggaactgtgtggaccgaaaagggtagtttctgtccatggattaccagggtatgtgcctatcatgggggtacgcttttattcatacgctgtaaaagtttgattcgaccatgctctcttattgaattcgccccaaccggattggtgctagactactgggaccgttttgtaaaaaacgtttggtgtgca

SEQ ID NO: 4503 - DNA, 346 bp, Bacillus thuringiensis
aggctaggaatccaaatcacattcactaagtggtattggttgggcgacggggcgaaatatcctattaaggctattacccaactatggatggtatggggggcaatacatagtgggtactagaattaatttcagattcaacgtaccaagttcaaaaagaatataaactatactaatcggatctgctggatgaaactgctctcataaagcttgtaactgataacacaccacataatggccatcatctacagcatgacacaatggagagagcgtgtttgttggaatcccactatcaacctgagcgaactgactaatatgaggccaaacatgcatagcacactagtgctga

SEQ ID NO: 4504 - DNA, 237 bp, Bacillus thuringiensis
gctcaacgatttcgccctgaaccaaactgacaccctacttatattgaataatgtaaacgcggtctacgaacggggaattccaaatctaaagtacacaaataaacctgcatcggcaagcattactgcggacctggcagatacgattgctatggcagatatatgaaacagacttcgggaactcacagagatctgactgcgtgaaaaaacatttgattgactatgaaaaggacggaacat

SEQ ID NO: 4505 - DNA, 207 bp, Bacillus thuringiensis
aatcgccttgcagcacaactctttttttaacgacggggaaaccatggaaggcgcaggggcctattacacttatgggcagcatgaaaaggtggcaaccgactaagtataccgctggaaacattcatacgtgtccgatcgatctgcaaaccgggggcatacaaatacggctgctcttgcaaacactctaggaactatagagttattaag

SEQ ID NO: 4506 - DNA, 168 bp, Bacillus thuringiensis
  unsure (1)...(168): unsure at all n locations
aagaagnagaccngcaaggagaagangaaccccccggacagaaaacgaaccagagcaggcccacacacacacagaggcagagccggcgcaacnngggcaacaggcacaccaggccacaaacnnccccacgcgacgaagaganagaaggccccgcaaagggaaaaccac

SEQ ID NO: 4507 - DNA, 283 bp, Bacillus thuringiensis
cgtgtggtagcagcctacgctcataagctgtcgcaataatatgatatatttggaacagcttatgctgctattttatacaccaccggtgacgaatgtgaaacaaacgatctgcgtgtgcgtgaatttggttggccaacatgcgacgacccgtagtatgaacactacactatgcggatgttctaagggattgttggctggtggctaatgagttgctctgtgaataacactaaagttggctctctgggttccatatgcttatcgactaagaaaccgatattgagat

SEQ ID NO: 4508 - DNA, 219 bp, Bacillus thuringiensis
agtaagaaacgtttcggcactaacgcatgttctaaactaaacgaccgagttgaagaccatcaaagacccatttacttatgttctgggttcgtagatacgcgaacgtagcttactgcttacaatgaatgctgacaagcgcctcccatctattctctgcatataacgggacatgcttttgcgactgcagagagagatactcactgatttgcagaggttaat

SEQ ID NO: 4509 - DNA, 131 bp, Bacillus thuringiensis
ctctatctctataccacgcgagatggggccccacctatcaaacgctcgactattgaaagacacgctgatgtacatacaagtaacggcgcgtcagctcacaccaatgagactggtgtaactctgcagctacc

SEQ ID NO: 4510 - DNA, 216 bp, Bacillus thuringiensis
aacgcatgagtatggatcaaaaatgcacataacggaatatgtccttttgccctgtaaaagggaatgcgctaagccttggagtcctgcagtatctgaaggacacaacacatccaaaggtgccactctaggagcccgcatcttccaaggatttacggaccccatttgaagatctctttagcatttacatacgttcgtatataacgcttacttgccatc

SEQ ID NO: 4511 - DNA, 162 bp, Bacillus thuringiensis
aatcgcagacttctacgtccaattcgttacactatggcactgtgcatggtagccatctttcgccatactgagacgagttcagagccagacgtggtattggtcatatcagatatggagtgaaaggagcgcgacatgaccattgcgaacattgtagccgacctg

SEQ ID NO: 4512 - DNA, 124 bp, Bacillus thuringiensis
cctggcgatttactctttttgctttatccccttgtattggagtgtggagatgggcttggaacatcaggtctcggttgcataccaaatcctgacaaatatcagcaaggaacaaaagaaaaacaac

SEQ ID NO: 4513 - DNA, 255 bp, Bacillus thuringiensis
tttaattgccagagctttatggggcttgtatggaacatacgaggccaggattacatcacttggtacgcttactgcaaatcggccgacctgcctgcgacactctattttgcaccaaactattgacctacctcgcaacaggattatttccaggtgggctaaggcgatggattgcgaacaacacaatagattgcctctctaggttccaacttatattggcctacgaagcctgctttttgatccgctagtgctgagcgt

SEQ ID NO: 4514 - DNA, 169 bp, Bacillus thuringiensis
cttcgggaagcgtgatcctttcttatttcgcacgcgcttatattcaaccaacgcggagtggcgttcgctcgaggcttgtctgtgttcacgaaccccggtgttcacgcgctcgatgggccttaactggcaaccatggtggagagaccagccctgattgacatccacactc

SEQ ID NO: 4515 - DNA, 409 bp, Bacillus thuringiensis
cattgtttgaagcgtgttttttttgaaaagaacctgttagacctgctattgctaatgcggatcaagctactcttgcggattttacagaacaaccatgtgttaaaactggactgtcataatgaaatgtagagctgacagaattacataacattatgccattcttaaggatactcgcgacggatgtaactgatgtaaacatgaacgcaaaggcagaagcaattgcaaatgacgcttttaaaagataaactgaagcctgctcttcctccttaacagattgcccaggaatattcttgtttggtcccttcttattataagagaatcggagccgcttctttaatagggggggtgggtgcatacttcatgtgaattgcgcttttatatatttgcttgttagaaactttcgatagac

SEQ ID NO: 4516 - DNA, 417 bp, Bacillus thuringiensis
ggatagggataaaagtttacatcaattttacgaatcgacatattctttcctcctaaccgcacattacaaggagaggactatatctacttgtacggataggtttacagaatctactgctactgatacagcctgatctactgttacacatactgtgactagtacagcatgagtcaccattgcaattattgccttacttattcattttttccaccttaactgaatgattcagtaaaagcacgatatgaatcattgtacttgcacaaaatcaattgccctaattaacattgtcttttaattccatatcaacattttctataattccatatttgttaataaagtttaatttgacaccccattccatatgcttaatctattacacctttttgtacttatccgagctatgaacacaccttatta

SEQ ID NO: 4517 - DNA, 461 bp, Bacillus thuringiensis
actgggttctcctacgcgcacgaccgacagggactgaactgtttcacaacctgctgatcccagctcgtgtaccgcctgaatggtcgaccacgccgctccttgggacaaattctagtctcgggataccatctgtccccagcacggtgccggaactaactgccgatgtaggcctcttgggggacagcagtccgctgttcacgatgcatcgcttatacaagcgagagcaaccccgtgctgactctggggtgcggcactaaaaccattgctccttgatcaacttgctggtcaggcagacattgctccttgaggcagtgtgatcttctaggtaatgacgcccattccggagcaacgtttgtgagtactcgtaacagatatggatggtaaccgacaaactctactggcgacgataaaccaccttctatttgaagaccatcactacttttgcatgagaagacaatcct

SEQ ID NO: 4518 - DNA, 225 bp, Bacillus thuringiensis
gattattaatgaaaaggattctgtcattctggtactgaggaacattagttaacattaaatgacgataaattcactagatacaggcataccgccgtcttacgcatacacaccaggaattgtactagcacccgtgggagcagtagtggcactggagttcacgcttggaagaagaataccgctcacatatgagctgggattcacgaaacccagaaaagcggctgcaat

SEQ ID NO: 4519 - DNA, 207 bp, Bacillus thuringiensis
cgagataatattctgtgcgactttttttacgtgagaatggaacttttttatacctagaatgtacaggcgatgatagggtagcgcggctatctgcttgcatagtgacaatattcccttttcatatttcatgggcttttgtgaatggtattccaactggaagagctataccctgctcattaaaaggtataaaccccctcccccctatat

SEQ ID NO: 4520 - DNA, 400 bp, Bacillus thuringiensis
ccagataccttcggaagccgagttgccggttttagcacgagcttgcaattcttcgatggtaccggcgatatcatgcgcgggcaaaccacgattacgctcataaaaaagggatctcaacaggactgttcaactatagttacagtcaaatgctatcatggcacgctgagctcacgcacacgagattgtggcaggtggttgaccttagatcatctaaccaaggcctaacgtttaaccaacgtattgaagcatacacatgaatttttaatgatattattcgagaaacactactccatgtatacaaggagtactttcactgtcgagatattataagatgtcaataacatgtcaaacgtctcacggtatgtgcttctaccatgacatacttttcacggaacataca

SEQ ID NO: 4521 - DNA, 171 bp, Bacillus thuringiensis
tctgccacactcagtgagagggatgacgcatgttgggcacccttacgcttactgaccgactcactctctgatctcgatcactcatgctgatcgcatcgaaagcataatcactcaaaggcgaggctcacaggtatatcacagaaacaagagagtgctctggaaagaacatgt

SEQ ID NO: 4522 - DNA, 274 bp, Bacillus thuringiensis
atttagcatctacacaactcgcagagcttattgaccctaatggggaaccacatcatgtattcggaggctggggcggagatgaatacagtgtattcgtgccatataccgtataacgggacgcgtgccaagttgcggatccattgcgaagcttcatagaaacaatacaatgctctgtaatttcaaagactacaactcactttggtgtttcgccctacgaacaatgcgctacagatgacaacttctatgaaaacgccgacattgcattcataggaag

SEQ ID NO: 4523 - DNA, 259 bp, Bacillus thuringiensis
ctctatcatccaatgcacttggaaaatggaagattccatatctgttcagaccatatttacactctctaatgggaacacatccatgctgtaaaatacagcctataccacgtgcaacgtccacatgagcacatagacatactccctcagaaagtttctaccttgactagggattataaagagacccaatatgaatcagagcgaggtaacgaccaatctgcttctagttttgacacacatattgagactcttatcggggaaa

SEQ ID NO: 4524 - DNA, 269 bp, Bacillus thuringiensis
aattaaccaagcggcccttttacgtataaagtagacggagaaacaacggatgtatcacgcaatcaatgccaatagctcaaggctcccgacgcccagatagtggatggaagggacttctacctatatgcgcactccccataccaccacgcttcccgaggccgacacatatcatcctcgcaccgtcggcgctgattcaaagcatcctattggcaggtgatgaaacgagggctctactgccggcttcattaataactgtatcaactcctaca

SEQ ID NO: 4525 - DNA, 217 bp, Bacillus thuringiensis
agctagcctaggttcaaaaacttggccaccaaatccaaatatcactaatgctgatacttgtacaggacacatatgtgtcttccgtggaacctaactctgcctatctcaattacgaatgatgaattgatgatgattgcgaatgactgcgttctaggactaaatgcactgcaatcacaagttcacacacatgtcgctccagctgcatacctagttcaga

SEQ ID NO: 4526 - DNA, 232 bp, Bacillus thuringiensis
atcggaaccgtggtttgttggagcgtcaatcgtagttaaggcgagtcgagttaatactctcctaccatggatgatgaaacggattgtgaagccgtccctgcgctggatgaatctatgatggtgcacatattacagaacggagttgtcacgaataattatgaaactgttagtgccccatgcatagctcgcacggctgacaccacgtactcttcattggcgtatgagcaaatgc

SEQ ID NO: 4527 - DNA, 388 bp, Bacillus thuringiensis
ttattatcagcggtccgtgaatgaaccttagatataacggatttgaaatgccacctgcttgatggatactacgggcgcggaatatcgacgttatatatccatattgacagcctgctacaccctactgatggtcaatttgcaatatagcggtaacgagtttgccagcaaaccaccgagctcatttaattgacgttcgtgtacccgttctgagtggaaagaatgactgttatagattctgtgttgaataacactcatcttatgaagacttgcgttcgtaatgcgtctatactatggctaaatataaaatcccgctagaagaacatatacctgctttgtcagagcgaatgctatagaagctgctactcactataacactttacgagcaaga

SEQ ID NO: 4528 - DNA, 198 bp, Bacillus thuringiensis
acgcgttcgtatcgatcccgcgcatcggttcccgatgcgcgaactccggcattagactaacgacactttttttttctggcgcctcagacgggtaattgaatacgagatacactgcaatgacttcggttgggatgattgtgtctggatgcctgatttctacccttccatcttccttagatctacttcccttaatccatc

SEQ ID NO: 4529 - DNA, 346 bp, Bacillus thuringiensis
gttgttgcatggcacgctcggggaagcaggtcgtcgactacagatcatgtataccagggcagtgttttttggaatggaaacatatcatccagcatagtgtcgcacgtggactaattgtggctatacctggattccatgacaacttaaccgcgagtttcaaggtggacttaaccctttatgccgaaacataagggcctctgaggaaaactggagcgtgcatggaaaagtgaaacttataaaaacaccgttcatataatttgtatacttagtatgcgcaattgggaggcgtttattttcccctaccaacaatggcgatgggttttcgattggctactaagccgaagac

SEQ ID NO: 4530 - DNA, 135 bp, Bacillus thuringiensis
gctgacttggggagcatgttgttttttacgggcaaccatagttaccaaaagagcgcgacttagctcgcattcgggcttgcctaactccgaacggtcttatgaaccgtcctcacgcgtgtcaaacgaaagatgagc

SEQ ID NO: 4531 - DNA, 249 bp, Bacillus thuringiensis
gatggagcataatcatatgttacagatatgaatgaagactgtttctaatctgccggattcggctattgcatgcggaacgcgatcggcagcgcgtagggtaacggccatgcttattctagcgatatactttatcttctttcccaaaataattggtttatacgaaattatatttgtaagattaagcttagaagaaacccaatatgctaagatctccctataaattttacctccatatgtgtctgaagaaat

SEQ ID NO: 4532 - DNA, 407 bp, Bacillus thuringiensis
gcattaacatatccctcttgtgactatacgtcttgaatgatctgaccgccttactcatgctgtccaacttcaatgaaaacatcgtgtaggatctagccccattctgcatctaacaccgatcgcacaggaagcgtatcgaacagcatcatttaacgctcagacactatttacggctgatccaatattagctaataatcttgcaggactacataacaagcatgttgggataccacaaccgcatatgcctggcgcggggaaatagctattagcgagtgaaacgagcccttttagcgttacaagctgcacatcgtttcacggatcaagcgcccgctgtaagagagcaaccgcaggcctcacatatgccgctgatgacagttcgtcgggatttggctgccgtttgacctttt

SEQ ID NO: 4533 - DNA, 254 bp, Bacillus thuringiensis
ctatggtacatctcagagacctgctatctgtatagatagagcaacccttagtgcttctttatgcacaagaaacataaccgctaactgcactttatccaaagggggcgcctcatgtcgccgattctcacttcccatagacttgcaatttctcaaaagtgaagtgtcatgcgaatcgactcttctcaccctttcgcaacgtcatgctgccagaaaatatgcggacaatacgcatccgtccgacagtatactgtatc

SEQ ID NO: 4534 - DNA, 248 bp, Bacillus thuringiensis
  unsure (1)...(248): unsure at all n locations
tgctctcgaaactcttgtacacatactcatatcttatgacaattatattttttaaacgttgaggaacaactattattataaacaattttattttttgtannnnnctgcataccataaaaaatttaattaattgcttattgaactcattgcatattttatacattgctaacaatgaacattttgacaccactgcaatactcttaaaaaagatgtttcaattatactagaaatatgttgaggataactaa

SEQ ID NO: 4535 - DNA, 262 bp, Bacillus thuringiensis
tagacgtgctctaacggcgctatcatactgtttcatgcgttttccgtcgattcaccagattgctcaacacatacggctctgacgagaggtagtgctttacgctacggttccaactttgacggcttgcggagactccttacatgttgatcttggaacatttttttctgtcgttcttctaataatgcacggactgtgaccattccaatattctcggatcgagaagaggactgaaagcgcatcgcgattcccttcgtattttgga

SEQ ID NO: 4536 - DNA, 185 bp, Bacillus thuringiensis
tactcactgaccaaacatttctcagtccccatcataaattcgcgacaaagagggttccctcggcacaccgccatgcctagagttatgaactatgctatcggagtcacaacccctccgtcaccttaatttgttgccaatcttgctaacagcaattgttgaacttcatttatactcatgtccttgct

SEQ ID NO: 4537 - DNA, 253 bp, Bacillus thuringiensis
atcgaataattgatcgaccgttgaacataactgctagtgttttatcattactctgacaaatgtgctatacctacatattgataaggattatattctgaagcaagcccgattttaagaatgccatgcttcctgttcgatctgaaaacatactatgaatggtatcccctcatacagaacacgaggaacttggtatggatgatactaaacgaggaatagggtagtgagcgagcagcgcgaacacagacttgatgat

SEQ ID NO: 4538 - DNA, 278 bp, Bacillus thuringiensis
ggtgatgttgcttgtcaatttgggggtacaacgcctgatgcagagcggcatatagcgcttattgatccagactatctgatggtatatgaacaagaattacaagtaaaactatcagaacttgactatccttacaagttttatacgcttgaacataggcgtacattaggtacagctatgtcttttggtgcaacaagagaatggtgtggtgatatttcgctcgctgaaaatcctgcccaagctgtggctgccaaagaaattgtatcgtatattgagacgaa

SEQ ID NO: 4539 - DNA, 174 bp, Bacillus thuringiensis
acatggacatggagtctttttttcggcacgtgtaaaccaggacccccgggagaggcgtgatttaccattcgaccagacgcttattggaaagcaggggcatgaccttttaccatacctgatccagactgtgaaactagtgagcattatactaaaagggggtactccaagtgcagc

SEQ ID NO: 4540 - DNA, 212 bp, Bacillus thuringiensis
caaagctaaccggatttttgggatccataattgataatcgggcttgatatagcccgtatacaattggaccttctcgaacatctgctatgtatgcatgttgtacaatgggagaccaacctacactaatagcgaacgcgcatatcttatatgtgctgataagcagggcccatacaaattcggacaccagacagcgtgcaacgaaagaggcccac

SEQ ID NO: 4541 - DNA, 274 bp, Bacillus thuringiensis
gaatctcgagatcatcatagttgctaacgaattgaactcgacttaaaatgtttcgaagatgtgttaccctaacttcatcctctgcggggaaaaacggaccatcttgactgaattgcgcccagattgggtgacgcgtttctttctgatgggagcacggtgcatctggattatgtgtgatgggaagatcggacataggcaactgtgcacgttctttttagttgggaccgaggtaaaaccgctgttcatgctataggggagtattctagagaactgg

SEQ ID NO: 4542 - DNA, 236 bp, Bacillus thuringiensis
aggccccccacgcgtggtgtcgagctcgcccacgcgcgagaagcgcgtcgacacgtactcagatcacagcgaaccccattttctgcgagccggtgattaaatccgagcatgaggtaggccctgaacacttggtgcttttccaacgtcctttttgtttgcacgttgggcaatgttcggaccgcctccactagtagcgaacttcaatattttctatatcggcacaaggcaagcccatt

SEQ ID NO: 4543 - DNA, 261 bp, Bacillus thuringiensis
  unsure (1)...(261): unsure at all n locations
aacaaaaacctttttaaaagccacaaaaacacagaaaaagaagagagattaataaacaacaaccccgggacgcccaaaaacccagagaagcagcaagaagccaaccaaaacaagagcaaccagaaacgcnggaaaaagaaaaagacgcagaaaaacagacgagagcacgagtgggaaacaacgaaccgaaacacaacagcagaaagaacccaaaaagaaaacgcccccaaaaaacaaaaacaaaagaggagcacaaaaaaa

SEQ ID NO: 4544 - DNA, 549 bp, Bacillus thuringiensis
  unsure (1)...(549): unsure at all n locations
gcattttatattctttaaagcgattaataaattcatgagcaacgaaaaacgatccagcagaagattttttttgataatctttctttttttttancnactcatggnggtatggtaacaagtactatttgttattgagttttttaaagttctttttatatcatttgattctgctttatttattgtatattatctaaatttatttttcgaaatatataaattttacatttttttaactatgtatggtaactaaaatgcttttgtttttttattaagagcttttataatgtattacactttactttactattttttctgaaattaatatattttttataactgattcgataatttaacatttttttttttttttctatctttttttctttaactattctttaagattgagttactttagttttttttttttcactttaatttttctatattttttagttatcactttttttttcaattggtgctttttatcctatttatagcttttttgctcttttctaatttttttttcatatctttattattcattttttt

SEQ ID NO: 4545 - DNA, 185 bp, Bacillus thuringiensis
  unsure (1)...(185): unsure at all n locations
atagcttcatccgcacccatcccttctactaatactcccaatgacnnttcatacgcaccagcaagagaaaaaacaacgggggcccttgcaggaagtacaacacccgccactaaaacagacgccaaaaaccgcaccgaatcacccgcggaaacaccaccaaccacaaaaaacagacccccgcaaaa

SEQ ID NO: 4546 - DNA, 301 bp, Bacillus thuringiensis
acgtgtggtcagcatgctcgccgctgctcgagctgctcgacgactacttctgctggatcaaacgagggtttttttgagcgattatgaatatcacactgtcctggggagctggcaagaactagctgttggatctaggcactaatattctggcacacatgcgctccgtatcaagatgacactatataatgaatttgacagccgatcattacagactgggcatgaattgatctgtgggagcgtcaatggcatacatgttcaggaaagaggcagtgttgttatatcgaatgttgatcataaacct

SEQ ID NO: 4547 - DNA, 140 bp, Bacillus thuringiensis
aggaaagacctgaataaaaatctatgtggctgagacctaacagggatccgatcaataatcgcggcgcaaatgtaatacattgtgcagatcacacacgattagtaattatcagtcttccacgaactcgccacatgctctca

SEQ ID NO: 4548 - DNA, 376 bp, Bacillus thuringiensis
caaaacccgtacttgttttttgactagaagccacttgtataacacacctgatagagaatgtgataccgctgagagcccttcgatttaaccaagttcagctagttaaagactatgtattaaagtgctgcgttacacaaacttattcgtatttcaacataacatgtcagttgtttctcacatagagttgacatatccggctgttcaactcataaatctgacttggcttttgaaacaagtactattatggggataccaataatgaaaggggaccaacaaggcattggatgatcattaaaagaatgcactgagatccccgcgattaatcacgaacaggcctatacaacttacagaatactgcatgtggctgataaacagc

SEQ ID NO: 4549 - DNA, 527 bp, Bacillus thuringiensis
atcgtttcaacttcacgtggatttttcatctcttccacatacacaactctaaatccgtgatcttctaaatcttccaataatgtctctaattcaccgtcgttaaactcttctcctaatgtaaacataattctacgaactaataaggcatcattatcaaaagtcatcaaactttgaataccagtgtatttctttaaaactgtcgataacttttggattgctccattatagtcttgcgttccaatcatgacagagtatttactagagtgaacgcccccatgcatcctctaataactcaaaaactttattatgcgttaaaattccaaggaaaacccctttttcatcaactactgataaataaggcaatttttttattgtaaaaaatactttaaagaaagatgaatcttctctcacaaatccttctttatcgtttaataattgtattacactctcatcaagtgatcctttatattctaaaatatctactttatatatattccctaaaaatttctctgttttttcatctaaaa

SEQ ID NO: 4550 - DNA, 327 bp, Bacillus thuringiensis
  unsure (1)...(327): unsure at all n locations
ttttttattaccccccataaaattanttaaaacaccaaacacncaacgcgcgatgcggactttagagggggaacacccgttattttccttcattaacggatttacagtacatatacccaccgcgatcatacataggaacacactatatgcactcttcttttggtgcaaaaccaattaccctaatcataagattaatcgggatccagagatcacttgaaaacaaatcacgatcattatgtattgagacaactatcactgcataatcatataactcattccctattacacccaaggttgcatccggtagataaacgccctgctctgcaa

SEQ ID NO: 4551 - DNA, 229 bp, Bacillus thuringiensis
ttggcaccgcgacaccgggaagaaagggaaaccaaccggattttggggtggatcataaatgaagaaaaatttgcttacattagaaaagtcaccgtgggaattcatatgacagcatcaaaataatagcgcattattttatagcagtcccaaaagaatttttgttccaagaaaaaattacgtttatcctatcacgttaccaacaattgaaatgaatgttttccatatctga

SEQ ID NO: 4552 - DNA, 128 bp, Bacillus thuringiensis
aagcgaaaagaccaaagggggcttttataacaccaaaaacggaagcaacaaaggagaggacagaagacgcaagaccacccagaaagacaaccccgggaaaaaggacaacaacaggaacaacagcaaaa

SEQ ID NO: 4553 - DNA, 238 bp, Bacillus thuringiensis
gtctctcacctaatgcagaggaactgctgcttcaaccgcttctccacacgcaagtggacgcaacacataacggggggaaacatttggaccttgccacccaagccgtactaaagtcgaactggagcttccagacagacaatactaagcacaatgcacctcgctttccagatttcctcataacgcaactgacatacataacgctcgcaacagcctttagggaaacatacacttgcgatat

SEQ ID NO: 4554 - DNA, 369 bp, Bacillus thuringiensis
tactggctatactggaggagtgagaccaccggaccatactggctctactggggctaccggtccagcggacctactggctctactggcatcacagggactacctgagctacccgttgcacgggacatacggggacgactgaagctactggctctaacacacctactgatcatacgagaatcactgagactaccgggactgccgatactactggagctaccagtgctgacagagactgactggcttccatcagaacctaaccggagctaccaacatcaaatgtataacgcggtgcactgggactatccaaaactactgggactaccggcactacagaaactaacagacctactactgctacaacatctagc

SEQ ID NO: 4555 - DNA, 167 bp, Bacillus thuringiensis
gaaaatcgtccggcctcgttattcgaatcacccaccccggtcacacacggggaatttaaatatacctccaagggtagaatccgttcctaagtcggctctcgttattatggctatcacctcttaatgaaaactgtggaaccataagactatccgcaaacattaccact

SEQ ID NO: 4556 - DNA, 101 bp, Bacillus thuringiensis
ttcattttttttttagagagtttccaatgaaagaagcctatgcattccaagctacactaaagagttctctacttttatacgatcgcttatataaagcatac

SEQ ID NO: 4557 - DNA, 104 bp, Bacillus thuringiensis
gaaagttgtcgaacgtggcaagaaaggaagggattttttcgaaaggagcggtcgctagggcagctggcatagtgttagcggttcacaactgtcgctgtaactca

SEQ ID NO: 4558 - DNA, 193 bp, Bacillus thuringiensis
agaacccagaaacgaggcagaaaacaccagaccaaccgagcaaaaagcgccgaaacagggcgcgacaggaggcacacaaacggggaaaggggcgcggaaccccaacgagcggaaaaaacgaaacacagacaaagaagaaaccgcacaagagacaacaaccccagacaaacgcaacaaaaagaacagaaaaagg

SEQ ID NO: 4559 - DNA, 310 bp, Bacillus thuringiensis
gatcgaaacgggcttttttccaacgcgattcataacatacggagttgacgtatctgtgaacatagaatctggttgaaatctatggtctcagtcggtaaccaccgtttcatgcgcggagtccgctactaatatgacaatgaggggcggctctactacgggctcctgttgtatcatccagttgcgttgcaaacgttgcgacctgagaacgaccatcatgcgcaccattaataagtcctatatccttatgtgaaaggcgccctccgtgagaatctacatcagcactctgcttcatcacgtctcgttgcggaaa

SEQ ID NO: 4560 - DNA, 119 bp, Bacillus thuringiensis
ctctgcgagtggcacaggcctggacagcgcctgaggctgttatttttgagataacccgctgtctcttccatgtcacgatgatcttcaccacgcctcgtcatcagcgttgagaatcgtga

SEQ ID NO: 4561 - DNA, 132 bp, Bacillus thuringiensis
tagttttccgcatatataacaagggctgctttatatgatattgtgggaatatacaaccaatcttcacatattgatataataatgacaatgaagggtataacttcaagcttatagacctgtattaggggggtt

SEQ ID NO: 4562 - DNA, 244 bp, Bacillus thuringiensis
cgctatcaatggacttctagccctagcacttatgcttctctctttttgaatcagatgcggttcttctcaaagtacttgtaaagttaacaaaacattcccatatcccgtcaattctggaagtagcgtccaatctatgaaatttatgctgtaggaccgactaaacaactgaacttctcctactgccaatgttcctaagaatcaccacatttacacttgtatatcctgtacctggtttctcatgact

SEQ ID NO: 4563 - DNA, 395 bp, Bacillus thuringiensis
aataggtaataaattcttatagttttacacagggcgtgaaatgcataataatggagtgagaacagacgattgttggatgccaatctgtattgcttgatctaatctaacttgacgtggatccaatatcctgctatacgctgcatcgaatgagaaagtgcgcactttaactgtggagagcaaaagagcaccggacgtacaactctgctcaggttaagaacccacctgttcatgttcaagctcgcttggtatcacagccatttacattcggacgacgtgttactatacacactgtgactagatgcgacaggtacgctgaatccgatggcttaaaagggcatcttatcagagcggctacgacagtttggtactattttacgctcgaacaagagctagcc

SEQ ID NO: 4564 - DNA, 388 bp, Bacillus thuringiensis
gcgtcgcgtcttgtatcctgaatacgtgagtgaggtctcctgatgtcagaagggatgggcactacacgtttgcgtcattttcatcaagagacgtcagcagtgctctaaagtcacatcgactgcttgtaacagccggtgctacatgagcaacagcaccttgtgctactctagttacatcagcgacgcttatggtttgcttcgccgcatgaacgcatgctttaaccacttgagactggctcaggagattcaagtgacacgttccttacatgattgcaaatcactccctgtgaagatggaattgtctcctgcatatcaaggaactcttttgttatatgcaagtcatgttacacgtcttaatatccatatgcctggttttaaatcattaaca

SEQ ID NO: 4565 - DNA, 224 bp, Bacillus thuringiensis
gatatggcgggcacgatactatttcatcgcagccttatcttaatttttatgacgtgcactatgaaaatagaatttgggcccgtggcagatcgtcatacgggatagcactgataaacgcatggtgcatattggtatacatcgtcagctgaggtttttccagccctatttgtaagaaatgcaacttaatctctctaactaaacattactacatctagagctgtttc

SEQ ID NO: 4566 - DNA, 251 bp, Bacillus thuringiensis
gaagatgggggcggtattgataaagtgccacagacataggtactgaaatcagaatacatgataacatataatgaacttttataggctttacttcatctctatccaggtgcgaccgatttactatcacaacgaggaaacttcatatatccaatattattactggagattatagatatagtttccattgccaatgctgcaacgctttttgtagagttaataccacggtagcacctgtctcttatgaaagatgg

SEQ ID NO: 4567 - DNA, 115 bp, Bacillus thuringiensis
gaactcaaccgccttttttctcccagaccgaccgaaacccatatgagccggctaatggaagcttctattgataacgtcttgattcgcctcattattcatgctgcacatctaccct

SEQ ID NO: 4568 - DNA, 256 bp, Bacillus thuringiensis
ccaagggaaaagaaaaataccggtgggagttttttaaggcctttggaagggagccaaattgggggataacctggaatttttttaaattcaaggcttttaggggcactcgtggaaataggggctccaaaattggcatttccatggccattaattatgaccaaaccaaatgtaggaaagattagtaggttgaatatggttttaataattccattaatacaccccgcgcgtatatggaatcagatggcctgaatttgtg

SEQ ID NO: 4569 - DNA, 227 bp, Bacillus thuringiensis
agcgcattgcttctatttcaaaaccaatatatatgacctaacgtaaaagcagcggcacgcatcgcgcagtcaggacctaaaccgcctacataatcctaaacatgtttatttatcatagctaatgacaatgctccggagtgatgccctaatgatgcagtaacctcgctgagcgtcctcccttgctgcgtttgaatatcttgcactttaccgacgctttgcggaatact

SEQ ID NO: 4570 - DNA, 232 bp, Bacillus thuringiensis
gcctaagttgaccggatgggaaattaccaatatttaaaaaggacaccacgttttcaaggggtaaccagccttatgtatatgagttattcatccttgccgttatactctatagattttgacctatgcctgagctcacacacatgtcgtacgaacgcagaatcatcacctgcttagaatgcacaatatccatttgaaattctaatcgtatgcgagcttatcccttccaattcaa

SEQ ID NO: 4571 - DNA, 179 bp, Bacillus thuringiensis
  unsure (1)...(179): unsure at all n locations
cccaacannggcancaccaacaaacacagggaaacgcgnacgaggaataccacgcccgagcaccgcgaagccgacaaacggacgaggcgcaccgagaagccgaagctcaaaaaacggagctacaccaaagaagacagccacctgagcgggaattaccgcaaagccaaagccagccacaa

SEQ ID NO: 4572 - DNA, 296 bp, Bacillus thuringiensis
tgacagaagctattgacggggttttgttataaagctttcggctgtgttcccggatagagagtatgctttaatatattacttggaacttaacttcactacatgcgaatactggttgattctttgactagaatggcggatttctctagtttgaactatgtgctgcaacaacctttgcattatacagagcgatagttttaatgcgagtgttttccctgtacataacggggtgaatgacttggggatgaattgaagaatgatgctgtatctagagagaaaaatgaaacattatacgatgc

SEQ ID NO: 4573 - DNA, 110 bp, Bacillus thuringiensis
ggacccgatccataacgggtccggagcatgcatggaaccgggcttgctctatatggtgtcaatggatagcatgtccatatgatggtcatagctgtgacctgtgtgaaatt

SEQ ID NO: 4574 - DNA, 204 bp, Bacillus thuringiensis
cccaaaaaaaaaaactattcagttgttgctttttggggagaaacaccgggtatccccttttaagagatgtaatgtagctgtttatcggtttatgtacagatgaatcctattaacaaggtgcaatccaattatatggtccacctattcttgtattctacccgatcatgaatatacctgcgacacatatgctcccacggttattgt

SEQ ID NO: 4575 - DNA, 224 bp, Bacillus thuringiensis
acttacgtattgattagttttgtgggtggtttttctatccgaatctatatggcctattctatccattgaaatagctcactatgtgtgctagccatatcatgtatcttgggactaggatcgtatggattatgtaccgtgactgatggtacatcttcaagaattatgactgaatgattcagcggcatatcatctagtatcaccaccatcatgtatggcgtatgtgc

SEQ ID NO: 4576 - DNA, 125 bp, Bacillus thuringiensis
atgggggcctcgtcatgtcccccatcggggagtcgcccacgggaatactcgctcacgcagccccccaggagcccaagcccatcctcggcgcgagccagacgctcccgaacatcccgagctcgctg

SEQ ID NO: 4577 - DNA, 186 bp, Bacillus thuringiensis
aatactaggaggtctggattcggaaactatcgcgatgcacaaatgcggagtgccgatctcacacgtcgtgagcactctgaaaaagagaagggagcttgtgaagagctggaccaaccacgagattgtgatgcggcgccactgttagacagcaaacgatttcgcacaataaaaaatgaagtctggggg

SEQ ID NO: 4578 - DNA, 308 bp, Bacillus thuringiensis
ggttgcaccactaacgtagcaatgtgaccttgtaggaggggtcccgccagcttaccctgtgcgccatgttgtcctggggtgggctaaatgcgatctgaatccggctccgagcttgtcggagccaagctatctggcgaccacacgtgtggtggacagagctcagacgtcgattgttatatagtggacctaaacggccgaccaaactactgacacagtttcacaaacaccgtgactgggctaaccctgtaggacaccaagttaagctgcctacataaacctaccactcataacggctggcttattattta

SEQ ID NO: 4579 - DNA, 106 bp, Bacillus thuringiensis
atgaaaaaaggcgcctgccccttactcacggaaataaattatatagattacaagcgcattactaaagcggttcatttgtacaagagcgaacattctttcggccaca

SEQ ID NO: 4580 - DNA, 289 bp, Bacillus thuringiensis
gctaaaataaagaaagcgacgattatagataggcttgctgatttatatatcgaaacatatcacataaactacccaggaggatgcctaatcggctgcggttgtcaaacccatgacgaatatgaatgtgttgaatgttaaaaacagcgaacatgcgtatatagaggaagcgctctcgtgacagcgctaggattgcatgttgaagaaccatacaaactcgtggagcgttgatgtgttgtttactggtgctacatgcgcacgtgtgcgtcactagtattacgtgactgataga

SEQ ID NO: 4581 - DNA, 475 bp, Bacillus thuringiensis
ccatcacaagaattgacctagagacggttgagagtgcctctttattggatccacagctctctattaatgttcgtgctctcctatgtgaagagggggaaagccgcttctcacggccatggccggctacgtgaaccacactcgtagccatgatcatcgggcccgggggggccattagcactaaatcggtaccttcaccggtgccctcaattggaagcttgtcatgggaaagtcttgcagcgcagtgagtaagggctgggggcacccataaggatgctgtcaaccgggttcgagaattcagtttcgctcaaacggtccgtttaaaatatctccggctagctcgctgtatagcgtcagggatgacacggtggctcattcgagggcagtgatcgcaccaagagctacgtatctatgattcagctcatacaacatatcacatacggaaggaacgatggcggcgccgagagcaataaattct

SEQ ID NO: 4582 - DNA, 157 bp, Bacillus thuringiensis
gtgagcagatcccgtgcgtttaatgcggactatcatgcgcgacttgccattgcacgtgagactcctggacgccccaagtctgcgtccgtcgattgcggtacgctgaccgctgggtaccagcaagcccgtcagaacggttgccttgctcttgagggaa

SEQ ID NO: 4583 - DNA, 215 bp, Bacillus thuringiensis
gagtgatacataacctatcgctcctaagaagggaccagaggttatatatttccgatggaccaccctaaaataatgctcggagatactttcgattagatccgtgtcgtggattaactgccagtgctaatatcacgttaacaactgcttcctatgggccagatcatacccaaacgtggattggcttgcaacgagccggaactcttttaaccaagttt

SEQ ID NO: 4584 - DNA, 128 bp, Bacillus thuringiensis
tgacttgtgaagggatatcactcgctcccctgaagagcatctatttctctcgccaaaatggtttcccgttcggatacatagaccctgttcacggcttatttctaaagaacatggcacagcttgagtat

SEQ ID NO: 4585 - DNA, 231 bp, Bacillus thuringiensis
cctatcaggtaatatcggttcccatcttctaactaacgcacttatctgttcactatacactacgggcacccttgctacgattgctgtcgatttcctccaaatgttgcagggggagactatctaatattttctttctccacaggacgctactaccgatgcggatgttttaattgcaccgcctaacatctttcaccctatttcctttattcattaacttgctcgctgccacct

SEQ ID NO: 4586 - DNA, 205 bp, Bacillus thuringiensis
ctcggctcgctaggcttggacatccaaatcagatactgaacaaaaactgccctttgtggacttgaaaccattcgtaccacctgcccgtgtgaatgtgggatttcgtattgcctaactgaagggcatttcttttggccatgggattgtaaccattctttattcgtttaccggtcggattttgcttatcagatttaattccaaacca

SEQ ID NO: 4587 - DNA, 284 bp, Bacillus thuringiensis
gagtgattaactacagatacgttagaaaatatcccgctatccgattttcttgaatgtaaagaacggtactaactgtgggactctcgactagaaatgcaagaccattcgatagataacgcgtacgagatgatgaaaaataataccgcattaagtctttccctggaaccacgcgtgttgatgaagcactcctactgctcttgctgcatgttgacgcctatagacgtaatggagacgtcttcaagtttgaattattcatcatacttaagccgacttattcagaattt

SEQ ID NO: 4588 - DNA, 129 bp, Bacillus thuringiensis
gacattatggcataaacttaccaaacttcggagctcgtttttattgatcccccatgggaaacgacgcgattcaattgaataataccgtccctatatgccgctggaaaactactcaccttgtaactcaac

SEQ ID NO: 4589 - DNA, 217 bp, Bacillus thuringiensis
tatagagttacgactagttgtagctgcataccatggcgggaatgctgcagtcatggatgatgctgatgatacaccacaagatacattcgcgtgccagaacggtcctattgtatctaaggttacaccttcaagtgcaccaggaactaaataaggccttataaccatgcctacagaaatgccaaatgcaatcgttcgtcaatttcaagatgggatgcga

SEQ ID NO: 4590 - DNA, 420 bp, Bacillus thuringiensis
gactcataaccggggacgaccctctggcacatttactgatcacggtgaccagccgatccgccggtccgtccatattaacaggcgtcaaccgaccattaagtaatatagagtgccgaatgtggcatacgtgtgagcacactattatcttatctatgatagagacgctgaactaattcaattacacacctcttatatgcacctgccctctccatgcacggacacatgccactcgccatcatttgctcaaacaatgctctacatcatgtggagagctagccttacaatagggacgccccttgtgcgcaagaacaaatgtaattcccaatgcaataagcgcataaatccctacttcacgcaaagtatgaactacattgagaaccgcatttttcgcttgagttcatgctgaactcactactataa

SEQ ID NO: 4591 - DNA, 181 bp, Bacillus thuringiensis
cgctcccgaattcggacgcaatcctgaaaaatataagtgattgaatatgaacaatcgggttaatacttatcgatctatccaataacaagacagatgccctggatgaaggataggggaatttcctctgcactagaaactggggttccgagcaccttttacagatgtctacttcctaaaactt

SEQ ID NO: 4592 - DNA, 147 bp, Bacillus thuringiensis
atacatcgtttaataaagtctctacttcatgacttacggtttctataaatgaacggtgacataacgtacatgattccttatgaaaacactatccctatgcccaataaacacttacttgctaccctgtcggactttctagattcaatg

SEQ ID NO: 4593 - DNA, 130 bp, Bacillus thuringiensis
acccaagatcgtgatttatgatcagctgtccacaggtactcctgtaacacattttccttgaatggtacaacccgtaggacaatggctgtacaaaacatgggaaggatatgcaatctgggaagaggacaaa

SEQ ID NO: 4594 - DNA, 165 bp, Bacillus thuringiensis
tgatttttttgaatgacaataaaaaaactgaccaagaattttttttttttgacaaaatgaaccagacccaccgtgtgtttgcacggagcaaattcccttcctattaaaaaaattggctagccaaatctaaccaataaaagcccaactttaattccttcccggtac

SEQ ID NO: 4595 - DNA, 230 bp, Bacillus thuringiensis
ttgctggatgggcttcgctttataagggcatcatgcatacctccggactgggattacattgcgtcaacaattgtgcggaataactgcatagcgcgaagatgcaccgcgaggtaagtcttttatacagttcaccttctataatgcatacaacccggtatacataaacgttgctagctcacgcatttgcgcgttatccatttctaattgtacgtgttatcgatattcatctt

SEQ ID NO: 4596 - DNA, 282 bp, Bacillus thuringiensis
ctcgggccccccacgtgtggtctagccttgcccagatcctaggctcgactccagataacatcgggaggaagtcaatatcgaattacttttaacggcgccatgtatggccgagaagatttaagatcttgaaaatggaaaccctcctccgtgcggactctagtttgttatagaatgtcgacaagccgctcctgtatatccgtgtgcatcaagtccttatgtcgaggttgtgacactaccaaatcacttttccaaaaatacgcattggaatagtaagaatgtcga

SEQ ID NO: 4597 - DNA, 395 bp, Bacillus thuringiensis
gtgtcattaccttatcacaacccttttctttatataactgcttttttttaataccaccacccactatttaactcggggggtccagaatgctgaacccaggagtttttttctcatttccccttcccaccctaacaattatacgaattttgtcatagaaatttaacattcccctgccctttcttaggcggttctattccaaaattcaagcctctggatatttttcaattttttaaaataacatagcggtcccaagggtgccccaaccctttttttaatgggtttttcccccccctccggggttttcccaaataaaacaaccttttgccaaaaacgtgcactcattccagccgttttcaaaaagttttttgaaccccaactttcccttcatttatttg

SEQ ID NO: 4598 - DNA, 363 bp, Bacillus thuringiensis
catgatagtagcggcaattcacattgtttctatttgagcgaaatctgcaatgacccgaatattttcgataatttcgcccacttgggtcattgccgcctgtacgtatttttgcagagttcactattgatgcactgtcatgttgttttctaagggccaagtcttggaatgatgaatttcgatactttacgtgaaccatcacctctactaaagttcctttatgcataaggagccgagcagcactttatttgagacttcgcttggatctacatagcggagagccagacagggaaacagcttgatcggcagagattaagacgacgccagagctacctgagcagcctgtaggatattggcgggtttctt

SEQ ID NO: 4599 - DNA, 213 bp, Bacillus thuringiensis
aaaaaagcgggagaccattttttactgagcaagatcgagtcgattcaggtgagaatgccgtagaagcggcgcttggaacaggcactcgagcgagagctggcatgggagaaacaaagctcgaaccggcggaaactgcatgagaactccgacgaacatatgccggatatatcatttggatagcccccgcggatgaagaagggacagctattgaag

SEQ ID NO: 4600 - DNA, 486 bp, Bacillus thuringiensis
agaggaagaggagtttgaattttttaatattccggatataaaggtagacaccatgtggaatatgatgataatggatgattaatggtccatggattattgactgttagcatgagggacgaaagtaggcgaagaattacattacatagcacgagaattactaagtgagtccattacgagctgttttgacactagattcgaacgctacaaagataatcttaccaaatgttgagcatgagtaacgctttcaatacattccatttgagacagggtagcgcaatcaatgcgtattgactgctccaccggggacttcgtttatgaatactaacgggctcaatcctaacagctgcgcatcaagcagaaagcgttatgattaataaatcgacaacaaacatttctcattcatggacaaaatcagtaagcaacctattttattttgctgttaccgaggacctggggtggcgcatgacggatatatttaccatttca

SEQ ID NO: 4601 - DNA, 427 bp, Bacillus thuringiensis
gctatcttgtaagagatgataatgactaccgcgctacctcacctagagatgtaaccactttaggaatcgacccagcaggatatctgacgtgctgcggttatcacattcacgaataccatccacgagttgttttttgggagcatgaacatgcatgtgcagcggaagcgctgatggaacgcgactaggattacagtttaatacgcatatacactcgggagcgaagctgtgttgtttggtgctgctacatgcgcatgtgttcgtaagtagtattacatgactcatagactcgtaaagattcgcggtctctggtatcagcggcagggtacagatgcttgtgagataccatgtttcatcattcgaatagaactgtggttgcacagagaggcccagtaaactactccctatgctattgcatattggcttaggt

SEQ ID NO: 4602 - DNA, 265 bp, Bacillus thuringiensis
ttatagtagtcaatatcatattacctcgcgctagcgcactacagtattatgtctatggattcttacctatatcaggacgcactcatatgccagacgatgtctgcacaacagaccggctccttgatactttattgttaaacgcgatacacatattgatagactgtctcccactgcgacaacgtataacgcgtcttccaaacgcgacggaagaaaaagacaaacggatgctctaattatatgcctaattgcatatgtggggagaact

SEQ ID NO: 4603 - DNA, 119 bp, Bacillus thuringiensis
cttacagcattcatttcaccattttgagtagaccgcaaacgatcaatagaggtagtagccccagatcaatgtatcccacttgtgctcacgtgttgcttttgaagaacgttcacttcgac

SEQ ID NO: 4604 - DNA, 253 bp, Bacillus thuringiensis
atcattatactgacttaattcaatactatttatcgcagggggagttaaagcgtgatcttgatgatgatcctgtagaaccaggctttaatctatctggcacgcctgtgtcgaaatccaatccttctattattgattttcataaaacaaatgaacggacgcttaatatttcacacgcacttggattagaagcatgagttgaagaaaatgtagctccttccaaaccctgggcgcttagctgaagattaaaacatga

SEQ ID NO: 4605 - DNA, 256 bp, Bacillus thuringiensis
gcgccctcaatgtacatttgtacagtatgaacagcccagatatcccattgattggggggggtgaaaattactccatatgcaacgaaccacaaataagcttcatctgcaatgcacaaaacgccccattatatggctacctgaagatgatactgatgatgtacgacgaccatccccatggatcaagaggaaccgcaagcgagagttgatttttactctggatgtgctgcgtcatctgaagcaactgattatttaccct

SEQ ID NO: 4606 - DNA, 120 bp, Bacillus thuringiensis
atccaatgcctctgtacatagaacatcttaacatcctttttttttatacctactcttacataactctaaaagggaaatttccgctgcattagccgataattaaaattccaatgcctctac

SEQ ID NO: 4607 - DNA, 176 bp, Bacillus thuringiensis
cccccaccactggtctacatgcagctctccgtctgcatgaagctggtcgacgactacatgactacatcaagccacgctatggccatgaaccggatgaaggccgggaatatagtcgtttctgcattagcgccaaccccacgacgtgcaacataaaccatttcacgcgcgtcactggc

SEQ ID NO: 4608 - DNA, 309 bp, Bacillus thuringiensis
tgccataatgagaaacgcggatgaggcggcacgtgtacaatttcaagcggcgattcgcccgattgcgatgaattgcacatatactgaagaggaaatagtaatggcgaaagaaaatatcatagtcgcacactaacatggagcagcggcgagggtatactgcgcttaaatctgcttcagcggacatagctccattcagcctaggctctctttaaaccacacatgtgggggcactgagcgtacctgtctgctgcattctacttgtggcacctataatggcacgtacacatccactagtccgcatgttttaca

SEQ ID NO: 4609 - DNA, 482 bp, Bacillus thuringiensis
  unsure (1)...(482): unsure at all n locations
cggggtcagagccaagccccgcgcgagaagccaggcgacgaagncagatcaaangggagcaagagttcataacaagcgcagccggaaaagcaaaaggggggggacaaaaaaagcaagagccccgaaaagaacacggcagcagcaaacagaaagaacaaccngccccccaagcacaacaagaacaagaaccacagacaaaccagaagaacaaaaangccaaagaggagagaagacacaangcaaaaggagaaagacaaaaggaagaagccagagcaaacgacgcaagcacggaaggcagaagaaacagaaacgagcaaaancgcaaagaaacacgaagaaggcaaaggacgagaacggccgacagccgacaacganggagcaaaggaacagcagccagaaggcgacgcaaaaaacgaaacgagcacaggacgcgcagaagcaagaaaaaaaacgacgnagaccgaacaaaaagggaaaacaaa

SEQ ID NO: 4610 - DNA, 107 bp, Bacillus thuringiensis
cagataaattggagaagacaaaggttttattattcaccaaaaaacaagcaccccagcggcagcggccgcaagaacagaggcacacgaaacaaaagaacggggacaaa

SEQ ID NO: 4611 - DNA, 307 bp, Bacillus thuringiensis
ctcacacaccatctgtacgtgaggaacttgaggacaagagaccgcggcttgaatacaccgccatttttgcgcagacatttttgctcggagatatcgactcttgcctaggtgctggtgatgcagcactacaagcctcccatggactccccccccatgaaaatgatattttagaccgcccgactccttaccaagctggctggttggctgcaaatgctatatcactatccgagaccacggtctactcgtgcagacctatcccgcgcatatgcagaactaccgtctgaccgaccctcccagactaacgaac

SEQ ID NO: 4612 - DNA, 331 bp, Bacillus thuringiensis
  unsure (1)...(331): unsure at all n locations
gcaaaaaccaacgactaagtaaaacgcgacgaacccaacggcaacacagggagggggccaagcgacccgaaccacgacaggcacgcgaacgcagaaaaagacaagcaaaaaaaacacgacacgaaaggagccaaccccaccagccacccaaaagaaaacgaaagagaaggcacggccaacaccgccacgagaacggcaaaagagagcncagaagagcgcgaaacccacgccggagaccccgcacggaaagaaaaaccacggcaaaaaaagacgccaaagacagaaagcgacacaacaaaaagcaaacaagcgcaacaaaaaagaaagaagg

SEQ ID NO: 4613 - DNA, 212 bp, Bacillus thuringiensis
gcaacgccaacactacgtagccgcgccgaactaggggcaacactgggagtggggcctaatcgatcccaatcactacttgcatgtatgagcaagactaggcatgcggacaaatcatgacatgaatggggctacttaccgcatctaccgatatgttaatgaaagcataggtacgggtgaaaccaccatcagtatgggatgagagaaattcaatc

SEQ ID NO: 4614 - DNA, 388 bp, Bacillus thuringiensis
  unsure (1)...(388): unsure at all n locations
tccaacaccgtnaaaaacaaggnagaccgaaccanangggaaatgggcagcaacgggagctaaacccgaacgaaaaccaagaacagggncataagccataaagaagcaaacttctccagggacgccacaaacaaacgcaacaggcacgagcaaacagcggacacgacacccaccaagaagagacaagaaaaaccccggaacaaaagagagcccaaaagaaaggcaaaaaacaagaccgggaaggaaaagcacaccgccaaaaaaccaagagccgaaaaccaagaagcccaaaaaaccaccaaccacgagacaaaaaagaaaccccaaaacaaaacgcgaaaaaggacaaggcccaaaccagacaaggaaacgaacaccaacggaccaa

SEQ ID NO: 4615 - DNA, 194 bp, Bacillus thuringiensis
tacatagttataagcccactctgaaagatactgtgtgccaaggtggggtgcaacaggtagtaagagagatcatagcacgagcaacaccttcaataacaggaagcatgaagatttttgtacgacgtgttaatgaattattaaacaagcgtagcgtcaagatttagaacatttttcagctgtatggggtgagttgc

SEQ ID NO: 4616 - DNA, 245 bp, Bacillus thuringiensis
  unsure (1)...(245): unsure at all n locations
caaagcnccaacaccgnaccccaaaggnagaccgaaccaaagggaaagggccagcaacgggagcaaaacccgaacgaaaaccaagaacagcgccancaaccaaaaagaagcaacancccccagggacgccacaaacaanngcnangaccaagagcacacgccgcanacgaaaaacaccaggaancgccangaagaacagcgagcaaaaaagacgnaacaaaaacgaaggaacaacaggcccaccg

SEQ ID NO: 4617 - DNA, 323 bp, Bacillus thuringiensis
  unsure (1)...(323): unsure at all n locations
acaacaaaacggaagggcnattataaggaacacgaaagcagcaaccgaaaggggggcgcccagcaggaaacacggcaccgacacacacccacagcgagacgcagaagagcaagacgaaccacggacaaagcaagaaaccagcgcgaaagaggcaaccgcacacaaaaccacacaacagacgagccggaagccaaaaggggaaagccagngaggcgcaangagngaacgaacacacaagaaaagcgaagcgcgcacagcccagcgaccaggcgacaaacccgccaggccagcagcaacaangaaacagccaacgcgcggagaga

SEQ ID NO: 4618 - DNA, 264 bp, Bacillus thuringiensis
  unsure (1)...(264): unsure at all n locations
agagggcacaagacaacaacttcatatacaagggccgggccgcgaacaacaggggggaggcaaggacgaaaancaaccgcggagaaaaaccacacgcagcaaaacccaagggcccgacgcggagcggcggnacagacaacagcaaaccagcaacacgcagagcagcaacaacaggaacgccaaaagacgaagcaacaggccagagaggccaaccccaagcccgaggcggcacgaaaaagcaaaacagcaaacacaacagcaaaa

SEQ ID NO: 4619 - DNA, 193 bp, Bacillus thuringiensis
tctttcagaacggggaaatacttaaagctgcgaaacttacctcgatgagatgcaaagagctgccaatgattttggagaggaaaatccacacgtgttttacaccccaaggcatgcggtatgctaagggaagttgagaaaaatggctccctactatcttatcgaaatcggatggtgacaaatcattatactgtcc

SEQ ID NO: 4620 - DNA, 198 bp, Bacillus thuringiensis
tctattcgaagcctcgacctggtgtttttattttggtattcgcagccttaccaatacccgctgctgaatccagtctcaacgcctatggattttaacaccttcttgggcttgatgaaactgttgtctatacccttgcgttataaggaccggctgcctatagaggtgttacacgtgctgcacaagctgcgggaatggtat

SEQ ID NO: 4621 - DNA, 185 bp, Bacillus thuringiensis
gatagcagcatctcggtggactttcaatagaacgcgctcagtagtctttaggcgtatcagaacttacttctatgcatacatatcgtcgcactaacgattaagctaaaccttggctactatggaagcgcaccatgaagtccgattctcgccatatctgacgcatcatgagggaaatcaaggaattg

SEQ ID NO: 4622 - DNA, 230 bp, Bacillus thuringiensis
ctgcagagatatgaacccactgcgattcaccgcgacttacctactgtgtacctcatgcagcgtgacttgctgttgtttctgcgcctaacgcgtatcctcccgaccctgaacctgtgaatgcgttatgcatcttagatttcacgaaaaagctagtgttggttagaactgtatcacttgctcctagtcaccgggtaacgctatagtgcgatatccgttgcccacgtgagcac

SEQ ID NO: 4623 - DNA, 390 bp, Bacillus thuringiensis
gcaagactacgttccgctgaggggaagcttgacacctttgaatcacctaattagcgactaacggctgtagcatcacatttatgcaaatgatgagccccagttaagctagcagaggtagcggttctcattccgtgcgtagcctttggtaccgcatattaaagacgtgggatgcaatatgacgcttgcctatgagcatctgtctgaccactgtgcgccccaagatcatactacactacgacatccactcggcccattaattgagcatcatgttgaagggtatgcttactgctcttatcagccgaagaatgaatcaccatccgtgatattgctgctaattccagatgtaaacagcttttcataagatgatcagggccttctgcctgagtgata

SEQ ID NO: 4624 - DNA, 241 bp, Bacillus thuringiensis
gggggagcaacgcgggtttctccctgtgccggagttggaacaatatacatgtgaactatctggatacatgtcaccatccggaggacgatcttgcatagaacaaaccttactacaccctacagttgcggagttctcatccgacgtaggacgttgattactcgctacacgcaaatgcaccattctcaatggcggtccaatcacgaaaagaaacgggttgctttgcatagtgatctgcacacca

SEQ ID NO: 4625 - DNA, 206 bp, Bacillus thuringiensis
  unsure (1)...(206): unsure at all n locations
attgataaaagngaatagaacttancgngaaccacagaggagcaccacggagatattggggagcaaaacacaccgcgnncgaatagcggccccggaaaangnacagaacaagacgggacaaccgcagccgaacgcgccccaacacncagcgggaacggccaagccgaaanaganancgcaacacangaagcanancaaggaaaagg

SEQ ID NO: 4626 - DNA, 219 bp, Bacillus thuringiensis
  unsure (1)...(219): unsure at all n locations
ctgtatcccacganccgacggcaaaccacaaacccccacggggaacgncacnagaaaaggcaagccgaaaaacangaaggacaaaaaggcgcacnnacaagaagcacgaaacaaaacccgacaangacgcngcancgaaaaaaaaaacaanncnaacgccgagnaaaagcggaaagncagcaagaccgaggagaanaccgccagcccccgacccngccc

SEQ ID NO: 4627 - DNA, 305 bp, Bacillus thuringiensis
aaaaccccgttgttttctttgcgccagcattttttagcctcctttataccatccaccagaatattcctgtgaaaccaatccatgaagcaatagtccctgctcttccagcgagctgactgcctcctgctagtcggtttcttatgccctgtacacttatttttagggccatacctcctgaaaagatgaacatctaaagcatgatttctctactaccgcttatacatgcataaacagctgttgatttggccctaaaattatatagtgcttcctacccccctttaacataaaacacctcctttttttcc

SEQ ID NO: 4628 - DNA, 423 bp, Bacillus thuringiensis
gacgcgtacgttttgggaccacagacctccgagatatcacgtttgctagcatgactgctgactctaggctagcaaattttctaactatctgaggagtaacagtgaaggcgctatcatccctatatccatcttgaaatccatcccctctaaccttattagtttcagctattctgataagcttcggccacggatgaccgcttaacgcattattccagtcaactattgctctaacgtcttcactatattcgactaaataggctggacgaatgtacatagtgagtaaacattttacatgatctgctgaactaagaaccaattcaatagtgttagaatccggctgatgaagcctgcagaccgtgatagtattaaaccctaatgtccgacacacaattcgatctgcgatatactgactaaggggctctc

SEQ ID NO: 4629 - DNA, 223 bp, Bacillus thuringiensis
tttcactgtgctgctcttgtgacccgaggctaccttggccatatgtaccaatatgacgataccgtgggtctatcgttctgactcacccactgatatgaagacggacatcatgattacttcggtagtgaagactcttatcatacatcttcgaatggcggcgctgaccatctcgtgtgtcactctatctaggattctacgtaggtacctattatggagccgctga

SEQ ID NO: 4630 - DNA, 239 bp, Bacillus thuringiensis
gagagcgtcggtacaaatatacatacttgaggtggtatttgtctgacggcacataacgctggtctgcgaggtgtcaaacaagctggtgcaattgcagggacagcaaatcgagctttacttgaataccaaccggactgggcacacagtgaccctcatgatgctgaagtggaaacagtgaaggatctcactggcgcttatggtctatgagagtcgtacccgtctactatggaagcacggcg

SEQ ID NO: 4631 - DNA, 449 bp, Bacillus thuringiensis
cgtctagagagcgtctggccaccaaatacatattgcatgcgtgattttctgaattagctgaaagtgaactgacggtacaatggtcagaagaagcggatcacgcgctcgcactggcgtttataggagctctataaacctatctgatccgaactctatagaacgaagctttggccctacatattcagccacgcgttccacccagggctcatcacgatcaagacgactgaggtcctgcccaagatcgtgtccatcattgatggaaagtcaagcgaatatgtatcgaagacgctcccccttattcccaaaattcgattcctgctaaacctgagaagacggtctattttatcgccgtgatataggatatctgcgcactggggcatgagatgacgaatgagcttatatgtgaaaatgccgatggggaatgagcgggattaactgtgcatctacat

SEQ ID NO: 4632 - DNA, 416 bp, Bacillus thuringiensis
cacacgtgttgtctagagctcccactgcgctcgagacgcgtgtacacaaattcatatgacttctatattttttctaggatatggaggctagctcggtggggcgaaaatagaatgtggtgcttattgtttggttcagtataattttatgagtcgcattgcttggttgatatacgtgtggcgccaatcgtttactgggtttcatgaagacgagccgtgtcaaggtggtaaagtaactcggttttgtaacaggactaacataaccggtatgtgagaacgtgacaatcacatcaggaactccccgcccaaattagtcttgttttaacgtttgatttaacagatactgaatctatttatgaaatgctaaaagacctgagtcgacctcaccacctaatatctatgttataccgcaattctga

SEQ ID NO: 4633 - DNA, 316 bp, Bacillus thuringiensis
gctcccctgcgctcgagacgcgtggacacaaactcatattgacatggagatttataaggtagctcaccctttatatagcgaggaagaaggtttatataaaagggcgaaacccagggcaatatgaacctttaactttccaaccatcggatcacagcacgcatgaacagtttcctaaccagacttactagtctttacaactatgaacaaagaaacttaaagctggtataccaaccgcaggattcaactgactcttaaccattatccgttccataggtggactggctcggcgataacggtcattccattgaaaatatgt

SEQ ID NO: 4634 - DNA, 274 bp, Bacillus thuringiensis
gtcccaactcgtgagtgtcgggaaaggccgtgaatacaacgtaatggttgcgattttttttacaccagggggatacaatactcgatgcgttattatgcactcaaacgaaaccagattggactattggttcagtacaggatgcaagacccttgccttatgctttgaatggatgagatagccataacagctgctatatgcttgatgagccttgtacagcgtatgtaccggatatgcatggtttattggcaacaactaaaaaaatgctagctactgc

SEQ ID NO: 4635 - DNA, 143 bp, Bacillus thuringiensis
tgtatgaacttgatgcaacaccccttcaataagcttttctaacatcctgctcacatattttcaggagggggctattaacggcgtccacccctgcatatgataaaattttttaccccctatcgcataaactagggcttttggta

SEQ ID NO: 4636 - DNA, 202 bp, Bacillus thuringiensis
gattaactgatgccccgtaccggtaccaccacagtattgtgatctgccggcacctccatctagccatttacggttattaacaacaacagtgccgtcacccgagggcgctgctttgctaagtatgctgacattggtgtaaatgacatgtcgctgcgtacaaagtagcccatttcccctccctactgggcccgtgagttgttca

SEQ ID NO: 4637 - DNA, 252 bp, Bacillus thuringiensis
tatcaacgctgtttcttagggacatatccatccaactctagaagtagtacaagaattgatctctcgtggtgaagatgactatcatttttcaatataagcttgcaaggatcggatcgataagacaggtgctactgtactagcgattgatgatctgaaatttatataaacgcttgtatatggaggctgtggttatttacaggaaagactgaacggtctgctacatacagcggatattgaaatatttaccgttct

SEQ ID NO: 4638 - DNA, 268 bp, Bacillus thuringiensis
tcaaataccactccaaattcattactgggaaaccaatttgcttgcgcggctcctgtctatcgcctacaccatcacgtttacacaatgacgcactgcgtagaattccggtgagctaccgaaaaatgctagacgctactgcccctgctctcatcttctgtactgtgcacctctgtacgtcctcaaatgttgtcgcggtcactttctcttacactatatcccgaaagaaatcattatatacataacagagacttgcgcgcctcggttgata

SEQ ID NO: 4639 - DNA, 109 bp, Bacillus thuringiensis
cggtagcagggcttttaactgggcgctacgcaactgaaatgggtgtgcagacaaatggttcacagatgtacagggtgacctaaccactgttagctgctcctgcaggtgc

SEQ ID NO: 4640 - DNA, 277 bp, Bacillus thuringiensis
ccaaggtgtgtttttctgtatgtgatgagagtgaactaacggggcaatggccagatataacggtgacttttgacttacttcctcacacaggatattcagaggcttttcaaaatggtgatattgtcagcggactatatgcactgcaagaggctattgatttgcatgcatgtcagcagtgaagcatggggactttgtatcgaacggaggccgcgtattaaaggtcgcttgtaacgcaaataatctacaggaagcccactatcatgcgtatgatgaaatc

SEQ ID NO: 4641 - DNA, 409 bp, Bacillus thuringiensis
gtgtggtcagagctccctgcgctcaaacgcgttgacgacaaattcagatatgcgattggtgattaaaagcaatgaatggacctgtagaatgtgcgtgtgaaaagacatggggattctttggtttctgctatttggcgatgaaacaatagtgtacaaactagtgagagcatatcctggccatggatggagatgaccatatacttacttaagcatgttatctacgaaaacaggataagtgataaagggcatagacaaatatgggcattgtcatatagtcaaggtactgaagagcacaaattggagtgtggtcgactatgatgagatctggggaaatcctcgtaaatgttaattagacgtatgaaatcgagcatgatagagcgtgacgggaaatgtcttttttcacaagatg

SEQ ID NO: 4642 - DNA, 381 bp, Bacillus thuringiensis
ctggcaatatgattgtttcttattgccctccaattggtaacttcataggcggtgaaacatgatggggagatattattgacggaaaacctgttatgttagcagggtggaatggtcaagggtgggagctaatcattcctggtgtgtaatcatgttctattgtttctctggcgccaggtactaatgatatatcgctaaccaaattgtaatgcttttttaggatgtcagaagcgcaatacgaaccgactgcaccatttagtctaggctcaacatgccttcaaaaagttacgagacctattgctgacgcacgatgagaccatggttggacttgaacaaaaagtaacggaggaagaacaggaatctgagggatttaaagctcctatt

SEQ ID NO: 4643 - DNA, 217 bp, Bacillus thuringiensis
ttttttgcctatgagctaaaaacgcttgatgtcccacttttttttttttgtccaaaggaaccagcggatttacactgctcataaagatacatcgtacccttatataatcttggggcagactttaaacctatgacgttactacatgtacaggaggccgcgtcatgatcattatgcgccagacattatgcaaggatatcatgaggcacacggacttact

SEQ ID NO: 4644 - DNA, 144 bp, Bacillus thuringiensis
  unsure (1)...(144): unsure at all n locations
gacgatcgaccaaaccggaaaactaaaacagcggcagcccagaagaacaaacaatcaatacagccaccnagacacaccagcaaacaggagcggcccaacaaggnacaaaaccgcagaaaacaaagccagaaaaacaccnaagcc

SEQ ID NO: 4645 - DNA, 137 bp, Bacillus thuringiensis
tccgggcaataccaagtggttatatgtatttttttgagcgcactttcacgcgctgtcataaactattcacccctagcaagctcaataagtttctgtattgatgaaacgatttcataatatatagcgatctaaaatat

SEQ ID NO: 4646 - DNA, 215 bp, Bacillus thuringiensis
cacgaaatgacacctggttgttgttttttgaacattatcaccggattcccttcatccccgccaggtctacatgaaaccacagtcgcagaccccactacaggcacaagtaacttattgactaccctgtctaactatctcatacaatgactaacaactgagtggattcaggggaacaatggattaagtgcaaattaaacatgctgcaaataattgca

SEQ ID NO: 4647 - DNA, 186 bp, Bacillus thuringiensis
  unsure (1)...(186): unsure at all n locations
gggacgccacaagaggaacgaaaggagcaagagaccgacgagaaaaacgaatgaggaaagcacgaggcgtacgcacagagaaacacttgtnggaaaataagagcaggaaacacctaaaggtaggattttacaaaaggagagaaaagccacaaaagaggtatacgcacacacgaataagcgaacagc

SEQ ID NO: 4648 - DNA, 472 bp, Bacillus thuringiensis
gattcctatatgggctgtccaaggctcctccacaacagcttctctctctctatggatgacgccaatggtgcgcctttttagagaactgccgctccagactcatttcggtcaaatcattgttactttctaaccaaatcgaccgactcagccaccggaattgcgtgtcacgagactacacctacatacactggactgtacaacctgtatataacaccacatgcctattgcatatcatgtcctagggcttcgccatgtcactaacactttatgacgcctatgacgctacaggagaaccatctatcctaccaattggactgtcaccaactagataatgagcacttaattggaccccccaatgtagcacccgagggagaacaagtcagggataggctccatccgaaccactaaacgaggggtatacagcacatagatcgtgctccccggcactcgctactcttttgtgaaatgaatc

SEQ ID NO: 4649 - DNA, 478 bp, Bacillus thuringiensis
ccattcgtgcgccgattcaaggggcatccggagacacagttacaggaagggatggcagggcctcgaacgtggaatttttgaagaaacagccgcaactgtatacgataacgagacaataaccgaggaacatgcttccacataattggagaaactcaaaatagaagagacgccgaatccgcgtccctcttactctgcaccttgcggaattgcaacatcatgctctagctcacctatagacactgcagccagcataaaatgcgctgcatcaggaagggccacaagcatatgagctctaacacaaactcagctcgtgcaggatcctacagcgtagtcgacaacatgaacgcccccgcttgatgcacactcaaagtgatgtacgaggaatccagctaccatactaccttgagcgcaatcaggagcacaaaatccagcgagcacaccatctgtataatgacatgaaaagatagtctgcgatcac

SEQ ID NO: 4650 - DNA, 232 bp, Bacillus thuringiensis
acccccctgcgctagaaacgcgtggccaaatatacagatcgccttacatctataacgaccgaaccgaccggcgtaaccagcagagactgaggcacactggcgaatgaaaatagatagcgtcattaattggaccgaatgtgagatcaatgttgggtaaagaaacgtatatattacccaataggccatggtaatcgaggtacctcaaaattcaaatgagccgaacgcgataggg

SEQ ID NO: 4651 - DNA, 329 bp, Bacillus thuringiensis
taaccatgcggatgtgtaccagagtaatgatacagctgcatctgagggtcgcctggtgtatccaggagagaagacatggaatgatgaagctggcatcatatacaatacagaagcactcgtaccggttgaacgaaggatggtacacacactatatcctacttatgatgagccaatccactaagctttaagggctgtaaaggacattatacataacaaagatgcaaattccttccatgagaatacgcgatccaaagatgcaccatctatatttcaaagatatggatcaacacaatctgtcggcttcagtatgagcattgatgcatttttat

SEQ ID NO: 4652 - DNA, 138 bp, Bacillus thuringiensis
atgcaacacacaactatatgcagatggcttatatgccggccgttgggcatctgcctaactggctattactgctcggacgatcgaatgtggagtgcaggaacagggaactggacggcagtactactgttgtacggataa

SEQ ID NO: 4653 - DNA, 465 bp, Bacillus thuringiensis
atttgggagacagatgttgctcctattattattaacggggatcctgtccgtgggaatgacttggcccgacatatgacgggaccatattaatatagtgtatctacgatggagtgcccgacaggccatcttcaaggaaccccggagggtcatgtacagcatacacttgcaccattcgaaccactaggcgatccgattacagtttctagataagctgccggtgatacacgagaaaatacgaccgcttggttactaaaactggcgcattaagctggcgatcaagtagacagtgccactattgctgatacacgtggaaggtcagaggatgtggatacacgcgaaccatctactacacgatcgggagtcgacaatgatcccgctgatcacggatggggatacggaccggtattagactgtattaaacgacatacgctactcacggagggacctgccaccatgtgaatagac

SEQ ID NO: 4654 - DNA, 134 bp, Bacillus thuringiensis
aagacgctcaataggcagttacaccagttaatccataggcctaagctccaaactgagaagaaaccttccggagctcaaaggctctcttatatttctttattcgctcttttagacggcctttgtctagtgacttg

SEQ ID NO: 4655 - DNA, 254 bp, Bacillus thuringiensis
aatgtctggcattttttatgggactaatagaccagggtagacccgggctgcttacacttttacccgcgctcacgaactatcgaaagaaacatgggctggggaacatatagcataagggagaagagagtaatatcaacgcgaattccccacgcgggacattgatatgaacatgtatgttgaacaaatgcaaggcatcttatcgaaataccacgtgccagcagactcctagcacgagtggtgaaacgtgccttgat

SEQ ID NO: 4656 - DNA, 379 bp, Bacillus thuringiensis
ctgcaccacgaagatctatttctcattatcggactatgctctagcaattgtccgtatgcatggcgatagcgacccagggctgtagtcaggctacgagccacgacaacaagacacttagtctctcctacatctggagtaacacgatggatcggccctattggtatcgttacacagtctcgcaatgatatagtgcaatcgcttgccagcacacgtttgaatcttaccctggtccacaatgatcaaagaacagcacatcgccatcacccttacgatagagattatgcaatttttctgatggactcactactacaatatacacatcttcatttgcaagaatgaaatgacgtgcacttattggctcaggacttttccgactctc

SEQ ID NO: 4657 - DNA, 176 bp, Bacillus thuringiensis
attatacaggcaataaagtttgtgagcgatgctaacaaacatgattacctttgcaggtaggccacttttttagccattactactgttattctgagcgttgacaccattaaattcggaagataaagcgtgtcacactcacgtgacgaaaacggagcgaaaggcccttactgaaaaga

SEQ ID NO: 4658 - DNA, 170 bp, Bacillus thuringiensis
ccctccgtacgtggtacttaagggatcccaacctttcactattactcagatttggagcgaaacgctactctatctcgatttacccggtcttctttcaaacatcatgaagacgatcttatctacggacctgtctgtgactagcatgttttagtcttctggacaaacacctt

SEQ ID NO: 4659 - DNA, 151 bp, Bacillus thuringiensis
atcgaatgctgaggactttttattgcgccatgccgccacatccgaatagggaagaatcggatccggtcgtgtcatatctttcctgcgctaaggatatcttcattcataagatacaccaggtttttattctgcggcttacgctgcggatgaa

SEQ ID NO: 4660 - DNA, 124 bp, Bacillus thuringiensis
gaatgggtgtcaccggtttattctatagactaaaatgctatcactgaaggaacctaagaatagattgatgtaaatggattttatccgactcatggtgagacatatgatgatacatcaatacaca

SEQ ID NO: 4661 - DNA, 100 bp, Bacillus thuringiensis
ggaggcataccattttttttgcaaggcgtgaagtgtgacagtgaaagtttgggttaaaatcgcttaactgtagataggcatacacacaaaacaggttatc

SEQ ID NO: 4662 - DNA, 111 bp, Bacillus thuringiensis
gatcataatgtcggtctttgtttgactgctaaagataagtcattcgtactccggagatcggctggatgggatgatactacgaggacccctagctctggccgctgctttgtc

SEQ ID NO: 4663 - DNA, 415 bp, Bacillus thuringiensis
ggaaggtatatttgtgatatgggatcatggttcactgtcagtcagtaatagtcttatatctattgggtcagttatatttacgcaatgacaactaccggctttatcacttactcatttccttgcttcaacgtaacgactctatcacaaaaaacaaactgtaaaaaacttgatctgttccccattggcgaatcgatgctatatacatggagggatgatccatactataattcggcagttcataccgtggcctttatccgaagttaccttctattccgtagaaaagaattggtcgcgcctggacactatgatgcttccatttacgattgcagacgaaagtataccaatgacatacggatcaaatgtgggatattctataatcgttgtaactattgcaaaacgatatatatcgcgtgtt

SEQ ID NO: 4664 - DNA, 157 bp, Bacillus thuringiensis
gcgagcatctatctttgttttacgtgtgaggagcgaaaacatggagaggatacccggtgactgattctatctttcaaacgccacaggaaaacgaacgaccatttagaaaaaaaccgtcaaatcgctcaatagcactgacatcattttcgcccactac

SEQ ID NO: 4665 - DNA, 242 bp, Bacillus thuringiensis
cgtcacgaaaagatttttttggtgaatatgagccattagcacagttggtcgatcattcgactattaatcagagggtctatgggtcgagtgcttcatggctcaccattatattttccgagggcctcagggccagtggttcaaacaccgcccttatactgtgggtacacgggttcgactcccgtacgggtcatgttatacattgctgaaacaaggacccgaggtgcaggggttaatatgcttgc

SEQ ID NO: 4666 - DNA, 468 bp, Bacillus thuringiensis
gtctatataggattgcattttcggagcaccggcattctgcttctcatttggtttattagtcgcattatattcgagatgatgcgtacctctagacgtatcgtgggttgacgattgtgttcgcgactgtaaaagaactgtatgaaaaattaactagtaatgaaacgaagagaaaagaaatcggcgaaaaagtttaaactgttaatgagttaaatgtggaagcacacacgtcgctagagcagtttaacaaatttacaaatgagtattatgacagtaaattagcattctacaaagatgcatagaattaagattaaagatcagaaataaagaagaatctaaagtgtaataaaaagccggagaaacatcgttataaatgttttttcggttttttacgttaaatgaatagaaaagactggaattgatatcataaaagagttatagtgagttattctaagggaaacattgtaaagt

SEQ ID NO: 4667 - DNA, 141 bp, Bacillus thuringiensis
attgggcactaatcattattgtcagttacagacagttcatgaaaaaacgtggctaagatggcctccattgccggaacattattattaaatatggggacacttcggcctttaaacaagctatctatgtttacttgcgggtta

SEQ ID NO: 4668 - DNA, 287 bp, Bacillus thuringiensis
atgactgactccctagcctactggtgtcttggttgagtgctctccgaatgcagaaaagactgttacagttggctggatagtgccaggagtttctccggcttccggattaccgcctggctgcactgcaggctttattggctagctatctaccgtaagtatcgtacgctcttgcagtgttattagcgaacacggtgtggtcagatggaacggttcctatattatgcacgtgagttgcgtgcgtggtactttgcccgattgatgcgagagttatatccgcgcttttaaca

SEQ ID NO: 4669 - DNA, 237 bp, Bacillus thuringiensis
atgactaacctcgacggtatggccttggcagaagttacgcgcactgccgctactaacactgtacatattcttggctggaacgatagcgccgtcgcagttgcctaggatgtagctatagattacagcggtactaatacgatgaattatattatctgatacactaacgcggacaatagtgcaatggcagactgcgatggatgggccgaggctcttactaataaactcctccgatacgaa

SEQ ID NO: 4670 - DNA, 133 bp, Bacillus thuringiensis
atcccccttataaaatcaaaaaagaaatagaaccgagaatagggggttggagtgttgttcccaagtttgggaaacaagaggtcccactattaaaagaaacgtgggacttccaaacgtcaaaggggcgaaaaaa

SEQ ID NO: 4671 - DNA, 431 bp, Bacillus thuringiensis
tataagaggtttgaaaaaattttctgtctatatttgaatgatgaataactagcctattttctagcgccagcggccgttacatacagaaaaaattctgaaaataaagcatattgtgcctctgtaaaatttttaccttaaaaaagaatagttgcaccaaataagtgaagttgctgtttttcataaaagggggcaggattatgttattgatggaaacattgtgatcagtggaagagcttttggaatccaaatggtatattaaccacctaggacaaaccggactagaaggtggtctctaaaggagaatcctactcaaccatatataattatacctttattttccttgaagtataacccttattacctttatttttaacctgctttttctacgttttgtagacgtaaaatttaaagacaccccttgtcacttttat

SEQ ID NO: 4672 - DNA, 450 bp, Bacillus thuringiensis
caaattttaatgatataatgctcctgctttcttagaaccattccgattaaaccaactaggagtggtaacattacagcttcaatttaaaactggttataagttttaactaggttatgctccaagtgtttaacgtccacaaatttaacttgtacgctcggataagctgagattattttaaagaagtatcgttaattgtgataatatatgggatattatttatatgattttgttgattctatttgtaaaattgtctataaaaataaaacgatcttttttaattgtttgtatcagtgatttaactctgtattaaacacagtttaatctatgcagcttaccaactattataaaacattttgcaggcatttaaaccctgctttttgtttagaattattctaacatttttttgcttggaacaggaaataattttggatttttaaacctatttttaaa

SEQ ID NO: 4673 - DNA, 192 bp, Bacillus thuringiensis
ctcggtacataatgactttcacgaggctaggctatgggtgtggtgggatattctatacactgacacacaggtccgaggcagtcaaatcgcccgctcaaggatcctcgaacagggtatcacacgcggtccgttacactcactgctctctttaatgcatcctgcgttcggcggaccaccgtaataaccggtgcg

SEQ ID NO: 4674 - DNA, 241 bp, Bacillus thuringiensis
tttttgcggatttatccaatagcagctcaatctgcatccgttcatgatacttcagcctttatatgcgctgaatttgtgacgcattaggatgaggatgcgcgttcaacttttgcgagtgttgctaataacgtaataagcgtgcttccgccgtcgggtgttggctcacacataaacgcttattaaagtacaagattctgaagataaggcgagcgcaagaccacacttcttcgggccggatctc

SEQ ID NO: 4675 - DNA, 104 bp, Bacillus thuringiensis
gatatatgcagcagaatagatccatatgtcctcgttgctacatttattcgtacaaacacaatgtgttcattccaacgcgtgatctgtccaagtaggatgctatt

SEQ ID NO: 4676 - DNA, 247 bp, Bacillus thuringiensis
tggccgaaaagatgctttttcactcaccgcattccgttggttcgcggctggtaacgaactttacatatccagacgcgcacatcatccgggacgactaacgtcatgactttcaagatgttcaatccgggcctcattcatctgttttctctgcaaatgaggcagtactaactctctgaacaacgatcgctccaactctaaaacaaagactggcgctccactagtaatgttcccccgctgcgtctcctgc

SEQ ID NO: 4677 - DNA, 237 bp, Bacillus thuringiensis
acgtggacttccgataaaaagctctaacgggtttcatgtatatacttaggcggctaactactgacctattaatccatgtatgctcgcagaccacacccataatattcggagaaagaaacctattaataatctgggggatttcggctcattttcaaatactacggtcaccaggcttgaagaaagccgcttgttattatactggggaggctttggatcgttatggaacacaggcacaga

SEQ ID NO: 4678 - DNA, 247 bp, Bacillus thuringiensis
ggttgggcagtccgtactaggcgcgacatgggccacaacgctttttttaccatccgggatgtaatccagccctgttgtattcttaccatcttctgctggaatgagagcgcggaacctctcccatagcggttaatgatgcactatatctcgccgctcgcttaaccaatcatctgttgacccttcgacatctccatatgctttattcactctactcacgagccaatgcaatcggataaggatgtacctt

SEQ ID NO: 4679 - DNA, 172 bp, Bacillus thuringiensis
ccccacacgtgtggacccccccccgcccatgctccccccgattgtaaacgaaattattattccacaaaacagatattttttcgactacgtgcactgaaaaaaacgcgaagcacatgaacgatcccttccggaatagggcatcaacgaaatgatgcatatgacaaccacagta

SEQ ID NO: 4680 - DNA, 221 bp, Bacillus thuringiensis
ttgctggcgtattgttatctgttgcgtgattgatattttttttaaattaagctacacttacttctttggggggattcacagatagcacactagagattcttcgtgttaaaccgtgtatgtccactgctgcactataaggtttattctatttcttttaactgaaagctctgggcaactgtgaattgcatattttacgctccatgcttttgcctctgctttat

SEQ ID NO: 4681 - DNA, 181 bp, Bacillus thuringiensis
ggatgtcgcatatgcatatgcatatattggcttaccacaagaagacaattcccataaatgatgaacgggatcttcaagcgtatgttttggccatgcttgagaatcgttatgatgtaaaatctgtagcacttcactagaagtatgacggaaatacaccggtgattgctcttcacattacgga

SEQ ID NO: 4682 - DNA, 159 bp, Bacillus thuringiensis
ttgtttaaaaattcggcggttaaatttttttgttaaaattcagcttcattttttttaaacccaataaggcccgaaaaatcgggcataaatccccttattaaatttaaaaagaaataggacccgaggataggggtttgaagtgtttgttcccagttttgg

SEQ ID NO: 4683 - DNA, 216 bp, Bacillus thuringiensis
tgaacgcagaataattcttggcgccagttggcgggtatggggccaaacgcctgtatacggccaattggatagacgttttatcggaagtatccatgcttatgtcgatgattacataagtgtactctttagacaaaggtggcgatacccggctggactatagggataccatgcgtcttcctccgaaagctcccatggtggcgcttctacttgtttcga

SEQ ID NO: 4684 - DNA, 186 bp, Bacillus thuringiensis
gcagaatccatattccgccggaccccccacctagtattactacgtgttgcatgatggataacaagtatttctgcggaaaaaccccctaatcataaaagggtatattaataaaatataacgactgtacacaagcaaattatatcggcatttgggaacaaatagcattgcatgaatgaattctctgtt

SEQ ID NO: 4685 - DNA, 221 bp, Bacillus thuringiensis
atatgcctgaacagtcctttttgggtgcgttttgtgaggtgccaacgcccatattataacctgacgcatagggtcagcggtctacgcctcatcctgcgaatatcgcccaaaaacactagataaatcggatggggtaagccacctatcgcgggtatcacgacctttaacataccgctctataagtttcgcacgtgacccagagttaagagctacatgtgtac

SEQ ID NO: 4686 - DNA, 231 bp, Bacillus thuringiensis
caagagaccgcccagctgctaggtagtgtacaggctttggtaaacaatggtgcgctattatagtccgtagcacggactagagtataggacagcagacctgtttgaagggactggccctattaataacccatcatattttcacgttgcgtaggcgtccctttcttatttgaacaaaggggatgtccctataaatactgtatactatcgctgcttagggacgcaatgaaacgt

SEQ ID NO: 4687 - DNA, 144 bp, Bacillus thuringiensis
acccgacgcactgcataaaaatggaggagccgaaggtatcactgtcgaccatacagcgcacgaatactgcactggaagcacctatcagaatttgtagcactgtaaagaaatctgggattccttcaaagcggaatgtacatataa

SEQ ID NO: 4688 - DNA, 240 bp, Bacillus thuringiensis
accacgagtcccaacagtacgtgtgaatgccgataaagcctcaccatagcaagccatagactactagccaagcgagtggatttgagcatatagtgccgacttttcaaagactgcaattcacattgtatgacgaattggatgccatacagaagcggaactgacgggaactcatgctctacacgatgaacgattcaatgctatgggcccgcacgtccacaagctctatccggtagatgcacg

SEQ ID NO: 4689 - DNA, 296 bp, Bacillus thuringiensis
agtgcaggattctcagaatggggggcgcttttaggggatgaacatcgcggtattacagagaacgaactgccccatgagcgtagtcactaagataagtgtgtgaaggaacatgtagagcttgggagaccgctgaatagaacataataaggtccgagcgaatcatagggagatggtttgatttttgataaagggagaactgggaagatgttcaaaaaactagcatgtgtatacatacctacgaaagatacacaaagaacagcctttggctttaaagaaatgggcatgaatcagaactg

SEQ ID NO: 4690 - DNA, 200 bp, Bacillus thuringiensis
atgacatgctctcacttgcatgcgtttcgtacagactcgtggggatcgcttgaatgatgtgccgctacttgatggtgatgcacctagcgcatactcagaagcatggaccatgaggtgccgatgcatatgctacaccgtacgacataacagatgagggcggaacatcgtaaacagctaatgcagggacaaatggtgataca

SEQ ID NO: 4691 - DNA, 253 bp, Bacillus thuringiensis
tttatgagagattgccccagattgtcgtatttggggacagagaccggcgcgtctcgctcgagcccgcgcatgactaccccgtctctatctgtgaggcctgctgcacactgggccgtcaacattttctggcaataagcaagccgtcatatatatgcgattgcgcctgatctgtgactataatcgcgatctatgctcatgggacttcctcctacttgcaggatttgctaccggcgctagcacgccgccatggcct

SEQ ID NO: 4692 - DNA, 214 bp, Bacillus thuringiensis
gcaactactgatcggcaaaagtcagcttcaaaactagatttcgtcctcgacacctcgcgatcctttcatatcataccacagaacgaatgccgcacatgcacattttatctcaccagaatctggactatatgcaggcgcaacatgcatctcaccccgtctggtgtctttacactgggaatccatttcctgcgcgccaacacgtatattacttatc

SEQ ID NO: 4693 - DNA, 440 bp, Bacillus thuringiensis
tggcataattcaacacacgctgggtacgttatgaatttaaacacgacacataccccggtcatacattctactttctaaacacagatgatggttatgccgcgattcctattacaaacgaatcgctactctattcgtgcgtgaaaagatttctggcgacatggtcgttgctgtacgtcaccatgatgcatcacttatggctgctctcagctacgaaatcgggtatgatattattgcacatatgactactcacaattcagtgcccggggatttacccattacatactgtgacaaacccagacgatcatggacatacttgacccgcaccgtattgatgcgaaatagctgcataataccgatgggaacgtaaaaggattacctaattgtacggtatatactgcctacacggcaaatggaacactgtaaccgttgtcttttgataa

SEQ ID NO: 4694 - DNA, 342 bp, Bacillus thuringiensis
tgctatgccaaatcaccatattttgttgtttctagagcaggaacccggtgtagtttcccagcaaccgcggcacactctttcgcaacgtcgccaaccactgtacctgcttcatttactgttggagaatatggcaaatatcgaccgcactctttagccacactcgtatcccacactctatttagtacgggaaaaattcctgacgtgcattcgatcgcgggatcaacttgtggtacgccgttcactttatataatatccaagcgtttaacacagtaatcgagcatatataagcctatacgctgcgttcatgtttttttatacagaggacgcgtgctgatgcacct

SEQ ID NO: 4695 - DNA, 236 bp, Bacillus thuringiensis
  unsure (1)...(236): unsure at all n locations
ccaaggaaaaagcgaaagcggcggggaagggggcgcccacgagaaagagaagcgaacgacgccgcagaagaaaacaaaaagggaggcggcgaaacgacagccgcaaaaggagaggaaaccgacgaagcagagggcgcgaaccccagccaaccggcngcgaaagagaccggnacgcgggaccacaagacaacagaccgcagggatagaaaacgcggacccggaaaacgaaaggccga

SEQ ID NO: 4696 - DNA, 113 bp, Bacillus thuringiensis
  unsure (1)...(113): unsure at all n locations
gaaaagcaaaacgancgaaacacacccaaagaaggacccgcccacgagacaacaaccccgaaaaaagccgcaaaaacaccgaaaaaggaagagcacgagcaaacaacaaaccc

SEQ ID NO: 4697 - DNA, 262 bp, Bacillus thuringiensis
  unsure (1)...(262): unsure at all n locations
gaaccaacgaaccgcacaggcacagcattacaaaaggataaagggcagccgcggagcaaaagacgcgcgcgncggggacagatagggagacgacccggagaaccgccgacgggcccggagcgggggacagcggggaacacgaaancaggaacccgaacggaacgcgacagcagcaggcgaggaaccgagcaaaccccagagagagccgcaccagagcaaggcgcaaacacggacagagcagaagccagcgggaaaaagacaa

SEQ ID NO: 4698 - DNA, 168 bp, Bacillus thuringiensis
  unsure (1)...(168): unsure at all n locations
cggatctgagtncgcgataacctctttcccctacgcttcttcataatcgttataagcccaaaagttttcattatttgtcccacccgccccanaaaaaacagtgcaaaggagtaccatgagcaactccattgggaatcatacgcctacgaaggaatccttcttcttgaa

SEQ ID NO: 4699 - DNA, 173 bp, Bacillus thuringiensis
  unsure (1)...(173): unsure at all n locations
ggcagaaagctagaagagggaaaccgaggaataaacccgttaacggacaaaacagngaaccacggggggaacagggggcccggaaaaaggggcccacaagaagccacaggaaaagccaccacaaaagaacaaaaccgccaaaaaagggaaaaacaaaaacagcaacccgaggc

SEQ ID NO: 4700 - DNA, 267 bp, Bacillus thuringiensis
  unsure (1)...(267): unsure at all n locations
cggtttgaacgggagcggcaagaagcccaaagggaaagggagacncgcggaagggcaacgaaagcgcaaacaacagacaaaggacganaaacacacagaagacgcaaaacacagcagaacaggggaaggaagaacagacaaacaaaccgcacacggaaaggcccccgagggcgacgcggggcgcgcaaaacgcaccacagagcccgcaaaagcaaacggagggcccgcaccaccagaacacccaccgcgcacgagaaaggaacagac

SEQ ID NO: 4701 - DNA, 161 bp, Bacillus thuringiensis
aaagcggaagcgaaccaaagacccccccaaaaggacgccaggcggggaaaaagacagagccagaaggcaacccaaccgaagacacgaaagaacacagggacgagcaaggcacacccaaagaacaaacaaccagagaagccgaaccagcagggagacacaca

SEQ ID NO: 4702 - DNA, 139 bp, Bacillus thuringiensis
  unsure (1)...(139): unsure at all n locations
ccagagcagccaggccgagagcccgcgacaatgagaaaaagcgtgcgccacngcccttatccagttagaaaccgcggccagcagcagggggaagcgccaacgcgcgggagaggcgggggcgaccggcgcaccccgctcc

SEQ ID NO: 4703 - DNA, 308 bp, Bacillus thuringiensis
acgccaacgggcaaagggggcaccgagcgcagagccaaaggaacgccaccgaacccccggccggaaacgaagcaagagacaaaaggagccgggcccagcgaaagaagcagccggccacacaccaacaaacggcggcaaaacagcaggcaccacaggcaagggaaaacgaaggaaaccaaaagggaccgaagggccacaaacagagcggcaaccgacaaaacaccgacgcaggaggacaaaagaaaaaacgcacagacccaacgcacgagcccaacaaaaacacccccaacaagacaaaggaggcaaaa

SEQ ID NO: 4704 - DNA, 247 bp, Bacillus thuringiensis
aaccaaagaaaccgcgggaacaaaagggggaagctccgaaggagccccagcgggccccagccccagaagcccgaacaaggaccgggaaccagcccacaaaggcacccaaacaaaaaggacagaagaccagggcccacgcggccgaacacgaacaccaccagaagcccggcgccaaccaggaaggaccccaccaacaaaacggaaaacaaaaagcccaaacgggaccacaacaccagcagcaaaagca

SEQ ID NO: 4705 - DNA, 115 bp, Bacillus thuringiensis
ttgcattagaaaatatgcattcaaaagtaccggaatttccagcacttcatcataacatattcacgccgaaaggatctgttgatagagatactgaaactctaatcattgggctgtt

SEQ ID NO: 4706 - DNA, 203 bp, Bacillus thuringiensis
ctgtattgagcaatggggcgtattccgcacgcagcatcccatcaactgcgttaaacagcaaacgacaacttactttaataacaccgttacatggatatttcatcgcgagcactaagactctgagcgctctaaacgtatgattcatatacaccacttgtaccagcagtgaaaatgaatgtgaaaaacgaagaagcgcaggacct

SEQ ID NO: 4707 - DNA, 342 bp, Bacillus thuringiensis
agactatcggcccttactgtataggtaggagcgaggatgttcgcacacaccgcaagaaatacactgaggagaaacattaaatatgagggcgtcgcatcaggagcgacttctacactaacgaaaataatttaaacaatgactgacatatgtaatacgagaactaacagctacagcaacaacatatatagattacaggcttcaaaaaaaactagtctaaatatgtatataggaacaaataaggcacacggtataaaagggtgcgaacaaaatcagtgaagtatgtacatgcgccacagcaccatttatgtaacccttcacgaaggacaccagcgttcaccatgc

SEQ ID NO: 4708 - DNA, 365 bp, Bacillus thuringiensis
acgagcaggctctttgtcgctgttggacagtcgaatatcttgtttagatgctaagctaataaaagtcgggatggacgctaaacgatcgggcttctcatttcaaatccgtatagcgaaatagcttaaaccatatcttcggttcccactggtgccatccatacgaagagtgagatgtctgatacataccagtcattcgacacacgaataacatccacacgtaatagaatacgtgctttgatggttaaacactcaccaccgacttacacgcttgggaccgctccatatagggtatgaactacgggagatacggcctatatctttgatccgatgtctccacatggatcccgaaagacccactgataaaa

SEQ ID NO: 4709 - DNA, 396 bp, Bacillus thuringiensis
ttttccttcatttacttatacccatttgccgtggatttgctattcgaatcacacttgtatacgaagtggaattctagacatgcgtcatgttccatctgttttgtaagatgctagattacatgtcgagtgactcctgctttagtattttctaaacaatctgcatattgcctttctaaaaggggaaaaactttgtgtttataagtgatatctaaaagaagtgctttatgcctcatccatttgattttctcatctgcacgaactaaagtatttttattcatggtatctattgcaattcgatttataagtaccctatttggttttatcatttttgtaatttaataattcgcttttttttcattgtttgtgtatatataagttatgacactgtttttcaca

SEQ ID NO: 4710 - DNA, 151 bp, Bacillus thuringiensis
tattcaaaacatggtttttagccaatatctgaccaactaactgatgcaacaggcgtatttttaaccgtgccatgcggttctcgttctgaaaacaggctagtctcacatttttatatacttctctccctttgcaacgattctcttatagcat

SEQ ID NO: 4711 - DNA, 102 bp, Bacillus thuringiensis
  unsure (1)...(102): unsure at all n locations
ttactcgataattatattgcanattacatatcattattatgagcatctaagccattactccatgaaatcttatatttaaaatatgttaaatctccattttct

SEQ ID NO: 4712 - DNA, 100 bp, Bacillus thuringiensis
accgtcgggttaattatggagtgaccaaaaccgaaaaatgggggggccaatttagagtttaactgggggaccagatttattatttggagtataaactact

SEQ ID NO: 4713 - DNA, 146 bp, Bacillus thuringiensis
cctttttacaaggctcaagtgttcttaagaacttttttaggctcccatacgtttagcgaagtgggggatcgtagagcttactgcgtaacctacattcatatataaagccagatgagctccattcgcatttgtgggggaatagcgaa

SEQ ID NO: 4714 - DNA, 297 bp, Bacillus thuringiensis
atacaacggctattcccaagcgtttattatatagatttttattaccaagtacgtgaccaaccggaagatggggttgttgatcttatacaagagactacagttggtatacgtgttgacgggtatatgacggaactaggcatgttacttttaccgaacgttgaaaatgatgatgatctgggagctctgctagtggatcaagatcgaaatacgtttgagaagtagagaactcttcggagtgcggaggatttgtgagtagataggaaggagttatatttggtacaagctgcatattatgtg

SEQ ID NO: 4715 - DNA, 502 bp, Bacillus thuringiensis
ccccacccggttggtcaaaacccccccaggcctcaaaaggctggcccccaattccagatgacccacctttttttccacaggtttacctttaatccccaaaatggagggctgaaccaactttttttataatggatttccgggtccaccccaccccattttaagggaaccaggtttaaaaaggggcccaggaattggaaaatcatccgaggaacctttattccccaaatggtccatcagtggaaaattaaaaaaaggatttttgggtggaaaaaaatttttccaaaaaaggggaaaaaaacccgggcttttccccccccccggggggttatttaaccgttcctgttttaaaaccaccaaaagaggcggtttataaacccgttctagggccggggcttaaacccccacgtgttgggccaaacccgggggggaattttatggaaaacaatgtgggaaaaaagcctaaaggggccaatttggtttggtcccatgagggggaaaagga

SEQ ID NO: 4716 - DNA, 278 bp, Bacillus thuringiensis
gaagggtgcatgcaatacattgttccacaagaagatttgtaccgatagcaacagagcacacaatgagggacacatggctttacaatcggaggcgaaggacgcatctacccgtcattattacggacgcaaaaagcaaaatcgaacgaaggcacagtaaaagcttacttactgggcacgaaacgaaaatagtatcacggatcctataaatgtttagaacagcttgaagaatctaaacagagatgggtgatggatccagcgaccgagaacaggttattaca

SEQ ID NO: 4717 - DNA, 105 bp, Bacillus thuringiensis
cgtcacatacttgtcctatccatctacagctgtatggcggcgggggagttgattaacttttagtggaggatctaactcattttgaaatgttagattgacacattt

SEQ ID NO: 4718 - DNA, 131 bp, Bacillus thuringiensis
gaagctccctttatataccagacagagcctacaaggactgggggggcattaaaaactccttgcgaagtctgcctattccgcagaaaagcactaacaataattgtaccgaacgcctcaagataaagatgaca

SEQ ID NO: 4719 - DNA, 277 bp, Bacillus thuringiensis
catgccacagatccggcagacattaccacccgtgagggccaagggttgtttgagtggatgagaccgactcctcgcagaagtttatgagaattgaggccgacgatctgtcatgactttatgatacagttgctacggaacacaaaagtgaggtccagcagagcatacttgtccatggttaacataactccataaagtgcaccaggtaattggcgagaaaaagagtatccgcaaggaagatatttggtggattaccagctaacttaagtgtaaactgcgt

SEQ ID NO: 4720 - DNA, 196 bp, Bacillus thuringiensis
  unsure (1)...(196): unsure at all n locations
agacgttnatcgtatcggactccgaagtcgtgatcagaactagaagccattgctacatatgacatgtttatgtacacaagaaacatctgctcgccaggaggacatgctaccatgctatcgcggactgccttgcaagctgagaagaataaaggggtcgcctcatctcaccccctgggcaatctttataatgcggggg

SEQ ID NO: 4721 - DNA, 294 bp, Bacillus thuringiensis
gctgggatatttttaatcaatgaaaccttaccgtaagtaagagggatatatatgactgcaccggcggagatactacaagacggagtacacaaagctaaagcaacttatattacgcatcgctatgaatatgaacgagacgtacgcaaacagatggaagcacagactgatttgaaaaaggtgtaacaagaagtccgacgttttgcaatattagtaaacactgcgggattggctctttttaaaccgctcgaagatgcgtcaatgcatgaattaaaatatatgttccaagtagatgta

SEQ ID NO: 4722 - DNA, 171 bp, Bacillus thuringiensis
tataatataatccgtggctgaatatatttttcacacatcaatgttggttcatcaccatgctatcttaaaacgaaaggagttaaatgtgaacattatgaaacgaaaacaaattgtaattaacaagatacgctattcgcacgtgcataaaacacaacagtttgatacctctat

SEQ ID NO: 4723 - DNA, 338 bp, Bacillus thuringiensis
gataacgacactttttttatgactaaaccgagtagccaataaagggggaatttctgggagggtggtggggatggaaaaaacactaccaccctgtcagaaagttatagtgattcgctactgcataaagaaagacaactgaaggtaattgcacagacatcgacggaacgtatctggtgtatcccgaacatgattctgtaattactataacctttcatatagccagcaatggaaacatactagcgatccagccaaaacattggaggacaccatgttagaagctctgctatttagcaattgaaacactggctcgtaggcagataaagaaaacattggcgggt

SEQ ID NO: 4724 - DNA, 318 bp, Bacillus thuringiensis
tgatcacagttaaaataaacttatatataggccaaattttttttaccaattgcacaaagctctataaggagatttttttcaagaccatagcggggaatttaaacccatatctcaactgaaccagtcatggatgcaacccctcaaatctccaggcgttctcttctaatgggattaaaactaaaacccaatcatatttctgtgaatacgaacattgcgtattttggggaacaatatacatatcgctaaggtcaaatgatcccaatgttcttattattgaacccaacatcacttaccatttgaaaaaaggctctctctcct

SEQ ID NO: 4725 - DNA, 350 bp, Bacillus thuringiensis
cgatcgattggcctatgagatgtatgatagaggtttttacttttgaaccgaccaggtagagaacagtgtcagaaccagttactcttaatggatcaaacgaagtctcttggataatattaagtggtgaagcgcctcattccatatgattacgatttcattggtatataaagggaatcatgaaaaaatgtgctagactcttctgggaatagcatatacaccaagcgagctattgacagtgaatataccataagcagctttctgtatgttacgccataaacagaccaggctgctgctttatatcaaagggtaggcagaagatgtgatgctttataatacagacgatggaacga

SEQ ID NO: 4726 - DNA, 197 bp, Bacillus thuringiensis
tataatctctacttcgtctattcactcaacatgggtagtcacttttaagggggcataatcagggattttagttaagcatgtgatcggaatttaatcgacacttttatacttagctgtctgcagcctgtctatctgttctaaaaaattaatcttctcgtacgttattaccaaaatataatgaatgtatctctctagaa

SEQ ID NO: 4727 - DNA, 427 bp, Bacillus thuringiensis
acccccccccgttgttgttagggccggcccgggcctggagaggttggcccccaattcaaaataattttcatttttttccgttaaaaatggggtaaaaattttttggggcccccgtttcccggtttgagaaaaaaacgggccccttccccggttgccgtttggggaaaccgttaatttttaaaccaccggtccggtttttttggcacggggtttggcccggcaaacttcccggcttttttgggtttaaaacgggccttgtccttttggggaaaccccgaataaaatcctttaaataatggggcgattggtggttcccccggtttatttttccctttatcccttggccaccggggagggtccctttccccatttttttattttccggcccccaaaaagggggggttttccattcctaattttttccccc

SEQ ID NO: 4728 - DNA, 186 bp, Bacillus thuringiensis
cgttaacatgcctttttttgtaatgatcattgcctactgcatcgaagggtaaccgcatcaaatcgaggcgttcacctttacttacttgaggcgataccacgtgccttggagcatattctagacggtcgtcaatacaaactggcaatttccctaggacagtctgagccgtttgttacacaggaaact
